United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 94

SEQ ID NO: 3976133 - DNA, 12 bp, Homo sapiens
gaacagtaaaca

SEQ ID NO: 3976134 - DNA, 18 bp, Homo sapiens
gaacagtgcacctgggac

SEQ ID NO: 3976135 - DNA, 16 bp, Homo sapiens
gaacagtggctgggtg

SEQ ID NO: 3976136 - DNA, 17 bp, Homo sapiens
gaacagtggctgggtgg

SEQ ID NO: 3976137 - DNA, 23 bp, Homo sapiens
gaacagtggctgggtgggcccag

SEQ ID NO: 3976138 - DNA, 23 bp, Homo sapiens
gaacagtgtggtttgggaaagat

SEQ ID NO: 3976139 - DNA, 17 bp, Homo sapiens
gaacagtgtttcccata

SEQ ID NO: 3976140 - DNA, 18 bp, Homo sapiens
gaacagtgtttcccataa

SEQ ID NO: 3976141 - DNA, 22 bp, Homo sapiens
gaacagttgcatttagcttctt

SEQ ID NO: 3976142 - DNA, 19 bp, Homo sapiens
gaacatacttcaaaaataa

SEQ ID NO: 3976143 - DNA, 23 bp, Homo sapiens
gaacatcaccgacgcgtctcctg

SEQ ID NO: 3976144 - DNA, 20 bp, Homo sapiens
gaacatcctttgcagggcag

SEQ ID NO: 3976145 - DNA, 21 bp, Homo sapiens
gaacatcctttgcagggcagc

SEQ ID NO: 3976146 - DNA, 16 bp, Homo sapiens
gaacatgcagttcatt

SEQ ID NO: 3976147 - DNA, 19 bp, Homo sapiens
gaacatggacttgtatatt

SEQ ID NO: 3976148 - DNA, 18 bp, Homo sapiens
gaacatggagctgtcatc

SEQ ID NO: 3976149 - DNA, 10 bp, Homo sapiens
gaacattgta

SEQ ID NO: 3976150 - DNA, 14 bp, Homo sapiens
gaacatttatatca

SEQ ID NO: 3976151 - DNA, 13 bp, Homo sapiens
gaaccaaagctca

SEQ ID NO: 3976152 - DNA, 15 bp, Homo sapiens
gaaccaacactaaca

SEQ ID NO: 3976153 - DNA, 15 bp, Homo sapiens
gaaccacagggccag

SEQ ID NO: 3976154 - DNA, 16 bp, Homo sapiens
gaaccacagggccaga

SEQ ID NO: 3976155 - DNA, 19 bp, Homo sapiens
gaaccacagggccagaggg

SEQ ID NO: 3976156 - DNA, 20 bp, Homo sapiens
gaaccacagggccagaggga

SEQ ID NO: 3976157 - DNA, 19 bp, Homo sapiens
gaaccactacatgcagccc

SEQ ID NO: 3976158 - DNA, 20 bp, Homo sapiens
gaaccacttcctgctacagg

SEQ ID NO: 3976159 - DNA, 22 bp, Homo sapiens
gaaccacttcctgctacaggag

SEQ ID NO: 3976160 - DNA, 20 bp, Homo sapiens
gaaccagccccatcagaacc

SEQ ID NO: 3976161 - DNA, 17 bp, Homo sapiens
gaaccagccggggcctt

SEQ ID NO: 3976162 - DNA, 18 bp, Homo sapiens
gaaccagggagaccgagc

SEQ ID NO: 3976163 - DNA, 19 bp, Homo sapiens
gaaccagtttcaggtgttt

SEQ ID NO: 3976164 - DNA, 22 bp, Homo sapiens
gaaccatagttgacagttccaa

SEQ ID NO: 3976165 - DNA, 17 bp, Homo sapiens
gaaccatgaagacagga

SEQ ID NO: 3976166 - DNA, 18 bp, Homo sapiens
gaaccatgaagacaggat

SEQ ID NO: 3976167 - DNA, 19 bp, Homo sapiens
gaacccaggacgcttctga

SEQ ID NO: 3976168 - DNA, 18 bp, Homo sapiens
gaaccccgagctgggggg

SEQ ID NO: 3976169 - DNA, 20 bp, Homo sapiens
gaaccccggggtgcccacag

SEQ ID NO: 3976170 - DNA, 17 bp, Homo sapiens
gaaccctctgtcccacc

SEQ ID NO: 3976171 - DNA, 16 bp, Homo sapiens
gaaccctggggcctga

SEQ ID NO: 3976172 - DNA, 21 bp, Homo sapiens
gaaccgagcaaagatcaaaat

SEQ ID NO: 3976173 - DNA, 19 bp, Homo sapiens
gaaccgtggtatgtctgcc

SEQ ID NO: 3976174 - DNA, 15 bp, Homo sapiens
gaaccgtgtccagca

SEQ ID NO: 3976175 - DNA, 18 bp, Homo sapiens
gaaccgtgtccagcacag

SEQ ID NO: 3976176 - DNA, 18 bp, Homo sapiens
gaaccgttttgaagctac

SEQ ID NO: 3976177 - DNA, 15 bp, Homo sapiens
gaacctcagattctt

SEQ ID NO: 3976178 - DNA, 18 bp, Homo sapiens
gaacctcagattcttcat

SEQ ID NO: 3976179 - DNA, 17 bp, Homo sapiens
gaacctcagcctggcca

SEQ ID NO: 3976180 - DNA, 21 bp, Homo sapiens
gaacctcagcctggccagaca

SEQ ID NO: 3976181 - DNA, 12 bp, Homo sapiens
gaacctctgtct

SEQ ID NO: 3976182 - DNA, 18 bp, Homo sapiens
gaacctctgtctcatcct

SEQ ID NO: 3976183 - DNA, 18 bp, Homo sapiens
gaacctgagctattttcc

SEQ ID NO: 3976184 - DNA, 11 bp, Homo sapiens
gaacctggatc

SEQ ID NO: 3976185 - DNA, 16 bp, Homo sapiens
gaacctgtcctaagga

SEQ ID NO: 3976186 - DNA, 15 bp, Homo sapiens
gaaccttccttcctg

SEQ ID NO: 3976187 - DNA, 14 bp, Homo sapiens
gaaccttgctgtcc

SEQ ID NO: 3976188 - DNA, 15 bp, Homo sapiens
gaaccttgctgtcct

SEQ ID NO: 3976189 - DNA, 16 bp, Homo sapiens
gaaccttgctgtcctg

SEQ ID NO: 3976190 - DNA, 23 bp, Homo sapiens
gaacctttttttttgaaacagca

SEQ ID NO: 3976191 - DNA, 17 bp, Homo sapiens
gaacgcagccctagagc

SEQ ID NO: 3976192 - DNA, 22 bp, Homo sapiens
gaacggagccccaggcctctgt

SEQ ID NO: 3976193 - DNA, 14 bp, Homo sapiens
gaactaaatgttct

SEQ ID NO: 3976194 - DNA, 16 bp, Homo sapiens
gaactaaatgttctat

SEQ ID NO: 3976195 - DNA, 15 bp, Homo sapiens
gaactaataaaagca

SEQ ID NO: 3976196 - DNA, 16 bp, Homo sapiens
gaactacccccttttc

SEQ ID NO: 3976197 - DNA, 18 bp, Homo sapiens
gaactagcatatagccat

SEQ ID NO: 3976198 - DNA, 20 bp, Homo sapiens
gaactaggaaggcacttctg

SEQ ID NO: 3976199 - DNA, 15 bp, Homo sapiens
gaactataaagaagt

SEQ ID NO: 3976200 - DNA, 23 bp, Homo sapiens
gaactcaaatggggccagatcca

SEQ ID NO: 3976201 - DNA, 15 bp, Homo sapiens
gaactcaactttgac

SEQ ID NO: 3976202 - DNA, 16 bp, Homo sapiens
gaactcaactttgaca

SEQ ID NO: 3976203 - DNA, 16 bp, Homo sapiens
gaactcactctgggct

SEQ ID NO: 3976204 - DNA, 17 bp, Homo sapiens
gaactcactctgggctg

SEQ ID NO: 3976205 - DNA, 16 bp, Homo sapiens
gaactcactggggcct

SEQ ID NO: 3976206 - DNA, 16 bp, Homo sapiens
gaactcagatccaggg

SEQ ID NO: 3976207 - DNA, 19 bp, Homo sapiens
gaactcagatccagggaca

SEQ ID NO: 3976208 - DNA, 16 bp, Homo sapiens
gaactcagctgtctgt

SEQ ID NO: 3976209 - DNA, 20 bp, Homo sapiens
gaactcattctatccccaat

SEQ ID NO: 3976210 - DNA, 23 bp, Homo sapiens
gaactccaccgaccaactgccct

SEQ ID NO: 3976211 - DNA, 14 bp, Homo sapiens
gaactccaggccct

SEQ ID NO: 3976212 - DNA, 17 bp, Homo sapiens
gaactccaggccctcct

SEQ ID NO: 3976213 - DNA, 11 bp, Homo sapiens
gaactcccagc

SEQ ID NO: 3976214 - DNA, 17 bp, Homo sapiens
gaactctctccacccta

SEQ ID NO: 3976215 - DNA, 19 bp, Homo sapiens
gaactctggtgctcctgca

SEQ ID NO: 3976216 - DNA, 19 bp, Homo sapiens
gaactctggtggcacagga

SEQ ID NO: 3976217 - DNA, 20 bp, Homo sapiens
gaactcttaatcaaatagca

SEQ ID NO: 3976218 - DNA, 12 bp, Homo sapiens
gaactcttcctc

SEQ ID NO: 3976219 - DNA, 22 bp, Homo sapiens
gaactcttcctccaaggacaga

SEQ ID NO: 3976220 - DNA, 23 bp, Homo sapiens
gaactgaggagatgaccagggat

SEQ ID NO: 3976221 - DNA, 15 bp, Homo sapiens
gaactgagggcaagg

SEQ ID NO: 3976222 - DNA, 15 bp, Homo sapiens
gaactgcatggacct

SEQ ID NO: 3976223 - DNA, 22 bp, Homo sapiens
gaactgccctactgggagactg

SEQ ID NO: 3976224 - DNA, 15 bp, Homo sapiens
gaactgctttcaagt

SEQ ID NO: 3976225 - DNA, 22 bp, Homo sapiens
gaagccatatatgaccagaagc

SEQ ID NO: 3976226 - DNA, 14 bp, Homo sapiens
gaagcccccagcta

SEQ ID NO: 3976227 - DNA, 17 bp, Homo sapiens
gaagcccccagctaaga

SEQ ID NO: 3976228 - DNA, 13 bp, Homo sapiens
gaagccctggaga

SEQ ID NO: 3976229 - DNA, 21 bp, Homo sapiens
gaagccgactctggccctggc

SEQ ID NO: 3976230 - DNA, 17 bp, Homo sapiens
gaagcctctggctagag

SEQ ID NO: 3976231 - DNA, 17 bp, Homo sapiens
gaagcctgtgcctccca

SEQ ID NO: 3976232 - DNA, 14 bp, Homo sapiens
gaagccttgctcat

SEQ ID NO: 3976233 - DNA, 20 bp, Homo sapiens
gaagccttggaaccagcccc

SEQ ID NO: 3976234 - DNA, 16 bp, Homo sapiens
gaagcgagcactgacc

SEQ ID NO: 3976235 - DNA, 16 bp, Homo sapiens
gaagcggatttccagg

SEQ ID NO: 3976236 - DNA, 14 bp, Homo sapiens
gaagctaatttgca

SEQ ID NO: 3976237 - DNA, 16 bp, Homo sapiens
gaagctaatttgcatt

SEQ ID NO: 3976238 - DNA, 20 bp, Homo sapiens
gaagctactgtgtgtgtgaa

SEQ ID NO: 3976239 - DNA, 22 bp, Homo sapiens
gaagctactgtgtgtgtgaatg

SEQ ID NO: 3976240 - DNA, 23 bp, Homo sapiens
gaagctactgtgtgtgtgaatga

SEQ ID NO: 3976241 - DNA, 21 bp, Homo sapiens
gaagctcctctccccagccca

SEQ ID NO: 3976242 - DNA, 20 bp, Homo sapiens
gaagctcttactctttccta

SEQ ID NO: 3976243 - DNA, 17 bp, Homo sapiens
gaagctgatgctttgct

SEQ ID NO: 3976244 - DNA, 21 bp, Homo sapiens
gaagctgatgctttgcttcaa

SEQ ID NO: 3976245 - DNA, 13 bp, Homo sapiens
gaagctgccagcc

SEQ ID NO: 3976246 - DNA, 15 bp, Homo sapiens
gaagctgccagccca

SEQ ID NO: 3976247 - DNA, 16 bp, Homo sapiens
gaagctgccagcccag

SEQ ID NO: 3976248 - DNA, 17 bp, Homo sapiens
gaagctgccagcccaga

SEQ ID NO: 3976249 - DNA, 21 bp, Homo sapiens
gaagctgccaggtgagaaact

SEQ ID NO: 3976250 - DNA, 22 bp, Homo sapiens
gaagctgccaggtgagaaactg

SEQ ID NO: 3976251 - DNA, 14 bp, Homo sapiens
gaagctgctccagg

SEQ ID NO: 3976252 - DNA, 10 bp, Homo sapiens
gaagctgctg

SEQ ID NO: 3976253 - DNA, 12 bp, Homo sapiens
gaagctgctgac

SEQ ID NO: 3976254 - DNA, 14 bp, Homo sapiens
gaagctgctgacca

SEQ ID NO: 3976255 - DNA, 17 bp, Homo sapiens
gaagctggcagaacgga

SEQ ID NO: 3976256 - DNA, 23 bp, Homo sapiens
gaagctggccgagggtcctggct

SEQ ID NO: 3976257 - DNA, 22 bp, Homo sapiens
gaagctggcctgagaggggaag

SEQ ID NO: 3976258 - DNA, 16 bp, Homo sapiens
gaagctgttgtacatt

SEQ ID NO: 3976259 - DNA, 17 bp, Homo sapiens
gaagcttggggaaccca

SEQ ID NO: 3976260 - DNA, 19 bp, Homo sapiens
gaagcttggggaacccatg

SEQ ID NO: 3976261 - DNA, 19 bp, Homo sapiens
gaaggaaagaaagaaggaa

SEQ ID NO: 3976262 - DNA, 15 bp, Homo sapiens
gaaggaactctggct

SEQ ID NO: 3976263 - DNA, 20 bp, Homo sapiens
gaaggaactctggcttccag

SEQ ID NO: 3976264 - DNA, 22 bp, Homo sapiens
gaaggaactctggcttccaggt

SEQ ID NO: 3976265 - DNA, 22 bp, Homo sapiens
gaaggaagccaaatttatcaaa

SEQ ID NO: 3976266 - DNA, 16 bp, Homo sapiens
gaaggaatctgtgcag

SEQ ID NO: 3976267 - DNA, 16 bp, Homo sapiens
gaaggaccacatttta

SEQ ID NO: 3976268 - DNA, 21 bp, Homo sapiens
gaaggacctgagctggccagg

SEQ ID NO: 3976269 - DNA, 22 bp, Homo sapiens
gaaggaggaatgctggactgga

SEQ ID NO: 3976270 - DNA, 18 bp, Homo sapiens
gaaggaggctccaggcag

SEQ ID NO: 3976271 - DNA, 20 bp, Homo sapiens
gaaggaggggagagacaggc

SEQ ID NO: 3976272 - DNA, 21 bp, Homo sapiens
gaaggaggggagagacaggca

SEQ ID NO: 3976273 - DNA, 20 bp, Homo sapiens
gaaggagggtacagctgggc

SEQ ID NO: 3976274 - DNA, 23 bp, Homo sapiens
gaaggatgggatgggttccagag

SEQ ID NO: 3976275 - DNA, 16 bp, Homo sapiens
gaaggcaagagggggt

SEQ ID NO: 3976276 - DNA, 17 bp, Homo sapiens
gaaggcaagagggggtg

SEQ ID NO: 3976277 - DNA, 15 bp, Homo sapiens
gaaggcagacagcag

SEQ ID NO: 3976278 - DNA, 20 bp, Homo sapiens
gaaggcagacagcaggcagc

SEQ ID NO: 3976279 - DNA, 15 bp, Homo sapiens
gaaggcatgagaaag

SEQ ID NO: 3976280 - DNA, 22 bp, Homo sapiens
gaaggcccagcaccaccctcct

SEQ ID NO: 3976281 - DNA, 17 bp, Homo sapiens
gaaggccgaggtcccat

SEQ ID NO: 3976282 - DNA, 15 bp, Homo sapiens
gaaggcgagtctggg

SEQ ID NO: 3976283 - DNA, 17 bp, Homo sapiens
gaagggaccttgaaggg

SEQ ID NO: 3976284 - DNA, 15 bp, Homo sapiens
gaagggacttttatt

SEQ ID NO: 3976285 - DNA, 16 bp, Homo sapiens
gaagggaggggctgtg

SEQ ID NO: 3976286 - DNA, 13 bp, Homo sapiens
gaagggcaagttt

SEQ ID NO: 3976287 - DNA, 15 bp, Homo sapiens
gaagggccagagcca

SEQ ID NO: 3976288 - DNA, 18 bp, Homo sapiens
gaagggccagtcctgcct

SEQ ID NO: 3976289 - DNA, 19 bp, Homo sapiens
gaagggccagtcctgcctg

SEQ ID NO: 3976290 - DNA, 19 bp, Homo sapiens
gaagggccagtctgggctg

SEQ ID NO: 3976291 - DNA, 20 bp, Homo sapiens
gaagggcttacaggcatgga

SEQ ID NO: 3976292 - DNA, 18 bp, Homo sapiens
gaagggggtccacccagc

SEQ ID NO: 3976293 - DNA, 14 bp, Homo sapiens
gaaggggttcctca

SEQ ID NO: 3976294 - DNA, 22 bp, Homo sapiens
gaaggtagcccagcactgtgaa

SEQ ID NO: 3976295 - DNA, 17 bp, Homo sapiens
gaaggtcacctgagccc

SEQ ID NO: 3976296 - DNA, 21 bp, Homo sapiens
gaaggtcactcttcctgcaag

SEQ ID NO: 3976297 - DNA, 23 bp, Homo sapiens
gaaggtcactcttcctgcaagga

SEQ ID NO: 3976298 - DNA, 17 bp, Homo sapiens
gaaggtgagatggccag

SEQ ID NO: 3976299 - DNA, 22 bp, Homo sapiens
gaaggtgcctcagactccgccc

SEQ ID NO: 3976300 - DNA, 23 bp, Homo sapiens
gaaggtgcctctggatgctgtga

SEQ ID NO: 3976301 - DNA, 19 bp, Homo sapiens
gaaggttcatgtagagaaa

SEQ ID NO: 3976302 - DNA, 15 bp, Homo sapiens
gaaggtttgtatatt

SEQ ID NO: 3976303 - DNA, 22 bp, Homo sapiens
gaaggtttgtgttttctctgga

SEQ ID NO: 3976304 - DNA, 16 bp, Homo sapiens
gaagtaaactttttgt

SEQ ID NO: 3976305 - DNA, 20 bp, Homo sapiens
gaagtaaactttttgttctg

SEQ ID NO: 3976306 - DNA, 13 bp, Homo sapiens
gaagtaatgaatt

SEQ ID NO: 3976307 - DNA, 19 bp, Homo sapiens
gaagtagcttgctccctgt

SEQ ID NO: 3976308 - DNA, 14 bp, Homo sapiens
gaagtagctttgca

SEQ ID NO: 3976309 - DNA, 22 bp, Homo sapiens
gaagtcacccctttctgtccca

SEQ ID NO: 3976310 - DNA, 23 bp, Homo sapiens
gaagtcacccctttctgtcccac

SEQ ID NO: 3976311 - DNA, 15 bp, Homo sapiens
gaagtcactgcacag

SEQ ID NO: 3976312 - DNA, 21 bp, Homo sapiens
gaagtcatgctcccctgtgcc

SEQ ID NO: 3976313 - DNA, 21 bp, Homo sapiens
gaagtctccatgaagagcttg

SEQ ID NO: 3976314 - DNA, 18 bp, Homo sapiens
gaagtctctaggttctga

SEQ ID NO: 3976315 - DNA, 15 bp, Homo sapiens
gaagtgaagaatgca

SEQ ID NO: 3976316 - DNA, 14 bp, Homo sapiens
gaagtgcatttctg

SEQ ID NO: 3976317 - DNA, 13 bp, Homo sapiens
gaagtgccttctc

SEQ ID NO: 3976318 - DNA, 20 bp, Homo sapiens
gaagtgccttctccttcccc

SEQ ID NO: 3976319 - DNA, 22 bp, Homo sapiens
gaagtgccttctccttccccag

SEQ ID NO: 3976320 - DNA, 15 bp, Homo sapiens
gaagtgcgtgaatgt

SEQ ID NO: 3976321 - DNA, 21 bp, Homo sapiens
gaagtgcgtgaatgtatgtaa

SEQ ID NO: 3976322 - DNA, 20 bp, Homo sapiens
gaagtgctcttggctgaccc

SEQ ID NO: 3976323 - DNA, 20 bp, Homo sapiens
gaagtgctggcaaccactaa

SEQ ID NO: 3976324 - DNA, 18 bp, Homo sapiens
gaagtggactggcccctg

SEQ ID NO: 3976325 - DNA, 23 bp, Homo sapiens
gaagtggctgccacacccagggg

SEQ ID NO: 3976326 - DNA, 18 bp, Homo sapiens
gaagtgtaacagctgagg

SEQ ID NO: 3976327 - DNA, 13 bp, Homo sapiens
aaaaagtttgttt

SEQ ID NO: 3976328 - DNA, 19 bp, Homo sapiens
aaaaataatcaagatttta

SEQ ID NO: 3976329 - DNA, 20 bp, Homo sapiens
aaaaatattcctccaaatct

SEQ ID NO: 3976330 - DNA, 11 bp, Homo sapiens
aaaaatattgt

SEQ ID NO: 3976331 - DNA, 17 bp, Homo sapiens
aaaaatcacaaaaattt

SEQ ID NO: 3976332 - DNA, 14 bp, Homo sapiens
aaaaatccagaaac

SEQ ID NO: 3976333 - DNA, 20 bp, Homo sapiens
aaaaatcctattctgatgaa

SEQ ID NO: 3976334 - DNA, 18 bp, Homo sapiens
aaaaatgaaagtgacttt

SEQ ID NO: 3976335 - DNA, 20 bp, Homo sapiens
aaaaatgaatgtctaaaatt

SEQ ID NO: 3976336 - DNA, 12 bp, Homo sapiens
aaaaatggatat

SEQ ID NO: 3976337 - DNA, 23 bp, Homo sapiens
aaaaatggatattattagaaatt

SEQ ID NO: 3976338 - DNA, 14 bp, Homo sapiens
aaaaatggttgatg

SEQ ID NO: 3976339 - DNA, 20 bp, Homo sapiens
aaaaatggttgatggaaaat

SEQ ID NO: 3976340 - DNA, 12 bp, Homo sapiens
aaaaatgtacat

SEQ ID NO: 3976341 - DNA, 18 bp, Homo sapiens
aaaaattaaaacgaaaat

SEQ ID NO: 3976342 - DNA, 14 bp, Homo sapiens
aaaaattactaatt

SEQ ID NO: 3976343 - DNA, 18 bp, Homo sapiens
aaaaattactaattttac

SEQ ID NO: 3976344 - DNA, 13 bp, Homo sapiens
aaaaattccagaa

SEQ ID NO: 3976345 - DNA, 14 bp, Homo sapiens
aaaaattgtgatca

SEQ ID NO: 3976346 - DNA, 21 bp, Homo sapiens
aaaaattgttaatttttccta

SEQ ID NO: 3976347 - DNA, 14 bp, Homo sapiens
aaaaatttaagcat

SEQ ID NO: 3976348 - DNA, 20 bp, Homo sapiens
aaaaatttaagcattgtttg

SEQ ID NO: 3976349 - DNA, 22 bp, Homo sapiens
aaaaatttaagcattgtttgct

SEQ ID NO: 3976350 - DNA, 15 bp, Homo sapiens
aaaacaaaattttat

SEQ ID NO: 3976351 - DNA, 15 bp, Homo sapiens
aaaacaagtgaaata

SEQ ID NO: 3976352 - DNA, 12 bp, Homo sapiens
aaaacacattgc

SEQ ID NO: 3976353 - DNA, 21 bp, Homo sapiens
aaaacaccgcttctgcctttt

SEQ ID NO: 3976354 - DNA, 14 bp, Homo sapiens
aaaacactagtttt

SEQ ID NO: 3976355 - DNA, 21 bp, Homo sapiens
aaaacactgaaaaatattcca

SEQ ID NO: 3976356 - DNA, 19 bp, Homo sapiens
aaaacagaaaaacagacaa

SEQ ID NO: 3976357 - DNA, 15 bp, Homo sapiens
aaaacagacaaaaca

SEQ ID NO: 3976358 - DNA, 23 bp, Homo sapiens
aaaacagctgtctctaacttatt

SEQ ID NO: 3976359 - DNA, 19 bp, Homo sapiens
aaaacagtatttattttgt

SEQ ID NO: 3976360 - DNA, 20 bp, Homo sapiens
aaaacagtatttattttgta

SEQ ID NO: 3976361 - DNA, 16 bp, Homo sapiens
aaaacatagcatctca

SEQ ID NO: 3976362 - DNA, 13 bp, Homo sapiens
aaaacatgtatgt

SEQ ID NO: 3976363 - DNA, 23 bp, Homo sapiens
aaaacattgcaaatttattttat

SEQ ID NO: 3976364 - DNA, 20 bp, Homo sapiens
aaaacatttttaatttaaca

SEQ ID NO: 3976365 - DNA, 21 bp, Homo sapiens
aaaacattttttttttaaatc

SEQ ID NO: 3976366 - DNA, 19 bp, Homo sapiens
aaaaccaagccgtggcttc

SEQ ID NO: 3976367 - DNA, 13 bp, Homo sapiens
aaaacgcatggag

SEQ ID NO: 3976368 - DNA, 18 bp, Homo sapiens
aaaacgcatggagtgtgt

SEQ ID NO: 3976369 - DNA, 17 bp, Homo sapiens
aaaacgttttattgtgt

SEQ ID NO: 3976370 - DNA, 14 bp, Homo sapiens
aaaactcactgtga

SEQ ID NO: 3976371 - DNA, 16 bp, Homo sapiens
aaaactcccatttacg

SEQ ID NO: 3976372 - DNA, 16 bp, Homo sapiens
aaaactcttaatctgt

SEQ ID NO: 3976373 - DNA, 18 bp, Homo sapiens
aaaactgattgaatgata

SEQ ID NO: 3976374 - DNA, 13 bp, Homo sapiens
aaaactggcctga

SEQ ID NO: 3976375 - DNA, 21 bp, Homo sapiens
aaaacttatgctgatttattt

SEQ ID NO: 3976376 - DNA, 23 bp, Homo sapiens
aaaacttcttaaatatcttttat

SEQ ID NO: 3976377 - DNA, 12 bp, Homo sapiens
aaaacttctttt

SEQ ID NO: 3976378 - DNA, 22 bp, Homo sapiens
aaaacttgatgtgttatctctt

SEQ ID NO: 3976379 - DNA, 14 bp, Homo sapiens
aaaacttggcactt

SEQ ID NO: 3976380 - DNA, 19 bp, Homo sapiens
aaaacttggttttatggtt

SEQ ID NO: 3976381 - DNA, 20 bp, Homo sapiens
aaaactttcctcgcctgaca

SEQ ID NO: 3976382 - DNA, 10 bp, Homo sapiens
aaaagaaaag

SEQ ID NO: 3976383 - DNA, 10 bp, Homo sapiens
aaaagaaagc

SEQ ID NO: 3976384 - DNA, 11 bp, Homo sapiens
aaaagaaagca

SEQ ID NO: 3976385 - DNA, 19 bp, Homo sapiens
aaaagaaatcatgtccata

SEQ ID NO: 3976386 - DNA, 13 bp, Homo sapiens
aaaagaaatgcaa

SEQ ID NO: 3976387 - DNA, 16 bp, Homo sapiens
aaaagaacagtaaaca

SEQ ID NO: 3976388 - DNA, 12 bp, Homo sapiens
aaaagaagttac

SEQ ID NO: 3976389 - DNA, 19 bp, Homo sapiens
aaaagaagttactttgtaa

SEQ ID NO: 3976390 - DNA, 20 bp, Homo sapiens
aaaagaagttactttgtaat

SEQ ID NO: 3976391 - DNA, 21 bp, Homo sapiens
aaaagaattaccaagagaagg

SEQ ID NO: 3976392 - DNA, 19 bp, Homo sapiens
aaaagacgatgtttatgtt

SEQ ID NO: 3976393 - DNA, 21 bp, Homo sapiens
aaaagacgatgtttatgttct

SEQ ID NO: 3976394 - DNA, 16 bp, Homo sapiens
aaaagactcagtgttc

SEQ ID NO: 3976395 - DNA, 16 bp, Homo sapiens
aaaagagatattttaa

SEQ ID NO: 3976396 - DNA, 18 bp, Homo sapiens
aaaagataaagatgatct

SEQ ID NO: 3976397 - DNA, 17 bp, Homo sapiens
aaaagatttgttttgtc

SEQ ID NO: 3976398 - DNA, 12 bp, Homo sapiens
aaaagattttat

SEQ ID NO: 3976399 - DNA, 21 bp, Homo sapiens
aaaagattttcagaaaatatt

SEQ ID NO: 3976400 - DNA, 14 bp, Homo sapiens
aaaagcaagactgt

SEQ ID NO: 3976401 - DNA, 18 bp, Homo sapiens
aaaagcaagggagaaaag

SEQ ID NO: 3976402 - DNA, 11 bp, Homo sapiens
aaaagcacctc

SEQ ID NO: 3976403 - DNA, 17 bp, Homo sapiens
aaaagcacttttgttat

SEQ ID NO: 3976404 - DNA, 18 bp, Homo sapiens
aaaagcacttttgttatt

SEQ ID NO: 3976405 - DNA, 21 bp, Homo sapiens
aaaagcacttttgttattcca

SEQ ID NO: 3976406 - DNA, 22 bp, Homo sapiens
aaaagcacttttgttattccat

SEQ ID NO: 3976407 - DNA, 14 bp, Homo sapiens
aaaagcagaatttt

SEQ ID NO: 3976408 - DNA, 12 bp, Homo sapiens
aaaagcagtcct

SEQ ID NO: 3976409 - DNA, 13 bp, Homo sapiens
aaaagcataaatg

SEQ ID NO: 3976410 - DNA, 10 bp, Homo sapiens
aaaagcattt

SEQ ID NO: 3976411 - DNA, 21 bp, Homo sapiens
aaaagcatttttcaatatatt

SEQ ID NO: 3976412 - DNA, 19 bp, Homo sapiens
aaaagcctgcaatttcata

SEQ ID NO: 3976413 - DNA, 17 bp, Homo sapiens
aaaagccttgtgtatat

SEQ ID NO: 3976414 - DNA, 20 bp, Homo sapiens
aaaagcgacccattcagaga

SEQ ID NO: 3976415 - DNA, 22 bp, Homo sapiens
aaaagcggaaagttagtgcttg

SEQ ID NO: 3976416 - DNA, 15 bp, Homo sapiens
aaaagctattagcca

SEQ ID NO: 3976417 - DNA, 13 bp, Homo sapiens
aaaagctcctgtc

SEQ ID NO: 3976418 - DNA, 13 bp, Homo sapiens
aaaagctctttta

SEQ ID NO: 3976419 - DNA, 14 bp, Homo sapiens
aaaagctcttttaa

SEQ ID NO: 3976420 - DNA, 20 bp, Homo sapiens
aaaagcttcttaattaattt

SEQ ID NO: 3976421 - DNA, 21 bp, Homo sapiens
aaaagcttcttaattaatttg

SEQ ID NO: 3976422 - DNA, 16 bp, Homo sapiens
aaaaggacacctttta

SEQ ID NO: 3976423 - DNA, 14 bp, Homo sapiens
aaaaggcccatgta

SEQ ID NO: 3976424 - DNA, 22 bp, Homo sapiens
aaaaggcctcttgtaaagactg

SEQ ID NO: 3976425 - DNA, 20 bp, Homo sapiens
aaaaggttgcctgaaaaatg

SEQ ID NO: 3976426 - DNA, 16 bp, Homo sapiens
aaaagtaaactactgt

SEQ ID NO: 3976427 - DNA, 11 bp, Homo sapiens
aaaagtaaatg

SEQ ID NO: 3976428 - DNA, 13 bp, Homo sapiens
aaaagtatatgtt

SEQ ID NO: 3976429 - DNA, 12 bp, Homo sapiens
aaaagtattttg

SEQ ID NO: 3976430 - DNA, 23 bp, Homo sapiens
aaaggaaatctcaccccatccca

SEQ ID NO: 3976431 - DNA, 12 bp, Homo sapiens
aaaggaagacta

SEQ ID NO: 3976432 - DNA, 15 bp, Homo sapiens
aaaggaagccaaaga

SEQ ID NO: 3976433 - DNA, 15 bp, Homo sapiens
aaaggacgcctgcag

SEQ ID NO: 3976434 - DNA, 20 bp, Homo sapiens
aaaggagcatttttttattc

SEQ ID NO: 3976435 - DNA, 23 bp, Homo sapiens
aaaggagcatttttttattcagc

SEQ ID NO: 3976436 - DNA, 21 bp, Homo sapiens
aaaggagccttttgctctctg

SEQ ID NO: 3976437 - DNA, 24 bp, Homo sapiens
aaaggagtttctttagctgacaga

SEQ ID NO: 3976438 - DNA, 16 bp, Homo sapiens
aaaggatatttaagaa

SEQ ID NO: 3976439 - DNA, 19 bp, Homo sapiens
aaaggatatttaagaaaat

SEQ ID NO: 3976440 - DNA, 23 bp, Homo sapiens
aaaggatatttaagaaaatacaa

SEQ ID NO: 3976441 - DNA, 12 bp, Homo sapiens
aaaggatgtgat

SEQ ID NO: 3976442 - DNA, 17 bp, Homo sapiens
aaaggatgtgatatata

SEQ ID NO: 3976443 - DNA, 23 bp, Homo sapiens
aaaggatgtgatatataagtgta

SEQ ID NO: 3976444 - DNA, 22 bp, Homo sapiens
aaaggcaagttaagagaaactt

SEQ ID NO: 3976445 - DNA, 17 bp, Homo sapiens
aaaggcagctgttgtct

SEQ ID NO: 3976446 - DNA, 16 bp, Homo sapiens
aaaggcagtattttgt

SEQ ID NO: 3976447 - DNA, 19 bp, Homo sapiens
aaaggcagtattttgtgtc

SEQ ID NO: 3976448 - DNA, 21 bp, Homo sapiens
aaaggcataagaccctaagcc

SEQ ID NO: 3976449 - DNA, 15 bp, Homo sapiens
aaaggcatcagtccc

SEQ ID NO: 3976450 - DNA, 23 bp, Homo sapiens
aaaggcatcagtccccctgtgca

SEQ ID NO: 3976451 - DNA, 21 bp, Homo sapiens
aaaggcctcttgtaaagactg

SEQ ID NO: 3976452 - DNA, 13 bp, Homo sapiens
aaaggctgtggta

SEQ ID NO: 3976453 - DNA, 17 bp, Homo sapiens
aaaggcttgcagaactt

SEQ ID NO: 3976454 - DNA, 16 bp, Homo sapiens
aaagggaaaagggaga

SEQ ID NO: 3976455 - DNA, 14 bp, Homo sapiens
aaagggaaactatt

SEQ ID NO: 3976456 - DNA, 14 bp, Homo sapiens
aaagggacagcatg

SEQ ID NO: 3976457 - DNA, 16 bp, Homo sapiens
aaagggacagcatgcc

SEQ ID NO: 3976458 - DNA, 18 bp, Homo sapiens
aaagggctggctccccct

SEQ ID NO: 3976459 - DNA, 19 bp, Homo sapiens
aaaggggagagcctgctgg

SEQ ID NO: 3976460 - DNA, 13 bp, Homo sapiens
aaaggggggaggg

SEQ ID NO: 3976461 - DNA, 15 bp, Homo sapiens
aaaggggtgctttta

SEQ ID NO: 3976462 - DNA, 22 bp, Homo sapiens
aaaggggttggggtgacagtca

SEQ ID NO: 3976463 - DNA, 10 bp, Homo sapiens
aaagggtgaa

SEQ ID NO: 3976464 - DNA, 14 bp, Homo sapiens
aaagggtgtactta

SEQ ID NO: 3976465 - DNA, 23 bp, Homo sapiens
aaagggttgaaaatgtgtttgct

SEQ ID NO: 3976466 - DNA, 14 bp, Homo sapiens
aaaggtataatttt

SEQ ID NO: 3976467 - DNA, 14 bp, Homo sapiens
aaaggtcaataagg

SEQ ID NO: 3976468 - DNA, 19 bp, Homo sapiens
aaaggttaatttttccttc

SEQ ID NO: 3976469 - DNA, 16 bp, Homo sapiens
aaaggttctttgtgta

SEQ ID NO: 3976470 - DNA, 19 bp, Homo sapiens
aaaggtttgcattctcaca

SEQ ID NO: 3976471 - DNA, 14 bp, Homo sapiens
aaaggttttgtatt

SEQ ID NO: 3976472 - DNA, 12 bp, Homo sapiens
aaaggtttttaa

SEQ ID NO: 3976473 - DNA, 18 bp, Homo sapiens
aaaggttttttttcagtt

SEQ ID NO: 3976474 - DNA, 13 bp, Homo sapiens
aaagtaaagctaa

SEQ ID NO: 3976475 - DNA, 23 bp, Homo sapiens
aaagtaaagctaaaatgatttta

SEQ ID NO: 3976476 - DNA, 15 bp, Homo sapiens
aaagtaaatacaaga

SEQ ID NO: 3976477 - DNA, 17 bp, Homo sapiens
aaagtaaatacaagact

SEQ ID NO: 3976478 - DNA, 19 bp, Homo sapiens
aaagtaaatacaagactgt

SEQ ID NO: 3976479 - DNA, 14 bp, Homo sapiens
aaagtaaatgggag

SEQ ID NO: 3976480 - DNA, 15 bp, Homo sapiens
aaagtaaatgggagg

SEQ ID NO: 3976481 - DNA, 14 bp, Homo sapiens
aaagtaactcattt

SEQ ID NO: 3976482 - DNA, 18 bp, Homo sapiens
aaagtaactcatttgtta

SEQ ID NO: 3976483 - DNA, 17 bp, Homo sapiens
aaagtaagttaataatg

SEQ ID NO: 3976484 - DNA, 18 bp, Homo sapiens
aaagtaagttaataatgt

SEQ ID NO: 3976485 - DNA, 23 bp, Homo sapiens
aaagtaagttaataatgtattgt

SEQ ID NO: 3976486 - DNA, 14 bp, Homo sapiens
aaagtaatttcttt

SEQ ID NO: 3976487 - DNA, 14 bp, Homo sapiens
aaagtacagcctgg

SEQ ID NO: 3976488 - DNA, 12 bp, Homo sapiens
aaagtacattta

SEQ ID NO: 3976489 - DNA, 15 bp, Homo sapiens
aaagtacatttaata

SEQ ID NO: 3976490 - DNA, 22 bp, Homo sapiens
aaagtagaagtcttagatgtat

SEQ ID NO: 3976491 - DNA, 11 bp, Homo sapiens
aaagtagaggt

SEQ ID NO: 3976492 - DNA, 22 bp, Homo sapiens
aaagtagttttattttaataca

SEQ ID NO: 3976493 - DNA, 18 bp, Homo sapiens
aaagtatatatagaatct

SEQ ID NO: 3976494 - DNA, 14 bp, Homo sapiens
aaagtatatattta

SEQ ID NO: 3976495 - DNA, 23 bp, Homo sapiens
aaagtatatatttatttaagctt

SEQ ID NO: 3976496 - DNA, 21 bp, Homo sapiens
aaagtatcactctaaaaaaca

SEQ ID NO: 3976497 - DNA, 23 bp, Homo sapiens
aaagtattttgaagtttacattt

SEQ ID NO: 3976498 - DNA, 13 bp, Homo sapiens
aaagtccctccct

SEQ ID NO: 3976499 - DNA, 16 bp, Homo sapiens
aaagtcctttttttcc

SEQ ID NO: 3976500 - DNA, 22 bp, Homo sapiens
aaagtctaaacaaaattgcaat

SEQ ID NO: 3976501 - DNA, 23 bp, Homo sapiens
aaagtctatttttttaactgaaa

SEQ ID NO: 3976502 - DNA, 19 bp, Homo sapiens
aaagtgaatttgaatgaaa

SEQ ID NO: 3976503 - DNA, 22 bp, Homo sapiens
aaagtgaatttgaatgaaaaat

SEQ ID NO: 3976504 - DNA, 22 bp, Homo sapiens
aaagtgagaaagaaagtaaaaa

SEQ ID NO: 3976505 - DNA, 20 bp, Homo sapiens
aaagtgcctgacacactaac

SEQ ID NO: 3976506 - DNA, 20 bp, Homo sapiens
aaagtgcctgagctggggaa

SEQ ID NO: 3976507 - DNA, 18 bp, Homo sapiens
aaagtggcacctgtctgc

SEQ ID NO: 3976508 - DNA, 20 bp, Homo sapiens
aaagtggcacctgtctgctc

SEQ ID NO: 3976509 - DNA, 17 bp, Homo sapiens
aaagtggccatgccacc

SEQ ID NO: 3976510 - DNA, 21 bp, Homo sapiens
aaagtggcgtgggagccagcc

SEQ ID NO: 3976511 - DNA, 21 bp, Homo sapiens
aaagtgggttattctggagtt

SEQ ID NO: 3976512 - DNA, 17 bp, Homo sapiens
aaagtgtgttgttgctt

SEQ ID NO: 3976513 - DNA, 13 bp, Homo sapiens
aaagtgttacttt

SEQ ID NO: 3976514 - DNA, 13 bp, Homo sapiens
aaagtgttgtatc

SEQ ID NO: 3976515 - DNA, 17 bp, Homo sapiens
aaagtgttgtgttcctg

SEQ ID NO: 3976516 - DNA, 18 bp, Homo sapiens
aaagtgttgtgttcctgg

SEQ ID NO: 3976517 - DNA, 23 bp, Homo sapiens
aaagtgttgtgttcctggctgat

SEQ ID NO: 3976518 - DNA, 12 bp, Homo sapiens
aaagtgtttcag

SEQ ID NO: 3976519 - DNA, 21 bp, Homo sapiens
aaagtgtttcagctaagggaa

SEQ ID NO: 3976520 - DNA, 14 bp, Homo sapiens
aaagttacagaaat

SEQ ID NO: 3976521 - DNA, 20 bp, Homo sapiens
aaagttactttgtcagaggc

SEQ ID NO: 3976522 - DNA, 12 bp, Homo sapiens
aaagttgcagat

SEQ ID NO: 3976523 - DNA, 18 bp, Homo sapiens
aaagttgcagatgtattg

SEQ ID NO: 3976524 - DNA, 13 bp, Homo sapiens
aaagtttaaatgt

SEQ ID NO: 3976525 - DNA, 13 bp, Homo sapiens
aaagtttccatat

SEQ ID NO: 3976526 - DNA, 22 bp, Homo sapiens
aaagtttcctaggatgtcatgt

SEQ ID NO: 3976527 - DNA, 16 bp, Homo sapiens
aaagttttatttttct

SEQ ID NO: 3976528 - DNA, 12 bp, Homo sapiens
aaagttttgaaa

SEQ ID NO: 3976529 - DNA, 18 bp, Homo sapiens
aaagttttgaaaagctat

SEQ ID NO: 3976530 - DNA, 16 bp, Homo sapiens
aaagttttgcaaaggg

SEQ ID NO: 3976531 - DNA, 16 bp, Homo sapiens
aaagttttgtaaaaga

SEQ ID NO: 3976532 - DNA, 10 bp, Homo sapiens
aaatatttat

SEQ ID NO: 3976533 - DNA, 15 bp, Homo sapiens
aaatatttatgtaaa

SEQ ID NO: 3976534 - DNA, 22 bp, Homo sapiens
aaatatttattaaataaaatca

SEQ ID NO: 3976535 - DNA, 17 bp, Homo sapiens
aaatatttcagatatca

SEQ ID NO: 3976536 - DNA, 20 bp, Homo sapiens
aaatatttcctgacttgagt

SEQ ID NO: 3976537 - DNA, 12 bp, Homo sapiens
aaatatttcctt

SEQ ID NO: 3976538 - DNA, 14 bp, Homo sapiens
aaatatttctcaac

SEQ ID NO: 3976539 - DNA, 13 bp, Homo sapiens
aaatatttctgag

SEQ ID NO: 3976540 - DNA, 12 bp, Homo sapiens
aaatatttgaat

SEQ ID NO: 3976541 - DNA, 14 bp, Homo sapiens
aaatatttttagta

SEQ ID NO: 3976542 - DNA, 21 bp, Homo sapiens
aaatcaaaactcacaagtgct

SEQ ID NO: 3976543 - DNA, 20 bp, Homo sapiens
aaatcaatctgtaaaactaa

SEQ ID NO: 3976544 - DNA, 17 bp, Homo sapiens
aaatcaatttttaggaa

SEQ ID NO: 3976545 - DNA, 22 bp, Homo sapiens
aaatcacaaaaatttgaacact

SEQ ID NO: 3976546 - DNA, 13 bp, Homo sapiens
aaatcagaataaa

SEQ ID NO: 3976547 - DNA, 21 bp, Homo sapiens
aaatcagaataaattaatatt

SEQ ID NO: 3976548 - DNA, 16 bp, Homo sapiens
aaatcagtaagaggtg

SEQ ID NO: 3976549 - DNA, 22 bp, Homo sapiens
aaatcataggaaagtatttttt

SEQ ID NO: 3976550 - DNA, 19 bp, Homo sapiens
aaatcatattagtattaat

SEQ ID NO: 3976551 - DNA, 20 bp, Homo sapiens
aaatcatttcagtatcatct

SEQ ID NO: 3976552 - DNA, 15 bp, Homo sapiens
aaatccaaaacttct

SEQ ID NO: 3976553 - DNA, 11 bp, Homo sapiens
aaatccagaaa

SEQ ID NO: 3976554 - DNA, 18 bp, Homo sapiens
aaatccattgtttaaaga

SEQ ID NO: 3976555 - DNA, 16 bp, Homo sapiens
aaatccggagaagctg

SEQ ID NO: 3976556 - DNA, 15 bp, Homo sapiens
aaatcctactgaatg

SEQ ID NO: 3976557 - DNA, 17 bp, Homo sapiens
aaatcctcatgttactc

SEQ ID NO: 3976558 - DNA, 22 bp, Homo sapiens
aaatctaaaacaaaatctgaac

SEQ ID NO: 3976559 - DNA, 13 bp, Homo sapiens
aaatctaaaagaa

SEQ ID NO: 3976560 - DNA, 16 bp, Homo sapiens
aaatctaaatctattt

SEQ ID NO: 3976561 - DNA, 17 bp, Homo sapiens
aaatctaaatctattta

SEQ ID NO: 3976562 - DNA, 23 bp, Homo sapiens
aaatctacagatcctttttccat

SEQ ID NO: 3976563 - DNA, 13 bp, Homo sapiens
aaatctcaaattt

SEQ ID NO: 3976564 - DNA, 16 bp, Homo sapiens
aaatctcaaatttatt

SEQ ID NO: 3976565 - DNA, 22 bp, Homo sapiens
aaatctcagaattccttttcta

SEQ ID NO: 3976566 - DNA, 12 bp, Homo sapiens
aaatctcttctg

SEQ ID NO: 3976567 - DNA, 17 bp, Homo sapiens
aaatctcttgcttgtca

SEQ ID NO: 3976568 - DNA, 15 bp, Homo sapiens
aaatctgaagattgc

SEQ ID NO: 3976569 - DNA, 14 bp, Homo sapiens
aaatctgacatatt

SEQ ID NO: 3976570 - DNA, 18 bp, Homo sapiens
aaatctgacccagtgccc

SEQ ID NO: 3976571 - DNA, 20 bp, Homo sapiens
aaatctgctggagtttcatg

SEQ ID NO: 3976572 - DNA, 18 bp, Homo sapiens
aaatctgctttttaaaga

SEQ ID NO: 3976573 - DNA, 15 bp, Homo sapiens
aaatctggtcttgtt

SEQ ID NO: 3976574 - DNA, 20 bp, Homo sapiens
aaatctggtcttgttagaaa

SEQ ID NO: 3976575 - DNA, 17 bp, Homo sapiens
aaatctgtaacaggtat

SEQ ID NO: 3976576 - DNA, 22 bp, Homo sapiens
aaatctgtaacaggtattttgt

SEQ ID NO: 3976577 - DNA, 15 bp, Homo sapiens
aaatctgtataaatg

SEQ ID NO: 3976578 - DNA, 18 bp, Homo sapiens
aaatctgtataaatgtct

SEQ ID NO: 3976579 - DNA, 22 bp, Homo sapiens
aaatctgtcagcatctggctgt

SEQ ID NO: 3976580 - DNA, 15 bp, Homo sapiens
aaatctgttctaaca

SEQ ID NO: 3976581 - DNA, 15 bp, Homo sapiens
aaatcttccttgtga

SEQ ID NO: 3976582 - DNA, 16 bp, Homo sapiens
aaatcttggcaatatt

SEQ ID NO: 3976583 - DNA, 17 bp, Homo sapiens
aaatcttggcacagaaa

SEQ ID NO: 3976584 - DNA, 22 bp, Homo sapiens
aaatgaaattactacaaaattt

SEQ ID NO: 3976585 - DNA, 16 bp, Homo sapiens
aaatgaaatttgcaaa

SEQ ID NO: 3976586 - DNA, 18 bp, Homo sapiens
aaatgaagcagctttaaa

SEQ ID NO: 3976587 - DNA, 15 bp, Homo sapiens
aaatgaataatttcc

SEQ ID NO: 3976588 - DNA, 18 bp, Homo sapiens
aaatgaatatctattaat

SEQ ID NO: 3976589 - DNA, 19 bp, Homo sapiens
aaatgaatatctattaata

SEQ ID NO: 3976590 - DNA, 19 bp, Homo sapiens
aaatgaatctcgttcccaa

SEQ ID NO: 3976591 - DNA, 14 bp, Homo sapiens
aaatgacagatgtt

SEQ ID NO: 3976592 - DNA, 21 bp, Homo sapiens
aaatgactacttagcatccta

SEQ ID NO: 3976593 - DNA, 17 bp, Homo sapiens
aaatgacttatttctgc

SEQ ID NO: 3976594 - DNA, 21 bp, Homo sapiens
aaatgagaaggcagccaccag

SEQ ID NO: 3976595 - DNA, 12 bp, Homo sapiens
aaatgagtaaca

SEQ ID NO: 3976596 - DNA, 12 bp, Homo sapiens
aaatgattttaa

SEQ ID NO: 3976597 - DNA, 13 bp, Homo sapiens
aaatgattttaat

SEQ ID NO: 3976598 - DNA, 15 bp, Homo sapiens
aaatgcaacaaatga

SEQ ID NO: 3976599 - DNA, 16 bp, Homo sapiens
aaatgcaacaaatgaa

SEQ ID NO: 3976600 - DNA, 18 bp, Homo sapiens
aaatgcaccaagaaagct

SEQ ID NO: 3976601 - DNA, 15 bp, Homo sapiens
aaatgcagggagggg

SEQ ID NO: 3976602 - DNA, 22 bp, Homo sapiens
aaatgcagggaggggaggcaga

SEQ ID NO: 3976603 - DNA, 12 bp, Homo sapiens
aaatgcagtgaa

SEQ ID NO: 3976604 - DNA, 17 bp, Homo sapiens
aaatgcagttttaagaa

SEQ ID NO: 3976605 - DNA, 18 bp, Homo sapiens
aaatgcatgattttgtaa

SEQ ID NO: 3976606 - DNA, 21 bp, Homo sapiens
aaatgcatgattttgtaaccc

SEQ ID NO: 3976607 - DNA, 19 bp, Homo sapiens
aaatgcattctatcgttat

SEQ ID NO: 3976608 - DNA, 13 bp, Homo sapiens
aaatgccctcttc

SEQ ID NO: 3976609 - DNA, 22 bp, Homo sapiens
aaatgccctcttctcgtgcctc

SEQ ID NO: 3976610 - DNA, 15 bp, Homo sapiens
aaatgcctaataaac

SEQ ID NO: 3976611 - DNA, 15 bp, Homo sapiens
aaatgccttaaaatg

SEQ ID NO: 3976612 - DNA, 13 bp, Homo sapiens
aaatgctagaagc

SEQ ID NO: 3976613 - DNA, 24 bp, Homo sapiens
aaatgctagaagctgtctaggtcc

SEQ ID NO: 3976614 - DNA, 13 bp, Homo sapiens
aaatgctccccac

SEQ ID NO: 3976615 - DNA, 13 bp, Homo sapiens
aaatgctctctca

SEQ ID NO: 3976616 - DNA, 22 bp, Homo sapiens
aaatgctctctcaaattgtcag

SEQ ID NO: 3976617 - DNA, 22 bp, Homo sapiens
aaatgctggtatttgatttcct

SEQ ID NO: 3976618 - DNA, 16 bp, Homo sapiens
aaatgctgtgttgggt

SEQ ID NO: 3976619 - DNA, 20 bp, Homo sapiens
aaatggaacgctaatgaaac

SEQ ID NO: 3976620 - DNA, 22 bp, Homo sapiens
aaatggaattgaaaaactcttt

SEQ ID NO: 3976621 - DNA, 15 bp, Homo sapiens
aaatggacatggtgg

SEQ ID NO: 3976622 - DNA, 22 bp, Homo sapiens
aaatggaggtccttctgctgga

SEQ ID NO: 3976623 - DNA, 21 bp, Homo sapiens
aaatggatactacatctttaa

SEQ ID NO: 3976624 - DNA, 21 bp, Homo sapiens
aaatggcgtctggaagtccaa

SEQ ID NO: 3976625 - DNA, 13 bp, Homo sapiens
aaatggggccaga

SEQ ID NO: 3976626 - DNA, 22 bp, Homo sapiens
aaatggggtttgggcccctcag

SEQ ID NO: 3976627 - DNA, 21 bp, Homo sapiens
aaatgggtgtatataatttta

SEQ ID NO: 3976628 - DNA, 22 bp, Homo sapiens
aaatggtccaattagtttcctt

SEQ ID NO: 3976629 - DNA, 17 bp, Homo sapiens
aaatggtcgcccaggag

SEQ ID NO: 3976630 - DNA, 18 bp, Homo sapiens
aaatggtcgcccaggaga

SEQ ID NO: 3976631 - DNA, 14 bp, Homo sapiens
aaatggtgtacata

SEQ ID NO: 3976632 - DNA, 14 bp, Homo sapiens
aaatggttgatgga

SEQ ID NO: 3976633 - DNA, 15 bp, Homo sapiens
aaatggttgatggaa

SEQ ID NO: 3976634 - DNA, 19 bp, Homo sapiens
aaatggttgatggaaaata

SEQ ID NO: 3976635 - DNA, 20 bp, Homo sapiens
aaatggttgatggaaaataa

SEQ ID NO: 3976636 - DNA, 21 bp, Homo sapiens
aaatggttgatggaaaataaa

SEQ ID NO: 3976637 - DNA, 23 bp, Homo sapiens
aaatggttgatggaaaataaaca

SEQ ID NO: 3976638 - DNA, 18 bp, Homo sapiens
aaatgtaactgtgccagt

SEQ ID NO: 3976639 - DNA, 14 bp, Homo sapiens
aaatgtaatactgg

SEQ ID NO: 3976640 - DNA, 15 bp, Homo sapiens
aaatgtaatactgga

SEQ ID NO: 3976641 - DNA, 20 bp, Homo sapiens
aaatgtaatgtggcttctgg

SEQ ID NO: 3976642 - DNA, 12 bp, Homo sapiens
aaatgtaattga

SEQ ID NO: 3976643 - DNA, 15 bp, Homo sapiens
aaatgtaatttagaa

SEQ ID NO: 3976644 - DNA, 16 bp, Homo sapiens
aaatgtacctgatgta

SEQ ID NO: 3976645 - DNA, 14 bp, Homo sapiens
aaatgtagcttttg

SEQ ID NO: 3976646 - DNA, 15 bp, Homo sapiens
aaatgtattttacat

SEQ ID NO: 3976647 - DNA, 16 bp, Homo sapiens
aaatgtattttacata

SEQ ID NO: 3976648 - DNA, 17 bp, Homo sapiens
aaatgtattttgaagaa

SEQ ID NO: 3976649 - DNA, 22 bp, Homo sapiens
aaatgtattttgaagaatattt

SEQ ID NO: 3976650 - DNA, 14 bp, Homo sapiens
aaatgtctattatt

SEQ ID NO: 3976651 - DNA, 14 bp, Homo sapiens
aaatgtctcagttt

SEQ ID NO: 3976652 - DNA, 21 bp, Homo sapiens
aaatgtctttgtaagtcagtg

SEQ ID NO: 3976653 - DNA, 15 bp, Homo sapiens
aaatgtgaattttta

SEQ ID NO: 3976654 - DNA, 16 bp, Homo sapiens
aaatgtgagtgttttt

SEQ ID NO: 3976655 - DNA, 15 bp, Homo sapiens
aaatgtgatttttct

SEQ ID NO: 3976656 - DNA, 16 bp, Homo sapiens
aaatgtgatttttctg

SEQ ID NO: 3976657 - DNA, 20 bp, Homo sapiens
aaatgtgtcctatctatctt

SEQ ID NO: 3976658 - DNA, 12 bp, Homo sapiens
aaatgttagttc

SEQ ID NO: 3976659 - DNA, 14 bp, Homo sapiens
aaatgttagttcta

SEQ ID NO: 3976660 - DNA, 15 bp, Homo sapiens
aaatgttatttaaca

SEQ ID NO: 3976661 - DNA, 18 bp, Homo sapiens
aaatgttctatggttatg

SEQ ID NO: 3976662 - DNA, 22 bp, Homo sapiens
aaatgttggatttataaatgct

SEQ ID NO: 3976663 - DNA, 23 bp, Homo sapiens
aaatgttggatttataaatgcta

SEQ ID NO: 3976664 - DNA, 12 bp, Homo sapiens
aaatgtttggat

SEQ ID NO: 3976665 - DNA, 20 bp, Homo sapiens
aaatgtttgttaaaaataaa

SEQ ID NO: 3976666 - DNA, 14 bp, Homo sapiens
aaatgttttataag

SEQ ID NO: 3976667 - DNA, 23 bp, Homo sapiens
aaatgtttttctgccagggagct

SEQ ID NO: 3976668 - DNA, 21 bp, Homo sapiens
aaattaaagcctttagtatca

SEQ ID NO: 3976669 - DNA, 23 bp, Homo sapiens
aaattaaagcctttagtatcagt

SEQ ID NO: 3976670 - DNA, 11 bp, Homo sapiens
aaattaacaca

SEQ ID NO: 3976671 - DNA, 17 bp, Homo sapiens
aaattaacttgagtttt

SEQ ID NO: 3976672 - DNA, 15 bp, Homo sapiens
aaattaagaaggcaa

SEQ ID NO: 3976673 - DNA, 13 bp, Homo sapiens
aaattaataatct

SEQ ID NO: 3976674 - DNA, 14 bp, Homo sapiens
aaattaatattgta

SEQ ID NO: 3976675 - DNA, 22 bp, Homo sapiens
aaattactaattttacacatta

SEQ ID NO: 3976676 - DNA, 15 bp, Homo sapiens
aaattactgtgtaaa

SEQ ID NO: 3976677 - DNA, 22 bp, Homo sapiens
aaattactgtgtaaatatatgt

SEQ ID NO: 3976678 - DNA, 12 bp, Homo sapiens
aaattagaaaaa

SEQ ID NO: 3976679 - DNA, 19 bp, Homo sapiens
aaattagaaaaaaattact

SEQ ID NO: 3976680 - DNA, 20 bp, Homo sapiens
aaattagacaaatgctacat

SEQ ID NO: 3976681 - DNA, 15 bp, Homo sapiens
aaattaggaataaat

SEQ ID NO: 3976682 - DNA, 19 bp, Homo sapiens
aaattataacttaaaatat

SEQ ID NO: 3976683 - DNA, 22 bp, Homo sapiens
aaattataacttaaaatatttt

SEQ ID NO: 3976684 - DNA, 13 bp, Homo sapiens
aaattatgacaat

SEQ ID NO: 3976685 - DNA, 19 bp, Homo sapiens
aaattatgtataaacataa

SEQ ID NO: 3976686 - DNA, 19 bp, Homo sapiens
aaattatgtatgtttacat

SEQ ID NO: 3976687 - DNA, 14 bp, Homo sapiens
aaattatgttttaa

SEQ ID NO: 3976688 - DNA, 13 bp, Homo sapiens
aaattatttgcta

SEQ ID NO: 3976689 - DNA, 14 bp, Homo sapiens
aaattatttgctaa

SEQ ID NO: 3976690 - DNA, 19 bp, Homo sapiens
aaattcaattgtaaattga

SEQ ID NO: 3976691 - DNA, 15 bp, Homo sapiens
aaattcacaaacttt

SEQ ID NO: 3976692 - DNA, 17 bp, Homo sapiens
aaattcacagaagccta

SEQ ID NO: 3976693 - DNA, 20 bp, Homo sapiens
aaattcagatatatttttca

SEQ ID NO: 3976694 - DNA, 13 bp, Homo sapiens
aaattcagtttca

SEQ ID NO: 3976695 - DNA, 14 bp, Homo sapiens
aaattcagtttcat

SEQ ID NO: 3976696 - DNA, 23 bp, Homo sapiens
aaattcagtttttgtatcttggg

SEQ ID NO: 3976697 - DNA, 16 bp, Homo sapiens
aaattcatattctgtc

SEQ ID NO: 3976698 - DNA, 22 bp, Homo sapiens
aaattcatttttttcactggag

SEQ ID NO: 3976699 - DNA, 17 bp, Homo sapiens
aaattccagaaaggata

SEQ ID NO: 3976700 - DNA, 23 bp, Homo sapiens
aaattccagcaataagaaatgaa

SEQ ID NO: 3976701 - DNA, 12 bp, Homo sapiens
aaattccattat

SEQ ID NO: 3976702 - DNA, 14 bp, Homo sapiens
aaattccattatct

SEQ ID NO: 3976703 - DNA, 15 bp, Homo sapiens
aaattctacaacaca

SEQ ID NO: 3976704 - DNA, 23 bp, Homo sapiens
aaattctataggaacatatgaaa

SEQ ID NO: 3976705 - DNA, 20 bp, Homo sapiens
aaattctgagacatgtgtca

SEQ ID NO: 3976706 - DNA, 15 bp, Homo sapiens
aaattctgattcttc

SEQ ID NO: 3976707 - DNA, 17 bp, Homo sapiens
aaattctgattcttcta

SEQ ID NO: 3976708 - DNA, 16 bp, Homo sapiens
aaattctgtgccttgt

SEQ ID NO: 3976709 - DNA, 10 bp, Homo sapiens
aaattctgtt

SEQ ID NO: 3976710 - DNA, 20 bp, Homo sapiens
aaattgaatgtggctgaagt

SEQ ID NO: 3976711 - DNA, 23 bp, Homo sapiens
aaattgactgatgattttccttt

SEQ ID NO: 3976712 - DNA, 20 bp, Homo sapiens
aaattgataatgctttcaca

SEQ ID NO: 3976713 - DNA, 19 bp, Homo sapiens
aaattgcaaatcttgaaat

SEQ ID NO: 3976714 - DNA, 13 bp, Homo sapiens
aaattgcactaaa

SEQ ID NO: 3976715 - DNA, 14 bp, Homo sapiens
aaattgcactaaat

SEQ ID NO: 3976716 - DNA, 13 bp, Homo sapiens
aaattgctatgtt

SEQ ID NO: 3976717 - DNA, 16 bp, Homo sapiens
aaattggaacagaatg

SEQ ID NO: 3976718 - DNA, 22 bp, Homo sapiens
aaattgggacaacagtgctttg

SEQ ID NO: 3976719 - DNA, 18 bp, Homo sapiens
aaattgtcacctctgtta

SEQ ID NO: 3976720 - DNA, 15 bp, Homo sapiens
aaattgtcattattt

SEQ ID NO: 3976721 - DNA, 21 bp, Homo sapiens
aaattgtcttttgtcatgtgg

SEQ ID NO: 3976722 - DNA, 22 bp, Homo sapiens
aaattgtttaagtgttgtaaat

SEQ ID NO: 3976723 - DNA, 11 bp, Homo sapiens
aaattgtttca

SEQ ID NO: 3976724 - DNA, 17 bp, Homo sapiens
aaattgtttcatatctg

SEQ ID NO: 3976725 - DNA, 23 bp, Homo sapiens
aaattgtttcatatctggtcaag

SEQ ID NO: 3976726 - DNA, 23 bp, Homo sapiens
aaatttaaagggtgtacttatat

SEQ ID NO: 3976727 - DNA, 13 bp, Homo sapiens
aaatttaagcatt

SEQ ID NO: 3976728 - DNA, 17 bp, Homo sapiens
aaatttaagcattgttt

SEQ ID NO: 3976729 - DNA, 23 bp, Homo sapiens
aaatttaagtatcttttttcaaa

SEQ ID NO: 3976730 - DNA, 16 bp, Homo sapiens
aaatttactttacaca

SEQ ID NO: 3976731 - DNA, 20 bp, Homo sapiens
aaatttagccctttaaaacg

SEQ ID NO: 3976732 - DNA, 14 bp, Homo sapiens
aaatttccatatcc

SEQ ID NO: 3976733 - DNA, 14 bp, Homo sapiens
aaatttcttatgtg

SEQ ID NO: 3976734 - DNA, 20 bp, Homo sapiens
aaatttcttatgtgacatta

SEQ ID NO: 3976735 - DNA, 14 bp, Homo sapiens
aaatttgagactat

SEQ ID NO: 3976736 - DNA, 14 bp, Homo sapiens
aaatttgattgatt

SEQ ID NO: 3976737 - DNA, 17 bp, Homo sapiens
aaatttgattgatttga

SEQ ID NO: 3976738 - DNA, 21 bp, Homo sapiens
aacagatgatgagaatttcta

SEQ ID NO: 3976739 - DNA, 20 bp, Homo sapiens
aacagattcaggccagccca

SEQ ID NO: 3976740 - DNA, 21 bp, Homo sapiens
aacagattcaggccagcccag

SEQ ID NO: 3976741 - DNA, 21 bp, Homo sapiens
aacagcagggtagtctggttt

SEQ ID NO: 3976742 - DNA, 11 bp, Homo sapiens
aacagcagtgt

SEQ ID NO: 3976743 - DNA, 24 bp, Homo sapiens
aacagcagtgttctcacagtgtgg

SEQ ID NO: 3976744 - DNA, 22 bp, Homo sapiens
aacagcatgtacggattttcag

SEQ ID NO: 3976745 - DNA, 12 bp, Homo sapiens
aacagcattgct

SEQ ID NO: 3976746 - DNA, 16 bp, Homo sapiens
aacagcattgctttct

SEQ ID NO: 3976747 - DNA, 17 bp, Homo sapiens
aacagcattgctttctg

SEQ ID NO: 3976748 - DNA, 19 bp, Homo sapiens
aacagccaactagcccctg

SEQ ID NO: 3976749 - DNA, 12 bp, Homo sapiens
aacagccagcaa

SEQ ID NO: 3976750 - DNA, 11 bp, Homo sapiens
aacagccatgc

SEQ ID NO: 3976751 - DNA, 22 bp, Homo sapiens
aacagccatgtccaagttcttc

SEQ ID NO: 3976752 - DNA, 22 bp, Homo sapiens
aacagccattgcggccccagga

SEQ ID NO: 3976753 - DNA, 23 bp, Homo sapiens
aacagccattgcggccccaggag

SEQ ID NO: 3976754 - DNA, 22 bp, Homo sapiens
aacagccttagctgccagtgct

SEQ ID NO: 3976755 - DNA, 20 bp, Homo sapiens
aacagcgggagacctgtgct

SEQ ID NO: 3976756 - DNA, 18 bp, Homo sapiens
aacagctgcattagaaaa

SEQ ID NO: 3976757 - DNA, 16 bp, Homo sapiens
aacagcttcaggttat

SEQ ID NO: 3976758 - DNA, 20 bp, Homo sapiens
aacagcttcatgcctttgta

SEQ ID NO: 3976759 - DNA, 22 bp, Homo sapiens
aacagcttcatgcctttgtaag

SEQ ID NO: 3976760 - DNA, 20 bp, Homo sapiens
aacaggaccacaaaaatgaa

SEQ ID NO: 3976761 - DNA, 20 bp, Homo sapiens
aacaggctcaatattcctga

SEQ ID NO: 3976762 - DNA, 14 bp, Homo sapiens
aacaggtattttgt

SEQ ID NO: 3976763 - DNA, 21 bp, Homo sapiens
aacaggtattttgtttctttt

SEQ ID NO: 3976764 - DNA, 22 bp, Homo sapiens
aacaggttcttaaaaaggaaca

SEQ ID NO: 3976765 - DNA, 16 bp, Homo sapiens
aacagtatttattttg

SEQ ID NO: 3976766 - DNA, 17 bp, Homo sapiens
aacagtatttattttgt

SEQ ID NO: 3976767 - DNA, 18 bp, Homo sapiens
aacagtatttattttgta

SEQ ID NO: 3976768 - DNA, 20 bp, Homo sapiens
aacagtatttattttgtaat

SEQ ID NO: 3976769 - DNA, 22 bp, Homo sapiens
aacagtatttcattgcctgtgt

SEQ ID NO: 3976770 - DNA, 17 bp, Homo sapiens
aacagtcaaaacagaga

SEQ ID NO: 3976771 - DNA, 14 bp, Homo sapiens
aacagtcatttaaa

SEQ ID NO: 3976772 - DNA, 23 bp, Homo sapiens
aacagtgcacctgggacagggag

SEQ ID NO: 3976773 - DNA, 20 bp, Homo sapiens
aacagtgggagccctgacct

SEQ ID NO: 3976774 - DNA, 22 bp, Homo sapiens
aacagtgggagccctgaccttg

SEQ ID NO: 3976775 - DNA, 22 bp, Homo sapiens
aacagtgtggtttgggaaagat

SEQ ID NO: 3976776 - DNA, 19 bp, Homo sapiens
aacagtgtttcccataatt

SEQ ID NO: 3976777 - DNA, 20 bp, Homo sapiens
aacagttaactttcagaaga

SEQ ID NO: 3976778 - DNA, 19 bp, Homo sapiens
aacagttttccatgaaaac

SEQ ID NO: 3976779 - DNA, 13 bp, Homo sapiens
aacataaaaagca

SEQ ID NO: 3976780 - DNA, 19 bp, Homo sapiens
aacataaaaaggacatcag

SEQ ID NO: 3976781 - DNA, 12 bp, Homo sapiens
aacataaaacaa

SEQ ID NO: 3976782 - DNA, 20 bp, Homo sapiens
aacataataaatcacacatt

SEQ ID NO: 3976783 - DNA, 19 bp, Homo sapiens
aacatacacgttaactgca

SEQ ID NO: 3976784 - DNA, 20 bp, Homo sapiens
aacatacttcaaaaataatg

SEQ ID NO: 3976785 - DNA, 21 bp, Homo sapiens
aacatacttcaaaaataatgt

SEQ ID NO: 3976786 - DNA, 17 bp, Homo sapiens
aacatagcccctgcccc

SEQ ID NO: 3976787 - DNA, 12 bp, Homo sapiens
aacatatgattt

SEQ ID NO: 3976788 - DNA, 12 bp, Homo sapiens
aacatcaatgtt

SEQ ID NO: 3976789 - DNA, 18 bp, Homo sapiens
aacatcaatgttcattgt

SEQ ID NO: 3976790 - DNA, 13 bp, Homo sapiens
aacatcacacaca

SEQ ID NO: 3976791 - DNA, 17 bp, Homo sapiens
aacatccaaccttccca

SEQ ID NO: 3976792 - DNA, 14 bp, Homo sapiens
aacatcctgccagc

SEQ ID NO: 3976793 - DNA, 19 bp, Homo sapiens
aacatccttcaagaactct

SEQ ID NO: 3976794 - DNA, 21 bp, Homo sapiens
aacatcctttgcagggcagcc

SEQ ID NO: 3976795 - DNA, 16 bp, Homo sapiens
aacatcgatatgtata

SEQ ID NO: 3976796 - DNA, 22 bp, Homo sapiens
aacatgaacacccttagaaaat

SEQ ID NO: 3976797 - DNA, 20 bp, Homo sapiens
aacatgcagttcattatttt

SEQ ID NO: 3976798 - DNA, 22 bp, Homo sapiens
aacatgcctgccccaaacaaat

SEQ ID NO: 3976799 - DNA, 15 bp, Homo sapiens
aacatggacttgtat

SEQ ID NO: 3976800 - DNA, 18 bp, Homo sapiens
aacatggacttgtatatt

SEQ ID NO: 3976801 - DNA, 19 bp, Homo sapiens
aacatggacttgtatattt

SEQ ID NO: 3976802 - DNA, 21 bp, Homo sapiens
aacatgggagcttattgctaa

SEQ ID NO: 3976803 - DNA, 20 bp, Homo sapiens
aacatggttacaatcattgc

SEQ ID NO: 3976804 - DNA, 20 bp, Homo sapiens
aacatgtaaccggcatgttt

SEQ ID NO: 3976805 - DNA, 11 bp, Homo sapiens
aacatgtatgt

SEQ ID NO: 3976806 - DNA, 17 bp, Homo sapiens
aacatgttactgaccag

SEQ ID NO: 3976807 - DNA, 14 bp, Homo sapiens
aacatgttctccat

SEQ ID NO: 3976808 - DNA, 16 bp, Homo sapiens
aacatgtttaatgggt

SEQ ID NO: 3976809 - DNA, 20 bp, Homo sapiens
aacatgtttacttttcaggg

SEQ ID NO: 3976810 - DNA, 22 bp, Homo sapiens
aacatgtttctgccttctttat

SEQ ID NO: 3976811 - DNA, 17 bp, Homo sapiens
aacattaaggaatttga

SEQ ID NO: 3976812 - DNA, 20 bp, Homo sapiens
aacattaatagcagcctttc

SEQ ID NO: 3976813 - DNA, 17 bp, Homo sapiens
aacattacagttcataa

SEQ ID NO: 3976814 - DNA, 16 bp, Homo sapiens
aacattaccttactgt

SEQ ID NO: 3976815 - DNA, 17 bp, Homo sapiens
aacattaccttactgtg

SEQ ID NO: 3976816 - DNA, 19 bp, Homo sapiens
aacattaccttactgtgga

SEQ ID NO: 3976817 - DNA, 18 bp, Homo sapiens
aacattcgtgagctgggg

SEQ ID NO: 3976818 - DNA, 19 bp, Homo sapiens
aacattgaagtaatgaatt

SEQ ID NO: 3976819 - DNA, 18 bp, Homo sapiens
aacattgaccaagaactg

SEQ ID NO: 3976820 - DNA, 19 bp, Homo sapiens
aacattgaccaagaactgc

SEQ ID NO: 3976821 - DNA, 20 bp, Homo sapiens
aacattgaccaagaactgca

SEQ ID NO: 3976822 - DNA, 15 bp, Homo sapiens
aacattggaatgttc

SEQ ID NO: 3976823 - DNA, 16 bp, Homo sapiens
aacattggaatgttct

SEQ ID NO: 3976824 - DNA, 21 bp, Homo sapiens
aacattggaatgttctcagat

SEQ ID NO: 3976825 - DNA, 15 bp, Homo sapiens
aacatttgctgtttt

SEQ ID NO: 3976826 - DNA, 15 bp, Homo sapiens
aacatttgttcctgg

SEQ ID NO: 3976827 - DNA, 17 bp, Homo sapiens
aacatttgttcctggag

SEQ ID NO: 3976828 - DNA, 14 bp, Homo sapiens
aacattttaattca

SEQ ID NO: 3976829 - DNA, 15 bp, Homo sapiens
aacattttgaagtgt

SEQ ID NO: 3976830 - DNA, 16 bp, Homo sapiens
aacattttgtcatata

SEQ ID NO: 3976831 - DNA, 20 bp, Homo sapiens
aacatttttaatttaacaaa

SEQ ID NO: 3976832 - DNA, 21 bp, Homo sapiens
aaccaaaagaacaagaatttc

SEQ ID NO: 3976833 - DNA, 18 bp, Homo sapiens
aaccaagtttattcagta

SEQ ID NO: 3976834 - DNA, 18 bp, Homo sapiens
aaccaatcccgtgaaaga

SEQ ID NO: 3976835 - DNA, 21 bp, Homo sapiens
aaccaatggtgatcctctatt

SEQ ID NO: 3976836 - DNA, 19 bp, Homo sapiens
aaccacaaggtccactccc

SEQ ID NO: 3976837 - DNA, 19 bp, Homo sapiens
aaccacgtggagaaaatca

SEQ ID NO: 3976838 - DNA, 20 bp, Homo sapiens
aaccacgtggagaaaatcaa

SEQ ID NO: 3976839 - DNA, 15 bp, Homo sapiens
aagctgagaagaatg

SEQ ID NO: 3976840 - DNA, 21 bp, Homo sapiens
aagataagtgtatttttcaat

SEQ ID NO: 3976841 - DNA, 14 bp, Homo sapiens
aagatacgacttta

SEQ ID NO: 3976842 - DNA, 21 bp, Homo sapiens
aagatacgactttattttctg

SEQ ID NO: 3976843 - DNA, 21 bp, Homo sapiens
aagataggggcacactacaga

SEQ ID NO: 3976844 - DNA, 21 bp, Homo sapiens
aagatatatacacaggatcct

SEQ ID NO: 3976845 - DNA, 15 bp, Homo sapiens
aagatatccatcttt

SEQ ID NO: 3976846 - DNA, 13 bp, Homo sapiens
aagatattgtaca

SEQ ID NO: 3976847 - DNA, 16 bp, Homo sapiens
aagatattgtacataa

SEQ ID NO: 3976848 - DNA, 21 bp, Homo sapiens
aagcatgatgggaaaatattt

SEQ ID NO: 3976849 - DNA, 23 bp, Homo sapiens
aagcatgtggtcttatagtgttt

SEQ ID NO: 3976850 - DNA, 19 bp, Homo sapiens
aagcattaccactcaggca

SEQ ID NO: 3976851 - DNA, 15 bp, Homo sapiens
aagcattcagagagc

SEQ ID NO: 3976852 - DNA, 13 bp, Homo sapiens
aagcattccttct

SEQ ID NO: 3976853 - DNA, 16 bp, Homo sapiens
aagcattccttctttg

SEQ ID NO: 3976854 - DNA, 20 bp, Homo sapiens
aagcattccttctttgataa

SEQ ID NO: 3976855 - DNA, 21 bp, Homo sapiens
aagcattccttctttgataat

SEQ ID NO: 3976856 - DNA, 14 bp, Homo sapiens
aagcattctcccca

SEQ ID NO: 3976857 - DNA, 23 bp, Homo sapiens
aagcattctccccagtgtatgtc

SEQ ID NO: 3976858 - DNA, 22 bp, Homo sapiens
aagcattgtttgcttattgttc

SEQ ID NO: 3976859 - DNA, 12 bp, Homo sapiens
aagcatttataa

SEQ ID NO: 3976860 - DNA, 19 bp, Homo sapiens
aagcatttatcattcttgt

SEQ ID NO: 3976861 - DNA, 18 bp, Homo sapiens
aagcatttttcaatatat

SEQ ID NO: 3976862 - DNA, 12 bp, Homo sapiens
aagccaaagagt

SEQ ID NO: 3976863 - DNA, 13 bp, Homo sapiens
aagccaaatttat

SEQ ID NO: 3976864 - DNA, 16 bp, Homo sapiens
aagccaacaccctgtc

SEQ ID NO: 3976865 - DNA, 17 bp, Homo sapiens
aagccaacagtcaaaac

SEQ ID NO: 3976866 - DNA, 17 bp, Homo sapiens
aagccaacttgtaaata

SEQ ID NO: 3976867 - DNA, 13 bp, Homo sapiens
aagccaagtgggg

SEQ ID NO: 3976868 - DNA, 17 bp, Homo sapiens
aagccaattcagacagg

SEQ ID NO: 3976869 - DNA, 21 bp, Homo sapiens
aagccacaaggctggccagca

SEQ ID NO: 3976870 - DNA, 21 bp, Homo sapiens
aagccacaggaaggaggggag

SEQ ID NO: 3976871 - DNA, 14 bp, Homo sapiens
aagccaccagatgt

SEQ ID NO: 3976872 - DNA, 17 bp, Homo sapiens
aagccacctctccctca

SEQ ID NO: 3976873 - DNA, 16 bp, Homo sapiens
aagccacgctgtcctc

SEQ ID NO: 3976874 - DNA, 15 bp, Homo sapiens
aagccactagactct

SEQ ID NO: 3976875 - DNA, 18 bp, Homo sapiens
aagccacttgaaatgtta

SEQ ID NO: 3976876 - DNA, 19 bp, Homo sapiens
aagccagcctgaccttcct

SEQ ID NO: 3976877 - DNA, 17 bp, Homo sapiens
aagccagctggctttgc

SEQ ID NO: 3976878 - DNA, 20 bp, Homo sapiens
aagccaggaatttcccagga

SEQ ID NO: 3976879 - DNA, 21 bp, Homo sapiens
aagccaggaatttcccaggac

SEQ ID NO: 3976880 - DNA, 22 bp, Homo sapiens
aagccaggaatttcccaggacc

SEQ ID NO: 3976881 - DNA, 24 bp, Homo sapiens
aagccaggaatttcccaggaccct

SEQ ID NO: 3976882 - DNA, 15 bp, Homo sapiens
aagccaggcctggct

SEQ ID NO: 3976883 - DNA, 22 bp, Homo sapiens
aagccaggcctggctggaggag

SEQ ID NO: 3976884 - DNA, 20 bp, Homo sapiens
aagccagggtctctccctca

SEQ ID NO: 3976885 - DNA, 21 bp, Homo sapiens
aagccagggtctctccctcag

SEQ ID NO: 3976886 - DNA, 23 bp, Homo sapiens
aagccagggtctctccctcaggt

SEQ ID NO: 3976887 - DNA, 19 bp, Homo sapiens
aagccaggtgagctctgac

SEQ ID NO: 3976888 - DNA, 23 bp, Homo sapiens
aagccatagaccctgaggccctg

SEQ ID NO: 3976889 - DNA, 18 bp, Homo sapiens
aagccataggcccaggat

SEQ ID NO: 3976890 - DNA, 18 bp, Homo sapiens
aagccatgtataaatgtg

SEQ ID NO: 3976891 - DNA, 17 bp, Homo sapiens
aagccattgaccaccca

SEQ ID NO: 3976892 - DNA, 16 bp, Homo sapiens
aagccattttctgtta

SEQ ID NO: 3976893 - DNA, 19 bp, Homo sapiens
aagcccagcccctactgct

SEQ ID NO: 3976894 - DNA, 21 bp, Homo sapiens
aagcccaggtgccagcctgag

SEQ ID NO: 3976895 - DNA, 21 bp, Homo sapiens
aagcccattttcaactgcttt

SEQ ID NO: 3976896 - DNA, 16 bp, Homo sapiens
aagccccatttcctca

SEQ ID NO: 3976897 - DNA, 20 bp, Homo sapiens
aagcccccaccgtgggcagg

SEQ ID NO: 3976898 - DNA, 21 bp, Homo sapiens
aagcccccagctaagaacctg

SEQ ID NO: 3976899 - DNA, 18 bp, Homo sapiens
aagcccccagggcctcca

SEQ ID NO: 3976900 - DNA, 19 bp, Homo sapiens
aagcccccagggcctccag

SEQ ID NO: 3976901 - DNA, 19 bp, Homo sapiens
aagcccgttagccccaggg

SEQ ID NO: 3976902 - DNA, 20 bp, Homo sapiens
aagccctgtcgagacacttg

SEQ ID NO: 3976903 - DNA, 14 bp, Homo sapiens
aagccctttgccat

SEQ ID NO: 3976904 - DNA, 16 bp, Homo sapiens
aagccgactctggccc

SEQ ID NO: 3976905 - DNA, 21 bp, Homo sapiens
aagccggggtgtaacttcctg

SEQ ID NO: 3976906 - DNA, 19 bp, Homo sapiens
aagcctacctgctctccaa

SEQ ID NO: 3976907 - DNA, 20 bp, Homo sapiens
aagcctagaagagcttctga

SEQ ID NO: 3976908 - DNA, 20 bp, Homo sapiens
aagcctcatatttaaagaca

SEQ ID NO: 3976909 - DNA, 14 bp, Homo sapiens
aagcctctggctag

SEQ ID NO: 3976910 - DNA, 23 bp, Homo sapiens
aagcctctggctagaggccagcc

SEQ ID NO: 3976911 - DNA, 12 bp, Homo sapiens
aagcctctggga

SEQ ID NO: 3976912 - DNA, 13 bp, Homo sapiens
aagcctgcctccc

SEQ ID NO: 3976913 - DNA, 21 bp, Homo sapiens
aagcctgcgttggtccagagc

SEQ ID NO: 3976914 - DNA, 18 bp, Homo sapiens
aagcctggactctgcccc

SEQ ID NO: 3976915 - DNA, 18 bp, Homo sapiens
aagcctggtttttctcaa

SEQ ID NO: 3976916 - DNA, 11 bp, Homo sapiens
aagcctgtgcc

SEQ ID NO: 3976917 - DNA, 16 bp, Homo sapiens
aagcctgttcccctca

SEQ ID NO: 3976918 - DNA, 20 bp, Homo sapiens
aagcctgttcccctcactgg

SEQ ID NO: 3976919 - DNA, 17 bp, Homo sapiens
aagccttaaactgtaca

SEQ ID NO: 3976920 - DNA, 22 bp, Homo sapiens
aagccttgtgtatatttgtata

SEQ ID NO: 3976921 - DNA, 20 bp, Homo sapiens
aagcggccctaagggagtgt

SEQ ID NO: 3976922 - DNA, 22 bp, Homo sapiens
aagcggctcaagcccaggaggg

SEQ ID NO: 3976923 - DNA, 21 bp, Homo sapiens
aagctaaatcctttactgtta

SEQ ID NO: 3976924 - DNA, 22 bp, Homo sapiens
aagctactgtgtgtgtgaatga

SEQ ID NO: 3976925 - DNA, 21 bp, Homo sapiens
aagctagacagatccccgttc

SEQ ID NO: 3976926 - DNA, 15 bp, Homo sapiens
aagctagggtggccc

SEQ ID NO: 3976927 - DNA, 18 bp, Homo sapiens
aagctagtggcttcaaaa

SEQ ID NO: 3976928 - DNA, 20 bp, Homo sapiens
aagctagtgtacctcctctc

SEQ ID NO: 3976929 - DNA, 12 bp, Homo sapiens
aagctagtgttt

SEQ ID NO: 3976930 - DNA, 20 bp, Homo sapiens
aagctagtgtttctagctaa

SEQ ID NO: 3976931 - DNA, 18 bp, Homo sapiens
aagctcaaataaaaataa

SEQ ID NO: 3976932 - DNA, 16 bp, Homo sapiens
aagctcacaccaaatt

SEQ ID NO: 3976933 - DNA, 23 bp, Homo sapiens
aagctcagaggcgcactgtgacc

SEQ ID NO: 3976934 - DNA, 21 bp, Homo sapiens
aagctcatgcatttcaagcag

SEQ ID NO: 3976935 - DNA, 16 bp, Homo sapiens
aagctccactgtcacc

SEQ ID NO: 3976936 - DNA, 19 bp, Homo sapiens
aagctccactgtcaccctc

SEQ ID NO: 3976937 - DNA, 20 bp, Homo sapiens
aagctcctctccccagccca

SEQ ID NO: 3976938 - DNA, 22 bp, Homo sapiens
aagctcctctccccagcccaga

SEQ ID NO: 3976939 - DNA, 23 bp, Homo sapiens
aagctcctctccccagcccagag

SEQ ID NO: 3976940 - DNA, 15 bp, Homo sapiens
aagctcctgtcctcc

SEQ ID NO: 3976941 - DNA, 22 bp, Homo sapiens
aagctccttgagtaaaaaggtg

SEQ ID NO: 3976942 - DNA, 22 bp, Homo sapiens
aagctctgaagtcacatcacag

SEQ ID NO: 3976943 - DNA, 17 bp, Homo sapiens
aagctgagaactcctga

SEQ ID NO: 3976944 - DNA, 18 bp, Homo sapiens
aagctgagaactcctgac

SEQ ID NO: 3976945 - DNA, 15 bp, Homo sapiens
aactctccagtgcct

SEQ ID NO: 3976946 - DNA, 22 bp, Homo sapiens
aactctctccaccctatatgta

SEQ ID NO: 3976947 - DNA, 18 bp, Homo sapiens
aactctgagcccatactt

SEQ ID NO: 3976948 - DNA, 12 bp, Homo sapiens
aactctgcctgc

SEQ ID NO: 3976949 - DNA, 18 bp, Homo sapiens
aactctggtgctcctgca

SEQ ID NO: 3976950 - DNA, 12 bp, Homo sapiens
aactctggtggc

SEQ ID NO: 3976951 - DNA, 14 bp, Homo sapiens
aactctgttccccc

SEQ ID NO: 3976952 - DNA, 15 bp, Homo sapiens
aactcttatctcagt

SEQ ID NO: 3976953 - DNA, 12 bp, Homo sapiens
aactcttcctcc

SEQ ID NO: 3976954 - DNA, 17 bp, Homo sapiens
aactcttgattatccat

SEQ ID NO: 3976955 - DNA, 12 bp, Homo sapiens
aactgaaaagac

SEQ ID NO: 3976956 - DNA, 20 bp, Homo sapiens
aactgaaaagactcagtgtt

SEQ ID NO: 3976957 - DNA, 14 bp, Homo sapiens
aactgaaaatgtaa

SEQ ID NO: 3976958 - DNA, 16 bp, Homo sapiens
aactgaaacatgctta

SEQ ID NO: 3976959 - DNA, 15 bp, Homo sapiens
aactgaacttcagag

SEQ ID NO: 3976960 - DNA, 19 bp, Homo sapiens
aactgaagcataaagaatt

SEQ ID NO: 3976961 - DNA, 16 bp, Homo sapiens
aactgaagtttcacat

SEQ ID NO: 3976962 - DNA, 14 bp, Homo sapiens
aactgaatattttg

SEQ ID NO: 3976963 - DNA, 15 bp, Homo sapiens
aaagaagtttgatat

SEQ ID NO: 3976964 - DNA, 17 bp, Homo sapiens
aaagaatatatttattt

SEQ ID NO: 3976965 - DNA, 13 bp, Homo sapiens
aaagaatgactat

SEQ ID NO: 3976966 - DNA, 20 bp, Homo sapiens
aaagaattatttttgtgttt

SEQ ID NO: 3976967 - DNA, 22 bp, Homo sapiens
aaagaattatttttgtgtttct

SEQ ID NO: 3976968 - DNA, 19 bp, Homo sapiens
aaagaattcttatacacat

SEQ ID NO: 3976969 - DNA, 18 bp, Homo sapiens
aaagacaaaagtctgtct

SEQ ID NO: 3976970 - DNA, 22 bp, Homo sapiens
aaagacaaattcggatgtatga

SEQ ID NO: 3976971 - DNA, 13 bp, Homo sapiens
aaagacacctact

SEQ ID NO: 3976972 - DNA, 15 bp, Homo sapiens
aaagacactggcaga

SEQ ID NO: 3976973 - DNA, 13 bp, Homo sapiens
aaagacagaatgg

SEQ ID NO: 3976974 - DNA, 19 bp, Homo sapiens
aaagacagaatggtggagt

SEQ ID NO: 3976975 - DNA, 21 bp, Homo sapiens
aaagacagaatggtggagtgt

SEQ ID NO: 3976976 - DNA, 15 bp, Homo sapiens
aaagacgatgtttat

SEQ ID NO: 3976977 - DNA, 16 bp, Homo sapiens
aaagacgatgtttatg

SEQ ID NO: 3976978 - DNA, 18 bp, Homo sapiens
aaagactcagccaagaca

SEQ ID NO: 3976979 - DNA, 16 bp, Homo sapiens
aaagactggttttctg

SEQ ID NO: 3976980 - DNA, 17 bp, Homo sapiens
aaagactggttttctgc

SEQ ID NO: 3976981 - DNA, 13 bp, Homo sapiens
aaagactgtacaa

SEQ ID NO: 3976982 - DNA, 16 bp, Homo sapiens
aaagacttgagacaat

SEQ ID NO: 3976983 - DNA, 20 bp, Homo sapiens
aaagacttggttggtagggt

SEQ ID NO: 3976984 - DNA, 13 bp, Homo sapiens
aaagagagaatgt

SEQ ID NO: 3976985 - DNA, 12 bp, Homo sapiens
aaagagatattt

SEQ ID NO: 3976986 - DNA, 14 bp, Homo sapiens
aaagagcagtcaga

SEQ ID NO: 3976987 - DNA, 12 bp, Homo sapiens
aaagaggctgag

SEQ ID NO: 3976988 - DNA, 20 bp, Homo sapiens
aaagaggctgaggcctggac

SEQ ID NO: 3976989 - DNA, 15 bp, Homo sapiens
aaagagggcttcctc

SEQ ID NO: 3976990 - DNA, 19 bp, Homo sapiens
aaagagggcttcctctaga

SEQ ID NO: 3976991 - DNA, 13 bp, Homo sapiens
aaagagttaagaa

SEQ ID NO: 3976992 - DNA, 16 bp, Homo sapiens
aaagagttcttaagga

SEQ ID NO: 3976993 - DNA, 22 bp, Homo sapiens
aaagataacaagatctttcagg

SEQ ID NO: 3976994 - DNA, 17 bp, Homo sapiens
aaagatatatacacagg

SEQ ID NO: 3976995 - DNA, 15 bp, Homo sapiens
aaagatattgttcaa

SEQ ID NO: 3976996 - DNA, 20 bp, Homo sapiens
aaagatcaaaataaaaagtg

SEQ ID NO: 3976997 - DNA, 20 bp, Homo sapiens
aaagatctgtcctcagcctt

SEQ ID NO: 3976998 - DNA, 23 bp, Homo sapiens
aaagatgaactctgaactttgga

SEQ ID NO: 3976999 - DNA, 20 bp, Homo sapiens
aaagatgcaaggaccaggac

SEQ ID NO: 3977000 - DNA, 21 bp, Homo sapiens
aaagatgccaattattgttac

SEQ ID NO: 3977001 - DNA, 17 bp, Homo sapiens
aaagatgccccattcct

SEQ ID NO: 3977002 - DNA, 22 bp, Homo sapiens
aaagatgccccattccttgcgc

SEQ ID NO: 3977003 - DNA, 23 bp, Homo sapiens
aaagatggtgtgggtgtcctgcc

SEQ ID NO: 3977004 - DNA, 21 bp, Homo sapiens
aaagatgtttgtcagatatga

SEQ ID NO: 3977005 - DNA, 18 bp, Homo sapiens
aaagattagcaaggtcat

SEQ ID NO: 3977006 - DNA, 17 bp, Homo sapiens
aaagattgctgaaaaag

SEQ ID NO: 3977007 - DNA, 17 bp, Homo sapiens
aaagatttaagcacaaa

SEQ ID NO: 3977008 - DNA, 12 bp, Homo sapiens
aaagattttatt

SEQ ID NO: 3977009 - DNA, 15 bp, Homo sapiens
aaagattttattgta

SEQ ID NO: 3977010 - DNA, 13 bp, Homo sapiens
aaagcaaagaaaa

SEQ ID NO: 3977011 - DNA, 17 bp, Homo sapiens
aaagcaagggagaaaag

SEQ ID NO: 3977012 - DNA, 23 bp, Homo sapiens
aaagcaagggagaaaagagaaac

SEQ ID NO: 3977013 - DNA, 19 bp, Homo sapiens
aaagcaatctgattcagca

SEQ ID NO: 3977014 - DNA, 22 bp, Homo sapiens
aaagcaatctgattcagcatca

SEQ ID NO: 3977015 - DNA, 19 bp, Homo sapiens
aaagcacgaaatgttattt

SEQ ID NO: 3977016 - DNA, 17 bp, Homo sapiens
aaagcacgtgcaaggac

SEQ ID NO: 3977017 - DNA, 14 bp, Homo sapiens
aaagcacttttgtt

SEQ ID NO: 3977018 - DNA, 14 bp, Homo sapiens
aaagcagaatttta

SEQ ID NO: 3977019 - DNA, 20 bp, Homo sapiens
aaagcagcattctggagggg

SEQ ID NO: 3977020 - DNA, 15 bp, Homo sapiens
aaagcagccacgagg

SEQ ID NO: 3977021 - DNA, 17 bp, Homo sapiens
aaagcagggaatttcta

SEQ ID NO: 3977022 - DNA, 23 bp, Homo sapiens
aaagcagttaactttaagactga

SEQ ID NO: 3977023 - DNA, 18 bp, Homo sapiens
aaagcataaaaacatttt

SEQ ID NO: 3977024 - DNA, 13 bp, Homo sapiens
aaagcatgaatgg

SEQ ID NO: 3977025 - DNA, 14 bp, Homo sapiens
aaagcatgaatggt

SEQ ID NO: 3977026 - DNA, 21 bp, Homo sapiens
aaagcatgatgggaaaatatt

SEQ ID NO: 3977027 - DNA, 13 bp, Homo sapiens
aaagcatgtctca

SEQ ID NO: 3977028 - DNA, 18 bp, Homo sapiens
aaagccacattatttcta

SEQ ID NO: 3977029 - DNA, 17 bp, Homo sapiens
aaagccacctctccctc

SEQ ID NO: 3977030 - DNA, 18 bp, Homo sapiens
aaagccacctctgtcatt

SEQ ID NO: 3977031 - DNA, 19 bp, Homo sapiens
aaagccacctctgtcattt

SEQ ID NO: 3977032 - DNA, 13 bp, Homo sapiens
aaagccagggtct

SEQ ID NO: 3977033 - DNA, 19 bp, Homo sapiens
aaagccagggtctctccct

SEQ ID NO: 3977034 - DNA, 14 bp, Homo sapiens
aaaatgattttatc

SEQ ID NO: 3977035 - DNA, 14 bp, Homo sapiens
aaaatgcacgtagc

SEQ ID NO: 3977036 - DNA, 19 bp, Homo sapiens
aaaatgcctcaattcacat

SEQ ID NO: 3977037 - DNA, 23 bp, Homo sapiens
aaaatgcctttgagacagtttct

SEQ ID NO: 3977038 - DNA, 16 bp, Homo sapiens
aaaatggaaaaaaaca

SEQ ID NO: 3977039 - DNA, 20 bp, Homo sapiens
aaaatggaaaaaaacataaa

SEQ ID NO: 3977040 - DNA, 21 bp, Homo sapiens
aaaatggatattattagaaat

SEQ ID NO: 3977041 - DNA, 22 bp, Homo sapiens
aaaatggatattattagaaatt

SEQ ID NO: 3977042 - DNA, 15 bp, Homo sapiens
aaaatggtctctaac

SEQ ID NO: 3977043 - DNA, 22 bp, Homo sapiens
aaaatggttgatggaaaataaa

SEQ ID NO: 3977044 - DNA, 12 bp, Homo sapiens
aaaatgtaaatt

SEQ ID NO: 3977045 - DNA, 21 bp, Homo sapiens
aaaatgtagggttataataat

SEQ ID NO: 3977046 - DNA, 17 bp, Homo sapiens
aaaatgtcctgcctttt

SEQ ID NO: 3977047 - DNA, 21 bp, Homo sapiens
aaaatgtctgtagctcctcaa

SEQ ID NO: 3977048 - DNA, 12 bp, Homo sapiens
aaaatgtgaagt

SEQ ID NO: 3977049 - DNA, 16 bp, Homo sapiens
aaaatgtgtaattcaa

SEQ ID NO: 3977050 - DNA, 19 bp, Homo sapiens
aaaatgttggatttataaa

SEQ ID NO: 3977051 - DNA, 18 bp, Homo sapiens
aaaattaaacacaaagtg

SEQ ID NO: 3977052 - DNA, 16 bp, Homo sapiens
aaaattaagtagaaca

SEQ ID NO: 3977053 - DNA, 18 bp, Homo sapiens
aaaattaagtagaacaaa

SEQ ID NO: 3977054 - DNA, 17 bp, Homo sapiens
aaaattacaaaagagca

SEQ ID NO: 3977055 - DNA, 14 bp, Homo sapiens
aaaattacaactaa

SEQ ID NO: 3977056 - DNA, 17 bp, Homo sapiens
aaaattacgtttgttat

SEQ ID NO: 3977057 - DNA, 12 bp, Homo sapiens
aaaattactaat

SEQ ID NO: 3977058 - DNA, 16 bp, Homo sapiens
aaaattagacaaatgc

SEQ ID NO: 3977059 - DNA, 14 bp, Homo sapiens
aaaattagccaggc

SEQ ID NO: 3977060 - DNA, 19 bp, Homo sapiens
aaaattattgattgctttt

SEQ ID NO: 3977061 - DNA, 16 bp, Homo sapiens
aaaattcagagtcctt

SEQ ID NO: 3977062 - DNA, 21 bp, Homo sapiens
aaaattcagcaaaccattttt

SEQ ID NO: 3977063 - DNA, 17 bp, Homo sapiens
aaaattcagtttttgta

SEQ ID NO: 3977064 - DNA, 20 bp, Homo sapiens
aaaattcagtttttgtatct

SEQ ID NO: 3977065 - DNA, 16 bp, Homo sapiens
aaaattctagctgtat

SEQ ID NO: 3977066 - DNA, 20 bp, Homo sapiens
aaaattctcagtcagtaatt

SEQ ID NO: 3977067 - DNA, 14 bp, Homo sapiens
aaaattctgtgcct

SEQ ID NO: 3977068 - DNA, 21 bp, Homo sapiens
aaaattgatgtgtttatttat

SEQ ID NO: 3977069 - DNA, 16 bp, Homo sapiens
aaaattggcaaaacta

SEQ ID NO: 3977070 - DNA, 14 bp, Homo sapiens
aaaatttaaaatta

SEQ ID NO: 3977071 - DNA, 16 bp, Homo sapiens
aaaatttaagcattgt

SEQ ID NO: 3977072 - DNA, 19 bp, Homo sapiens
aaaatttaagtatcttttt

SEQ ID NO: 3977073 - DNA, 16 bp, Homo sapiens
aaaatttgaacactgg

SEQ ID NO: 3977074 - DNA, 13 bp, Homo sapiens
aaaatttgagact

SEQ ID NO: 3977075 - DNA, 19 bp, Homo sapiens
aaaatttgtttgaaatctt

SEQ ID NO: 3977076 - DNA, 12 bp, Homo sapiens
aaaattttactt

SEQ ID NO: 3977077 - DNA, 14 bp, Homo sapiens
aaaattttatagct

SEQ ID NO: 3977078 - DNA, 19 bp, Homo sapiens
aaaattttctcattttctt

SEQ ID NO: 3977079 - DNA, 16 bp, Homo sapiens
aaaattttgcttttaa

SEQ ID NO: 3977080 - DNA, 12 bp, Homo sapiens
aaacaaaaggca

SEQ ID NO: 3977081 - DNA, 20 bp, Homo sapiens
aaacaaaatttgtttgaaat

SEQ ID NO: 3977082 - DNA, 16 bp, Homo sapiens
aaacaaagtgactgtt

SEQ ID NO: 3977083 - DNA, 17 bp, Homo sapiens
aaacaaagttactaggt

SEQ ID NO: 3977084 - DNA, 17 bp, Homo sapiens
aaacaaatatgcaaaag

SEQ ID NO: 3977085 - DNA, 19 bp, Homo sapiens
aaacaaattcatattctgt

SEQ ID NO: 3977086 - DNA, 16 bp, Homo sapiens
aaacaacttgtacttg

SEQ ID NO: 3977087 - DNA, 12 bp, Homo sapiens
aaacaatatcat

SEQ ID NO: 3977088 - DNA, 23 bp, Homo sapiens
aaacaatgtggagtctccctctg

SEQ ID NO: 3977089 - DNA, 23 bp, Homo sapiens
aaacaattcatgcctttcatagt

SEQ ID NO: 3977090 - DNA, 14 bp, Homo sapiens
aaacacaatatttt

SEQ ID NO: 3977091 - DNA, 10 bp, Homo sapiens
aaacacacac

SEQ ID NO: 3977092 - DNA, 21 bp, Homo sapiens
aaacacacagatacacacaca

SEQ ID NO: 3977093 - DNA, 23 bp, Homo sapiens
aaacacagcttacaatcgcaaat

SEQ ID NO: 3977094 - DNA, 18 bp, Homo sapiens
aaacacaggctgtcctta

SEQ ID NO: 3977095 - DNA, 19 bp, Homo sapiens
aaacacagtcaaaataatt

SEQ ID NO: 3977096 - DNA, 21 bp, Homo sapiens
aaacacatgccttaaatttgt

SEQ ID NO: 3977097 - DNA, 23 bp, Homo sapiens
aaacacattcttattaattcttc

SEQ ID NO: 3977098 - DNA, 14 bp, Homo sapiens
aaacacattgaatg

SEQ ID NO: 3977099 - DNA, 13 bp, Homo sapiens
aaacacattgcct

SEQ ID NO: 3977100 - DNA, 12 bp, Homo sapiens
aaacacctgaca

SEQ ID NO: 3977101 - DNA, 13 bp, Homo sapiens
aaacacctgacac

SEQ ID NO: 3977102 - DNA, 17 bp, Homo sapiens
aaacacctgacacatct

SEQ ID NO: 3977103 - DNA, 13 bp, Homo sapiens
aaacactgcaaat

SEQ ID NO: 3977104 - DNA, 22 bp, Homo sapiens
aaacactgcaaattttaactgt

SEQ ID NO: 3977105 - DNA, 19 bp, Homo sapiens
aaacactgcagtttcctgg

SEQ ID NO: 3977106 - DNA, 22 bp, Homo sapiens
aaacactgcagtttcctggaaa

SEQ ID NO: 3977107 - DNA, 19 bp, Homo sapiens
aaacagaaaaacagacaaa

SEQ ID NO: 3977108 - DNA, 22 bp, Homo sapiens
aaacagaaatcaggtgttttaa

SEQ ID NO: 3977109 - DNA, 15 bp, Homo sapiens
aaacagaacagggtc

SEQ ID NO: 3977110 - DNA, 16 bp, Homo sapiens
aaacagacaaaacaat

SEQ ID NO: 3977111 - DNA, 20 bp, Homo sapiens
aaacagaggccatggcagaa

SEQ ID NO: 3977112 - DNA, 22 bp, Homo sapiens
aaacagagtggcctccctgctg

SEQ ID NO: 3977113 - DNA, 15 bp, Homo sapiens
aaacagatataaatg

SEQ ID NO: 3977114 - DNA, 18 bp, Homo sapiens
aaacagatgtgaatattc

SEQ ID NO: 3977115 - DNA, 14 bp, Homo sapiens
aaacagcagtgttc

SEQ ID NO: 3977116 - DNA, 14 bp, Homo sapiens
aaacagcattgctt

SEQ ID NO: 3977117 - DNA, 16 bp, Homo sapiens
aaacagcattgctttc

SEQ ID NO: 3977118 - DNA, 21 bp, Homo sapiens
aaacagcattgctttctgaaa

SEQ ID NO: 3977119 - DNA, 13 bp, Homo sapiens
aaacagccattgc

SEQ ID NO: 3977120 - DNA, 22 bp, Homo sapiens
aaacagccgtcagccaaatgta

SEQ ID NO: 3977121 - DNA, 23 bp, Homo sapiens
aaacagccgtcagccaaatgtaa

SEQ ID NO: 3977122 - DNA, 20 bp, Homo sapiens
aaacagcttcatgcctttgt

SEQ ID NO: 3977123 - DNA, 11 bp, Homo sapiens
aaacaggcagt

SEQ ID NO: 3977124 - DNA, 21 bp, Homo sapiens
aaacaggcagttggccagaga

SEQ ID NO: 3977125 - DNA, 20 bp, Homo sapiens
aaacagtaatctaggtgtgg

SEQ ID NO: 3977126 - DNA, 14 bp, Homo sapiens
aaacagtaatgact

SEQ ID NO: 3977127 - DNA, 20 bp, Homo sapiens
aaacagtaatgactctctga

SEQ ID NO: 3977128 - DNA, 23 bp, Homo sapiens
aaacagtagttgtattcttctgt

SEQ ID NO: 3977129 - DNA, 12 bp, Homo sapiens
aaacagtattta

SEQ ID NO: 3977130 - DNA, 14 bp, Homo sapiens
aaacagtatttatt

SEQ ID NO: 3977131 - DNA, 20 bp, Homo sapiens
aaacagtgggagccctgacc

SEQ ID NO: 3977132 - DNA, 22 bp, Homo sapiens
aaacagtttttattaaaacatg

SEQ ID NO: 3977133 - DNA, 22 bp, Homo sapiens
aaacataaaaagcagaatttta

SEQ ID NO: 3977134 - DNA, 14 bp, Homo sapiens
aaacataataaatc

SEQ ID NO: 3977135 - DNA, 16 bp, Homo sapiens
aaacatatacagaaaa

SEQ ID NO: 3977136 - DNA, 23 bp, Homo sapiens
aaacatgaggttctctctactgg

SEQ ID NO: 3977137 - DNA, 14 bp, Homo sapiens
aataaactactctt

SEQ ID NO: 3977138 - DNA, 16 bp, Homo sapiens
aataaactagagaagg

SEQ ID NO: 3977139 - DNA, 17 bp, Homo sapiens
aataaactgtgtttact

SEQ ID NO: 3977140 - DNA, 16 bp, Homo sapiens
aataaacttaacttta

SEQ ID NO: 3977141 - DNA, 20 bp, Homo sapiens
aataaagaagtatggtaatc

SEQ ID NO: 3977142 - DNA, 15 bp, Homo sapiens
aataaagcactgagc

SEQ ID NO: 3977143 - DNA, 22 bp, Homo sapiens
aataaaggactgtaatcttatt

SEQ ID NO: 3977144 - DNA, 14 bp, Homo sapiens
aataaagtatataa

SEQ ID NO: 3977145 - DNA, 15 bp, Homo sapiens
aataaagtatataat

SEQ ID NO: 3977146 - DNA, 20 bp, Homo sapiens
aataaagttacttgaatttc

SEQ ID NO: 3977147 - DNA, 19 bp, Homo sapiens
aataaagtttgcttagaaa

SEQ ID NO: 3977148 - DNA, 17 bp, Homo sapiens
aagtggcacctgtctgc

SEQ ID NO: 3977149 - DNA, 18 bp, Homo sapiens
aagtggcacctgtctgct

SEQ ID NO: 3977150 - DNA, 17 bp, Homo sapiens
aagtggcatgtgctgtg

SEQ ID NO: 3977151 - DNA, 18 bp, Homo sapiens
aagtggcatgtgctgtga

SEQ ID NO: 3977152 - DNA, 16 bp, Homo sapiens
aagtggcatgttttgt

SEQ ID NO: 3977153 - DNA, 22 bp, Homo sapiens
aagtggcatgttttgtgcattt

SEQ ID NO: 3977154 - DNA, 12 bp, Homo sapiens
aagtgggcttga

SEQ ID NO: 3977155 - DNA, 12 bp, Homo sapiens
aataaatactgc

SEQ ID NO: 3977156 - DNA, 22 bp, Homo sapiens
aataaatatcacagtattatct

SEQ ID NO: 3977157 - DNA, 13 bp, Homo sapiens
aataaatcacaca

SEQ ID NO: 3977158 - DNA, 14 bp, Homo sapiens
aataaatcacacat

SEQ ID NO: 3977159 - DNA, 15 bp, Homo sapiens
aataaatctgaccca

SEQ ID NO: 3977160 - DNA, 14 bp, Homo sapiens
aataaatgtacctg

SEQ ID NO: 3977161 - DNA, 20 bp, Homo sapiens
aataaatgtatcttattcac

SEQ ID NO: 3977162 - DNA, 19 bp, Homo sapiens
aataaatttaaacttacaa

SEQ ID NO: 3977163 - DNA, 19 bp, Homo sapiens
aataacactaaaattttag

SEQ ID NO: 3977164 - DNA, 20 bp, Homo sapiens
aataacagccgctccagagt

SEQ ID NO: 3977165 - DNA, 20 bp, Homo sapiens
aataacattaccttactgtg

SEQ ID NO: 3977166 - DNA, 16 bp, Homo sapiens
aataaccaagtttatt

SEQ ID NO: 3977167 - DNA, 21 bp, Homo sapiens
aataaccacaaggtccactcc

SEQ ID NO: 3977168 - DNA, 22 bp, Homo sapiens
aataaccacttaaaaaatgtcc

SEQ ID NO: 3977169 - DNA, 19 bp, Homo sapiens
aataaccttccatacattt

SEQ ID NO: 3977170 - DNA, 17 bp, Homo sapiens
aataactactgtgttcc

SEQ ID NO: 3977171 - DNA, 13 bp, Homo sapiens
aataacttctata

SEQ ID NO: 3977172 - DNA, 20 bp, Homo sapiens
aataacttctatattttaat

SEQ ID NO: 3977173 - DNA, 23 bp, Homo sapiens
aataacttctatattttaataga

SEQ ID NO: 3977174 - DNA, 21 bp, Homo sapiens
aataagaaatgaacaaaagat

SEQ ID NO: 3977175 - DNA, 13 bp, Homo sapiens
aataagagatttg

SEQ ID NO: 3977176 - DNA, 21 bp, Homo sapiens
aataaggcaggcattgaggaa

SEQ ID NO: 3977177 - DNA, 16 bp, Homo sapiens
aataagtatttataat

SEQ ID NO: 3977178 - DNA, 22 bp, Homo sapiens
aataagtgtgtggtagaaacaa

SEQ ID NO: 3977179 - DNA, 14 bp, Homo sapiens
aataagtttgaacc

SEQ ID NO: 3977180 - DNA, 16 bp, Homo sapiens
aataataaatgccctc

SEQ ID NO: 3977181 - DNA, 18 bp, Homo sapiens
aataatagttattattta

SEQ ID NO: 3977182 - DNA, 19 bp, Homo sapiens
aataatatggctatgctta

SEQ ID NO: 3977183 - DNA, 14 bp, Homo sapiens
aataatattgttgt

SEQ ID NO: 3977184 - DNA, 15 bp, Homo sapiens
aataatcaagatttt

SEQ ID NO: 3977185 - DNA, 18 bp, Homo sapiens
aataatcaagattttagg

SEQ ID NO: 3977186 - DNA, 20 bp, Homo sapiens
aataatcatgtgaaatgttt

SEQ ID NO: 3977187 - DNA, 14 bp, Homo sapiens
aataatccagtatt

SEQ ID NO: 3977188 - DNA, 16 bp, Homo sapiens
aataatccagtattgc

SEQ ID NO: 3977189 - DNA, 19 bp, Homo sapiens
aataatcttattagggaga

SEQ ID NO: 3977190 - DNA, 19 bp, Homo sapiens
aataatgaataaactgaat

SEQ ID NO: 3977191 - DNA, 16 bp, Homo sapiens
aataatggaaacatta

SEQ ID NO: 3977192 - DNA, 18 bp, Homo sapiens
aataatgggtttctttca

SEQ ID NO: 3977193 - DNA, 19 bp, Homo sapiens
aataatgtagttttgttta

SEQ ID NO: 3977194 - DNA, 18 bp, Homo sapiens
aataattatccagagttt

SEQ ID NO: 3977195 - DNA, 22 bp, Homo sapiens
aataatttcccaattaggaagt

SEQ ID NO: 3977196 - DNA, 13 bp, Homo sapiens
aataatttgtaaa

SEQ ID NO: 3977197 - DNA, 22 bp, Homo sapiens
aataatttgtaaatgattttaa

SEQ ID NO: 3977198 - DNA, 21 bp, Homo sapiens
aataattttaagaaatcaaag

SEQ ID NO: 3977199 - DNA, 17 bp, Homo sapiens
aataattttaatattct

SEQ ID NO: 3977200 - DNA, 23 bp, Homo sapiens
aataattttaatattcttttgtt

SEQ ID NO: 3977201 - DNA, 13 bp, Homo sapiens
aatacaaaacttc

SEQ ID NO: 3977202 - DNA, 14 bp, Homo sapiens
aatacaaagtaaat

SEQ ID NO: 3977203 - DNA, 17 bp, Homo sapiens
aatacaaatagattttt

SEQ ID NO: 3977204 - DNA, 19 bp, Homo sapiens
aatacaaatctgtataaat

SEQ ID NO: 3977205 - DNA, 22 bp, Homo sapiens
aatacaaatctgtataaatgtc

SEQ ID NO: 3977206 - DNA, 13 bp, Homo sapiens
aatacaaatggat

SEQ ID NO: 3977207 - DNA, 18 bp, Homo sapiens
aatacaacttaaataata

SEQ ID NO: 3977208 - DNA, 11 bp, Homo sapiens
aatacaataaa

SEQ ID NO: 3977209 - DNA, 13 bp, Homo sapiens
aatacaataaact

SEQ ID NO: 3977210 - DNA, 19 bp, Homo sapiens
aatacaatcctgtttataa

SEQ ID NO: 3977211 - DNA, 16 bp, Homo sapiens
aatacaattaaaggtc

SEQ ID NO: 3977212 - DNA, 22 bp, Homo sapiens
aatacaattaaaggtcctgccc

SEQ ID NO: 3977213 - DNA, 15 bp, Homo sapiens
aatacacaagtaaac

SEQ ID NO: 3977214 - DNA, 17 bp, Homo sapiens
aatacactagttgtttc

SEQ ID NO: 3977215 - DNA, 12 bp, Homo sapiens
aatacagataac

SEQ ID NO: 3977216 - DNA, 23 bp, Homo sapiens
aatacagggcatgcattttgcag

SEQ ID NO: 3977217 - DNA, 13 bp, Homo sapiens
aatacatgcatct

SEQ ID NO: 3977218 - DNA, 17 bp, Homo sapiens
aatacatttaaaactta

SEQ ID NO: 3977219 - DNA, 21 bp, Homo sapiens
aatacccttgtgagagcccat

SEQ ID NO: 3977220 - DNA, 23 bp, Homo sapiens
aatacctcttactttgcttgaga

SEQ ID NO: 3977221 - DNA, 15 bp, Homo sapiens
aatacgcctttaaag

SEQ ID NO: 3977222 - DNA, 18 bp, Homo sapiens
aatactaaaagcaaatct

SEQ ID NO: 3977223 - DNA, 13 bp, Homo sapiens
aatactacccata

SEQ ID NO: 3977224 - DNA, 20 bp, Homo sapiens
aatactacccatagaaaact

SEQ ID NO: 3977225 - DNA, 15 bp, Homo sapiens
aatactaccttgaaa

SEQ ID NO: 3977226 - DNA, 17 bp, Homo sapiens
aatactaccttgaaaat

SEQ ID NO: 3977227 - DNA, 12 bp, Homo sapiens
aatactggaata

SEQ ID NO: 3977228 - DNA, 16 bp, Homo sapiens
aatactggaataattt

SEQ ID NO: 3977229 - DNA, 21 bp, Homo sapiens
aatactggaataatttgtaaa

SEQ ID NO: 3977230 - DNA, 18 bp, Homo sapiens
aatactgggttcttagtt

SEQ ID NO: 3977231 - DNA, 21 bp, Homo sapiens
aatactgtgcagaataatgga

SEQ ID NO: 3977232 - DNA, 18 bp, Homo sapiens
aatacttaaaaatagtct

SEQ ID NO: 3977233 - DNA, 10 bp, Homo sapiens
aatacttgtc

SEQ ID NO: 3977234 - DNA, 15 bp, Homo sapiens
aatactttaaaggaa

SEQ ID NO: 3977235 - DNA, 16 bp, Homo sapiens
aatactttaaaggaaa

SEQ ID NO: 3977236 - DNA, 23 bp, Homo sapiens
aatactttctatgtgacatttct

SEQ ID NO: 3977237 - DNA, 16 bp, Homo sapiens
aatactttgcttcata

SEQ ID NO: 3977238 - DNA, 15 bp, Homo sapiens
aatacttttactctg

SEQ ID NO: 3977239 - DNA, 13 bp, Homo sapiens
aatagaaactcac

SEQ ID NO: 3977240 - DNA, 19 bp, Homo sapiens
aatagaaataaattcctaa

SEQ ID NO: 3977241 - DNA, 20 bp, Homo sapiens
aatagaaataaattcctaaa

SEQ ID NO: 3977242 - DNA, 16 bp, Homo sapiens
aatagaaattttgtaa

SEQ ID NO: 3977243 - DNA, 17 bp, Homo sapiens
aatagaaattttgtaag

SEQ ID NO: 3977244 - DNA, 19 bp, Homo sapiens
aatagaaattttgtaagaa

SEQ ID NO: 3977245 - DNA, 22 bp, Homo sapiens
aatagacaaatagaaaatggtc

SEQ ID NO: 3977246 - DNA, 18 bp, Homo sapiens
aatagagactgtagattg

SEQ ID NO: 3977247 - DNA, 20 bp, Homo sapiens
aatagagcaaaattgatgtg

SEQ ID NO: 3977248 - DNA, 22 bp, Homo sapiens
aatagagcaaaattgatgtgtt

SEQ ID NO: 3977249 - DNA, 15 bp, Homo sapiens
aatagatcttagggt

SEQ ID NO: 3977250 - DNA, 16 bp, Homo sapiens
aatagatgctgactgt

SEQ ID NO: 3977251 - DNA, 15 bp, Homo sapiens
aatagcaacttttgt

SEQ ID NO: 3977252 - DNA, 14 bp, Homo sapiens
aatagcagcctttc

SEQ ID NO: 3977253 - DNA, 22 bp, Homo sapiens
aatagcgctgtttttgttgtgt

SEQ ID NO: 3977254 - DNA, 21 bp, Homo sapiens
aatagctatatccatgtactg

SEQ ID NO: 3977255 - DNA, 17 bp, Homo sapiens
aatagggtagaatgatt

SEQ ID NO: 3977256 - DNA, 22 bp, Homo sapiens
aatagggtagaatgattaatca

SEQ ID NO: 3977257 - DNA, 17 bp, Homo sapiens
aataggtagtttggata

SEQ ID NO: 3977258 - DNA, 16 bp, Homo sapiens
aatcaaataagtattt

SEQ ID NO: 3977259 - DNA, 13 bp, Homo sapiens
aatcaagagctgc

SEQ ID NO: 3977260 - DNA, 16 bp, Homo sapiens
aatcaagagctgccct

SEQ ID NO: 3977261 - DNA, 19 bp, Homo sapiens
aatcaagatttttttcctg

SEQ ID NO: 3977262 - DNA, 20 bp, Homo sapiens
aatcaagcctttatggctgc

SEQ ID NO: 3977263 - DNA, 23 bp, Homo sapiens
aatcaagcctttatggctgctgg

SEQ ID NO: 3977264 - DNA, 23 bp, Homo sapiens
aatcaagggcaaaaagtctacat

SEQ ID NO: 3977265 - DNA, 15 bp, Homo sapiens
aatcaagttgtaact

SEQ ID NO: 3977266 - DNA, 17 bp, Homo sapiens
aatcaataacagccgct

SEQ ID NO: 3977267 - DNA, 20 bp, Homo sapiens
aatcaatacactagttgttt

SEQ ID NO: 3977268 - DNA, 14 bp, Homo sapiens
aatcaatgaatatt

SEQ ID NO: 3977269 - DNA, 19 bp, Homo sapiens
aatcaatgaatattgaagt

SEQ ID NO: 3977270 - DNA, 22 bp, Homo sapiens
aatcaatgcaagagtgattgca

SEQ ID NO: 3977271 - DNA, 16 bp, Homo sapiens
aatcaatttttaggaa

SEQ ID NO: 3977272 - DNA, 20 bp, Homo sapiens
aatcacataatttgttttgt

SEQ ID NO: 3977273 - DNA, 13 bp, Homo sapiens
aatcaccatgtaa

SEQ ID NO: 3977274 - DNA, 14 bp, Homo sapiens
aatcaccatgtaag

SEQ ID NO: 3977275 - DNA, 15 bp, Homo sapiens
aatcaccatgtaagc

SEQ ID NO: 3977276 - DNA, 12 bp, Homo sapiens
aatcacctggct

SEQ ID NO: 3977277 - DNA, 23 bp, Homo sapiens
aatcactttgtctaactcagaat

SEQ ID NO: 3977278 - DNA, 12 bp, Homo sapiens
aatcagaataaa

SEQ ID NO: 3977279 - DNA, 18 bp, Homo sapiens
aatcagaataaattaata

SEQ ID NO: 3977280 - DNA, 17 bp, Homo sapiens
aatcagaatcatggaga

SEQ ID NO: 3977281 - DNA, 18 bp, Homo sapiens
aatcagaatcatggagaa

SEQ ID NO: 3977282 - DNA, 16 bp, Homo sapiens
aatcagaatttttaga

SEQ ID NO: 3977283 - DNA, 17 bp, Homo sapiens
aatcagagagcaaggca

SEQ ID NO: 3977284 - DNA, 14 bp, Homo sapiens
aatcagaggagaga

SEQ ID NO: 3977285 - DNA, 18 bp, Homo sapiens
aatcagagtagaaataaa

SEQ ID NO: 3977286 - DNA, 18 bp, Homo sapiens
aatcagcattctcactcc

SEQ ID NO: 3977287 - DNA, 15 bp, Homo sapiens
aatcaggtgttttaa

SEQ ID NO: 3977288 - DNA, 21 bp, Homo sapiens
aatcagtagcttaagaaaaaa

SEQ ID NO: 3977289 - DNA, 17 bp, Homo sapiens
aatcagtataaacaaag

SEQ ID NO: 3977290 - DNA, 18 bp, Homo sapiens
aatcagtgtgtctaaatt

SEQ ID NO: 3977291 - DNA, 19 bp, Homo sapiens
aatcatagtactctttgta

SEQ ID NO: 3977292 - DNA, 18 bp, Homo sapiens
aatcatataataaatgta

SEQ ID NO: 3977293 - DNA, 23 bp, Homo sapiens
aatcatattgatgaaaagattta

SEQ ID NO: 3977294 - DNA, 20 bp, Homo sapiens
aatcatccccatcctccaga

SEQ ID NO: 3977295 - DNA, 24 bp, Homo sapiens
aatcatcggagtcagccaggagct

SEQ ID NO: 3977296 - DNA, 18 bp, Homo sapiens
aatcatctataaagaaga

SEQ ID NO: 3977297 - DNA, 13 bp, Homo sapiens
aatcatgagcctg

SEQ ID NO: 3977298 - DNA, 17 bp, Homo sapiens
aatcatgagcctgctgg

SEQ ID NO: 3977299 - DNA, 15 bp, Homo sapiens
aatcattagttttag

SEQ ID NO: 3977300 - DNA, 16 bp, Homo sapiens
aatcattccagtgcta

SEQ ID NO: 3977301 - DNA, 18 bp, Homo sapiens
aatcattccagtgctaga

SEQ ID NO: 3977302 - DNA, 20 bp, Homo sapiens
aatcattgctgaaaatggta

SEQ ID NO: 3977303 - DNA, 13 bp, Homo sapiens
aatcatttctcac

SEQ ID NO: 3977304 - DNA, 16 bp, Homo sapiens
aatcatttctcactgt

SEQ ID NO: 3977305 - DNA, 16 bp, Homo sapiens
aatcattttaattatt

SEQ ID NO: 3977306 - DNA, 17 bp, Homo sapiens
aatcattttaattatta

SEQ ID NO: 3977307 - DNA, 19 bp, Homo sapiens
aatcattttaattattatt

SEQ ID NO: 3977308 - DNA, 17 bp, Homo sapiens
aatccaaaacttctctt

SEQ ID NO: 3977309 - DNA, 16 bp, Homo sapiens
aatccacctgccttgg

SEQ ID NO: 3977310 - DNA, 20 bp, Homo sapiens
aatccagaaacttgttcttc

SEQ ID NO: 3977311 - DNA, 22 bp, Homo sapiens
aatccagctccctagactgcat

SEQ ID NO: 3977312 - DNA, 18 bp, Homo sapiens
aatccaggcacagctgag

SEQ ID NO: 3977313 - DNA, 18 bp, Homo sapiens
aatccaggcagatccagg

SEQ ID NO: 3977314 - DNA, 14 bp, Homo sapiens
aatccagtattatc

SEQ ID NO: 3977315 - DNA, 13 bp, Homo sapiens
aatccagtattgc

SEQ ID NO: 3977316 - DNA, 15 bp, Homo sapiens
aatccattgtttaaa

SEQ ID NO: 3977317 - DNA, 19 bp, Homo sapiens
aatccattgtttaaagatg

SEQ ID NO: 3977318 - DNA, 11 bp, Homo sapiens
aatcccaaatt

SEQ ID NO: 3977319 - DNA, 18 bp, Homo sapiens
aatcccaaatttgattga

SEQ ID NO: 3977320 - DNA, 13 bp, Homo sapiens
aatcccagggctg

SEQ ID NO: 3977321 - DNA, 18 bp, Homo sapiens
aatcccagggctggctct

SEQ ID NO: 3977322 - DNA, 17 bp, Homo sapiens
aatccctgggcattgct

SEQ ID NO: 3977323 - DNA, 17 bp, Homo sapiens
aatccctgtttaatatt

SEQ ID NO: 3977324 - DNA, 23 bp, Homo sapiens
aatccctgtttaatatttaaaca

SEQ ID NO: 3977325 - DNA, 15 bp, Homo sapiens
aatcccttaaaatta

SEQ ID NO: 3977326 - DNA, 19 bp, Homo sapiens
aatccctttattaccccct

SEQ ID NO: 3977327 - DNA, 23 bp, Homo sapiens
aatccctttattaccccctcctt

SEQ ID NO: 3977328 - DNA, 21 bp, Homo sapiens
aatccgaccactaattgccaa

SEQ ID NO: 3977329 - DNA, 16 bp, Homo sapiens
aatcctaatttctcct

SEQ ID NO: 3977330 - DNA, 21 bp, Homo sapiens
aatcctaatttctcctccctt

SEQ ID NO: 3977331 - DNA, 15 bp, Homo sapiens
aatcctacctgtttt

SEQ ID NO: 3977332 - DNA, 24 bp, Homo sapiens
aatcctattaaaacacagctttac

SEQ ID NO: 3977333 - DNA, 21 bp, Homo sapiens
aatcctattctgatgaatctc

SEQ ID NO: 3977334 - DNA, 21 bp, Homo sapiens
aatcctcatgttactcagtgt

SEQ ID NO: 3977335 - DNA, 11 bp, Homo sapiens
aatcctcctcc

SEQ ID NO: 3977336 - DNA, 17 bp, Homo sapiens
aatcctgcaatgaaagg

SEQ ID NO: 3977337 - DNA, 18 bp, Homo sapiens
aatcctgtaccaaatctg

SEQ ID NO: 3977338 - DNA, 13 bp, Homo sapiens
aatcctttactgt

SEQ ID NO: 3977339 - DNA, 14 bp, Homo sapiens
aatcctttggaaaa

SEQ ID NO: 3977340 - DNA, 23 bp, Homo sapiens
aatcctttgttttctgactaatt

SEQ ID NO: 3977341 - DNA, 18 bp, Homo sapiens
aatccttttcctgttcat

SEQ ID NO: 3977342 - DNA, 13 bp, Homo sapiens
aatccttttcctt

SEQ ID NO: 3977343 - DNA, 14 bp, Homo sapiens
aatccttttcctta

SEQ ID NO: 3977344 - DNA, 17 bp, Homo sapiens
aatccttttccttattt

SEQ ID NO: 3977345 - DNA, 20 bp, Homo sapiens
aatcgagtgagacaaaattt

SEQ ID NO: 3977346 - DNA, 13 bp, Homo sapiens
aatctaaggataa

SEQ ID NO: 3977347 - DNA, 21 bp, Homo sapiens
aatctaaggataatgaaataa

SEQ ID NO: 3977348 - DNA, 14 bp, Homo sapiens
aatctaattttttc

SEQ ID NO: 3977349 - DNA, 22 bp, Homo sapiens
aatctacagatcctttttccat

SEQ ID NO: 3977350 - DNA, 15 bp, Homo sapiens
aatctactaattcca

SEQ ID NO: 3977351 - DNA, 17 bp, Homo sapiens
aatctacttgttaaaaa

SEQ ID NO: 3977352 - DNA, 16 bp, Homo sapiens
aatctagacaatatac

SEQ ID NO: 3977353 - DNA, 19 bp, Homo sapiens
aatctaggtgtggctgtga

SEQ ID NO: 3977354 - DNA, 14 bp, Homo sapiens
aatctataaagaag

SEQ ID NO: 3977355 - DNA, 21 bp, Homo sapiens
aatctataaagaaggataaat

SEQ ID NO: 3977356 - DNA, 13 bp, Homo sapiens
aatctattctgtg

SEQ ID NO: 3977357 - DNA, 15 bp, Homo sapiens
aatctattgggttca

SEQ ID NO: 3977358 - DNA, 17 bp, Homo sapiens
aatctatttcacttatt

SEQ ID NO: 3977359 - DNA, 13 bp, Homo sapiens
aatctcaccccat

SEQ ID NO: 3977360 - DNA, 22 bp, Homo sapiens
aatctcctctctctttcctcca

SEQ ID NO: 3977361 - DNA, 20 bp, Homo sapiens
actacatgcagcccatgccc

SEQ ID NO: 3977362 - DNA, 13 bp, Homo sapiens
actaccacaagga

SEQ ID NO: 3977363 - DNA, 14 bp, Homo sapiens
actaccacaaggaa

SEQ ID NO: 3977364 - DNA, 16 bp, Homo sapiens
actaccccacaccagc

SEQ ID NO: 3977365 - DNA, 18 bp, Homo sapiens
actacccccttttcagct

SEQ ID NO: 3977366 - DNA, 16 bp, Homo sapiens
actacctcctctcctg

SEQ ID NO: 3977367 - DNA, 12 bp, Homo sapiens
actacctgtgta

SEQ ID NO: 3977368 - DNA, 15 bp, Homo sapiens
actacgttaagggaa

SEQ ID NO: 3977369 - DNA, 19 bp, Homo sapiens
acctctttttcctcctgga

SEQ ID NO: 3977370 - DNA, 21 bp, Homo sapiens
acctctttttcctcctggaca

SEQ ID NO: 3977371 - DNA, 22 bp, Homo sapiens
acctctttttcctcctggacac

SEQ ID NO: 3977372 - DNA, 14 bp, Homo sapiens
acctgacacatctt

SEQ ID NO: 3977373 - DNA, 14 bp, Homo sapiens
acctgacctcttgc

SEQ ID NO: 3977374 - DNA, 15 bp, Homo sapiens
acctgacctcttgct

SEQ ID NO: 3977375 - DNA, 18 bp, Homo sapiens
acctgacctcttgctgtc

SEQ ID NO: 3977376 - DNA, 21 bp, Homo sapiens
acctgacctcttgctgtctct

SEQ ID NO: 3977377 - DNA, 15 bp, Homo sapiens
acctgagacgggcat

SEQ ID NO: 3977378 - DNA, 23 bp, Homo sapiens
acctgagacgggcatcgcaggag

SEQ ID NO: 3977379 - DNA, 23 bp, Homo sapiens
acctgagcccggatgcttctcca

SEQ ID NO: 3977380 - DNA, 18 bp, Homo sapiens
acctgagctattttcctc

SEQ ID NO: 3977381 - DNA, 14 bp, Homo sapiens
acctgagctggcca

SEQ ID NO: 3977382 - DNA, 21 bp, Homo sapiens
acctgaggacatggcttctga

SEQ ID NO: 3977383 - DNA, 22 bp, Homo sapiens
acctgatcactagcctgtcatc

SEQ ID NO: 3977384 - DNA, 13 bp, Homo sapiens
acctgatcctgga

SEQ ID NO: 3977385 - DNA, 21 bp, Homo sapiens
acctgatgttaaaattccatc

SEQ ID NO: 3977386 - DNA, 15 bp, Homo sapiens
acctgcaaagatctg

SEQ ID NO: 3977387 - DNA, 22 bp, Homo sapiens
acctgcacactccatctcctgc

SEQ ID NO: 3977388 - DNA, 16 bp, Homo sapiens
accttgctctcctcat

SEQ ID NO: 3977389 - DNA, 11 bp, Homo sapiens
accttgctgtc

SEQ ID NO: 3977390 - DNA, 16 bp, Homo sapiens
accttggcaccagaca

SEQ ID NO: 3977391 - DNA, 18 bp, Homo sapiens
accttggcaccagacacc

SEQ ID NO: 3977392 - DNA, 22 bp, Homo sapiens
accttggcaccagacacccagg

SEQ ID NO: 3977393 - DNA, 17 bp, Homo sapiens
accttggctctgccagt

SEQ ID NO: 3977394 - DNA, 19 bp, Homo sapiens
acctttaacttttttttct

SEQ ID NO: 3977395 - DNA, 19 bp, Homo sapiens
acctttccgctgtcgcccc

SEQ ID NO: 3977396 - DNA, 18 bp, Homo sapiens
acctttggagcaaagctg

SEQ ID NO: 3977397 - DNA, 23 bp, Homo sapiens
acctttgtggggtttttggagaa

SEQ ID NO: 3977398 - DNA, 13 bp, Homo sapiens
accttttaaagtg

SEQ ID NO: 3977399 - DNA, 21 bp, Homo sapiens
accttttaaagtgtttcagct

SEQ ID NO: 3977400 - DNA, 22 bp, Homo sapiens
accttttaaagtgtttcagcta

SEQ ID NO: 3977401 - DNA, 20 bp, Homo sapiens
accttttattgacacagaaa

SEQ ID NO: 3977402 - DNA, 23 bp, Homo sapiens
accttttccccaaccacagagaa

SEQ ID NO: 3977403 - DNA, 14 bp, Homo sapiens
accttttctctttt

SEQ ID NO: 3977404 - DNA, 15 bp, Homo sapiens
accttttctgtggct

SEQ ID NO: 3977405 - DNA, 16 bp, Homo sapiens
accttttctgtggctg

SEQ ID NO: 3977406 - DNA, 20 bp, Homo sapiens
accttttctgtggctggctc

SEQ ID NO: 3977407 - DNA, 21 bp, Homo sapiens
accttttctgtggctggctct

SEQ ID NO: 3977408 - DNA, 12 bp, Homo sapiens
accttttcttca

SEQ ID NO: 3977409 - DNA, 14 bp, Homo sapiens
accttttcttcatt

SEQ ID NO: 3977410 - DNA, 19 bp, Homo sapiens
accttttgggaatgtttta

SEQ ID NO: 3977411 - DNA, 17 bp, Homo sapiens
acctttttcttgatctt

SEQ ID NO: 3977412 - DNA, 12 bp, Homo sapiens
acgaaatgttat

SEQ ID NO: 3977413 - DNA, 12 bp, Homo sapiens
acgaagccttaa

SEQ ID NO: 3977414 - DNA, 14 bp, Homo sapiens
acgacttcagggca

SEQ ID NO: 3977415 - DNA, 22 bp, Homo sapiens
acgacttcagggcagggctctg

SEQ ID NO: 3977416 - DNA, 19 bp, Homo sapiens
acgagaccctacaggagag

SEQ ID NO: 3977417 - DNA, 17 bp, Homo sapiens
acgagagcagaggtctc

SEQ ID NO: 3977418 - DNA, 19 bp, Homo sapiens
acgagcacctccagcctga

SEQ ID NO: 3977419 - DNA, 22 bp, Homo sapiens
acgaggaatctgtgggtctggg

SEQ ID NO: 3977420 - DNA, 11 bp, Homo sapiens
acgagggctgg

SEQ ID NO: 3977421 - DNA, 12 bp, Homo sapiens
acgagggctggc

SEQ ID NO: 3977422 - DNA, 14 bp, Homo sapiens
acgatcacctgcat

SEQ ID NO: 3977423 - DNA, 22 bp, Homo sapiens
acgatcacctgcatcacagccc

SEQ ID NO: 3977424 - DNA, 15 bp, Homo sapiens
acgatgtgtctgtat

SEQ ID NO: 3977425 - DNA, 16 bp, Homo sapiens
acgatgtttatgttct

SEQ ID NO: 3977426 - DNA, 13 bp, Homo sapiens
acgattccttctc

SEQ ID NO: 3977427 - DNA, 16 bp, Homo sapiens
acgattccttctctga

SEQ ID NO: 3977428 - DNA, 17 bp, Homo sapiens
acgcacaaacacacaca

SEQ ID NO: 3977429 - DNA, 21 bp, Homo sapiens
acgcaccggcctggctgcagc

SEQ ID NO: 3977430 - DNA, 22 bp, Homo sapiens
acgcaccggcctggctgcagct

SEQ ID NO: 3977431 - DNA, 15 bp, Homo sapiens
acgcacctgcctcag

SEQ ID NO: 3977432 - DNA, 14 bp, Homo sapiens
acgcacgcacacac

SEQ ID NO: 3977433 - DNA, 15 bp, Homo sapiens
acgcacgcacacaca

SEQ ID NO: 3977434 - DNA, 17 bp, Homo sapiens
acgcactccatgagcac

SEQ ID NO: 3977435 - DNA, 21 bp, Homo sapiens
acgcactccatgagcacccca

SEQ ID NO: 3977436 - DNA, 14 bp, Homo sapiens
acgcagccctagag

SEQ ID NO: 3977437 - DNA, 18 bp, Homo sapiens
acgcagccctagagcctg

SEQ ID NO: 3977438 - DNA, 12 bp, Homo sapiens
acgcagccctgc

SEQ ID NO: 3977439 - DNA, 23 bp, Homo sapiens
acgcagccctgctttgggctgcc

SEQ ID NO: 3977440 - DNA, 15 bp, Homo sapiens
acgcagttctttcca

SEQ ID NO: 3977441 - DNA, 14 bp, Homo sapiens
acgcatccagcaag

SEQ ID NO: 3977442 - DNA, 12 bp, Homo sapiens
acgccacatccc

SEQ ID NO: 3977443 - DNA, 18 bp, Homo sapiens
acgccactccacaaatga

SEQ ID NO: 3977444 - DNA, 16 bp, Homo sapiens
acgccactccctggga

SEQ ID NO: 3977445 - DNA, 11 bp, Homo sapiens
acgccagggac

SEQ ID NO: 3977446 - DNA, 15 bp, Homo sapiens
acgccagtctcccag

SEQ ID NO: 3977447 - DNA, 13 bp, Homo sapiens
acgcccagcccca

SEQ ID NO: 3977448 - DNA, 18 bp, Homo sapiens
acgccctttcctcctcag

SEQ ID NO: 3977449 - DNA, 21 bp, Homo sapiens
acgccctttcctcctcaggca

SEQ ID NO: 3977450 - DNA, 20 bp, Homo sapiens
acgccggggacagaggcctg

SEQ ID NO: 3977451 - DNA, 21 bp, Homo sapiens
acgccggggacagaggcctgc

SEQ ID NO: 3977452 - DNA, 18 bp, Homo sapiens
acgcctcactgaaacatg

SEQ ID NO: 3977453 - DNA, 13 bp, Homo sapiens
acgcctcctggcc

SEQ ID NO: 3977454 - DNA, 14 bp, Homo sapiens
acgcctcctggcca

SEQ ID NO: 3977455 - DNA, 15 bp, Homo sapiens
acgcctcctggccag

SEQ ID NO: 3977456 - DNA, 11 bp, Homo sapiens
acgcctggcta

SEQ ID NO: 3977457 - DNA, 20 bp, Homo sapiens
acgcgccttgtctcctactc

SEQ ID NO: 3977458 - DNA, 19 bp, Homo sapiens
acgcggttttttcacttcc

SEQ ID NO: 3977459 - DNA, 12 bp, Homo sapiens
acgcgtctcctg

SEQ ID NO: 3977460 - DNA, 15 bp, Homo sapiens
acgcgtctcctgttt

SEQ ID NO: 3977461 - DNA, 15 bp, Homo sapiens
acgcgtcttcctgag

SEQ ID NO: 3977462 - DNA, 21 bp, Homo sapiens
acgctaaagagcccttgcctc

SEQ ID NO: 3977463 - DNA, 18 bp, Homo sapiens
acgctactataaagagaa

SEQ ID NO: 3977464 - DNA, 15 bp, Homo sapiens
acgctcacccagtca

SEQ ID NO: 3977465 - DNA, 22 bp, Homo sapiens
acgctcctttgtgtgtgtgtca

SEQ ID NO: 3977466 - DNA, 15 bp, Homo sapiens
acgctcgcgggcagc

SEQ ID NO: 3977467 - DNA, 11 bp, Homo sapiens
acgctctgctg

SEQ ID NO: 3977468 - DNA, 22 bp, Homo sapiens
acgctgccgctgccgctgcacc

SEQ ID NO: 3977469 - DNA, 15 bp, Homo sapiens
acgctggggctctct

SEQ ID NO: 3977470 - DNA, 19 bp, Homo sapiens
acgctggggctctctgaga

SEQ ID NO: 3977471 - DNA, 14 bp, Homo sapiens
acgctgtcctctcg

SEQ ID NO: 3977472 - DNA, 18 bp, Homo sapiens
acgcttgcgtatgtctgt

SEQ ID NO: 3977473 - DNA, 20 bp, Homo sapiens
acgcttgtagaactcactct

SEQ ID NO: 3977474 - DNA, 13 bp, Homo sapiens
acgctttgattca

SEQ ID NO: 3977475 - DNA, 11 bp, Homo sapiens
acgctttgtca

SEQ ID NO: 3977476 - DNA, 23 bp, Homo sapiens
accctctggaggggtgtggctcc

SEQ ID NO: 3977477 - DNA, 13 bp, Homo sapiens
accctctgtccca

SEQ ID NO: 3977478 - DNA, 20 bp, Homo sapiens
accctctgtcccacccctag

SEQ ID NO: 3977479 - DNA, 13 bp, Homo sapiens
accctcttcatgg

SEQ ID NO: 3977480 - DNA, 16 bp, Homo sapiens
accctctttgctgcag

SEQ ID NO: 3977481 - DNA, 20 bp, Homo sapiens
accctctttgctgcagagaa

SEQ ID NO: 3977482 - DNA, 20 bp, Homo sapiens
accctgacctccgcccctgc

SEQ ID NO: 3977483 - DNA, 17 bp, Homo sapiens
accctgaggccctgggc

SEQ ID NO: 3977484 - DNA, 14 bp, Homo sapiens
accctgaggtcagg

SEQ ID NO: 3977485 - DNA, 19 bp, Homo sapiens
accctgcactttcctccac

SEQ ID NO: 3977486 - DNA, 20 bp, Homo sapiens
accctgcattacatgtgttt

SEQ ID NO: 3977487 - DNA, 19 bp, Homo sapiens
accctgccacagccagagg

SEQ ID NO: 3977488 - DNA, 15 bp, Homo sapiens
accctgcctcagctg

SEQ ID NO: 3977489 - DNA, 18 bp, Homo sapiens
accctgcgcctccagagg

SEQ ID NO: 3977490 - DNA, 12 bp, Homo sapiens
accctgctccct

SEQ ID NO: 3977491 - DNA, 13 bp, Homo sapiens
accctgctccctg

SEQ ID NO: 3977492 - DNA, 15 bp, Homo sapiens
accctgctcctcctg

SEQ ID NO: 3977493 - DNA, 19 bp, Homo sapiens
accctgctcctcctgccct

SEQ ID NO: 3977494 - DNA, 21 bp, Homo sapiens
accctgctcctcctgccctgt

SEQ ID NO: 3977495 - DNA, 13 bp, Homo sapiens
accctggagccca

SEQ ID NO: 3977496 - DNA, 21 bp, Homo sapiens
accctggccgagtccaagctg

SEQ ID NO: 3977497 - DNA, 22 bp, Homo sapiens
accctggccgagtccaagctgg

SEQ ID NO: 3977498 - DNA, 19 bp, Homo sapiens
accctggccgccccctgcc

SEQ ID NO: 3977499 - DNA, 22 bp, Homo sapiens
accctggccgccccctgccccc

SEQ ID NO: 3977500 - DNA, 16 bp, Homo sapiens
accctggcctgaactg

SEQ ID NO: 3977501 - DNA, 22 bp, Homo sapiens
accctgggagccagtcctccac

SEQ ID NO: 3977502 - DNA, 20 bp, Homo sapiens
accctggggacccccacgat

SEQ ID NO: 3977503 - DNA, 15 bp, Homo sapiens
acccccgaggggagg

SEQ ID NO: 3977504 - DNA, 20 bp, Homo sapiens
acccccgaggggagggcagg

SEQ ID NO: 3977505 - DNA, 15 bp, Homo sapiens
acccccgccacctca

SEQ ID NO: 3977506 - DNA, 14 bp, Homo sapiens
accccctcaagccc

SEQ ID NO: 3977507 - DNA, 19 bp, Homo sapiens
accccctcaagccccagca

SEQ ID NO: 3977508 - DNA, 16 bp, Homo sapiens
accccctcattgttta

SEQ ID NO: 3977509 - DNA, 20 bp, Homo sapiens
accccctccccgcccctgtg

SEQ ID NO: 3977510 - DNA, 14 bp, Homo sapiens
accccctctagaaa

SEQ ID NO: 3977511 - DNA, 22 bp, Homo sapiens
accccctgagatcccctgagcc

SEQ ID NO: 3977512 - DNA, 15 bp, Homo sapiens
accccgagaagtgct

SEQ ID NO: 3977513 - DNA, 20 bp, Homo sapiens
accccgagaagtgctcttgg

SEQ ID NO: 3977514 - DNA, 14 bp, Homo sapiens
accccgaggtaggg

SEQ ID NO: 3977515 - DNA, 19 bp, Homo sapiens
accccgcctgccctcatgg

SEQ ID NO: 3977516 - DNA, 17 bp, Homo sapiens
accccgggctctctgct

SEQ ID NO: 3977517 - DNA, 18 bp, Homo sapiens
accccgggctctctgctg

SEQ ID NO: 3977518 - DNA, 17 bp, Homo sapiens
accccggggaccctgtg

SEQ ID NO: 3977519 - DNA, 19 bp, Homo sapiens
accccgtctctataccaac

SEQ ID NO: 3977520 - DNA, 15 bp, Homo sapiens
acccctacacacaca

SEQ ID NO: 3977521 - DNA, 21 bp, Homo sapiens
acccctagccaccagtgtcct

SEQ ID NO: 3977522 - DNA, 17 bp, Homo sapiens
acccctagttccctctg

SEQ ID NO: 3977523 - DNA, 15 bp, Homo sapiens
acccctcactctggc

SEQ ID NO: 3977524 - DNA, 17 bp, Homo sapiens
acccctcactctggcct

SEQ ID NO: 3977525 - DNA, 18 bp, Homo sapiens
acccctcactctggcctc

SEQ ID NO: 3977526 - DNA, 18 bp, Homo sapiens
acccctcccggccctgcc

SEQ ID NO: 3977527 - DNA, 19 bp, Homo sapiens
acccctcccggccctgcct

SEQ ID NO: 3977528 - DNA, 20 bp, Homo sapiens
acccctcccggccctgcctg

SEQ ID NO: 3977529 - DNA, 15 bp, Homo sapiens
acccctcgtccaccc

SEQ ID NO: 3977530 - DNA, 13 bp, Homo sapiens
acccctctggcca

SEQ ID NO: 3977531 - DNA, 14 bp, Homo sapiens
acccctctggccag

SEQ ID NO: 3977532 - DNA, 16 bp, Homo sapiens
acccctgactcatcat

SEQ ID NO: 3977533 - DNA, 18 bp, Homo sapiens
acccctgagccagcaggg

SEQ ID NO: 3977534 - DNA, 16 bp, Homo sapiens
acccctgcccagatca

SEQ ID NO: 3977535 - DNA, 12 bp, Homo sapiens
acccctgccccc

SEQ ID NO: 3977536 - DNA, 13 bp, Homo sapiens
acccctgccccca

SEQ ID NO: 3977537 - DNA, 20 bp, Homo sapiens
acccctgcccccagccccgg

SEQ ID NO: 3977538 - DNA, 18 bp, Homo sapiens
acccctgctcccagcctg

SEQ ID NO: 3977539 - DNA, 17 bp, Homo sapiens
acccctggcttttcact

SEQ ID NO: 3977540 - DNA, 14 bp, Homo sapiens
acccctgggcaggc

SEQ ID NO: 3977541 - DNA, 15 bp, Homo sapiens
acccgacctggctgc

SEQ ID NO: 3977542 - DNA, 20 bp, Homo sapiens
acccgacctggctgcccctc

SEQ ID NO: 3977543 - DNA, 15 bp, Homo sapiens
acccgagctgggacc

SEQ ID NO: 3977544 - DNA, 18 bp, Homo sapiens
acccgctcatcactggat

SEQ ID NO: 3977545 - DNA, 22 bp, Homo sapiens
acccggcctctctgccccaccc

SEQ ID NO: 3977546 - DNA, 19 bp, Homo sapiens
acccggcctggatgccagc

SEQ ID NO: 3977547 - DNA, 21 bp, Homo sapiens
acccggcctggatgccagctg

SEQ ID NO: 3977548 - DNA, 20 bp, Homo sapiens
acccgggggagcccagtgaa

SEQ ID NO: 3977549 - DNA, 20 bp, Homo sapiens
acccgttctgctggcctgga

SEQ ID NO: 3977550 - DNA, 15 bp, Homo sapiens
accctagccttgctt

SEQ ID NO: 3977551 - DNA, 17 bp, Homo sapiens
accctatatgtagtata

SEQ ID NO: 3977552 - DNA, 19 bp, Homo sapiens
accctcacacacacagctg

SEQ ID NO: 3977553 - DNA, 20 bp, Homo sapiens
accctcagggagcctcccca

SEQ ID NO: 3977554 - DNA, 18 bp, Homo sapiens
accctcatacacagaaac

SEQ ID NO: 3977555 - DNA, 12 bp, Homo sapiens
accctcccaccc

SEQ ID NO: 3977556 - DNA, 13 bp, Homo sapiens
accctcccacccc

SEQ ID NO: 3977557 - DNA, 13 bp, Homo sapiens
accctcccccgca

SEQ ID NO: 3977558 - DNA, 14 bp, Homo sapiens
accctcccccgcag

SEQ ID NO: 3977559 - DNA, 15 bp, Homo sapiens
accctccccttccca

SEQ ID NO: 3977560 - DNA, 19 bp, Homo sapiens
accctccccttcccagggc

SEQ ID NO: 3977561 - DNA, 18 bp, Homo sapiens
accctccctgactggcct

SEQ ID NO: 3977562 - DNA, 19 bp, Homo sapiens
accctccctgactggcctg

SEQ ID NO: 3977563 - DNA, 12 bp, Homo sapiens
accctccctgga

SEQ ID NO: 3977564 - DNA, 13 bp, Homo sapiens
accctcctcctct

SEQ ID NO: 3977565 - DNA, 19 bp, Homo sapiens
accctcctcctcttcacca

SEQ ID NO: 3977566 - DNA, 20 bp, Homo sapiens
accctcctcctcttcaccag

SEQ ID NO: 3977567 - DNA, 13 bp, Homo sapiens
accctcctgcccc

SEQ ID NO: 3977568 - DNA, 15 bp, Homo sapiens
accctcctgccccac

SEQ ID NO: 3977569 - DNA, 16 bp, Homo sapiens
accctcctgccccaca

SEQ ID NO: 3977570 - DNA, 18 bp, Homo sapiens
accctcctgccccacact

SEQ ID NO: 3977571 - DNA, 14 bp, Homo sapiens
accctcctgtaaat

SEQ ID NO: 3977572 - DNA, 17 bp, Homo sapiens
accctcctgtaaatggt

SEQ ID NO: 3977573 - DNA, 13 bp, Homo sapiens
accctccttccca

SEQ ID NO: 3977574 - DNA, 15 bp, Homo sapiens
accctccttcccact

SEQ ID NO: 3977575 - DNA, 15 bp, Homo sapiens
accctctcctggggg

SEQ ID NO: 3977576 - DNA, 19 bp, Homo sapiens
accctctgaatggtccagg

SEQ ID NO: 3977577 - DNA, 21 bp, Homo sapiens
acatcaccgacgcgtctcctg

SEQ ID NO: 3977578 - DNA, 22 bp, Homo sapiens
acatcaccgacgcgtctcctgt

SEQ ID NO: 3977579 - DNA, 16 bp, Homo sapiens
acatcagacctgtctt

SEQ ID NO: 3977580 - DNA, 20 bp, Homo sapiens
acatcagacctgtcttccaa

SEQ ID NO: 3977581 - DNA, 21 bp, Homo sapiens
acatccaaaatagttaagaca

SEQ ID NO: 3977582 - DNA, 15 bp, Homo sapiens
acatccaaagcagac

SEQ ID NO: 3977583 - DNA, 17 bp, Homo sapiens
acatccaaagcagacag

SEQ ID NO: 3977584 - DNA, 12 bp, Homo sapiens
acatccatccct

SEQ ID NO: 3977585 - DNA, 21 bp, Homo sapiens
acatcccaccccatcctccag

SEQ ID NO: 3977586 - DNA, 17 bp, Homo sapiens
acatcccagcagcccaa

SEQ ID NO: 3977587 - DNA, 18 bp, Homo sapiens
acatccccaagcccacca

SEQ ID NO: 3977588 - DNA, 18 bp, Homo sapiens
acatccggggccagctcc

SEQ ID NO: 3977589 - DNA, 14 bp, Homo sapiens
acatcctccgtcca

SEQ ID NO: 3977590 - DNA, 23 bp, Homo sapiens
acatcctttgcagggcagcccca

SEQ ID NO: 3977591 - DNA, 19 bp, Homo sapiens
acatcgcacactggggccc

SEQ ID NO: 3977592 - DNA, 23 bp, Homo sapiens
acatctattttggattgtatatt

SEQ ID NO: 3977593 - DNA, 21 bp, Homo sapiens
acatctcctccatactcagga

SEQ ID NO: 3977594 - DNA, 11 bp, Homo sapiens
acatctcctta

SEQ ID NO: 3977595 - DNA, 19 bp, Homo sapiens
acatctgtgcagggctggt

SEQ ID NO: 3977596 - DNA, 22 bp, Homo sapiens
acatctgtgcagggctggtttg

SEQ ID NO: 3977597 - DNA, 23 bp, Homo sapiens
acatcttccctagagggttcctg

SEQ ID NO: 3977598 - DNA, 18 bp, Homo sapiens
acatcttctgtgaaatat

SEQ ID NO: 3977599 - DNA, 15 bp, Homo sapiens
acatcttcttcccag

SEQ ID NO: 3977600 - DNA, 19 bp, Homo sapiens
acatcttggtcagatttga

SEQ ID NO: 3977601 - DNA, 20 bp, Homo sapiens
acatctttaaggggaggaac

SEQ ID NO: 3977602 - DNA, 18 bp, Homo sapiens
acatgaaaattttaaaaa

SEQ ID NO: 3977603 - DNA, 19 bp, Homo sapiens
acatgaacacccttagaaa

SEQ ID NO: 3977604 - DNA, 21 bp, Homo sapiens
acatgaagcaattagtctgaa

SEQ ID NO: 3977605 - DNA, 15 bp, Homo sapiens
acatgaatacaaatt

SEQ ID NO: 3977606 - DNA, 14 bp, Homo sapiens
acatgaatgcagtc

SEQ ID NO: 3977607 - DNA, 22 bp, Homo sapiens
acatgaatgcagtcatgcaaac

SEQ ID NO: 3977608 - DNA, 13 bp, Homo sapiens
acatgactgggcc

SEQ ID NO: 3977609 - DNA, 16 bp, Homo sapiens
acatgaggggacattt

SEQ ID NO: 3977610 - DNA, 15 bp, Homo sapiens
acatgatcttcttta

SEQ ID NO: 3977611 - DNA, 19 bp, Homo sapiens
acatgatcttctttataat

SEQ ID NO: 3977612 - DNA, 22 bp, Homo sapiens
acatgatgttatgtaccatatg

SEQ ID NO: 3977613 - DNA, 14 bp, Homo sapiens
acatgcaaaaagaa

SEQ ID NO: 3977614 - DNA, 23 bp, Homo sapiens
acatgcaaaaagaaatgactaat

SEQ ID NO: 3977615 - DNA, 17 bp, Homo sapiens
acatgcattgttggcta

SEQ ID NO: 3977616 - DNA, 22 bp, Homo sapiens
acatgcattgttggctatttga

SEQ ID NO: 3977617 - DNA, 15 bp, Homo sapiens
acatgccacctggca

SEQ ID NO: 3977618 - DNA, 14 bp, Homo sapiens
acatgccactgcct

SEQ ID NO: 3977619 - DNA, 14 bp, Homo sapiens
acatgcctgcgcct

SEQ ID NO: 3977620 - DNA, 15 bp, Homo sapiens
acatgcctgcgcctg

SEQ ID NO: 3977621 - DNA, 17 bp, Homo sapiens
acatgcctgcgcctgct

SEQ ID NO: 3977622 - DNA, 20 bp, Homo sapiens
acatgcctgcgcctgctgcc

SEQ ID NO: 3977623 - DNA, 18 bp, Homo sapiens
acatgcggtagccagcac

SEQ ID NO: 3977624 - DNA, 15 bp, Homo sapiens
acatgctcacctcta

SEQ ID NO: 3977625 - DNA, 16 bp, Homo sapiens
acatggcagtgtttta

SEQ ID NO: 3977626 - DNA, 12 bp, Homo sapiens
acatgggcagcc

SEQ ID NO: 3977627 - DNA, 13 bp, Homo sapiens
acatgggcagccc

SEQ ID NO: 3977628 - DNA, 19 bp, Homo sapiens
acatggtgcctgagaggca

SEQ ID NO: 3977629 - DNA, 20 bp, Homo sapiens
acatggtgcctgagaggcag

SEQ ID NO: 3977630 - DNA, 20 bp, Homo sapiens
acatggttgtgacctgagga

SEQ ID NO: 3977631 - DNA, 17 bp, Homo sapiens
acatgtaataaaaagta

SEQ ID NO: 3977632 - DNA, 23 bp, Homo sapiens
acatgtaataaaaagtatatgtt

SEQ ID NO: 3977633 - DNA, 21 bp, Homo sapiens
acatgtaattaagtactatgt

SEQ ID NO: 3977634 - DNA, 14 bp, Homo sapiens
acatgtagcttctt

SEQ ID NO: 3977635 - DNA, 13 bp, Homo sapiens
acatgtcttccat

SEQ ID NO: 3977636 - DNA, 21 bp, Homo sapiens
acatgtgaaaccttttttaag

SEQ ID NO: 3977637 - DNA, 16 bp, Homo sapiens
acaggcatgtgtcacc

SEQ ID NO: 3977638 - DNA, 18 bp, Homo sapiens
acaggcatttgttcactg

SEQ ID NO: 3977639 - DNA, 16 bp, Homo sapiens
acaggccaccctgtgc

SEQ ID NO: 3977640 - DNA, 20 bp, Homo sapiens
acaggcccagcgcggccagc

SEQ ID NO: 3977641 - DNA, 13 bp, Homo sapiens
acaggcccaggga

SEQ ID NO: 3977642 - DNA, 14 bp, Homo sapiens
acaggcccagggag

SEQ ID NO: 3977643 - DNA, 20 bp, Homo sapiens
acaggccctggagaagcagc

SEQ ID NO: 3977644 - DNA, 13 bp, Homo sapiens
acaggcgagagag

SEQ ID NO: 3977645 - DNA, 14 bp, Homo sapiens
acaggctcaatatt

SEQ ID NO: 3977646 - DNA, 14 bp, Homo sapiens
acaggctggcgggg

SEQ ID NO: 3977647 - DNA, 23 bp, Homo sapiens
acaggctgtccttaacccacctc

SEQ ID NO: 3977648 - DNA, 14 bp, Homo sapiens
acagggcaccagag

SEQ ID NO: 3977649 - DNA, 16 bp, Homo sapiens
acagggcaccagaggc

SEQ ID NO: 3977650 - DNA, 17 bp, Homo sapiens
acagggcagagcaggaa

SEQ ID NO: 3977651 - DNA, 13 bp, Homo sapiens
acagggccagagg

SEQ ID NO: 3977652 - DNA, 18 bp, Homo sapiens
acagggccagtggggcct

SEQ ID NO: 3977653 - DNA, 21 bp, Homo sapiens
acagggcccgcagtgctggga

SEQ ID NO: 3977654 - DNA, 22 bp, Homo sapiens
acaggggcgtgaggtcccagga

SEQ ID NO: 3977655 - DNA, 19 bp, Homo sapiens
acagggggattctgagcag

SEQ ID NO: 3977656 - DNA, 22 bp, Homo sapiens
acagggggattctgagcagtgc

SEQ ID NO: 3977657 - DNA, 15 bp, Homo sapiens
acagggtacctcaag

SEQ ID NO: 3977658 - DNA, 23 bp, Homo sapiens
acagggtctgctctttctctgcc

SEQ ID NO: 3977659 - DNA, 15 bp, Homo sapiens
acagggtcttgctct

SEQ ID NO: 3977660 - DNA, 14 bp, Homo sapiens
acagggtctttttt

SEQ ID NO: 3977661 - DNA, 21 bp, Homo sapiens
acagggtgggcttcctgccct

SEQ ID NO: 3977662 - DNA, 20 bp, Homo sapiens
acagggtttttacctgtcac

SEQ ID NO: 3977663 - DNA, 23 bp, Homo sapiens
acagggtttttacctgtcacatt

SEQ ID NO: 3977664 - DNA, 16 bp, Homo sapiens
acaggtcttcatcgaa

SEQ ID NO: 3977665 - DNA, 19 bp, Homo sapiens
acaggtggcaggaccagga

SEQ ID NO: 3977666 - DNA, 12 bp, Homo sapiens
acaggtggggac

SEQ ID NO: 3977667 - DNA, 21 bp, Homo sapiens
acaggtggggactgggcacag

SEQ ID NO: 3977668 - DNA, 18 bp, Homo sapiens
acaggtgtggggacacag

SEQ ID NO: 3977669 - DNA, 19 bp, Homo sapiens
acaggttcttaaaaaggaa

SEQ ID NO: 3977670 - DNA, 20 bp, Homo sapiens
acaggttcttaaaaaggaac

SEQ ID NO: 3977671 - DNA, 15 bp, Homo sapiens
acagtacagcatgtg

SEQ ID NO: 3977672 - DNA, 19 bp, Homo sapiens
acagtacagcatgtgcctt

SEQ ID NO: 3977673 - DNA, 13 bp, Homo sapiens
acagtagaactgt

SEQ ID NO: 3977674 - DNA, 14 bp, Homo sapiens
acagtagtcttgat

SEQ ID NO: 3977675 - DNA, 22 bp, Homo sapiens
acagtatatcccaagtgcactt

SEQ ID NO: 3977676 - DNA, 15 bp, Homo sapiens
acagtatcttttctt

SEQ ID NO: 3977677 - DNA, 19 bp, Homo sapiens
acagtatgagtcaatgtgc

SEQ ID NO: 3977678 - DNA, 20 bp, Homo sapiens
acagtattatacgctggcaa

SEQ ID NO: 3977679 - DNA, 14 bp, Homo sapiens
acagtattatctgt

SEQ ID NO: 3977680 - DNA, 16 bp, Homo sapiens
acagtatttattttgt

SEQ ID NO: 3977681 - DNA, 17 bp, Homo sapiens
acagtcaaaacagagat

SEQ ID NO: 3977682 - DNA, 18 bp, Homo sapiens
acagtcaaaacagagatg

SEQ ID NO: 3977683 - DNA, 13 bp, Homo sapiens
acagtcaaaataa

SEQ ID NO: 3977684 - DNA, 15 bp, Homo sapiens
acagtcaggttgaag

SEQ ID NO: 3977685 - DNA, 14 bp, Homo sapiens
acagtcatcatcag

SEQ ID NO: 3977686 - DNA, 18 bp, Homo sapiens
acagtcatcatcagggcc

SEQ ID NO: 3977687 - DNA, 20 bp, Homo sapiens
acagtcatcatcagggcctg

SEQ ID NO: 3977688 - DNA, 15 bp, Homo sapiens
acagtcattctagga

SEQ ID NO: 3977689 - DNA, 19 bp, Homo sapiens
acagtcattctaggatgtg

SEQ ID NO: 3977690 - DNA, 13 bp, Homo sapiens
acagtcatttaaa

SEQ ID NO: 3977691 - DNA, 21 bp, Homo sapiens
acagtccagtgtcacctctct

SEQ ID NO: 3977692 - DNA, 18 bp, Homo sapiens
acagtccttaaaaatcac

SEQ ID NO: 3977693 - DNA, 16 bp, Homo sapiens
acagtcgtaaaagaga

SEQ ID NO: 3977694 - DNA, 19 bp, Homo sapiens
acagtctctttaatcttca

SEQ ID NO: 3977695 - DNA, 13 bp, Homo sapiens
acagtgaatgtgt

SEQ ID NO: 3977696 - DNA, 12 bp, Homo sapiens
acagtgagccaa

SEQ ID NO: 3977697 - DNA, 18 bp, Homo sapiens
acagtgatctccatatgt

SEQ ID NO: 3977698 - DNA, 21 bp, Homo sapiens
acagtgcacctgggacaggga

SEQ ID NO: 3977699 - DNA, 13 bp, Homo sapiens
acagtgcagacag

SEQ ID NO: 3977700 - DNA, 14 bp, Homo sapiens
acagtgcagacagg

SEQ ID NO: 3977701 - DNA, 14 bp, Homo sapiens
acagtgcagaggct

SEQ ID NO: 3977702 - DNA, 11 bp, Homo sapiens
acagtgccaaa

SEQ ID NO: 3977703 - DNA, 13 bp, Homo sapiens
acagtgccaaatg

SEQ ID NO: 3977704 - DNA, 14 bp, Homo sapiens
acagtgccaaatgc

SEQ ID NO: 3977705 - DNA, 15 bp, Homo sapiens
acagtgccaaatgct

SEQ ID NO: 3977706 - DNA, 23 bp, Homo sapiens
acagtgccaaatgctggggcagg

SEQ ID NO: 3977707 - DNA, 14 bp, Homo sapiens
acagtgcctgggaa

SEQ ID NO: 3977708 - DNA, 18 bp, Homo sapiens
acagtgcctgggaatgta

SEQ ID NO: 3977709 - DNA, 20 bp, Homo sapiens
acagtgctgaccagacagcc

SEQ ID NO: 3977710 - DNA, 17 bp, Homo sapiens
acagtgctttgtaaatt

SEQ ID NO: 3977711 - DNA, 18 bp, Homo sapiens
acagtggaatataaggaa

SEQ ID NO: 3977712 - DNA, 17 bp, Homo sapiens
acagtggattgcatttc

SEQ ID NO: 3977713 - DNA, 19 bp, Homo sapiens
acagtggctcgtatcccaa

SEQ ID NO: 3977714 - DNA, 14 bp, Homo sapiens
acagtgggagccct

SEQ ID NO: 3977715 - DNA, 15 bp, Homo sapiens
acagtgggcatcagc

SEQ ID NO: 3977716 - DNA, 18 bp, Homo sapiens
acagtgggcatcagcagc

SEQ ID NO: 3977717 - DNA, 20 bp, Homo sapiens
acagtggttttatactgaag

SEQ ID NO: 3977718 - DNA, 22 bp, Homo sapiens
acagtggttttatactgaagga

SEQ ID NO: 3977719 - DNA, 22 bp, Homo sapiens
acagtgttattttctttgaaat

SEQ ID NO: 3977720 - DNA, 16 bp, Homo sapiens
acagtgtttcccataa

SEQ ID NO: 3977721 - DNA, 22 bp, Homo sapiens
acagtgtttcccataattttct

SEQ ID NO: 3977722 - DNA, 13 bp, Homo sapiens
acagttaactttc

SEQ ID NO: 3977723 - DNA, 15 bp, Homo sapiens
acagttattttgata

SEQ ID NO: 3977724 - DNA, 13 bp, Homo sapiens
acagttattttgg

SEQ ID NO: 3977725 - DNA, 14 bp, Homo sapiens
acagttattttgga

SEQ ID NO: 3977726 - DNA, 16 bp, Homo sapiens
acagttattttggata

SEQ ID NO: 3977727 - DNA, 21 bp, Homo sapiens
acagttattttggatatatta

SEQ ID NO: 3977728 - DNA, 23 bp, Homo sapiens
acagttcaataaacttaacttta

SEQ ID NO: 3977729 - DNA, 15 bp, Homo sapiens
acagttcatatgtac

SEQ ID NO: 3977730 - DNA, 20 bp, Homo sapiens
acagttcatgtttgcttcat

SEQ ID NO: 3977731 - DNA, 18 bp, Homo sapiens
acagttctttgggccaga

SEQ ID NO: 3977732 - DNA, 20 bp, Homo sapiens
acagttgccaccacctctgt

SEQ ID NO: 3977733 - DNA, 21 bp, Homo sapiens
acagttgccaccacctctgtg

SEQ ID NO: 3977734 - DNA, 15 bp, Homo sapiens
acagttgctgtcata

SEQ ID NO: 3977735 - DNA, 17 bp, Homo sapiens
acagtttcttagctttt

SEQ ID NO: 3977736 - DNA, 14 bp, Homo sapiens
acagttttcagaaa

SEQ ID NO: 3977737 - DNA, 12 bp, Homo sapiens
acagttttccat

SEQ ID NO: 3977738 - DNA, 17 bp, Homo sapiens
acagttttccatgaaaa

SEQ ID NO: 3977739 - DNA, 23 bp, Homo sapiens
acataaaaagcagaattttaatg

SEQ ID NO: 3977740 - DNA, 14 bp, Homo sapiens
acataaaaaggaca

SEQ ID NO: 3977741 - DNA, 16 bp, Homo sapiens
acagctgaggtctctt

SEQ ID NO: 3977742 - DNA, 19 bp, Homo sapiens
acagctgagttatgatgta

SEQ ID NO: 3977743 - DNA, 17 bp, Homo sapiens
acagctgataaatttaa

SEQ ID NO: 3977744 - DNA, 21 bp, Homo sapiens
acagctgataaatttaatcct

SEQ ID NO: 3977745 - DNA, 19 bp, Homo sapiens
acagctgccctagctgacc

SEQ ID NO: 3977746 - DNA, 13 bp, Homo sapiens
acagctgctgttc

SEQ ID NO: 3977747 - DNA, 18 bp, Homo sapiens
acagctgctgttctcagg

SEQ ID NO: 3977748 - DNA, 13 bp, Homo sapiens
acagctggatctg

SEQ ID NO: 3977749 - DNA, 13 bp, Homo sapiens
acagctggctctg

SEQ ID NO: 3977750 - DNA, 17 bp, Homo sapiens
acagctgggcaaagcca

SEQ ID NO: 3977751 - DNA, 23 bp, Homo sapiens
acagctgtgtgacatttggagag

SEQ ID NO: 3977752 - DNA, 12 bp, Homo sapiens
acagctgtgtta

SEQ ID NO: 3977753 - DNA, 14 bp, Homo sapiens
acagcttagatttc

SEQ ID NO: 3977754 - DNA, 18 bp, Homo sapiens
acagcttagatttcatag

SEQ ID NO: 3977755 - DNA, 21 bp, Homo sapiens
acagcttcaccctgtcaagtt

SEQ ID NO: 3977756 - DNA, 13 bp, Homo sapiens
acagcttcaggtt

SEQ ID NO: 3977757 - DNA, 21 bp, Homo sapiens
acagcttcattttatttttga

SEQ ID NO: 3977758 - DNA, 21 bp, Homo sapiens
acagcttgagccgggcccctg

SEQ ID NO: 3977759 - DNA, 22 bp, Homo sapiens
acagctttcttgctcccttcag

SEQ ID NO: 3977760 - DNA, 13 bp, Homo sapiens
acagcttttgcaa

SEQ ID NO: 3977761 - DNA, 21 bp, Homo sapiens
acagcttttgcaacttaatac

SEQ ID NO: 3977762 - DNA, 14 bp, Homo sapiens
acaggaaaaacaaa

SEQ ID NO: 3977763 - DNA, 20 bp, Homo sapiens
acaggaaaattttaaaaata

SEQ ID NO: 3977764 - DNA, 17 bp, Homo sapiens
acaggaaagccctcccc

SEQ ID NO: 3977765 - DNA, 18 bp, Homo sapiens
acaggaaagccctccccc

SEQ ID NO: 3977766 - DNA, 20 bp, Homo sapiens
acaggaagcaccccatgcca

SEQ ID NO: 3977767 - DNA, 14 bp, Homo sapiens
acaggaaggagggg

SEQ ID NO: 3977768 - DNA, 17 bp, Homo sapiens
acaggaaggaggggaga

SEQ ID NO: 3977769 - DNA, 22 bp, Homo sapiens
acaggaaggaggggagagacag

SEQ ID NO: 3977770 - DNA, 17 bp, Homo sapiens
acaggaagtcttcaggg

SEQ ID NO: 3977771 - DNA, 15 bp, Homo sapiens
acaggacagagttca

SEQ ID NO: 3977772 - DNA, 14 bp, Homo sapiens
acaggacttttaaa

SEQ ID NO: 3977773 - DNA, 14 bp, Homo sapiens
acaggagcctagcg

SEQ ID NO: 3977774 - DNA, 17 bp, Homo sapiens
acaggagcctagcggag

SEQ ID NO: 3977775 - DNA, 18 bp, Homo sapiens
acaggaggaggagatggc

SEQ ID NO: 3977776 - DNA, 13 bp, Homo sapiens
acaggaggccagt

SEQ ID NO: 3977777 - DNA, 16 bp, Homo sapiens
acaggaggcggcccgg

SEQ ID NO: 3977778 - DNA, 17 bp, Homo sapiens
acaggaggcggcccggc

SEQ ID NO: 3977779 - DNA, 21 bp, Homo sapiens
acaggaggcggcccggccagc

SEQ ID NO: 3977780 - DNA, 19 bp, Homo sapiens
acaggagtcagtgtctggc

SEQ ID NO: 3977781 - DNA, 20 bp, Homo sapiens
acaggagtcagtgtctggct

SEQ ID NO: 3977782 - DNA, 17 bp, Homo sapiens
acaggagtgtcctcttc

SEQ ID NO: 3977783 - DNA, 23 bp, Homo sapiens
acaggagtgtcctcttccctctc

SEQ ID NO: 3977784 - DNA, 19 bp, Homo sapiens
acaggatgggggctggcct

SEQ ID NO: 3977785 - DNA, 20 bp, Homo sapiens
acaggatttgaactcagatc

SEQ ID NO: 3977786 - DNA, 14 bp, Homo sapiens
acaggcaaatgcat

SEQ ID NO: 3977787 - DNA, 9 bp, Homo sapiens
acaggcagc

SEQ ID NO: 3977788 - DNA, 16 bp, Homo sapiens
acaggcagcccagcag

SEQ ID NO: 3977789 - DNA, 15 bp, Homo sapiens
acaggcagctttcta

SEQ ID NO: 3977790 - DNA, 17 bp, Homo sapiens
acaggcagctttctaga

SEQ ID NO: 3977791 - DNA, 19 bp, Homo sapiens
acaggcagctttctagaag

SEQ ID NO: 3977792 - DNA, 21 bp, Homo sapiens
acaggcataaaatagagtaaa

SEQ ID NO: 3977793 - DNA, 21 bp, Homo sapiens
acaggcatctacacagcctgg

SEQ ID NO: 3977794 - DNA, 22 bp, Homo sapiens
acaggcatgaggaatctgggag

SEQ ID NO: 3977795 - DNA, 16 bp, Homo sapiens
acagagcgcccctccc

SEQ ID NO: 3977796 - DNA, 20 bp, Homo sapiens
acagagcgtccttccccctg

SEQ ID NO: 3977797 - DNA, 13 bp, Homo sapiens
acagagctctggg

SEQ ID NO: 3977798 - DNA, 17 bp, Homo sapiens
acagaggaaagggctgg

SEQ ID NO: 3977799 - DNA, 21 bp, Homo sapiens
acagaggaatttatacctcaa

SEQ ID NO: 3977800 - DNA, 16 bp, Homo sapiens
acagaggccccagcct

SEQ ID NO: 3977801 - DNA, 18 bp, Homo sapiens
acagaggccccagcctcc

SEQ ID NO: 3977802 - DNA, 16 bp, Homo sapiens
acagagtgcttttctg

SEQ ID NO: 3977803 - DNA, 18 bp, Homo sapiens
acagagtggcctccctgc

SEQ ID NO: 3977804 - DNA, 19 bp, Homo sapiens
acagagtggcctccctgct

SEQ ID NO: 3977805 - DNA, 13 bp, Homo sapiens
acagagttcacag

SEQ ID NO: 3977806 - DNA, 17 bp, Homo sapiens
acagagttcacaggagg

SEQ ID NO: 3977807 - DNA, 13 bp, Homo sapiens
acagataagcaag

SEQ ID NO: 3977808 - DNA, 18 bp, Homo sapiens
acagataagcaagagaga

SEQ ID NO: 3977809 - DNA, 20 bp, Homo sapiens
acagataagcaagagagatg

SEQ ID NO: 3977810 - DNA, 22 bp, Homo sapiens
acagatactggaagttttgcat

SEQ ID NO: 3977811 - DNA, 18 bp, Homo sapiens
acagatatttccatttct

SEQ ID NO: 3977812 - DNA, 23 bp, Homo sapiens
acagatcccatccatcagctccc

SEQ ID NO: 3977813 - DNA, 19 bp, Homo sapiens
acagatcctttttccatca

SEQ ID NO: 3977814 - DNA, 20 bp, Homo sapiens
acagatctcagggctcggga

SEQ ID NO: 3977815 - DNA, 14 bp, Homo sapiens
acagatctggaacc

SEQ ID NO: 3977816 - DNA, 23 bp, Homo sapiens
acagatgaaaatttgagactatt

SEQ ID NO: 3977817 - DNA, 19 bp, Homo sapiens
acagatgaactctttctgg

SEQ ID NO: 3977818 - DNA, 17 bp, Homo sapiens
acagatgaatgtattta

SEQ ID NO: 3977819 - DNA, 16 bp, Homo sapiens
acagatgcaatgtgct

SEQ ID NO: 3977820 - DNA, 16 bp, Homo sapiens
acagatgccccagagc

SEQ ID NO: 3977821 - DNA, 19 bp, Homo sapiens
acagatgccccagagctgt

SEQ ID NO: 3977822 - DNA, 21 bp, Homo sapiens
acagatgccccagagctgttt

SEQ ID NO: 3977823 - DNA, 22 bp, Homo sapiens
acagatgccccagagctgttta

SEQ ID NO: 3977824 - DNA, 18 bp, Homo sapiens
acagatgccttttttgta

SEQ ID NO: 3977825 - DNA, 19 bp, Homo sapiens
acagatgccttttttgtag

SEQ ID NO: 3977826 - DNA, 16 bp, Homo sapiens
acagatgctaataaac

SEQ ID NO: 3977827 - DNA, 20 bp, Homo sapiens
acagatgctaataaactgtt

SEQ ID NO: 3977828 - DNA, 19 bp, Homo sapiens
acagatggaaaaactgagg

SEQ ID NO: 3977829 - DNA, 21 bp, Homo sapiens
acagatggaaaaactgaggct

SEQ ID NO: 3977830 - DNA, 16 bp, Homo sapiens
acagatggatttgcct

SEQ ID NO: 3977831 - DNA, 17 bp, Homo sapiens
acagatggatttgcctg

SEQ ID NO: 3977832 - DNA, 16 bp, Homo sapiens
acagatgggcaaatta

SEQ ID NO: 3977833 - DNA, 20 bp, Homo sapiens
acagatgtcagccgagccgg

SEQ ID NO: 3977834 - DNA, 14 bp, Homo sapiens
acagatgtctctgg

SEQ ID NO: 3977835 - DNA, 18 bp, Homo sapiens
acagatgtctctggggca

SEQ ID NO: 3977836 - DNA, 18 bp, Homo sapiens
acagattcaggccagccc

SEQ ID NO: 3977837 - DNA, 20 bp, Homo sapiens
acagattcaggccagcccag

SEQ ID NO: 3977838 - DNA, 23 bp, Homo sapiens
acagattcaggccagcccagcca

SEQ ID NO: 3977839 - DNA, 15 bp, Homo sapiens
acagatttcatacct

SEQ ID NO: 3977840 - DNA, 15 bp, Homo sapiens
acagatttttacaaa

SEQ ID NO: 3977841 - DNA, 19 bp, Homo sapiens
acagcaacagcaagaaata

SEQ ID NO: 3977842 - DNA, 17 bp, Homo sapiens
acagcacctccccgctg

SEQ ID NO: 3977843 - DNA, 18 bp, Homo sapiens
acagcactactgggtgtc

SEQ ID NO: 3977844 - DNA, 15 bp, Homo sapiens
acagcagaggttctt

SEQ ID NO: 3977845 - DNA, 19 bp, Homo sapiens
aatttttttaatttacaaa

SEQ ID NO: 3977846 - DNA, 23 bp, Homo sapiens
aatttttttatgttttgtttctg

SEQ ID NO: 3977847 - DNA, 15 bp, Homo sapiens
aatttttttattact

SEQ ID NO: 3977848 - DNA, 17 bp, Homo sapiens
aatttttttattactga

SEQ ID NO: 3977849 - DNA, 16 bp, Homo sapiens
aatttttttgtcttta

SEQ ID NO: 3977850 - DNA, 20 bp, Homo sapiens
aattttttttaaaatagaaa

SEQ ID NO: 3977851 - DNA, 20 bp, Homo sapiens
aatttttttttcatagagat

SEQ ID NO: 3977852 - DNA, 17 bp, Homo sapiens
acaaaaaaaaagtttta

SEQ ID NO: 3977853 - DNA, 17 bp, Homo sapiens
acaaaaaaatttaaaat

SEQ ID NO: 3977854 - DNA, 14 bp, Homo sapiens
acaaaaaaccgagg

SEQ ID NO: 3977855 - DNA, 13 bp, Homo sapiens
acaaaaacaggta

SEQ ID NO: 3977856 - DNA, 20 bp, Homo sapiens
acaaaaacaggtatatactt

SEQ ID NO: 3977857 - DNA, 15 bp, Homo sapiens
acaaaaagcttcccc

SEQ ID NO: 3977858 - DNA, 15 bp, Homo sapiens
acaaaactacatgag

SEQ ID NO: 3977859 - DNA, 15 bp, Homo sapiens
acaaaagaaatacct

SEQ ID NO: 3977860 - DNA, 16 bp, Homo sapiens
acaaaagaaatacctt

SEQ ID NO: 3977861 - DNA, 21 bp, Homo sapiens
acaaaagagcagcatttttaa

SEQ ID NO: 3977862 - DNA, 21 bp, Homo sapiens
acaaaagcattcggagggagg

SEQ ID NO: 3977863 - DNA, 10 bp, Homo sapiens
acaaaaggca

SEQ ID NO: 3977864 - DNA, 16 bp, Homo sapiens
acaaaataaaataata

SEQ ID NO: 3977865 - DNA, 22 bp, Homo sapiens
acaaaatctaaaacaaaatctg

SEQ ID NO: 3977866 - DNA, 14 bp, Homo sapiens
acaaaatctgaact

SEQ ID NO: 3977867 - DNA, 19 bp, Homo sapiens
acaaaatctgaactctcaa

SEQ ID NO: 3977868 - DNA, 20 bp, Homo sapiens
acaaaatgtagggttataat

SEQ ID NO: 3977869 - DNA, 20 bp, Homo sapiens
acaaaattgcaatttcttag

SEQ ID NO: 3977870 - DNA, 15 bp, Homo sapiens
acaaaattttatttt

SEQ ID NO: 3977871 - DNA, 13 bp, Homo sapiens
acaaacaaaagca

SEQ ID NO: 3977872 - DNA, 12 bp, Homo sapiens
acaaacacacac

SEQ ID NO: 3977873 - DNA, 14 bp, Homo sapiens
acaaacagatgctc

SEQ ID NO: 3977874 - DNA, 12 bp, Homo sapiens
acaaaccaagtc

SEQ ID NO: 3977875 - DNA, 14 bp, Homo sapiens
acaaactggagtct

SEQ ID NO: 3977876 - DNA, 17 bp, Homo sapiens
acaaactggtattctgt

SEQ ID NO: 3977877 - DNA, 22 bp, Homo sapiens
acaaagatgtttgtcagatatg

SEQ ID NO: 3977878 - DNA, 13 bp, Homo sapiens
acaaagcagccac

SEQ ID NO: 3977879 - DNA, 20 bp, Homo sapiens
acaaagcttctatcccagga

SEQ ID NO: 3977880 - DNA, 23 bp, Homo sapiens
acaaaggcaagttaagagaaact

SEQ ID NO: 3977881 - DNA, 19 bp, Homo sapiens
acaaagtaaatacaagact

SEQ ID NO: 3977882 - DNA, 21 bp, Homo sapiens
acaaagtaaatacaagactgt

SEQ ID NO: 3977883 - DNA, 14 bp, Homo sapiens
acaaagtaatttct

SEQ ID NO: 3977884 - DNA, 18 bp, Homo sapiens
acaaataaaattggcacc

SEQ ID NO: 3977885 - DNA, 20 bp, Homo sapiens
acaaatagtgcaactatgaa

SEQ ID NO: 3977886 - DNA, 19 bp, Homo sapiens
acaaatattcactggcccc

SEQ ID NO: 3977887 - DNA, 20 bp, Homo sapiens
acaaatctataaagaaggat

SEQ ID NO: 3977888 - DNA, 15 bp, Homo sapiens
acaaatctgtataaa

SEQ ID NO: 3977889 - DNA, 20 bp, Homo sapiens
acaaatggagctttctgtat

SEQ ID NO: 3977890 - DNA, 22 bp, Homo sapiens
acaaatgtattttgaagaatat

SEQ ID NO: 3977891 - DNA, 22 bp, Homo sapiens
acaaattatgttacatctgttt

SEQ ID NO: 3977892 - DNA, 14 bp, Homo sapiens
acaacacacacact

SEQ ID NO: 3977893 - DNA, 13 bp, Homo sapiens
acaacagaagtca

SEQ ID NO: 3977894 - DNA, 16 bp, Homo sapiens
acaacagctgaagcac

SEQ ID NO: 3977895 - DNA, 19 bp, Homo sapiens
acaaccatccctgccacat

SEQ ID NO: 3977896 - DNA, 14 bp, Homo sapiens
acaacccccagctc

SEQ ID NO: 3977897 - DNA, 16 bp, Homo sapiens
acaacccccagctccc

SEQ ID NO: 3977898 - DNA, 18 bp, Homo sapiens
acaaccctgttttatact

SEQ ID NO: 3977899 - DNA, 14 bp, Homo sapiens
acaacctagaatgt

SEQ ID NO: 3977900 - DNA, 16 bp, Homo sapiens
acaacgagccttttca

SEQ ID NO: 3977901 - DNA, 10 bp, Homo sapiens
acaactaagt

SEQ ID NO: 3977902 - DNA, 22 bp, Homo sapiens
acaactaagtgatttgtatgtc

SEQ ID NO: 3977903 - DNA, 17 bp, Homo sapiens
acaactatggatcagaa

SEQ ID NO: 3977904 - DNA, 13 bp, Homo sapiens
acaacttagtgta

SEQ ID NO: 3977905 - DNA, 18 bp, Homo sapiens
acaacttatttaaaaata

SEQ ID NO: 3977906 - DNA, 15 bp, Homo sapiens
acaacttgatttttt

SEQ ID NO: 3977907 - DNA, 18 bp, Homo sapiens
acaacttgattttttcaa

SEQ ID NO: 3977908 - DNA, 14 bp, Homo sapiens
acactcctagagaa

SEQ ID NO: 3977909 - DNA, 23 bp, Homo sapiens
acactcctagagaacgcagccct

SEQ ID NO: 3977910 - DNA, 16 bp, Homo sapiens
acactctgctgtttga

SEQ ID NO: 3977911 - DNA, 16 bp, Homo sapiens
acactctttgtaagag

SEQ ID NO: 3977912 - DNA, 21 bp, Homo sapiens
acactcttttgctttattcca

SEQ ID NO: 3977913 - DNA, 23 bp, Homo sapiens
acactgaaaaatctaagtgatat

SEQ ID NO: 3977914 - DNA, 13 bp, Homo sapiens
acactgaaaaatt

SEQ ID NO: 3977915 - DNA, 21 bp, Homo sapiens
acactgaaagctctgttgcaa

SEQ ID NO: 3977916 - DNA, 14 bp, Homo sapiens
acactgaaagtttt

SEQ ID NO: 3977917 - DNA, 23 bp, Homo sapiens
acactgaaagttttgtaaaagaa

SEQ ID NO: 3977918 - DNA, 18 bp, Homo sapiens
acactgaatatttatatt

SEQ ID NO: 3977919 - DNA, 23 bp, Homo sapiens
acactgaatatttatatttcact

SEQ ID NO: 3977920 - DNA, 17 bp, Homo sapiens
acactgaccatccactc

SEQ ID NO: 3977921 - DNA, 14 bp, Homo sapiens
acactgagccccac

SEQ ID NO: 3977922 - DNA, 14 bp, Homo sapiens
acactgaggcagcc

SEQ ID NO: 3977923 - DNA, 16 bp, Homo sapiens
acactgcagtttcctg

SEQ ID NO: 3977924 - DNA, 15 bp, Homo sapiens
acactgctgtaccca

SEQ ID NO: 3977925 - DNA, 21 bp, Homo sapiens
acactgctgtacccagatgcc

SEQ ID NO: 3977926 - DNA, 13 bp, Homo sapiens
acactggcccctc

SEQ ID NO: 3977927 - DNA, 14 bp, Homo sapiens
acactggcccctca

SEQ ID NO: 3977928 - DNA, 22 bp, Homo sapiens
acactggctaaagataattgct

SEQ ID NO: 3977929 - DNA, 23 bp, Homo sapiens
acactgggtggtggcctggtccc

SEQ ID NO: 3977930 - DNA, 14 bp, Homo sapiens
acactggtgactgc

SEQ ID NO: 3977931 - DNA, 20 bp, Homo sapiens
acactggtgtgacctgaggg

SEQ ID NO: 3977932 - DNA, 21 bp, Homo sapiens
acactggtgtgacctgagggc

SEQ ID NO: 3977933 - DNA, 17 bp, Homo sapiens
acactgtcatgcttcat

SEQ ID NO: 3977934 - DNA, 16 bp, Homo sapiens
acactgtgacatctct

SEQ ID NO: 3977935 - DNA, 22 bp, Homo sapiens
acactgtgcccagcccggacct

SEQ ID NO: 3977936 - DNA, 23 bp, Homo sapiens
acactgtgcccagcccggacctt

SEQ ID NO: 3977937 - DNA, 16 bp, Homo sapiens
acactgttactccaca

SEQ ID NO: 3977938 - DNA, 20 bp, Homo sapiens
acactgttctgaaagtgact

SEQ ID NO: 3977939 - DNA, 16 bp, Homo sapiens
acacttaaaattgtaa

SEQ ID NO: 3977940 - DNA, 14 bp, Homo sapiens
acacttaatactac

SEQ ID NO: 3977941 - DNA, 16 bp, Homo sapiens
acacttacactttatg

SEQ ID NO: 3977942 - DNA, 21 bp, Homo sapiens
acacttacactttatgcacaa

SEQ ID NO: 3977943 - DNA, 19 bp, Homo sapiens
acacttagggtttggagct

SEQ ID NO: 3977944 - DNA, 14 bp, Homo sapiens
acacttataagtga

SEQ ID NO: 3977945 - DNA, 19 bp, Homo sapiens
acacttcagagagctggta

SEQ ID NO: 3977946 - DNA, 15 bp, Homo sapiens
acacttcaggctctt

SEQ ID NO: 3977947 - DNA, 22 bp, Homo sapiens
acacttcaggctcttctccttt

SEQ ID NO: 3977948 - DNA, 14 bp, Homo sapiens
acacttgagaggat

SEQ ID NO: 3977949 - DNA, 16 bp, Homo sapiens
acacttgagaggatga

SEQ ID NO: 3977950 - DNA, 18 bp, Homo sapiens
acacttgagaggatgaat

SEQ ID NO: 3977951 - DNA, 14 bp, Homo sapiens
acacttgtcggctc

SEQ ID NO: 3977952 - DNA, 13 bp, Homo sapiens
acacttgtgtgtg

SEQ ID NO: 3977953 - DNA, 16 bp, Homo sapiens
acacttgtgtgtgggc

SEQ ID NO: 3977954 - DNA, 20 bp, Homo sapiens
acacttgttccagctctttg

SEQ ID NO: 3977955 - DNA, 22 bp, Homo sapiens
aatgaattttccacgcagttct

SEQ ID NO: 3977956 - DNA, 17 bp, Homo sapiens
aatgaatttttatgata

SEQ ID NO: 3977957 - DNA, 22 bp, Homo sapiens
aatgacatctcaggggccagag

SEQ ID NO: 3977958 - DNA, 18 bp, Homo sapiens
aatgacatcttcaaagct

SEQ ID NO: 3977959 - DNA, 14 bp, Homo sapiens
aatgaccaatatta

SEQ ID NO: 3977960 - DNA, 16 bp, Homo sapiens
aatgactaattagggt

SEQ ID NO: 3977961 - DNA, 20 bp, Homo sapiens
aatgactcagaatattgctt

SEQ ID NO: 3977962 - DNA, 22 bp, Homo sapiens
aatgacttatttctgctctgga

SEQ ID NO: 3977963 - DNA, 19 bp, Homo sapiens
aatgagaattttatattct

SEQ ID NO: 3977964 - DNA, 16 bp, Homo sapiens
aatgagattgaatttc

SEQ ID NO: 3977965 - DNA, 18 bp, Homo sapiens
aatgagcaatatctgcta

SEQ ID NO: 3977966 - DNA, 14 bp, Homo sapiens
aatgagcacctcca

SEQ ID NO: 3977967 - DNA, 21 bp, Homo sapiens
aatgagccatcactagaagaa

SEQ ID NO: 3977968 - DNA, 22 bp, Homo sapiens
aatgagccatcactagaagaaa

SEQ ID NO: 3977969 - DNA, 12 bp, Homo sapiens
aatgagctcctg

SEQ ID NO: 3977970 - DNA, 14 bp, Homo sapiens
aatgagctcctgcg

SEQ ID NO: 3977971 - DNA, 20 bp, Homo sapiens
aatgagggactggaaccagg

SEQ ID NO: 3977972 - DNA, 22 bp, Homo sapiens
aatgataaaataaataatttta

SEQ ID NO: 3977973 - DNA, 18 bp, Homo sapiens
aatgataccctgaatttg

SEQ ID NO: 3977974 - DNA, 12 bp, Homo sapiens
aatgatgataac

SEQ ID NO: 3977975 - DNA, 17 bp, Homo sapiens
aatgatgattaaacacc

SEQ ID NO: 3977976 - DNA, 22 bp, Homo sapiens
aatgatggtaggaagaagctct

SEQ ID NO: 3977977 - DNA, 18 bp, Homo sapiens
aatgatgtccagaagaat

SEQ ID NO: 3977978 - DNA, 14 bp, Homo sapiens
aatgatgtgaccct

SEQ ID NO: 3977979 - DNA, 20 bp, Homo sapiens
aatatttattattttcacct

SEQ ID NO: 3977980 - DNA, 13 bp, Homo sapiens
aatatttatttat

SEQ ID NO: 3977981 - DNA, 13 bp, Homo sapiens
aatatttccatat

SEQ ID NO: 3977982 - DNA, 19 bp, Homo sapiens
aatatttcctgacttgagt

SEQ ID NO: 3977983 - DNA, 19 bp, Homo sapiens
aatatttccttaaactgtg

SEQ ID NO: 3977984 - DNA, 18 bp, Homo sapiens
aatatttctattgaattc

SEQ ID NO: 3977985 - DNA, 15 bp, Homo sapiens
aatatttgaatgaaa

SEQ ID NO: 3977986 - DNA, 17 bp, Homo sapiens
aatattttatctttcct

SEQ ID NO: 3977987 - DNA, 21 bp, Homo sapiens
aatattttctttaatgctttt

SEQ ID NO: 3977988 - DNA, 15 bp, Homo sapiens
aatattttggaaact

SEQ ID NO: 3977989 - DNA, 14 bp, Homo sapiens
aatatttttagata

SEQ ID NO: 3977990 - DNA, 23 bp, Homo sapiens
aatatttttatatacagaggaaa

SEQ ID NO: 3977991 - DNA, 18 bp, Homo sapiens
aatatttttatatttcct

SEQ ID NO: 3977992 - DNA, 20 bp, Homo sapiens
aatatttttatatttccttt

SEQ ID NO: 3977993 - DNA, 17 bp, Homo sapiens
aatattttttgcaagtt

SEQ ID NO: 3977994 - DNA, 18 bp, Homo sapiens
aatcaaaactctcctaca

SEQ ID NO: 3977995 - DNA, 13 bp, Homo sapiens
aatcaaaattgtc

SEQ ID NO: 3977996 - DNA, 23 bp, Homo sapiens
actgttaactatgacagatatat

SEQ ID NO: 3977997 - DNA, 17 bp, Homo sapiens
actgttactccacagcg

SEQ ID NO: 3977998 - DNA, 20 bp, Homo sapiens
actgttagaaaatggacact

SEQ ID NO: 3977999 - DNA, 14 bp, Homo sapiens
actgttatttaatt

SEQ ID NO: 3978000 - DNA, 15 bp, Homo sapiens
actgttatttaattg

SEQ ID NO: 3978001 - DNA, 23 bp, Homo sapiens
actgttccaaagccagtgaaatg

SEQ ID NO: 3978002 - DNA, 20 bp, Homo sapiens
actgttccctctgctcctgg

SEQ ID NO: 3978003 - DNA, 12 bp, Homo sapiens
actgttctgcaa

SEQ ID NO: 3978004 - DNA, 14 bp, Homo sapiens
actgttctgcaaag

SEQ ID NO: 3978005 - DNA, 20 bp, Homo sapiens
actgttctgcaaaggtggca

SEQ ID NO: 3978006 - DNA, 13 bp, Homo sapiens
actgttctgtgtc

SEQ ID NO: 3978007 - DNA, 17 bp, Homo sapiens
actgttctgtgtctttc

SEQ ID NO: 3978008 - DNA, 16 bp, Homo sapiens
actgttgatgaagtat

SEQ ID NO: 3978009 - DNA, 20 bp, Homo sapiens
actgttgatgaagtatactt

SEQ ID NO: 3978010 - DNA, 21 bp, Homo sapiens
actgttgatgaagtatacttt

SEQ ID NO: 3978011 - DNA, 18 bp, Homo sapiens
actgttgcatttactttt

SEQ ID NO: 3978012 - DNA, 13 bp, Homo sapiens
actgttgccacca

SEQ ID NO: 3978013 - DNA, 20 bp, Homo sapiens
actgttgtaactaggctcag

SEQ ID NO: 3978014 - DNA, 21 bp, Homo sapiens
actgttgtgatcttgcattca

SEQ ID NO: 3978015 - DNA, 19 bp, Homo sapiens
actgtttaacaacatggct

SEQ ID NO: 3978016 - DNA, 19 bp, Homo sapiens
actgtttatttctgtttct

SEQ ID NO: 3978017 - DNA, 21 bp, Homo sapiens
actgtttcactgaaatgtttg

SEQ ID NO: 3978018 - DNA, 13 bp, Homo sapiens
actgtttctctgc

SEQ ID NO: 3978019 - DNA, 14 bp, Homo sapiens
actgtttctctgct

SEQ ID NO: 3978020 - DNA, 15 bp, Homo sapiens
actgtttctctgctg

SEQ ID NO: 3978021 - DNA, 14 bp, Homo sapiens
actgtttggcttat

SEQ ID NO: 3978022 - DNA, 17 bp, Homo sapiens
actgttttccagttcat

SEQ ID NO: 3978023 - DNA, 18 bp, Homo sapiens
actgtttttaagtaactt

SEQ ID NO: 3978024 - DNA, 21 bp, Homo sapiens
actcagtgagcctcctgtgcc

SEQ ID NO: 3978025 - DNA, 18 bp, Homo sapiens
actcagtgttagagaaat

SEQ ID NO: 3978026 - DNA, 17 bp, Homo sapiens
actcagttccaggcctg

SEQ ID NO: 3978027 - DNA, 22 bp, Homo sapiens
actcagttccaggcctgatctt

SEQ ID NO: 3978028 - DNA, 13 bp, Homo sapiens
actcagtttgtca

SEQ ID NO: 3978029 - DNA, 13 bp, Homo sapiens
actctccatctta

SEQ ID NO: 3978030 - DNA, 10 bp, Homo sapiens
actctcccca

SEQ ID NO: 3978031 - DNA, 20 bp, Homo sapiens
actctccccacgagggctgg

SEQ ID NO: 3978032 - DNA, 17 bp, Homo sapiens
actctctgcctggtggt

SEQ ID NO: 3978033 - DNA, 17 bp, Homo sapiens
actctgaagcctctggg

SEQ ID NO: 3978034 - DNA, 13 bp, Homo sapiens
actctgactcatc

SEQ ID NO: 3978035 - DNA, 18 bp, Homo sapiens
actctgagcgggaggcag

SEQ ID NO: 3978036 - DNA, 18 bp, Homo sapiens
actctgagtccactgctc

SEQ ID NO: 3978037 - DNA, 18 bp, Homo sapiens
actctgcatcccagcacc

SEQ ID NO: 3978038 - DNA, 18 bp, Homo sapiens
actctgccccctgctggc

SEQ ID NO: 3978039 - DNA, 21 bp, Homo sapiens
actctgccccctgctggctct

SEQ ID NO: 3978040 - DNA, 22 bp, Homo sapiens
actctggaatgtttttccctcc

SEQ ID NO: 3978041 - DNA, 12 bp, Homo sapiens
actctgggctgt

SEQ ID NO: 3978042 - DNA, 17 bp, Homo sapiens
actctggtttctcattc

SEQ ID NO: 3978043 - DNA, 16 bp, Homo sapiens
actctgtcagatggga

SEQ ID NO: 3978044 - DNA, 21 bp, Homo sapiens
actctgtcagccagccgccct

SEQ ID NO: 3978045 - DNA, 21 bp, Homo sapiens
actctgtcgagcctgggggct

SEQ ID NO: 3978046 - DNA, 14 bp, Homo sapiens
actctgtcttaaat

SEQ ID NO: 3978047 - DNA, 16 bp, Homo sapiens
actctgtcttaaatga

SEQ ID NO: 3978048 - DNA, 13 bp, Homo sapiens
actcttaatctgt

SEQ ID NO: 3978049 - DNA, 18 bp, Homo sapiens
actcttaatctgtgtgta

SEQ ID NO: 3978050 - DNA, 19 bp, Homo sapiens
actcttaggaagagaaacc

SEQ ID NO: 3978051 - DNA, 20 bp, Homo sapiens
actcttaggaagagaaacca

SEQ ID NO: 3978052 - DNA, 22 bp, Homo sapiens
actcttcctatttttgtagtga

SEQ ID NO: 3978053 - DNA, 15 bp, Homo sapiens
actcttctcggctca

SEQ ID NO: 3978054 - DNA, 18 bp, Homo sapiens
actcttctcggctcaggc

SEQ ID NO: 3978055 - DNA, 13 bp, Homo sapiens
actcttctctctg

SEQ ID NO: 3978056 - DNA, 18 bp, Homo sapiens
actcttctttaagccata

SEQ ID NO: 3978057 - DNA, 19 bp, Homo sapiens
actcttgatctctcttgtc

SEQ ID NO: 3978058 - DNA, 10 bp, Homo sapiens
actcttgatg

SEQ ID NO: 3978059 - DNA, 16 bp, Homo sapiens
actcttgattatccat

SEQ ID NO: 3978060 - DNA, 13 bp, Homo sapiens
actctttagagca

SEQ ID NO: 3978061 - DNA, 14 bp, Homo sapiens
actctttagagcag

SEQ ID NO: 3978062 - DNA, 17 bp, Homo sapiens
actctttctaatgctga

SEQ ID NO: 3978063 - DNA, 22 bp, Homo sapiens
actctttctgtatatacttttt

SEQ ID NO: 3978064 - DNA, 17 bp, Homo sapiens
actcttttgagtggtaa

SEQ ID NO: 3978065 - DNA, 21 bp, Homo sapiens
actcttttgctttattccaga

SEQ ID NO: 3978066 - DNA, 19 bp, Homo sapiens
actctttttagggccaggc

SEQ ID NO: 3978067 - DNA, 16 bp, Homo sapiens
actgaaaaattatact

SEQ ID NO: 3978068 - DNA, 13 bp, Homo sapiens
actgaaaatgtaa

SEQ ID NO: 3978069 - DNA, 14 bp, Homo sapiens
actgaaaatgtaaa

SEQ ID NO: 3978070 - DNA, 13 bp, Homo sapiens
actgaaacagatt

SEQ ID NO: 3978071 - DNA, 18 bp, Homo sapiens
actgaaacagatttcata

SEQ ID NO: 3978072 - DNA, 14 bp, Homo sapiens
actgaagcctgcag

SEQ ID NO: 3978073 - DNA, 16 bp, Homo sapiens
actgaagcctgcagga

SEQ ID NO: 3978074 - DNA, 17 bp, Homo sapiens
actgaagtgcttagtgt

SEQ ID NO: 3978075 - DNA, 21 bp, Homo sapiens
actgaagttaacagagacaga

SEQ ID NO: 3978076 - DNA, 15 bp, Homo sapiens
actgaagtttcacat

SEQ ID NO: 3978077 - DNA, 17 bp, Homo sapiens
actgaatataaagctta

SEQ ID NO: 3978078 - DNA, 18 bp, Homo sapiens
actgaatataaagcttaa

SEQ ID NO: 3978079 - DNA, 18 bp, Homo sapiens
actgaatatttatatttc

SEQ ID NO: 3978080 - DNA, 15 bp, Homo sapiens
actgaatattttgga

SEQ ID NO: 3978081 - DNA, 19 bp, Homo sapiens
actgaatattttggaaact

SEQ ID NO: 3978082 - DNA, 13 bp, Homo sapiens
actgaatgtttta

SEQ ID NO: 3978083 - DNA, 14 bp, Homo sapiens
actgaatgttttat

SEQ ID NO: 3978084 - DNA, 17 bp, Homo sapiens
actgaatgttttattta

SEQ ID NO: 3978085 - DNA, 16 bp, Homo sapiens
actgaatttttttgta

SEQ ID NO: 3978086 - DNA, 18 bp, Homo sapiens
actgaatttttttgtaat

SEQ ID NO: 3978087 - DNA, 22 bp, Homo sapiens
actgacatgtggggccaggtca

SEQ ID NO: 3978088 - DNA, 19 bp, Homo sapiens
actgacccactcggatgga

SEQ ID NO: 3978089 - DNA, 16 bp, Homo sapiens
actgactggaggaggc

SEQ ID NO: 3978090 - DNA, 22 bp, Homo sapiens
actgactgtcgggctttaaaaa

SEQ ID NO: 3978091 - DNA, 14 bp, Homo sapiens
actgactttatcct

SEQ ID NO: 3978092 - DNA, 19 bp, Homo sapiens
actgagatcactgactctg

SEQ ID NO: 3978093 - DNA, 13 bp, Homo sapiens
actgagcaagatc

SEQ ID NO: 3978094 - DNA, 14 bp, Homo sapiens
actgagcaccctct

SEQ ID NO: 3978095 - DNA, 15 bp, Homo sapiens
actgagcagccgcca

SEQ ID NO: 3978096 - DNA, 16 bp, Homo sapiens
actgagcagccgccag

SEQ ID NO: 3978097 - DNA, 14 bp, Homo sapiens
actgagccttgtaa

SEQ ID NO: 3978098 - DNA, 22 bp, Homo sapiens
actgagctcacatgggactggg

SEQ ID NO: 3978099 - DNA, 13 bp, Homo sapiens
actgagctcccca

SEQ ID NO: 3978100 - DNA, 15 bp, Homo sapiens
actgagctccccaga

SEQ ID NO: 3978101 - DNA, 19 bp, Homo sapiens
actgagctccccagatctc

SEQ ID NO: 3978102 - DNA, 21 bp, Homo sapiens
actgagctgagaccactgagt

SEQ ID NO: 3978103 - DNA, 17 bp, Homo sapiens
actgagcttctctgtga

SEQ ID NO: 3978104 - DNA, 22 bp, Homo sapiens
actgaggagatgaccagggatg

SEQ ID NO: 3978105 - DNA, 21 bp, Homo sapiens
actgagggaccaactgggccc

SEQ ID NO: 3978106 - DNA, 17 bp, Homo sapiens
actgagggactctgaag

SEQ ID NO: 3978107 - DNA, 23 bp, Homo sapiens
actgagtaccaggggctgggctc

SEQ ID NO: 3978108 - DNA, 23 bp, Homo sapiens
actgagtcacgctggggctctct

SEQ ID NO: 3978109 - DNA, 17 bp, Homo sapiens
actgagtcccctccagg

SEQ ID NO: 3978110 - DNA, 15 bp, Homo sapiens
actgatcacccaatg

SEQ ID NO: 3978111 - DNA, 17 bp, Homo sapiens
actgatctctactacca

SEQ ID NO: 3978112 - DNA, 15 bp, Homo sapiens
actggctggctccta

SEQ ID NO: 3978113 - DNA, 17 bp, Homo sapiens
actggctggctcctagg

SEQ ID NO: 3978114 - DNA, 22 bp, Homo sapiens
actgggaagataggctctgcac

SEQ ID NO: 3978115 - DNA, 23 bp, Homo sapiens
actgggaagataggctctgcaca

SEQ ID NO: 3978116 - DNA, 14 bp, Homo sapiens
actgggagactggg

SEQ ID NO: 3978117 - DNA, 17 bp, Homo sapiens
actgggagtcagagccc

SEQ ID NO: 3978118 - DNA, 19 bp, Homo sapiens
actgggagtcagagccctg

SEQ ID NO: 3978119 - DNA, 22 bp, Homo sapiens
actgggagtgtccttagtgtat

SEQ ID NO: 3978120 - DNA, 14 bp, Homo sapiens
actgggccagccct

SEQ ID NO: 3978121 - DNA, 20 bp, Homo sapiens
actgggccagccctgcagcc

SEQ ID NO: 3978122 - DNA, 15 bp, Homo sapiens
actgggccaggggag

SEQ ID NO: 3978123 - DNA, 16 bp, Homo sapiens
actggggactttattt

SEQ ID NO: 3978124 - DNA, 21 bp, Homo sapiens
actggggcctacagctttgat

SEQ ID NO: 3978125 - DNA, 20 bp, Homo sapiens
actggggctttgccttgcag

SEQ ID NO: 3978126 - DNA, 23 bp, Homo sapiens
actggggctttgccttgcagcca

SEQ ID NO: 3978127 - DNA, 17 bp, Homo sapiens
actggggtgggaggtct

SEQ ID NO: 3978128 - DNA, 22 bp, Homo sapiens
actgggtggggtgaggaccact

SEQ ID NO: 3978129 - DNA, 14 bp, Homo sapiens
actgggtgtcattt

SEQ ID NO: 3978130 - DNA, 21 bp, Homo sapiens
actgggttcttgttttatata

SEQ ID NO: 3978131 - DNA, 16 bp, Homo sapiens
actggtacttagagtt

SEQ ID NO: 3978132 - DNA, 20 bp, Homo sapiens
actggtacttagagtttctg

SEQ ID NO: 3978133 - DNA, 23 bp, Homo sapiens
actggtacttagagtttctgttt

SEQ ID NO: 3978134 - DNA, 14 bp, Homo sapiens
actggtacttcctt

SEQ ID NO: 3978135 - DNA, 14 bp, Homo sapiens
actggtattgttta

SEQ ID NO: 3978136 - DNA, 21 bp, Homo sapiens
acttttaccactatttaagtt

SEQ ID NO: 3978137 - DNA, 19 bp, Homo sapiens
acttttactctgcctacag

SEQ ID NO: 3978138 - DNA, 19 bp, Homo sapiens
acttttatgatgtatattt

SEQ ID NO: 3978139 - DNA, 14 bp, Homo sapiens
acttttatttgcaa

SEQ ID NO: 3978140 - DNA, 17 bp, Homo sapiens
acttttcccctgttaaa

SEQ ID NO: 3978141 - DNA, 17 bp, Homo sapiens
acttttgtactgaattt

SEQ ID NO: 3978142 - DNA, 19 bp, Homo sapiens
acttttgtgtaatgaaaat

SEQ ID NO: 3978143 - DNA, 18 bp, Homo sapiens
acttttgttattccatca

SEQ ID NO: 3978144 - DNA, 11 bp, Homo sapiens
actttttacaa

SEQ ID NO: 3978145 - DNA, 18 bp, Homo sapiens
actttttgttctggtcct

SEQ ID NO: 3978146 - DNA, 19 bp, Homo sapiens
acttttttagaaatgcaaa

SEQ ID NO: 3978147 - DNA, 13 bp, Homo sapiens
acttttttatagc

SEQ ID NO: 3978148 - DNA, 14 bp, Homo sapiens
actttttttgtatg

SEQ ID NO: 3978149 - DNA, 16 bp, Homo sapiens
actttttttgtatgtg

SEQ ID NO: 3978150 - DNA, 17 bp, Homo sapiens
actttttttgtatgtgt

SEQ ID NO: 3978151 - DNA, 14 bp, Homo sapiens
agaaaaaaaagaaa

SEQ ID NO: 3978152 - DNA, 13 bp, Homo sapiens
agaaaaaatcaga

SEQ ID NO: 3978153 - DNA, 15 bp, Homo sapiens
agaaaaacagacaaa

SEQ ID NO: 3978154 - DNA, 20 bp, Homo sapiens
agaaaaagcaataacctcaa

SEQ ID NO: 3978155 - DNA, 15 bp, Homo sapiens
agaaaaataaccctt

SEQ ID NO: 3978156 - DNA, 12 bp, Homo sapiens
agaaaacagaaa

SEQ ID NO: 3978157 - DNA, 13 bp, Homo sapiens
agaaaacattttt

SEQ ID NO: 3978158 - DNA, 14 bp, Homo sapiens
agaaaacttctttt

SEQ ID NO: 3978159 - DNA, 19 bp, Homo sapiens
agaaaagagatattttaaa

SEQ ID NO: 3978160 - DNA, 16 bp, Homo sapiens
agaaaagataaagatg

SEQ ID NO: 3978161 - DNA, 12 bp, Homo sapiens
agaaaagatttt

SEQ ID NO: 3978162 - DNA, 17 bp, Homo sapiens
agaaaagcacttttgtt

SEQ ID NO: 3978163 - DNA, 18 bp, Homo sapiens
agaaaagcacttttgtta

SEQ ID NO: 3978164 - DNA, 19 bp, Homo sapiens
agaaaagcacttttgttat

SEQ ID NO: 3978165 - DNA, 20 bp, Homo sapiens
agaaaagcacttttgttatt

SEQ ID NO: 3978166 - DNA, 19 bp, Homo sapiens
agaaaagctgccatttccc

SEQ ID NO: 3978167 - DNA, 13 bp, Homo sapiens
agaaaagtatttt

SEQ ID NO: 3978168 - DNA, 16 bp, Homo sapiens
agaaaagtattttgaa

SEQ ID NO: 3978169 - DNA, 16 bp, Homo sapiens
agaaaagttgcagatg

SEQ ID NO: 3978170 - DNA, 19 bp, Homo sapiens
agaaaagttgcagatgtat

SEQ ID NO: 3978171 - DNA, 20 bp, Homo sapiens
agaaaagttgcagatgtatt

SEQ ID NO: 3978172 - DNA, 21 bp, Homo sapiens
agaaaatgcctcaattcacat

SEQ ID NO: 3978173 - DNA, 15 bp, Homo sapiens
agaaaatggacactg

SEQ ID NO: 3978174 - DNA, 13 bp, Homo sapiens
agaaaatgttatt

SEQ ID NO: 3978175 - DNA, 16 bp, Homo sapiens
agaaaatgttatttaa

SEQ ID NO: 3978176 - DNA, 14 bp, Homo sapiens
agaaaatgttctgt

SEQ ID NO: 3978177 - DNA, 18 bp, Homo sapiens
agaaaatgttctgtttgc

SEQ ID NO: 3978178 - DNA, 18 bp, Homo sapiens
agaaaattaaacacaaag

SEQ ID NO: 3978179 - DNA, 12 bp, Homo sapiens
agaaaattcaat

SEQ ID NO: 3978180 - DNA, 18 bp, Homo sapiens
agaaaattcaattgtaaa

SEQ ID NO: 3978181 - DNA, 15 bp, Homo sapiens
agaaaattgcactaa

SEQ ID NO: 3978182 - DNA, 16 bp, Homo sapiens
agaaacactgcaaatt

SEQ ID NO: 3978183 - DNA, 22 bp, Homo sapiens
agaaacagagtggcctccctgc

SEQ ID NO: 3978184 - DNA, 15 bp, Homo sapiens
agaaacagccagcaa

SEQ ID NO: 3978185 - DNA, 13 bp, Homo sapiens
agaaacagccatt

SEQ ID NO: 3978186 - DNA, 20 bp, Homo sapiens
agaaacagtgggagccctga

SEQ ID NO: 3978187 - DNA, 14 bp, Homo sapiens
agaaacatggtttt

SEQ ID NO: 3978188 - DNA, 18 bp, Homo sapiens
agaaacctttttaaaaat

SEQ ID NO: 3978189 - DNA, 15 bp, Homo sapiens
agaaacgcatccagc

SEQ ID NO: 3978190 - DNA, 19 bp, Homo sapiens
agaaactatgaagatctga

SEQ ID NO: 3978191 - DNA, 13 bp, Homo sapiens
agaaactcccctg

SEQ ID NO: 3978192 - DNA, 14 bp, Homo sapiens
agaaactgatttct

SEQ ID NO: 3978193 - DNA, 23 bp, Homo sapiens
agaaacttgtgaagtggaaatgt

SEQ ID NO: 3978194 - DNA, 13 bp, Homo sapiens
agaaacttgttct

SEQ ID NO: 3978195 - DNA, 16 bp, Homo sapiens
agaaactttatacatt

SEQ ID NO: 3978196 - DNA, 18 bp, Homo sapiens
agaaactttatacattag

SEQ ID NO: 3978197 - DNA, 22 bp, Homo sapiens
agaaactttatacattagtaaa

SEQ ID NO: 3978198 - DNA, 12 bp, Homo sapiens
agaaagaaagtt

SEQ ID NO: 3978199 - DNA, 12 bp, Homo sapiens
agaaagaagcca

SEQ ID NO: 3978200 - DNA, 12 bp, Homo sapiens
agaaagaagccc

SEQ ID NO: 3978201 - DNA, 14 bp, Homo sapiens
agaaagaaggaagt

SEQ ID NO: 3978202 - DNA, 20 bp, Homo sapiens
agaaagactatctaaatgtt

SEQ ID NO: 3978203 - DNA, 23 bp, Homo sapiens
agaaagactctgagatgtggaga

SEQ ID NO: 3978204 - DNA, 22 bp, Homo sapiens
agaaagacttggttggtagggt

SEQ ID NO: 3978205 - DNA, 18 bp, Homo sapiens
agaaagatcattgaaatt

SEQ ID NO: 3978206 - DNA, 21 bp, Homo sapiens
agaaagcagatacctcaccct

SEQ ID NO: 3978207 - DNA, 20 bp, Homo sapiens
agaaagcctgttcccctcac

SEQ ID NO: 3978208 - DNA, 22 bp, Homo sapiens
agaaagcctgttcccctcactg

SEQ ID NO: 3978209 - DNA, 16 bp, Homo sapiens
agaaaggaaaacctga

SEQ ID NO: 3978210 - DNA, 20 bp, Homo sapiens
agaaaggaaaacctgaagac

SEQ ID NO: 3978211 - DNA, 20 bp, Homo sapiens
agaaaggaagccttgctcat

SEQ ID NO: 3978212 - DNA, 14 bp, Homo sapiens
agaaaggatattta

SEQ ID NO: 3978213 - DNA, 16 bp, Homo sapiens
agaaaggggagcccac

SEQ ID NO: 3978214 - DNA, 23 bp, Homo sapiens
agaaaggtgagtttgagctgcct

SEQ ID NO: 3978215 - DNA, 14 bp, Homo sapiens
agaaagtcaccagg

SEQ ID NO: 3978216 - DNA, 21 bp, Homo sapiens
agaaagtggccatgccaccct

SEQ ID NO: 3978217 - DNA, 15 bp, Homo sapiens
agaaagtgttttatt

SEQ ID NO: 3978218 - DNA, 22 bp, Homo sapiens
agaaagtgttttattttcaaat

SEQ ID NO: 3978219 - DNA, 19 bp, Homo sapiens
agaaataaaaggaagccaa

SEQ ID NO: 3978220 - DNA, 13 bp, Homo sapiens
agaaataaaagtg

SEQ ID NO: 3978221 - DNA, 18 bp, Homo sapiens
agaaataaatagctatat

SEQ ID NO: 3978222 - DNA, 22 bp, Homo sapiens
agaaataaatagctatatccat

SEQ ID NO: 3978223 - DNA, 14 bp, Homo sapiens
agaaataaatcaga

SEQ ID NO: 3978224 - DNA, 20 bp, Homo sapiens
agaaataaatcagagagcaa

SEQ ID NO: 3978225 - DNA, 11 bp, Homo sapiens
agaaataaatt

SEQ ID NO: 3978226 - DNA, 16 bp, Homo sapiens
agaaataagaaaatgg

SEQ ID NO: 3978227 - DNA, 15 bp, Homo sapiens
agaaataatatgcat

SEQ ID NO: 3978228 - DNA, 16 bp, Homo sapiens
agaaataatatgcatt

SEQ ID NO: 3978229 - DNA, 20 bp, Homo sapiens
agaaatatctgaaaatgtat

SEQ ID NO: 3978230 - DNA, 20 bp, Homo sapiens
agaaatatgaaattccagca

SEQ ID NO: 3978231 - DNA, 17 bp, Homo sapiens
agaaatatggaacttac

SEQ ID NO: 3978232 - DNA, 22 bp, Homo sapiens
agaaatatggaacttacattgt

SEQ ID NO: 3978233 - DNA, 18 bp, Homo sapiens
agaaatattccaaatgtc

SEQ ID NO: 3978234 - DNA, 17 bp, Homo sapiens
agaaatcaagcataaat

SEQ ID NO: 3978235 - DNA, 19 bp, Homo sapiens
agaaatcaagcataaatca

SEQ ID NO: 3978236 - DNA, 15 bp, Homo sapiens
agaaatcaggtgttt

SEQ ID NO: 3978237 - DNA, 23 bp, Homo sapiens
agaaatcaggtgttttaagactg

SEQ ID NO: 3978238 - DNA, 24 bp, Homo sapiens
agaaatcaggtgttttaagactga

SEQ ID NO: 3978239 - DNA, 16 bp, Homo sapiens
agaaatcatgtccata

SEQ ID NO: 3978240 - DNA, 19 bp, Homo sapiens
actgtttttctctaatgct

SEQ ID NO: 3978241 - DNA, 23 bp, Homo sapiens
actgtttttgaaaaattacagct

SEQ ID NO: 3978242 - DNA, 13 bp, Homo sapiens
actgttttttaag

SEQ ID NO: 3978243 - DNA, 15 bp, Homo sapiens
actgttttttaagtc

SEQ ID NO: 3978244 - DNA, 23 bp, Homo sapiens
actgttttttttttttttaattt

SEQ ID NO: 3978245 - DNA, 16 bp, Homo sapiens
acttaaaaaaatgaca

SEQ ID NO: 3978246 - DNA, 22 bp, Homo sapiens
acttaaaaaaatgacagatgtt

SEQ ID NO: 3978247 - DNA, 18 bp, Homo sapiens
acttaaaaatgtaaatat

SEQ ID NO: 3978248 - DNA, 21 bp, Homo sapiens
acttaaaattgtaacctgcat

SEQ ID NO: 3978249 - DNA, 17 bp, Homo sapiens
acttaaaggctgtggta

SEQ ID NO: 3978250 - DNA, 14 bp, Homo sapiens
acttaacagatgca

SEQ ID NO: 3978251 - DNA, 16 bp, Homo sapiens
acttaactactttgtt

SEQ ID NO: 3978252 - DNA, 19 bp, Homo sapiens
acttaactttaactgaaca

SEQ ID NO: 3978253 - DNA, 15 bp, Homo sapiens
acttaagcaaaagaa

SEQ ID NO: 3978254 - DNA, 15 bp, Homo sapiens
acttaataactgtgt

SEQ ID NO: 3978255 - DNA, 19 bp, Homo sapiens
acttaatactaccttgaaa

SEQ ID NO: 3978256 - DNA, 21 bp, Homo sapiens
acttaatactaccttgaaaat

SEQ ID NO: 3978257 - DNA, 17 bp, Homo sapiens
acttacactttatgcac

SEQ ID NO: 3978258 - DNA, 19 bp, Homo sapiens
acttacatatatttttaaa

SEQ ID NO: 3978259 - DNA, 17 bp, Homo sapiens
acttacatcttctgtga

SEQ ID NO: 3978260 - DNA, 21 bp, Homo sapiens
acttacctaagtgacatttgt

SEQ ID NO: 3978261 - DNA, 20 bp, Homo sapiens
acttactgggtgaggaaatc

SEQ ID NO: 3978262 - DNA, 21 bp, Homo sapiens
acttactttaattactggaat

SEQ ID NO: 3978263 - DNA, 18 bp, Homo sapiens
acttagaacctttctgtg

SEQ ID NO: 3978264 - DNA, 19 bp, Homo sapiens
acttagaacctttctgtgt

SEQ ID NO: 3978265 - DNA, 15 bp, Homo sapiens
acttagagtttctgt

SEQ ID NO: 3978266 - DNA, 18 bp, Homo sapiens
acttagagtttctgtttg

SEQ ID NO: 3978267 - DNA, 14 bp, Homo sapiens
acttagcaggcacc

SEQ ID NO: 3978268 - DNA, 12 bp, Homo sapiens
acttagccagag

SEQ ID NO: 3978269 - DNA, 19 bp, Homo sapiens
acttagctggagatgtctc

SEQ ID NO: 3978270 - DNA, 21 bp, Homo sapiens
acttagctggagatgtctcta

SEQ ID NO: 3978271 - DNA, 18 bp, Homo sapiens
acttagcttgcacatgaa

SEQ ID NO: 3978272 - DNA, 18 bp, Homo sapiens
acttaggccctagcggca

SEQ ID NO: 3978273 - DNA, 20 bp, Homo sapiens
acttagtgcggacaagtttt

SEQ ID NO: 3978274 - DNA, 11 bp, Homo sapiens
acttatacctg

SEQ ID NO: 3978275 - DNA, 14 bp, Homo sapiens
acttatagtacatg

SEQ ID NO: 3978276 - DNA, 15 bp, Homo sapiens
acttatagtacatga

SEQ ID NO: 3978277 - DNA, 16 bp, Homo sapiens
acttatattgaagaca

SEQ ID NO: 3978278 - DNA, 20 bp, Homo sapiens
acttatattgaagacaattt

SEQ ID NO: 3978279 - DNA, 18 bp, Homo sapiens
acttatcctaaaacaaat

SEQ ID NO: 3978280 - DNA, 17 bp, Homo sapiens
acttatctctctgtgct

SEQ ID NO: 3978281 - DNA, 13 bp, Homo sapiens
acttattacaatt

SEQ ID NO: 3978282 - DNA, 20 bp, Homo sapiens
acttatttaaaaatatttca

SEQ ID NO: 3978283 - DNA, 15 bp, Homo sapiens
acttatttaaactct

SEQ ID NO: 3978284 - DNA, 13 bp, Homo sapiens
acttatttaatgc

SEQ ID NO: 3978285 - DNA, 17 bp, Homo sapiens
acttatttatgaacctg

SEQ ID NO: 3978286 - DNA, 14 bp, Homo sapiens
acttatttcactat

SEQ ID NO: 3978287 - DNA, 16 bp, Homo sapiens
acttattttatttcca

SEQ ID NO: 3978288 - DNA, 19 bp, Homo sapiens
acttcaaaacaaacagatg

SEQ ID NO: 3978289 - DNA, 15 bp, Homo sapiens
acttcaataatcatt

SEQ ID NO: 3978290 - DNA, 12 bp, Homo sapiens
acttcagaaaga

SEQ ID NO: 3978291 - DNA, 16 bp, Homo sapiens
acttcagaaagacttg

SEQ ID NO: 3978292 - DNA, 17 bp, Homo sapiens
acttcagagagctggta

SEQ ID NO: 3978293 - DNA, 18 bp, Homo sapiens
acttcagagagctggtag

SEQ ID NO: 3978294 - DNA, 16 bp, Homo sapiens
acttcagctgcctgaa

SEQ ID NO: 3978295 - DNA, 18 bp, Homo sapiens
acttcaggctcttctcct

SEQ ID NO: 3978296 - DNA, 21 bp, Homo sapiens
acttcagggcagggctctgat

SEQ ID NO: 3978297 - DNA, 23 bp, Homo sapiens
acttcagggcagggctctgatat

SEQ ID NO: 3978298 - DNA, 17 bp, Homo sapiens
acttcatactggcagga

SEQ ID NO: 3978299 - DNA, 20 bp, Homo sapiens
acttcatactggcaggaggg

SEQ ID NO: 3978300 - DNA, 24 bp, Homo sapiens
acttcatattgctgagagaaatat

SEQ ID NO: 3978301 - DNA, 15 bp, Homo sapiens
acttcatggaatgga

SEQ ID NO: 3978302 - DNA, 21 bp, Homo sapiens
acttcattcttgaaagctgtg

SEQ ID NO: 3978303 - DNA, 15 bp, Homo sapiens
acttcattgtccctc

SEQ ID NO: 3978304 - DNA, 17 bp, Homo sapiens
acttccatacagctcta

SEQ ID NO: 3978305 - DNA, 12 bp, Homo sapiens
acttccatgcct

SEQ ID NO: 3978306 - DNA, 14 bp, Homo sapiens
acttcccaacagcc

SEQ ID NO: 3978307 - DNA, 17 bp, Homo sapiens
acttcccagtgaattct

SEQ ID NO: 3978308 - DNA, 19 bp, Homo sapiens
acttcccattttggaagtt

SEQ ID NO: 3978309 - DNA, 21 bp, Homo sapiens
acttccctgattgacctgctc

SEQ ID NO: 3978310 - DNA, 12 bp, Homo sapiens
acttcctgctgc

SEQ ID NO: 3978311 - DNA, 15 bp, Homo sapiens
acttcctgctgcacc

SEQ ID NO: 3978312 - DNA, 22 bp, Homo sapiens
atctgagctgcagcctggctgg

SEQ ID NO: 3978313 - DNA, 17 bp, Homo sapiens
atctgatccccatgcct

SEQ ID NO: 3978314 - DNA, 19 bp, Homo sapiens
atctgatggccttaatttc

SEQ ID NO: 3978315 - DNA, 22 bp, Homo sapiens
atctgatggccttaatttcctt

SEQ ID NO: 3978316 - DNA, 11 bp, Homo sapiens
atctgcaaaag

SEQ ID NO: 3978317 - DNA, 22 bp, Homo sapiens
atctgcaaaaggcctcttgtaa

SEQ ID NO: 3978318 - DNA, 14 bp, Homo sapiens
atctgcaatatgaa

SEQ ID NO: 3978319 - DNA, 15 bp, Homo sapiens
atctgcaatatgaat

SEQ ID NO: 3978320 - DNA, 20 bp, Homo sapiens
atctgcacacacctccgaga

SEQ ID NO: 3978321 - DNA, 16 bp, Homo sapiens
atctgcacactccagg

SEQ ID NO: 3978322 - DNA, 17 bp, Homo sapiens
atctgcacactccaggc

SEQ ID NO: 3978323 - DNA, 10 bp, Homo sapiens
atctgcaccc

SEQ ID NO: 3978324 - DNA, 18 bp, Homo sapiens
atctgcaccccttctctc

SEQ ID NO: 3978325 - DNA, 21 bp, Homo sapiens
atctgcaccccttctctcctc

SEQ ID NO: 3978326 - DNA, 20 bp, Homo sapiens
atctgcactctaaactgcaa

SEQ ID NO: 3978327 - DNA, 11 bp, Homo sapiens
atctgcagaac

SEQ ID NO: 3978328 - DNA, 22 bp, Homo sapiens
atctgcattttcaccccaccct

SEQ ID NO: 3978329 - DNA, 17 bp, Homo sapiens
atctgccttaaaaccaa

SEQ ID NO: 3978330 - DNA, 23 bp, Homo sapiens
atctgcgtgacaataaaacatta

SEQ ID NO: 3978331 - DNA, 13 bp, Homo sapiens
atctgctgcatag

SEQ ID NO: 3978332 - DNA, 18 bp, Homo sapiens
atctgctggagtttcatg

SEQ ID NO: 3978333 - DNA, 15 bp, Homo sapiens
atctgctgtatatgg

SEQ ID NO: 3978334 - DNA, 22 bp, Homo sapiens
atctgctttttaaagaatgctc

SEQ ID NO: 3978335 - DNA, 11 bp, Homo sapiens
atctggaaccc

SEQ ID NO: 3978336 - DNA, 17 bp, Homo sapiens
atctggaacccagactc

SEQ ID NO: 3978337 - DNA, 11 bp, Homo sapiens
atctggaacct

SEQ ID NO: 3978338 - DNA, 14 bp, Homo sapiens
atctggacagaaca

SEQ ID NO: 3978339 - DNA, 17 bp, Homo sapiens
atctggacagaacattt

SEQ ID NO: 3978340 - DNA, 20 bp, Homo sapiens
atctggagaccagggagcct

SEQ ID NO: 3978341 - DNA, 20 bp, Homo sapiens
atctggcccttacacactca

SEQ ID NO: 3978342 - DNA, 19 bp, Homo sapiens
atctggctcctttacaaaa

SEQ ID NO: 3978343 - DNA, 21 bp, Homo sapiens
atctggctcctttacaaaaga

SEQ ID NO: 3978344 - DNA, 13 bp, Homo sapiens
atctggctgttta

SEQ ID NO: 3978345 - DNA, 16 bp, Homo sapiens
atctggctgtttagca

SEQ ID NO: 3978346 - DNA, 20 bp, Homo sapiens
atctggggttggcaacagga

SEQ ID NO: 3978347 - DNA, 16 bp, Homo sapiens
atctgggttaagtgtt

SEQ ID NO: 3978348 - DNA, 21 bp, Homo sapiens
atctggtcttgttagaaaaca

SEQ ID NO: 3978349 - DNA, 22 bp, Homo sapiens
atctggttgtgactctaagctc

SEQ ID NO: 3978350 - DNA, 15 bp, Homo sapiens
atctggttttattac

SEQ ID NO: 3978351 - DNA, 11 bp, Homo sapiens
atctgtaacag

SEQ ID NO: 3978352 - DNA, 20 bp, Homo sapiens
atctgtaacaggtattttgt

SEQ ID NO: 3978353 - DNA, 17 bp, Homo sapiens
atctgtacttcttcgat

SEQ ID NO: 3978354 - DNA, 18 bp, Homo sapiens
atctgtataccctctgtt

SEQ ID NO: 3978355 - DNA, 18 bp, Homo sapiens
atctgtcacaccagccat

SEQ ID NO: 3978356 - DNA, 18 bp, Homo sapiens
atctgtcagcatctggct

SEQ ID NO: 3978357 - DNA, 21 bp, Homo sapiens
atctgtccaaaggaggctggc

SEQ ID NO: 3978358 - DNA, 13 bp, Homo sapiens
atctgtccaagga

SEQ ID NO: 3978359 - DNA, 17 bp, Homo sapiens
atctgtccatggccttt

SEQ ID NO: 3978360 - DNA, 22 bp, Homo sapiens
atctgtccatggcctttctaat

SEQ ID NO: 3978361 - DNA, 19 bp, Homo sapiens
atctgtccgtggaaaattt

SEQ ID NO: 3978362 - DNA, 15 bp, Homo sapiens
atctgtcctcagcct

SEQ ID NO: 3978363 - DNA, 16 bp, Homo sapiens
atctgtgaattcagat

SEQ ID NO: 3978364 - DNA, 17 bp, Homo sapiens
atctgtgaattcagatt

SEQ ID NO: 3978365 - DNA, 19 bp, Homo sapiens
atctgtgaggtgctgatga

SEQ ID NO: 3978366 - DNA, 14 bp, Homo sapiens
atctgtgatgggag

SEQ ID NO: 3978367 - DNA, 16 bp, Homo sapiens
atctgtgcactgccca

SEQ ID NO: 3978368 - DNA, 21 bp, Homo sapiens
atctgtgcctgcactgagagg

SEQ ID NO: 3978369 - DNA, 19 bp, Homo sapiens
atctgtgcgtgaaacacac

SEQ ID NO: 3978370 - DNA, 23 bp, Homo sapiens
atctgtgggtctgggagtcacac

SEQ ID NO: 3978371 - DNA, 17 bp, Homo sapiens
atctgtttaaagcatat

SEQ ID NO: 3978372 - DNA, 21 bp, Homo sapiens
atctgtttaaagcatatagag

SEQ ID NO: 3978373 - DNA, 14 bp, Homo sapiens
atctgttttaaatt

SEQ ID NO: 3978374 - DNA, 22 bp, Homo sapiens
atcttaaacataataaatcaca

SEQ ID NO: 3978375 - DNA, 19 bp, Homo sapiens
atcttaaagtttcatgtga

SEQ ID NO: 3978376 - DNA, 14 bp, Homo sapiens
atcttaaatcagaa

SEQ ID NO: 3978377 - DNA, 18 bp, Homo sapiens
atcttaaatcagaataaa

SEQ ID NO: 3978378 - DNA, 12 bp, Homo sapiens
atcttagtggtt

SEQ ID NO: 3978379 - DNA, 21 bp, Homo sapiens
atcttattagggagaaaattc

SEQ ID NO: 3978380 - DNA, 21 bp, Homo sapiens
atcttattttctcaatctcct

SEQ ID NO: 3978381 - DNA, 19 bp, Homo sapiens
atcttcaaactttcacttt

SEQ ID NO: 3978382 - DNA, 15 bp, Homo sapiens
atcttcaaagcttga

SEQ ID NO: 3978383 - DNA, 14 bp, Homo sapiens
atcttcactagaag

SEQ ID NO: 3978384 - DNA, 13 bp, Homo sapiens
atcttcacttcta

SEQ ID NO: 3978385 - DNA, 18 bp, Homo sapiens
atcttcagagcaggggtc

SEQ ID NO: 3978386 - DNA, 14 bp, Homo sapiens
atcttcagttttat

SEQ ID NO: 3978387 - DNA, 22 bp, Homo sapiens
atcttcagttttatctttaatc

SEQ ID NO: 3978388 - DNA, 16 bp, Homo sapiens
atcttccatatttgga

SEQ ID NO: 3978389 - DNA, 18 bp, Homo sapiens
atcttccatatttggaag

SEQ ID NO: 3978390 - DNA, 15 bp, Homo sapiens
atcttcccataataa

SEQ ID NO: 3978391 - DNA, 18 bp, Homo sapiens
atcttcccataataaagc

SEQ ID NO: 3978392 - DNA, 19 bp, Homo sapiens
atcttcccataataaagca

SEQ ID NO: 3978393 - DNA, 20 bp, Homo sapiens
atcttcccataataaagcaa

SEQ ID NO: 3978394 - DNA, 21 bp, Homo sapiens
atcttctaaacccaatccaaa

SEQ ID NO: 3978395 - DNA, 23 bp, Homo sapiens
atcttctatttttatcatgaatt

SEQ ID NO: 3978396 - DNA, 19 bp, Homo sapiens
atcttctgtgaaatataat

SEQ ID NO: 3978397 - DNA, 12 bp, Homo sapiens
atcttcttcaaa

SEQ ID NO: 3978398 - DNA, 14 bp, Homo sapiens
atcttcttcccagt

SEQ ID NO: 3978399 - DNA, 14 bp, Homo sapiens
atcttctttataat

SEQ ID NO: 3978400 - DNA, 13 bp, Homo sapiens
atcttgaatgtgg

SEQ ID NO: 3978401 - DNA, 14 bp, Homo sapiens
atcttgacagagcc

SEQ ID NO: 3978402 - DNA, 15 bp, Homo sapiens
atcttgactttctga

SEQ ID NO: 3978403 - DNA, 23 bp, Homo sapiens
atcttgactttctgattggtgat

SEQ ID NO: 3978404 - DNA, 19 bp, Homo sapiens
atcttgagtataagaaatg

SEQ ID NO: 3978405 - DNA, 14 bp, Homo sapiens
atcttgcattcatt

SEQ ID NO: 3978406 - DNA, 15 bp, Homo sapiens
atcttgcattcattt

SEQ ID NO: 3978407 - DNA, 12 bp, Homo sapiens
atcttgccacat

SEQ ID NO: 3978408 - DNA, 19 bp, Homo sapiens
atcttgccacatttctgat

SEQ ID NO: 3978409 - DNA, 14 bp, Homo sapiens
atcttggactgaca

SEQ ID NO: 3978410 - DNA, 21 bp, Homo sapiens
atcttggactgacatttagcg

SEQ ID NO: 3978411 - DNA, 22 bp, Homo sapiens
atcttggctatgtaattcttgt

SEQ ID NO: 3978412 - DNA, 18 bp, Homo sapiens
atcttggggcaagactgc

SEQ ID NO: 3978413 - DNA, 22 bp, Homo sapiens
atcttggggcaagactgcaaac

SEQ ID NO: 3978414 - DNA, 14 bp, Homo sapiens
atcttgtctctggg

SEQ ID NO: 3978415 - DNA, 17 bp, Homo sapiens
atcgggagcagtgtctt

SEQ ID NO: 3978416 - DNA, 18 bp, Homo sapiens
atcgggagcagtgtcttc

SEQ ID NO: 3978417 - DNA, 21 bp, Homo sapiens
atcgggagcagtgtcttccat

SEQ ID NO: 3978418 - DNA, 16 bp, Homo sapiens
atcggggtagaaatgc

SEQ ID NO: 3978419 - DNA, 19 bp, Homo sapiens
atcggtgaaactaacagat

SEQ ID NO: 3978420 - DNA, 21 bp, Homo sapiens
atcggtgaaactaacagataa

SEQ ID NO: 3978421 - DNA, 16 bp, Homo sapiens
atcgtattcaccttca

SEQ ID NO: 3978422 - DNA, 16 bp, Homo sapiens
atcgtgctaaattttc

SEQ ID NO: 3978423 - DNA, 12 bp, Homo sapiens
atcgttattata

SEQ ID NO: 3978424 - DNA, 18 bp, Homo sapiens
atcgttattataaatgtt

SEQ ID NO: 3978425 - DNA, 15 bp, Homo sapiens
atcgttccagttccc

SEQ ID NO: 3978426 - DNA, 13 bp, Homo sapiens
atctaaagtttgt

SEQ ID NO: 3978427 - DNA, 23 bp, Homo sapiens
atctaaccattaagtcatgtgtg

SEQ ID NO: 3978428 - DNA, 11 bp, Homo sapiens
atctaaggata

SEQ ID NO: 3978429 - DNA, 20 bp, Homo sapiens
atctaaggatgtcacagggc

SEQ ID NO: 3978430 - DNA, 13 bp, Homo sapiens
atctaagtgatat

SEQ ID NO: 3978431 - DNA, 15 bp, Homo sapiens
atctaatatatatga

SEQ ID NO: 3978432 - DNA, 16 bp, Homo sapiens
atctaatatggccaca

SEQ ID NO: 3978433 - DNA, 13 bp, Homo sapiens
atctacaagccaa

SEQ ID NO: 3978434 - DNA, 13 bp, Homo sapiens
atctacaatcagt

SEQ ID NO: 3978435 - DNA, 14 bp, Homo sapiens
atctacacagcctg

SEQ ID NO: 3978436 - DNA, 17 bp, Homo sapiens
atctacacagcctggac

SEQ ID NO: 3978437 - DNA, 18 bp, Homo sapiens
atctacacagcctggact

SEQ ID NO: 3978438 - DNA, 19 bp, Homo sapiens
atctacacagcctggactt

SEQ ID NO: 3978439 - DNA, 19 bp, Homo sapiens
atctaccttttctggcaaa

SEQ ID NO: 3978440 - DNA, 15 bp, Homo sapiens
atctactaattccac

SEQ ID NO: 3978441 - DNA, 18 bp, Homo sapiens
atctacttcatagctcct

SEQ ID NO: 3978442 - DNA, 13 bp, Homo sapiens
atctacttttttt

SEQ ID NO: 3978443 - DNA, 12 bp, Homo sapiens
atctagaagact

SEQ ID NO: 3978444 - DNA, 21 bp, Homo sapiens
atctagaatgtgttttctgaa

SEQ ID NO: 3978445 - DNA, 21 bp, Homo sapiens
atctagccagcccctcttccc

SEQ ID NO: 3978446 - DNA, 20 bp, Homo sapiens
atctaggtgtggctgtgaag

SEQ ID NO: 3978447 - DNA, 15 bp, Homo sapiens
atctagtgcagctga

SEQ ID NO: 3978448 - DNA, 22 bp, Homo sapiens
atctagttatttacaggaactt

SEQ ID NO: 3978449 - DNA, 12 bp, Homo sapiens
atctataaagcg

SEQ ID NO: 3978450 - DNA, 17 bp, Homo sapiens
atctatagaaagctata

SEQ ID NO: 3978451 - DNA, 17 bp, Homo sapiens
atctatgggaagatact

SEQ ID NO: 3978452 - DNA, 18 bp, Homo sapiens
atctattaaagtgacttt

SEQ ID NO: 3978453 - DNA, 15 bp, Homo sapiens
atctattaatatatg

SEQ ID NO: 3978454 - DNA, 17 bp, Homo sapiens
atctattcagacaagca

SEQ ID NO: 3978455 - DNA, 21 bp, Homo sapiens
atctattcagacaagcaacag

SEQ ID NO: 3978456 - DNA, 13 bp, Homo sapiens
atctatttattaa

SEQ ID NO: 3978457 - DNA, 19 bp, Homo sapiens
atctatttattaatattta

SEQ ID NO: 3978458 - DNA, 13 bp, Homo sapiens
atctcaaatttat

SEQ ID NO: 3978459 - DNA, 22 bp, Homo sapiens
atctcaagatgggggcagggct

SEQ ID NO: 3978460 - DNA, 16 bp, Homo sapiens
atctcaccccatccca

SEQ ID NO: 3978461 - DNA, 17 bp, Homo sapiens
atctcacctccgaactg

SEQ ID NO: 3978462 - DNA, 19 bp, Homo sapiens
atctcagaaagtgcctgac

SEQ ID NO: 3978463 - DNA, 19 bp, Homo sapiens
atctcagaggctcagagac

SEQ ID NO: 3978464 - DNA, 14 bp, Homo sapiens
atctcagcctcctg

SEQ ID NO: 3978465 - DNA, 18 bp, Homo sapiens
atctcaggagatttcatg

SEQ ID NO: 3978466 - DNA, 13 bp, Homo sapiens
atctcagggcaga

SEQ ID NO: 3978467 - DNA, 18 bp, Homo sapiens
atctcagtcatgcataaa

SEQ ID NO: 3978468 - DNA, 21 bp, Homo sapiens
atctcagtcatgcataaatat

SEQ ID NO: 3978469 - DNA, 15 bp, Homo sapiens
atctcatctatctca

SEQ ID NO: 3978470 - DNA, 16 bp, Homo sapiens
atctcatgtatcatct

SEQ ID NO: 3978471 - DNA, 19 bp, Homo sapiens
atctcatgtatcatctgga

SEQ ID NO: 3978472 - DNA, 16 bp, Homo sapiens
atctcattcagtatta

SEQ ID NO: 3978473 - DNA, 18 bp, Homo sapiens
atctccaaggatcctctc

SEQ ID NO: 3978474 - DNA, 12 bp, Homo sapiens
atctccaggatt

SEQ ID NO: 3978475 - DNA, 14 bp, Homo sapiens
atctccagggagca

SEQ ID NO: 3978476 - DNA, 22 bp, Homo sapiens
atctccagggagcaagacagag

SEQ ID NO: 3978477 - DNA, 15 bp, Homo sapiens
atctccatggccctg

SEQ ID NO: 3978478 - DNA, 17 bp, Homo sapiens
atctcccactgcgggga

SEQ ID NO: 3978479 - DNA, 17 bp, Homo sapiens
atctcccattttggaat

SEQ ID NO: 3978480 - DNA, 14 bp, Homo sapiens
atctccccactcta

SEQ ID NO: 3978481 - DNA, 15 bp, Homo sapiens
atctcccgctgctgc

SEQ ID NO: 3978482 - DNA, 13 bp, Homo sapiens
atctccctgcctg

SEQ ID NO: 3978483 - DNA, 20 bp, Homo sapiens
atctccctgcctggccccca

SEQ ID NO: 3978484 - DNA, 13 bp, Homo sapiens
atctcctgctcac

SEQ ID NO: 3978485 - DNA, 12 bp, Homo sapiens
atctcctgctct

SEQ ID NO: 3978486 - DNA, 18 bp, Homo sapiens
atctcctgtgcatgggtg

SEQ ID NO: 3978487 - DNA, 16 bp, Homo sapiens
atctccttagaaaagc

SEQ ID NO: 3978488 - DNA, 15 bp, Homo sapiens
atctctaccatcatc

SEQ ID NO: 3978489 - DNA, 20 bp, Homo sapiens
atctctacgactaatcacct

SEQ ID NO: 3978490 - DNA, 16 bp, Homo sapiens
atctctagaattttaa

SEQ ID NO: 3978491 - DNA, 14 bp, Homo sapiens
atctctatttaata

SEQ ID NO: 3978492 - DNA, 15 bp, Homo sapiens
atctctatttaatat

SEQ ID NO: 3978493 - DNA, 17 bp, Homo sapiens
atctctatttaatattt

SEQ ID NO: 3978494 - DNA, 18 bp, Homo sapiens
atctctatttaatattta

SEQ ID NO: 3978495 - DNA, 13 bp, Homo sapiens
atctctcaggagc

SEQ ID NO: 3978496 - DNA, 18 bp, Homo sapiens
atctctcaggagcacagg

SEQ ID NO: 3978497 - DNA, 22 bp, Homo sapiens
atctctcaggagcacaggcagc

SEQ ID NO: 3978498 - DNA, 23 bp, Homo sapiens
atctctcaggagcacaggcagct

SEQ ID NO: 3978499 - DNA, 21 bp, Homo sapiens
atctctcatcctccagtacct

SEQ ID NO: 3978500 - DNA, 23 bp, Homo sapiens
atctctccctcccctgccatttt

SEQ ID NO: 3978501 - DNA, 18 bp, Homo sapiens
atctctctgcagctgccg

SEQ ID NO: 3978502 - DNA, 18 bp, Homo sapiens
atctctctgtgctgtgga

SEQ ID NO: 3978503 - DNA, 18 bp, Homo sapiens
atctctcttgtcctcttc

SEQ ID NO: 3978504 - DNA, 20 bp, Homo sapiens
atctctcttgtcctcttctg

SEQ ID NO: 3978505 - DNA, 21 bp, Homo sapiens
atctctcttgtcctcttctgc

SEQ ID NO: 3978506 - DNA, 13 bp, Homo sapiens
atctcttcattat

SEQ ID NO: 3978507 - DNA, 22 bp, Homo sapiens
atctcttcctacccaaccactc

SEQ ID NO: 3978508 - DNA, 13 bp, Homo sapiens
atctcttctggtg

SEQ ID NO: 3978509 - DNA, 15 bp, Homo sapiens
atctcttgaggccag

SEQ ID NO: 3978510 - DNA, 12 bp, Homo sapiens
atctcttttata

SEQ ID NO: 3978511 - DNA, 15 bp, Homo sapiens
atctgaaaactggaa

SEQ ID NO: 3978512 - DNA, 14 bp, Homo sapiens
atctgaaaatgtat

SEQ ID NO: 3978513 - DNA, 19 bp, Homo sapiens
atctgaaaatgtatgtgta

SEQ ID NO: 3978514 - DNA, 13 bp, Homo sapiens
atctgaactctca

SEQ ID NO: 3978515 - DNA, 12 bp, Homo sapiens
atctgacatatt

SEQ ID NO: 3978516 - DNA, 18 bp, Homo sapiens
atctgacccagtgccccc

SEQ ID NO: 3978517 - DNA, 16 bp, Homo sapiens
atctgagctgcagcct

SEQ ID NO: 3978518 - DNA, 17 bp, Homo sapiens
atctgagctgcagcctg

SEQ ID NO: 3978519 - DNA, 18 bp, Homo sapiens
atcccccttgccacccca

SEQ ID NO: 3978520 - DNA, 22 bp, Homo sapiens
atcccgtacctcttcccatgac

SEQ ID NO: 3978521 - DNA, 15 bp, Homo sapiens
atccctacatgtatt

SEQ ID NO: 3978522 - DNA, 17 bp, Homo sapiens
atccctcacctgtagca

SEQ ID NO: 3978523 - DNA, 16 bp, Homo sapiens
atccctccccagttca

SEQ ID NO: 3978524 - DNA, 19 bp, Homo sapiens
atccctcccccccatgcac

SEQ ID NO: 3978525 - DNA, 21 bp, Homo sapiens
atccctcccccccatgcactg

SEQ ID NO: 3978526 - DNA, 17 bp, Homo sapiens
atccctcgatattttta

SEQ ID NO: 3978527 - DNA, 20 bp, Homo sapiens
atccctcgggaagcagccag

SEQ ID NO: 3978528 - DNA, 13 bp, Homo sapiens
atccctctcttcc

SEQ ID NO: 3978529 - DNA, 19 bp, Homo sapiens
atccctctcttccccttcc

SEQ ID NO: 3978530 - DNA, 20 bp, Homo sapiens
atccctgatcccattttcct

SEQ ID NO: 3978531 - DNA, 15 bp, Homo sapiens
atccctgatcccttc

SEQ ID NO: 3978532 - DNA, 22 bp, Homo sapiens
atccctgccacatacaggtgct

SEQ ID NO: 3978533 - DNA, 23 bp, Homo sapiens
atccctgccacatacaggtgctc

SEQ ID NO: 3978534 - DNA, 14 bp, Homo sapiens
atccctggagcagg

SEQ ID NO: 3978535 - DNA, 13 bp, Homo sapiens
atccctgggcccc

SEQ ID NO: 3978536 - DNA, 19 bp, Homo sapiens
atccctgggggccttgggt

SEQ ID NO: 3978537 - DNA, 16 bp, Homo sapiens
atccctgtttaatatt

SEQ ID NO: 3978538 - DNA, 17 bp, Homo sapiens
atccctgtttaatattt

SEQ ID NO: 3978539 - DNA, 21 bp, Homo sapiens
atccctgtttaatatttaaac

SEQ ID NO: 3978540 - DNA, 14 bp, Homo sapiens
atcccttccacctg

SEQ ID NO: 3978541 - DNA, 16 bp, Homo sapiens
atcccttccacctgct

SEQ ID NO: 3978542 - DNA, 22 bp, Homo sapiens
atcccttccacctgctctgctg

SEQ ID NO: 3978543 - DNA, 19 bp, Homo sapiens
atcccttcccacatgcctg

SEQ ID NO: 3978544 - DNA, 14 bp, Homo sapiens
atcccttctcttcc

SEQ ID NO: 3978545 - DNA, 15 bp, Homo sapiens
atcccttctcttcca

SEQ ID NO: 3978546 - DNA, 17 bp, Homo sapiens
atcccttctcttccagg

SEQ ID NO: 3978547 - DNA, 22 bp, Homo sapiens
atcccttctcttccaggcagcc

SEQ ID NO: 3978548 - DNA, 22 bp, Homo sapiens
atccctttattaccccctcctt

SEQ ID NO: 3978549 - DNA, 18 bp, Homo sapiens
atccgcctacctcagcct

SEQ ID NO: 3978550 - DNA, 20 bp, Homo sapiens
atccgctgccagccttgagc

SEQ ID NO: 3978551 - DNA, 19 bp, Homo sapiens
atcctaagaaatatgtgag

SEQ ID NO: 3978552 - DNA, 23 bp, Homo sapiens
atcctaagaaatatgtgagattt

SEQ ID NO: 3978553 - DNA, 12 bp, Homo sapiens
atcctaagctat

SEQ ID NO: 3978554 - DNA, 21 bp, Homo sapiens
atcctaagctattcagtaata

SEQ ID NO: 3978555 - DNA, 15 bp, Homo sapiens
atcctaatttctcct

SEQ ID NO: 3978556 - DNA, 18 bp, Homo sapiens
atcctatatagaatgctg

SEQ ID NO: 3978557 - DNA, 20 bp, Homo sapiens
atcctatatagaatgctgca

SEQ ID NO: 3978558 - DNA, 18 bp, Homo sapiens
atcctatccactgggcac

SEQ ID NO: 3978559 - DNA, 21 bp, Homo sapiens
atcctattaaaacacagcttt

SEQ ID NO: 3978560 - DNA, 16 bp, Homo sapiens
atcctcactgccctcc

SEQ ID NO: 3978561 - DNA, 22 bp, Homo sapiens
atcctccagagaaacccaggga

SEQ ID NO: 3978562 - DNA, 12 bp, Homo sapiens
atcctccagggc

SEQ ID NO: 3978563 - DNA, 19 bp, Homo sapiens
atcctccagtaccttgctt

SEQ ID NO: 3978564 - DNA, 12 bp, Homo sapiens
atcctccctcca

SEQ ID NO: 3978565 - DNA, 19 bp, Homo sapiens
atcctccctccacctcaag

SEQ ID NO: 3978566 - DNA, 13 bp, Homo sapiens
atcctcctccttc

SEQ ID NO: 3978567 - DNA, 14 bp, Homo sapiens
atcctcctccttcc

SEQ ID NO: 3978568 - DNA, 12 bp, Homo sapiens
atcctcctggaa

SEQ ID NO: 3978569 - DNA, 16 bp, Homo sapiens
atcctcctggaacctt

SEQ ID NO: 3978570 - DNA, 15 bp, Homo sapiens
atcctctccactcca

SEQ ID NO: 3978571 - DNA, 19 bp, Homo sapiens
atcctgaactgcttctcca

SEQ ID NO: 3978572 - DNA, 14 bp, Homo sapiens
atcctgactctgcc

SEQ ID NO: 3978573 - DNA, 17 bp, Homo sapiens
atcctgactctgccccc

SEQ ID NO: 3978574 - DNA, 18 bp, Homo sapiens
atcctgactctgccccct

SEQ ID NO: 3978575 - DNA, 19 bp, Homo sapiens
atcctgactctgccccctg

SEQ ID NO: 3978576 - DNA, 23 bp, Homo sapiens
atcctgacttctaatatcattca

SEQ ID NO: 3978577 - DNA, 24 bp, Homo sapiens
atcctgagccatcggtgaaactaa

SEQ ID NO: 3978578 - DNA, 13 bp, Homo sapiens
atcctgccattta

SEQ ID NO: 3978579 - DNA, 16 bp, Homo sapiens
atcctgccatttaaaa

SEQ ID NO: 3978580 - DNA, 14 bp, Homo sapiens
atcctggaggccca

SEQ ID NO: 3978581 - DNA, 15 bp, Homo sapiens
atcctggaggcccag

SEQ ID NO: 3978582 - DNA, 16 bp, Homo sapiens
atcctggaggcccagt

SEQ ID NO: 3978583 - DNA, 18 bp, Homo sapiens
atcctggctaacatggtg

SEQ ID NO: 3978584 - DNA, 20 bp, Homo sapiens
atcctggggcattaaaaaaa

SEQ ID NO: 3978585 - DNA, 21 bp, Homo sapiens
atcctgtgactgtctcactta

SEQ ID NO: 3978586 - DNA, 23 bp, Homo sapiens
atcctgttaagagataattctta

SEQ ID NO: 3978587 - DNA, 20 bp, Homo sapiens
atccttatcagagctaaggg

SEQ ID NO: 3978588 - DNA, 20 bp, Homo sapiens
atccttcaagaactctgggc

SEQ ID NO: 3978589 - DNA, 16 bp, Homo sapiens
atccttcaccagagcc

SEQ ID NO: 3978590 - DNA, 20 bp, Homo sapiens
atccttcaccagagcccatg

SEQ ID NO: 3978591 - DNA, 19 bp, Homo sapiens
atccttccaaaaattatta

SEQ ID NO: 3978592 - DNA, 20 bp, Homo sapiens
atccttccaaaaattattat

SEQ ID NO: 3978593 - DNA, 21 bp, Homo sapiens
atccttccgccaatctggccc

SEQ ID NO: 3978594 - DNA, 22 bp, Homo sapiens
atccttccgccaatctggccct

SEQ ID NO: 3978595 - DNA, 11 bp, Homo sapiens
atccttccttc

SEQ ID NO: 3978596 - DNA, 17 bp, Homo sapiens
atccttctcattaccca

SEQ ID NO: 3978597 - DNA, 20 bp, Homo sapiens
atccttctttgtaatacttt

SEQ ID NO: 3978598 - DNA, 22 bp, Homo sapiens
atccttgatgcaagtgcaacct

SEQ ID NO: 3978599 - DNA, 18 bp, Homo sapiens
atccttgggggctcccag

SEQ ID NO: 3978600 - DNA, 18 bp, Homo sapiens
atcctttcacttctttcc

SEQ ID NO: 3978601 - DNA, 20 bp, Homo sapiens
atcctttcacttctttccct

SEQ ID NO: 3978602 - DNA, 20 bp, Homo sapiens
atcctttgcagggcagcccc

SEQ ID NO: 3978603 - DNA, 21 bp, Homo sapiens
atccttttccttatttgcctt

SEQ ID NO: 3978604 - DNA, 12 bp, Homo sapiens
atccttttctgt

SEQ ID NO: 3978605 - DNA, 16 bp, Homo sapiens
atccttttctgtgttt

SEQ ID NO: 3978606 - DNA, 17 bp, Homo sapiens
atcgaaataacaatgtt

SEQ ID NO: 3978607 - DNA, 19 bp, Homo sapiens
atcgaaataacaatgttaa

SEQ ID NO: 3978608 - DNA, 15 bp, Homo sapiens
atcgagaccatcctg

SEQ ID NO: 3978609 - DNA, 16 bp, Homo sapiens
atcgagaccatcctgg

SEQ ID NO: 3978610 - DNA, 17 bp, Homo sapiens
atcgagaccatcctggc

SEQ ID NO: 3978611 - DNA, 21 bp, Homo sapiens
atcgagtgagacaaaatttta

SEQ ID NO: 3978612 - DNA, 15 bp, Homo sapiens
atcgatatgtatatc

SEQ ID NO: 3978613 - DNA, 21 bp, Homo sapiens
atcgcaggagtctctgccacc

SEQ ID NO: 3978614 - DNA, 22 bp, Homo sapiens
atcgcaggagtctctgccaccc

SEQ ID NO: 3978615 - DNA, 23 bp, Homo sapiens
atcgcaggagtctctgccaccca

SEQ ID NO: 3978616 - DNA, 20 bp, Homo sapiens
atcgccagaggtgcttcacc

SEQ ID NO: 3978617 - DNA, 14 bp, Homo sapiens
atcgccagcaaaac

SEQ ID NO: 3978618 - DNA, 17 bp, Homo sapiens
atcgctttatgtttttg

SEQ ID NO: 3978619 - DNA, 21 bp, Homo sapiens
atcggaggctgggcccctggg

SEQ ID NO: 3978620 - DNA, 18 bp, Homo sapiens
atcggagtcagccaggag

SEQ ID NO: 3978621 - DNA, 20 bp, Homo sapiens
atcaactcccaacttcttcc

SEQ ID NO: 3978622 - DNA, 21 bp, Homo sapiens
atcaactcccaacttcttcct

SEQ ID NO: 3978623 - DNA, 12 bp, Homo sapiens
atcaagaaagtc

SEQ ID NO: 3978624 - DNA, 15 bp, Homo sapiens
atcaagaaagtgttg

SEQ ID NO: 3978625 - DNA, 18 bp, Homo sapiens
atcaagatttttttcctg

SEQ ID NO: 3978626 - DNA, 16 bp, Homo sapiens
atcaagcaacattctt

SEQ ID NO: 3978627 - DNA, 22 bp, Homo sapiens
atcaaggaagaaatggttcaga

SEQ ID NO: 3978628 - DNA, 23 bp, Homo sapiens
atcaaggttataattttttttaa

SEQ ID NO: 3978629 - DNA, 16 bp, Homo sapiens
atcaagtatttgggaa

SEQ ID NO: 3978630 - DNA, 19 bp, Homo sapiens
atcaagtcaatcatttctc

SEQ ID NO: 3978631 - DNA, 16 bp, Homo sapiens
atcaagtgtgctttag

SEQ ID NO: 3978632 - DNA, 20 bp, Homo sapiens
atcaagttgtaacttatatt

SEQ ID NO: 3978633 - DNA, 13 bp, Homo sapiens
atcaataaatgct

SEQ ID NO: 3978634 - DNA, 12 bp, Homo sapiens
atcaatacacta

SEQ ID NO: 3978635 - DNA, 19 bp, Homo sapiens
atcaatacactagttgttt

SEQ ID NO: 3978636 - DNA, 11 bp, Homo sapiens
atcaatacaga

SEQ ID NO: 3978637 - DNA, 15 bp, Homo sapiens
atcaatatctaatat

SEQ ID NO: 3978638 - DNA, 13 bp, Homo sapiens
atcaatcaaataa

SEQ ID NO: 3978639 - DNA, 15 bp, Homo sapiens
atcaatctttagaaa

SEQ ID NO: 3978640 - DNA, 21 bp, Homo sapiens
atcaatctttagaaaaggcat

SEQ ID NO: 3978641 - DNA, 15 bp, Homo sapiens
atcaatgaatattga

SEQ ID NO: 3978642 - DNA, 20 bp, Homo sapiens
atcaatgaatttgttctttc

SEQ ID NO: 3978643 - DNA, 14 bp, Homo sapiens
atcaatgagtaaca

SEQ ID NO: 3978644 - DNA, 21 bp, Homo sapiens
atcaatgttcacgcaacttga

SEQ ID NO: 3978645 - DNA, 15 bp, Homo sapiens
atcaatgttcattgt

SEQ ID NO: 3978646 - DNA, 16 bp, Homo sapiens
atcaatgttcattgta

SEQ ID NO: 3978647 - DNA, 17 bp, Homo sapiens
atcaatgttcattgtaa

SEQ ID NO: 3978648 - DNA, 19 bp, Homo sapiens
atcaatgtttcttctaggt

SEQ ID NO: 3978649 - DNA, 17 bp, Homo sapiens
atcatggcactgcattc

SEQ ID NO: 3978650 - DNA, 14 bp, Homo sapiens
atcatggtgtaata

SEQ ID NO: 3978651 - DNA, 19 bp, Homo sapiens
atcatggtgtaataagaca

SEQ ID NO: 3978652 - DNA, 11 bp, Homo sapiens
atcatgtatgt

SEQ ID NO: 3978653 - DNA, 14 bp, Homo sapiens
atcattaatgtaat

SEQ ID NO: 3978654 - DNA, 17 bp, Homo sapiens
atcattaatttttaatt

SEQ ID NO: 3978655 - DNA, 18 bp, Homo sapiens
atcattaatttttaattg

SEQ ID NO: 3978656 - DNA, 22 bp, Homo sapiens
atcattacccttccctgcacta

SEQ ID NO: 3978657 - DNA, 16 bp, Homo sapiens
atcattataaacgtga

SEQ ID NO: 3978658 - DNA, 22 bp, Homo sapiens
atcattccctctcatctcaggt

SEQ ID NO: 3978659 - DNA, 16 bp, Homo sapiens
atcattccttctggcc

SEQ ID NO: 3978660 - DNA, 18 bp, Homo sapiens
atcattgattgtcagcta

SEQ ID NO: 3978661 - DNA, 19 bp, Homo sapiens
atcattggaacaactgata

SEQ ID NO: 3978662 - DNA, 22 bp, Homo sapiens
atcatttattttttacattatt

SEQ ID NO: 3978663 - DNA, 15 bp, Homo sapiens
atcatttgcccttaa

SEQ ID NO: 3978664 - DNA, 18 bp, Homo sapiens
atcatttgcccttaagga

SEQ ID NO: 3978665 - DNA, 22 bp, Homo sapiens
atcattttcttatcttctgcaa

SEQ ID NO: 3978666 - DNA, 17 bp, Homo sapiens
atcattttgcattcaaa

SEQ ID NO: 3978667 - DNA, 19 bp, Homo sapiens
atcattttgcattcaaatt

SEQ ID NO: 3978668 - DNA, 19 bp, Homo sapiens
atcattttgcctcttttct

SEQ ID NO: 3978669 - DNA, 18 bp, Homo sapiens
atccaaaaatagccctgc

SEQ ID NO: 3978670 - DNA, 17 bp, Homo sapiens
atccaaaacttctcttg

SEQ ID NO: 3978671 - DNA, 19 bp, Homo sapiens
atccaaaatgtgtatttct

SEQ ID NO: 3978672 - DNA, 20 bp, Homo sapiens
atccaaagaacttgatttgc

SEQ ID NO: 3978673 - DNA, 21 bp, Homo sapiens
atccaaagaacttgatttgca

SEQ ID NO: 3978674 - DNA, 13 bp, Homo sapiens
atccaacaagaag

SEQ ID NO: 3978675 - DNA, 15 bp, Homo sapiens
atccaacttccaaga

SEQ ID NO: 3978676 - DNA, 21 bp, Homo sapiens
atccaagatcaattccctctc

SEQ ID NO: 3978677 - DNA, 23 bp, Homo sapiens
atccaagcttttttaaagtaaaa

SEQ ID NO: 3978678 - DNA, 19 bp, Homo sapiens
atccaatattttctttaat

SEQ ID NO: 3978679 - DNA, 22 bp, Homo sapiens
atccaatattttctttaatgct

SEQ ID NO: 3978680 - DNA, 20 bp, Homo sapiens
atccacaggaaagtgttatt

SEQ ID NO: 3978681 - DNA, 20 bp, Homo sapiens
atccacagtctcccccaccc

SEQ ID NO: 3978682 - DNA, 16 bp, Homo sapiens
atccactctaccctcc

SEQ ID NO: 3978683 - DNA, 20 bp, Homo sapiens
atccagaaacttgttcttcc

SEQ ID NO: 3978684 - DNA, 21 bp, Homo sapiens
atccagacatcatgaatttta

SEQ ID NO: 3978685 - DNA, 14 bp, Homo sapiens
atccagagagcagc

SEQ ID NO: 3978686 - DNA, 17 bp, Homo sapiens
atccagcagtgttgctc

SEQ ID NO: 3978687 - DNA, 22 bp, Homo sapiens
atccaggactatatttgggcct

SEQ ID NO: 3978688 - DNA, 22 bp, Homo sapiens
atccaggcagatccaggactat

SEQ ID NO: 3978689 - DNA, 14 bp, Homo sapiens
atccagggacagag

SEQ ID NO: 3978690 - DNA, 18 bp, Homo sapiens
atccaggtcttgactcat

SEQ ID NO: 3978691 - DNA, 15 bp, Homo sapiens
atccagtaaaataat

SEQ ID NO: 3978692 - DNA, 16 bp, Homo sapiens
atccataccagctcgc

SEQ ID NO: 3978693 - DNA, 22 bp, Homo sapiens
atccataggtttctctccctcc

SEQ ID NO: 3978694 - DNA, 14 bp, Homo sapiens
atccatcagctccc

SEQ ID NO: 3978695 - DNA, 21 bp, Homo sapiens
atccatcagctcccttttctt

SEQ ID NO: 3978696 - DNA, 13 bp, Homo sapiens
atccatcagtgcc

SEQ ID NO: 3978697 - DNA, 12 bp, Homo sapiens
atccatctccag

SEQ ID NO: 3978698 - DNA, 14 bp, Homo sapiens
atccatgtactgta

SEQ ID NO: 3978699 - DNA, 20 bp, Homo sapiens
atccatgtactgtagttttt

SEQ ID NO: 3978700 - DNA, 18 bp, Homo sapiens
atccattacctccatcca

SEQ ID NO: 3978701 - DNA, 17 bp, Homo sapiens
atccattaggccagcaa

SEQ ID NO: 3978702 - DNA, 18 bp, Homo sapiens
atccattaggccagcaac

SEQ ID NO: 3978703 - DNA, 19 bp, Homo sapiens
atccattaggccagcaacg

SEQ ID NO: 3978704 - DNA, 13 bp, Homo sapiens
atccatttcccct

SEQ ID NO: 3978705 - DNA, 14 bp, Homo sapiens
atccatttgccttt

SEQ ID NO: 3978706 - DNA, 23 bp, Homo sapiens
atcccaactgtctttttttccct

SEQ ID NO: 3978707 - DNA, 14 bp, Homo sapiens
atcccaagcctcct

SEQ ID NO: 3978708 - DNA, 18 bp, Homo sapiens
atcccacgcactccatga

SEQ ID NO: 3978709 - DNA, 22 bp, Homo sapiens
atcccactttctatagcagatt

SEQ ID NO: 3978710 - DNA, 20 bp, Homo sapiens
atcccagctacttgggaagc

SEQ ID NO: 3978711 - DNA, 22 bp, Homo sapiens
atcccagctacttgggaggctg

SEQ ID NO: 3978712 - DNA, 20 bp, Homo sapiens
atcccagctttaaaaagaaa

SEQ ID NO: 3978713 - DNA, 13 bp, Homo sapiens
atcccagggctgg

SEQ ID NO: 3978714 - DNA, 18 bp, Homo sapiens
atcccagggctggctctg

SEQ ID NO: 3978715 - DNA, 15 bp, Homo sapiens
atcccatccatcagc

SEQ ID NO: 3978716 - DNA, 19 bp, Homo sapiens
atcccatgagaccctggtg

SEQ ID NO: 3978717 - DNA, 15 bp, Homo sapiens
atcccatgtatttat

SEQ ID NO: 3978718 - DNA, 18 bp, Homo sapiens
atcccattaatcatttcc

SEQ ID NO: 3978719 - DNA, 15 bp, Homo sapiens
atccccaatcagctc

SEQ ID NO: 3978720 - DNA, 19 bp, Homo sapiens
atccccactgggaccaacc

SEQ ID NO: 3978721 - DNA, 12 bp, Homo sapiens
atccccagggca

SEQ ID NO: 3978722 - DNA, 20 bp, Homo sapiens
atccccatcaggtagctgtc

SEQ ID NO: 3978723 - DNA, 13 bp, Homo sapiens
atccccatctccc

SEQ ID NO: 3978724 - DNA, 16 bp, Homo sapiens
atccccatctccctgc

SEQ ID NO: 3978725 - DNA, 12 bp, Homo sapiens
atcccccagcct

SEQ ID NO: 3978726 - DNA, 13 bp, Homo sapiens
atcccccctgctc

SEQ ID NO: 3978727 - DNA, 22 bp, Homo sapiens
ataaagttgaagctaagattta

SEQ ID NO: 3978728 - DNA, 15 bp, Homo sapiens
ataaataaaaatgga

SEQ ID NO: 3978729 - DNA, 17 bp, Homo sapiens
ataaataaaaatggata

SEQ ID NO: 3978730 - DNA, 14 bp, Homo sapiens
ataaataaaactga

SEQ ID NO: 3978731 - DNA, 19 bp, Homo sapiens
ataaataactcaatggaaa

SEQ ID NO: 3978732 - DNA, 13 bp, Homo sapiens
ataaatacaaatc

SEQ ID NO: 3978733 - DNA, 14 bp, Homo sapiens
ataaatacaaatct

SEQ ID NO: 3978734 - DNA, 18 bp, Homo sapiens
ataaatacaaatctgtat

SEQ ID NO: 3978735 - DNA, 15 bp, Homo sapiens
ataaatagaactatc

SEQ ID NO: 3978736 - DNA, 15 bp, Homo sapiens
ataaatagctatatc

SEQ ID NO: 3978737 - DNA, 15 bp, Homo sapiens
ataaatataagcctt

SEQ ID NO: 3978738 - DNA, 14 bp, Homo sapiens
ataaatatgcagtg

SEQ ID NO: 3978739 - DNA, 20 bp, Homo sapiens
ataaatatttatgtagatgt

SEQ ID NO: 3978740 - DNA, 15 bp, Homo sapiens
ataaatcaatgtcac

SEQ ID NO: 3978741 - DNA, 20 bp, Homo sapiens
ataaatcagagagcaaggca

SEQ ID NO: 3978742 - DNA, 14 bp, Homo sapiens
ataaatcatattga

SEQ ID NO: 3978743 - DNA, 15 bp, Homo sapiens
ataaatcatattgat

SEQ ID NO: 3978744 - DNA, 21 bp, Homo sapiens
ataaatcatattgatgaaaag

SEQ ID NO: 3978745 - DNA, 15 bp, Homo sapiens
ataaatctgacccag

SEQ ID NO: 3978746 - DNA, 19 bp, Homo sapiens
ataaatctgacccagtgcc

SEQ ID NO: 3978747 - DNA, 22 bp, Homo sapiens
ataaatctgttctgggctcttt

SEQ ID NO: 3978748 - DNA, 14 bp, Homo sapiens
ataaatgaagatta

SEQ ID NO: 3978749 - DNA, 20 bp, Homo sapiens
ataaatgaagcagctttaaa

SEQ ID NO: 3978750 - DNA, 16 bp, Homo sapiens
ataaatgattcttagt

SEQ ID NO: 3978751 - DNA, 21 bp, Homo sapiens
ataaatgctattttttatttt

SEQ ID NO: 3978752 - DNA, 15 bp, Homo sapiens
ataaatgctctattt

SEQ ID NO: 3978753 - DNA, 13 bp, Homo sapiens
ataaatgggtgta

SEQ ID NO: 3978754 - DNA, 22 bp, Homo sapiens
ataaatgtattcaaataccaat

SEQ ID NO: 3978755 - DNA, 17 bp, Homo sapiens
ataaatgtctattatta

SEQ ID NO: 3978756 - DNA, 21 bp, Homo sapiens
ataaatgtctattattatgaa

SEQ ID NO: 3978757 - DNA, 16 bp, Homo sapiens
ataaatgttagttcta

SEQ ID NO: 3978758 - DNA, 17 bp, Homo sapiens
ataaattaatattgtat

SEQ ID NO: 3978759 - DNA, 21 bp, Homo sapiens
ataaattctataggaacatat

SEQ ID NO: 3978760 - DNA, 13 bp, Homo sapiens
ataaattgaaatt

SEQ ID NO: 3978761 - DNA, 17 bp, Homo sapiens
ataaattgaaattgtga

SEQ ID NO: 3978762 - DNA, 18 bp, Homo sapiens
ataacaactatttacata

SEQ ID NO: 3978763 - DNA, 16 bp, Homo sapiens
ataacaagatctttca

SEQ ID NO: 3978764 - DNA, 17 bp, Homo sapiens
ataacaagatctttcag

SEQ ID NO: 3978765 - DNA, 14 bp, Homo sapiens
ataacacagagaga

SEQ ID NO: 3978766 - DNA, 15 bp, Homo sapiens
ataacactaaaattt

SEQ ID NO: 3978767 - DNA, 20 bp, Homo sapiens
ataacatgtaattaagtact

SEQ ID NO: 3978768 - DNA, 20 bp, Homo sapiens
ataacattaccttactgtgg

SEQ ID NO: 3978769 - DNA, 14 bp, Homo sapiens
ataattcttgtata

SEQ ID NO: 3978770 - DNA, 22 bp, Homo sapiens
ataattgacaggattattggaa

SEQ ID NO: 3978771 - DNA, 14 bp, Homo sapiens
ataattgatcaaat

SEQ ID NO: 3978772 - DNA, 13 bp, Homo sapiens
ataattgcatcta

SEQ ID NO: 3978773 - DNA, 15 bp, Homo sapiens
ataattgttgaaatt

SEQ ID NO: 3978774 - DNA, 18 bp, Homo sapiens
ataattgttgaaattttg

SEQ ID NO: 3978775 - DNA, 20 bp, Homo sapiens
ataatttatttccactaaaa

SEQ ID NO: 3978776 - DNA, 15 bp, Homo sapiens
ataatttcgagattt

SEQ ID NO: 3978777 - DNA, 12 bp, Homo sapiens
ataatttgtaaa

SEQ ID NO: 3978778 - DNA, 14 bp, Homo sapiens
ataatttgtaaatg

SEQ ID NO: 3978779 - DNA, 15 bp, Homo sapiens
ataatttgtaaatga

SEQ ID NO: 3978780 - DNA, 21 bp, Homo sapiens
ataatttgtaaatgattttaa

SEQ ID NO: 3978781 - DNA, 22 bp, Homo sapiens
ataatttgtaaatgattttaat

SEQ ID NO: 3978782 - DNA, 22 bp, Homo sapiens
ataattttgctggaattcctaa

SEQ ID NO: 3978783 - DNA, 23 bp, Homo sapiens
ataatttttttattactgatttt

SEQ ID NO: 3978784 - DNA, 22 bp, Homo sapiens
ataatttttttcaatatttatt

SEQ ID NO: 3978785 - DNA, 13 bp, Homo sapiens
atacaaaaagaaa

SEQ ID NO: 3978786 - DNA, 16 bp, Homo sapiens
atacaaagtaaataca

SEQ ID NO: 3978787 - DNA, 17 bp, Homo sapiens
atacaaagtaaatacaa

SEQ ID NO: 3978788 - DNA, 18 bp, Homo sapiens
atacaaagtaaatacaag

SEQ ID NO: 3978789 - DNA, 14 bp, Homo sapiens
atacaaatctgtat

SEQ ID NO: 3978790 - DNA, 16 bp, Homo sapiens
atacaaatctgtataa

SEQ ID NO: 3978791 - DNA, 18 bp, Homo sapiens
atacaaattaattttact

SEQ ID NO: 3978792 - DNA, 17 bp, Homo sapiens
atacaaattagaaaatg

SEQ ID NO: 3978793 - DNA, 19 bp, Homo sapiens
atacaaattttcagaaggt

SEQ ID NO: 3978794 - DNA, 12 bp, Homo sapiens
atacaacaaagg

SEQ ID NO: 3978795 - DNA, 23 bp, Homo sapiens
atacaacaaaggcaagttaagag

SEQ ID NO: 3978796 - DNA, 18 bp, Homo sapiens
atacaagactgttgtgat

SEQ ID NO: 3978797 - DNA, 19 bp, Homo sapiens
atacaagactgttgtgatc

SEQ ID NO: 3978798 - DNA, 15 bp, Homo sapiens
atacaagattgaaaa

SEQ ID NO: 3978799 - DNA, 20 bp, Homo sapiens
atacaataaactattggaaa

SEQ ID NO: 3978800 - DNA, 14 bp, Homo sapiens
atacaattaaaggt

SEQ ID NO: 3978801 - DNA, 22 bp, Homo sapiens
atacaattaaaggtcctgccct

SEQ ID NO: 3978802 - DNA, 21 bp, Homo sapiens
atacacagaggagtgcagcct

SEQ ID NO: 3978803 - DNA, 14 bp, Homo sapiens
atacaccgggcctg

SEQ ID NO: 3978804 - DNA, 19 bp, Homo sapiens
atacactaaccaaatctct

SEQ ID NO: 3978805 - DNA, 21 bp, Homo sapiens
atacactatgaagatgtttca

SEQ ID NO: 3978806 - DNA, 21 bp, Homo sapiens
atacactgaagttaacagaga

SEQ ID NO: 3978807 - DNA, 22 bp, Homo sapiens
atacacttacactttatgcaca

SEQ ID NO: 3978808 - DNA, 18 bp, Homo sapiens
atacagacactaagttat

SEQ ID NO: 3978809 - DNA, 19 bp, Homo sapiens
atacagacactaagttata

SEQ ID NO: 3978810 - DNA, 12 bp, Homo sapiens
atacagaggaaa

SEQ ID NO: 3978811 - DNA, 21 bp, Homo sapiens
atacagaggaaatctgtaaca

SEQ ID NO: 3978812 - DNA, 15 bp, Homo sapiens
atacagataacatta

SEQ ID NO: 3978813 - DNA, 22 bp, Homo sapiens
atacagatgaaaatttgagact

SEQ ID NO: 3978814 - DNA, 17 bp, Homo sapiens
atacaggaaaaacaaaa

SEQ ID NO: 3978815 - DNA, 18 bp, Homo sapiens
atacaggcccctgggttt

SEQ ID NO: 3978816 - DNA, 22 bp, Homo sapiens
atacaggttaacctgcagaaac

SEQ ID NO: 3978817 - DNA, 17 bp, Homo sapiens
atacagtgcagagcctt

SEQ ID NO: 3978818 - DNA, 15 bp, Homo sapiens
atacagtgccttgct

SEQ ID NO: 3978819 - DNA, 23 bp, Homo sapiens
atacagtgttattttctttgaaa

SEQ ID NO: 3978820 - DNA, 15 bp, Homo sapiens
atacagttcaataaa

SEQ ID NO: 3978821 - DNA, 21 bp, Homo sapiens
atacagtttatttttaaagat

SEQ ID NO: 3978822 - DNA, 17 bp, Homo sapiens
atacagttttcagaaaa

SEQ ID NO: 3978823 - DNA, 13 bp, Homo sapiens
atacataataaaa

SEQ ID NO: 3978824 - DNA, 22 bp, Homo sapiens
atacatatactgattctgtgta

SEQ ID NO: 3978825 - DNA, 21 bp, Homo sapiens
atacatatcgctgacttcatg

SEQ ID NO: 3978826 - DNA, 17 bp, Homo sapiens
atacatatctttattaa

SEQ ID NO: 3978827 - DNA, 20 bp, Homo sapiens
atacatatctttattaatca

SEQ ID NO: 3978828 - DNA, 19 bp, Homo sapiens
atacatcactgcttgatga

SEQ ID NO: 3978829 - DNA, 22 bp, Homo sapiens
atacatcactgcttgatgaagc

SEQ ID NO: 3978830 - DNA, 14 bp, Homo sapiens
atacatcagttatt

SEQ ID NO: 3978831 - DNA, 19 bp, Homo sapiens
agtgaaataacaaaatgga

SEQ ID NO: 3978832 - DNA, 20 bp, Homo sapiens
agtgaaataacaaaatggac

SEQ ID NO: 3978833 - DNA, 15 bp, Homo sapiens
agtgaaatgtgaagg

SEQ ID NO: 3978834 - DNA, 14 bp, Homo sapiens
agtgaactcctgcc

SEQ ID NO: 3978835 - DNA, 20 bp, Homo sapiens
agtgaactcctgccaggcac

SEQ ID NO: 3978836 - DNA, 21 bp, Homo sapiens
agtgaactcctgccaggcaca

SEQ ID NO: 3978837 - DNA, 15 bp, Homo sapiens
agtgaagactccaga

SEQ ID NO: 3978838 - DNA, 19 bp, Homo sapiens
agtgaagagggagaaggga

SEQ ID NO: 3978839 - DNA, 13 bp, Homo sapiens
agtgaataaatgt

SEQ ID NO: 3978840 - DNA, 19 bp, Homo sapiens
agtgaatttgaatgaaaaa

SEQ ID NO: 3978841 - DNA, 20 bp, Homo sapiens
agtgaatttgaatgaaaaat

SEQ ID NO: 3978842 - DNA, 15 bp, Homo sapiens
agtgacacttcagag

SEQ ID NO: 3978843 - DNA, 16 bp, Homo sapiens
agtgacagacaggctc

SEQ ID NO: 3978844 - DNA, 15 bp, Homo sapiens
agtgacagagttcac

SEQ ID NO: 3978845 - DNA, 20 bp, Homo sapiens
agtgacagtggattgcattt

SEQ ID NO: 3978846 - DNA, 15 bp, Homo sapiens
agtgaccgagagaac

SEQ ID NO: 3978847 - DNA, 14 bp, Homo sapiens
agtgactcgagggt

SEQ ID NO: 3978848 - DNA, 17 bp, Homo sapiens
agtgactgaaaccattt

SEQ ID NO: 3978849 - DNA, 21 bp, Homo sapiens
agtgactgatggctaatgtac

SEQ ID NO: 3978850 - DNA, 17 bp, Homo sapiens
agtgactgtttggctta

SEQ ID NO: 3978851 - DNA, 20 bp, Homo sapiens
agtgactttgtatagagaat

SEQ ID NO: 3978852 - DNA, 18 bp, Homo sapiens
agtgagaaaaagctcctg

SEQ ID NO: 3978853 - DNA, 20 bp, Homo sapiens
agtgagaaaaagctcctgtc

SEQ ID NO: 3978854 - DNA, 22 bp, Homo sapiens
agtgagaaaaagctcctgtcct

SEQ ID NO: 3978855 - DNA, 15 bp, Homo sapiens
agtgagacaaaattt

SEQ ID NO: 3978856 - DNA, 13 bp, Homo sapiens
agtgagacagaag

SEQ ID NO: 3978857 - DNA, 11 bp, Homo sapiens
agtgagactgc

SEQ ID NO: 3978858 - DNA, 21 bp, Homo sapiens
agtgagcagtcgcctgcctgc

SEQ ID NO: 3978859 - DNA, 20 bp, Homo sapiens
agtgagccacagaccacctg

SEQ ID NO: 3978860 - DNA, 13 bp, Homo sapiens
agtgagcctcctg

SEQ ID NO: 3978861 - DNA, 21 bp, Homo sapiens
agtgagcctcctgtgcctggc

SEQ ID NO: 3978862 - DNA, 22 bp, Homo sapiens
agtgagcctcctgtgcctggcc

SEQ ID NO: 3978863 - DNA, 14 bp, Homo sapiens
agtgagtcacctgc

SEQ ID NO: 3978864 - DNA, 19 bp, Homo sapiens
agtgagtcacctgctccag

SEQ ID NO: 3978865 - DNA, 21 bp, Homo sapiens
agtgagtcacctgctccagaa

SEQ ID NO: 3978866 - DNA, 16 bp, Homo sapiens
agtgagtctcttcaga

SEQ ID NO: 3978867 - DNA, 16 bp, Homo sapiens
agtgataatgccccaa

SEQ ID NO: 3978868 - DNA, 14 bp, Homo sapiens
agtgataggcccaa

SEQ ID NO: 3978869 - DNA, 14 bp, Homo sapiens
agtgatataaatca

SEQ ID NO: 3978870 - DNA, 24 bp, Homo sapiens
agtgatatggcagaagacaccaga

SEQ ID NO: 3978871 - DNA, 14 bp, Homo sapiens
agtgatcaaactac

SEQ ID NO: 3978872 - DNA, 16 bp, Homo sapiens
agtgatcaataaaatg

SEQ ID NO: 3978873 - DNA, 17 bp, Homo sapiens
agtgatcaataaaatgt

SEQ ID NO: 3978874 - DNA, 19 bp, Homo sapiens
agtgatcaataaaatgtga

SEQ ID NO: 3978875 - DNA, 20 bp, Homo sapiens
agtgatcaataaaatgtgat

SEQ ID NO: 3978876 - DNA, 17 bp, Homo sapiens
agtgatctcagggcaga

SEQ ID NO: 3978877 - DNA, 21 bp, Homo sapiens
agtgatctccatatgttacac

SEQ ID NO: 3978878 - DNA, 17 bp, Homo sapiens
agtgatgatttggggga

SEQ ID NO: 3978879 - DNA, 22 bp, Homo sapiens
agtgatgatttgggggaggctt

SEQ ID NO: 3978880 - DNA, 21 bp, Homo sapiens
agtgatgctgtgctatgaatt

SEQ ID NO: 3978881 - DNA, 11 bp, Homo sapiens
ataaaaagttc

SEQ ID NO: 3978882 - DNA, 13 bp, Homo sapiens
ataaaaagtttca

SEQ ID NO: 3978883 - DNA, 21 bp, Homo sapiens
ataaaaatggcaaatgcactg

SEQ ID NO: 3978884 - DNA, 14 bp, Homo sapiens
ataaaaattctgaa

SEQ ID NO: 3978885 - DNA, 15 bp, Homo sapiens
ataaaaattctgaat

SEQ ID NO: 3978886 - DNA, 13 bp, Homo sapiens
ataaaagaaacac

SEQ ID NO: 3978887 - DNA, 20 bp, Homo sapiens
ataaaagcagcatctgctaa

SEQ ID NO: 3978888 - DNA, 13 bp, Homo sapiens
ataaaagccttgg

SEQ ID NO: 3978889 - DNA, 12 bp, Homo sapiens
ataaaagctgtg

SEQ ID NO: 3978890 - DNA, 12 bp, Homo sapiens
ataaaaggaaaa

SEQ ID NO: 3978891 - DNA, 17 bp, Homo sapiens
ataaaaggaagccaaag

SEQ ID NO: 3978892 - DNA, 17 bp, Homo sapiens
ataaaagggcaaatctg

SEQ ID NO: 3978893 - DNA, 17 bp, Homo sapiens
ataaaagggtcaaacct

SEQ ID NO: 3978894 - DNA, 21 bp, Homo sapiens
ataaaagggtcaaacctgtag

SEQ ID NO: 3978895 - DNA, 21 bp, Homo sapiens
ataaaaggtggagtttctctg

SEQ ID NO: 3978896 - DNA, 18 bp, Homo sapiens
ataaaagtgatcaataaa

SEQ ID NO: 3978897 - DNA, 22 bp, Homo sapiens
ataaaagtgatcaataaaatgt

SEQ ID NO: 3978898 - DNA, 14 bp, Homo sapiens
ataaaataaagtat

SEQ ID NO: 3978899 - DNA, 16 bp, Homo sapiens
ataaaataattctaaa

SEQ ID NO: 3978900 - DNA, 17 bp, Homo sapiens
ataaaataattctaaag

SEQ ID NO: 3978901 - DNA, 18 bp, Homo sapiens
ataaaataattctaaagg

SEQ ID NO: 3978902 - DNA, 21 bp, Homo sapiens
ataaaatatgaagacataaac

SEQ ID NO: 3978903 - DNA, 21 bp, Homo sapiens
ataaaatcaaaacaagtgaaa

SEQ ID NO: 3978904 - DNA, 13 bp, Homo sapiens
ataaaatgtgatt

SEQ ID NO: 3978905 - DNA, 19 bp, Homo sapiens
ataaaattacaaaagagca

SEQ ID NO: 3978906 - DNA, 16 bp, Homo sapiens
ataaaattcatttcta

SEQ ID NO: 3978907 - DNA, 13 bp, Homo sapiens
ataaaattcgctt

SEQ ID NO: 3978908 - DNA, 17 bp, Homo sapiens
ataaaattcgctttcta

SEQ ID NO: 3978909 - DNA, 22 bp, Homo sapiens
ataaaattctattacagtatgt

SEQ ID NO: 3978910 - DNA, 16 bp, Homo sapiens
ataaacaacagctgaa

SEQ ID NO: 3978911 - DNA, 20 bp, Homo sapiens
ataaacatatacagaaaaat

SEQ ID NO: 3978912 - DNA, 15 bp, Homo sapiens
ataaaccactgtgcg

SEQ ID NO: 3978913 - DNA, 16 bp, Homo sapiens
ataaacctcaaaatgt

SEQ ID NO: 3978914 - DNA, 13 bp, Homo sapiens
ataaacctggaga

SEQ ID NO: 3978915 - DNA, 20 bp, Homo sapiens
ataaacgcgggaaaaaagat

SEQ ID NO: 3978916 - DNA, 17 bp, Homo sapiens
ataaactactctttgat

SEQ ID NO: 3978917 - DNA, 12 bp, Homo sapiens
ataaactgaata

SEQ ID NO: 3978918 - DNA, 17 bp, Homo sapiens
ataaactgaatattttg

SEQ ID NO: 3978919 - DNA, 23 bp, Homo sapiens
ataaactgaatattttggaaact

SEQ ID NO: 3978920 - DNA, 12 bp, Homo sapiens
ataaactgactt

SEQ ID NO: 3978921 - DNA, 13 bp, Homo sapiens
ataaactgacttt

SEQ ID NO: 3978922 - DNA, 18 bp, Homo sapiens
ataaactgactttatcct

SEQ ID NO: 3978923 - DNA, 17 bp, Homo sapiens
ataaacttggattctct

SEQ ID NO: 3978924 - DNA, 18 bp, Homo sapiens
ataaacttttttttatga

SEQ ID NO: 3978925 - DNA, 19 bp, Homo sapiens
ataaagaaaacttccatag

SEQ ID NO: 3978926 - DNA, 18 bp, Homo sapiens
ataaagaaatatttacct

SEQ ID NO: 3978927 - DNA, 19 bp, Homo sapiens
ataaagaaggataaattgt

SEQ ID NO: 3978928 - DNA, 18 bp, Homo sapiens
ataaagaattaatgactt

SEQ ID NO: 3978929 - DNA, 16 bp, Homo sapiens
ataaagacccaggggg

SEQ ID NO: 3978930 - DNA, 23 bp, Homo sapiens
ataaagatgatctactcagaaat

SEQ ID NO: 3978931 - DNA, 14 bp, Homo sapiens
ataaagcacagctg

SEQ ID NO: 3978932 - DNA, 20 bp, Homo sapiens
ataaagcacgtgcaaggact

SEQ ID NO: 3978933 - DNA, 20 bp, Homo sapiens
ataaagcataagtatacagt

SEQ ID NO: 3978934 - DNA, 17 bp, Homo sapiens
ataaagcgatatacaga

SEQ ID NO: 3978935 - DNA, 19 bp, Homo sapiens
ataaagcgatatacagatg

SEQ ID NO: 3978936 - DNA, 13 bp, Homo sapiens
ataaagcttaata

SEQ ID NO: 3978937 - DNA, 17 bp, Homo sapiens
ataaaggatgtgattgt

SEQ ID NO: 3978938 - DNA, 19 bp, Homo sapiens
ataaaggccccaaatacca

SEQ ID NO: 3978939 - DNA, 16 bp, Homo sapiens
ataaaggctaactatg

SEQ ID NO: 3978940 - DNA, 14 bp, Homo sapiens
ataaagtgtaacaa

SEQ ID NO: 3978941 - DNA, 22 bp, Homo sapiens
ataggtttttctcatgtatctt

SEQ ID NO: 3978942 - DNA, 19 bp, Homo sapiens
atagtaacttcttatggaa

SEQ ID NO: 3978943 - DNA, 21 bp, Homo sapiens
atagtaacttcttatggaatt

SEQ ID NO: 3978944 - DNA, 17 bp, Homo sapiens
atagtaccaatcatttt

SEQ ID NO: 3978945 - DNA, 19 bp, Homo sapiens
atagtaccatttatacaaa

SEQ ID NO: 3978946 - DNA, 21 bp, Homo sapiens
atagtaccatttatacaaatt

SEQ ID NO: 3978947 - DNA, 18 bp, Homo sapiens
atagtaccttcaatactt

SEQ ID NO: 3978948 - DNA, 18 bp, Homo sapiens
atagtactctttgtagca

SEQ ID NO: 3978949 - DNA, 17 bp, Homo sapiens
atagtagcatacattta

SEQ ID NO: 3978950 - DNA, 15 bp, Homo sapiens
atagtaggcatgtta

SEQ ID NO: 3978951 - DNA, 15 bp, Homo sapiens
atagtatatctggac

SEQ ID NO: 3978952 - DNA, 17 bp, Homo sapiens
atagtatatctggacaa

SEQ ID NO: 3978953 - DNA, 22 bp, Homo sapiens
atagtattggagcacatgttac

SEQ ID NO: 3978954 - DNA, 17 bp, Homo sapiens
atagtcaatttctactt

SEQ ID NO: 3978955 - DNA, 14 bp, Homo sapiens
atagtcacaagagc

SEQ ID NO: 3978956 - DNA, 20 bp, Homo sapiens
atagtccagacacttaactc

SEQ ID NO: 3978957 - DNA, 14 bp, Homo sapiens
atagtctctttaaa

SEQ ID NO: 3978958 - DNA, 21 bp, Homo sapiens
atagtctctttaaaaggaaag

SEQ ID NO: 3978959 - DNA, 16 bp, Homo sapiens
atagtgaatacttact

SEQ ID NO: 3978960 - DNA, 21 bp, Homo sapiens
atagtgatggggctcagatgg

SEQ ID NO: 3978961 - DNA, 20 bp, Homo sapiens
atagtgcaactatgaatgta

SEQ ID NO: 3978962 - DNA, 22 bp, Homo sapiens
atagtgctgggatggaggggag

SEQ ID NO: 3978963 - DNA, 17 bp, Homo sapiens
atagtgcttaaaaatca

SEQ ID NO: 3978964 - DNA, 14 bp, Homo sapiens
atagtgtgttctga

SEQ ID NO: 3978965 - DNA, 19 bp, Homo sapiens
atagtgtgttctgattaga

SEQ ID NO: 3978966 - DNA, 22 bp, Homo sapiens
atagtgttctgcaaaaatattt

SEQ ID NO: 3978967 - DNA, 18 bp, Homo sapiens
atagtgttctgctcctgc

SEQ ID NO: 3978968 - DNA, 17 bp, Homo sapiens
atagttattatttaatt

SEQ ID NO: 3978969 - DNA, 13 bp, Homo sapiens
atagtttgtctat

SEQ ID NO: 3978970 - DNA, 15 bp, Homo sapiens
atagtttgtctattt

SEQ ID NO: 3978971 - DNA, 23 bp, Homo sapiens
atataaaaaccccaaactgttga

SEQ ID NO: 3978972 - DNA, 18 bp, Homo sapiens
atataaaaagaaaagata

SEQ ID NO: 3978973 - DNA, 15 bp, Homo sapiens
atataaatggctggt

SEQ ID NO: 3978974 - DNA, 13 bp, Homo sapiens
atataaattctgt

SEQ ID NO: 3978975 - DNA, 14 bp, Homo sapiens
atataaattctgtg

SEQ ID NO: 3978976 - DNA, 15 bp, Homo sapiens
atataaattctgtgg

SEQ ID NO: 3978977 - DNA, 23 bp, Homo sapiens
atataaccctaacacacacagaa

SEQ ID NO: 3978978 - DNA, 16 bp, Homo sapiens
atataaccctaggaat

SEQ ID NO: 3978979 - DNA, 18 bp, Homo sapiens
atataaccctaggaattt

SEQ ID NO: 3978980 - DNA, 21 bp, Homo sapiens
atataacttaaaaatgtaaat

SEQ ID NO: 3978981 - DNA, 16 bp, Homo sapiens
atataagacatttgtt

SEQ ID NO: 3978982 - DNA, 14 bp, Homo sapiens
atataagtgtacat

SEQ ID NO: 3978983 - DNA, 18 bp, Homo sapiens
atataattcactcaagca

SEQ ID NO: 3978984 - DNA, 14 bp, Homo sapiens
atataattctgtaa

SEQ ID NO: 3978985 - DNA, 21 bp, Homo sapiens
atataatttttttatgttttg

SEQ ID NO: 3978986 - DNA, 13 bp, Homo sapiens
atatacagatgaa

SEQ ID NO: 3978987 - DNA, 16 bp, Homo sapiens
atatacagatgaaaat

SEQ ID NO: 3978988 - DNA, 21 bp, Homo sapiens
atatacagatgaaaatttgag

SEQ ID NO: 3978989 - DNA, 22 bp, Homo sapiens
atatacagatgaaaatttgaga

SEQ ID NO: 3978990 - DNA, 12 bp, Homo sapiens
atatacagttat

SEQ ID NO: 3978991 - DNA, 15 bp, Homo sapiens
atatacagttatttt

SEQ ID NO: 3978992 - DNA, 19 bp, Homo sapiens
atatacatgaaaattttaa

SEQ ID NO: 3978993 - DNA, 20 bp, Homo sapiens
atatactgaagtcttttctg

SEQ ID NO: 3978994 - DNA, 22 bp, Homo sapiens
atatactgggttcttgttttat

SEQ ID NO: 3978995 - DNA, 20 bp, Homo sapiens
atatactttgaaaggagatg

SEQ ID NO: 3978996 - DNA, 14 bp, Homo sapiens
atatagattagaaa

SEQ ID NO: 3978997 - DNA, 15 bp, Homo sapiens
atatagattagaaaa

SEQ ID NO: 3978998 - DNA, 16 bp, Homo sapiens
atatagattagaaaaa

SEQ ID NO: 3978999 - DNA, 14 bp, Homo sapiens
atatagtaaacact

SEQ ID NO: 3979000 - DNA, 15 bp, Homo sapiens
atatagtccagacac

SEQ ID NO: 3979001 - DNA, 21 bp, Homo sapiens
atatataaaacggtgctgtga

SEQ ID NO: 3979002 - DNA, 15 bp, Homo sapiens
atatataagtgtaca

SEQ ID NO: 3979003 - DNA, 16 bp, Homo sapiens
atatataagtgtacat

SEQ ID NO: 3979004 - DNA, 21 bp, Homo sapiens
atatataagtttacaccttta

SEQ ID NO: 3979005 - DNA, 17 bp, Homo sapiens
atatatacaaaaagaaa

SEQ ID NO: 3979006 - DNA, 12 bp, Homo sapiens
atatatacttgt

SEQ ID NO: 3979007 - DNA, 15 bp, Homo sapiens
atatatatatatgca

SEQ ID NO: 3979008 - DNA, 21 bp, Homo sapiens
atactggtgcagtcattatga

SEQ ID NO: 3979009 - DNA, 21 bp, Homo sapiens
atactgtcggttttttttaaa

SEQ ID NO: 3979010 - DNA, 19 bp, Homo sapiens
atactgtgaagttacatgc

SEQ ID NO: 3979011 - DNA, 17 bp, Homo sapiens
atactgtgcagaataat

SEQ ID NO: 3979012 - DNA, 18 bp, Homo sapiens
atactgtgcagaataatg

SEQ ID NO: 3979013 - DNA, 22 bp, Homo sapiens
atactgtgtgcttgttttataa

SEQ ID NO: 3979014 - DNA, 15 bp, Homo sapiens
atacttatctctctg

SEQ ID NO: 3979015 - DNA, 16 bp, Homo sapiens
atacttatctctctgt

SEQ ID NO: 3979016 - DNA, 18 bp, Homo sapiens
atacttcaaaaataatgt

SEQ ID NO: 3979017 - DNA, 16 bp, Homo sapiens
atacttcactacttta

SEQ ID NO: 3979018 - DNA, 21 bp, Homo sapiens
atacttcatgagcattcataa

SEQ ID NO: 3979019 - DNA, 17 bp, Homo sapiens
atacttcatttaaaaaa

SEQ ID NO: 3979020 - DNA, 20 bp, Homo sapiens
atacttcatttaaaaaaatc

SEQ ID NO: 3979021 - DNA, 20 bp, Homo sapiens
atacttgaagggccagagcc

SEQ ID NO: 3979022 - DNA, 21 bp, Homo sapiens
atacttgaagggccagagcca

SEQ ID NO: 3979023 - DNA, 16 bp, Homo sapiens
atacttggatttagtt

SEQ ID NO: 3979024 - DNA, 14 bp, Homo sapiens
atacttgtgatttt

SEQ ID NO: 3979025 - DNA, 17 bp, Homo sapiens
atacttgtggttttcaa

SEQ ID NO: 3979026 - DNA, 18 bp, Homo sapiens
atacttgtggttttcaaa

SEQ ID NO: 3979027 - DNA, 19 bp, Homo sapiens
atacttgtggttttcaaat

SEQ ID NO: 3979028 - DNA, 12 bp, Homo sapiens
atactttacatg

SEQ ID NO: 3979029 - DNA, 15 bp, Homo sapiens
atactttatttctga

SEQ ID NO: 3979030 - DNA, 21 bp, Homo sapiens
atactttcatcctgactctgc

SEQ ID NO: 3979031 - DNA, 23 bp, Homo sapiens
atactttgcttcatagtattgga

SEQ ID NO: 3979032 - DNA, 15 bp, Homo sapiens
atacttttactctgc

SEQ ID NO: 3979033 - DNA, 19 bp, Homo sapiens
atacttttcccctgttaaa

SEQ ID NO: 3979034 - DNA, 21 bp, Homo sapiens
atacttttcccctgttaaaca

SEQ ID NO: 3979035 - DNA, 13 bp, Homo sapiens
atactttttacaa

SEQ ID NO: 3979036 - DNA, 10 bp, Homo sapiens
atagaaaaat

SEQ ID NO: 3979037 - DNA, 23 bp, Homo sapiens
atagaaaaattcagcaaaccatt

SEQ ID NO: 3979038 - DNA, 18 bp, Homo sapiens
atagaaataaattcctaa

SEQ ID NO: 3979039 - DNA, 14 bp, Homo sapiens
atagaaattttgta

SEQ ID NO: 3979040 - DNA, 15 bp, Homo sapiens
atagaactctgggct

SEQ ID NO: 3979041 - DNA, 18 bp, Homo sapiens
atagaataaaatataatt

SEQ ID NO: 3979042 - DNA, 16 bp, Homo sapiens
atagaatcaatcagta

SEQ ID NO: 3979043 - DNA, 21 bp, Homo sapiens
atagaatgtggccacttattt

SEQ ID NO: 3979044 - DNA, 15 bp, Homo sapiens
atagaccaaagcaaa

SEQ ID NO: 3979045 - DNA, 15 bp, Homo sapiens
atagacttaaatctc

SEQ ID NO: 3979046 - DNA, 15 bp, Homo sapiens
atagagcaaaattga

SEQ ID NO: 3979047 - DNA, 22 bp, Homo sapiens
atagagctgcagggtggattgt

SEQ ID NO: 3979048 - DNA, 17 bp, Homo sapiens
atagagctgggtggcct

SEQ ID NO: 3979049 - DNA, 21 bp, Homo sapiens
atagaggcttctccgccagcc

SEQ ID NO: 3979050 - DNA, 13 bp, Homo sapiens
atagaggggctgc

SEQ ID NO: 3979051 - DNA, 14 bp, Homo sapiens
atagagtgtactta

SEQ ID NO: 3979052 - DNA, 18 bp, Homo sapiens
atagataggcccctgggg

SEQ ID NO: 3979053 - DNA, 13 bp, Homo sapiens
atagatctccagc

SEQ ID NO: 3979054 - DNA, 17 bp, Homo sapiens
atagatgctggcccagg

SEQ ID NO: 3979055 - DNA, 23 bp, Homo sapiens
atagatgctggcccagggcccag

SEQ ID NO: 3979056 - DNA, 22 bp, Homo sapiens
atagatgtccctttcttggcca

SEQ ID NO: 3979057 - DNA, 14 bp, Homo sapiens
atagattagaaaaa

SEQ ID NO: 3979058 - DNA, 16 bp, Homo sapiens
atagcaacaacaattg

SEQ ID NO: 3979059 - DNA, 18 bp, Homo sapiens
atagcaacaacaattggt

SEQ ID NO: 3979060 - DNA, 22 bp, Homo sapiens
atagcaacttttgtgtaatgaa

SEQ ID NO: 3979061 - DNA, 19 bp, Homo sapiens
atagcagcctttctctctt

SEQ ID NO: 3979062 - DNA, 15 bp, Homo sapiens
atagcattaactaat

SEQ ID NO: 3979063 - DNA, 21 bp, Homo sapiens
atagcattaactaatctattg

SEQ ID NO: 3979064 - DNA, 22 bp, Homo sapiens
atagccacatccctttgaaaca

SEQ ID NO: 3979065 - DNA, 13 bp, Homo sapiens
atagccacatttg

SEQ ID NO: 3979066 - DNA, 16 bp, Homo sapiens
atagccacatttggaa

SEQ ID NO: 3979067 - DNA, 22 bp, Homo sapiens
atagccacatttggaatacttt

SEQ ID NO: 3979068 - DNA, 21 bp, Homo sapiens
atagccattgatcataaactg

SEQ ID NO: 3979069 - DNA, 19 bp, Homo sapiens
atagcccctctccccgcag

SEQ ID NO: 3979070 - DNA, 23 bp, Homo sapiens
atagcctggccaccagccatcct

SEQ ID NO: 3979071 - DNA, 15 bp, Homo sapiens
atagctaagtacaca

SEQ ID NO: 3979072 - DNA, 16 bp, Homo sapiens
atatccatctttttct

SEQ ID NO: 3979073 - DNA, 18 bp, Homo sapiens
atatccatgtactgtagt

SEQ ID NO: 3979074 - DNA, 16 bp, Homo sapiens
atatcccagctttaaa

SEQ ID NO: 3979075 - DNA, 17 bp, Homo sapiens
atatcctctccccctcc

SEQ ID NO: 3979076 - DNA, 19 bp, Homo sapiens
atatcctctccccctcctc

SEQ ID NO: 3979077 - DNA, 13 bp, Homo sapiens
atatcctgagcca

SEQ ID NO: 3979078 - DNA, 13 bp, Homo sapiens
atatcgtgtgtgt

SEQ ID NO: 3979079 - DNA, 14 bp, Homo sapiens
atatctaatatata

SEQ ID NO: 3979080 - DNA, 18 bp, Homo sapiens
atatctaatatatatgaa

SEQ ID NO: 3979081 - DNA, 19 bp, Homo sapiens
atatctaatatatatgaat

SEQ ID NO: 3979082 - DNA, 20 bp, Homo sapiens
atatctaattattttgcagt

SEQ ID NO: 3979083 - DNA, 15 bp, Homo sapiens
atatctattaatata

SEQ ID NO: 3979084 - DNA, 18 bp, Homo sapiens
atatctattaatatatgt

SEQ ID NO: 3979085 - DNA, 23 bp, Homo sapiens
atatctgaaaactggaataagaa

SEQ ID NO: 3979086 - DNA, 16 bp, Homo sapiens
atatctgaaaatgtat

SEQ ID NO: 3979087 - DNA, 13 bp, Homo sapiens
atatctgcaaaaa

SEQ ID NO: 3979088 - DNA, 20 bp, Homo sapiens
atatctggcctaaaatcttg

SEQ ID NO: 3979089 - DNA, 19 bp, Homo sapiens
atatctgggttaagtgttt

SEQ ID NO: 3979090 - DNA, 16 bp, Homo sapiens
atatctgtaatggtac

SEQ ID NO: 3979091 - DNA, 20 bp, Homo sapiens
atatcttctatatctgaaga

SEQ ID NO: 3979092 - DNA, 22 bp, Homo sapiens
atatctttgtgataatttaaga

SEQ ID NO: 3979093 - DNA, 22 bp, Homo sapiens
atatcttttatgtttgaatatg

SEQ ID NO: 3979094 - DNA, 13 bp, Homo sapiens
atatgaaaactat

SEQ ID NO: 3979095 - DNA, 23 bp, Homo sapiens
atatgaaaatacaacttaaataa

SEQ ID NO: 3979096 - DNA, 14 bp, Homo sapiens
atatgatatgtaaa

SEQ ID NO: 3979097 - DNA, 13 bp, Homo sapiens
atatgatctgttt

SEQ ID NO: 3979098 - DNA, 15 bp, Homo sapiens
atatgattggcaata

SEQ ID NO: 3979099 - DNA, 17 bp, Homo sapiens
atatgatttcactagaa

SEQ ID NO: 3979100 - DNA, 18 bp, Homo sapiens
atatgatttcactagaaa

SEQ ID NO: 3979101 - DNA, 19 bp, Homo sapiens
atatgattttatttgacaa

SEQ ID NO: 3979102 - DNA, 20 bp, Homo sapiens
atatgcagtgatatggcaga

SEQ ID NO: 3979103 - DNA, 20 bp, Homo sapiens
atatgcctgaccccttgctc

SEQ ID NO: 3979104 - DNA, 14 bp, Homo sapiens
atatgctaatttgg

SEQ ID NO: 3979105 - DNA, 14 bp, Homo sapiens
atatgcttatacac

SEQ ID NO: 3979106 - DNA, 19 bp, Homo sapiens
atatgcttatacacttaca

SEQ ID NO: 3979107 - DNA, 21 bp, Homo sapiens
atatgcttatacacttacact

SEQ ID NO: 3979108 - DNA, 12 bp, Homo sapiens
atatggaacctt

SEQ ID NO: 3979109 - DNA, 13 bp, Homo sapiens
atatggaaccttc

SEQ ID NO: 3979110 - DNA, 19 bp, Homo sapiens
atatggaaccttccctcca

SEQ ID NO: 3979111 - DNA, 12 bp, Homo sapiens
atatggcagaag

SEQ ID NO: 3979112 - DNA, 14 bp, Homo sapiens
atatggcttcaagt

SEQ ID NO: 3979113 - DNA, 19 bp, Homo sapiens
atatggcttcaagttgtaa

SEQ ID NO: 3979114 - DNA, 21 bp, Homo sapiens
atatgggggcatctcttcccc

SEQ ID NO: 3979115 - DNA, 23 bp, Homo sapiens
atatggtgcagagaagctggact

SEQ ID NO: 3979116 - DNA, 20 bp, Homo sapiens
atatgtaaacataagtgtac

SEQ ID NO: 3979117 - DNA, 14 bp, Homo sapiens
atatgtacataaat

SEQ ID NO: 3979118 - DNA, 15 bp, Homo sapiens
atatgtacataaatt

SEQ ID NO: 3979119 - DNA, 19 bp, Homo sapiens
atatgtagtataaagaaaa

SEQ ID NO: 3979120 - DNA, 17 bp, Homo sapiens
atatgtatatgacattt

SEQ ID NO: 3979121 - DNA, 14 bp, Homo sapiens
atatgtatgctttt

SEQ ID NO: 3979122 - DNA, 16 bp, Homo sapiens
atatgtattatttata

SEQ ID NO: 3979123 - DNA, 18 bp, Homo sapiens
atatgtattatttataat

SEQ ID NO: 3979124 - DNA, 14 bp, Homo sapiens
atatgtattttcct

SEQ ID NO: 3979125 - DNA, 17 bp, Homo sapiens
atatgtcactagaatgg

SEQ ID NO: 3979126 - DNA, 15 bp, Homo sapiens
atatgtgaaacattt

SEQ ID NO: 3979127 - DNA, 21 bp, Homo sapiens
atatgtgagattttttattgc

SEQ ID NO: 3979128 - DNA, 16 bp, Homo sapiens
atatgtgatctgggca

SEQ ID NO: 3979129 - DNA, 18 bp, Homo sapiens
atatgtgctggaattcta

SEQ ID NO: 3979130 - DNA, 16 bp, Homo sapiens
atatgtgtgtgtatgt

SEQ ID NO: 3979131 - DNA, 15 bp, Homo sapiens
atatgttgaatactt

SEQ ID NO: 3979132 - DNA, 13 bp, Homo sapiens
atatgttgctcag

SEQ ID NO: 3979133 - DNA, 14 bp, Homo sapiens
atatgtttatatac

SEQ ID NO: 3979134 - DNA, 15 bp, Homo sapiens
atatgtttatatact

SEQ ID NO: 3979135 - DNA, 11 bp, Homo sapiens
atattaatcaa

SEQ ID NO: 3979136 - DNA, 12 bp, Homo sapiens
atattaatcaaa

SEQ ID NO: 3979137 - DNA, 13 bp, Homo sapiens
atattaatcaaaa

SEQ ID NO: 3979138 - DNA, 19 bp, Homo sapiens
atattaatcaaaattgtct

SEQ ID NO: 3979139 - DNA, 22 bp, Homo sapiens
atattacacaggaggcttcgga

SEQ ID NO: 3979140 - DNA, 15 bp, Homo sapiens
atattactgttgcat

SEQ ID NO: 3979141 - DNA, 17 bp, Homo sapiens
atattactgttgcattt

SEQ ID NO: 3979142 - DNA, 21 bp, Homo sapiens
atattgtacataaaagaattt

SEQ ID NO: 3979143 - DNA, 17 bp, Homo sapiens
atattgtattgctgctg

SEQ ID NO: 3979144 - DNA, 12 bp, Homo sapiens
atattgtcagat

SEQ ID NO: 3979145 - DNA, 16 bp, Homo sapiens
atattgtcagatattt

SEQ ID NO: 3979146 - DNA, 13 bp, Homo sapiens
atattgtgaagta

SEQ ID NO: 3979147 - DNA, 17 bp, Homo sapiens
atattgtgtttgtgtat

SEQ ID NO: 3979148 - DNA, 12 bp, Homo sapiens
atattgtttaaa

SEQ ID NO: 3979149 - DNA, 16 bp, Homo sapiens
atattgtttaaaattc

SEQ ID NO: 3979150 - DNA, 19 bp, Homo sapiens
atattgtttctgcattcat

SEQ ID NO: 3979151 - DNA, 17 bp, Homo sapiens
atattgttttcagtgta

SEQ ID NO: 3979152 - DNA, 22 bp, Homo sapiens
atatttaaaaacaaaaggcaat

SEQ ID NO: 3979153 - DNA, 18 bp, Homo sapiens
atatttaaacagcagtgt

SEQ ID NO: 3979154 - DNA, 22 bp, Homo sapiens
atatttaaacctttttcttgat

SEQ ID NO: 3979155 - DNA, 22 bp, Homo sapiens
atatttaacattatttatatgg

SEQ ID NO: 3979156 - DNA, 23 bp, Homo sapiens
atatttaagaaaagcacttttgt

SEQ ID NO: 3979157 - DNA, 22 bp, Homo sapiens
atatttaagaaaatacaataaa

SEQ ID NO: 3979158 - DNA, 20 bp, Homo sapiens
atatttaagccttataaacc

SEQ ID NO: 3979159 - DNA, 12 bp, Homo sapiens
atatttaatgat

SEQ ID NO: 3979160 - DNA, 15 bp, Homo sapiens
atatttaattattaa

SEQ ID NO: 3979161 - DNA, 15 bp, Homo sapiens
atatttacaataaat

SEQ ID NO: 3979162 - DNA, 18 bp, Homo sapiens
atatttacaataaatgaa

SEQ ID NO: 3979163 - DNA, 21 bp, Homo sapiens
atatttacatgaattgcattt

SEQ ID NO: 3979164 - DNA, 15 bp, Homo sapiens
atatttataactcat

SEQ ID NO: 3979165 - DNA, 23 bp, Homo sapiens
atatttataactcatcataaaat

SEQ ID NO: 3979166 - DNA, 20 bp, Homo sapiens
atatttatccaaaatgtgta

SEQ ID NO: 3979167 - DNA, 20 bp, Homo sapiens
atatttatgtagatgtgcat

SEQ ID NO: 3979168 - DNA, 21 bp, Homo sapiens
atatttatgtctatttaagcc

SEQ ID NO: 3979169 - DNA, 18 bp, Homo sapiens
atatttattaaataaaat

SEQ ID NO: 3979170 - DNA, 16 bp, Homo sapiens
atatttatttaaagca

SEQ ID NO: 3979171 - DNA, 19 bp, Homo sapiens
atatttcacttttgttctg

SEQ ID NO: 3979172 - DNA, 14 bp, Homo sapiens
atatttccatttct

SEQ ID NO: 3979173 - DNA, 17 bp, Homo sapiens
atatttcctttatgtga

SEQ ID NO: 3979174 - DNA, 14 bp, Homo sapiens
atatttctattgaa

SEQ ID NO: 3979175 - DNA, 16 bp, Homo sapiens
atatttctattgaatt

SEQ ID NO: 3979176 - DNA, 13 bp, Homo sapiens
atatttcttgctt

SEQ ID NO: 3979177 - DNA, 14 bp, Homo sapiens
atatttcttgcttt

SEQ ID NO: 3979178 - DNA, 23 bp, Homo sapiens
atatttgaaaaaaacttcattct

SEQ ID NO: 3979179 - DNA, 15 bp, Homo sapiens
atatttgacttgcat

SEQ ID NO: 3979180 - DNA, 22 bp, Homo sapiens
atatttgacttgcatgaagaga

SEQ ID NO: 3979181 - DNA, 21 bp, Homo sapiens
atatttggaagaaaaaaatct

SEQ ID NO: 3979182 - DNA, 23 bp, Homo sapiens
atatttggaagaaaaaaatcttc

SEQ ID NO: 3979183 - DNA, 23 bp, Homo sapiens
atatttggggtccttttttatac

SEQ ID NO: 3979184 - DNA, 13 bp, Homo sapiens
atatttgtaggag

SEQ ID NO: 3979185 - DNA, 21 bp, Homo sapiens
atatttgtgaatataatttta

SEQ ID NO: 3979186 - DNA, 22 bp, Homo sapiens
atatttgtgatagcactttcta

SEQ ID NO: 3979187 - DNA, 14 bp, Homo sapiens
atattttaaaatga

SEQ ID NO: 3979188 - DNA, 14 bp, Homo sapiens
atattttataattt

SEQ ID NO: 3979189 - DNA, 20 bp, Homo sapiens
atattttcaacgcagccctg

SEQ ID NO: 3979190 - DNA, 18 bp, Homo sapiens
atattttgagaaactgct

SEQ ID NO: 3979191 - DNA, 13 bp, Homo sapiens
atattttggaaac

SEQ ID NO: 3979192 - DNA, 14 bp, Homo sapiens
atattttggaaact

SEQ ID NO: 3979193 - DNA, 19 bp, Homo sapiens
atattttggaaactgctaa

SEQ ID NO: 3979194 - DNA, 20 bp, Homo sapiens
atattttggaaactgctaaa

SEQ ID NO: 3979195 - DNA, 13 bp, Homo sapiens
atatttttaaaga

SEQ ID NO: 3979196 - DNA, 14 bp, Homo sapiens
atatttttaaagat

SEQ ID NO: 3979197 - DNA, 16 bp, Homo sapiens
atatttttagactcat

SEQ ID NO: 3979198 - DNA, 23 bp, Homo sapiens
atattttttaaaaaacacttgaa

SEQ ID NO: 3979199 - DNA, 17 bp, Homo sapiens
atattttttaatttaaa

SEQ ID NO: 3979200 - DNA, 21 bp, Homo sapiens
atattttttaatttaaagctt

SEQ ID NO: 3979201 - DNA, 19 bp, Homo sapiens
atattttttgcaagttata

SEQ ID NO: 3979202 - DNA, 17 bp, Homo sapiens
atcaaaaaaagactcag

SEQ ID NO: 3979203 - DNA, 19 bp, Homo sapiens
atcaaaactcacaagtgct

SEQ ID NO: 3979204 - DNA, 21 bp, Homo sapiens
atcaaaactttcttttctgga

SEQ ID NO: 3979205 - DNA, 18 bp, Homo sapiens
atcaaaataaaaagtgac

SEQ ID NO: 3979206 - DNA, 13 bp, Homo sapiens
atcaaaatgcttt

SEQ ID NO: 3979207 - DNA, 12 bp, Homo sapiens
atcaaaatgtag

SEQ ID NO: 3979208 - DNA, 21 bp, Homo sapiens
atcaaaccctagccttgcttg

SEQ ID NO: 3979209 - DNA, 16 bp, Homo sapiens
atcaaagccagggtct

SEQ ID NO: 3979210 - DNA, 19 bp, Homo sapiens
atcaaataagtatttataa

SEQ ID NO: 3979211 - DNA, 11 bp, Homo sapiens
atcaaatactt

SEQ ID NO: 3979212 - DNA, 21 bp, Homo sapiens
atcaaatactttaaaggaaaa

SEQ ID NO: 3979213 - DNA, 15 bp, Homo sapiens
atcaaccaccatgga

SEQ ID NO: 3979214 - DNA, 18 bp, Homo sapiens
atcaactcccaacttctt

SEQ ID NO: 3979215 - DNA, 21 bp, Homo sapiens
caagagcagcctgtggcatct

SEQ ID NO: 3979216 - DNA, 13 bp, Homo sapiens
caagagcccagca

SEQ ID NO: 3979217 - DNA, 17 bp, Homo sapiens
caagagcccccttgaca

SEQ ID NO: 3979218 - DNA, 13 bp, Homo sapiens
caagagctgccct

SEQ ID NO: 3979219 - DNA, 16 bp, Homo sapiens
caagagctgccctcct

SEQ ID NO: 3979220 - DNA, 14 bp, Homo sapiens
caagaggagatcca

SEQ ID NO: 3979221 - DNA, 19 bp, Homo sapiens
caagaggctgtagaaaggg

SEQ ID NO: 3979222 - DNA, 17 bp, Homo sapiens
caagagggcactggtgg

SEQ ID NO: 3979223 - DNA, 18 bp, Homo sapiens
caagagggcactggtggc

SEQ ID NO: 3979224 - DNA, 20 bp, Homo sapiens
caagagggcactggtggccc

SEQ ID NO: 3979225 - DNA, 17 bp, Homo sapiens
caagagggggtggaggg

SEQ ID NO: 3979226 - DNA, 16 bp, Homo sapiens
caagaggtgggagggc

SEQ ID NO: 3979227 - DNA, 21 bp, Homo sapiens
caagagtggagagaagctctt

SEQ ID NO: 3979228 - DNA, 16 bp, Homo sapiens
caagagtttgttctgt

SEQ ID NO: 3979229 - DNA, 18 bp, Homo sapiens
caagatattgatgataac

SEQ ID NO: 3979230 - DNA, 14 bp, Homo sapiens
caagatccatttgc

SEQ ID NO: 3979231 - DNA, 16 bp, Homo sapiens
caagatccatttgcct

SEQ ID NO: 3979232 - DNA, 17 bp, Homo sapiens
caagatccatttgcctt

SEQ ID NO: 3979233 - DNA, 12 bp, Homo sapiens
caagatctttca

SEQ ID NO: 3979234 - DNA, 17 bp, Homo sapiens
caagatgaaataatttt

SEQ ID NO: 3979235 - DNA, 17 bp, Homo sapiens
caagatgactggggtgg

SEQ ID NO: 3979236 - DNA, 21 bp, Homo sapiens
caagatggacttacctggcag

SEQ ID NO: 3979237 - DNA, 18 bp, Homo sapiens
caagatgggggcagggct

SEQ ID NO: 3979238 - DNA, 20 bp, Homo sapiens
caagatgggggcagggctgt

SEQ ID NO: 3979239 - DNA, 12 bp, Homo sapiens
caagatgtgaat

SEQ ID NO: 3979240 - DNA, 19 bp, Homo sapiens
caagatgtgaattattgac

SEQ ID NO: 3979241 - DNA, 22 bp, Homo sapiens
caagatgtgaattattgacact

SEQ ID NO: 3979242 - DNA, 23 bp, Homo sapiens
caagatgtgaattattgacactg

SEQ ID NO: 3979243 - DNA, 20 bp, Homo sapiens
caagattttagggcttttat

SEQ ID NO: 3979244 - DNA, 18 bp, Homo sapiens
caagattttcctcttgtg

SEQ ID NO: 3979245 - DNA, 18 bp, Homo sapiens
caagcaacattcttgtta

SEQ ID NO: 3979246 - DNA, 18 bp, Homo sapiens
caagcaatcctcctgcct

SEQ ID NO: 3979247 - DNA, 14 bp, Homo sapiens
caagcacagagcct

SEQ ID NO: 3979248 - DNA, 12 bp, Homo sapiens
caagcacagcag

SEQ ID NO: 3979249 - DNA, 13 bp, Homo sapiens
caagcacagtcag

SEQ ID NO: 3979250 - DNA, 14 bp, Homo sapiens
caagcacagtcagg

SEQ ID NO: 3979251 - DNA, 11 bp, Homo sapiens
caagcactgat

SEQ ID NO: 3979252 - DNA, 23 bp, Homo sapiens
caagcactgctaggcgagtgcca

SEQ ID NO: 3979253 - DNA, 19 bp, Homo sapiens
caagcagagtgcacagctg

SEQ ID NO: 3979254 - DNA, 12 bp, Homo sapiens
caagcagattcg

SEQ ID NO: 3979255 - DNA, 21 bp, Homo sapiens
caagcagcctgagcaactctt

SEQ ID NO: 3979256 - DNA, 22 bp, Homo sapiens
caagcagcgaccgccccctcct

SEQ ID NO: 3979257 - DNA, 16 bp, Homo sapiens
caagcaggaattatgt

SEQ ID NO: 3979258 - DNA, 19 bp, Homo sapiens
caagcaggacctggcatca

SEQ ID NO: 3979259 - DNA, 13 bp, Homo sapiens
caagcaggaggct

SEQ ID NO: 3979260 - DNA, 16 bp, Homo sapiens
caagccacaggaagga

SEQ ID NO: 3979261 - DNA, 12 bp, Homo sapiens
caagcccaccag

SEQ ID NO: 3979262 - DNA, 15 bp, Homo sapiens
caagcccaccaggtg

SEQ ID NO: 3979263 - DNA, 17 bp, Homo sapiens
caagcccaccaggtgtc

SEQ ID NO: 3979264 - DNA, 22 bp, Homo sapiens
caagccccagcagccctcaaca

SEQ ID NO: 3979265 - DNA, 16 bp, Homo sapiens
caagccccccacacct

SEQ ID NO: 3979266 - DNA, 16 bp, Homo sapiens
caagccgaccttccct

SEQ ID NO: 3979267 - DNA, 21 bp, Homo sapiens
caagccgaccttccctccgcc

SEQ ID NO: 3979268 - DNA, 14 bp, Homo sapiens
caagccgtggcttc

SEQ ID NO: 3979269 - DNA, 15 bp, Homo sapiens
caagccgtggcttcc

SEQ ID NO: 3979270 - DNA, 17 bp, Homo sapiens
caagccgtggcttcccg

SEQ ID NO: 3979271 - DNA, 21 bp, Homo sapiens
caagcctgaccacgctttcta

SEQ ID NO: 3979272 - DNA, 14 bp, Homo sapiens
caagcctgcctccc

SEQ ID NO: 3979273 - DNA, 15 bp, Homo sapiens
caagcctgcctccca

SEQ ID NO: 3979274 - DNA, 18 bp, Homo sapiens
caagcctttatggctgct

SEQ ID NO: 3979275 - DNA, 16 bp, Homo sapiens
caagctatctaaagtt

SEQ ID NO: 3979276 - DNA, 20 bp, Homo sapiens
caagctccgcctcccgggtt

SEQ ID NO: 3979277 - DNA, 16 bp, Homo sapiens
caagctgagtttccta

SEQ ID NO: 3979278 - DNA, 23 bp, Homo sapiens
caagctgagtttcctatgggaac

SEQ ID NO: 3979279 - DNA, 18 bp, Homo sapiens
caagctgctctgagccac

SEQ ID NO: 3979280 - DNA, 23 bp, Homo sapiens
caagctgcttgtcctgggcctgc

SEQ ID NO: 3979281 - DNA, 14 bp, Homo sapiens
caagctggaagcac

SEQ ID NO: 3979282 - DNA, 18 bp, Homo sapiens
caagctggaagcacatgt

SEQ ID NO: 3979283 - DNA, 12 bp, Homo sapiens
caagctggcctc

SEQ ID NO: 3979284 - DNA, 17 bp, Homo sapiens
caagctgtccagagaaa

SEQ ID NO: 3979285 - DNA, 18 bp, Homo sapiens
caagctgtccagagaaaa

SEQ ID NO: 3979286 - DNA, 21 bp, Homo sapiens
caagctgttatttcttccctg

SEQ ID NO: 3979287 - DNA, 21 bp, Homo sapiens
caagcttttacaacagtgctg

SEQ ID NO: 3979288 - DNA, 21 bp, Homo sapiens
caagcttttgcttgatccaga

SEQ ID NO: 3979289 - DNA, 15 bp, Homo sapiens
caaggaaaaacaggt

SEQ ID NO: 3979290 - DNA, 22 bp, Homo sapiens
caaggaaaatagtttaggagaa

SEQ ID NO: 3979291 - DNA, 20 bp, Homo sapiens
caaggaaacgctacctctct

SEQ ID NO: 3979292 - DNA, 17 bp, Homo sapiens
caaggaagatatacatg

SEQ ID NO: 3979293 - DNA, 23 bp, Homo sapiens
caaggaaggaaagaaagaaggaa

SEQ ID NO: 3979294 - DNA, 23 bp, Homo sapiens
caaggaaggttcatgtagagaaa

SEQ ID NO: 3979295 - DNA, 14 bp, Homo sapiens
caaggacaaggggc

SEQ ID NO: 3979296 - DNA, 21 bp, Homo sapiens
caaggacagaaggctcctgcc

SEQ ID NO: 3979297 - DNA, 13 bp, Homo sapiens
caaggacattgcc

SEQ ID NO: 3979298 - DNA, 16 bp, Homo sapiens
caaggacattgcccca

SEQ ID NO: 3979299 - DNA, 20 bp, Homo sapiens
caaggacattgccccaagat

SEQ ID NO: 3979300 - DNA, 21 bp, Homo sapiens
caaggacattgccccaagata

SEQ ID NO: 3979301 - DNA, 13 bp, Homo sapiens
caaggaccaggac

SEQ ID NO: 3979302 - DNA, 18 bp, Homo sapiens
caaggaccaggactccct

SEQ ID NO: 3979303 - DNA, 20 bp, Homo sapiens
caaggaccaggactccctcc

SEQ ID NO: 3979304 - DNA, 20 bp, Homo sapiens
caaggacgcttcacaggaca

SEQ ID NO: 3979305 - DNA, 15 bp, Homo sapiens
caaggactcccggag

SEQ ID NO: 3979306 - DNA, 22 bp, Homo sapiens
caaggactcccggagcctgtgc

SEQ ID NO: 3979307 - DNA, 12 bp, Homo sapiens
caaggactgagc

SEQ ID NO: 3979308 - DNA, 13 bp, Homo sapiens
caaggactgagca

SEQ ID NO: 3979309 - DNA, 21 bp, Homo sapiens
caaggacttcctgtccagctc

SEQ ID NO: 3979310 - DNA, 23 bp, Homo sapiens
caaggacttcctgtccagctcca

SEQ ID NO: 3979311 - DNA, 16 bp, Homo sapiens
caaggacttgaaagca

SEQ ID NO: 3979312 - DNA, 20 bp, Homo sapiens
caaggacttgaaagcatcca

SEQ ID NO: 3979313 - DNA, 23 bp, Homo sapiens
caaggagttccatgaagaccaca

SEQ ID NO: 3979314 - DNA, 24 bp, Homo sapiens
caaggagtttgagaccagcttagc

SEQ ID NO: 3979315 - DNA, 23 bp, Homo sapiens
caaggatagatgctggcccaggg

SEQ ID NO: 3979316 - DNA, 13 bp, Homo sapiens
caaggatcctctc

SEQ ID NO: 3979317 - DNA, 20 bp, Homo sapiens
caaggatcggactctgcccc

SEQ ID NO: 3979318 - DNA, 22 bp, Homo sapiens
caaggatcggactctgcccctg

SEQ ID NO: 3979319 - DNA, 15 bp, Homo sapiens
caaggcagcgggatc

SEQ ID NO: 3979320 - DNA, 13 bp, Homo sapiens
caaggcagggacc

SEQ ID NO: 3979321 - DNA, 17 bp, Homo sapiens
caaggccagagtggcct

SEQ ID NO: 3979322 - DNA, 19 bp, Homo sapiens
caaggccagagtggcctgg

SEQ ID NO: 3979323 - DNA, 17 bp, Homo sapiens
caaggccccctgcctgc

SEQ ID NO: 3979324 - DNA, 22 bp, Homo sapiens
caaggccgagcgttcccagcag

SEQ ID NO: 3979325 - DNA, 21 bp, Homo sapiens
caaggcctggtgtttcttgat

SEQ ID NO: 3979326 - DNA, 22 bp, Homo sapiens
caaggcctggtgtttcttgata

SEQ ID NO: 3979327 - DNA, 13 bp, Homo sapiens
caaggcggcccct

SEQ ID NO: 3979328 - DNA, 14 bp, Homo sapiens
caaggcggcccctc

SEQ ID NO: 3979329 - DNA, 16 bp, Homo sapiens
caaggcggcccctccc

SEQ ID NO: 3979330 - DNA, 16 bp, Homo sapiens
caaggctgcttagaat

SEQ ID NO: 3979331 - DNA, 14 bp, Homo sapiens
caagggagaaaaga

SEQ ID NO: 3979332 - DNA, 18 bp, Homo sapiens
caagggagaaaagagaaa

SEQ ID NO: 3979333 - DNA, 20 bp, Homo sapiens
caagggagagacctcatcag

SEQ ID NO: 3979334 - DNA, 18 bp, Homo sapiens
caagggctttcctgtgcc

SEQ ID NO: 3979335 - DNA, 21 bp, Homo sapiens
caagggctttcctgtgccagg

SEQ ID NO: 3979336 - DNA, 20 bp, Homo sapiens
caaggggtcccctccaggag

SEQ ID NO: 3979337 - DNA, 16 bp, Homo sapiens
caagggttaaggcctg

SEQ ID NO: 3979338 - DNA, 17 bp, Homo sapiens
caagggttaaggcctga

SEQ ID NO: 3979339 - DNA, 18 bp, Homo sapiens
caagggttaaggcctgaa

SEQ ID NO: 3979340 - DNA, 22 bp, Homo sapiens
caaggtatttctccagttggga

SEQ ID NO: 3979341 - DNA, 18 bp, Homo sapiens
caaggtccactccctgct

SEQ ID NO: 3979342 - DNA, 21 bp, Homo sapiens
caaggtccactccctgctcca

SEQ ID NO: 3979343 - DNA, 16 bp, Homo sapiens
caaggtcccctccaca

SEQ ID NO: 3979344 - DNA, 15 bp, Homo sapiens
caaggtcctgctcaa

SEQ ID NO: 3979345 - DNA, 17 bp, Homo sapiens
caaggtgcaggcaggct

SEQ ID NO: 3979346 - DNA, 19 bp, Homo sapiens
caaggtgcaggcaggctgg

SEQ ID NO: 3979347 - DNA, 22 bp, Homo sapiens
caaggtggcagatgtcttccct

SEQ ID NO: 3979348 - DNA, 22 bp, Homo sapiens
caaggtggggggatcacaaggt

SEQ ID NO: 3979349 - DNA, 18 bp, Homo sapiens
caaggtggtgtgatctta

SEQ ID NO: 3979350 - DNA, 17 bp, Homo sapiens
caaggttataatttttt

SEQ ID NO: 3979351 - DNA, 17 bp, Homo sapiens
caaggttccctctgaga

SEQ ID NO: 3979352 - DNA, 18 bp, Homo sapiens
caaggttccctctgagaa

SEQ ID NO: 3979353 - DNA, 13 bp, Homo sapiens
caaggttctgggt

SEQ ID NO: 3979354 - DNA, 21 bp, Homo sapiens
caaggttctgggtgcaggagc

SEQ ID NO: 3979355 - DNA, 16 bp, Homo sapiens
caaggttggcacccca

SEQ ID NO: 3979356 - DNA, 15 bp, Homo sapiens
caagtaaaaaggcta

SEQ ID NO: 3979357 - DNA, 11 bp, Homo sapiens
caagtaattgt

SEQ ID NO: 3979358 - DNA, 22 bp, Homo sapiens
caagtatttgggaagtgaagac

SEQ ID NO: 3979359 - DNA, 14 bp, Homo sapiens
caagtcaatcattt

SEQ ID NO: 3979360 - DNA, 16 bp, Homo sapiens
caagtcaatcatttct

SEQ ID NO: 3979361 - DNA, 17 bp, Homo sapiens
caagtcaatcatttctc

SEQ ID NO: 3979362 - DNA, 15 bp, Homo sapiens
caagtcacacccact

SEQ ID NO: 3979363 - DNA, 15 bp, Homo sapiens
caagtcagctccagc

SEQ ID NO: 3979364 - DNA, 13 bp, Homo sapiens
caagtcatgtgca

SEQ ID NO: 3979365 - DNA, 16 bp, Homo sapiens
caagtcatgtgcattt

SEQ ID NO: 3979366 - DNA, 19 bp, Homo sapiens
caagtcctatcctaaataa

SEQ ID NO: 3979367 - DNA, 20 bp, Homo sapiens
caagtcctgactgggctggg

SEQ ID NO: 3979368 - DNA, 12 bp, Homo sapiens
caagtcctggct

SEQ ID NO: 3979369 - DNA, 13 bp, Homo sapiens
caagtcctggcta

SEQ ID NO: 3979370 - DNA, 22 bp, Homo sapiens
caagtccttacctcttccggag

SEQ ID NO: 3979371 - DNA, 17 bp, Homo sapiens
caagtcctttgtgaata

SEQ ID NO: 3979372 - DNA, 16 bp, Homo sapiens
caagtcggaacagcag

SEQ ID NO: 3979373 - DNA, 17 bp, Homo sapiens
caagtcggaacagcaga

SEQ ID NO: 3979374 - DNA, 18 bp, Homo sapiens
caagtcggaacagcagat

SEQ ID NO: 3979375 - DNA, 14 bp, Homo sapiens
caagtctagagtct

SEQ ID NO: 3979376 - DNA, 16 bp, Homo sapiens
caagtctctctgtgaa

SEQ ID NO: 3979377 - DNA, 18 bp, Homo sapiens
caagtctctgctggccca

SEQ ID NO: 3979378 - DNA, 22 bp, Homo sapiens
caagtcttgggtctgaatttat

SEQ ID NO: 3979379 - DNA, 22 bp, Homo sapiens
caagtgaaataacaaaatggac

SEQ ID NO: 3979380 - DNA, 19 bp, Homo sapiens
caagtgaagaacactactg

SEQ ID NO: 3979381 - DNA, 14 bp, Homo sapiens
caagtgccccctca

SEQ ID NO: 3979382 - DNA, 18 bp, Homo sapiens
caagtgccccctcacctc

SEQ ID NO: 3979383 - DNA, 14 bp, Homo sapiens
caagtgctgaacag

SEQ ID NO: 3979384 - DNA, 17 bp, Homo sapiens
caagtgctgaacagtgg

SEQ ID NO: 3979385 - DNA, 21 bp, Homo sapiens
caagtggaccttaggccttcc

SEQ ID NO: 3979386 - DNA, 22 bp, Homo sapiens
caagtggaccttaggccttcct

SEQ ID NO: 3979387 - DNA, 15 bp, Homo sapiens
caagtggactcaggg

SEQ ID NO: 3979388 - DNA, 19 bp, Homo sapiens
caagtggatgggaatttgt

SEQ ID NO: 3979389 - DNA, 22 bp, Homo sapiens
caagtggatgggaatttgtcag

SEQ ID NO: 3979390 - DNA, 20 bp, Homo sapiens
caagtgggatctgtcacacc

SEQ ID NO: 3979391 - DNA, 22 bp, Homo sapiens
caagtgggatctgtcacaccag

SEQ ID NO: 3979392 - DNA, 21 bp, Homo sapiens
caagtggggatggggcctccc

SEQ ID NO: 3979393 - DNA, 18 bp, Homo sapiens
caagtggggtgctgggag

SEQ ID NO: 3979394 - DNA, 19 bp, Homo sapiens
caagtggggtgctgggagg

SEQ ID NO: 3979395 - DNA, 17 bp, Homo sapiens
caagtggtgtttattgc

SEQ ID NO: 3979396 - DNA, 22 bp, Homo sapiens
caagtgtggtagggacttaaaa

SEQ ID NO: 3979397 - DNA, 18 bp, Homo sapiens
caagttaaagtgaataac

SEQ ID NO: 3979398 - DNA, 18 bp, Homo sapiens
caagttaacaaggaatgc

SEQ ID NO: 3979399 - DNA, 21 bp, Homo sapiens
caagttaagagaaactttata

SEQ ID NO: 3979400 - DNA, 22 bp, Homo sapiens
caagttaagagaaactttatac

SEQ ID NO: 3979401 - DNA, 16 bp, Homo sapiens
caagttcgtctgttgt

SEQ ID NO: 3979402 - DNA, 18 bp, Homo sapiens
caagttctagagaagagg

SEQ ID NO: 3979403 - DNA, 15 bp, Homo sapiens
caagttcttcacctc

SEQ ID NO: 3979404 - DNA, 16 bp, Homo sapiens
caagttcttcacctct

SEQ ID NO: 3979405 - DNA, 20 bp, Homo sapiens
caagttgagatttttaagaa

SEQ ID NO: 3979406 - DNA, 15 bp, Homo sapiens
caagttgcgacggag

SEQ ID NO: 3979407 - DNA, 12 bp, Homo sapiens
caagtttattca

SEQ ID NO: 3979408 - DNA, 18 bp, Homo sapiens
caagtttattcagtaaac

SEQ ID NO: 3979409 - DNA, 16 bp, Homo sapiens
caagtttccatagcaa

SEQ ID NO: 3979410 - DNA, 20 bp, Homo sapiens
caagtttccatagcaacagg

SEQ ID NO: 3979411 - DNA, 22 bp, Homo sapiens
caataaaaacattttgaagtgt

SEQ ID NO: 3979412 - DNA, 15 bp, Homo sapiens
caataaaaagttcag

SEQ ID NO: 3979413 - DNA, 16 bp, Homo sapiens
caataaaaagttcaga

SEQ ID NO: 3979414 - DNA, 20 bp, Homo sapiens
caataaaaagttcagagttc

SEQ ID NO: 3979415 - DNA, 11 bp, Homo sapiens
caataaaagtg

SEQ ID NO: 3979416 - DNA, 12 bp, Homo sapiens
caataaaagtga

SEQ ID NO: 3979417 - DNA, 19 bp, Homo sapiens
caataaaagtgactctcag

SEQ ID NO: 3979418 - DNA, 16 bp, Homo sapiens
caataaaatgtgattt

SEQ ID NO: 3979419 - DNA, 21 bp, Homo sapiens
caataaaatgtgatttttctg

SEQ ID NO: 3979420 - DNA, 22 bp, Homo sapiens
caataaaatgtgatttttctga

SEQ ID NO: 3979421 - DNA, 17 bp, Homo sapiens
caataaaatttctaaga

SEQ ID NO: 3979422 - DNA, 16 bp, Homo sapiens
caataaacaacagctg

SEQ ID NO: 3979423 - DNA, 21 bp, Homo sapiens
caataaacaacagctgaagca

SEQ ID NO: 3979424 - DNA, 16 bp, Homo sapiens
caataaagcatttata

SEQ ID NO: 3979425 - DNA, 13 bp, Homo sapiens
caataaatgaaga

SEQ ID NO: 3979426 - DNA, 15 bp, Homo sapiens
caataaatgaagatt

SEQ ID NO: 3979427 - DNA, 18 bp, Homo sapiens
caataaatgctctatttt

SEQ ID NO: 3979428 - DNA, 17 bp, Homo sapiens
caataaatgtgcttatg

SEQ ID NO: 3979429 - DNA, 14 bp, Homo sapiens
caataacactaaaa

SEQ ID NO: 3979430 - DNA, 17 bp, Homo sapiens
caataacactaaaattt

SEQ ID NO: 3979431 - DNA, 19 bp, Homo sapiens
caataactactgtgttcct

SEQ ID NO: 3979432 - DNA, 17 bp, Homo sapiens
caataacttctatattt

SEQ ID NO: 3979433 - DNA, 20 bp, Homo sapiens
caataacttctatattttaa

SEQ ID NO: 3979434 - DNA, 21 bp, Homo sapiens
caataacttctatattttaat

SEQ ID NO: 3979435 - DNA, 12 bp, Homo sapiens
caataagaaatg

SEQ ID NO: 3979436 - DNA, 16 bp, Homo sapiens
caataagaaatgaaca

SEQ ID NO: 3979437 - DNA, 18 bp, Homo sapiens
caataagaaatgaacaaa

SEQ ID NO: 3979438 - DNA, 21 bp, Homo sapiens
caataagtgtgtggtagaaac

SEQ ID NO: 3979439 - DNA, 23 bp, Homo sapiens
caataatattgttgtataatttc

SEQ ID NO: 3979440 - DNA, 15 bp, Homo sapiens
caatacaaatggatt

SEQ ID NO: 3979441 - DNA, 21 bp, Homo sapiens
caatacaaatggattttggga

SEQ ID NO: 3979442 - DNA, 17 bp, Homo sapiens
caatacactagttgttt

SEQ ID NO: 3979443 - DNA, 11 bp, Homo sapiens
caatagaaata

SEQ ID NO: 3979444 - DNA, 14 bp, Homo sapiens
caatagagactgta

SEQ ID NO: 3979445 - DNA, 16 bp, Homo sapiens
caatagatctccagcg

SEQ ID NO: 3979446 - DNA, 23 bp, Homo sapiens
caatagctttaccctcaggcata

SEQ ID NO: 3979447 - DNA, 16 bp, Homo sapiens
caatagggtagaatga

SEQ ID NO: 3979448 - DNA, 21 bp, Homo sapiens
caatagggtagaatgattaat

SEQ ID NO: 3979449 - DNA, 23 bp, Homo sapiens
caatagggtagaatgattaatca

SEQ ID NO: 3979450 - DNA, 14 bp, Homo sapiens
caatagtgtgttct

SEQ ID NO: 3979451 - DNA, 23 bp, Homo sapiens
caatagtgtgttctgattagaaa

SEQ ID NO: 3979452 - DNA, 14 bp, Homo sapiens
caatatattgaact

SEQ ID NO: 3979453 - DNA, 20 bp, Homo sapiens
caatatattgaacttttgta

SEQ ID NO: 3979454 - DNA, 15 bp, Homo sapiens
caatatctaatatat

SEQ ID NO: 3979455 - DNA, 16 bp, Homo sapiens
caatatctaatatata

SEQ ID NO: 3979456 - DNA, 18 bp, Homo sapiens
caatatgggggccttttg

SEQ ID NO: 3979457 - DNA, 22 bp, Homo sapiens
caatatgtgagtgccttttgca

SEQ ID NO: 3979458 - DNA, 21 bp, Homo sapiens
caatattaaatacagacacta

SEQ ID NO: 3979459 - DNA, 14 bp, Homo sapiens
caatattatactaa

SEQ ID NO: 3979460 - DNA, 23 bp, Homo sapiens
caatattatactaagaaaagata

SEQ ID NO: 3979461 - DNA, 15 bp, Homo sapiens
caatattatgaaatt

SEQ ID NO: 3979462 - DNA, 13 bp, Homo sapiens
caatattcctgaa

SEQ ID NO: 3979463 - DNA, 14 bp, Homo sapiens
caatattccttagt

SEQ ID NO: 3979464 - DNA, 17 bp, Homo sapiens
caatattgacatttgta

SEQ ID NO: 3979465 - DNA, 22 bp, Homo sapiens
caatattgtctcccttccagca

SEQ ID NO: 3979466 - DNA, 13 bp, Homo sapiens
caatatttaaaca

SEQ ID NO: 3979467 - DNA, 19 bp, Homo sapiens
caatatttatggatgcaac

SEQ ID NO: 3979468 - DNA, 13 bp, Homo sapiens
caatatttattat

SEQ ID NO: 3979469 - DNA, 19 bp, Homo sapiens
caatatttattattttcac

SEQ ID NO: 3979470 - DNA, 15 bp, Homo sapiens
caatatttgaatttt

SEQ ID NO: 3979471 - DNA, 21 bp, Homo sapiens
caatattttggagtatgttaa

SEQ ID NO: 3979472 - DNA, 22 bp, Homo sapiens
caatcaaataagtatttataat

SEQ ID NO: 3979473 - DNA, 23 bp, Homo sapiens
caatcaaataagtatttataata

SEQ ID NO: 3979474 - DNA, 11 bp, Homo sapiens
caatcagctcc

SEQ ID NO: 3979475 - DNA, 17 bp, Homo sapiens
caatcagctccttttcc

SEQ ID NO: 3979476 - DNA, 15 bp, Homo sapiens
caatcagttgacttt

SEQ ID NO: 3979477 - DNA, 22 bp, Homo sapiens
caatcagttgactttaagtgaa

SEQ ID NO: 3979478 - DNA, 16 bp, Homo sapiens
caatcattgctgaaaa

SEQ ID NO: 3979479 - DNA, 12 bp, Homo sapiens
caatcatttctc

SEQ ID NO: 3979480 - DNA, 14 bp, Homo sapiens
caatcatttctcac

SEQ ID NO: 3979481 - DNA, 13 bp, Homo sapiens
caatccaacccgg

SEQ ID NO: 3979482 - DNA, 16 bp, Homo sapiens
caatccacctgccttg

SEQ ID NO: 3979483 - DNA, 21 bp, Homo sapiens
caatccatgttagtttttact

SEQ ID NO: 3979484 - DNA, 18 bp, Homo sapiens
caatcccagggctggctc

SEQ ID NO: 3979485 - DNA, 12 bp, Homo sapiens
caatccccatca

SEQ ID NO: 3979486 - DNA, 12 bp, Homo sapiens
caatccctgggg

SEQ ID NO: 3979487 - DNA, 20 bp, Homo sapiens
caatccctggggctgtgcat

SEQ ID NO: 3979488 - DNA, 17 bp, Homo sapiens
caatcctaacacattat

SEQ ID NO: 3979489 - DNA, 14 bp, Homo sapiens
caatcctcactggg

SEQ ID NO: 3979490 - DNA, 16 bp, Homo sapiens
caatcctcactgggtg

SEQ ID NO: 3979491 - DNA, 18 bp, Homo sapiens
caatcctcactgggtggg

SEQ ID NO: 3979492 - DNA, 13 bp, Homo sapiens
caatcctcctgcc

SEQ ID NO: 3979493 - DNA, 15 bp, Homo sapiens
caatcctcctgcctc

SEQ ID NO: 3979494 - DNA, 20 bp, Homo sapiens
caatcctcctgcctcagcct

SEQ ID NO: 3979495 - DNA, 13 bp, Homo sapiens
caatcctctaagc

SEQ ID NO: 3979496 - DNA, 23 bp, Homo sapiens
caatcctgttaagagataattct

SEQ ID NO: 3979497 - DNA, 15 bp, Homo sapiens
caatcctgtttataa

SEQ ID NO: 3979498 - DNA, 13 bp, Homo sapiens
caatcgcaaatca

SEQ ID NO: 3979499 - DNA, 17 bp, Homo sapiens
caatctcccgctgctgc

SEQ ID NO: 3979500 - DNA, 17 bp, Homo sapiens
caatctggaagaaaaaa

SEQ ID NO: 3979501 - DNA, 12 bp, Homo sapiens
caatctggccct

SEQ ID NO: 3979502 - DNA, 15 bp, Homo sapiens
caaacatttcaaagt

SEQ ID NO: 3979503 - DNA, 15 bp, Homo sapiens
caaaccaaataaaaa

SEQ ID NO: 3979504 - DNA, 16 bp, Homo sapiens
caaaccaacatctttg

SEQ ID NO: 3979505 - DNA, 17 bp, Homo sapiens
caaaccaagtcggaaca

SEQ ID NO: 3979506 - DNA, 14 bp, Homo sapiens
caaaccattgctct

SEQ ID NO: 3979507 - DNA, 19 bp, Homo sapiens
caaacccccattctgtcct

SEQ ID NO: 3979508 - DNA, 18 bp, Homo sapiens
caaaccctagccttgctt

SEQ ID NO: 3979509 - DNA, 16 bp, Homo sapiens
caaacccttgctttcc

SEQ ID NO: 3979510 - DNA, 17 bp, Homo sapiens
caaaccgagcagggctg

SEQ ID NO: 3979511 - DNA, 19 bp, Homo sapiens
caaacctccagcctccctg

SEQ ID NO: 3979512 - DNA, 20 bp, Homo sapiens
caaacctccagcctccctgt

SEQ ID NO: 3979513 - DNA, 21 bp, Homo sapiens
caaacctttcccccttagcac

SEQ ID NO: 3979514 - DNA, 17 bp, Homo sapiens
caaacgcctcccctgcc

SEQ ID NO: 3979515 - DNA, 21 bp, Homo sapiens
caaacgctaaagagcccttgc

SEQ ID NO: 3979516 - DNA, 13 bp, Homo sapiens
caaacgtgttttt

SEQ ID NO: 3979517 - DNA, 19 bp, Homo sapiens
caaacgtgttttttaaaaa

SEQ ID NO: 3979518 - DNA, 20 bp, Homo sapiens
caaactaaaagacatttgtt

SEQ ID NO: 3979519 - DNA, 16 bp, Homo sapiens
caaactaaaggtgcac

SEQ ID NO: 3979520 - DNA, 18 bp, Homo sapiens
caaactcactgctcaaga

SEQ ID NO: 3979521 - DNA, 11 bp, Homo sapiens
caaactgcaat

SEQ ID NO: 3979522 - DNA, 13 bp, Homo sapiens
caaactgcaatag

SEQ ID NO: 3979523 - DNA, 19 bp, Homo sapiens
caaactgcaatagagactg

SEQ ID NO: 3979524 - DNA, 17 bp, Homo sapiens
caaactggagtctggag

SEQ ID NO: 3979525 - DNA, 20 bp, Homo sapiens
caaactggagtctggagtgg

SEQ ID NO: 3979526 - DNA, 15 bp, Homo sapiens
caaactggggcctcc

SEQ ID NO: 3979527 - DNA, 17 bp, Homo sapiens
caaactggggcctccct

SEQ ID NO: 3979528 - DNA, 21 bp, Homo sapiens
caaactggtattctgttctgg

SEQ ID NO: 3979529 - DNA, 19 bp, Homo sapiens
caaactgtccctcccttgc

SEQ ID NO: 3979530 - DNA, 14 bp, Homo sapiens
caaacttactattt

SEQ ID NO: 3979531 - DNA, 22 bp, Homo sapiens
caaacttggaatttgtaacctc

SEQ ID NO: 3979532 - DNA, 15 bp, Homo sapiens
caaacttttttatat

SEQ ID NO: 3979533 - DNA, 19 bp, Homo sapiens
caaagaaagaaagtttaga

SEQ ID NO: 3979534 - DNA, 19 bp, Homo sapiens
caaagagagaaaataaaga

SEQ ID NO: 3979535 - DNA, 22 bp, Homo sapiens
caaagaggctgaggctggcaca

SEQ ID NO: 3979536 - DNA, 21 bp, Homo sapiens
caaagaggctgcccctctcac

SEQ ID NO: 3979537 - DNA, 15 bp, Homo sapiens
caaagagggcttcct

SEQ ID NO: 3979538 - DNA, 12 bp, Homo sapiens
caaagataattt

SEQ ID NO: 3979539 - DNA, 22 bp, Homo sapiens
caaagatctgaattaaataaat

SEQ ID NO: 3979540 - DNA, 20 bp, Homo sapiens
caaagatctgtcctcagcct

SEQ ID NO: 3979541 - DNA, 21 bp, Homo sapiens
caaagatctgtcctcagcctt

SEQ ID NO: 3979542 - DNA, 22 bp, Homo sapiens
caaagatgtttgtcagatatga

SEQ ID NO: 3979543 - DNA, 17 bp, Homo sapiens
caaagcaaaccaacaag

SEQ ID NO: 3979544 - DNA, 17 bp, Homo sapiens
caaagcaaatgttggga

SEQ ID NO: 3979545 - DNA, 17 bp, Homo sapiens
caaagcacattgaaaga

SEQ ID NO: 3979546 - DNA, 18 bp, Homo sapiens
caaagcacattgaaagag

SEQ ID NO: 3979547 - DNA, 17 bp, Homo sapiens
caaagcagacagctcca

SEQ ID NO: 3979548 - DNA, 12 bp, Homo sapiens
caaagcagccac

SEQ ID NO: 3979549 - DNA, 22 bp, Homo sapiens
caaagccaacagtcaaaacaga

SEQ ID NO: 3979550 - DNA, 15 bp, Homo sapiens
caaagccagggtctc

SEQ ID NO: 3979551 - DNA, 16 bp, Homo sapiens
caaagcggggggaggg

SEQ ID NO: 3979552 - DNA, 17 bp, Homo sapiens
caaagcggggggagggt

SEQ ID NO: 3979553 - DNA, 19 bp, Homo sapiens
caaagcggtccctgtccct

SEQ ID NO: 3979554 - DNA, 18 bp, Homo sapiens
caaagctcaaataaaaat

SEQ ID NO: 3979555 - DNA, 19 bp, Homo sapiens
caaagctgatgacaacttc

SEQ ID NO: 3979556 - DNA, 17 bp, Homo sapiens
caaagctgcaggtgcca

SEQ ID NO: 3979557 - DNA, 18 bp, Homo sapiens
caaagctgttcttcctgg

SEQ ID NO: 3979558 - DNA, 20 bp, Homo sapiens
caaagcttcccgattaactg

SEQ ID NO: 3979559 - DNA, 21 bp, Homo sapiens
caaagcttctatcccaggagg

SEQ ID NO: 3979560 - DNA, 19 bp, Homo sapiens
caaagcttgaagatcgtta

SEQ ID NO: 3979561 - DNA, 14 bp, Homo sapiens
caaagctttcctgc

SEQ ID NO: 3979562 - DNA, 16 bp, Homo sapiens
caaagctttcctgccc

SEQ ID NO: 3979563 - DNA, 22 bp, Homo sapiens
caaagctttcctgccccaggcc

SEQ ID NO: 3979564 - DNA, 16 bp, Homo sapiens
caaagcttttagaaat

SEQ ID NO: 3979565 - DNA, 20 bp, Homo sapiens
caaagcttttagaaatactg

SEQ ID NO: 3979566 - DNA, 22 bp, Homo sapiens
caaaggaaaatagtaatgtttt

SEQ ID NO: 3979567 - DNA, 17 bp, Homo sapiens
caaaggagctcgaagga

SEQ ID NO: 3979568 - DNA, 21 bp, Homo sapiens
caaaggatgtgatatataagt

SEQ ID NO: 3979569 - DNA, 14 bp, Homo sapiens
caaaggcaagttaa

SEQ ID NO: 3979570 - DNA, 15 bp, Homo sapiens
caaaggcatcccagc

SEQ ID NO: 3979571 - DNA, 17 bp, Homo sapiens
caaaggcatcccagcct

SEQ ID NO: 3979572 - DNA, 19 bp, Homo sapiens
caaaggcatcccagcctgg

SEQ ID NO: 3979573 - DNA, 21 bp, Homo sapiens
caaaggcatcccagcctgggg

SEQ ID NO: 3979574 - DNA, 21 bp, Homo sapiens
caaagggctgaaagccatttg

SEQ ID NO: 3979575 - DNA, 23 bp, Homo sapiens
caaagggttgggagctgatgaaa

SEQ ID NO: 3979576 - DNA, 23 bp, Homo sapiens
caaagtaaatacaagactgttgt

SEQ ID NO: 3979577 - DNA, 23 bp, Homo sapiens
caaagtcctttttttccatcttt

SEQ ID NO: 3979578 - DNA, 19 bp, Homo sapiens
caaagtgctgggattacag

SEQ ID NO: 3979579 - DNA, 18 bp, Homo sapiens
caaagtgttgtgttcctg

SEQ ID NO: 3979580 - DNA, 20 bp, Homo sapiens
caaagtgttgtgttcctggc

SEQ ID NO: 3979581 - DNA, 16 bp, Homo sapiens
caaagttactaggtaa

SEQ ID NO: 3979582 - DNA, 15 bp, Homo sapiens
caaagttgttgtaac

SEQ ID NO: 3979583 - DNA, 22 bp, Homo sapiens
caaagttgttgtaacctgctgt

SEQ ID NO: 3979584 - DNA, 13 bp, Homo sapiens
caaagttttgaaa

SEQ ID NO: 3979585 - DNA, 18 bp, Homo sapiens
caaagttttgaaaagcta

SEQ ID NO: 3979586 - DNA, 18 bp, Homo sapiens
caaataaaattggcacca

SEQ ID NO: 3979587 - DNA, 17 bp, Homo sapiens
caaataagtatttataa

SEQ ID NO: 3979588 - DNA, 12 bp, Homo sapiens
caaataatttca

SEQ ID NO: 3979589 - DNA, 14 bp, Homo sapiens
caaataatttcata

SEQ ID NO: 3979590 - DNA, 16 bp, Homo sapiens
caaatacaaagtaaat

SEQ ID NO: 3979591 - DNA, 22 bp, Homo sapiens
caaatacaaagtaaatacaaga

SEQ ID NO: 3979592 - DNA, 15 bp, Homo sapiens
caaatataagatttt

SEQ ID NO: 3979593 - DNA, 18 bp, Homo sapiens
caaatataagattttctg

SEQ ID NO: 3979594 - DNA, 18 bp, Homo sapiens
caaatatgtattttccta

SEQ ID NO: 3979595 - DNA, 13 bp, Homo sapiens
caaatatgtcctg

SEQ ID NO: 3979596 - DNA, 23 bp, Homo sapiens
caaatattgttgacaactgtgac

SEQ ID NO: 3979597 - DNA, 13 bp, Homo sapiens
caaatcacatctc

SEQ ID NO: 3979598 - DNA, 13 bp, Homo sapiens
caaatcagctgct

SEQ ID NO: 3979599 - DNA, 16 bp, Homo sapiens
caaatcagctgctact

SEQ ID NO: 3979600 - DNA, 17 bp, Homo sapiens
caaatcagctgctacta

SEQ ID NO: 3979601 - DNA, 16 bp, Homo sapiens
caaatcagttagtttt

SEQ ID NO: 3979602 - DNA, 16 bp, Homo sapiens
caaatccatccagaat

SEQ ID NO: 3979603 - DNA, 18 bp, Homo sapiens
caaatccttccaaaaatt

SEQ ID NO: 3979604 - DNA, 19 bp, Homo sapiens
caaatcgtccagcgacctt

SEQ ID NO: 3979605 - DNA, 15 bp, Homo sapiens
caaatctataaagaa

SEQ ID NO: 3979606 - DNA, 14 bp, Homo sapiens
caaatctattcaga

SEQ ID NO: 3979607 - DNA, 21 bp, Homo sapiens
caaatctcaatgaagccagct

SEQ ID NO: 3979608 - DNA, 19 bp, Homo sapiens
caaatctcttgcttgtcat

SEQ ID NO: 3979609 - DNA, 21 bp, Homo sapiens
caaatctcttgcttgtcattg

SEQ ID NO: 3979610 - DNA, 21 bp, Homo sapiens
caaatctgacatattatgcct

SEQ ID NO: 3979611 - DNA, 12 bp, Homo sapiens
caaatcttgaaa

SEQ ID NO: 3979612 - DNA, 10 bp, Homo sapiens
caaatgaatt

SEQ ID NO: 3979613 - DNA, 17 bp, Homo sapiens
caaatgagacagcagtc

SEQ ID NO: 3979614 - DNA, 20 bp, Homo sapiens
caaatgagatctaagccttt

SEQ ID NO: 3979615 - DNA, 18 bp, Homo sapiens
caaatgagtaacatttgc

SEQ ID NO: 3979616 - DNA, 21 bp, Homo sapiens
caaatgagtaacatttgctgt

SEQ ID NO: 3979617 - DNA, 17 bp, Homo sapiens
caaatgccttaaaatgg

SEQ ID NO: 3979618 - DNA, 19 bp, Homo sapiens
caaatgccttaaaatggaa

SEQ ID NO: 3979619 - DNA, 16 bp, Homo sapiens
caaatgctcaaagaaa

SEQ ID NO: 3979620 - DNA, 13 bp, Homo sapiens
caaatgctggggc

SEQ ID NO: 3979621 - DNA, 14 bp, Homo sapiens
caaatgctggggca

SEQ ID NO: 3979622 - DNA, 22 bp, Homo sapiens
caaatggattttgggagtgact

SEQ ID NO: 3979623 - DNA, 15 bp, Homo sapiens
caaatggggccagat

SEQ ID NO: 3979624 - DNA, 17 bp, Homo sapiens
caaatggggccagatcc

SEQ ID NO: 3979625 - DNA, 20 bp, Homo sapiens
caaatggggccagatccagc

SEQ ID NO: 3979626 - DNA, 20 bp, Homo sapiens
caaatggtaggcatttccta

SEQ ID NO: 3979627 - DNA, 21 bp, Homo sapiens
caaatgtaattgaataaagtt

SEQ ID NO: 3979628 - DNA, 12 bp, Homo sapiens
caaatgtatttt

SEQ ID NO: 3979629 - DNA, 17 bp, Homo sapiens
caaatgtttatgttttc

SEQ ID NO: 3979630 - DNA, 13 bp, Homo sapiens
caaattaacttga

SEQ ID NO: 3979631 - DNA, 11 bp, Homo sapiens
caaattagaaa

SEQ ID NO: 3979632 - DNA, 12 bp, Homo sapiens
caaattagaaaa

SEQ ID NO: 3979633 - DNA, 22 bp, Homo sapiens
caaattagaaaatgttatttaa

SEQ ID NO: 3979634 - DNA, 20 bp, Homo sapiens
caaattcagtttcataaaag

SEQ ID NO: 3979635 - DNA, 22 bp, Homo sapiens
caaattctgcttgcttgctttt

SEQ ID NO: 3979636 - DNA, 21 bp, Homo sapiens
caaattggactttcaaaatta

SEQ ID NO: 3979637 - DNA, 19 bp, Homo sapiens
caaattgtcacctgcttct

SEQ ID NO: 3979638 - DNA, 22 bp, Homo sapiens
caaattgtcttttgtcatgtgg

SEQ ID NO: 3979639 - DNA, 21 bp, Homo sapiens
caaatttattttaatgtaaag

SEQ ID NO: 3979640 - DNA, 17 bp, Homo sapiens
caaatttcatgaccagt

SEQ ID NO: 3979641 - DNA, 19 bp, Homo sapiens
caaatttgtacctctaagt

SEQ ID NO: 3979642 - DNA, 16 bp, Homo sapiens
caacaaaaagcttccc

SEQ ID NO: 3979643 - DNA, 13 bp, Homo sapiens
caacaaagaaata

SEQ ID NO: 3979644 - DNA, 22 bp, Homo sapiens
caacaaatattcactggcccct

SEQ ID NO: 3979645 - DNA, 23 bp, Homo sapiens
caacaagaagaaatatgaaattc

SEQ ID NO: 3979646 - DNA, 18 bp, Homo sapiens
caacaagaataaaggcag

SEQ ID NO: 3979647 - DNA, 19 bp, Homo sapiens
caacaagaataaaggcagc

SEQ ID NO: 3979648 - DNA, 12 bp, Homo sapiens
caacaagaatgc

SEQ ID NO: 3979649 - DNA, 19 bp, Homo sapiens
caacaaggcttgctgcaga

SEQ ID NO: 3979650 - DNA, 14 bp, Homo sapiens
caacaagggagaga

SEQ ID NO: 3979651 - DNA, 19 bp, Homo sapiens
caacaaggttggcacccca

SEQ ID NO: 3979652 - DNA, 13 bp, Homo sapiens
caacaataacact

SEQ ID NO: 3979653 - DNA, 14 bp, Homo sapiens
caacacacacactc

SEQ ID NO: 3979654 - DNA, 14 bp, Homo sapiens
caacacagaggaat

SEQ ID NO: 3979655 - DNA, 13 bp, Homo sapiens
caacaccaagcac

SEQ ID NO: 3979656 - DNA, 12 bp, Homo sapiens
caacaccacaga

SEQ ID NO: 3979657 - DNA, 17 bp, Homo sapiens
caacaccacagacacac

SEQ ID NO: 3979658 - DNA, 19 bp, Homo sapiens
caacaccacagacacacac

SEQ ID NO: 3979659 - DNA, 22 bp, Homo sapiens
caacaccactaggaatcccaga

SEQ ID NO: 3979660 - DNA, 20 bp, Homo sapiens
caacacgcatggtcaaccct

SEQ ID NO: 3979661 - DNA, 23 bp, Homo sapiens
caacactggtgtgacctgagggc

SEQ ID NO: 3979662 - DNA, 22 bp, Homo sapiens
caacagaaacctatcctcactg

SEQ ID NO: 3979663 - DNA, 16 bp, Homo sapiens
caacagaactaaatgt

SEQ ID NO: 3979664 - DNA, 20 bp, Homo sapiens
caacagaagtcatgaagccc

SEQ ID NO: 3979665 - DNA, 17 bp, Homo sapiens
caacagatcaatttgta

SEQ ID NO: 3979666 - DNA, 22 bp, Homo sapiens
caacagcaagaaataaatcaga

SEQ ID NO: 3979667 - DNA, 17 bp, Homo sapiens
caacagcacctccccgc

SEQ ID NO: 3979668 - DNA, 18 bp, Homo sapiens
caacagcacctccccgct

SEQ ID NO: 3979669 - DNA, 22 bp, Homo sapiens
caacagcacctccccgctggga

SEQ ID NO: 3979670 - DNA, 23 bp, Homo sapiens
caacagcagtgatctcagggcag

SEQ ID NO: 3979671 - DNA, 11 bp, Homo sapiens
caacaggacag

SEQ ID NO: 3979672 - DNA, 14 bp, Homo sapiens
caacaggacagagt

SEQ ID NO: 3979673 - DNA, 16 bp, Homo sapiens
caacaggacagagttc

SEQ ID NO: 3979674 - DNA, 23 bp, Homo sapiens
caacaggacagagttcacaggag

SEQ ID NO: 3979675 - DNA, 16 bp, Homo sapiens
caacaggcccagggag

SEQ ID NO: 3979676 - DNA, 17 bp, Homo sapiens
caacaggcccagggagg

SEQ ID NO: 3979677 - DNA, 18 bp, Homo sapiens
caacaggcccagggaggg

SEQ ID NO: 3979678 - DNA, 20 bp, Homo sapiens
caacaggcttatgaatatat

SEQ ID NO: 3979679 - DNA, 21 bp, Homo sapiens
caacaggtggcaggaccagga

SEQ ID NO: 3979680 - DNA, 21 bp, Homo sapiens
caacatatatttattgagtac

SEQ ID NO: 3979681 - DNA, 13 bp, Homo sapiens
caacatcaatgtt

SEQ ID NO: 3979682 - DNA, 16 bp, Homo sapiens
caacatcaatgttcat

SEQ ID NO: 3979683 - DNA, 22 bp, Homo sapiens
caacatcaatgttcattgtaat

SEQ ID NO: 3979684 - DNA, 17 bp, Homo sapiens
caacatcctgccagccc

SEQ ID NO: 3979685 - DNA, 18 bp, Homo sapiens
caacatcctgccagcccc

SEQ ID NO: 3979686 - DNA, 22 bp, Homo sapiens
caacatcttggtcagatttgaa

SEQ ID NO: 3979687 - DNA, 20 bp, Homo sapiens
caaccaagtcatgtgcattt

SEQ ID NO: 3979688 - DNA, 12 bp, Homo sapiens
caaccacagaga

SEQ ID NO: 3979689 - DNA, 13 bp, Homo sapiens
caaccaccatgga

SEQ ID NO: 3979690 - DNA, 22 bp, Homo sapiens
caaccacgtggagaaaatcaaa

SEQ ID NO: 3979691 - DNA, 21 bp, Homo sapiens
caaccactaagaattcaaact

SEQ ID NO: 3979692 - DNA, 14 bp, Homo sapiens
caaccactggtctg

SEQ ID NO: 3979693 - DNA, 23 bp, Homo sapiens
caaccactggtctgtagggattt

SEQ ID NO: 3979694 - DNA, 11 bp, Homo sapiens
caaccagagcc

SEQ ID NO: 3979695 - DNA, 20 bp, Homo sapiens
caaccagataacataccttt

SEQ ID NO: 3979696 - DNA, 17 bp, Homo sapiens
caaccagctaagaaaag

SEQ ID NO: 3979697 - DNA, 20 bp, Homo sapiens
caaccaggagctgatggcag

SEQ ID NO: 3979698 - DNA, 22 bp, Homo sapiens
caaccaggagctgatggcagct

SEQ ID NO: 3979699 - DNA, 16 bp, Homo sapiens
caaccaggcacctctt

SEQ ID NO: 3979700 - DNA, 19 bp, Homo sapiens
caaccaggcacctcttcct

SEQ ID NO: 3979701 - DNA, 22 bp, Homo sapiens
caaccaggcagtagatgtgctt

SEQ ID NO: 3979702 - DNA, 14 bp, Homo sapiens
caaccatccctgcc

SEQ ID NO: 3979703 - DNA, 16 bp, Homo sapiens
caaccatccctgccac

SEQ ID NO: 3979704 - DNA, 17 bp, Homo sapiens
caacccccaccccacac

SEQ ID NO: 3979705 - DNA, 16 bp, Homo sapiens
caacccccatttctat

SEQ ID NO: 3979706 - DNA, 21 bp, Homo sapiens
caaccctaggttccctgttct

SEQ ID NO: 3979707 - DNA, 22 bp, Homo sapiens
caaccctaggttccctgttctt

SEQ ID NO: 3979708 - DNA, 13 bp, Homo sapiens
caaccctcccggg

SEQ ID NO: 3979709 - DNA, 22 bp, Homo sapiens
caaccctgggctattgctgctg

SEQ ID NO: 3979710 - DNA, 16 bp, Homo sapiens
caaccctggggaagga

SEQ ID NO: 3979711 - DNA, 22 bp, Homo sapiens
caaccctggggaaggagccagt

SEQ ID NO: 3979712 - DNA, 17 bp, Homo sapiens
caaccctgttttatact

SEQ ID NO: 3979713 - DNA, 19 bp, Homo sapiens
caaccctgttttatactgt

SEQ ID NO: 3979714 - DNA, 20 bp, Homo sapiens
caacccttaccccttagcct

SEQ ID NO: 3979715 - DNA, 18 bp, Homo sapiens
caacccttccctcacctt

SEQ ID NO: 3979716 - DNA, 17 bp, Homo sapiens
caaccgcctcaaaatgt

SEQ ID NO: 3979717 - DNA, 12 bp, Homo sapiens
caacctagaatg

SEQ ID NO: 3979718 - DNA, 17 bp, Homo sapiens
caacctcaccttcctgt

SEQ ID NO: 3979719 - DNA, 20 bp, Homo sapiens
caacctcaccttcctgtggg

SEQ ID NO: 3979720 - DNA, 14 bp, Homo sapiens
caacctcagaggca

SEQ ID NO: 3979721 - DNA, 19 bp, Homo sapiens
caacctcagggctcccagg

SEQ ID NO: 3979722 - DNA, 20 bp, Homo sapiens
caacctcagggctcccaggg

SEQ ID NO: 3979723 - DNA, 14 bp, Homo sapiens
caacctcattgaca

SEQ ID NO: 3979724 - DNA, 14 bp, Homo sapiens
caacctctcactcc

SEQ ID NO: 3979725 - DNA, 17 bp, Homo sapiens
caacctctcactcccca

SEQ ID NO: 3979726 - DNA, 16 bp, Homo sapiens
caacctctctgatctt

SEQ ID NO: 3979727 - DNA, 14 bp, Homo sapiens
caacctctgcctcc

SEQ ID NO: 3979728 - DNA, 18 bp, Homo sapiens
caacctcttctggctcaa

SEQ ID NO: 3979729 - DNA, 15 bp, Homo sapiens
caacctcttggcctg

SEQ ID NO: 3979730 - DNA, 15 bp, Homo sapiens
caacctctttgctca

SEQ ID NO: 3979731 - DNA, 19 bp, Homo sapiens
caacctctttttcctcctg

SEQ ID NO: 3979732 - DNA, 23 bp, Homo sapiens
caacctctttttcctcctggaca

SEQ ID NO: 3979733 - DNA, 17 bp, Homo sapiens
caacctgcaaagatctg

SEQ ID NO: 3979734 - DNA, 18 bp, Homo sapiens
caacctgctctgtcccca

SEQ ID NO: 3979735 - DNA, 16 bp, Homo sapiens
caaccttctgtggctc

SEQ ID NO: 3979736 - DNA, 17 bp, Homo sapiens
caaccttctgtggctca

SEQ ID NO: 3979737 - DNA, 19 bp, Homo sapiens
caaccttctgtggctcaca

SEQ ID NO: 3979738 - DNA, 24 bp, Homo sapiens
caacctttaaaattgtcacctctg

SEQ ID NO: 3979739 - DNA, 14 bp, Homo sapiens
caacgaagaaaaaa

SEQ ID NO: 3979740 - DNA, 20 bp, Homo sapiens
caacgaagaaaaaaaataac

SEQ ID NO: 3979741 - DNA, 12 bp, Homo sapiens
caacgaccaggg

SEQ ID NO: 3979742 - DNA, 16 bp, Homo sapiens
caacgataaaattaca

SEQ ID NO: 3979743 - DNA, 18 bp, Homo sapiens
caacgcagccctgctttg

SEQ ID NO: 3979744 - DNA, 13 bp, Homo sapiens
caacgcccctcca

SEQ ID NO: 3979745 - DNA, 19 bp, Homo sapiens
caacggccctgcagccagc

SEQ ID NO: 3979746 - DNA, 18 bp, Homo sapiens
caactagcccctggggtg

SEQ ID NO: 3979747 - DNA, 19 bp, Homo sapiens
caactataagcccactgtt

SEQ ID NO: 3979748 - DNA, 22 bp, Homo sapiens
caactatgatatggtaaaagtt

SEQ ID NO: 3979749 - DNA, 12 bp, Homo sapiens
caactatgtagg

SEQ ID NO: 3979750 - DNA, 13 bp, Homo sapiens
caactatgtaggt

SEQ ID NO: 3979751 - DNA, 23 bp, Homo sapiens
caactccaccagatagcagaggg

SEQ ID NO: 3979752 - DNA, 15 bp, Homo sapiens
caactcccaacttct

SEQ ID NO: 3979753 - DNA, 14 bp, Homo sapiens
caactcctaatttt

SEQ ID NO: 3979754 - DNA, 13 bp, Homo sapiens
caactctgagccc

SEQ ID NO: 3979755 - DNA, 15 bp, Homo sapiens
caactctgagcccat

SEQ ID NO: 3979756 - DNA, 12 bp, Homo sapiens
caactcttgatt

SEQ ID NO: 3979757 - DNA, 18 bp, Homo sapiens
caactctttgttatttga

SEQ ID NO: 3979758 - DNA, 13 bp, Homo sapiens
caactgaaaagac

SEQ ID NO: 3979759 - DNA, 21 bp, Homo sapiens
caactgaggttcttgggatac

SEQ ID NO: 3979760 - DNA, 19 bp, Homo sapiens
caactgcaataacttctga

SEQ ID NO: 3979761 - DNA, 18 bp, Homo sapiens
caactgcacatgaaagtt

SEQ ID NO: 3979762 - DNA, 16 bp, Homo sapiens
caactgccaggctgcc

SEQ ID NO: 3979763 - DNA, 20 bp, Homo sapiens
caactgccaggctgcctcct

SEQ ID NO: 3979764 - DNA, 21 bp, Homo sapiens
caactgccaggctgcctcctg

SEQ ID NO: 3979765 - DNA, 22 bp, Homo sapiens
caactgccctaagcccccaggg

SEQ ID NO: 3979766 - DNA, 16 bp, Homo sapiens
caactggagttcctta

SEQ ID NO: 3979767 - DNA, 18 bp, Homo sapiens
caactggccctatttaga

SEQ ID NO: 3979768 - DNA, 19 bp, Homo sapiens
caactgttgtaactaggct

SEQ ID NO: 3979769 - DNA, 22 bp, Homo sapiens
caacttaatactcaaatgagta

SEQ ID NO: 3979770 - DNA, 14 bp, Homo sapiens
caacttaatggaaa

SEQ ID NO: 3979771 - DNA, 18 bp, Homo sapiens
caacttattctttgagta

SEQ ID NO: 3979772 - DNA, 20 bp, Homo sapiens
caacttatttaaaaatattt

SEQ ID NO: 3979773 - DNA, 21 bp, Homo sapiens
caacttatttaaaaatatttc

SEQ ID NO: 3979774 - DNA, 23 bp, Homo sapiens
caacttcccagttcaggagtccc

SEQ ID NO: 3979775 - DNA, 19 bp, Homo sapiens
caacttcctcccttacaga

SEQ ID NO: 3979776 - DNA, 24 bp, Homo sapiens
caacttgaaattatatctgtggtc

SEQ ID NO: 3979777 - DNA, 13 bp, Homo sapiens
caacttgagggcc

SEQ ID NO: 3979778 - DNA, 19 bp, Homo sapiens
caacttgagggcccagagc

SEQ ID NO: 3979779 - DNA, 22 bp, Homo sapiens
caacttgagggcccagagcagg

SEQ ID NO: 3979780 - DNA, 18 bp, Homo sapiens
caacttggcttcctttct

SEQ ID NO: 3979781 - DNA, 19 bp, Homo sapiens
caacttgtctttttctgga

SEQ ID NO: 3979782 - DNA, 24 bp, Homo sapiens
caactttagctagtatcttcaaac

SEQ ID NO: 3979783 - DNA, 19 bp, Homo sapiens
caactttagtatttttact

SEQ ID NO: 3979784 - DNA, 14 bp, Homo sapiens
caacttttaaagct

SEQ ID NO: 3979785 - DNA, 16 bp, Homo sapiens
caagaaacagccagca

SEQ ID NO: 3979786 - DNA, 16 bp, Homo sapiens
caagaaacctgactca

SEQ ID NO: 3979787 - DNA, 15 bp, Homo sapiens
caagaaactttgtaa

SEQ ID NO: 3979788 - DNA, 10 bp, Homo sapiens
caagaacctg

SEQ ID NO: 3979789 - DNA, 12 bp, Homo sapiens
caagaactgcat

SEQ ID NO: 3979790 - DNA, 18 bp, Homo sapiens
caagaagaaatatgaaat

SEQ ID NO: 3979791 - DNA, 20 bp, Homo sapiens
caagaagaaatatgaaattc

SEQ ID NO: 3979792 - DNA, 19 bp, Homo sapiens
caagaagaagggcacccta

SEQ ID NO: 3979793 - DNA, 14 bp, Homo sapiens
caagaagaatgaac

SEQ ID NO: 3979794 - DNA, 14 bp, Homo sapiens
caagaagtgaagaa

SEQ ID NO: 3979795 - DNA, 21 bp, Homo sapiens
caagaataaaggcagctgttg

SEQ ID NO: 3979796 - DNA, 14 bp, Homo sapiens
caagaatacttgaa

SEQ ID NO: 3979797 - DNA, 23 bp, Homo sapiens
caagaatgcattccctgaatctg

SEQ ID NO: 3979798 - DNA, 21 bp, Homo sapiens
caagaatggatcacaagatgg

SEQ ID NO: 3979799 - DNA, 17 bp, Homo sapiens
caagacagaagctgaag

SEQ ID NO: 3979800 - DNA, 15 bp, Homo sapiens
caagacctaggctca

SEQ ID NO: 3979801 - DNA, 14 bp, Homo sapiens
caagactgcaaact

SEQ ID NO: 3979802 - DNA, 23 bp, Homo sapiens
caagactgcaaacttttttatat

SEQ ID NO: 3979803 - DNA, 16 bp, Homo sapiens
caagactgttgctcaa

SEQ ID NO: 3979804 - DNA, 16 bp, Homo sapiens
caagactgttgtgatc

SEQ ID NO: 3979805 - DNA, 19 bp, Homo sapiens
caagactttagcttttcct

SEQ ID NO: 3979806 - DNA, 11 bp, Homo sapiens
caagagaaggg

SEQ ID NO: 3979807 - DNA, 15 bp, Homo sapiens
caagagagatgtttt

SEQ ID NO: 3979808 - DNA, 14 bp, Homo sapiens
caagagcagagtct

SEQ ID NO: 3979809 - DNA, 19 bp, Homo sapiens
caagagcagagtctgggcc

SEQ ID NO: 3979810 - DNA, 20 bp, Homo sapiens
caagagcagcctgtggcatc

SEQ ID NO: 3979811 - DNA, 20 bp, Homo sapiens
attaaaaaaaaagatctgtt

SEQ ID NO: 3979812 - DNA, 14 bp, Homo sapiens
attaaaatgcttcc

SEQ ID NO: 3979813 - DNA, 17 bp, Homo sapiens
attaaaatttatcttaa

SEQ ID NO: 3979814 - DNA, 14 bp, Homo sapiens
attaaaatttctta

SEQ ID NO: 3979815 - DNA, 13 bp, Homo sapiens
attaaacacctga

SEQ ID NO: 3979816 - DNA, 19 bp, Homo sapiens
attaaacacctgacacatc

SEQ ID NO: 3979817 - DNA, 14 bp, Homo sapiens
attaaacagatgat

SEQ ID NO: 3979818 - DNA, 14 bp, Homo sapiens
attaaaccctggat

SEQ ID NO: 3979819 - DNA, 13 bp, Homo sapiens
attaaacttgaag

SEQ ID NO: 3979820 - DNA, 14 bp, Homo sapiens
attaaacttgaagc

SEQ ID NO: 3979821 - DNA, 12 bp, Homo sapiens
attaaacttttt

SEQ ID NO: 3979822 - DNA, 13 bp, Homo sapiens
attaaagtgactt

SEQ ID NO: 3979823 - DNA, 17 bp, Homo sapiens
attaaagtgactttcta

SEQ ID NO: 3979824 - DNA, 19 bp, Homo sapiens
attaaataaaatcaatttt

SEQ ID NO: 3979825 - DNA, 14 bp, Homo sapiens
attaaataaataaa

SEQ ID NO: 3979826 - DNA, 17 bp, Homo sapiens
attaaatacagacacta

SEQ ID NO: 3979827 - DNA, 19 bp, Homo sapiens
attaaatacagacactaag

SEQ ID NO: 3979828 - DNA, 22 bp, Homo sapiens
attaaatatagattagaaaaat

SEQ ID NO: 3979829 - DNA, 14 bp, Homo sapiens
attaaatgtattta

SEQ ID NO: 3979830 - DNA, 13 bp, Homo sapiens
attaaattaggaa

SEQ ID NO: 3979831 - DNA, 16 bp, Homo sapiens
attaaattcacaaact

SEQ ID NO: 3979832 - DNA, 17 bp, Homo sapiens
attaaattcacaaactt

SEQ ID NO: 3979833 - DNA, 13 bp, Homo sapiens
attaaatttaact

SEQ ID NO: 3979834 - DNA, 12 bp, Homo sapiens
attaaatttaat

SEQ ID NO: 3979835 - DNA, 21 bp, Homo sapiens
attaaatttgttgacaaaatt

SEQ ID NO: 3979836 - DNA, 18 bp, Homo sapiens
attaaattttgagttcta

SEQ ID NO: 3979837 - DNA, 18 bp, Homo sapiens
attaaattttttttacat

SEQ ID NO: 3979838 - DNA, 13 bp, Homo sapiens
attaacaaatatg

SEQ ID NO: 3979839 - DNA, 15 bp, Homo sapiens
attaacaaatatgct

SEQ ID NO: 3979840 - DNA, 16 bp, Homo sapiens
attaacaaatatgcta

SEQ ID NO: 3979841 - DNA, 18 bp, Homo sapiens
attaacaacaataacact

SEQ ID NO: 3979842 - DNA, 13 bp, Homo sapiens
attaacacaaagg

SEQ ID NO: 3979843 - DNA, 18 bp, Homo sapiens
attaacagttttccatga

SEQ ID NO: 3979844 - DNA, 23 bp, Homo sapiens
attaacagttttccatgaaaacg

SEQ ID NO: 3979845 - DNA, 14 bp, Homo sapiens
attaacctggtgct

SEQ ID NO: 3979846 - DNA, 17 bp, Homo sapiens
attaacctggtgctgga

SEQ ID NO: 3979847 - DNA, 17 bp, Homo sapiens
attaactaatctattgg

SEQ ID NO: 3979848 - DNA, 17 bp, Homo sapiens
attaactacatttatga

SEQ ID NO: 3979849 - DNA, 22 bp, Homo sapiens
attaactgagtagctctcctga

SEQ ID NO: 3979850 - DNA, 15 bp, Homo sapiens
attaacttagcatgt

SEQ ID NO: 3979851 - DNA, 15 bp, Homo sapiens
attaacttatttaga

SEQ ID NO: 3979852 - DNA, 13 bp, Homo sapiens
attaactttaatg

SEQ ID NO: 3979853 - DNA, 15 bp, Homo sapiens
attaagaaggcaaaa

SEQ ID NO: 3979854 - DNA, 20 bp, Homo sapiens
attaagaatatgtttccttg

SEQ ID NO: 3979855 - DNA, 16 bp, Homo sapiens
attaagatacaaatta

SEQ ID NO: 3979856 - DNA, 20 bp, Homo sapiens
attaagattgaggcctgccc

SEQ ID NO: 3979857 - DNA, 18 bp, Homo sapiens
attaagattttacaaaag

SEQ ID NO: 3979858 - DNA, 20 bp, Homo sapiens
attaaggtatttcgaaactg

SEQ ID NO: 3979859 - DNA, 22 bp, Homo sapiens
attaaggtatttcgaaactgcc

SEQ ID NO: 3979860 - DNA, 15 bp, Homo sapiens
attaagtaatcaata

SEQ ID NO: 3979861 - DNA, 14 bp, Homo sapiens
attaagtcatgtgt

SEQ ID NO: 3979862 - DNA, 16 bp, Homo sapiens
attaatactacccata

SEQ ID NO: 3979863 - DNA, 17 bp, Homo sapiens
attaatagcagcctttc

SEQ ID NO: 3979864 - DNA, 16 bp, Homo sapiens
attaatatatagtcca

SEQ ID NO: 3979865 - DNA, 19 bp, Homo sapiens
attaatatccctacatgta

SEQ ID NO: 3979866 - DNA, 14 bp, Homo sapiens
attaatatgaaaac

SEQ ID NO: 3979867 - DNA, 13 bp, Homo sapiens
attaatattatta

SEQ ID NO: 3979868 - DNA, 20 bp, Homo sapiens
attaatattattatgaattt

SEQ ID NO: 3979869 - DNA, 17 bp, Homo sapiens
attaatattgtattgct

SEQ ID NO: 3979870 - DNA, 12 bp, Homo sapiens
attaatatttaa

SEQ ID NO: 3979871 - DNA, 12 bp, Homo sapiens
attaatatttgt

SEQ ID NO: 3979872 - DNA, 13 bp, Homo sapiens
attaatcaaaggc

SEQ ID NO: 3979873 - DNA, 13 bp, Homo sapiens
attaatcactatt

SEQ ID NO: 3979874 - DNA, 19 bp, Homo sapiens
attaatcatctataaagaa

SEQ ID NO: 3979875 - DNA, 12 bp, Homo sapiens
attaatgactta

SEQ ID NO: 3979876 - DNA, 20 bp, Homo sapiens
attaatgccattatccctga

SEQ ID NO: 3979877 - DNA, 23 bp, Homo sapiens
attaatgtacttgtttctctgtt

SEQ ID NO: 3979878 - DNA, 20 bp, Homo sapiens
attaatgtcagtatttcaac

SEQ ID NO: 3979879 - DNA, 14 bp, Homo sapiens
attaatgtgtatta

SEQ ID NO: 3979880 - DNA, 13 bp, Homo sapiens
attaatgttaatt

SEQ ID NO: 3979881 - DNA, 16 bp, Homo sapiens
attaatgtttctatct

SEQ ID NO: 3979882 - DNA, 18 bp, Homo sapiens
attaatgtttctatctga

SEQ ID NO: 3979883 - DNA, 20 bp, Homo sapiens
attaatgtttctatctgatt

SEQ ID NO: 3979884 - DNA, 16 bp, Homo sapiens
attaattaaacattgt

SEQ ID NO: 3979885 - DNA, 15 bp, Homo sapiens
attaattaatggctt

SEQ ID NO: 3979886 - DNA, 19 bp, Homo sapiens
attaattcaccttccagtg

SEQ ID NO: 3979887 - DNA, 15 bp, Homo sapiens
attaatttgaaacca

SEQ ID NO: 3979888 - DNA, 20 bp, Homo sapiens
attaatttgattaacaaata

SEQ ID NO: 3979889 - DNA, 13 bp, Homo sapiens
attaatttttaat

SEQ ID NO: 3979890 - DNA, 15 bp, Homo sapiens
attaatttttaattg

SEQ ID NO: 3979891 - DNA, 15 bp, Homo sapiens
attacacatttgtac

SEQ ID NO: 3979892 - DNA, 18 bp, Homo sapiens
attacacatttgtacaga

SEQ ID NO: 3979893 - DNA, 17 bp, Homo sapiens
attacagagaggagaaa

SEQ ID NO: 3979894 - DNA, 19 bp, Homo sapiens
attacagagaggagaaaca

SEQ ID NO: 3979895 - DNA, 21 bp, Homo sapiens
attacagagaggagaaacaca

SEQ ID NO: 3979896 - DNA, 13 bp, Homo sapiens
attacagcttcac

SEQ ID NO: 3979897 - DNA, 20 bp, Homo sapiens
attacaggcacctgccacca

SEQ ID NO: 3979898 - DNA, 12 bp, Homo sapiens
attacatgtgtt

SEQ ID NO: 3979899 - DNA, 18 bp, Homo sapiens
attaccaaaaatcttggg

SEQ ID NO: 3979900 - DNA, 22 bp, Homo sapiens
attaccaccatcccgtgctttt

SEQ ID NO: 3979901 - DNA, 23 bp, Homo sapiens
attaccagggactatctttgctg

SEQ ID NO: 3979902 - DNA, 20 bp, Homo sapiens
attaccatgagaagagggcc

SEQ ID NO: 3979903 - DNA, 12 bp, Homo sapiens
attacccacccg

SEQ ID NO: 3979904 - DNA, 16 bp, Homo sapiens
attacccacccgacct

SEQ ID NO: 3979905 - DNA, 22 bp, Homo sapiens
attacccacccgacctggctgc

SEQ ID NO: 3979906 - DNA, 18 bp, Homo sapiens
attaccccctccttcaga

SEQ ID NO: 3979907 - DNA, 16 bp, Homo sapiens
attaccctcaaatgct

SEQ ID NO: 3979908 - DNA, 14 bp, Homo sapiens
attacctccatcca

SEQ ID NO: 3979909 - DNA, 14 bp, Homo sapiens
attacgtgagccag

SEQ ID NO: 3979910 - DNA, 20 bp, Homo sapiens
attactaattttacacatta

SEQ ID NO: 3979911 - DNA, 19 bp, Homo sapiens
attactggaattcttctgc

SEQ ID NO: 3979912 - DNA, 16 bp, Homo sapiens
attactgtcaataaac

SEQ ID NO: 3979913 - DNA, 13 bp, Homo sapiens
attactgtgtaaa

SEQ ID NO: 3979914 - DNA, 14 bp, Homo sapiens
attactgttgcatt

SEQ ID NO: 3979915 - DNA, 15 bp, Homo sapiens
attagaaattagctg

SEQ ID NO: 3979916 - DNA, 20 bp, Homo sapiens
attagaaattagctgtgtga

SEQ ID NO: 3979917 - DNA, 13 bp, Homo sapiens
attagaattattt

SEQ ID NO: 3979918 - DNA, 14 bp, Homo sapiens
attagaattattta

SEQ ID NO: 3979919 - DNA, 16 bp, Homo sapiens
attagactcctcctcc

SEQ ID NO: 3979920 - DNA, 22 bp, Homo sapiens
attcacaaacttttatactctt

SEQ ID NO: 3979921 - DNA, 13 bp, Homo sapiens
attcacaatagaa

SEQ ID NO: 3979922 - DNA, 22 bp, Homo sapiens
attcaccaacacagttgggacc

SEQ ID NO: 3979923 - DNA, 13 bp, Homo sapiens
attcaccttcagt

SEQ ID NO: 3979924 - DNA, 18 bp, Homo sapiens
attcactcaagcactgat

SEQ ID NO: 3979925 - DNA, 14 bp, Homo sapiens
attcacttgcattt

SEQ ID NO: 3979926 - DNA, 18 bp, Homo sapiens
attcagaaaatgttctgt

SEQ ID NO: 3979927 - DNA, 20 bp, Homo sapiens
attcagaaaatgttctgttt

SEQ ID NO: 3979928 - DNA, 22 bp, Homo sapiens
attcagaaaatgttctgtttgc

SEQ ID NO: 3979929 - DNA, 15 bp, Homo sapiens
attcagattgtcttg

SEQ ID NO: 3979930 - DNA, 17 bp, Homo sapiens
attcagattgttatcta

SEQ ID NO: 3979931 - DNA, 14 bp, Homo sapiens
attcagcactgatt

SEQ ID NO: 3979932 - DNA, 19 bp, Homo sapiens
attcagcactgatttcaca

SEQ ID NO: 3979933 - DNA, 20 bp, Homo sapiens
attcagcactgatttcacaa

SEQ ID NO: 3979934 - DNA, 22 bp, Homo sapiens
attcagcatcactaaaccgata

SEQ ID NO: 3979935 - DNA, 21 bp, Homo sapiens
attcaggagagtagaacagat

SEQ ID NO: 3979936 - DNA, 15 bp, Homo sapiens
attcaggccagccca

SEQ ID NO: 3979937 - DNA, 23 bp, Homo sapiens
attcaggccagcccagccaggcc

SEQ ID NO: 3979938 - DNA, 15 bp, Homo sapiens
attcaggggctgggg

SEQ ID NO: 3979939 - DNA, 15 bp, Homo sapiens
attcagtgattactg

SEQ ID NO: 3979940 - DNA, 19 bp, Homo sapiens
attcagtgcttcttaaaga

SEQ ID NO: 3979941 - DNA, 22 bp, Homo sapiens
attcagttcccaccatctgatt

SEQ ID NO: 3979942 - DNA, 15 bp, Homo sapiens
attcagttttcattt

SEQ ID NO: 3979943 - DNA, 15 bp, Homo sapiens
attcagtttttgtat

SEQ ID NO: 3979944 - DNA, 20 bp, Homo sapiens
attcagtttttgtatcttgg

SEQ ID NO: 3979945 - DNA, 16 bp, Homo sapiens
attcataattaaaatt

SEQ ID NO: 3979946 - DNA, 21 bp, Homo sapiens
attcatagggaaaggttttgt

SEQ ID NO: 3979947 - DNA, 22 bp, Homo sapiens
attcatagggaaaggttttgta

SEQ ID NO: 3979948 - DNA, 14 bp, Homo sapiens
attcatatttactt

SEQ ID NO: 3979949 - DNA, 14 bp, Homo sapiens
attcatccagcagt

SEQ ID NO: 3979950 - DNA, 13 bp, Homo sapiens
attcatccttcca

SEQ ID NO: 3979951 - DNA, 16 bp, Homo sapiens
attcatgcctttcata

SEQ ID NO: 3979952 - DNA, 17 bp, Homo sapiens
attcatgcctttcatag

SEQ ID NO: 3979953 - DNA, 20 bp, Homo sapiens
attcattatttttccacttt

SEQ ID NO: 3979954 - DNA, 20 bp, Homo sapiens
attcattctcataattccta

SEQ ID NO: 3979955 - DNA, 22 bp, Homo sapiens
attcattctcataattcctaca

SEQ ID NO: 3979956 - DNA, 18 bp, Homo sapiens
attcattctgtgatcatt

SEQ ID NO: 3979957 - DNA, 22 bp, Homo sapiens
attcattctgtgatcatttatt

SEQ ID NO: 3979958 - DNA, 10 bp, Homo sapiens
attcatttaa

SEQ ID NO: 3979959 - DNA, 19 bp, Homo sapiens
attccaagcttcatattaa

SEQ ID NO: 3979960 - DNA, 16 bp, Homo sapiens
attccacctgcaatca

SEQ ID NO: 3979961 - DNA, 22 bp, Homo sapiens
attccagaagaagagaagctgc

SEQ ID NO: 3979962 - DNA, 22 bp, Homo sapiens
attccagaatcttgactttctg

SEQ ID NO: 3979963 - DNA, 18 bp, Homo sapiens
attccagagacatcagca

SEQ ID NO: 3979964 - DNA, 14 bp, Homo sapiens
attccagcaataag

SEQ ID NO: 3979965 - DNA, 17 bp, Homo sapiens
attccatatttattcaa

SEQ ID NO: 3979966 - DNA, 13 bp, Homo sapiens
attccatgaatgt

SEQ ID NO: 3979967 - DNA, 16 bp, Homo sapiens
attccatgaatgtatc

SEQ ID NO: 3979968 - DNA, 18 bp, Homo sapiens
attccatgaatgtatcag

SEQ ID NO: 3979969 - DNA, 14 bp, Homo sapiens
attccattatctta

SEQ ID NO: 3979970 - DNA, 15 bp, Homo sapiens
attccattatcttat

SEQ ID NO: 3979971 - DNA, 19 bp, Homo sapiens
attcccaagccgaccttcc

SEQ ID NO: 3979972 - DNA, 23 bp, Homo sapiens
attcccattttgcaaaatttcca

SEQ ID NO: 3979973 - DNA, 21 bp, Homo sapiens
attcccctatctctagaattt

SEQ ID NO: 3979974 - DNA, 14 bp, Homo sapiens
attcccctgtgtca

SEQ ID NO: 3979975 - DNA, 16 bp, Homo sapiens
attccctctcatctca

SEQ ID NO: 3979976 - DNA, 13 bp, Homo sapiens
attccctctcctg

SEQ ID NO: 3979977 - DNA, 19 bp, Homo sapiens
attccctctcctgcccaga

SEQ ID NO: 3979978 - DNA, 21 bp, Homo sapiens
attccctctctcagcacagcc

SEQ ID NO: 3979979 - DNA, 20 bp, Homo sapiens
attccctttgacttcagctg

SEQ ID NO: 3979980 - DNA, 13 bp, Homo sapiens
attcccttttaat

SEQ ID NO: 3979981 - DNA, 12 bp, Homo sapiens
attccgtcacca

SEQ ID NO: 3979982 - DNA, 19 bp, Homo sapiens
attccgttgtctgtggatg

SEQ ID NO: 3979983 - DNA, 18 bp, Homo sapiens
attcctaacttttcaatg

SEQ ID NO: 3979984 - DNA, 13 bp, Homo sapiens
attcctacagcac

SEQ ID NO: 3979985 - DNA, 20 bp, Homo sapiens
attcctactgacaacattat

SEQ ID NO: 3979986 - DNA, 15 bp, Homo sapiens
attcctagataaaaa

SEQ ID NO: 3979987 - DNA, 21 bp, Homo sapiens
attcctagataaaaagatggc

SEQ ID NO: 3979988 - DNA, 21 bp, Homo sapiens
attcctccaaatctcttgctt

SEQ ID NO: 3979989 - DNA, 22 bp, Homo sapiens
attcctctgggaatgttacatt

SEQ ID NO: 3979990 - DNA, 13 bp, Homo sapiens
attcctctgtatt

SEQ ID NO: 3979991 - DNA, 13 bp, Homo sapiens
attcctcttttta

SEQ ID NO: 3979992 - DNA, 13 bp, Homo sapiens
attcctgaaagaa

SEQ ID NO: 3979993 - DNA, 17 bp, Homo sapiens
attcctgaatgaaatat

SEQ ID NO: 3979994 - DNA, 20 bp, Homo sapiens
attcctgagatttcctcctg

SEQ ID NO: 3979995 - DNA, 16 bp, Homo sapiens
attcctgatcccatgg

SEQ ID NO: 3979996 - DNA, 22 bp, Homo sapiens
attcctggtttgactcagttcc

SEQ ID NO: 3979997 - DNA, 15 bp, Homo sapiens
attccttcagatttg

SEQ ID NO: 3979998 - DNA, 14 bp, Homo sapiens
attccttctctgaa

SEQ ID NO: 3979999 - DNA, 21 bp, Homo sapiens
attccttctttgataatgtta

SEQ ID NO: 3980000 - DNA, 20 bp, Homo sapiens
attccttgatcattttggga

SEQ ID NO: 3980001 - DNA, 18 bp, Homo sapiens
attccttgcgcctcagcc

SEQ ID NO: 3980002 - DNA, 19 bp, Homo sapiens
attccttgcgcctcagccc

SEQ ID NO: 3980003 - DNA, 15 bp, Homo sapiens
attcctttctcatcc

SEQ ID NO: 3980004 - DNA, 16 bp, Homo sapiens
attcctttgtcttcaa

SEQ ID NO: 3980005 - DNA, 19 bp, Homo sapiens
attcgatctcattcagtat

SEQ ID NO: 3980006 - DNA, 16 bp, Homo sapiens
attcgctgtacccttt

SEQ ID NO: 3980007 - DNA, 13 bp, Homo sapiens
attcgctttctaa

SEQ ID NO: 3980008 - DNA, 20 bp, Homo sapiens
attcggaactgtcctttcct

SEQ ID NO: 3980009 - DNA, 21 bp, Homo sapiens
attcggaactgtcctttcctt

SEQ ID NO: 3980010 - DNA, 14 bp, Homo sapiens
attcgggccacagg

SEQ ID NO: 3980011 - DNA, 16 bp, Homo sapiens
attcgggccacagggc

SEQ ID NO: 3980012 - DNA, 15 bp, Homo sapiens
attcgggccccacct

SEQ ID NO: 3980013 - DNA, 16 bp, Homo sapiens
attcgtcctttgacaa

SEQ ID NO: 3980014 - DNA, 17 bp, Homo sapiens
attcgtcctttgacaaa

SEQ ID NO: 3980015 - DNA, 22 bp, Homo sapiens
attcgttgtgttttttaagata

SEQ ID NO: 3980016 - DNA, 23 bp, Homo sapiens
attctaagccagttttcattttg

SEQ ID NO: 3980017 - DNA, 13 bp, Homo sapiens
attctaagttatt

SEQ ID NO: 3980018 - DNA, 17 bp, Homo sapiens
attctaagttatttact

SEQ ID NO: 3980019 - DNA, 15 bp, Homo sapiens
atgggtccagggcct

SEQ ID NO: 3980020 - DNA, 20 bp, Homo sapiens
atgggtcctagcccttccct

SEQ ID NO: 3980021 - DNA, 20 bp, Homo sapiens
atgggtgcaaggaaaattag

SEQ ID NO: 3980022 - DNA, 13 bp, Homo sapiens
atgggtggaaagg

SEQ ID NO: 3980023 - DNA, 20 bp, Homo sapiens
atgggtgtatataattttat

SEQ ID NO: 3980024 - DNA, 13 bp, Homo sapiens
atgggttccagag

SEQ ID NO: 3980025 - DNA, 15 bp, Homo sapiens
atggtaactgctttc

SEQ ID NO: 3980026 - DNA, 23 bp, Homo sapiens
atggtaatctttacctgtataca

SEQ ID NO: 3980027 - DNA, 20 bp, Homo sapiens
atggtatgagctgagggggg

SEQ ID NO: 3980028 - DNA, 18 bp, Homo sapiens
atggtcacacactgatgc

SEQ ID NO: 3980029 - DNA, 14 bp, Homo sapiens
atgtcactgtggtc

SEQ ID NO: 3980030 - DNA, 16 bp, Homo sapiens
atgtcactgtggtcct

SEQ ID NO: 3980031 - DNA, 14 bp, Homo sapiens
atgtcagatttctg

SEQ ID NO: 3980032 - DNA, 17 bp, Homo sapiens
atgtcagatttctggtt

SEQ ID NO: 3980033 - DNA, 19 bp, Homo sapiens
atgtcagatttctggttga

SEQ ID NO: 3980034 - DNA, 18 bp, Homo sapiens
atgtcagcagacacacat

SEQ ID NO: 3980035 - DNA, 17 bp, Homo sapiens
atgtcaggaacagaagg

SEQ ID NO: 3980036 - DNA, 19 bp, Homo sapiens
atgtcaggaacagaaggat

SEQ ID NO: 3980037 - DNA, 20 bp, Homo sapiens
atgtcaggaacagaaggatg

SEQ ID NO: 3980038 - DNA, 12 bp, Homo sapiens
atgtcaggcctg

SEQ ID NO: 3980039 - DNA, 24 bp, Homo sapiens
atgtcagtatttcagtgtagttaa

SEQ ID NO: 3980040 - DNA, 20 bp, Homo sapiens
atgtcatctaaccattaagt

SEQ ID NO: 3980041 - DNA, 13 bp, Homo sapiens
atgtcatgtctgc

SEQ ID NO: 3980042 - DNA, 18 bp, Homo sapiens
atgtcatgtctgcttgtc

SEQ ID NO: 3980043 - DNA, 15 bp, Homo sapiens
atgtccaaagaggct

SEQ ID NO: 3980044 - DNA, 21 bp, Homo sapiens
atgtccaaagaggctgcccct

SEQ ID NO: 3980045 - DNA, 21 bp, Homo sapiens
atgtccagaagaatattcagg

SEQ ID NO: 3980046 - DNA, 22 bp, Homo sapiens
atgtccagaagaatattcagga

SEQ ID NO: 3980047 - DNA, 14 bp, Homo sapiens
atgtccattctcat

SEQ ID NO: 3980048 - DNA, 14 bp, Homo sapiens
atgtccctgggcca

SEQ ID NO: 3980049 - DNA, 18 bp, Homo sapiens
atgtccctgggccagggt

SEQ ID NO: 3980050 - DNA, 16 bp, Homo sapiens
atgtccctttcttctc

SEQ ID NO: 3980051 - DNA, 18 bp, Homo sapiens
atgtcctaaggacacact

SEQ ID NO: 3980052 - DNA, 19 bp, Homo sapiens
atgtcctaattcttctgtc

SEQ ID NO: 3980053 - DNA, 20 bp, Homo sapiens
atgtcctactatcactgaac

SEQ ID NO: 3980054 - DNA, 21 bp, Homo sapiens
atgtcctcagcatttcttttc

SEQ ID NO: 3980055 - DNA, 19 bp, Homo sapiens
atgtcctccagaagcctct

SEQ ID NO: 3980056 - DNA, 23 bp, Homo sapiens
atgtcctccagaagcctctggct

SEQ ID NO: 3980057 - DNA, 13 bp, Homo sapiens
atgtcctgccttt

SEQ ID NO: 3980058 - DNA, 19 bp, Homo sapiens
atgtcctgctggcttccag

SEQ ID NO: 3980059 - DNA, 13 bp, Homo sapiens
atgtctaaaattg

SEQ ID NO: 3980060 - DNA, 23 bp, Homo sapiens
atgtctagaccaggacctccctc

SEQ ID NO: 3980061 - DNA, 13 bp, Homo sapiens
atgtctatttaag

SEQ ID NO: 3980062 - DNA, 23 bp, Homo sapiens
atgtctatttaagcctcatattt

SEQ ID NO: 3980063 - DNA, 13 bp, Homo sapiens
atgtctcactgtt

SEQ ID NO: 3980064 - DNA, 18 bp, Homo sapiens
atgtctcactgttctgca

SEQ ID NO: 3980065 - DNA, 19 bp, Homo sapiens
atgtctcagttttcagcta

SEQ ID NO: 3980066 - DNA, 12 bp, Homo sapiens
atgtctgataat

SEQ ID NO: 3980067 - DNA, 22 bp, Homo sapiens
atgtctgataatgatttgctct

SEQ ID NO: 3980068 - DNA, 21 bp, Homo sapiens
atgtctgcttgtcaaaagaaa

SEQ ID NO: 3980069 - DNA, 19 bp, Homo sapiens
atgtctgtagctcctcaac

SEQ ID NO: 3980070 - DNA, 22 bp, Homo sapiens
atgtcttccatgtatcttttga

SEQ ID NO: 3980071 - DNA, 11 bp, Homo sapiens
atgtcttccct

SEQ ID NO: 3980072 - DNA, 24 bp, Homo sapiens
atgtcttccctgggctgccaccag

SEQ ID NO: 3980073 - DNA, 22 bp, Homo sapiens
atgtctttaggcagcagctttt

SEQ ID NO: 3980074 - DNA, 12 bp, Homo sapiens
atgtctttgtaa

SEQ ID NO: 3980075 - DNA, 20 bp, Homo sapiens
atgtctttgttggaaaagaa

SEQ ID NO: 3980076 - DNA, 15 bp, Homo sapiens
atgtgaaaaaaatga

SEQ ID NO: 3980077 - DNA, 12 bp, Homo sapiens
atgtgaaacctt

SEQ ID NO: 3980078 - DNA, 13 bp, Homo sapiens
atgtgaaaccttt

SEQ ID NO: 3980079 - DNA, 20 bp, Homo sapiens
atgtgaaaccttttttaaga

SEQ ID NO: 3980080 - DNA, 16 bp, Homo sapiens
atgtgaacccgggacg

SEQ ID NO: 3980081 - DNA, 20 bp, Homo sapiens
atgtgaagacattttttgct

SEQ ID NO: 3980082 - DNA, 21 bp, Homo sapiens
atgtgaagacattttttgcta

SEQ ID NO: 3980083 - DNA, 19 bp, Homo sapiens
atgtgaagataatttgcat

SEQ ID NO: 3980084 - DNA, 20 bp, Homo sapiens
atgtgaatgatctctctgaa

SEQ ID NO: 3980085 - DNA, 14 bp, Homo sapiens
atgtgaatttttaa

SEQ ID NO: 3980086 - DNA, 16 bp, Homo sapiens
atgtgacaataatatt

SEQ ID NO: 3980087 - DNA, 18 bp, Homo sapiens
atgtgacattaacaaata

SEQ ID NO: 3980088 - DNA, 18 bp, Homo sapiens
atgtgacattttacatta

SEQ ID NO: 3980089 - DNA, 14 bp, Homo sapiens
atgtgactgtataa

SEQ ID NO: 3980090 - DNA, 16 bp, Homo sapiens
atgtgactttttttgg

SEQ ID NO: 3980091 - DNA, 18 bp, Homo sapiens
atgtgactttttttggta

SEQ ID NO: 3980092 - DNA, 15 bp, Homo sapiens
atgtgagaagccagc

SEQ ID NO: 3980093 - DNA, 15 bp, Homo sapiens
atgtgagagaaagtg

SEQ ID NO: 3980094 - DNA, 17 bp, Homo sapiens
atgtgagaggtttgact

SEQ ID NO: 3980095 - DNA, 17 bp, Homo sapiens
atgtgagccaccgctgc

SEQ ID NO: 3980096 - DNA, 19 bp, Homo sapiens
atgtgagccaccgctgcca

SEQ ID NO: 3980097 - DNA, 21 bp, Homo sapiens
atgtgagccaccgtgcctggc

SEQ ID NO: 3980098 - DNA, 15 bp, Homo sapiens
atgtgagctgctgcc

SEQ ID NO: 3980099 - DNA, 23 bp, Homo sapiens
atgtgagctgctgccatgaactg

SEQ ID NO: 3980100 - DNA, 21 bp, Homo sapiens
atgtgaggaagaactacagct

SEQ ID NO: 3980101 - DNA, 19 bp, Homo sapiens
atgtgaggaggaaaaggaa

SEQ ID NO: 3980102 - DNA, 23 bp, Homo sapiens
atgtgatctgggcattttcctcc

SEQ ID NO: 3980103 - DNA, 14 bp, Homo sapiens
atgtgatggttggt

SEQ ID NO: 3980104 - DNA, 14 bp, Homo sapiens
atgtgattgtggaa

SEQ ID NO: 3980105 - DNA, 17 bp, Homo sapiens
atgtgattgtggaatgg

SEQ ID NO: 3980106 - DNA, 18 bp, Homo sapiens
atgtgcacccggcctgga

SEQ ID NO: 3980107 - DNA, 15 bp, Homo sapiens
atgtgcactgtcact

SEQ ID NO: 3980108 - DNA, 19 bp, Homo sapiens
atgtgcaggtttgttacat

SEQ ID NO: 3980109 - DNA, 21 bp, Homo sapiens
atgtgcatttttgtgaaatga

SEQ ID NO: 3980110 - DNA, 17 bp, Homo sapiens
atgtgccaataaccaag

SEQ ID NO: 3980111 - DNA, 15 bp, Homo sapiens
atgtgccagttcctg

SEQ ID NO: 3980112 - DNA, 22 bp, Homo sapiens
atgtgccattttaaaaaaaaag

SEQ ID NO: 3980113 - DNA, 15 bp, Homo sapiens
atgtgcccctggccc

SEQ ID NO: 3980114 - DNA, 16 bp, Homo sapiens
atgtgcccctggccca

SEQ ID NO: 3980115 - DNA, 20 bp, Homo sapiens
atgtgcccctggcccatctc

SEQ ID NO: 3980116 - DNA, 11 bp, Homo sapiens
atgtgcctttc

SEQ ID NO: 3980117 - DNA, 13 bp, Homo sapiens
atgtgcctttctt

SEQ ID NO: 3980118 - DNA, 18 bp, Homo sapiens
atgtgcctttctttgcct

SEQ ID NO: 3980119 - DNA, 20 bp, Homo sapiens
atgtgctactgattgtttca

SEQ ID NO: 3980120 - DNA, 15 bp, Homo sapiens
atgtggaaagtgaat

SEQ ID NO: 3980121 - DNA, 13 bp, Homo sapiens
atgtggagactga

SEQ ID NO: 3980122 - DNA, 23 bp, Homo sapiens
atgtggagactgatggccaggca

SEQ ID NO: 3980123 - DNA, 19 bp, Homo sapiens
atgtggagtcagcctcgca

SEQ ID NO: 3980124 - DNA, 18 bp, Homo sapiens
atgtggagtctccctctg

SEQ ID NO: 3980125 - DNA, 22 bp, Homo sapiens
atgtggcattggggggccgggc

SEQ ID NO: 3980126 - DNA, 19 bp, Homo sapiens
atgtggccacttatttcac

SEQ ID NO: 3980127 - DNA, 21 bp, Homo sapiens
atgtggcttgagaaatatgga

SEQ ID NO: 3980128 - DNA, 11 bp, Homo sapiens
atgtgggaggg

SEQ ID NO: 3980129 - DNA, 18 bp, Homo sapiens
atgtggtggcacaggccc

SEQ ID NO: 3980130 - DNA, 23 bp, Homo sapiens
atgtggttacttcctactgtagg

SEQ ID NO: 3980131 - DNA, 18 bp, Homo sapiens
atgtggttatttctctga

SEQ ID NO: 3980132 - DNA, 14 bp, Homo sapiens
atgtgtagcctatg

SEQ ID NO: 3980133 - DNA, 15 bp, Homo sapiens
atgtgtatgcacagt

SEQ ID NO: 3980134 - DNA, 14 bp, Homo sapiens
atgtgtatgtgtct

SEQ ID NO: 3980135 - DNA, 23 bp, Homo sapiens
atgtgtattaaaacacattatgt

SEQ ID NO: 3980136 - DNA, 14 bp, Homo sapiens
atgtgtatttctta

SEQ ID NO: 3980137 - DNA, 16 bp, Homo sapiens
atgtgtatttcttata

SEQ ID NO: 3980138 - DNA, 19 bp, Homo sapiens
atgtgtcccctcactctgt

SEQ ID NO: 3980139 - DNA, 22 bp, Homo sapiens
atgtgtcccctcactctgtcag

SEQ ID NO: 3980140 - DNA, 18 bp, Homo sapiens
atgtgtctgctaatgtaa

SEQ ID NO: 3980141 - DNA, 21 bp, Homo sapiens
atgtgtctgctaatgtaaact

SEQ ID NO: 3980142 - DNA, 18 bp, Homo sapiens
atgtgtctgtatttcatg

SEQ ID NO: 3980143 - DNA, 20 bp, Homo sapiens
atgtgtctgtatttcatgtg

SEQ ID NO: 3980144 - DNA, 15 bp, Homo sapiens
atgtgtgtgtatgtt

SEQ ID NO: 3980145 - DNA, 21 bp, Homo sapiens
atgtgtttattcatccagcag

SEQ ID NO: 3980146 - DNA, 21 bp, Homo sapiens
atgtgtttttgggaagaagaa

SEQ ID NO: 3980147 - DNA, 12 bp, Homo sapiens
atgttaaatact

SEQ ID NO: 3980148 - DNA, 15 bp, Homo sapiens
atgttaaatactgtg

SEQ ID NO: 3980149 - DNA, 19 bp, Homo sapiens
atgttaaatactgtgcaga

SEQ ID NO: 3980150 - DNA, 13 bp, Homo sapiens
atgttaaggaaac

SEQ ID NO: 3980151 - DNA, 18 bp, Homo sapiens
atgttaaggaaactctta

SEQ ID NO: 3980152 - DNA, 22 bp, Homo sapiens
atgttaattcagcactgatttc

SEQ ID NO: 3980153 - DNA, 23 bp, Homo sapiens
atgttaattcagcactgatttca

SEQ ID NO: 3980154 - DNA, 14 bp, Homo sapiens
atgttactcagtgt

SEQ ID NO: 3980155 - DNA, 13 bp, Homo sapiens
atgttactgacca

SEQ ID NO: 3980156 - DNA, 16 bp, Homo sapiens
atgttactgatcatgc

SEQ ID NO: 3980157 - DNA, 19 bp, Homo sapiens
atgttactgatcatgcatt

SEQ ID NO: 3980158 - DNA, 21 bp, Homo sapiens
atgttagtattttaatcctgt

SEQ ID NO: 3980159 - DNA, 15 bp, Homo sapiens
atgttagtcattgtt

SEQ ID NO: 3980160 - DNA, 16 bp, Homo sapiens
atgttagtcattgtta

SEQ ID NO: 3980161 - DNA, 19 bp, Homo sapiens
atgttatatcatatgtata

SEQ ID NO: 3980162 - DNA, 11 bp, Homo sapiens
atgttatgaac

SEQ ID NO: 3980163 - DNA, 12 bp, Homo sapiens
atgttattttgt

SEQ ID NO: 3980164 - DNA, 20 bp, Homo sapiens
atgttattttttaattatta

SEQ ID NO: 3980165 - DNA, 16 bp, Homo sapiens
atgttcagcactgtcc

SEQ ID NO: 3980166 - DNA, 22 bp, Homo sapiens
atgttcattgtaatgttactga

SEQ ID NO: 3980167 - DNA, 18 bp, Homo sapiens
atgttcatttgtttgttt

SEQ ID NO: 3980168 - DNA, 15 bp, Homo sapiens
atgttcgggtgtggg

SEQ ID NO: 3980169 - DNA, 19 bp, Homo sapiens
atgttctatggttatgaaa

SEQ ID NO: 3980170 - DNA, 21 bp, Homo sapiens
atgttctatggttatgaaaga

SEQ ID NO: 3980171 - DNA, 18 bp, Homo sapiens
atgttctattaatcacct

SEQ ID NO: 3980172 - DNA, 15 bp, Homo sapiens
atgttctgacattaa

SEQ ID NO: 3980173 - DNA, 20 bp, Homo sapiens
atgttcttagtggatgttct

SEQ ID NO: 3980174 - DNA, 15 bp, Homo sapiens
atgttcttatagaat

SEQ ID NO: 3980175 - DNA, 20 bp, Homo sapiens
atgttcttatagaataaaag

SEQ ID NO: 3980176 - DNA, 19 bp, Homo sapiens
atgttcttgcagtcatcag

SEQ ID NO: 3980177 - DNA, 14 bp, Homo sapiens
atgttctttggaaa

SEQ ID NO: 3980178 - DNA, 18 bp, Homo sapiens
atgttggatttataaatg

SEQ ID NO: 3980179 - DNA, 20 bp, Homo sapiens
atgttggcagatgcagctct

SEQ ID NO: 3980180 - DNA, 21 bp, Homo sapiens
atgttggcagatgcagctctt

SEQ ID NO: 3980181 - DNA, 12 bp, Homo sapiens
atgttgggaaag

SEQ ID NO: 3980182 - DNA, 21 bp, Homo sapiens
atgttgggaaagtatttactt

SEQ ID NO: 3980183 - DNA, 11 bp, Homo sapiens
atgttgtacaa

SEQ ID NO: 3980184 - DNA, 20 bp, Homo sapiens
atgttgttcattattggagg

SEQ ID NO: 3980185 - DNA, 20 bp, Homo sapiens
atgttgttgaggctgtcaca

SEQ ID NO: 3980186 - DNA, 12 bp, Homo sapiens
atgtttaaaata

SEQ ID NO: 3980187 - DNA, 22 bp, Homo sapiens
atgtttaaagtaattgttccag

SEQ ID NO: 3980188 - DNA, 18 bp, Homo sapiens
atgtttaaatcatgtatg

SEQ ID NO: 3980189 - DNA, 19 bp, Homo sapiens
atgtttaaatcatgtatgt

SEQ ID NO: 3980190 - DNA, 14 bp, Homo sapiens
atgtttaatctgtt

SEQ ID NO: 3980191 - DNA, 17 bp, Homo sapiens
atgtttaatctgttatg

SEQ ID NO: 3980192 - DNA, 13 bp, Homo sapiens
atgtttacatatc

SEQ ID NO: 3980193 - DNA, 20 bp, Homo sapiens
atgtttacatatcacctcat

SEQ ID NO: 3980194 - DNA, 21 bp, Homo sapiens
atgtttatgagccagacaaat

SEQ ID NO: 3980195 - DNA, 15 bp, Homo sapiens
atgtttatgttctta

SEQ ID NO: 3980196 - DNA, 18 bp, Homo sapiens
atgtttattcctgataat

SEQ ID NO: 3980197 - DNA, 17 bp, Homo sapiens
atgtttatttactaatt

SEQ ID NO: 3980198 - DNA, 19 bp, Homo sapiens
atgtttccagcagaagaca

SEQ ID NO: 3980199 - DNA, 15 bp, Homo sapiens
atgtttcttctaggt

SEQ ID NO: 3980200 - DNA, 22 bp, Homo sapiens
atgtttcttctaggttctaaaa

SEQ ID NO: 3980201 - DNA, 11 bp, Homo sapiens
atgtttgaata

SEQ ID NO: 3980202 - DNA, 18 bp, Homo sapiens
atgtttgaatttttctct

SEQ ID NO: 3980203 - DNA, 20 bp, Homo sapiens
atgtttgaatttttctcttc

SEQ ID NO: 3980204 - DNA, 13 bp, Homo sapiens
atgtttgcagggg

SEQ ID NO: 3980205 - DNA, 16 bp, Homo sapiens
atgtttgcctcataat

SEQ ID NO: 3980206 - DNA, 18 bp, Homo sapiens
atgtttgcttcataaatg

SEQ ID NO: 3980207 - DNA, 20 bp, Homo sapiens
atgtttgcttcataaatgaa

SEQ ID NO: 3980208 - DNA, 12 bp, Homo sapiens
atgtttggggtc

SEQ ID NO: 3980209 - DNA, 10 bp, Homo sapiens
atgtttgtgg

SEQ ID NO: 3980210 - DNA, 13 bp, Homo sapiens
atgtttgtggcct

SEQ ID NO: 3980211 - DNA, 16 bp, Homo sapiens
atgtttgtggcctcag

SEQ ID NO: 3980212 - DNA, 14 bp, Homo sapiens
atgtttgttaaaaa

SEQ ID NO: 3980213 - DNA, 16 bp, Homo sapiens
atgttttataagttca

SEQ ID NO: 3980214 - DNA, 23 bp, Homo sapiens
atgttttatttatcaaaatgtag

SEQ ID NO: 3980215 - DNA, 15 bp, Homo sapiens
atgttttcaggtgtc

SEQ ID NO: 3980216 - DNA, 20 bp, Homo sapiens
atgttttgtcccatttcctt

SEQ ID NO: 3980217 - DNA, 15 bp, Homo sapiens
atgttttgtgcattt

SEQ ID NO: 3980218 - DNA, 22 bp, Homo sapiens
atgttttgtgcatttgtaaatg

SEQ ID NO: 3980219 - DNA, 14 bp, Homo sapiens
atgttttgtttctg

SEQ ID NO: 3980220 - DNA, 13 bp, Homo sapiens
atgtttttccctc

SEQ ID NO: 3980221 - DNA, 19 bp, Homo sapiens
atgtttttccctccccaga

SEQ ID NO: 3980222 - DNA, 20 bp, Homo sapiens
atgtttttccctccccagaa

SEQ ID NO: 3980223 - DNA, 22 bp, Homo sapiens
atgtttttgatcaaaaactatt

SEQ ID NO: 3980224 - DNA, 22 bp, Homo sapiens
atgttttttagatcaaatactt

SEQ ID NO: 3980225 - DNA, 12 bp, Homo sapiens
atgttttttgcc

SEQ ID NO: 3980226 - DNA, 22 bp, Homo sapiens
aggcagcccagcagtgtggaga

SEQ ID NO: 3980227 - DNA, 12 bp, Homo sapiens
aggcagccccct

SEQ ID NO: 3980228 - DNA, 15 bp, Homo sapiens
aggcagccccctcca

SEQ ID NO: 3980229 - DNA, 21 bp, Homo sapiens
aggcagccccctccacaccag

SEQ ID NO: 3980230 - DNA, 21 bp, Homo sapiens
aggcagcgccaagtgcgtgcc

SEQ ID NO: 3980231 - DNA, 15 bp, Homo sapiens
aggcagctcacccct

SEQ ID NO: 3980232 - DNA, 18 bp, Homo sapiens
aggcaggagaactacttg

SEQ ID NO: 3980233 - DNA, 14 bp, Homo sapiens
aggcaggcattgag

SEQ ID NO: 3980234 - DNA, 22 bp, Homo sapiens
aggcaggccaaggccttctcct

SEQ ID NO: 3980235 - DNA, 12 bp, Homo sapiens
aggcaggctggg

SEQ ID NO: 3980236 - DNA, 12 bp, Homo sapiens
aggcagggccct

SEQ ID NO: 3980237 - DNA, 15 bp, Homo sapiens
aggcagggctctccc

SEQ ID NO: 3980238 - DNA, 20 bp, Homo sapiens
aggcaggggccctgcagctc

SEQ ID NO: 3980239 - DNA, 21 bp, Homo sapiens
aggcaggggccctgcagctct

SEQ ID NO: 3980240 - DNA, 22 bp, Homo sapiens
aggcaggggccctgcagctctc

SEQ ID NO: 3980241 - DNA, 14 bp, Homo sapiens
aggcagggtgcagt

SEQ ID NO: 3980242 - DNA, 19 bp, Homo sapiens
aggcagggtgtctgccccc

SEQ ID NO: 3980243 - DNA, 20 bp, Homo sapiens
aggcagggttaaactgcagg

SEQ ID NO: 3980244 - DNA, 13 bp, Homo sapiens
aggcataggcctg

SEQ ID NO: 3980245 - DNA, 14 bp, Homo sapiens
aggcataggcctgg

SEQ ID NO: 3980246 - DNA, 15 bp, Homo sapiens
aggcataggcctggg

SEQ ID NO: 3980247 - DNA, 16 bp, Homo sapiens
aggcataggcctgggt

SEQ ID NO: 3980248 - DNA, 18 bp, Homo sapiens
aggcataggcctgggtgc

SEQ ID NO: 3980249 - DNA, 16 bp, Homo sapiens
aggcatcccagcctgg

SEQ ID NO: 3980250 - DNA, 19 bp, Homo sapiens
aggcatctacacagcctgg

SEQ ID NO: 3980251 - DNA, 22 bp, Homo sapiens
aggcatctacacagcctggact

SEQ ID NO: 3980252 - DNA, 21 bp, Homo sapiens
aggcatctctgtactttgctt

SEQ ID NO: 3980253 - DNA, 14 bp, Homo sapiens
aggcatctgagggg

SEQ ID NO: 3980254 - DNA, 19 bp, Homo sapiens
aggcatctgtgggcatggt

SEQ ID NO: 3980255 - DNA, 18 bp, Homo sapiens
aggcatggctcagagctt

SEQ ID NO: 3980256 - DNA, 12 bp, Homo sapiens
aggcatggctgg

SEQ ID NO: 3980257 - DNA, 17 bp, Homo sapiens
aggcatgtaggaccctg

SEQ ID NO: 3980258 - DNA, 19 bp, Homo sapiens
aggcatgtaggaccctgca

SEQ ID NO: 3980259 - DNA, 16 bp, Homo sapiens
aggcattaatgtttct

SEQ ID NO: 3980260 - DNA, 19 bp, Homo sapiens
aggcattaatgtttctatc

SEQ ID NO: 3980261 - DNA, 21 bp, Homo sapiens
aggcattaatgtttctatctg

SEQ ID NO: 3980262 - DNA, 21 bp, Homo sapiens
aggcattgttagtttagtgtg

SEQ ID NO: 3980263 - DNA, 14 bp, Homo sapiens
aggccaaactgtcc

SEQ ID NO: 3980264 - DNA, 14 bp, Homo sapiens
aggccaagaaacgt

SEQ ID NO: 3980265 - DNA, 17 bp, Homo sapiens
aggccaagaaacgtctt

SEQ ID NO: 3980266 - DNA, 14 bp, Homo sapiens
aggccaagaggttt

SEQ ID NO: 3980267 - DNA, 17 bp, Homo sapiens
aggccaaggccttctcc

SEQ ID NO: 3980268 - DNA, 22 bp, Homo sapiens
aggccaagtgtgataaataaac

SEQ ID NO: 3980269 - DNA, 23 bp, Homo sapiens
aggccaataaaaagttcagagtt

SEQ ID NO: 3980270 - DNA, 21 bp, Homo sapiens
aggccaccccctatcctctga

SEQ ID NO: 3980271 - DNA, 15 bp, Homo sapiens
aggccaccctgtgca

SEQ ID NO: 3980272 - DNA, 21 bp, Homo sapiens
aggccagagtcaccttttctg

SEQ ID NO: 3980273 - DNA, 14 bp, Homo sapiens
aggccagcaacatt

SEQ ID NO: 3980274 - DNA, 13 bp, Homo sapiens
aggccagcccagc

SEQ ID NO: 3980275 - DNA, 16 bp, Homo sapiens
aggccagcccagccag

SEQ ID NO: 3980276 - DNA, 18 bp, Homo sapiens
aggccagccccacccagg

SEQ ID NO: 3980277 - DNA, 10 bp, Homo sapiens
aggccagcct

SEQ ID NO: 3980278 - DNA, 17 bp, Homo sapiens
aggccaggacgtctggg

SEQ ID NO: 3980279 - DNA, 21 bp, Homo sapiens
aggccaggagtttgagaccag

SEQ ID NO: 3980280 - DNA, 16 bp, Homo sapiens
aggccagggctgatgg

SEQ ID NO: 3980281 - DNA, 15 bp, Homo sapiens
aggccatctcaggag

SEQ ID NO: 3980282 - DNA, 20 bp, Homo sapiens
aggccatggaggcagtagga

SEQ ID NO: 3980283 - DNA, 19 bp, Homo sapiens
aggcccaaggtcccctcca

SEQ ID NO: 3980284 - DNA, 20 bp, Homo sapiens
aggcccaaggtcccctccac

SEQ ID NO: 3980285 - DNA, 15 bp, Homo sapiens
aggcccagcgcggcc

SEQ ID NO: 3980286 - DNA, 18 bp, Homo sapiens
aggcccagcgcggccagc

SEQ ID NO: 3980287 - DNA, 23 bp, Homo sapiens
aggcccaggaatcggagcgaagc

SEQ ID NO: 3980288 - DNA, 21 bp, Homo sapiens
aggcccaggatatttctgaga

SEQ ID NO: 3980289 - DNA, 14 bp, Homo sapiens
aggcccaggcctca

SEQ ID NO: 3980290 - DNA, 15 bp, Homo sapiens
aggcccaggcctcac

SEQ ID NO: 3980291 - DNA, 17 bp, Homo sapiens
aggcccagttcaccctg

SEQ ID NO: 3980292 - DNA, 16 bp, Homo sapiens
aggcccatgccaaggc

SEQ ID NO: 3980293 - DNA, 17 bp, Homo sapiens
aggcccatgccaaggcc

SEQ ID NO: 3980294 - DNA, 13 bp, Homo sapiens
aggccccagcctc

SEQ ID NO: 3980295 - DNA, 14 bp, Homo sapiens
aggccccagcctcc

SEQ ID NO: 3980296 - DNA, 17 bp, Homo sapiens
aggcccctggacaagca

SEQ ID NO: 3980297 - DNA, 17 bp, Homo sapiens
aggcccctggggctccc

SEQ ID NO: 3980298 - DNA, 16 bp, Homo sapiens
aggcccctgggtttct

SEQ ID NO: 3980299 - DNA, 19 bp, Homo sapiens
aggcccgcaccccggcctc

SEQ ID NO: 3980300 - DNA, 20 bp, Homo sapiens
aggccctccctgttccccag

SEQ ID NO: 3980301 - DNA, 23 bp, Homo sapiens
aggccctccctgttccccagaga

SEQ ID NO: 3980302 - DNA, 23 bp, Homo sapiens
aggccctcctctcccatccttga

SEQ ID NO: 3980303 - DNA, 15 bp, Homo sapiens
aggccctcctgtgct

SEQ ID NO: 3980304 - DNA, 21 bp, Homo sapiens
aggccctcctgtgctggggga

SEQ ID NO: 3980305 - DNA, 15 bp, Homo sapiens
aggccctgactcctc

SEQ ID NO: 3980306 - DNA, 15 bp, Homo sapiens
aggccctgaggcgga

SEQ ID NO: 3980307 - DNA, 12 bp, Homo sapiens
aggccctgccca

SEQ ID NO: 3980308 - DNA, 12 bp, Homo sapiens
aggccctgcccc

SEQ ID NO: 3980309 - DNA, 12 bp, Homo sapiens
aggccctgggct

SEQ ID NO: 3980310 - DNA, 20 bp, Homo sapiens
aggccctgtggtccccgaga

SEQ ID NO: 3980311 - DNA, 18 bp, Homo sapiens
aggccgaaggtgcctcag

SEQ ID NO: 3980312 - DNA, 20 bp, Homo sapiens
aggccgaaggtgcctcagac

SEQ ID NO: 3980313 - DNA, 14 bp, Homo sapiens
aggccggaaccaca

SEQ ID NO: 3980314 - DNA, 17 bp, Homo sapiens
aggccggaaccacaggg

SEQ ID NO: 3980315 - DNA, 18 bp, Homo sapiens
aggccggaaccacagggc

SEQ ID NO: 3980316 - DNA, 14 bp, Homo sapiens
aggccggcccagat

SEQ ID NO: 3980317 - DNA, 13 bp, Homo sapiens
aggccgggcagag

SEQ ID NO: 3980318 - DNA, 16 bp, Homo sapiens
aggccgggcagagcac

SEQ ID NO: 3980319 - DNA, 21 bp, Homo sapiens
aggccgggccgaatcccctcc

SEQ ID NO: 3980320 - DNA, 14 bp, Homo sapiens
aggccgtgtctctg

SEQ ID NO: 3980321 - DNA, 18 bp, Homo sapiens
aggccgtgtctctgagga

SEQ ID NO: 3980322 - DNA, 21 bp, Homo sapiens
aggccgttgccgctgatgttt

SEQ ID NO: 3980323 - DNA, 14 bp, Homo sapiens
aggcctcaggtgct

SEQ ID NO: 3980324 - DNA, 21 bp, Homo sapiens
aggcctcaggtgctgtccatg

SEQ ID NO: 3980325 - DNA, 17 bp, Homo sapiens
aggcctccatctcatgt

SEQ ID NO: 3980326 - DNA, 16 bp, Homo sapiens
aggcctccctgccagt

SEQ ID NO: 3980327 - DNA, 17 bp, Homo sapiens
aggcctccctgccagta

SEQ ID NO: 3980328 - DNA, 21 bp, Homo sapiens
aggcctcctgtggcctgccag

SEQ ID NO: 3980329 - DNA, 17 bp, Homo sapiens
aggctgcctcctgccct

SEQ ID NO: 3980330 - DNA, 18 bp, Homo sapiens
aggctgcctctcccatca

SEQ ID NO: 3980331 - DNA, 13 bp, Homo sapiens
aggctgcttggga

SEQ ID NO: 3980332 - DNA, 14 bp, Homo sapiens
aggctggagaagct

SEQ ID NO: 3980333 - DNA, 20 bp, Homo sapiens
aggctggagaagctcaccca

SEQ ID NO: 3980334 - DNA, 15 bp, Homo sapiens
aggctggagaccccc

SEQ ID NO: 3980335 - DNA, 17 bp, Homo sapiens
aggctggcacaggacat

SEQ ID NO: 3980336 - DNA, 15 bp, Homo sapiens
aggctggcaggtatg

SEQ ID NO: 3980337 - DNA, 13 bp, Homo sapiens
aggctggccagca

SEQ ID NO: 3980338 - DNA, 22 bp, Homo sapiens
aggctggccagcaaggcaggtt

SEQ ID NO: 3980339 - DNA, 19 bp, Homo sapiens
aggctggctccagatgcag

SEQ ID NO: 3980340 - DNA, 22 bp, Homo sapiens
aggctggctggcccgtcatgtt

SEQ ID NO: 3980341 - DNA, 19 bp, Homo sapiens
aggctgggacgctctgctg

SEQ ID NO: 3980342 - DNA, 14 bp, Homo sapiens
aggctgggagtccc

SEQ ID NO: 3980343 - DNA, 22 bp, Homo sapiens
aggctgggagtccctacctgct

SEQ ID NO: 3980344 - DNA, 13 bp, Homo sapiens
aggctgggcacag

SEQ ID NO: 3980345 - DNA, 16 bp, Homo sapiens
aggctgggcagcccca

SEQ ID NO: 3980346 - DNA, 12 bp, Homo sapiens
aggctgggccat

SEQ ID NO: 3980347 - DNA, 20 bp, Homo sapiens
aggctgggccatgtccaaag

SEQ ID NO: 3980348 - DNA, 21 bp, Homo sapiens
aggctgggccatgtccaaaga

SEQ ID NO: 3980349 - DNA, 12 bp, Homo sapiens
aggctgggcccc

SEQ ID NO: 3980350 - DNA, 16 bp, Homo sapiens
aggctgggcccctggg

SEQ ID NO: 3980351 - DNA, 20 bp, Homo sapiens
aggctgggtaatgtgaaggc

SEQ ID NO: 3980352 - DNA, 22 bp, Homo sapiens
aggctgtagaaaggggagaatg

SEQ ID NO: 3980353 - DNA, 23 bp, Homo sapiens
aggctgtagaaaggggagaatgt

SEQ ID NO: 3980354 - DNA, 15 bp, Homo sapiens
aggctgtctggggcc

SEQ ID NO: 3980355 - DNA, 18 bp, Homo sapiens
aggctgtgcagcgcagct

SEQ ID NO: 3980356 - DNA, 18 bp, Homo sapiens
aggctgtgggcctcaagg

SEQ ID NO: 3980357 - DNA, 11 bp, Homo sapiens
aggctgttctc

SEQ ID NO: 3980358 - DNA, 15 bp, Homo sapiens
aggctgttctccagg

SEQ ID NO: 3980359 - DNA, 12 bp, Homo sapiens
aggcttcaccct

SEQ ID NO: 3980360 - DNA, 20 bp, Homo sapiens
aggcttcagcatatttatag

SEQ ID NO: 3980361 - DNA, 20 bp, Homo sapiens
aggcttcctgcgtcctcctc

SEQ ID NO: 3980362 - DNA, 21 bp, Homo sapiens
aggcttcctgcgtcctcctca

SEQ ID NO: 3980363 - DNA, 18 bp, Homo sapiens
aggcttcggagtttctta

SEQ ID NO: 3980364 - DNA, 14 bp, Homo sapiens
aggcttctccgcca

SEQ ID NO: 3980365 - DNA, 21 bp, Homo sapiens
aggcttctccgccagcctcct

SEQ ID NO: 3980366 - DNA, 13 bp, Homo sapiens
agctccaggggcc

SEQ ID NO: 3980367 - DNA, 13 bp, Homo sapiens
agctccattttct

SEQ ID NO: 3980368 - DNA, 23 bp, Homo sapiens
agctccccacaccttccagggcc

SEQ ID NO: 3980369 - DNA, 14 bp, Homo sapiens
agctcccccagctc

SEQ ID NO: 3980370 - DNA, 15 bp, Homo sapiens
agctcccccagctcc

SEQ ID NO: 3980371 - DNA, 16 bp, Homo sapiens
agctcccccagctccc

SEQ ID NO: 3980372 - DNA, 21 bp, Homo sapiens
agctccccgcttctgcctgca

SEQ ID NO: 3980373 - DNA, 19 bp, Homo sapiens
agctcctacctctgtgcca

SEQ ID NO: 3980374 - DNA, 17 bp, Homo sapiens
agctcctctccccagcc

SEQ ID NO: 3980375 - DNA, 18 bp, Homo sapiens
agctcctctccccagccc

SEQ ID NO: 3980376 - DNA, 19 bp, Homo sapiens
agctcctctccccagccca

SEQ ID NO: 3980377 - DNA, 22 bp, Homo sapiens
agctcctctccccagcccagag

SEQ ID NO: 3980378 - DNA, 13 bp, Homo sapiens
agctcctgccaca

SEQ ID NO: 3980379 - DNA, 21 bp, Homo sapiens
agctcctgccacatggagccc

SEQ ID NO: 3980380 - DNA, 12 bp, Homo sapiens
agctcctgtcct

SEQ ID NO: 3980381 - DNA, 14 bp, Homo sapiens
agctcctgtcctcc

SEQ ID NO: 3980382 - DNA, 21 bp, Homo sapiens
agctcctgtcctcccatcccc

SEQ ID NO: 3980383 - DNA, 12 bp, Homo sapiens
agctccttggag

SEQ ID NO: 3980384 - DNA, 14 bp, Homo sapiens
agctccttggagca

SEQ ID NO: 3980385 - DNA, 15 bp, Homo sapiens
agctccttggagcag

SEQ ID NO: 3980386 - DNA, 22 bp, Homo sapiens
agctccttttccgttctgttct

SEQ ID NO: 3980387 - DNA, 17 bp, Homo sapiens
agctcgaattaagaata

SEQ ID NO: 3980388 - DNA, 20 bp, Homo sapiens
agctctaccctgctccctgc

SEQ ID NO: 3980389 - DNA, 21 bp, Homo sapiens
agctctcaagtcaaggaagct

SEQ ID NO: 3980390 - DNA, 17 bp, Homo sapiens
agctctcccagtgaact

SEQ ID NO: 3980391 - DNA, 14 bp, Homo sapiens
agctctcctgactt

SEQ ID NO: 3980392 - DNA, 16 bp, Homo sapiens
agctctctaggcctct

SEQ ID NO: 3980393 - DNA, 14 bp, Homo sapiens
agctctctgccctg

SEQ ID NO: 3980394 - DNA, 17 bp, Homo sapiens
agctctctgccctgtgt

SEQ ID NO: 3980395 - DNA, 12 bp, Homo sapiens
agctctctggga

SEQ ID NO: 3980396 - DNA, 21 bp, Homo sapiens
agctctgaagtcacatcacag

SEQ ID NO: 3980397 - DNA, 19 bp, Homo sapiens
agctctgcatctcctgtct

SEQ ID NO: 3980398 - DNA, 13 bp, Homo sapiens
agctctgcattat

SEQ ID NO: 3980399 - DNA, 18 bp, Homo sapiens
agctctggacagccccac

SEQ ID NO: 3980400 - DNA, 22 bp, Homo sapiens
agctctgttccatgcaactgga

SEQ ID NO: 3980401 - DNA, 16 bp, Homo sapiens
agctctgttgcaatta

SEQ ID NO: 3980402 - DNA, 21 bp, Homo sapiens
agctctgttgcaattaggatt

SEQ ID NO: 3980403 - DNA, 19 bp, Homo sapiens
agctcttactctttcctat

SEQ ID NO: 3980404 - DNA, 11 bp, Homo sapiens
agctcttccct

SEQ ID NO: 3980405 - DNA, 13 bp, Homo sapiens
agctcttggcctt

SEQ ID NO: 3980406 - DNA, 11 bp, Homo sapiens
agctcttttaa

SEQ ID NO: 3980407 - DNA, 21 bp, Homo sapiens
agctcttttttgtttgtttct

SEQ ID NO: 3980408 - DNA, 22 bp, Homo sapiens
agctcttttttgtttgtttctt

SEQ ID NO: 3980409 - DNA, 23 bp, Homo sapiens
agctcttttttgtttgtttcttt

SEQ ID NO: 3980410 - DNA, 22 bp, Homo sapiens
agctgaacagccaaatgcatgg

SEQ ID NO: 3980411 - DNA, 13 bp, Homo sapiens
agctgaagagctg

SEQ ID NO: 3980412 - DNA, 18 bp, Homo sapiens
agctgaatgcctcctgtg

SEQ ID NO: 3980413 - DNA, 20 bp, Homo sapiens
agctgaatgcctcctgtggg

SEQ ID NO: 3980414 - DNA, 22 bp, Homo sapiens
agctgaatgcctcctgtgggga

SEQ ID NO: 3980415 - DNA, 23 bp, Homo sapiens
agctgacccagccccttgagaaa

SEQ ID NO: 3980416 - DNA, 18 bp, Homo sapiens
agctgacccggcctctct

SEQ ID NO: 3980417 - DNA, 14 bp, Homo sapiens
agctgactgtggcc

SEQ ID NO: 3980418 - DNA, 21 bp, Homo sapiens
agctgagcacttagcaggcac

SEQ ID NO: 3980419 - DNA, 10 bp, Homo sapiens
agctgagcca

SEQ ID NO: 3980420 - DNA, 14 bp, Homo sapiens
agctgagccctggg

SEQ ID NO: 3980421 - DNA, 15 bp, Homo sapiens
agctgagccctgggg

SEQ ID NO: 3980422 - DNA, 17 bp, Homo sapiens
agctgagcgccaggatg

SEQ ID NO: 3980423 - DNA, 17 bp, Homo sapiens
agctgaggccacactca

SEQ ID NO: 3980424 - DNA, 22 bp, Homo sapiens
agctgaggccacactcagcaca

SEQ ID NO: 3980425 - DNA, 18 bp, Homo sapiens
agctgaggtctcttgagg

SEQ ID NO: 3980426 - DNA, 21 bp, Homo sapiens
agctgaggtctcttgagggag

SEQ ID NO: 3980427 - DNA, 13 bp, Homo sapiens
agctgagtggcca

SEQ ID NO: 3980428 - DNA, 14 bp, Homo sapiens
agctgatataaatt

SEQ ID NO: 3980429 - DNA, 17 bp, Homo sapiens
agctgatataaattctg

SEQ ID NO: 3980430 - DNA, 13 bp, Homo sapiens
agctgatggcagc

SEQ ID NO: 3980431 - DNA, 15 bp, Homo sapiens
agctgatggcagctg

SEQ ID NO: 3980432 - DNA, 17 bp, Homo sapiens
agctgatgttggaagag

SEQ ID NO: 3980433 - DNA, 20 bp, Homo sapiens
agctgatgttggaagagaaa

SEQ ID NO: 3980434 - DNA, 21 bp, Homo sapiens
agctgatgttggaagagaaag

SEQ ID NO: 3980435 - DNA, 19 bp, Homo sapiens
agctgattactgtcaataa

SEQ ID NO: 3980436 - DNA, 21 bp, Homo sapiens
agctgattactgtcaataaac

SEQ ID NO: 3980437 - DNA, 19 bp, Homo sapiens
agctgattttaacaataac

SEQ ID NO: 3980438 - DNA, 17 bp, Homo sapiens
agctgcactgatgctgc

SEQ ID NO: 3980439 - DNA, 19 bp, Homo sapiens
agctgcactgatgctgccc

SEQ ID NO: 3980440 - DNA, 22 bp, Homo sapiens
agctgcagcctggctggtcctc

SEQ ID NO: 3980441 - DNA, 19 bp, Homo sapiens
agctgcagctgagcctgag

SEQ ID NO: 3980442 - DNA, 17 bp, Homo sapiens
agctgcaggaatcaaaa

SEQ ID NO: 3980443 - DNA, 20 bp, Homo sapiens
agctgcaggtgccagggccc

SEQ ID NO: 3980444 - DNA, 16 bp, Homo sapiens
agctgccagcccagaa

SEQ ID NO: 3980445 - DNA, 19 bp, Homo sapiens
agctgccaggtgagaaact

SEQ ID NO: 3980446 - DNA, 13 bp, Homo sapiens
agctgccagtgct

SEQ ID NO: 3980447 - DNA, 16 bp, Homo sapiens
agctgccccggcccct

SEQ ID NO: 3980448 - DNA, 17 bp, Homo sapiens
agctgccccggcccctc

SEQ ID NO: 3980449 - DNA, 21 bp, Homo sapiens
agctgccctatgggcctgccg

SEQ ID NO: 3980450 - DNA, 11 bp, Homo sapiens
agctgccctcc

SEQ ID NO: 3980451 - DNA, 23 bp, Homo sapiens
agctgccctcccctccggactgg

SEQ ID NO: 3980452 - DNA, 18 bp, Homo sapiens
agctgccgggcctgattt

SEQ ID NO: 3980453 - DNA, 15 bp, Homo sapiens
agggcttggccagcg

SEQ ID NO: 3980454 - DNA, 15 bp, Homo sapiens
agggcttggcccagc

SEQ ID NO: 3980455 - DNA, 21 bp, Homo sapiens
agggcttggcccagcgccaag

SEQ ID NO: 3980456 - DNA, 17 bp, Homo sapiens
agggctttggttccttc

SEQ ID NO: 3980457 - DNA, 15 bp, Homo sapiens
aggggaaaactgtta

SEQ ID NO: 3980458 - DNA, 21 bp, Homo sapiens
aggggaaagaaagggaaaagg

SEQ ID NO: 3980459 - DNA, 14 bp, Homo sapiens
aggggaaagtccag

SEQ ID NO: 3980460 - DNA, 13 bp, Homo sapiens
aggggaaatgtaa

SEQ ID NO: 3980461 - DNA, 14 bp, Homo sapiens
aggggaacctgcca

SEQ ID NO: 3980462 - DNA, 16 bp, Homo sapiens
aggggaatcagaactc

SEQ ID NO: 3980463 - DNA, 18 bp, Homo sapiens
aggggactgggggactgg

SEQ ID NO: 3980464 - DNA, 16 bp, Homo sapiens
aggggagaagagccct

SEQ ID NO: 3980465 - DNA, 13 bp, Homo sapiens
aggggagccagga

SEQ ID NO: 3980466 - DNA, 13 bp, Homo sapiens
aggggagcccact

SEQ ID NO: 3980467 - DNA, 12 bp, Homo sapiens
aggggagtagag

SEQ ID NO: 3980468 - DNA, 13 bp, Homo sapiens
aggggatatttaa

SEQ ID NO: 3980469 - DNA, 14 bp, Homo sapiens
aggggatatttaag

SEQ ID NO: 3980470 - DNA, 17 bp, Homo sapiens
aggggatgtgtgtgtgc

SEQ ID NO: 3980471 - DNA, 16 bp, Homo sapiens
aggggcacactacaga

SEQ ID NO: 3980472 - DNA, 18 bp, Homo sapiens
aggggcacactacagagc

SEQ ID NO: 3980473 - DNA, 17 bp, Homo sapiens
aggggcagaaaaactct

SEQ ID NO: 3980474 - DNA, 19 bp, Homo sapiens
aggggcatctgcccctccc

SEQ ID NO: 3980475 - DNA, 17 bp, Homo sapiens
aggggcccaaggcggcc

SEQ ID NO: 3980476 - DNA, 20 bp, Homo sapiens
aggggcccaaggcggcccct

SEQ ID NO: 3980477 - DNA, 14 bp, Homo sapiens
aggggcccacaggg

SEQ ID NO: 3980478 - DNA, 19 bp, Homo sapiens
aggggcccacagggaaccc

SEQ ID NO: 3980479 - DNA, 21 bp, Homo sapiens
aggggcccacagggaaccctg

SEQ ID NO: 3980480 - DNA, 12 bp, Homo sapiens
aggggccctgca

SEQ ID NO: 3980481 - DNA, 17 bp, Homo sapiens
aggggcccttgggacag

SEQ ID NO: 3980482 - DNA, 15 bp, Homo sapiens
aggggccggggaagc

SEQ ID NO: 3980483 - DNA, 18 bp, Homo sapiens
aggggcctggcagccgtg

SEQ ID NO: 3980484 - DNA, 17 bp, Homo sapiens
aggggccttagggcact

SEQ ID NO: 3980485 - DNA, 14 bp, Homo sapiens
aggggcggcaggag

SEQ ID NO: 3980486 - DNA, 16 bp, Homo sapiens
aggggctccatgccag

SEQ ID NO: 3980487 - DNA, 22 bp, Homo sapiens
aggggctctcagctcagcgcca

SEQ ID NO: 3980488 - DNA, 13 bp, Homo sapiens
aggggctgcaggg

SEQ ID NO: 3980489 - DNA, 21 bp, Homo sapiens
aggggctgggctccctgatga

SEQ ID NO: 3980490 - DNA, 12 bp, Homo sapiens
aggggcttggga

SEQ ID NO: 3980491 - DNA, 14 bp, Homo sapiens
aggggctttctctt

SEQ ID NO: 3980492 - DNA, 16 bp, Homo sapiens
aggggctttctcttcc

SEQ ID NO: 3980493 - DNA, 23 bp, Homo sapiens
aggggctttctcttccccttcct

SEQ ID NO: 3980494 - DNA, 18 bp, Homo sapiens
agggggacggggctcagc

SEQ ID NO: 3980495 - DNA, 22 bp, Homo sapiens
agggggagccccttctgctcag

SEQ ID NO: 3980496 - DNA, 22 bp, Homo sapiens
agggggagggggttacaaactg

SEQ ID NO: 3980497 - DNA, 13 bp, Homo sapiens
agggggccccgcc

SEQ ID NO: 3980498 - DNA, 18 bp, Homo sapiens
agggggccccgccagggc

SEQ ID NO: 3980499 - DNA, 12 bp, Homo sapiens
agggggctggcc

SEQ ID NO: 3980500 - DNA, 16 bp, Homo sapiens
agggggctggccatgg

SEQ ID NO: 3980501 - DNA, 21 bp, Homo sapiens
agggggctggccatggggccc

SEQ ID NO: 3980502 - DNA, 18 bp, Homo sapiens
agggggctttctggggcc

SEQ ID NO: 3980503 - DNA, 14 bp, Homo sapiens
agggggttacaaac

SEQ ID NO: 3980504 - DNA, 19 bp, Homo sapiens
agggggttacaaactgcaa

SEQ ID NO: 3980505 - DNA, 21 bp, Homo sapiens
agggggttcttattttgcatt

SEQ ID NO: 3980506 - DNA, 16 bp, Homo sapiens
aggggtagggagcctc

SEQ ID NO: 3980507 - DNA, 23 bp, Homo sapiens
aggggtatgttccctcttgtccc

SEQ ID NO: 3980508 - DNA, 13 bp, Homo sapiens
aggggtcaggctc

SEQ ID NO: 3980509 - DNA, 16 bp, Homo sapiens
aggggtcaggctccat

SEQ ID NO: 3980510 - DNA, 15 bp, Homo sapiens
aggggtcccccctca

SEQ ID NO: 3980511 - DNA, 17 bp, Homo sapiens
aggggtctccctggagt

SEQ ID NO: 3980512 - DNA, 16 bp, Homo sapiens
aggggtctccctggct

SEQ ID NO: 3980513 - DNA, 17 bp, Homo sapiens
aggggtctccctggctc

SEQ ID NO: 3980514 - DNA, 19 bp, Homo sapiens
aggggtctccctggctccc

SEQ ID NO: 3980515 - DNA, 16 bp, Homo sapiens
aggggtgacggccctc

SEQ ID NO: 3980516 - DNA, 17 bp, Homo sapiens
aggggtgatttcagaga

SEQ ID NO: 3980517 - DNA, 19 bp, Homo sapiens
aggggtgggcctgtgaatc

SEQ ID NO: 3980518 - DNA, 15 bp, Homo sapiens
aggggtggtcctgac

SEQ ID NO: 3980519 - DNA, 14 bp, Homo sapiens
aggggttcctcaaa

SEQ ID NO: 3980520 - DNA, 18 bp, Homo sapiens
aggggttggggtgacagt

SEQ ID NO: 3980521 - DNA, 21 bp, Homo sapiens
aggggttggggtgacagtcat

SEQ ID NO: 3980522 - DNA, 11 bp, Homo sapiens
agggtaaatca

SEQ ID NO: 3980523 - DNA, 23 bp, Homo sapiens
agggtaaatcagtaagaggtgtt

SEQ ID NO: 3980524 - DNA, 14 bp, Homo sapiens
agggtacagctggg

SEQ ID NO: 3980525 - DNA, 18 bp, Homo sapiens
agggtacatttataattg

SEQ ID NO: 3980526 - DNA, 20 bp, Homo sapiens
agggtaccctttggggagca

SEQ ID NO: 3980527 - DNA, 13 bp, Homo sapiens
agggtactaaatt

SEQ ID NO: 3980528 - DNA, 19 bp, Homo sapiens
agggtactaaggaatcttt

SEQ ID NO: 3980529 - DNA, 22 bp, Homo sapiens
agggtatccaagttggactggg

SEQ ID NO: 3980530 - DNA, 23 bp, Homo sapiens
agggtcaaagacagaatggtgga

SEQ ID NO: 3980531 - DNA, 20 bp, Homo sapiens
agggtcaacatcttttacat

SEQ ID NO: 3980532 - DNA, 16 bp, Homo sapiens
agggtcctggctcctg

SEQ ID NO: 3980533 - DNA, 19 bp, Homo sapiens
agggtcctggctcctgagg

SEQ ID NO: 3980534 - DNA, 17 bp, Homo sapiens
agggtctcgctgtcact

SEQ ID NO: 3980535 - DNA, 14 bp, Homo sapiens
agggtctgctcttt

SEQ ID NO: 3980536 - DNA, 13 bp, Homo sapiens
agggtctgtgtga

SEQ ID NO: 3980537 - DNA, 18 bp, Homo sapiens
agggtctgtgtgaatgtg

SEQ ID NO: 3980538 - DNA, 15 bp, Homo sapiens
agggtcttttttcat

SEQ ID NO: 3980539 - DNA, 12 bp, Homo sapiens
agggtgagccca

SEQ ID NO: 3980540 - DNA, 18 bp, Homo sapiens
agggtgagtcctccagaa

SEQ ID NO: 3980541 - DNA, 21 bp, Homo sapiens
agggtgagtcctccagaactc

SEQ ID NO: 3980542 - DNA, 22 bp, Homo sapiens
agggtgatgcattaattaatgg

SEQ ID NO: 3980543 - DNA, 23 bp, Homo sapiens
agggtgattttatgatcagtgtt

SEQ ID NO: 3980544 - DNA, 20 bp, Homo sapiens
agggtgcagtatcatgccct

SEQ ID NO: 3980545 - DNA, 17 bp, Homo sapiens
agggtgccctttggggt

SEQ ID NO: 3980546 - DNA, 12 bp, Homo sapiens
agggtggagact

SEQ ID NO: 3980547 - DNA, 21 bp, Homo sapiens
agggtggagactaagccctgt

SEQ ID NO: 3980548 - DNA, 14 bp, Homo sapiens
agggtggcccttgc

SEQ ID NO: 3980549 - DNA, 17 bp, Homo sapiens
agggtgggcttcctgcc

SEQ ID NO: 3980550 - DNA, 11 bp, Homo sapiens
agggtgggggg

SEQ ID NO: 3980551 - DNA, 12 bp, Homo sapiens
agggtggggggt

SEQ ID NO: 3980552 - DNA, 17 bp, Homo sapiens
agggtgggtgctcagaa

SEQ ID NO: 3980553 - DNA, 18 bp, Homo sapiens
agggtgggtgctcagaat

SEQ ID NO: 3980554 - DNA, 21 bp, Homo sapiens
agggtgtctgccccctcctga

SEQ ID NO: 3980555 - DNA, 14 bp, Homo sapiens
agggtgtttatgta

SEQ ID NO: 3980556 - DNA, 14 bp, Homo sapiens
agtccttaaaaatc

SEQ ID NO: 3980557 - DNA, 13 bp, Homo sapiens
agtcctttgtgaa

SEQ ID NO: 3980558 - DNA, 22 bp, Homo sapiens
agtcgcagaccagagctgtctg

SEQ ID NO: 3980559 - DNA, 22 bp, Homo sapiens
agtcgcctgcctgcagcaggca

SEQ ID NO: 3980560 - DNA, 15 bp, Homo sapiens
agtcggaacagcaga

SEQ ID NO: 3980561 - DNA, 18 bp, Homo sapiens
agtcgggatgtcagcaga

SEQ ID NO: 3980562 - DNA, 14 bp, Homo sapiens
agtctaaacaaaat

SEQ ID NO: 3980563 - DNA, 18 bp, Homo sapiens
agtctaagatgattcaaa

SEQ ID NO: 3980564 - DNA, 19 bp, Homo sapiens
agtctcaaaaatacaaaat

SEQ ID NO: 3980565 - DNA, 20 bp, Homo sapiens
agtctcacccattatctgga

SEQ ID NO: 3980566 - DNA, 19 bp, Homo sapiens
agtctcactttgtcgccca

SEQ ID NO: 3980567 - DNA, 19 bp, Homo sapiens
agtctcagaaactcccctg

SEQ ID NO: 3980568 - DNA, 20 bp, Homo sapiens
agtctcagaaactcccctgg

SEQ ID NO: 3980569 - DNA, 20 bp, Homo sapiens
agtctcagtttgtgtgtctt

SEQ ID NO: 3980570 - DNA, 13 bp, Homo sapiens
agtctcccaggcc

SEQ ID NO: 3980571 - DNA, 13 bp, Homo sapiens
agtctccctctga

SEQ ID NO: 3980572 - DNA, 17 bp, Homo sapiens
agtctccctttcccttc

SEQ ID NO: 3980573 - DNA, 18 bp, Homo sapiens
agtctcctttgcactgag

SEQ ID NO: 3980574 - DNA, 17 bp, Homo sapiens
agtctctctgtgaatac

SEQ ID NO: 3980575 - DNA, 18 bp, Homo sapiens
agtctctctgtgaataca

SEQ ID NO: 3980576 - DNA, 20 bp, Homo sapiens
agtctctctgtgaatacaat

SEQ ID NO: 3980577 - DNA, 23 bp, Homo sapiens
agtctctcttaaagttggaattt

SEQ ID NO: 3980578 - DNA, 16 bp, Homo sapiens
agtctctgccacccac

SEQ ID NO: 3980579 - DNA, 17 bp, Homo sapiens
agtctctgccacccact

SEQ ID NO: 3980580 - DNA, 16 bp, Homo sapiens
agtctctgctggccca

SEQ ID NO: 3980581 - DNA, 21 bp, Homo sapiens
agtctcttctccactggatgg

SEQ ID NO: 3980582 - DNA, 23 bp, Homo sapiens
agtctctttaatcttcagtttta

SEQ ID NO: 3980583 - DNA, 14 bp, Homo sapiens
agtctgaaactggc

SEQ ID NO: 3980584 - DNA, 15 bp, Homo sapiens
agtctgataaactga

SEQ ID NO: 3980585 - DNA, 11 bp, Homo sapiens
agtctggactt

SEQ ID NO: 3980586 - DNA, 23 bp, Homo sapiens
agtctggactttgcttcccctcc

SEQ ID NO: 3980587 - DNA, 13 bp, Homo sapiens
agtctggagtggg

SEQ ID NO: 3980588 - DNA, 16 bp, Homo sapiens
agtctggagtgggcag

SEQ ID NO: 3980589 - DNA, 13 bp, Homo sapiens
agtctgtcctgtg

SEQ ID NO: 3980590 - DNA, 20 bp, Homo sapiens
agtcttaacaaaccaacatc

SEQ ID NO: 3980591 - DNA, 22 bp, Homo sapiens
agtcttaacaaaccaacatctt

SEQ ID NO: 3980592 - DNA, 14 bp, Homo sapiens
agtcttagatgtat

SEQ ID NO: 3980593 - DNA, 23 bp, Homo sapiens
agtcttagatgtatatatttcct

SEQ ID NO: 3980594 - DNA, 16 bp, Homo sapiens
agtcttatgcttccag

SEQ ID NO: 3980595 - DNA, 18 bp, Homo sapiens
agtcttatgcttccagaa

SEQ ID NO: 3980596 - DNA, 19 bp, Homo sapiens
agtcttcacttgcactggg

SEQ ID NO: 3980597 - DNA, 18 bp, Homo sapiens
agtcttctcatagcatta

SEQ ID NO: 3980598 - DNA, 20 bp, Homo sapiens
agtcttctcatagcattaac

SEQ ID NO: 3980599 - DNA, 14 bp, Homo sapiens
agtctttgccttct

SEQ ID NO: 3980600 - DNA, 13 bp, Homo sapiens
agtcttttctgtc

SEQ ID NO: 3980601 - DNA, 22 bp, Homo sapiens
agtcttttgttcgcatggtcac

SEQ ID NO: 3980602 - DNA, 14 bp, Homo sapiens
agtgaaaagatttt

SEQ ID NO: 3980603 - DNA, 18 bp, Homo sapiens
agtgaaacatcatagaaa

SEQ ID NO: 3980604 - DNA, 21 bp, Homo sapiens
agtgaaataaattctgattct

SEQ ID NO: 3980605 - DNA, 22 bp, Homo sapiens
agtgaaataaattctgattctt

SEQ ID NO: 3980606 - DNA, 12 bp, Homo sapiens
agtgaaataaca

SEQ ID NO: 3980607 - DNA, 16 bp, Homo sapiens
agggagtgctggctca

SEQ ID NO: 3980608 - DNA, 20 bp, Homo sapiens
agggagtgctggctcacagt

SEQ ID NO: 3980609 - DNA, 23 bp, Homo sapiens
agggagtgctggctcacagtaca

SEQ ID NO: 3980610 - DNA, 14 bp, Homo sapiens
agggatacactgaa

SEQ ID NO: 3980611 - DNA, 22 bp, Homo sapiens
agggatcaaccagctaagaaaa

SEQ ID NO: 3980612 - DNA, 22 bp, Homo sapiens
agggatgctgctccgcccgctc

SEQ ID NO: 3980613 - DNA, 13 bp, Homo sapiens
agggatgctgggc

SEQ ID NO: 3980614 - DNA, 22 bp, Homo sapiens
agggatggaaaaggaagactag

SEQ ID NO: 3980615 - DNA, 18 bp, Homo sapiens
agggattcacatctgcat

SEQ ID NO: 3980616 - DNA, 14 bp, Homo sapiens
agggattcaggctg

SEQ ID NO: 3980617 - DNA, 15 bp, Homo sapiens
agggattcaggctgc

SEQ ID NO: 3980618 - DNA, 22 bp, Homo sapiens
agggattcctaatcactcagag

SEQ ID NO: 3980619 - DNA, 20 bp, Homo sapiens
agggattctgggcttggggt

SEQ ID NO: 3980620 - DNA, 20 bp, Homo sapiens
agggattggaccgagctgga

SEQ ID NO: 3980621 - DNA, 16 bp, Homo sapiens
agggatttccctgcag

SEQ ID NO: 3980622 - DNA, 13 bp, Homo sapiens
agggcaaatctgc

SEQ ID NO: 3980623 - DNA, 20 bp, Homo sapiens
agggcaagggttaaggcctg

SEQ ID NO: 3980624 - DNA, 19 bp, Homo sapiens
agggcaagtggatgggaat

SEQ ID NO: 3980625 - DNA, 21 bp, Homo sapiens
agggcaagtggatgggaattt

SEQ ID NO: 3980626 - DNA, 22 bp, Homo sapiens
agggcaagtggatgggaatttg

SEQ ID NO: 3980627 - DNA, 20 bp, Homo sapiens
agggcacaagtcctggatgt

SEQ ID NO: 3980628 - DNA, 18 bp, Homo sapiens
agggcacagccctccgac

SEQ ID NO: 3980629 - DNA, 21 bp, Homo sapiens
agggcaccctagttctacctc

SEQ ID NO: 3980630 - DNA, 21 bp, Homo sapiens
agggcaccctgtggccctggc

SEQ ID NO: 3980631 - DNA, 16 bp, Homo sapiens
agggcacgcaggacca

SEQ ID NO: 3980632 - DNA, 16 bp, Homo sapiens
agggcactgggctgtt

SEQ ID NO: 3980633 - DNA, 18 bp, Homo sapiens
agggcactgggctgttgt

SEQ ID NO: 3980634 - DNA, 12 bp, Homo sapiens
agggcagcccca

SEQ ID NO: 3980635 - DNA, 16 bp, Homo sapiens
agggcaggaaggagag

SEQ ID NO: 3980636 - DNA, 20 bp, Homo sapiens
agggcaggatggcctttcct

SEQ ID NO: 3980637 - DNA, 22 bp, Homo sapiens
agggcagggaccacaccctgta

SEQ ID NO: 3980638 - DNA, 13 bp, Homo sapiens
agggcagggcatc

SEQ ID NO: 3980639 - DNA, 15 bp, Homo sapiens
agggcagggctctga

SEQ ID NO: 3980640 - DNA, 20 bp, Homo sapiens
agggcagtcattggctgtct

SEQ ID NO: 3980641 - DNA, 19 bp, Homo sapiens
agggcagtgcaaggaggga

SEQ ID NO: 3980642 - DNA, 16 bp, Homo sapiens
agggcatctcctgtgc

SEQ ID NO: 3980643 - DNA, 21 bp, Homo sapiens
agggcatctcctgtgcatggg

SEQ ID NO: 3980644 - DNA, 13 bp, Homo sapiens
agtacctccaagc

SEQ ID NO: 3980645 - DNA, 17 bp, Homo sapiens
agtaccttgaactctta

SEQ ID NO: 3980646 - DNA, 23 bp, Homo sapiens
agtaccttgaactcttagtgatt

SEQ ID NO: 3980647 - DNA, 12 bp, Homo sapiens
agtaccttgctt

SEQ ID NO: 3980648 - DNA, 16 bp, Homo sapiens
agtacgtcctgcctgg

SEQ ID NO: 3980649 - DNA, 18 bp, Homo sapiens
agtacgtgctaacaggct

SEQ ID NO: 3980650 - DNA, 20 bp, Homo sapiens
agtactagatgcatcactgg

SEQ ID NO: 3980651 - DNA, 12 bp, Homo sapiens
agtacttaacat

SEQ ID NO: 3980652 - DNA, 20 bp, Homo sapiens
agtacttgagtgtaatgttt

SEQ ID NO: 3980653 - DNA, 20 bp, Homo sapiens
agtacttttattaatatttg

SEQ ID NO: 3980654 - DNA, 19 bp, Homo sapiens
agtagaaataatatgcatt

SEQ ID NO: 3980655 - DNA, 17 bp, Homo sapiens
agtagaaattttacaat

SEQ ID NO: 3980656 - DNA, 11 bp, Homo sapiens
agtagaactgt

SEQ ID NO: 3980657 - DNA, 20 bp, Homo sapiens
agtagaagatttgatgctgg

SEQ ID NO: 3980658 - DNA, 15 bp, Homo sapiens
agtagaagcatgttt

SEQ ID NO: 3980659 - DNA, 17 bp, Homo sapiens
agtagaagcatgtttgt

SEQ ID NO: 3980660 - DNA, 19 bp, Homo sapiens
agtagaagtcttagatgta

SEQ ID NO: 3980661 - DNA, 21 bp, Homo sapiens
agtagaagtcttagatgtata

SEQ ID NO: 3980662 - DNA, 14 bp, Homo sapiens
agtagaattgcatt

SEQ ID NO: 3980663 - DNA, 14 bp, Homo sapiens
agtagagtcatctc

SEQ ID NO: 3980664 - DNA, 20 bp, Homo sapiens
agtagcaaatgagacagcag

SEQ ID NO: 3980665 - DNA, 22 bp, Homo sapiens
agtagcaagttctagagaagag

SEQ ID NO: 3980666 - DNA, 18 bp, Homo sapiens
agtagcaccctggattga

SEQ ID NO: 3980667 - DNA, 20 bp, Homo sapiens
agtagcatgttgagccaggc

SEQ ID NO: 3980668 - DNA, 15 bp, Homo sapiens
agtagctctcctgac

SEQ ID NO: 3980669 - DNA, 14 bp, Homo sapiens
agtagcttgctccc

SEQ ID NO: 3980670 - DNA, 17 bp, Homo sapiens
agtagcttgctccctgt

SEQ ID NO: 3980671 - DNA, 21 bp, Homo sapiens
agtaggaatgtacatgaagca

SEQ ID NO: 3980672 - DNA, 22 bp, Homo sapiens
agtaggacaaggtgcaggcagg

SEQ ID NO: 3980673 - DNA, 21 bp, Homo sapiens
agtaggcggcgatttttgtat

SEQ ID NO: 3980674 - DNA, 20 bp, Homo sapiens
agtaggtcgttttaaaaaca

SEQ ID NO: 3980675 - DNA, 16 bp, Homo sapiens
agtagtccttggcata

SEQ ID NO: 3980676 - DNA, 18 bp, Homo sapiens
agtagtgaagactccaga

SEQ ID NO: 3980677 - DNA, 14 bp, Homo sapiens
agtagttcctgcta

SEQ ID NO: 3980678 - DNA, 13 bp, Homo sapiens
agtataaaaacaa

SEQ ID NO: 3980679 - DNA, 19 bp, Homo sapiens
agtataaacaaagttacta

SEQ ID NO: 3980680 - DNA, 13 bp, Homo sapiens
agtataagaaatg

SEQ ID NO: 3980681 - DNA, 18 bp, Homo sapiens
agtataagaaatgcatat

SEQ ID NO: 3980682 - DNA, 18 bp, Homo sapiens
agtataattttttgtaat

SEQ ID NO: 3980683 - DNA, 23 bp, Homo sapiens
agtatacttttcccctgttaaac

SEQ ID NO: 3980684 - DNA, 18 bp, Homo sapiens
agtatattttcttttcct

SEQ ID NO: 3980685 - DNA, 21 bp, Homo sapiens
agtatcagtgttttaaattct

SEQ ID NO: 3980686 - DNA, 19 bp, Homo sapiens
agtatcatgccctgtgcaa

SEQ ID NO: 3980687 - DNA, 13 bp, Homo sapiens
agtatccttcctt

SEQ ID NO: 3980688 - DNA, 21 bp, Homo sapiens
agtatctcatcaacaaagaaa

SEQ ID NO: 3980689 - DNA, 15 bp, Homo sapiens
agtatcttctatttt

SEQ ID NO: 3980690 - DNA, 19 bp, Homo sapiens
agtattaatactacccata

SEQ ID NO: 3980691 - DNA, 12 bp, Homo sapiens
agtattatgcat

SEQ ID NO: 3980692 - DNA, 14 bp, Homo sapiens
agtattcattctgc

SEQ ID NO: 3980693 - DNA, 22 bp, Homo sapiens
agtattcctttatacacagtgg

SEQ ID NO: 3980694 - DNA, 12 bp, Homo sapiens
agtattgctgat

SEQ ID NO: 3980695 - DNA, 12 bp, Homo sapiens
agtatttatata

SEQ ID NO: 3980696 - DNA, 13 bp, Homo sapiens
agtatttatatat

SEQ ID NO: 3980697 - DNA, 16 bp, Homo sapiens
agtatttatatattta

SEQ ID NO: 3980698 - DNA, 16 bp, Homo sapiens
agtatttattttgtaa

SEQ ID NO: 3980699 - DNA, 18 bp, Homo sapiens
agtatttattttgtaatt

SEQ ID NO: 3980700 - DNA, 13 bp, Homo sapiens
agtatttcattgc

SEQ ID NO: 3980701 - DNA, 15 bp, Homo sapiens
agtatttctcaggaa

SEQ ID NO: 3980702 - DNA, 17 bp, Homo sapiens
agtatttgaattaaaac

SEQ ID NO: 3980703 - DNA, 19 bp, Homo sapiens
agtatttggtccaaaaaaa

SEQ ID NO: 3980704 - DNA, 14 bp, Homo sapiens
agtattttaatcct

SEQ ID NO: 3980705 - DNA, 15 bp, Homo sapiens
agtattttgaagttt

SEQ ID NO: 3980706 - DNA, 22 bp, Homo sapiens
agtattttgaagtttacatttt

SEQ ID NO: 3980707 - DNA, 23 bp, Homo sapiens
agtattttgaagtttacattttt

SEQ ID NO: 3980708 - DNA, 18 bp, Homo sapiens
agtattttggttcttagt

SEQ ID NO: 3980709 - DNA, 19 bp, Homo sapiens
agtattttttcaagttgta

SEQ ID NO: 3980710 - DNA, 14 bp, Homo sapiens
agtcaaaataattc

SEQ ID NO: 3980711 - DNA, 14 bp, Homo sapiens
agtcaaattaataa

SEQ ID NO: 3980712 - DNA, 15 bp, Homo sapiens
agtcaagaagaaaaa

SEQ ID NO: 3980713 - DNA, 17 bp, Homo sapiens
agtcaatatttttagat

SEQ ID NO: 3980714 - DNA, 16 bp, Homo sapiens
agtcaatcatttctca

SEQ ID NO: 3980715 - DNA, 22 bp, Homo sapiens
agtcaatcatttctcactgtgt

SEQ ID NO: 3980716 - DNA, 13 bp, Homo sapiens
agtcacacagcta

SEQ ID NO: 3980717 - DNA, 16 bp, Homo sapiens
agtcacacccactccc

SEQ ID NO: 3980718 - DNA, 13 bp, Homo sapiens
agtcacagccacc

SEQ ID NO: 3980719 - DNA, 15 bp, Homo sapiens
agtcacatcacagga

SEQ ID NO: 3980720 - DNA, 16 bp, Homo sapiens
agtcaccaggacttgg

SEQ ID NO: 3980721 - DNA, 16 bp, Homo sapiens
agtcacctgctccaga

SEQ ID NO: 3980722 - DNA, 18 bp, Homo sapiens
agtcacctgctccagaag

SEQ ID NO: 3980723 - DNA, 21 bp, Homo sapiens
agtcacctgctccagaagatg

SEQ ID NO: 3980724 - DNA, 19 bp, Homo sapiens
agtcaccttttctgtggct

SEQ ID NO: 3980725 - DNA, 20 bp, Homo sapiens
agtcaccttttctgtggctg

SEQ ID NO: 3980726 - DNA, 23 bp, Homo sapiens
agtcacgctggggctctctgaga

SEQ ID NO: 3980727 - DNA, 16 bp, Homo sapiens
agtcactaatatagta

SEQ ID NO: 3980728 - DNA, 21 bp, Homo sapiens
agtcactatgggatgagaaaa

SEQ ID NO: 3980729 - DNA, 22 bp, Homo sapiens
agtcactatgggatgagaaaat

SEQ ID NO: 3980730 - DNA, 21 bp, Homo sapiens
agtcactggaggttgaagcca

SEQ ID NO: 3980731 - DNA, 17 bp, Homo sapiens
agtcagaaaactttaaa

SEQ ID NO: 3980732 - DNA, 11 bp, Homo sapiens
agtcagagccc

SEQ ID NO: 3980733 - DNA, 18 bp, Homo sapiens
agtcagagtccagtgctc

SEQ ID NO: 3980734 - DNA, 11 bp, Homo sapiens
agtcagatgag

SEQ ID NO: 3980735 - DNA, 20 bp, Homo sapiens
agtcagatgagcaaggacat

SEQ ID NO: 3980736 - DNA, 22 bp, Homo sapiens
agtcagcatgcttcccagaggg

SEQ ID NO: 3980737 - DNA, 14 bp, Homo sapiens
agtcagccagtggc

SEQ ID NO: 3980738 - DNA, 15 bp, Homo sapiens
agtcagccagtggct

SEQ ID NO: 3980739 - DNA, 18 bp, Homo sapiens
agtcagctctctgccctg

SEQ ID NO: 3980740 - DNA, 13 bp, Homo sapiens
agtcaggtgctca

SEQ ID NO: 3980741 - DNA, 14 bp, Homo sapiens
agtcaggtgctcaa

SEQ ID NO: 3980742 - DNA, 22 bp, Homo sapiens
agtcatcatcagggcctggggc

SEQ ID NO: 3980743 - DNA, 18 bp, Homo sapiens
agtcatctacttaataaa

SEQ ID NO: 3980744 - DNA, 19 bp, Homo sapiens
agtcatctacttaataaat

SEQ ID NO: 3980745 - DNA, 18 bp, Homo sapiens
agtcatctccatcagctg

SEQ ID NO: 3980746 - DNA, 14 bp, Homo sapiens
agtcatgaagccca

SEQ ID NO: 3980747 - DNA, 17 bp, Homo sapiens
aggtgtcatttccatta

SEQ ID NO: 3980748 - DNA, 14 bp, Homo sapiens
aggtgtctggcctg

SEQ ID NO: 3980749 - DNA, 14 bp, Homo sapiens
aggtgtgagactgg

SEQ ID NO: 3980750 - DNA, 14 bp, Homo sapiens
aggtgtgcctggcc

SEQ ID NO: 3980751 - DNA, 22 bp, Homo sapiens
aggtgttgccaaatatgtcctg

SEQ ID NO: 3980752 - DNA, 15 bp, Homo sapiens
aggtgttgtgcattt

SEQ ID NO: 3980753 - DNA, 16 bp, Homo sapiens
aggtgttgtgcatttg

SEQ ID NO: 3980754 - DNA, 17 bp, Homo sapiens
aggtgttgtgcatttgt

SEQ ID NO: 3980755 - DNA, 22 bp, Homo sapiens
aggtgttttttatgaagtgcgt

SEQ ID NO: 3980756 - DNA, 23 bp, Homo sapiens
aggtgttttttatgaagtgcgtg

SEQ ID NO: 3980757 - DNA, 17 bp, Homo sapiens
aggttaatttttccttc

SEQ ID NO: 3980758 - DNA, 14 bp, Homo sapiens
aggttataattttt

SEQ ID NO: 3980759 - DNA, 20 bp, Homo sapiens
aggttataattttttttaaa

SEQ ID NO: 3980760 - DNA, 14 bp, Homo sapiens
aggttataggtcac

SEQ ID NO: 3980761 - DNA, 19 bp, Homo sapiens
aggttataggtcactcctg

SEQ ID NO: 3980762 - DNA, 17 bp, Homo sapiens
aggttatcgaaataaca

SEQ ID NO: 3980763 - DNA, 14 bp, Homo sapiens
aggttatttaaaat

SEQ ID NO: 3980764 - DNA, 20 bp, Homo sapiens
aggttcactgagctccccag

SEQ ID NO: 3980765 - DNA, 21 bp, Homo sapiens
aggttcatgccaccatggcca

SEQ ID NO: 3980766 - DNA, 14 bp, Homo sapiens
aggttcccctgtca

SEQ ID NO: 3980767 - DNA, 19 bp, Homo sapiens
aggttccctgttcttcctc

SEQ ID NO: 3980768 - DNA, 13 bp, Homo sapiens
aggttcctctgcc

SEQ ID NO: 3980769 - DNA, 15 bp, Homo sapiens
aggttcctctgcctg

SEQ ID NO: 3980770 - DNA, 20 bp, Homo sapiens
aggttcctctgcctgccccg

SEQ ID NO: 3980771 - DNA, 15 bp, Homo sapiens
aggttctcagagcca

SEQ ID NO: 3980772 - DNA, 17 bp, Homo sapiens
aggttctgagaccagtg

SEQ ID NO: 3980773 - DNA, 12 bp, Homo sapiens
aggttctgccct

SEQ ID NO: 3980774 - DNA, 17 bp, Homo sapiens
aggttcttagtgtcact

SEQ ID NO: 3980775 - DNA, 13 bp, Homo sapiens
aggttctttgtgt

SEQ ID NO: 3980776 - DNA, 12 bp, Homo sapiens
aggttgaaagac

SEQ ID NO: 3980777 - DNA, 17 bp, Homo sapiens
aggttgaactttgccaa

SEQ ID NO: 3980778 - DNA, 19 bp, Homo sapiens
aggttgaactttgccaaaa

SEQ ID NO: 3980779 - DNA, 20 bp, Homo sapiens
aggttgaagacctaaccagg

SEQ ID NO: 3980780 - DNA, 16 bp, Homo sapiens
aggttgcagtgagctg

SEQ ID NO: 3980781 - DNA, 16 bp, Homo sapiens
aggttgctgtttcaca

SEQ ID NO: 3980782 - DNA, 16 bp, Homo sapiens
aggttggcaccccagc

SEQ ID NO: 3980783 - DNA, 16 bp, Homo sapiens
aggttggggtgtacta

SEQ ID NO: 3980784 - DNA, 19 bp, Homo sapiens
aggttggggtgtactagtt

SEQ ID NO: 3980785 - DNA, 14 bp, Homo sapiens
aggttgtctccagg

SEQ ID NO: 3980786 - DNA, 16 bp, Homo sapiens
aggttgtctgaagtca

SEQ ID NO: 3980787 - DNA, 21 bp, Homo sapiens
aggtttggatgggagtgagac

SEQ ID NO: 3980788 - DNA, 16 bp, Homo sapiens
aggtttggctcctgcc

SEQ ID NO: 3980789 - DNA, 16 bp, Homo sapiens
aggtttggtgtgtgga

SEQ ID NO: 3980790 - DNA, 13 bp, Homo sapiens
aggtttgtatatt

SEQ ID NO: 3980791 - DNA, 17 bp, Homo sapiens
aggtttgtcatcagatg

SEQ ID NO: 3980792 - DNA, 22 bp, Homo sapiens
aggttttcccctcttttgttaa

SEQ ID NO: 3980793 - DNA, 13 bp, Homo sapiens
aggttttgtattt

SEQ ID NO: 3980794 - DNA, 22 bp, Homo sapiens
aggttttgtattttttaaaaca

SEQ ID NO: 3980795 - DNA, 23 bp, Homo sapiens
aggtttttaaacactaaaatata

SEQ ID NO: 3980796 - DNA, 15 bp, Homo sapiens
agtaaacctgtctga

SEQ ID NO: 3980797 - DNA, 14 bp, Homo sapiens
agtaaactatttat

SEQ ID NO: 3980798 - DNA, 16 bp, Homo sapiens
agtaaactatttatct

SEQ ID NO: 3980799 - DNA, 14 bp, Homo sapiens
agtaaagctaaaat

SEQ ID NO: 3980800 - DNA, 17 bp, Homo sapiens
agtaaatacaagactgt

SEQ ID NO: 3980801 - DNA, 20 bp, Homo sapiens
agtaaatacaagactgttgt

SEQ ID NO: 3980802 - DNA, 18 bp, Homo sapiens
agtaaatattgaggcttt

SEQ ID NO: 3980803 - DNA, 14 bp, Homo sapiens
agtaaatctcttct

SEQ ID NO: 3980804 - DNA, 18 bp, Homo sapiens
agtaaatctcttctgtgt

SEQ ID NO: 3980805 - DNA, 11 bp, Homo sapiens
agtaaatgcta

SEQ ID NO: 3980806 - DNA, 17 bp, Homo sapiens
agtaaatgggagggcat

SEQ ID NO: 3980807 - DNA, 12 bp, Homo sapiens
agtaaatgtctt

SEQ ID NO: 3980808 - DNA, 13 bp, Homo sapiens
agtaaattatgta

SEQ ID NO: 3980809 - DNA, 14 bp, Homo sapiens
agtaaattgctctg

SEQ ID NO: 3980810 - DNA, 15 bp, Homo sapiens
agtaaattgctctgt

SEQ ID NO: 3980811 - DNA, 19 bp, Homo sapiens
agtaacaatacaaatggat

SEQ ID NO: 3980812 - DNA, 17 bp, Homo sapiens
agtaacatgaggggaca

SEQ ID NO: 3980813 - DNA, 16 bp, Homo sapiens
agtaacgcgtcttcct

SEQ ID NO: 3980814 - DNA, 19 bp, Homo sapiens
agtaacgcgtcttcctgag

SEQ ID NO: 3980815 - DNA, 15 bp, Homo sapiens
agtaactattattat

SEQ ID NO: 3980816 - DNA, 12 bp, Homo sapiens
agtaactcattt

SEQ ID NO: 3980817 - DNA, 22 bp, Homo sapiens
agtaactcatttgttaaaatta

SEQ ID NO: 3980818 - DNA, 11 bp, Homo sapiens
agtaactgttt

SEQ ID NO: 3980819 - DNA, 23 bp, Homo sapiens
agtaactgttttttaagtctctc

SEQ ID NO: 3980820 - DNA, 17 bp, Homo sapiens
agtaacttcttatggaa

SEQ ID NO: 3980821 - DNA, 22 bp, Homo sapiens
agtaactttactctgtgtttaa

SEQ ID NO: 3980822 - DNA, 20 bp, Homo sapiens
agtaagaaagtgaagcaaat

SEQ ID NO: 3980823 - DNA, 15 bp, Homo sapiens
agtaagaagacatga

SEQ ID NO: 3980824 - DNA, 12 bp, Homo sapiens
agtaagagctgg

SEQ ID NO: 3980825 - DNA, 21 bp, Homo sapiens
agtaagcggctcaagcccagg

SEQ ID NO: 3980826 - DNA, 22 bp, Homo sapiens
agtaagcggctcaagcccagga

SEQ ID NO: 3980827 - DNA, 14 bp, Homo sapiens
agtaaggcatgtta

SEQ ID NO: 3980828 - DNA, 14 bp, Homo sapiens
agtaagtttcccct

SEQ ID NO: 3980829 - DNA, 14 bp, Homo sapiens
agtaatagagcaaa

SEQ ID NO: 3980830 - DNA, 22 bp, Homo sapiens
agtaatatattctgaagcaaca

SEQ ID NO: 3980831 - DNA, 15 bp, Homo sapiens
agtaatcaatacaga

SEQ ID NO: 3980832 - DNA, 19 bp, Homo sapiens
agtaatctaatatggccac

SEQ ID NO: 3980833 - DNA, 22 bp, Homo sapiens
agtaatctaggtgtggctgtga

SEQ ID NO: 3980834 - DNA, 21 bp, Homo sapiens
agtaatgaatttttatgatat

SEQ ID NO: 3980835 - DNA, 15 bp, Homo sapiens
agtaattcaagaaaa

SEQ ID NO: 3980836 - DNA, 15 bp, Homo sapiens
agtaattgtgaaaaa

SEQ ID NO: 3980837 - DNA, 16 bp, Homo sapiens
agtaattgtgaaaaag

SEQ ID NO: 3980838 - DNA, 23 bp, Homo sapiens
agtacaaatgccttaaaatggaa

SEQ ID NO: 3980839 - DNA, 17 bp, Homo sapiens
agtacaaattataaaaa

SEQ ID NO: 3980840 - DNA, 16 bp, Homo sapiens
agtacacaataagcaa

SEQ ID NO: 3980841 - DNA, 14 bp, Homo sapiens
agtacactctgctg

SEQ ID NO: 3980842 - DNA, 17 bp, Homo sapiens
agtacactctgctgttt

SEQ ID NO: 3980843 - DNA, 22 bp, Homo sapiens
agtacagcggctcccctctgct

SEQ ID NO: 3980844 - DNA, 13 bp, Homo sapiens
agtacatttaata

SEQ ID NO: 3980845 - DNA, 15 bp, Homo sapiens
agtaccactcttggt

SEQ ID NO: 3980846 - DNA, 23 bp, Homo sapiens
agtaccaggggctgggctccctg

SEQ ID NO: 3980847 - DNA, 21 bp, Homo sapiens
agtaccatttatacaaattag

SEQ ID NO: 3980848 - DNA, 19 bp, Homo sapiens
agtaccctccattgggcac

SEQ ID NO: 3980849 - DNA, 21 bp, Homo sapiens
agtaccctccattgggcacag

SEQ ID NO: 3980850 - DNA, 23 bp, Homo sapiens
agtacctataaagtaaagctaaa

SEQ ID NO: 3980851 - DNA, 23 bp, Homo sapiens
aggtagtttggatatttttgtac

SEQ ID NO: 3980852 - DNA, 11 bp, Homo sapiens
aggtataattt

SEQ ID NO: 3980853 - DNA, 15 bp, Homo sapiens
aggtataattttatg

SEQ ID NO: 3980854 - DNA, 21 bp, Homo sapiens
aggtatgcaatcaaatctgct

SEQ ID NO: 3980855 - DNA, 22 bp, Homo sapiens
aggtatggaagggtttgtggct

SEQ ID NO: 3980856 - DNA, 13 bp, Homo sapiens
aggtatggctctg

SEQ ID NO: 3980857 - DNA, 17 bp, Homo sapiens
aggtatttcgaaactgc

SEQ ID NO: 3980858 - DNA, 18 bp, Homo sapiens
aggtatttcgaaactgcc

SEQ ID NO: 3980859 - DNA, 12 bp, Homo sapiens
aggtatttgaaa

SEQ ID NO: 3980860 - DNA, 22 bp, Homo sapiens
aggtcaataaggtcaagggaaa

SEQ ID NO: 3980861 - DNA, 22 bp, Homo sapiens
aggtcacacgaccggggccagc

SEQ ID NO: 3980862 - DNA, 23 bp, Homo sapiens
aggtcacacgaccggggccagca

SEQ ID NO: 3980863 - DNA, 18 bp, Homo sapiens
aggtcacattcaggaaga

SEQ ID NO: 3980864 - DNA, 19 bp, Homo sapiens
aggtcacattcaggaagat

SEQ ID NO: 3980865 - DNA, 21 bp, Homo sapiens
aggtcactcttcctgcaagga

SEQ ID NO: 3980866 - DNA, 23 bp, Homo sapiens
aggtcagatggaggttctcagag

SEQ ID NO: 3980867 - DNA, 14 bp, Homo sapiens
aggtcagccaggct

SEQ ID NO: 3980868 - DNA, 17 bp, Homo sapiens
aggtcaggacggctcct

SEQ ID NO: 3980869 - DNA, 15 bp, Homo sapiens
aggtcagggacttgg

SEQ ID NO: 3980870 - DNA, 21 bp, Homo sapiens
aggtcattaaggccacatcca

SEQ ID NO: 3980871 - DNA, 14 bp, Homo sapiens
aggtcatttcttca

SEQ ID NO: 3980872 - DNA, 14 bp, Homo sapiens
aggtccaaatgttt

SEQ ID NO: 3980873 - DNA, 16 bp, Homo sapiens
aggtccaatttgtaaa

SEQ ID NO: 3980874 - DNA, 20 bp, Homo sapiens
aggtccactccctgctccac

SEQ ID NO: 3980875 - DNA, 18 bp, Homo sapiens
aggtcccacgtctggcca

SEQ ID NO: 3980876 - DNA, 14 bp, Homo sapiens
aggtcccctccaca

SEQ ID NO: 3980877 - DNA, 20 bp, Homo sapiens
aggtcctctgatacccagag

SEQ ID NO: 3980878 - DNA, 14 bp, Homo sapiens
aggtcctctgtcag

SEQ ID NO: 3980879 - DNA, 15 bp, Homo sapiens
aggtcctgcccatgt

SEQ ID NO: 3980880 - DNA, 12 bp, Homo sapiens
aggtcctgccct

SEQ ID NO: 3980881 - DNA, 13 bp, Homo sapiens
aggtcctgccctc

SEQ ID NO: 3980882 - DNA, 16 bp, Homo sapiens
aggtccttctgctgga

SEQ ID NO: 3980883 - DNA, 21 bp, Homo sapiens
aggtctattggccaacaatcc

SEQ ID NO: 3980884 - DNA, 17 bp, Homo sapiens
aggtctcccacgtggga

SEQ ID NO: 3980885 - DNA, 15 bp, Homo sapiens
aggtctcctcagggt

SEQ ID NO: 3980886 - DNA, 19 bp, Homo sapiens
aggtctcctcagggtgggg

SEQ ID NO: 3980887 - DNA, 16 bp, Homo sapiens
aggtctcttgagggag

SEQ ID NO: 3980888 - DNA, 15 bp, Homo sapiens
aggtctgaaatggag

SEQ ID NO: 3980889 - DNA, 21 bp, Homo sapiens
aggtctgaaatggaggtcctt

SEQ ID NO: 3980890 - DNA, 20 bp, Homo sapiens
aggtctgtttaaagtggcaa

SEQ ID NO: 3980891 - DNA, 18 bp, Homo sapiens
aggtcttacattgcctga

SEQ ID NO: 3980892 - DNA, 15 bp, Homo sapiens
aggtcttgactcatg

SEQ ID NO: 3980893 - DNA, 18 bp, Homo sapiens
aggtcttgactcatggca

SEQ ID NO: 3980894 - DNA, 20 bp, Homo sapiens
aggtcttgactcatggcagc

SEQ ID NO: 3980895 - DNA, 19 bp, Homo sapiens
aggtcttttgacatgtgga

SEQ ID NO: 3980896 - DNA, 21 bp, Homo sapiens
aggtcttttgacatgtggaaa

SEQ ID NO: 3980897 - DNA, 14 bp, Homo sapiens
aggtgaaagggagc

SEQ ID NO: 3980898 - DNA, 13 bp, Homo sapiens
aggtgaaggaggc

SEQ ID NO: 3980899 - DNA, 21 bp, Homo sapiens
aggtgaaggaggctccaggca

SEQ ID NO: 3980900 - DNA, 23 bp, Homo sapiens
aggtgaaggaggctccaggcagc

SEQ ID NO: 3980901 - DNA, 23 bp, Homo sapiens
aggtgaattaattaaacattgtg

SEQ ID NO: 3980902 - DNA, 14 bp, Homo sapiens
aggtgacatgtgaa

SEQ ID NO: 3980903 - DNA, 16 bp, Homo sapiens
aggtgacatgtgaaac

SEQ ID NO: 3980904 - DNA, 20 bp, Homo sapiens
aggtgacatgtgaaaccttt

SEQ ID NO: 3980905 - DNA, 20 bp, Homo sapiens
aggtgaccttgcaacttcat

SEQ ID NO: 3980906 - DNA, 14 bp, Homo sapiens
aggtgagaaaaaaa

SEQ ID NO: 3980907 - DNA, 19 bp, Homo sapiens
aggtgagagtgggagggag

SEQ ID NO: 3980908 - DNA, 15 bp, Homo sapiens
aggtgagatggccag

SEQ ID NO: 3980909 - DNA, 13 bp, Homo sapiens
aggtgagggatgt

SEQ ID NO: 3980910 - DNA, 13 bp, Homo sapiens
aggtgaggggggc

SEQ ID NO: 3980911 - DNA, 17 bp, Homo sapiens
aggtgaggtctgttcct

SEQ ID NO: 3980912 - DNA, 21 bp, Homo sapiens
aggtgagtttgagctgccttc

SEQ ID NO: 3980913 - DNA, 16 bp, Homo sapiens
aggtgatatatttaaa

SEQ ID NO: 3980914 - DNA, 20 bp, Homo sapiens
aggtgatggaggtatttgaa

SEQ ID NO: 3980915 - DNA, 20 bp, Homo sapiens
aggtgatttttttattattt

SEQ ID NO: 3980916 - DNA, 22 bp, Homo sapiens
aggtgcaacaaggtcctctgtc

SEQ ID NO: 3980917 - DNA, 15 bp, Homo sapiens
aggtgcaggcaggct

SEQ ID NO: 3980918 - DNA, 20 bp, Homo sapiens
aggtgcatgcatgccctctc

SEQ ID NO: 3980919 - DNA, 19 bp, Homo sapiens
aggtgccagggcccacccc

SEQ ID NO: 3980920 - DNA, 12 bp, Homo sapiens
aggtgcctcaga

SEQ ID NO: 3980921 - DNA, 13 bp, Homo sapiens
aggtgcctcagac

SEQ ID NO: 3980922 - DNA, 14 bp, Homo sapiens
aggtgcctcagact

SEQ ID NO: 3980923 - DNA, 21 bp, Homo sapiens
aggtgcctcagactccgccct

SEQ ID NO: 3980924 - DNA, 17 bp, Homo sapiens
aggtgcctgtcccaccc

SEQ ID NO: 3980925 - DNA, 18 bp, Homo sapiens
aggtgcctgtcccacccc

SEQ ID NO: 3980926 - DNA, 22 bp, Homo sapiens
aggtgcgcgccaccgtgcctgg

SEQ ID NO: 3980927 - DNA, 17 bp, Homo sapiens
aggtgctcccctgacag

SEQ ID NO: 3980928 - DNA, 14 bp, Homo sapiens
aggtgctgtccatg

SEQ ID NO: 3980929 - DNA, 23 bp, Homo sapiens
aggtggaccttttaaagtgtttc

SEQ ID NO: 3980930 - DNA, 20 bp, Homo sapiens
aggtggagattgcagtgagc

SEQ ID NO: 3980931 - DNA, 15 bp, Homo sapiens
aggtggagggcacag

SEQ ID NO: 3980932 - DNA, 13 bp, Homo sapiens
aggtggcctttgt

SEQ ID NO: 3980933 - DNA, 14 bp, Homo sapiens
aggtggcctttgtg

SEQ ID NO: 3980934 - DNA, 15 bp, Homo sapiens
aggtggctctccagt

SEQ ID NO: 3980935 - DNA, 19 bp, Homo sapiens
aggtggctctccagttagt

SEQ ID NO: 3980936 - DNA, 23 bp, Homo sapiens
aggtgggaaatggtatgagctga

SEQ ID NO: 3980937 - DNA, 16 bp, Homo sapiens
aggtgggatcctccct

SEQ ID NO: 3980938 - DNA, 17 bp, Homo sapiens
aggtgggcatgccaccc

SEQ ID NO: 3980939 - DNA, 15 bp, Homo sapiens
aggtgggccttgcta

SEQ ID NO: 3980940 - DNA, 21 bp, Homo sapiens
aggtgggccttgctacctcaa

SEQ ID NO: 3980941 - DNA, 18 bp, Homo sapiens
aggtgggcttcagtaagt

SEQ ID NO: 3980942 - DNA, 18 bp, Homo sapiens
aggtggggactgggcaca

SEQ ID NO: 3980943 - DNA, 17 bp, Homo sapiens
aggtggggcgaggcagg

SEQ ID NO: 3980944 - DNA, 22 bp, Homo sapiens
aggtggggtatttaccacagca

SEQ ID NO: 3980945 - DNA, 16 bp, Homo sapiens
aggtgggtgtgggtgg

SEQ ID NO: 3980946 - DNA, 20 bp, Homo sapiens
aggtggtatgtaatttatgc

SEQ ID NO: 3980947 - DNA, 19 bp, Homo sapiens
aggtggtcctgagacctga

SEQ ID NO: 3980948 - DNA, 15 bp, Homo sapiens
aggtggtctgaatgt

SEQ ID NO: 3980949 - DNA, 16 bp, Homo sapiens
aggtggtctgaatgtt

SEQ ID NO: 3980950 - DNA, 22 bp, Homo sapiens
aggtggtctgaatgttctgaca

SEQ ID NO: 3980951 - DNA, 18 bp, Homo sapiens
aggtggtgggcattctct

SEQ ID NO: 3980952 - DNA, 21 bp, Homo sapiens
aggtggtgggcattctctctc

SEQ ID NO: 3980953 - DNA, 16 bp, Homo sapiens
aggtggtgtgatctta

SEQ ID NO: 3980954 - DNA, 20 bp, Homo sapiens
agcttggggaacccatgagt

SEQ ID NO: 3980955 - DNA, 16 bp, Homo sapiens
agcttggggagaggga

SEQ ID NO: 3980956 - DNA, 18 bp, Homo sapiens
agcttgggtttttgttac

SEQ ID NO: 3980957 - DNA, 18 bp, Homo sapiens
agcttgtaataaatactg

SEQ ID NO: 3980958 - DNA, 18 bp, Homo sapiens
agcttgtgctcctcttga

SEQ ID NO: 3980959 - DNA, 16 bp, Homo sapiens
agcttgttctgggctc

SEQ ID NO: 3980960 - DNA, 15 bp, Homo sapiens
agctttaaaaagaaa

SEQ ID NO: 3980961 - DNA, 17 bp, Homo sapiens
agctttacaacttccat

SEQ ID NO: 3980962 - DNA, 13 bp, Homo sapiens
agctttagaccct

SEQ ID NO: 3980963 - DNA, 16 bp, Homo sapiens
agctttagaccctggg

SEQ ID NO: 3980964 - DNA, 17 bp, Homo sapiens
agctttagaccctgggt

SEQ ID NO: 3980965 - DNA, 19 bp, Homo sapiens
agctttagaccctgggtgg

SEQ ID NO: 3980966 - DNA, 14 bp, Homo sapiens
agctttcctgcccc

SEQ ID NO: 3980967 - DNA, 15 bp, Homo sapiens
agctttcctgcccca

SEQ ID NO: 3980968 - DNA, 20 bp, Homo sapiens
agctttcctgccccaggcct

SEQ ID NO: 3980969 - DNA, 22 bp, Homo sapiens
agctttctagaagtttcccttc

SEQ ID NO: 3980970 - DNA, 20 bp, Homo sapiens
agctttctgtccttttggca

SEQ ID NO: 3980971 - DNA, 17 bp, Homo sapiens
agctttcttctacaacc

SEQ ID NO: 3980972 - DNA, 16 bp, Homo sapiens
agctttcttgctccct

SEQ ID NO: 3980973 - DNA, 21 bp, Homo sapiens
agctttgggatcccaccctgg

SEQ ID NO: 3980974 - DNA, 22 bp, Homo sapiens
agcttttgccagtattatgcat

SEQ ID NO: 3980975 - DNA, 16 bp, Homo sapiens
agcttttggggaggga

SEQ ID NO: 3980976 - DNA, 15 bp, Homo sapiens
agctttttaattgtt

SEQ ID NO: 3980977 - DNA, 20 bp, Homo sapiens
aggaaaaacaaaacaaagaa

SEQ ID NO: 3980978 - DNA, 17 bp, Homo sapiens
aggaaaaacacaagcaa

SEQ ID NO: 3980979 - DNA, 14 bp, Homo sapiens
aggaaaaacaggtc

SEQ ID NO: 3980980 - DNA, 22 bp, Homo sapiens
aggaaaaagcaagttcgtctgt

SEQ ID NO: 3980981 - DNA, 16 bp, Homo sapiens
aggaaaagtacattta

SEQ ID NO: 3980982 - DNA, 16 bp, Homo sapiens
aggaaaccgcctagtt

SEQ ID NO: 3980983 - DNA, 20 bp, Homo sapiens
aggaaaccgcctagtttact

SEQ ID NO: 3980984 - DNA, 22 bp, Homo sapiens
aggaaaccgcctagtttactgt

SEQ ID NO: 3980985 - DNA, 22 bp, Homo sapiens
aggaaactcttatctcagtcat

SEQ ID NO: 3980986 - DNA, 21 bp, Homo sapiens
aggaaacttcagttgatcttc

SEQ ID NO: 3980987 - DNA, 18 bp, Homo sapiens
aggaaagagcagtcagag

SEQ ID NO: 3980988 - DNA, 19 bp, Homo sapiens
aggaaagcaataaatgaat

SEQ ID NO: 3980989 - DNA, 20 bp, Homo sapiens
aggaaagccccagcactaac

SEQ ID NO: 3980990 - DNA, 16 bp, Homo sapiens
aggaaagcctcactga

SEQ ID NO: 3980991 - DNA, 22 bp, Homo sapiens
aggaaagggaggagtggaggtg

SEQ ID NO: 3980992 - DNA, 13 bp, Homo sapiens
aggaaagggctgg

SEQ ID NO: 3980993 - DNA, 17 bp, Homo sapiens
aggaaagggctggctcc

SEQ ID NO: 3980994 - DNA, 22 bp, Homo sapiens
aggaaagggctggctccccctc

SEQ ID NO: 3980995 - DNA, 21 bp, Homo sapiens
aggaaagtttacccatgaaga

SEQ ID NO: 3980996 - DNA, 20 bp, Homo sapiens
aggaaatatatatgtgtgtg

SEQ ID NO: 3980997 - DNA, 11 bp, Homo sapiens
aggaaatccat

SEQ ID NO: 3980998 - DNA, 14 bp, Homo sapiens
aggaaatctcaccc

SEQ ID NO: 3980999 - DNA, 13 bp, Homo sapiens
aggaacagaagga

SEQ ID NO: 3981000 - DNA, 14 bp, Homo sapiens
aggaacagaaggat

SEQ ID NO: 3981001 - DNA, 21 bp, Homo sapiens
aggaacagaaggatgaatgag

SEQ ID NO: 3981002 - DNA, 15 bp, Homo sapiens
aggaacagcagtgtt

SEQ ID NO: 3981003 - DNA, 19 bp, Homo sapiens
aggaacatggagctgtcat

SEQ ID NO: 3981004 - DNA, 23 bp, Homo sapiens
aggaaccatagttgacagttcca

SEQ ID NO: 3981005 - DNA, 17 bp, Homo sapiens
aggaacccccaccagac

SEQ ID NO: 3981006 - DNA, 12 bp, Homo sapiens
aggaacctggga

SEQ ID NO: 3981007 - DNA, 13 bp, Homo sapiens
aggaacctgtcct

SEQ ID NO: 3981008 - DNA, 20 bp, Homo sapiens
aggaactcgcacctgtgctg

SEQ ID NO: 3981009 - DNA, 23 bp, Homo sapiens
aggaactggggctttgccttgca

SEQ ID NO: 3981010 - DNA, 16 bp, Homo sapiens
aggaactgtccagaga

SEQ ID NO: 3981011 - DNA, 13 bp, Homo sapiens
aggaacttcagag

SEQ ID NO: 3981012 - DNA, 22 bp, Homo sapiens
aggaagatatacatgaaaattt

SEQ ID NO: 3981013 - DNA, 15 bp, Homo sapiens
aggaagatgaaagag

SEQ ID NO: 3981014 - DNA, 18 bp, Homo sapiens
aggaagcattcagagagc

SEQ ID NO: 3981015 - DNA, 19 bp, Homo sapiens
aggaagcattcagagagca

SEQ ID NO: 3981016 - DNA, 16 bp, Homo sapiens
aggaagccaaatttat

SEQ ID NO: 3981017 - DNA, 16 bp, Homo sapiens
aggaagccagctggct

SEQ ID NO: 3981018 - DNA, 19 bp, Homo sapiens
aggaagcctgcagtcctgg

SEQ ID NO: 3981019 - DNA, 20 bp, Homo sapiens
aggaagcctgcagtcctgga

SEQ ID NO: 3981020 - DNA, 18 bp, Homo sapiens
aggaaggattgtaaaaaa

SEQ ID NO: 3981021 - DNA, 19 bp, Homo sapiens
aggaaggggggttgcagtg

SEQ ID NO: 3981022 - DNA, 14 bp, Homo sapiens
aggaaggtagaaat

SEQ ID NO: 3981023 - DNA, 16 bp, Homo sapiens
aggaagtgtaacagct

SEQ ID NO: 3981024 - DNA, 17 bp, Homo sapiens
aggaagtgtaacagctg

SEQ ID NO: 3981025 - DNA, 21 bp, Homo sapiens
aggaagtgttgaagggaggtg

SEQ ID NO: 3981026 - DNA, 23 bp, Homo sapiens
aggaagttgacttatagtacatg

SEQ ID NO: 3981027 - DNA, 19 bp, Homo sapiens
aggagcctagcggagccca

SEQ ID NO: 3981028 - DNA, 19 bp, Homo sapiens
aggagccttttgctctctg

SEQ ID NO: 3981029 - DNA, 19 bp, Homo sapiens
aggagctcaggtggggagt

SEQ ID NO: 3981030 - DNA, 19 bp, Homo sapiens
aggagctcttcaggcctcc

SEQ ID NO: 3981031 - DNA, 19 bp, Homo sapiens
aggagctgatggcagctgg

SEQ ID NO: 3981032 - DNA, 12 bp, Homo sapiens
aggagctgctgg

SEQ ID NO: 3981033 - DNA, 19 bp, Homo sapiens
aggagcttcttgtttcctt

SEQ ID NO: 3981034 - DNA, 15 bp, Homo sapiens
aggagcttttctgga

SEQ ID NO: 3981035 - DNA, 14 bp, Homo sapiens
aggaggaaggcaag

SEQ ID NO: 3981036 - DNA, 22 bp, Homo sapiens
aggaggaatgctggactggagg

SEQ ID NO: 3981037 - DNA, 21 bp, Homo sapiens
aggaggatgtccctgggccag

SEQ ID NO: 3981038 - DNA, 21 bp, Homo sapiens
aggaggattgcttgagcccag

SEQ ID NO: 3981039 - DNA, 16 bp, Homo sapiens
aggaggcagccccctc

SEQ ID NO: 3981040 - DNA, 13 bp, Homo sapiens
aggaggccaataa

SEQ ID NO: 3981041 - DNA, 22 bp, Homo sapiens
aggaggccaataaaaagttcag

SEQ ID NO: 3981042 - DNA, 14 bp, Homo sapiens
aggaggccagtggg

SEQ ID NO: 3981043 - DNA, 12 bp, Homo sapiens
aggaggcctcca

SEQ ID NO: 3981044 - DNA, 21 bp, Homo sapiens
aggaggccttgggctctgctg

SEQ ID NO: 3981045 - DNA, 15 bp, Homo sapiens
aggaggcggcccggc

SEQ ID NO: 3981046 - DNA, 23 bp, Homo sapiens
aggaggcggcccggccagcgggc

SEQ ID NO: 3981047 - DNA, 18 bp, Homo sapiens
aggaggctccaggcagca

SEQ ID NO: 3981048 - DNA, 21 bp, Homo sapiens
aggaggctggaggaagggggg

SEQ ID NO: 3981049 - DNA, 21 bp, Homo sapiens
aggaggctgggacgctctgct

SEQ ID NO: 3981050 - DNA, 16 bp, Homo sapiens
aggagggagacactgg

SEQ ID NO: 3981051 - DNA, 12 bp, Homo sapiens
aggagggagagg

SEQ ID NO: 3981052 - DNA, 21 bp, Homo sapiens
aggagggatgctgctccgccc

SEQ ID NO: 3981053 - DNA, 14 bp, Homo sapiens
aggagggcagaggg

SEQ ID NO: 3981054 - DNA, 22 bp, Homo sapiens
aggagggcagagggagaatcca

SEQ ID NO: 3981055 - DNA, 20 bp, Homo sapiens
aggagggccctacctgattg

SEQ ID NO: 3981056 - DNA, 19 bp, Homo sapiens
aggaggggagagacaggca

SEQ ID NO: 3981057 - DNA, 21 bp, Homo sapiens
aggaggggagagacaggcagc

SEQ ID NO: 3981058 - DNA, 11 bp, Homo sapiens
agcgccttggt

SEQ ID NO: 3981059 - DNA, 15 bp, Homo sapiens
agcgcggccagcgtc

SEQ ID NO: 3981060 - DNA, 19 bp, Homo sapiens
agcgctggtcccctccctc

SEQ ID NO: 3981061 - DNA, 16 bp, Homo sapiens
agcgctttctggaaaa

SEQ ID NO: 3981062 - DNA, 17 bp, Homo sapiens
agcgctttctggaaaag

SEQ ID NO: 3981063 - DNA, 15 bp, Homo sapiens
agcggaaaagttgtc

SEQ ID NO: 3981064 - DNA, 22 bp, Homo sapiens
agcggaacaaggagtcagacat

SEQ ID NO: 3981065 - DNA, 18 bp, Homo sapiens
agcggagcccagcctggg

SEQ ID NO: 3981066 - DNA, 15 bp, Homo sapiens
agcggaggctgtgtg

SEQ ID NO: 3981067 - DNA, 17 bp, Homo sapiens
agcggagtctgtcctgt

SEQ ID NO: 3981068 - DNA, 13 bp, Homo sapiens
agcggatttccag

SEQ ID NO: 3981069 - DNA, 14 bp, Homo sapiens
agcggctacaaagc

SEQ ID NO: 3981070 - DNA, 17 bp, Homo sapiens
agcggctcaagcccagg

SEQ ID NO: 3981071 - DNA, 14 bp, Homo sapiens
agcggctcccctct

SEQ ID NO: 3981072 - DNA, 15 bp, Homo sapiens
agcggctcccctctg

SEQ ID NO: 3981073 - DNA, 15 bp, Homo sapiens
agcggctgttccccc

SEQ ID NO: 3981074 - DNA, 11 bp, Homo sapiens
agcgggagccc

SEQ ID NO: 3981075 - DNA, 12 bp, Homo sapiens
agcgggaggcag

SEQ ID NO: 3981076 - DNA, 11 bp, Homo sapiens
agcgggcacag

SEQ ID NO: 3981077 - DNA, 15 bp, Homo sapiens
agcgggcacagggca

SEQ ID NO: 3981078 - DNA, 12 bp, Homo sapiens
agcgggccaggc

SEQ ID NO: 3981079 - DNA, 13 bp, Homo sapiens
agcgggccaggcc

SEQ ID NO: 3981080 - DNA, 21 bp, Homo sapiens
agcgggctaacgggaggctgg

SEQ ID NO: 3981081 - DNA, 13 bp, Homo sapiens
agcggggctgctc

SEQ ID NO: 3981082 - DNA, 14 bp, Homo sapiens
agcggggggagggt

SEQ ID NO: 3981083 - DNA, 21 bp, Homo sapiens
agcggtaccaatgcagaactc

SEQ ID NO: 3981084 - DNA, 14 bp, Homo sapiens
agcggtttggggag

SEQ ID NO: 3981085 - DNA, 20 bp, Homo sapiens
agcgtagtgcagcagggcag

SEQ ID NO: 3981086 - DNA, 21 bp, Homo sapiens
agcgtcagggttggtgtgctg

SEQ ID NO: 3981087 - DNA, 15 bp, Homo sapiens
agcgtgcataagtta

SEQ ID NO: 3981088 - DNA, 23 bp, Homo sapiens
agcgtgtctgtatttatgtgtga

SEQ ID NO: 3981089 - DNA, 13 bp, Homo sapiens
agcgttcccagca

SEQ ID NO: 3981090 - DNA, 17 bp, Homo sapiens
agcgtttctttacttct

SEQ ID NO: 3981091 - DNA, 18 bp, Homo sapiens
agcgttttgttgagcatg

SEQ ID NO: 3981092 - DNA, 11 bp, Homo sapiens
agcgtttttta

SEQ ID NO: 3981093 - DNA, 18 bp, Homo sapiens
agcgttttttaaatgtat

SEQ ID NO: 3981094 - DNA, 17 bp, Homo sapiens
agctaaaccaaggactg

SEQ ID NO: 3981095 - DNA, 17 bp, Homo sapiens
agctaaacggattccaa

SEQ ID NO: 3981096 - DNA, 15 bp, Homo sapiens
agctaaagaggctga

SEQ ID NO: 3981097 - DNA, 21 bp, Homo sapiens
agctaaagaggctgaaagagg

SEQ ID NO: 3981098 - DNA, 23 bp, Homo sapiens
agctaaccagttaccacacatct

SEQ ID NO: 3981099 - DNA, 12 bp, Homo sapiens
agctaagaacct

SEQ ID NO: 3981100 - DNA, 16 bp, Homo sapiens
agctaagaacctggaa

SEQ ID NO: 3981101 - DNA, 19 bp, Homo sapiens
agctaaggacatttcccag

SEQ ID NO: 3981102 - DNA, 16 bp, Homo sapiens
agctaagggtgggtgc

SEQ ID NO: 3981103 - DNA, 19 bp, Homo sapiens
agctaagtgaaaaggtcat

SEQ ID NO: 3981104 - DNA, 12 bp, Homo sapiens
agctaataaatc

SEQ ID NO: 3981105 - DNA, 16 bp, Homo sapiens
agctaatcagcattct

SEQ ID NO: 3981106 - DNA, 19 bp, Homo sapiens
agctaatctgtagggctgg

SEQ ID NO: 3981107 - DNA, 20 bp, Homo sapiens
agctaatttatttccccagg

SEQ ID NO: 3981108 - DNA, 20 bp, Homo sapiens
agctaatttgcattaaattc

SEQ ID NO: 3981109 - DNA, 23 bp, Homo sapiens
agctacagagccgagcaatattt

SEQ ID NO: 3981110 - DNA, 22 bp, Homo sapiens
agctacaggaagcaccccatgc

SEQ ID NO: 3981111 - DNA, 13 bp, Homo sapiens
agctaccccttct

SEQ ID NO: 3981112 - DNA, 12 bp, Homo sapiens
agctacctgaga

SEQ ID NO: 3981113 - DNA, 16 bp, Homo sapiens
agctactaaaatcagt

SEQ ID NO: 3981114 - DNA, 13 bp, Homo sapiens
agctactgatgaa

SEQ ID NO: 3981115 - DNA, 16 bp, Homo sapiens
agctactgtatgcaaa

SEQ ID NO: 3981116 - DNA, 14 bp, Homo sapiens
agctacttgggagg

SEQ ID NO: 3981117 - DNA, 16 bp, Homo sapiens
agctacttgggaggct

SEQ ID NO: 3981118 - DNA, 14 bp, Homo sapiens
agctacttggtttg

SEQ ID NO: 3981119 - DNA, 15 bp, Homo sapiens
agctagaaatatgat

SEQ ID NO: 3981120 - DNA, 15 bp, Homo sapiens
agctagcttttagga

SEQ ID NO: 3981121 - DNA, 20 bp, Homo sapiens
agctagcttttaggaaaatc

SEQ ID NO: 3981122 - DNA, 21 bp, Homo sapiens
agctaggaagagcaggactcc

SEQ ID NO: 3981123 - DNA, 19 bp, Homo sapiens
agctaggcttaaacctgga

SEQ ID NO: 3981124 - DNA, 19 bp, Homo sapiens
agctagtaggaatgtacat

SEQ ID NO: 3981125 - DNA, 13 bp, Homo sapiens
agctagtatcttc

SEQ ID NO: 3981126 - DNA, 22 bp, Homo sapiens
agctagtatcttcaaactttca

SEQ ID NO: 3981127 - DNA, 21 bp, Homo sapiens
agctagtgaagaccagagcag

SEQ ID NO: 3981128 - DNA, 12 bp, Homo sapiens
agctagtgcctt

SEQ ID NO: 3981129 - DNA, 17 bp, Homo sapiens
agctagtgcctttagag

SEQ ID NO: 3981130 - DNA, 21 bp, Homo sapiens
agctagtgcctttagagggta

SEQ ID NO: 3981131 - DNA, 14 bp, Homo sapiens
agctagtgtttcta

SEQ ID NO: 3981132 - DNA, 22 bp, Homo sapiens
agctatacctgcacgttcataa

SEQ ID NO: 3981133 - DNA, 22 bp, Homo sapiens
agctatcaagtgtgctttagct

SEQ ID NO: 3981134 - DNA, 18 bp, Homo sapiens
agctatctaaagtttgtt

SEQ ID NO: 3981135 - DNA, 21 bp, Homo sapiens
agctatctgcactctaaactg

SEQ ID NO: 3981136 - DNA, 21 bp, Homo sapiens
agctatggcccagaaacaaca

SEQ ID NO: 3981137 - DNA, 17 bp, Homo sapiens
agctatgggagccccag

SEQ ID NO: 3981138 - DNA, 22 bp, Homo sapiens
agctatgggagccccagggtct

SEQ ID NO: 3981139 - DNA, 14 bp, Homo sapiens
agctattagccagg

SEQ ID NO: 3981140 - DNA, 18 bp, Homo sapiens
agctattagccaggatca

SEQ ID NO: 3981141 - DNA, 22 bp, Homo sapiens
agctattagccaggatcatggt

SEQ ID NO: 3981142 - DNA, 17 bp, Homo sapiens
agctattgccaaccagt

SEQ ID NO: 3981143 - DNA, 20 bp, Homo sapiens
agctatttccattccagaat

SEQ ID NO: 3981144 - DNA, 15 bp, Homo sapiens
agctattttcctctg

SEQ ID NO: 3981145 - DNA, 16 bp, Homo sapiens
agctcacatgggactg

SEQ ID NO: 3981146 - DNA, 19 bp, Homo sapiens
agctcacatgggactggga

SEQ ID NO: 3981147 - DNA, 18 bp, Homo sapiens
agcattacgtgagccagg

SEQ ID NO: 3981148 - DNA, 15 bp, Homo sapiens
agcattcagagagca

SEQ ID NO: 3981149 - DNA, 17 bp, Homo sapiens
agcattcagagagcagc

SEQ ID NO: 3981150 - DNA, 16 bp, Homo sapiens
agcattccttctttga

SEQ ID NO: 3981151 - DNA, 17 bp, Homo sapiens
agcattccttctttgat

SEQ ID NO: 3981152 - DNA, 22 bp, Homo sapiens
agcattccttctttgataatgt

SEQ ID NO: 3981153 - DNA, 18 bp, Homo sapiens
agcattctcactcctacc

SEQ ID NO: 3981154 - DNA, 20 bp, Homo sapiens
agcattctcactcctacctg

SEQ ID NO: 3981155 - DNA, 17 bp, Homo sapiens
agcattctccccagtgt

SEQ ID NO: 3981156 - DNA, 14 bp, Homo sapiens
agcattctggaggg

SEQ ID NO: 3981157 - DNA, 20 bp, Homo sapiens
agcattgctgttatgtctgt

SEQ ID NO: 3981158 - DNA, 23 bp, Homo sapiens
agcattgctgttatgtctgttta

SEQ ID NO: 3981159 - DNA, 11 bp, Homo sapiens
agcattgcttt

SEQ ID NO: 3981160 - DNA, 21 bp, Homo sapiens
agcattgcttttattttgaaa

SEQ ID NO: 3981161 - DNA, 23 bp, Homo sapiens
agcattgcttttattttgaaaag

SEQ ID NO: 3981162 - DNA, 22 bp, Homo sapiens
agcattgtttgcttattgttcc

SEQ ID NO: 3981163 - DNA, 14 bp, Homo sapiens
agcatttataaatt

SEQ ID NO: 3981164 - DNA, 17 bp, Homo sapiens
agcatttccaacaccac

SEQ ID NO: 3981165 - DNA, 18 bp, Homo sapiens
agcatttccaacaccaca

SEQ ID NO: 3981166 - DNA, 21 bp, Homo sapiens
agcatttccaacaccacagac

SEQ ID NO: 3981167 - DNA, 20 bp, Homo sapiens
agcatttccttccagcccat

SEQ ID NO: 3981168 - DNA, 23 bp, Homo sapiens
agcatttccttccagcccatcca

SEQ ID NO: 3981169 - DNA, 23 bp, Homo sapiens
agcattttagcaatttatacaat

SEQ ID NO: 3981170 - DNA, 12 bp, Homo sapiens
agcatttttcaa

SEQ ID NO: 3981171 - DNA, 16 bp, Homo sapiens
agcatttttcaatata

SEQ ID NO: 3981172 - DNA, 18 bp, Homo sapiens
agccaaacccatgaggca

SEQ ID NO: 3981173 - DNA, 14 bp, Homo sapiens
agccaaaccctgtc

SEQ ID NO: 3981174 - DNA, 15 bp, Homo sapiens
agccaaaccctgtct

SEQ ID NO: 3981175 - DNA, 13 bp, Homo sapiens
agccaaagaaaaa

SEQ ID NO: 3981176 - DNA, 23 bp, Homo sapiens
agccaaatgcagggaggggaggc

SEQ ID NO: 3981177 - DNA, 20 bp, Homo sapiens
agccaaatgtaattgaataa

SEQ ID NO: 3981178 - DNA, 16 bp, Homo sapiens
agccaaatttatcaaa

SEQ ID NO: 3981179 - DNA, 21 bp, Homo sapiens
agccaacaggtggcaggacca

SEQ ID NO: 3981180 - DNA, 21 bp, Homo sapiens
agccaacagtcaaaacagaga

SEQ ID NO: 3981181 - DNA, 18 bp, Homo sapiens
agccaacctcggcttgtg

SEQ ID NO: 3981182 - DNA, 20 bp, Homo sapiens
agccaacctcggcttgtggg

SEQ ID NO: 3981183 - DNA, 17 bp, Homo sapiens
agccaagcttgttatca

SEQ ID NO: 3981184 - DNA, 20 bp, Homo sapiens
agccaagggaaaggggtgct

SEQ ID NO: 3981185 - DNA, 16 bp, Homo sapiens
agccaagtcctccctc

SEQ ID NO: 3981186 - DNA, 18 bp, Homo sapiens
agccaagtgccaaatgct

SEQ ID NO: 3981187 - DNA, 14 bp, Homo sapiens
agccaatgttttcc

SEQ ID NO: 3981188 - DNA, 17 bp, Homo sapiens
agccaattcagacaggc

SEQ ID NO: 3981189 - DNA, 17 bp, Homo sapiens
agccacaaggctggcca

SEQ ID NO: 3981190 - DNA, 15 bp, Homo sapiens
agccacacccaggca

SEQ ID NO: 3981191 - DNA, 16 bp, Homo sapiens
agccacagaccacctg

SEQ ID NO: 3981192 - DNA, 18 bp, Homo sapiens
agccacagcctccccacc

SEQ ID NO: 3981193 - DNA, 17 bp, Homo sapiens
agccacaggccctggct

SEQ ID NO: 3981194 - DNA, 11 bp, Homo sapiens
agccacatccc

SEQ ID NO: 3981195 - DNA, 15 bp, Homo sapiens
agccacatttggaat

SEQ ID NO: 3981196 - DNA, 22 bp, Homo sapiens
agccacatttggaatacttttt

SEQ ID NO: 3981197 - DNA, 12 bp, Homo sapiens
agccaccagtgt

SEQ ID NO: 3981198 - DNA, 19 bp, Homo sapiens
agccaccccgggctctctg

SEQ ID NO: 3981199 - DNA, 13 bp, Homo sapiens
agccacccctgag

SEQ ID NO: 3981200 - DNA, 14 bp, Homo sapiens
agccaccgctgcca

SEQ ID NO: 3981201 - DNA, 15 bp, Homo sapiens
agccaccgtgcctgg

SEQ ID NO: 3981202 - DNA, 17 bp, Homo sapiens
agccaccgtgcctggcc

SEQ ID NO: 3981203 - DNA, 19 bp, Homo sapiens
agccaccgtgcctggccag

SEQ ID NO: 3981204 - DNA, 21 bp, Homo sapiens
agccaccgtgcctggccagat

SEQ ID NO: 3981205 - DNA, 22 bp, Homo sapiens
agccaccgtgcctggccagatt

SEQ ID NO: 3981206 - DNA, 12 bp, Homo sapiens
agccacctctcc

SEQ ID NO: 3981207 - DNA, 22 bp, Homo sapiens
agccaccttttgggaatgtttt

SEQ ID NO: 3981208 - DNA, 16 bp, Homo sapiens
agccacgattggagaa

SEQ ID NO: 3981209 - DNA, 15 bp, Homo sapiens
agccacgctgtcctc

SEQ ID NO: 3981210 - DNA, 22 bp, Homo sapiens
agccactcaggaggctgaggca

SEQ ID NO: 3981211 - DNA, 17 bp, Homo sapiens
agccactctgtcccttc

SEQ ID NO: 3981212 - DNA, 16 bp, Homo sapiens
agccagaactctgtgt

SEQ ID NO: 3981213 - DNA, 12 bp, Homo sapiens
agccagacagac

SEQ ID NO: 3981214 - DNA, 13 bp, Homo sapiens
agccagacagacc

SEQ ID NO: 3981215 - DNA, 19 bp, Homo sapiens
agccagacctagcaggctg

SEQ ID NO: 3981216 - DNA, 13 bp, Homo sapiens
agccagagctggg

SEQ ID NO: 3981217 - DNA, 14 bp, Homo sapiens
agccagagctgggt

SEQ ID NO: 3981218 - DNA, 17 bp, Homo sapiens
agccagaggagggcaga

SEQ ID NO: 3981219 - DNA, 12 bp, Homo sapiens
agccagatcctc

SEQ ID NO: 3981220 - DNA, 17 bp, Homo sapiens
agccagatcctcttggt

SEQ ID NO: 3981221 - DNA, 16 bp, Homo sapiens
agccagatgcaggaca

SEQ ID NO: 3981222 - DNA, 23 bp, Homo sapiens
agccagcaatgatgtccagaaga

SEQ ID NO: 3981223 - DNA, 18 bp, Homo sapiens
agccagcacctgtaagaa

SEQ ID NO: 3981224 - DNA, 21 bp, Homo sapiens
agccagcacttgtccagctga

SEQ ID NO: 3981225 - DNA, 18 bp, Homo sapiens
agccagcagcagcccaag

SEQ ID NO: 3981226 - DNA, 15 bp, Homo sapiens
agccagccgccctgg

SEQ ID NO: 3981227 - DNA, 21 bp, Homo sapiens
agccagccgccctgggctgtc

SEQ ID NO: 3981228 - DNA, 22 bp, Homo sapiens
agccagccgccctgggctgtct

SEQ ID NO: 3981229 - DNA, 11 bp, Homo sapiens
agccagcctga

SEQ ID NO: 3981230 - DNA, 15 bp, Homo sapiens
agccagcctgacctt

SEQ ID NO: 3981231 - DNA, 23 bp, Homo sapiens
agccagctcacagtgctgtgtgc

SEQ ID NO: 3981232 - DNA, 18 bp, Homo sapiens
agccagctgcaggaatca

SEQ ID NO: 3981233 - DNA, 15 bp, Homo sapiens
agccagctgcttttt

SEQ ID NO: 3981234 - DNA, 20 bp, Homo sapiens
agccaggaatttcccaggac

SEQ ID NO: 3981235 - DNA, 17 bp, Homo sapiens
agccaggagctgtcacc

SEQ ID NO: 3981236 - DNA, 15 bp, Homo sapiens
agccaggatcatggt

SEQ ID NO: 3981237 - DNA, 18 bp, Homo sapiens
agccaggatcatggtgta

SEQ ID NO: 3981238 - DNA, 22 bp, Homo sapiens
agccaggatcatggtgtaataa

SEQ ID NO: 3981239 - DNA, 18 bp, Homo sapiens
agccaggccaacagcacc

SEQ ID NO: 3981240 - DNA, 13 bp, Homo sapiens
agccaggcctggc

SEQ ID NO: 3981241 - DNA, 15 bp, Homo sapiens
agccaggcctggctg

SEQ ID NO: 3981242 - DNA, 21 bp, Homo sapiens
agccaggcctggctggaggag

SEQ ID NO: 3981243 - DNA, 21 bp, Homo sapiens
agccaggctgctaacctggaa

SEQ ID NO: 3981244 - DNA, 20 bp, Homo sapiens
agccagggtctctccctcag

SEQ ID NO: 3981245 - DNA, 21 bp, Homo sapiens
agccagggtctctccctcagg

SEQ ID NO: 3981246 - DNA, 18 bp, Homo sapiens
agcctcccatccagggcc

SEQ ID NO: 3981247 - DNA, 18 bp, Homo sapiens
agcctccccatctgtcca

SEQ ID NO: 3981248 - DNA, 21 bp, Homo sapiens
agcctccccatctgtccagct

SEQ ID NO: 3981249 - DNA, 22 bp, Homo sapiens
agcctccccatctgtccagctg

SEQ ID NO: 3981250 - DNA, 13 bp, Homo sapiens
agcctccccctca

SEQ ID NO: 3981251 - DNA, 15 bp, Homo sapiens
agcctccccctcaga

SEQ ID NO: 3981252 - DNA, 11 bp, Homo sapiens
agcctccctga

SEQ ID NO: 3981253 - DNA, 13 bp, Homo sapiens
agcctccctgaag

SEQ ID NO: 3981254 - DNA, 16 bp, Homo sapiens
agcctccctgaagcct

SEQ ID NO: 3981255 - DNA, 19 bp, Homo sapiens
agcctccctgtctccagct

SEQ ID NO: 3981256 - DNA, 16 bp, Homo sapiens
agatttactaaatcaa

SEQ ID NO: 3981257 - DNA, 15 bp, Homo sapiens
agatttatataaatg

SEQ ID NO: 3981258 - DNA, 18 bp, Homo sapiens
agatttcatagttcagaa

SEQ ID NO: 3981259 - DNA, 13 bp, Homo sapiens
agatttcctcctg

SEQ ID NO: 3981260 - DNA, 14 bp, Homo sapiens
agatttctggttga

SEQ ID NO: 3981261 - DNA, 22 bp, Homo sapiens
agatttcttaaataatgcttca

SEQ ID NO: 3981262 - DNA, 17 bp, Homo sapiens
agatttgaactcttcaa

SEQ ID NO: 3981263 - DNA, 16 bp, Homo sapiens
agatttgatatttgca

SEQ ID NO: 3981264 - DNA, 23 bp, Homo sapiens
agatttgtaggaaggtctcattc

SEQ ID NO: 3981265 - DNA, 19 bp, Homo sapiens
agattttaatcaagttgaa

SEQ ID NO: 3981266 - DNA, 14 bp, Homo sapiens
agattttaattttg

SEQ ID NO: 3981267 - DNA, 18 bp, Homo sapiens
agattttacaaaagatgt

SEQ ID NO: 3981268 - DNA, 14 bp, Homo sapiens
agattttcagtcta

SEQ ID NO: 3981269 - DNA, 17 bp, Homo sapiens
agattttcctcttgtga

SEQ ID NO: 3981270 - DNA, 22 bp, Homo sapiens
agattttctgggcctaaaggat

SEQ ID NO: 3981271 - DNA, 17 bp, Homo sapiens
agatttttaagaacttc

SEQ ID NO: 3981272 - DNA, 20 bp, Homo sapiens
agatttttaagaacttcatt

SEQ ID NO: 3981273 - DNA, 22 bp, Homo sapiens
agatttttctcaaagttttgaa

SEQ ID NO: 3981274 - DNA, 13 bp, Homo sapiens
agattttttattg

SEQ ID NO: 3981275 - DNA, 13 bp, Homo sapiens
agatttttttcct

SEQ ID NO: 3981276 - DNA, 18 bp, Homo sapiens
agatttttttgtgtatgt

SEQ ID NO: 3981277 - DNA, 13 bp, Homo sapiens
agattttttttaa

SEQ ID NO: 3981278 - DNA, 14 bp, Homo sapiens
agcaaaaacatgta

SEQ ID NO: 3981279 - DNA, 13 bp, Homo sapiens
agcaaaagaaaaa

SEQ ID NO: 3981280 - DNA, 14 bp, Homo sapiens
agcaaaagaaaaag

SEQ ID NO: 3981281 - DNA, 13 bp, Homo sapiens
agcaaaaggcagc

SEQ ID NO: 3981282 - DNA, 12 bp, Homo sapiens
agcaaaaggcat

SEQ ID NO: 3981283 - DNA, 21 bp, Homo sapiens
agcaaaataaggaagagggct

SEQ ID NO: 3981284 - DNA, 18 bp, Homo sapiens
agcaaaatatgccccttc

SEQ ID NO: 3981285 - DNA, 19 bp, Homo sapiens
agcaaaattgatgtgttta

SEQ ID NO: 3981286 - DNA, 23 bp, Homo sapiens
agcaaaattgatgtgtttattta

SEQ ID NO: 3981287 - DNA, 19 bp, Homo sapiens
agcaaactaacttgacttt

SEQ ID NO: 3981288 - DNA, 13 bp, Homo sapiens
agcaaacttggaa

SEQ ID NO: 3981289 - DNA, 12 bp, Homo sapiens
agcaaagatcaa

SEQ ID NO: 3981290 - DNA, 13 bp, Homo sapiens
agcaaagatcaaa

SEQ ID NO: 3981291 - DNA, 15 bp, Homo sapiens
agcaaagatcaaaat

SEQ ID NO: 3981292 - DNA, 22 bp, Homo sapiens
agcaaagcaccagcttctccag

SEQ ID NO: 3981293 - DNA, 23 bp, Homo sapiens
agcaaagctgatgacaacttccc

SEQ ID NO: 3981294 - DNA, 17 bp, Homo sapiens
agcaaaggggacagctg

SEQ ID NO: 3981295 - DNA, 16 bp, Homo sapiens
agcaaatcagaaactt

SEQ ID NO: 3981296 - DNA, 20 bp, Homo sapiens
agcaaatcagaaacttgtga

SEQ ID NO: 3981297 - DNA, 13 bp, Homo sapiens
agcaacaaagaaa

SEQ ID NO: 3981298 - DNA, 20 bp, Homo sapiens
agcaacacaagctggaagca

SEQ ID NO: 3981299 - DNA, 23 bp, Homo sapiens
agcaacattggcacatgccacct

SEQ ID NO: 3981300 - DNA, 14 bp, Homo sapiens
agcaaccccaggct

SEQ ID NO: 3981301 - DNA, 21 bp, Homo sapiens
agcaaccgcctcaaaatgtgt

SEQ ID NO: 3981302 - DNA, 14 bp, Homo sapiens
agcaacgcttgtag

SEQ ID NO: 3981303 - DNA, 14 bp, Homo sapiens
agcaactgaagaca

SEQ ID NO: 3981304 - DNA, 15 bp, Homo sapiens
agcaagacagagacg

SEQ ID NO: 3981305 - DNA, 23 bp, Homo sapiens
agcaagacagagacgcaggaatg

SEQ ID NO: 3981306 - DNA, 12 bp, Homo sapiens
agcaagactctg

SEQ ID NO: 3981307 - DNA, 13 bp, Homo sapiens
agcaagagctggc

SEQ ID NO: 3981308 - DNA, 21 bp, Homo sapiens
agcaagatcctgtctttaagg

SEQ ID NO: 3981309 - DNA, 20 bp, Homo sapiens
agcaagccctacagagctgt

SEQ ID NO: 3981310 - DNA, 13 bp, Homo sapiens
agcaagctggcct

SEQ ID NO: 3981311 - DNA, 14 bp, Homo sapiens
agcaagctggcctc

SEQ ID NO: 3981312 - DNA, 23 bp, Homo sapiens
agcaagcttttacaacagtgctg

SEQ ID NO: 3981313 - DNA, 14 bp, Homo sapiens
agcaaggacattgc

SEQ ID NO: 3981314 - DNA, 19 bp, Homo sapiens
agcaaggacattgccccaa

SEQ ID NO: 3981315 - DNA, 12 bp, Homo sapiens
agcaaggcaggt

SEQ ID NO: 3981316 - DNA, 16 bp, Homo sapiens
agcaaggcaggttgga

SEQ ID NO: 3981317 - DNA, 17 bp, Homo sapiens
agcaaggccctgctgcc

SEQ ID NO: 3981318 - DNA, 18 bp, Homo sapiens
agcaaggccctgctgccc

SEQ ID NO: 3981319 - DNA, 13 bp, Homo sapiens
agcaaggctgggt

SEQ ID NO: 3981320 - DNA, 12 bp, Homo sapiens
agcaagggagaa

SEQ ID NO: 3981321 - DNA, 16 bp, Homo sapiens
agcaagggagaaaaga

SEQ ID NO: 3981322 - DNA, 18 bp, Homo sapiens
agcaagggggtgatgtag

SEQ ID NO: 3981323 - DNA, 16 bp, Homo sapiens
agcaaggtcatttctt

SEQ ID NO: 3981324 - DNA, 20 bp, Homo sapiens
agcaaggtgggtggaaacta

SEQ ID NO: 3981325 - DNA, 21 bp, Homo sapiens
agcaaggtttaaatttgttat

SEQ ID NO: 3981326 - DNA, 18 bp, Homo sapiens
agcaagtaaaaaggctaa

SEQ ID NO: 3981327 - DNA, 20 bp, Homo sapiens
agcaagtagataaatatttg

SEQ ID NO: 3981328 - DNA, 16 bp, Homo sapiens
agcaagtcttaacaaa

SEQ ID NO: 3981329 - DNA, 17 bp, Homo sapiens
agcaagtgagagagatg

SEQ ID NO: 3981330 - DNA, 18 bp, Homo sapiens
agcaagtgagagagatgg

SEQ ID NO: 3981331 - DNA, 15 bp, Homo sapiens
agcaagttcgtctgt

SEQ ID NO: 3981332 - DNA, 17 bp, Homo sapiens
agcaagttctagagaag

SEQ ID NO: 3981333 - DNA, 20 bp, Homo sapiens
agcaagttctagagaagagg

SEQ ID NO: 3981334 - DNA, 13 bp, Homo sapiens
agcaataaatgaa

SEQ ID NO: 3981335 - DNA, 15 bp, Homo sapiens
agcaataaatgaatg

SEQ ID NO: 3981336 - DNA, 13 bp, Homo sapiens
agcaataagaaat

SEQ ID NO: 3981337 - DNA, 13 bp, Homo sapiens
agcaatatctgct

SEQ ID NO: 3981338 - DNA, 22 bp, Homo sapiens
agcaatccatgttagtttttac

SEQ ID NO: 3981339 - DNA, 23 bp, Homo sapiens
agcaatccatgttagtttttact

SEQ ID NO: 3981340 - DNA, 18 bp, Homo sapiens
agcaatcctcctgcctca

SEQ ID NO: 3981341 - DNA, 19 bp, Homo sapiens
agcaatcctcctgcctcag

SEQ ID NO: 3981342 - DNA, 23 bp, Homo sapiens
agcaatctcttcattattctctg

SEQ ID NO: 3981343 - DNA, 19 bp, Homo sapiens
agcaatgacatctcagggg

SEQ ID NO: 3981344 - DNA, 19 bp, Homo sapiens
agcaatgatgtccagaaga

SEQ ID NO: 3981345 - DNA, 23 bp, Homo sapiens
agcaatgatgtccagaagaatat

SEQ ID NO: 3981346 - DNA, 14 bp, Homo sapiens
agcaatgggactgg

SEQ ID NO: 3981347 - DNA, 16 bp, Homo sapiens
agcaatgggactggag

SEQ ID NO: 3981348 - DNA, 23 bp, Homo sapiens
agcaatggtgtcagtatccaggc

SEQ ID NO: 3981349 - DNA, 23 bp, Homo sapiens
agcaattagtctgaaactggctt

SEQ ID NO: 3981350 - DNA, 16 bp, Homo sapiens
agcaattctcctgcct

SEQ ID NO: 3981351 - DNA, 22 bp, Homo sapiens
agcaatttaactagacacagat

SEQ ID NO: 3981352 - DNA, 15 bp, Homo sapiens
agcacaaactttagg

SEQ ID NO: 3981353 - DNA, 22 bp, Homo sapiens
agcacaacccccagctcccgct

SEQ ID NO: 3981354 - DNA, 22 bp, Homo sapiens
agcacactgcacagggaaaatt

SEQ ID NO: 3981355 - DNA, 23 bp, Homo sapiens
agcacagaaggaatctgtgcaga

SEQ ID NO: 3981356 - DNA, 11 bp, Homo sapiens
agcagcctttc

SEQ ID NO: 3981357 - DNA, 22 bp, Homo sapiens
agcagcctttctctctttatac

SEQ ID NO: 3981358 - DNA, 12 bp, Homo sapiens
agcagcgggcta

SEQ ID NO: 3981359 - DNA, 23 bp, Homo sapiens
agcagcgggctaacgggaggctg

SEQ ID NO: 3981360 - DNA, 18 bp, Homo sapiens
agcagctaaattttctga

SEQ ID NO: 3981361 - DNA, 13 bp, Homo sapiens
agcagctccccag

SEQ ID NO: 3981362 - DNA, 15 bp, Homo sapiens
agcagctccccagga

SEQ ID NO: 3981363 - DNA, 12 bp, Homo sapiens
agcagcttccag

SEQ ID NO: 3981364 - DNA, 14 bp, Homo sapiens
agcagcttccagat

SEQ ID NO: 3981365 - DNA, 16 bp, Homo sapiens
agcagcttccagattg

SEQ ID NO: 3981366 - DNA, 14 bp, Homo sapiens
agcagcttggggag

SEQ ID NO: 3981367 - DNA, 16 bp, Homo sapiens
agcagctttaaacaaa

SEQ ID NO: 3981368 - DNA, 21 bp, Homo sapiens
agcaggaagcattcagagagc

SEQ ID NO: 3981369 - DNA, 21 bp, Homo sapiens
agcaggaatatatgtgtgcct

SEQ ID NO: 3981370 - DNA, 14 bp, Homo sapiens
agcaggaattatgt

SEQ ID NO: 3981371 - DNA, 13 bp, Homo sapiens
agcaggacctggc

SEQ ID NO: 3981372 - DNA, 16 bp, Homo sapiens
agcaggacctggcatc

SEQ ID NO: 3981373 - DNA, 18 bp, Homo sapiens
agcaggactccaggccca

SEQ ID NO: 3981374 - DNA, 12 bp, Homo sapiens
agcaggagacga

SEQ ID NO: 3981375 - DNA, 15 bp, Homo sapiens
agcaggagagaaatt

SEQ ID NO: 3981376 - DNA, 16 bp, Homo sapiens
agcaggaggccaataa

SEQ ID NO: 3981377 - DNA, 22 bp, Homo sapiens
agcaggaggccaataaaaagtt

SEQ ID NO: 3981378 - DNA, 10 bp, Homo sapiens
agcaggcagc

SEQ ID NO: 3981379 - DNA, 16 bp, Homo sapiens
agcaggcagcgccaag

SEQ ID NO: 3981380 - DNA, 20 bp, Homo sapiens
agcaggccggaaccacaggg

SEQ ID NO: 3981381 - DNA, 16 bp, Homo sapiens
agcagggaatttctat

SEQ ID NO: 3981382 - DNA, 17 bp, Homo sapiens
agcagggtaccctttgg

SEQ ID NO: 3981383 - DNA, 13 bp, Homo sapiens
agcaggtggtcct

SEQ ID NO: 3981384 - DNA, 17 bp, Homo sapiens
agcaggtggtcctgaga

SEQ ID NO: 3981385 - DNA, 16 bp, Homo sapiens
agcaggttcccaagct

SEQ ID NO: 3981386 - DNA, 20 bp, Homo sapiens
agcagtaaatttgctagcag

SEQ ID NO: 3981387 - DNA, 17 bp, Homo sapiens
agcagtaccagcgctct

SEQ ID NO: 3981388 - DNA, 22 bp, Homo sapiens
agcagtcctgcctcagcctccg

SEQ ID NO: 3981389 - DNA, 17 bp, Homo sapiens
agcagtctgataaactg

SEQ ID NO: 3981390 - DNA, 19 bp, Homo sapiens
agcagtctgataaactgac

SEQ ID NO: 3981391 - DNA, 19 bp, Homo sapiens
agcagtcttatgcttccag

SEQ ID NO: 3981392 - DNA, 20 bp, Homo sapiens
agcagtcttatgcttccaga

SEQ ID NO: 3981393 - DNA, 21 bp, Homo sapiens
agcagtgagaaaaagctcctg

SEQ ID NO: 3981394 - DNA, 13 bp, Homo sapiens
agcagtgagcaga

SEQ ID NO: 3981395 - DNA, 16 bp, Homo sapiens
agcagtgagtctcttc

SEQ ID NO: 3981396 - DNA, 20 bp, Homo sapiens
agcagtgatctcagggcaga

SEQ ID NO: 3981397 - DNA, 23 bp, Homo sapiens
agcagtgccaatcgggcagaagt

SEQ ID NO: 3981398 - DNA, 20 bp, Homo sapiens
agcagtgcctcttgtctgag

SEQ ID NO: 3981399 - DNA, 20 bp, Homo sapiens
agcagtgccttccataatta

SEQ ID NO: 3981400 - DNA, 17 bp, Homo sapiens
agcagtggctggtccag

SEQ ID NO: 3981401 - DNA, 22 bp, Homo sapiens
agcagtggctggtccagggcta

SEQ ID NO: 3981402 - DNA, 17 bp, Homo sapiens
agcagtgtcttccataa

SEQ ID NO: 3981403 - DNA, 22 bp, Homo sapiens
agcagtgtcttccataatgtat

SEQ ID NO: 3981404 - DNA, 17 bp, Homo sapiens
agcagtgttctcacagt

SEQ ID NO: 3981405 - DNA, 18 bp, Homo sapiens
agcagtgttctcacagtg

SEQ ID NO: 3981406 - DNA, 19 bp, Homo sapiens
agcagtgttctcacagtgt

SEQ ID NO: 3981407 - DNA, 21 bp, Homo sapiens
agcagtgttctcacagtgtgg

SEQ ID NO: 3981408 - DNA, 15 bp, Homo sapiens
agcagtgttgctcag

SEQ ID NO: 3981409 - DNA, 18 bp, Homo sapiens
agcagtgttgctcagctc

SEQ ID NO: 3981410 - DNA, 21 bp, Homo sapiens
agcagttacaaaaaccttccc

SEQ ID NO: 3981411 - DNA, 19 bp, Homo sapiens
agcagttcccctggagccc

SEQ ID NO: 3981412 - DNA, 18 bp, Homo sapiens
agcagtttcatctggttg

SEQ ID NO: 3981413 - DNA, 19 bp, Homo sapiens
agcataaataaaactgaat

SEQ ID NO: 3981414 - DNA, 19 bp, Homo sapiens
agcataacaccaatcccag

SEQ ID NO: 3981415 - DNA, 18 bp, Homo sapiens
agcataagtatacagttc

SEQ ID NO: 3981416 - DNA, 17 bp, Homo sapiens
agcataagtttctggga

SEQ ID NO: 3981417 - DNA, 20 bp, Homo sapiens
agcatacatttataatgttt

SEQ ID NO: 3981418 - DNA, 22 bp, Homo sapiens
agcatattttctctaggctttt

SEQ ID NO: 3981419 - DNA, 20 bp, Homo sapiens
agcatcactccccaaggaag

SEQ ID NO: 3981420 - DNA, 19 bp, Homo sapiens
agcatcattttgcattcaa

SEQ ID NO: 3981421 - DNA, 22 bp, Homo sapiens
agcatcattttgcattcaaatt

SEQ ID NO: 3981422 - DNA, 17 bp, Homo sapiens
agcatccaccttggctc

SEQ ID NO: 3981423 - DNA, 15 bp, Homo sapiens
agcatcccttcccac

SEQ ID NO: 3981424 - DNA, 12 bp, Homo sapiens
agcatcgggagc

SEQ ID NO: 3981425 - DNA, 19 bp, Homo sapiens
agcatcgggagcacccaga

SEQ ID NO: 3981426 - DNA, 17 bp, Homo sapiens
agcatctcttgaggcca

SEQ ID NO: 3981427 - DNA, 13 bp, Homo sapiens
agcatctgctaat

SEQ ID NO: 3981428 - DNA, 22 bp, Homo sapiens
agcatctggctgtctagaatgt

SEQ ID NO: 3981429 - DNA, 23 bp, Homo sapiens
agcatctggctgtctagaatgtg

SEQ ID NO: 3981430 - DNA, 23 bp, Homo sapiens
agcatctggctgtttagcagaac

SEQ ID NO: 3981431 - DNA, 13 bp, Homo sapiens
agcatgaaaaagc

SEQ ID NO: 3981432 - DNA, 14 bp, Homo sapiens
agcatgacagcctg

SEQ ID NO: 3981433 - DNA, 18 bp, Homo sapiens
agcatgacctgtgaccag

SEQ ID NO: 3981434 - DNA, 22 bp, Homo sapiens
agcatgacctgtgaccagcact

SEQ ID NO: 3981435 - DNA, 23 bp, Homo sapiens
agcatgacctgtgaccagcactg

SEQ ID NO: 3981436 - DNA, 19 bp, Homo sapiens
agcatgagagaattgtatc

SEQ ID NO: 3981437 - DNA, 14 bp, Homo sapiens
agcatgatgggaaa

SEQ ID NO: 3981438 - DNA, 17 bp, Homo sapiens
agcatgatgggaaaata

SEQ ID NO: 3981439 - DNA, 20 bp, Homo sapiens
agcatgatgggaaaatattt

SEQ ID NO: 3981440 - DNA, 19 bp, Homo sapiens
agcatgattctttaataga

SEQ ID NO: 3981441 - DNA, 20 bp, Homo sapiens
agcatgattctttaatagaa

SEQ ID NO: 3981442 - DNA, 15 bp, Homo sapiens
agcatgcttcccaga

SEQ ID NO: 3981443 - DNA, 20 bp, Homo sapiens
agcatgcttcccagagggag

SEQ ID NO: 3981444 - DNA, 22 bp, Homo sapiens
agcatgcttcccagagggagca

SEQ ID NO: 3981445 - DNA, 18 bp, Homo sapiens
agcatgctttctttgagt

SEQ ID NO: 3981446 - DNA, 16 bp, Homo sapiens
agcatggggtttttat

SEQ ID NO: 3981447 - DNA, 16 bp, Homo sapiens
agcatggtccctgcct

SEQ ID NO: 3981448 - DNA, 17 bp, Homo sapiens
agcatggtccctgcctt

SEQ ID NO: 3981449 - DNA, 20 bp, Homo sapiens
agcatgtacggattttcagt

SEQ ID NO: 3981450 - DNA, 21 bp, Homo sapiens
agcatgtacggattttcagtt

SEQ ID NO: 3981451 - DNA, 17 bp, Homo sapiens
agcatgtggcatgttca

SEQ ID NO: 3981452 - DNA, 13 bp, Homo sapiens
agcatgtgtcaga

SEQ ID NO: 3981453 - DNA, 15 bp, Homo sapiens
agcatgtgtcagagt

SEQ ID NO: 3981454 - DNA, 20 bp, Homo sapiens
agcatgttgagccaggcctg

SEQ ID NO: 3981455 - DNA, 14 bp, Homo sapiens
agcattaactaatc

SEQ ID NO: 3981456 - DNA, 18 bp, Homo sapiens
agcattaactaatctatt

SEQ ID NO: 3981457 - DNA, 14 bp, Homo sapiens
agcattacaggcaa

SEQ ID NO: 3981458 - DNA, 16 bp, Homo sapiens
agagtgaaaaagagaa

SEQ ID NO: 3981459 - DNA, 19 bp, Homo sapiens
agagtgactagtacaaatt

SEQ ID NO: 3981460 - DNA, 18 bp, Homo sapiens
agagtgattgcagcttta

SEQ ID NO: 3981461 - DNA, 14 bp, Homo sapiens
agagtgcacagctg

SEQ ID NO: 3981462 - DNA, 18 bp, Homo sapiens
agagtgccctgctttgca

SEQ ID NO: 3981463 - DNA, 20 bp, Homo sapiens
agagtgccctgctttgcaaa

SEQ ID NO: 3981464 - DNA, 22 bp, Homo sapiens
agagtgccctgctttgcaaaca

SEQ ID NO: 3981465 - DNA, 12 bp, Homo sapiens
agagtggcctcc

SEQ ID NO: 3981466 - DNA, 15 bp, Homo sapiens
agagtggcctccctg

SEQ ID NO: 3981467 - DNA, 11 bp, Homo sapiens
agagtggcctg

SEQ ID NO: 3981468 - DNA, 16 bp, Homo sapiens
agagtggcctggccag

SEQ ID NO: 3981469 - DNA, 17 bp, Homo sapiens
agagtggcctggccagg

SEQ ID NO: 3981470 - DNA, 19 bp, Homo sapiens
agagtggcctggccaggag

SEQ ID NO: 3981471 - DNA, 18 bp, Homo sapiens
agagtgtagactgtggct

SEQ ID NO: 3981472 - DNA, 23 bp, Homo sapiens
agatgagaggggagagctgaaca

SEQ ID NO: 3981473 - DNA, 22 bp, Homo sapiens
agatgagcaaggacattgcccc

SEQ ID NO: 3981474 - DNA, 14 bp, Homo sapiens
agatgaggggttga

SEQ ID NO: 3981475 - DNA, 14 bp, Homo sapiens
agatgataaagaga

SEQ ID NO: 3981476 - DNA, 16 bp, Homo sapiens
agatgataaagagaca

SEQ ID NO: 3981477 - DNA, 20 bp, Homo sapiens
agatgatacatccaaagcag

SEQ ID NO: 3981478 - DNA, 13 bp, Homo sapiens
agatgatcatttg

SEQ ID NO: 3981479 - DNA, 14 bp, Homo sapiens
agatgatctctcca

SEQ ID NO: 3981480 - DNA, 17 bp, Homo sapiens
agatgattcaaagtagt

SEQ ID NO: 3981481 - DNA, 16 bp, Homo sapiens
agatgcaacctcacta

SEQ ID NO: 3981482 - DNA, 17 bp, Homo sapiens
agatgcaaggaccagga

SEQ ID NO: 3981483 - DNA, 18 bp, Homo sapiens
agatgcaaggaccaggac

SEQ ID NO: 3981484 - DNA, 13 bp, Homo sapiens
agatgcaatcaga

SEQ ID NO: 3981485 - DNA, 18 bp, Homo sapiens
agatgcaatgtgctactg

SEQ ID NO: 3981486 - DNA, 14 bp, Homo sapiens
agatgcaattgttt

SEQ ID NO: 3981487 - DNA, 12 bp, Homo sapiens
agatgcactgaa

SEQ ID NO: 3981488 - DNA, 22 bp, Homo sapiens
agatgcactgaaaacttagcca

SEQ ID NO: 3981489 - DNA, 15 bp, Homo sapiens
agatgcagaaaaaga

SEQ ID NO: 3981490 - DNA, 18 bp, Homo sapiens
agatgcagagagccattt

SEQ ID NO: 3981491 - DNA, 19 bp, Homo sapiens
agatgcaggacaggaggcg

SEQ ID NO: 3981492 - DNA, 20 bp, Homo sapiens
agatgcaggttggaaggggc

SEQ ID NO: 3981493 - DNA, 17 bp, Homo sapiens
agatgccagcttctctc

SEQ ID NO: 3981494 - DNA, 21 bp, Homo sapiens
agatgccagcttctctctcca

SEQ ID NO: 3981495 - DNA, 23 bp, Homo sapiens
agatgccccattccttgcgcctc

SEQ ID NO: 3981496 - DNA, 21 bp, Homo sapiens
agatgccctttggaaagccat

SEQ ID NO: 3981497 - DNA, 16 bp, Homo sapiens
agatgccgcatttgga

SEQ ID NO: 3981498 - DNA, 22 bp, Homo sapiens
agatgcctacaaccatccctgc

SEQ ID NO: 3981499 - DNA, 16 bp, Homo sapiens
agatgctcactttatt

SEQ ID NO: 3981500 - DNA, 15 bp, Homo sapiens
agatgctgactggca

SEQ ID NO: 3981501 - DNA, 15 bp, Homo sapiens
agatgctggcccagg

SEQ ID NO: 3981502 - DNA, 17 bp, Homo sapiens
agatgctggcccagggc

SEQ ID NO: 3981503 - DNA, 22 bp, Homo sapiens
agatgctggcccagggcccaga

SEQ ID NO: 3981504 - DNA, 23 bp, Homo sapiens
agatgctggcccagggcccagag

SEQ ID NO: 3981505 - DNA, 20 bp, Homo sapiens
agatgctgtaacttaaaata

SEQ ID NO: 3981506 - DNA, 19 bp, Homo sapiens
agatgcttctctccttgcc

SEQ ID NO: 3981507 - DNA, 20 bp, Homo sapiens
agatgcttctctccttgccc

SEQ ID NO: 3981508 - DNA, 12 bp, Homo sapiens
agatgcttctgg

SEQ ID NO: 3981509 - DNA, 13 bp, Homo sapiens
agatggactggga

SEQ ID NO: 3981510 - DNA, 16 bp, Homo sapiens
agatggactgggagga

SEQ ID NO: 3981511 - DNA, 17 bp, Homo sapiens
agatggactgggaggag

SEQ ID NO: 3981512 - DNA, 22 bp, Homo sapiens
agatggactgggaggaggggga

SEQ ID NO: 3981513 - DNA, 22 bp, Homo sapiens
agatggagcccataggccaccc

SEQ ID NO: 3981514 - DNA, 16 bp, Homo sapiens
agatggagggcttggc

SEQ ID NO: 3981515 - DNA, 22 bp, Homo sapiens
agatggagggcttggcccagcg

SEQ ID NO: 3981516 - DNA, 17 bp, Homo sapiens
agatggaggttctcaga

SEQ ID NO: 3981517 - DNA, 14 bp, Homo sapiens
agatggcactttga

SEQ ID NO: 3981518 - DNA, 22 bp, Homo sapiens
agatggccagtttgaagcctgt

SEQ ID NO: 3981519 - DNA, 16 bp, Homo sapiens
agatggccataggaga

SEQ ID NO: 3981520 - DNA, 18 bp, Homo sapiens
agatggcttattttttaa

SEQ ID NO: 3981521 - DNA, 13 bp, Homo sapiens
agatgggaatgag

SEQ ID NO: 3981522 - DNA, 13 bp, Homo sapiens
agatgggagctcc

SEQ ID NO: 3981523 - DNA, 17 bp, Homo sapiens
agatggggataaaatga

SEQ ID NO: 3981524 - DNA, 20 bp, Homo sapiens
agatggggataaaatgacta

SEQ ID NO: 3981525 - DNA, 22 bp, Homo sapiens
agatgggggcagggctgtgctt

SEQ ID NO: 3981526 - DNA, 15 bp, Homo sapiens
agatgggggcctctt

SEQ ID NO: 3981527 - DNA, 18 bp, Homo sapiens
agatgggggcctctttca

SEQ ID NO: 3981528 - DNA, 13 bp, Homo sapiens
agatgggtccagg

SEQ ID NO: 3981529 - DNA, 21 bp, Homo sapiens
agatgggtctgatattaatca

SEQ ID NO: 3981530 - DNA, 19 bp, Homo sapiens
agatgggtctggctgagct

SEQ ID NO: 3981531 - DNA, 19 bp, Homo sapiens
agatggtatatttggtact

SEQ ID NO: 3981532 - DNA, 18 bp, Homo sapiens
agatggtccatttgttcc

SEQ ID NO: 3981533 - DNA, 19 bp, Homo sapiens
agatggtccatttgttcct

SEQ ID NO: 3981534 - DNA, 22 bp, Homo sapiens
agatggtgtgggtgtcctgcct

SEQ ID NO: 3981535 - DNA, 15 bp, Homo sapiens
agatgtattgactgt

SEQ ID NO: 3981536 - DNA, 16 bp, Homo sapiens
agatgtattgactgta

SEQ ID NO: 3981537 - DNA, 17 bp, Homo sapiens
agatgtattgactgtac

SEQ ID NO: 3981538 - DNA, 20 bp, Homo sapiens
agatgtcagccgagccgggc

SEQ ID NO: 3981539 - DNA, 18 bp, Homo sapiens
agatgtctaatagttatt

SEQ ID NO: 3981540 - DNA, 14 bp, Homo sapiens
agatgtctctaaaa

SEQ ID NO: 3981541 - DNA, 14 bp, Homo sapiens
agatgtcttggaac

SEQ ID NO: 3981542 - DNA, 18 bp, Homo sapiens
agatgtcttggaacattg

SEQ ID NO: 3981543 - DNA, 15 bp, Homo sapiens
agatgtctttaggca

SEQ ID NO: 3981544 - DNA, 23 bp, Homo sapiens
agatgtctttaggcagcagcttt

SEQ ID NO: 3981545 - DNA, 20 bp, Homo sapiens
agatgtgaattattgacact

SEQ ID NO: 3981546 - DNA, 14 bp, Homo sapiens
agatgtttcacacc

SEQ ID NO: 3981547 - DNA, 23 bp, Homo sapiens
agatgtttccagacttccttgag

SEQ ID NO: 3981548 - DNA, 14 bp, Homo sapiens
agatgtttgcctca

SEQ ID NO: 3981549 - DNA, 19 bp, Homo sapiens
agatgtttgtcagatatga

SEQ ID NO: 3981550 - DNA, 23 bp, Homo sapiens
agattacttaaataatttgggtg

SEQ ID NO: 3981551 - DNA, 19 bp, Homo sapiens
agattagaaaaattcctaa

SEQ ID NO: 3981552 - DNA, 18 bp, Homo sapiens
agattagagggaggtgtt

SEQ ID NO: 3981553 - DNA, 21 bp, Homo sapiens
agattagcaaggtcatttctt

SEQ ID NO: 3981554 - DNA, 15 bp, Homo sapiens
agattaggagaaaca

SEQ ID NO: 3981555 - DNA, 18 bp, Homo sapiens
agattcaggccagcccag

SEQ ID NO: 3981556 - DNA, 20 bp, Homo sapiens
agattcaggccagcccagcc

SEQ ID NO: 3981557 - DNA, 18 bp, Homo sapiens
agattccagagagtggct

SEQ ID NO: 3981558 - DNA, 12 bp, Homo sapiens
agattctgcctc

SEQ ID NO: 3981559 - DNA, 14 bp, Homo sapiens
agattctgcctctc

SEQ ID NO: 3981560 - DNA, 16 bp, Homo sapiens
agattctgcctctctg

SEQ ID NO: 3981561 - DNA, 21 bp, Homo sapiens
agattctgtgatcttttaaag

SEQ ID NO: 3981562 - DNA, 13 bp, Homo sapiens
agattcttaattc

SEQ ID NO: 3981563 - DNA, 14 bp, Homo sapiens
agattgaaaatctt

SEQ ID NO: 3981564 - DNA, 17 bp, Homo sapiens
agagcgccaggaagcca

SEQ ID NO: 3981565 - DNA, 23 bp, Homo sapiens
agagctatggacagcattgccag

SEQ ID NO: 3981566 - DNA, 18 bp, Homo sapiens
agagctatggcccagaaa

SEQ ID NO: 3981567 - DNA, 19 bp, Homo sapiens
agagctatggtgcttgctg

SEQ ID NO: 3981568 - DNA, 18 bp, Homo sapiens
agagctgagccagttgtc

SEQ ID NO: 3981569 - DNA, 15 bp, Homo sapiens
agagctgcagggtgg

SEQ ID NO: 3981570 - DNA, 13 bp, Homo sapiens
agagctgccagtg

SEQ ID NO: 3981571 - DNA, 20 bp, Homo sapiens
agagctgccctccttgtcca

SEQ ID NO: 3981572 - DNA, 21 bp, Homo sapiens
agagctgccctccttgtccac

SEQ ID NO: 3981573 - DNA, 23 bp, Homo sapiens
agagctggagcccccagcagagg

SEQ ID NO: 3981574 - DNA, 15 bp, Homo sapiens
agagctggcaaaggt

SEQ ID NO: 3981575 - DNA, 17 bp, Homo sapiens
agagctggtgtctgatt

SEQ ID NO: 3981576 - DNA, 16 bp, Homo sapiens
agagctgtctgaactc

SEQ ID NO: 3981577 - DNA, 20 bp, Homo sapiens
agagctgtggaggattgcta

SEQ ID NO: 3981578 - DNA, 20 bp, Homo sapiens
agagctgtttatggcctcag

SEQ ID NO: 3981579 - DNA, 14 bp, Homo sapiens
agagcttaaattgt

SEQ ID NO: 3981580 - DNA, 14 bp, Homo sapiens
agagcttgaagatt

SEQ ID NO: 3981581 - DNA, 20 bp, Homo sapiens
agagcttgtaataaatactg

SEQ ID NO: 3981582 - DNA, 13 bp, Homo sapiens
agagagagaaaga

SEQ ID NO: 3981583 - DNA, 14 bp, Homo sapiens
agagagagaaagag

SEQ ID NO: 3981584 - DNA, 11 bp, Homo sapiens
agagagagaga

SEQ ID NO: 3981585 - DNA, 12 bp, Homo sapiens
agagagagagaa

SEQ ID NO: 3981586 - DNA, 15 bp, Homo sapiens
agagagagagagagg

SEQ ID NO: 3981587 - DNA, 14 bp, Homo sapiens
agagagagaggaca

SEQ ID NO: 3981588 - DNA, 16 bp, Homo sapiens
agagagagaggacaga

SEQ ID NO: 3981589 - DNA, 14 bp, Homo sapiens
agagagattctcca

SEQ ID NO: 3981590 - DNA, 15 bp, Homo sapiens
agagagccattttgt

SEQ ID NO: 3981591 - DNA, 17 bp, Homo sapiens
agagagccattttgtga

SEQ ID NO: 3981592 - DNA, 16 bp, Homo sapiens
agagagcttaaattgt

SEQ ID NO: 3981593 - DNA, 13 bp, Homo sapiens
agagaggacagct

SEQ ID NO: 3981594 - DNA, 16 bp, Homo sapiens
agagaggagaaacaca

SEQ ID NO: 3981595 - DNA, 18 bp, Homo sapiens
agagaggaggcagccccc

SEQ ID NO: 3981596 - DNA, 20 bp, Homo sapiens
agagaggaggcagccccctc

SEQ ID NO: 3981597 - DNA, 17 bp, Homo sapiens
agagaggctctggggca

SEQ ID NO: 3981598 - DNA, 17 bp, Homo sapiens
agagaggtggagaactg

SEQ ID NO: 3981599 - DNA, 20 bp, Homo sapiens
agagaggttatagagtagaa

SEQ ID NO: 3981600 - DNA, 14 bp, Homo sapiens
agagagtggctcct

SEQ ID NO: 3981601 - DNA, 15 bp, Homo sapiens
agagataataagatt

SEQ ID NO: 3981602 - DNA, 21 bp, Homo sapiens
agagataattcttaaaaggga

SEQ ID NO: 3981603 - DNA, 23 bp, Homo sapiens
agagatatatctgaaaactggaa

SEQ ID NO: 3981604 - DNA, 18 bp, Homo sapiens
agagatattttaaaatga

SEQ ID NO: 3981605 - DNA, 22 bp, Homo sapiens
agagatcttcccataataaagc

SEQ ID NO: 3981606 - DNA, 15 bp, Homo sapiens
agagatgagaaatga

SEQ ID NO: 3981607 - DNA, 23 bp, Homo sapiens
agagatgctgtaacttaaaatag

SEQ ID NO: 3981608 - DNA, 19 bp, Homo sapiens
agagatgggagctcctctc

SEQ ID NO: 3981609 - DNA, 17 bp, Homo sapiens
agagatgtgcacccatg

SEQ ID NO: 3981610 - DNA, 21 bp, Homo sapiens
agagatttatataaatgtaaa

SEQ ID NO: 3981611 - DNA, 17 bp, Homo sapiens
agagcaacctctcactc

SEQ ID NO: 3981612 - DNA, 13 bp, Homo sapiens
agagcaagagagc

SEQ ID NO: 3981613 - DNA, 20 bp, Homo sapiens
agagcagaacagatctttta

SEQ ID NO: 3981614 - DNA, 20 bp, Homo sapiens
agagcagaacggagccccag

SEQ ID NO: 3981615 - DNA, 23 bp, Homo sapiens
agagcagaacggagccccaggcc

SEQ ID NO: 3981616 - DNA, 15 bp, Homo sapiens
agagcagagtctggg

SEQ ID NO: 3981617 - DNA, 12 bp, Homo sapiens
agagcagatgca

SEQ ID NO: 3981618 - DNA, 14 bp, Homo sapiens
agagcagatgcaga

SEQ ID NO: 3981619 - DNA, 19 bp, Homo sapiens
agagcagatgcagagagcc

SEQ ID NO: 3981620 - DNA, 12 bp, Homo sapiens
agagcagcaagg

SEQ ID NO: 3981621 - DNA, 19 bp, Homo sapiens
agagcagcaaggtcttgct

SEQ ID NO: 3981622 - DNA, 16 bp, Homo sapiens
agagcagcagcaccaa

SEQ ID NO: 3981623 - DNA, 12 bp, Homo sapiens
agagcagcctgt

SEQ ID NO: 3981624 - DNA, 16 bp, Homo sapiens
agagcagctccccagg

SEQ ID NO: 3981625 - DNA, 20 bp, Homo sapiens
agagcagctccccaggagct

SEQ ID NO: 3981626 - DNA, 21 bp, Homo sapiens
agagcagctccccaggagctc

SEQ ID NO: 3981627 - DNA, 20 bp, Homo sapiens
agagcagctttaaactcagg

SEQ ID NO: 3981628 - DNA, 22 bp, Homo sapiens
agagcaggactccaggcccaag

SEQ ID NO: 3981629 - DNA, 24 bp, Homo sapiens
agagcagggattaacctctgcact

SEQ ID NO: 3981630 - DNA, 22 bp, Homo sapiens
agagcattacgtgagccaggta

SEQ ID NO: 3981631 - DNA, 16 bp, Homo sapiens
agagcattccagtcag

SEQ ID NO: 3981632 - DNA, 21 bp, Homo sapiens
agagcattccagtcaggctct

SEQ ID NO: 3981633 - DNA, 17 bp, Homo sapiens
agagcattgcatggaca

SEQ ID NO: 3981634 - DNA, 16 bp, Homo sapiens
agagccaacctcggct

SEQ ID NO: 3981635 - DNA, 23 bp, Homo sapiens
agagccaagccttaaactgtaca

SEQ ID NO: 3981636 - DNA, 14 bp, Homo sapiens
agagccagatgcag

SEQ ID NO: 3981637 - DNA, 18 bp, Homo sapiens
agagccagatgcaggaca

SEQ ID NO: 3981638 - DNA, 23 bp, Homo sapiens
agagccaggggggtgaggagctg

SEQ ID NO: 3981639 - DNA, 14 bp, Homo sapiens
agagcccagaggta

SEQ ID NO: 3981640 - DNA, 22 bp, Homo sapiens
agagcccagaggtaacagaaca

SEQ ID NO: 3981641 - DNA, 16 bp, Homo sapiens
agagccccaagcagga

SEQ ID NO: 3981642 - DNA, 15 bp, Homo sapiens
agagcccccaccttg

SEQ ID NO: 3981643 - DNA, 19 bp, Homo sapiens
agagcccctcctccagccc

SEQ ID NO: 3981644 - DNA, 20 bp, Homo sapiens
agagcccctcctccagcccc

SEQ ID NO: 3981645 - DNA, 13 bp, Homo sapiens
agagccctgctcc

SEQ ID NO: 3981646 - DNA, 18 bp, Homo sapiens
agagccctggacacccct

SEQ ID NO: 3981647 - DNA, 16 bp, Homo sapiens
agagccctggctgggt

SEQ ID NO: 3981648 - DNA, 14 bp, Homo sapiens
agagcccttgcctc

SEQ ID NO: 3981649 - DNA, 19 bp, Homo sapiens
agagcccttgcctccccat

SEQ ID NO: 3981650 - DNA, 17 bp, Homo sapiens
agagcctcgtccctccc

SEQ ID NO: 3981651 - DNA, 16 bp, Homo sapiens
agagcctgccccagcg

SEQ ID NO: 3981652 - DNA, 17 bp, Homo sapiens
agagcctgccccagcgc

SEQ ID NO: 3981653 - DNA, 16 bp, Homo sapiens
agagcctgcctggagc

SEQ ID NO: 3981654 - DNA, 16 bp, Homo sapiens
agagcctggagaagct

SEQ ID NO: 3981655 - DNA, 18 bp, Homo sapiens
agagcctggccccaggcc

SEQ ID NO: 3981656 - DNA, 16 bp, Homo sapiens
agagcctggtgctgct

SEQ ID NO: 3981657 - DNA, 18 bp, Homo sapiens
agagcctggtgctgctgc

SEQ ID NO: 3981658 - DNA, 20 bp, Homo sapiens
agagccttccacagtgaatg

SEQ ID NO: 3981659 - DNA, 19 bp, Homo sapiens
agagccttctcagaagcac

SEQ ID NO: 3981660 - DNA, 22 bp, Homo sapiens
agagccttctgatgtctctaaa

SEQ ID NO: 3981661 - DNA, 15 bp, Homo sapiens
agagcgacagagcag

SEQ ID NO: 3981662 - DNA, 16 bp, Homo sapiens
agagcgacagagcagt

SEQ ID NO: 3981663 - DNA, 14 bp, Homo sapiens
agagcgaggctgag

SEQ ID NO: 3981664 - DNA, 19 bp, Homo sapiens
ccccagggtcttccctacc

SEQ ID NO: 3981665 - DNA, 15 bp, Homo sapiens
ccccaggtgtgtgct

SEQ ID NO: 3981666 - DNA, 14 bp, Homo sapiens
ccccagtacctcca

SEQ ID NO: 3981667 - DNA, 18 bp, Homo sapiens
ccccagtacctccaagca

SEQ ID NO: 3981668 - DNA, 18 bp, Homo sapiens
ccccagtccccacccctg

SEQ ID NO: 3981669 - DNA, 22 bp, Homo sapiens
ccccagtgcggttcctcatctg

SEQ ID NO: 3981670 - DNA, 18 bp, Homo sapiens
ccccagtgggatgggaca

SEQ ID NO: 3981671 - DNA, 18 bp, Homo sapiens
ccccatagataggcccct

SEQ ID NO: 3981672 - DNA, 19 bp, Homo sapiens
ccccatcagaacctgagct

SEQ ID NO: 3981673 - DNA, 18 bp, Homo sapiens
ccccatccagacctggct

SEQ ID NO: 3981674 - DNA, 19 bp, Homo sapiens
ccccatccagacctggctc

SEQ ID NO: 3981675 - DNA, 12 bp, Homo sapiens
ccccatccccac

SEQ ID NO: 3981676 - DNA, 15 bp, Homo sapiens
ccccatcggccaaga

SEQ ID NO: 3981677 - DNA, 21 bp, Homo sapiens
ccccatctcatgcccctggct

SEQ ID NO: 3981678 - DNA, 13 bp, Homo sapiens
ccccatctccctg

SEQ ID NO: 3981679 - DNA, 14 bp, Homo sapiens
ccccatctccctgc

SEQ ID NO: 3981680 - DNA, 17 bp, Homo sapiens
ccccatctccctgcctg

SEQ ID NO: 3981681 - DNA, 14 bp, Homo sapiens
ccccatctgtccag

SEQ ID NO: 3981682 - DNA, 19 bp, Homo sapiens
ccccatctgtccagctggg

SEQ ID NO: 3981683 - DNA, 23 bp, Homo sapiens
ccccatgcactgtgaaggaccct

SEQ ID NO: 3981684 - DNA, 22 bp, Homo sapiens
ccccatgccaaagctagggtgg

SEQ ID NO: 3981685 - DNA, 15 bp, Homo sapiens
ccccatgcctgtcca

SEQ ID NO: 3981686 - DNA, 17 bp, Homo sapiens
ccccatgcctgtccagc

SEQ ID NO: 3981687 - DNA, 14 bp, Homo sapiens
ccccatgtgtcctg

SEQ ID NO: 3981688 - DNA, 16 bp, Homo sapiens
ccccatgtgtcctggt

SEQ ID NO: 3981689 - DNA, 12 bp, Homo sapiens
ccccattccctc

SEQ ID NO: 3981690 - DNA, 19 bp, Homo sapiens
ccccattcctgatcccatg

SEQ ID NO: 3981691 - DNA, 13 bp, Homo sapiens
ccccattccttgc

SEQ ID NO: 3981692 - DNA, 17 bp, Homo sapiens
ccccatttcccatctgc

SEQ ID NO: 3981693 - DNA, 13 bp, Homo sapiens
ccccatttcctca

SEQ ID NO: 3981694 - DNA, 14 bp, Homo sapiens
ccccatttctgcct

SEQ ID NO: 3981695 - DNA, 18 bp, Homo sapiens
ccccatttctgcctcgct

SEQ ID NO: 3981696 - DNA, 18 bp, Homo sapiens
cccccaaaatccaaaact

SEQ ID NO: 3981697 - DNA, 21 bp, Homo sapiens
cccccaaaggcatcccagcct

SEQ ID NO: 3981698 - DNA, 16 bp, Homo sapiens
cccccaactccaggaa

SEQ ID NO: 3981699 - DNA, 14 bp, Homo sapiens
cccccacacacact

SEQ ID NO: 3981700 - DNA, 15 bp, Homo sapiens
cccccacacacacta

SEQ ID NO: 3981701 - DNA, 15 bp, Homo sapiens
cccccaccagctgca

SEQ ID NO: 3981702 - DNA, 14 bp, Homo sapiens
cccccacccccagc

SEQ ID NO: 3981703 - DNA, 15 bp, Homo sapiens
cccccacccccagct

SEQ ID NO: 3981704 - DNA, 12 bp, Homo sapiens
cccccaccctgc

SEQ ID NO: 3981705 - DNA, 19 bp, Homo sapiens
cccccactgaatccctgta

SEQ ID NO: 3981706 - DNA, 11 bp, Homo sapiens
cccccagcact

SEQ ID NO: 3981707 - DNA, 15 bp, Homo sapiens
cccccagctccggcc

SEQ ID NO: 3981708 - DNA, 19 bp, Homo sapiens
cccccagcttcacttctga

SEQ ID NO: 3981709 - DNA, 13 bp, Homo sapiens
cccccaggaagcc

SEQ ID NO: 3981710 - DNA, 19 bp, Homo sapiens
cccccaggctgttctccag

SEQ ID NO: 3981711 - DNA, 15 bp, Homo sapiens
cccccagggcctcca

SEQ ID NO: 3981712 - DNA, 16 bp, Homo sapiens
cccccagggcctccag

SEQ ID NO: 3981713 - DNA, 17 bp, Homo sapiens
cccccagggcctccagg

SEQ ID NO: 3981714 - DNA, 19 bp, Homo sapiens
cccccagggcctccagggc

SEQ ID NO: 3981715 - DNA, 11 bp, Homo sapiens
cccccaggtct

SEQ ID NO: 3981716 - DNA, 15 bp, Homo sapiens
cccccagtccccacc

SEQ ID NO: 3981717 - DNA, 20 bp, Homo sapiens
cccccagtccccacccctgc

SEQ ID NO: 3981718 - DNA, 15 bp, Homo sapiens
cccccatgggctcct

SEQ ID NO: 3981719 - DNA, 17 bp, Homo sapiens
cccccatgggctcctgc

SEQ ID NO: 3981720 - DNA, 15 bp, Homo sapiens
cccccatttcccgca

SEQ ID NO: 3981721 - DNA, 11 bp, Homo sapiens
ccccccagtgg

SEQ ID NO: 3981722 - DNA, 12 bp, Homo sapiens
cccccctgctca

SEQ ID NO: 3981723 - DNA, 12 bp, Homo sapiens
cccccctgtcac

SEQ ID NO: 3981724 - DNA, 18 bp, Homo sapiens
cccccgagctcttggcct

SEQ ID NO: 3981725 - DNA, 14 bp, Homo sapiens
cccccgccatcctt

SEQ ID NO: 3981726 - DNA, 18 bp, Homo sapiens
cccccgcgctcgcccagc

SEQ ID NO: 3981727 - DNA, 15 bp, Homo sapiens
cccccggccccctgg

SEQ ID NO: 3981728 - DNA, 24 bp, Homo sapiens
ccccctcacctctccaggtgctca

SEQ ID NO: 3981729 - DNA, 23 bp, Homo sapiens
ccccctctgccggtcgggcagcc

SEQ ID NO: 3981730 - DNA, 22 bp, Homo sapiens
ccccctgagatcccctgagccc

SEQ ID NO: 3981731 - DNA, 12 bp, Homo sapiens
ccccctgccctg

SEQ ID NO: 3981732 - DNA, 15 bp, Homo sapiens
ccccctgctggctct

SEQ ID NO: 3981733 - DNA, 20 bp, Homo sapiens
ccccctgctggctcttctgc

SEQ ID NO: 3981734 - DNA, 19 bp, Homo sapiens
ccccctggcctctgtgcct

SEQ ID NO: 3981735 - DNA, 12 bp, Homo sapiens
cccccttcccat

SEQ ID NO: 3981736 - DNA, 18 bp, Homo sapiens
cccccttcctgtccccaa

SEQ ID NO: 3981737 - DNA, 17 bp, Homo sapiens
cccccttctctgctcca

SEQ ID NO: 3981738 - DNA, 14 bp, Homo sapiens
cccccttgagtggg

SEQ ID NO: 3981739 - DNA, 15 bp, Homo sapiens
cccccttgccacccc

SEQ ID NO: 3981740 - DNA, 15 bp, Homo sapiens
ccccctttcttcctc

SEQ ID NO: 3981741 - DNA, 18 bp, Homo sapiens
ccccctttgctgtgagga

SEQ ID NO: 3981742 - DNA, 23 bp, Homo sapiens
cccccttttcagctgagccctgg

SEQ ID NO: 3981743 - DNA, 16 bp, Homo sapiens
ccccgagaagtgctct

SEQ ID NO: 3981744 - DNA, 12 bp, Homo sapiens
ccccgccacagc

SEQ ID NO: 3981745 - DNA, 14 bp, Homo sapiens
ccccgccagggctg

SEQ ID NO: 3981746 - DNA, 12 bp, Homo sapiens
ccccgcccccag

SEQ ID NO: 3981747 - DNA, 22 bp, Homo sapiens
ccccgcgctcgcccagcaggag

SEQ ID NO: 3981748 - DNA, 14 bp, Homo sapiens
ccccgcttctgcct

SEQ ID NO: 3981749 - DNA, 13 bp, Homo sapiens
ccccggaggaagc

SEQ ID NO: 3981750 - DNA, 13 bp, Homo sapiens
ccccggcaagcca

SEQ ID NO: 3981751 - DNA, 22 bp, Homo sapiens
ccccggcaagccacaggaagga

SEQ ID NO: 3981752 - DNA, 14 bp, Homo sapiens
ccccggcagacgcc

SEQ ID NO: 3981753 - DNA, 23 bp, Homo sapiens
cccatgtagccccctggcctctg

SEQ ID NO: 3981754 - DNA, 16 bp, Homo sapiens
cccatgtcaccggtca

SEQ ID NO: 3981755 - DNA, 18 bp, Homo sapiens
cccatgtgagctgctgcc

SEQ ID NO: 3981756 - DNA, 20 bp, Homo sapiens
cccatgtgtcccctcactct

SEQ ID NO: 3981757 - DNA, 18 bp, Homo sapiens
cccattccaaagctttat

SEQ ID NO: 3981758 - DNA, 14 bp, Homo sapiens
cccattcctccctc

SEQ ID NO: 3981759 - DNA, 21 bp, Homo sapiens
cccattccttgcgcctcagcc

SEQ ID NO: 3981760 - DNA, 22 bp, Homo sapiens
cccattccttgcgcctcagccc

SEQ ID NO: 3981761 - DNA, 12 bp, Homo sapiens
cccattctgtcc

SEQ ID NO: 3981762 - DNA, 21 bp, Homo sapiens
cccattgttggcgctgaggtg

SEQ ID NO: 3981763 - DNA, 14 bp, Homo sapiens
cccatttcccatct

SEQ ID NO: 3981764 - DNA, 14 bp, Homo sapiens
cccatttcccgcac

SEQ ID NO: 3981765 - DNA, 19 bp, Homo sapiens
cccatttccttggaggcca

SEQ ID NO: 3981766 - DNA, 15 bp, Homo sapiens
cccatttctatttat

SEQ ID NO: 3981767 - DNA, 16 bp, Homo sapiens
cccatttctatttatt

SEQ ID NO: 3981768 - DNA, 15 bp, Homo sapiens
cccatttctcactga

SEQ ID NO: 3981769 - DNA, 15 bp, Homo sapiens
cccatttctgcctcg

SEQ ID NO: 3981770 - DNA, 17 bp, Homo sapiens
cccatttctgcctcgct

SEQ ID NO: 3981771 - DNA, 23 bp, Homo sapiens
cccatttctgcctcgctcaccgc

SEQ ID NO: 3981772 - DNA, 13 bp, Homo sapiens
cccatttgtccca

SEQ ID NO: 3981773 - DNA, 18 bp, Homo sapiens
cccattttgagtgactcg

SEQ ID NO: 3981774 - DNA, 12 bp, Homo sapiens
cccattttgcaa

SEQ ID NO: 3981775 - DNA, 22 bp, Homo sapiens
cccattttgcaaaatttccagt

SEQ ID NO: 3981776 - DNA, 20 bp, Homo sapiens
cccatttttatatcgatctc

SEQ ID NO: 3981777 - DNA, 17 bp, Homo sapiens
ccccaaaatccaaaact

SEQ ID NO: 3981778 - DNA, 21 bp, Homo sapiens
ccccaaaatccaaaacttctc

SEQ ID NO: 3981779 - DNA, 15 bp, Homo sapiens
ccccaaacatagccc

SEQ ID NO: 3981780 - DNA, 19 bp, Homo sapiens
ccccaaagagcctggagaa

SEQ ID NO: 3981781 - DNA, 21 bp, Homo sapiens
ccccaaagctttcctgcccca

SEQ ID NO: 3981782 - DNA, 22 bp, Homo sapiens
ccccaaaggacgcctgcaggag

SEQ ID NO: 3981783 - DNA, 20 bp, Homo sapiens
ccccaaaggcatcccagcct

SEQ ID NO: 3981784 - DNA, 22 bp, Homo sapiens
ccccaaaggcatcccagcctgg

SEQ ID NO: 3981785 - DNA, 13 bp, Homo sapiens
ccccaacccccac

SEQ ID NO: 3981786 - DNA, 22 bp, Homo sapiens
ccccaacctcagggctcccagg

SEQ ID NO: 3981787 - DNA, 17 bp, Homo sapiens
ccccaactccaggaaag

SEQ ID NO: 3981788 - DNA, 19 bp, Homo sapiens
ccccaagcccaccaggtgt

SEQ ID NO: 3981789 - DNA, 13 bp, Homo sapiens
ccccaaggctgcg

SEQ ID NO: 3981790 - DNA, 12 bp, Homo sapiens
ccccacacagct

SEQ ID NO: 3981791 - DNA, 17 bp, Homo sapiens
ccccacaccagccttgg

SEQ ID NO: 3981792 - DNA, 15 bp, Homo sapiens
ccccacaccccagcc

SEQ ID NO: 3981793 - DNA, 20 bp, Homo sapiens
ccccacaccttccagggccc

SEQ ID NO: 3981794 - DNA, 13 bp, Homo sapiens
ccccacacggact

SEQ ID NO: 3981795 - DNA, 23 bp, Homo sapiens
ccccacactccccgccttagagc

SEQ ID NO: 3981796 - DNA, 22 bp, Homo sapiens
ccccacagaaccttcaacccag

SEQ ID NO: 3981797 - DNA, 18 bp, Homo sapiens
ccccacagcgtccctggc

SEQ ID NO: 3981798 - DNA, 19 bp, Homo sapiens
ccccacatcgcacactggg

SEQ ID NO: 3981799 - DNA, 21 bp, Homo sapiens
ccccaccagacatcacccttt

SEQ ID NO: 3981800 - DNA, 15 bp, Homo sapiens
ccccaccagctgcag

SEQ ID NO: 3981801 - DNA, 19 bp, Homo sapiens
ccccaccatatgaattgta

SEQ ID NO: 3981802 - DNA, 16 bp, Homo sapiens
ccccacccccagctca

SEQ ID NO: 3981803 - DNA, 14 bp, Homo sapiens
ccccacccctgccc

SEQ ID NO: 3981804 - DNA, 23 bp, Homo sapiens
ccccacccctgcccccagccccg

SEQ ID NO: 3981805 - DNA, 15 bp, Homo sapiens
ccccaccctccactc

SEQ ID NO: 3981806 - DNA, 13 bp, Homo sapiens
ccccacctccact

SEQ ID NO: 3981807 - DNA, 14 bp, Homo sapiens
ccccacctctccaa

SEQ ID NO: 3981808 - DNA, 21 bp, Homo sapiens
ccccacgagggctggctggcc

SEQ ID NO: 3981809 - DNA, 20 bp, Homo sapiens
ccccacgctgtggccctgga

SEQ ID NO: 3981810 - DNA, 19 bp, Homo sapiens
ccccacgtgacagtgcctg

SEQ ID NO: 3981811 - DNA, 14 bp, Homo sapiens
ccccactgggccag

SEQ ID NO: 3981812 - DNA, 21 bp, Homo sapiens
ccccactgggccagccctgca

SEQ ID NO: 3981813 - DNA, 22 bp, Homo sapiens
ccccactgtccccctacccacc

SEQ ID NO: 3981814 - DNA, 15 bp, Homo sapiens
ccccagaactctgcc

SEQ ID NO: 3981815 - DNA, 21 bp, Homo sapiens
ccccagacccttcttgcctgc

SEQ ID NO: 3981816 - DNA, 16 bp, Homo sapiens
ccccagagtggcccac

SEQ ID NO: 3981817 - DNA, 18 bp, Homo sapiens
ccccagatcaccagcccg

SEQ ID NO: 3981818 - DNA, 15 bp, Homo sapiens
ccccagatggctttg

SEQ ID NO: 3981819 - DNA, 11 bp, Homo sapiens
ccccagcacta

SEQ ID NO: 3981820 - DNA, 12 bp, Homo sapiens
ccccagcatcac

SEQ ID NO: 3981821 - DNA, 23 bp, Homo sapiens
ccccagcccatccattaggccag

SEQ ID NO: 3981822 - DNA, 14 bp, Homo sapiens
ccccagccccttct

SEQ ID NO: 3981823 - DNA, 22 bp, Homo sapiens
ccccagccccttctcccagcac

SEQ ID NO: 3981824 - DNA, 16 bp, Homo sapiens
ccccagccctggctct

SEQ ID NO: 3981825 - DNA, 18 bp, Homo sapiens
ccccagcccttcctctgc

SEQ ID NO: 3981826 - DNA, 13 bp, Homo sapiens
ccccagcctccct

SEQ ID NO: 3981827 - DNA, 18 bp, Homo sapiens
ccccagcctcgcctgtca

SEQ ID NO: 3981828 - DNA, 16 bp, Homo sapiens
ccccagcctctggcat

SEQ ID NO: 3981829 - DNA, 11 bp, Homo sapiens
ccccagcctga

SEQ ID NO: 3981830 - DNA, 14 bp, Homo sapiens
ccccagcctgggcc

SEQ ID NO: 3981831 - DNA, 23 bp, Homo sapiens
ccccagcgtcccagtctctggca

SEQ ID NO: 3981832 - DNA, 19 bp, Homo sapiens
ccccagctaagaacctgga

SEQ ID NO: 3981833 - DNA, 21 bp, Homo sapiens
ccccagctaagaacctggaac

SEQ ID NO: 3981834 - DNA, 22 bp, Homo sapiens
ccccagctaccctttttctcca

SEQ ID NO: 3981835 - DNA, 14 bp, Homo sapiens
ccccagctcaatgg

SEQ ID NO: 3981836 - DNA, 11 bp, Homo sapiens
ccccagctccg

SEQ ID NO: 3981837 - DNA, 22 bp, Homo sapiens
cccaggaccagctcaggacaga

SEQ ID NO: 3981838 - DNA, 11 bp, Homo sapiens
cccaggaccct

SEQ ID NO: 3981839 - DNA, 13 bp, Homo sapiens
cccaggaccctga

SEQ ID NO: 3981840 - DNA, 23 bp, Homo sapiens
cccaggaccctgaaggggccatg

SEQ ID NO: 3981841 - DNA, 18 bp, Homo sapiens
cccaggacctggctgcca

SEQ ID NO: 3981842 - DNA, 15 bp, Homo sapiens
cccaggacgcttctg

SEQ ID NO: 3981843 - DNA, 21 bp, Homo sapiens
cccaggagctcaggtggggag

SEQ ID NO: 3981844 - DNA, 13 bp, Homo sapiens
cccaggaggggaa

SEQ ID NO: 3981845 - DNA, 23 bp, Homo sapiens
cccaggaggggaactgagtcacg

SEQ ID NO: 3981846 - DNA, 22 bp, Homo sapiens
cccaggcagcacagtgtgtgaa

SEQ ID NO: 3981847 - DNA, 17 bp, Homo sapiens
cccaggccaggccacca

SEQ ID NO: 3981848 - DNA, 20 bp, Homo sapiens
cccaggccaggccaccagga

SEQ ID NO: 3981849 - DNA, 17 bp, Homo sapiens
cccaggccccagacagg

SEQ ID NO: 3981850 - DNA, 15 bp, Homo sapiens
cccaggccccctgca

SEQ ID NO: 3981851 - DNA, 13 bp, Homo sapiens
cccaggcccttca

SEQ ID NO: 3981852 - DNA, 15 bp, Homo sapiens
cccaggccggcccag

SEQ ID NO: 3981853 - DNA, 16 bp, Homo sapiens
cccaggccttgtccta

SEQ ID NO: 3981854 - DNA, 21 bp, Homo sapiens
cccaggctggacatgctgact

SEQ ID NO: 3981855 - DNA, 17 bp, Homo sapiens
cccaggctggagacccc

SEQ ID NO: 3981856 - DNA, 19 bp, Homo sapiens
cccaggctggagtgcagtg

SEQ ID NO: 3981857 - DNA, 20 bp, Homo sapiens
cccaggctggagtgcagtgg

SEQ ID NO: 3981858 - DNA, 12 bp, Homo sapiens
cccaggctggga

SEQ ID NO: 3981859 - DNA, 22 bp, Homo sapiens
cccaggctgtgcagcgcagctg

SEQ ID NO: 3981860 - DNA, 13 bp, Homo sapiens
cccagggaaggac

SEQ ID NO: 3981861 - DNA, 16 bp, Homo sapiens
cccagggagctctggg

SEQ ID NO: 3981862 - DNA, 14 bp, Homo sapiens
cccagggagggaag

SEQ ID NO: 3981863 - DNA, 19 bp, Homo sapiens
cccagggagggaagtgtga

SEQ ID NO: 3981864 - DNA, 17 bp, Homo sapiens
cccagggcatcttgctg

SEQ ID NO: 3981865 - DNA, 21 bp, Homo sapiens
cccagggcatcttgctggcta

SEQ ID NO: 3981866 - DNA, 13 bp, Homo sapiens
cccagggcccaga

SEQ ID NO: 3981867 - DNA, 12 bp, Homo sapiens
cccagggccctg

SEQ ID NO: 3981868 - DNA, 14 bp, Homo sapiens
cccagggcctccag

SEQ ID NO: 3981869 - DNA, 15 bp, Homo sapiens
cccagggcctccagg

SEQ ID NO: 3981870 - DNA, 16 bp, Homo sapiens
cccagggcctccaggg

SEQ ID NO: 3981871 - DNA, 17 bp, Homo sapiens
cccagggcctccagggc

SEQ ID NO: 3981872 - DNA, 12 bp, Homo sapiens
cccagggctggc

SEQ ID NO: 3981873 - DNA, 14 bp, Homo sapiens
cccagggctggctc

SEQ ID NO: 3981874 - DNA, 15 bp, Homo sapiens
cccagggctggctct

SEQ ID NO: 3981875 - DNA, 16 bp, Homo sapiens
cccaggggcaggactg

SEQ ID NO: 3981876 - DNA, 17 bp, Homo sapiens
cccaggggcaggactga

SEQ ID NO: 3981877 - DNA, 18 bp, Homo sapiens
cccaggggcccacaggga

SEQ ID NO: 3981878 - DNA, 18 bp, Homo sapiens
cccaggggtcccagccac

SEQ ID NO: 3981879 - DNA, 20 bp, Homo sapiens
cccaggggtcccagccaccc

SEQ ID NO: 3981880 - DNA, 16 bp, Homo sapiens
cccagggtcttcccta

SEQ ID NO: 3981881 - DNA, 14 bp, Homo sapiens
cccaggtaccagct

SEQ ID NO: 3981882 - DNA, 15 bp, Homo sapiens
cccaggtcctctgat

SEQ ID NO: 3981883 - DNA, 21 bp, Homo sapiens
cccaggtggaaggcagacagc

SEQ ID NO: 3981884 - DNA, 18 bp, Homo sapiens
cccaggtggagggcacag

SEQ ID NO: 3981885 - DNA, 19 bp, Homo sapiens
cccaggtggagggcacagc

SEQ ID NO: 3981886 - DNA, 16 bp, Homo sapiens
cccagtacctccaagc

SEQ ID NO: 3981887 - DNA, 13 bp, Homo sapiens
cccagtcacctcc

SEQ ID NO: 3981888 - DNA, 17 bp, Homo sapiens
cccagtcacctccccac

SEQ ID NO: 3981889 - DNA, 13 bp, Homo sapiens
cccagtccccacc

SEQ ID NO: 3981890 - DNA, 22 bp, Homo sapiens
cccagtcggccccatctctcat

SEQ ID NO: 3981891 - DNA, 17 bp, Homo sapiens
cccagtgaactcctgcc

SEQ ID NO: 3981892 - DNA, 12 bp, Homo sapiens
cccagtgacact

SEQ ID NO: 3981893 - DNA, 18 bp, Homo sapiens
cccagtgacacttcagag

SEQ ID NO: 3981894 - DNA, 19 bp, Homo sapiens
cccagtgacacttcagaga

SEQ ID NO: 3981895 - DNA, 22 bp, Homo sapiens
cccagtgacacttcagagagct

SEQ ID NO: 3981896 - DNA, 20 bp, Homo sapiens
cccagtgcccccactgacca

SEQ ID NO: 3981897 - DNA, 16 bp, Homo sapiens
cccagtggccactcag

SEQ ID NO: 3981898 - DNA, 17 bp, Homo sapiens
cccagtgggatgggaca

SEQ ID NO: 3981899 - DNA, 19 bp, Homo sapiens
cccagtgtatgtcttgtat

SEQ ID NO: 3981900 - DNA, 18 bp, Homo sapiens
cccagtgttgtttgtaaa

SEQ ID NO: 3981901 - DNA, 19 bp, Homo sapiens
cccagttcaggagtcccaa

SEQ ID NO: 3981902 - DNA, 16 bp, Homo sapiens
cccataaacagtaatg

SEQ ID NO: 3981903 - DNA, 21 bp, Homo sapiens
cccatagataggcccctgggg

SEQ ID NO: 3981904 - DNA, 16 bp, Homo sapiens
cccatagcttccatga

SEQ ID NO: 3981905 - DNA, 17 bp, Homo sapiens
cccataggccaccccct

SEQ ID NO: 3981906 - DNA, 18 bp, Homo sapiens
cccatcagcccaatccct

SEQ ID NO: 3981907 - DNA, 17 bp, Homo sapiens
cccatcaggtagctgtc

SEQ ID NO: 3981908 - DNA, 14 bp, Homo sapiens
cccatcatgtggcc

SEQ ID NO: 3981909 - DNA, 17 bp, Homo sapiens
cccatccatcagctccc

SEQ ID NO: 3981910 - DNA, 19 bp, Homo sapiens
cccatccattaggccagca

SEQ ID NO: 3981911 - DNA, 13 bp, Homo sapiens
cccatcctccaga

SEQ ID NO: 3981912 - DNA, 16 bp, Homo sapiens
cccatccttccctcat

SEQ ID NO: 3981913 - DNA, 22 bp, Homo sapiens
cccatctcatgcccctggctgg

SEQ ID NO: 3981914 - DNA, 18 bp, Homo sapiens
cccatctctccctcccct

SEQ ID NO: 3981915 - DNA, 19 bp, Homo sapiens
cccatctgcaccccttctc

SEQ ID NO: 3981916 - DNA, 12 bp, Homo sapiens
cccatctgtcca

SEQ ID NO: 3981917 - DNA, 13 bp, Homo sapiens
cccatgagcctgc

SEQ ID NO: 3981918 - DNA, 22 bp, Homo sapiens
attctacagtttcttactgttt

SEQ ID NO: 3981919 - DNA, 18 bp, Homo sapiens
attctagctgtatgattt

SEQ ID NO: 3981920 - DNA, 22 bp, Homo sapiens
attctagctgtatgatttgttt

SEQ ID NO: 3981921 - DNA, 18 bp, Homo sapiens
attctagttcagagccaa

SEQ ID NO: 3981922 - DNA, 16 bp, Homo sapiens
attctagttttgtcaa

SEQ ID NO: 3981923 - DNA, 15 bp, Homo sapiens
attctataaggccat

SEQ ID NO: 3981924 - DNA, 14 bp, Homo sapiens
attctatatgaatt

SEQ ID NO: 3981925 - DNA, 19 bp, Homo sapiens
attctatatgaatttaaat

SEQ ID NO: 3981926 - DNA, 18 bp, Homo sapiens
attctatcgttattataa

SEQ ID NO: 3981927 - DNA, 13 bp, Homo sapiens
attctatgttaaa

SEQ ID NO: 3981928 - DNA, 21 bp, Homo sapiens
attctatgttaaatactgtgc

SEQ ID NO: 3981929 - DNA, 20 bp, Homo sapiens
attctattacattttcagtg

SEQ ID NO: 3981930 - DNA, 13 bp, Homo sapiens
attctattgcctt

SEQ ID NO: 3981931 - DNA, 21 bp, Homo sapiens
attctattgccttctttgaag

SEQ ID NO: 3981932 - DNA, 17 bp, Homo sapiens
attctattgtattattt

SEQ ID NO: 3981933 - DNA, 18 bp, Homo sapiens
attctattttagaataaa

SEQ ID NO: 3981934 - DNA, 17 bp, Homo sapiens
attctcacatccctcta

SEQ ID NO: 3981935 - DNA, 16 bp, Homo sapiens
attctcagatatttat

SEQ ID NO: 3981936 - DNA, 20 bp, Homo sapiens
attctcccaggtaccagctg

SEQ ID NO: 3981937 - DNA, 14 bp, Homo sapiens
attctcccctccct

SEQ ID NO: 3981938 - DNA, 22 bp, Homo sapiens
attctccctatcttgtgaagtt

SEQ ID NO: 3981939 - DNA, 19 bp, Homo sapiens
attctcgtgagtcatttaa

SEQ ID NO: 3981940 - DNA, 12 bp, Homo sapiens
attctcttatcc

SEQ ID NO: 3981941 - DNA, 14 bp, Homo sapiens
attctcttatccaa

SEQ ID NO: 3981942 - DNA, 17 bp, Homo sapiens
attctcttttatctgtt

SEQ ID NO: 3981943 - DNA, 19 bp, Homo sapiens
attctcttttatctgttta

SEQ ID NO: 3981944 - DNA, 14 bp, Homo sapiens
attctgaatctcaa

SEQ ID NO: 3981945 - DNA, 16 bp, Homo sapiens
attctgagcagtgcct

SEQ ID NO: 3981946 - DNA, 19 bp, Homo sapiens
attctgagcatactcaaca

SEQ ID NO: 3981947 - DNA, 15 bp, Homo sapiens
attctgattcttcta

SEQ ID NO: 3981948 - DNA, 19 bp, Homo sapiens
attctgcaagcacatctgc

SEQ ID NO: 3981949 - DNA, 17 bp, Homo sapiens
attctgcagtaaatctt

SEQ ID NO: 3981950 - DNA, 20 bp, Homo sapiens
attctgcagtaaatctttta

SEQ ID NO: 3981951 - DNA, 23 bp, Homo sapiens
attctgcagtaaatcttttacaa

SEQ ID NO: 3981952 - DNA, 17 bp, Homo sapiens
attctgcctctctggaa

SEQ ID NO: 3981953 - DNA, 21 bp, Homo sapiens
attctgggaggcaagaaaagg

SEQ ID NO: 3981954 - DNA, 22 bp, Homo sapiens
attctgggaggcaagaaaagga

SEQ ID NO: 3981955 - DNA, 18 bp, Homo sapiens
attctgggcttggggtgt

SEQ ID NO: 3981956 - DNA, 14 bp, Homo sapiens
attctgtaaaatgt

SEQ ID NO: 3981957 - DNA, 12 bp, Homo sapiens
attctgtaaatg

SEQ ID NO: 3981958 - DNA, 16 bp, Homo sapiens
attctgtgtatctttt

SEQ ID NO: 3981959 - DNA, 21 bp, Homo sapiens
attctgtgtgttttcataata

SEQ ID NO: 3981960 - DNA, 22 bp, Homo sapiens
attctgtgtgttttcataataa

SEQ ID NO: 3981961 - DNA, 18 bp, Homo sapiens
attctgtgttgcattatt

SEQ ID NO: 3981962 - DNA, 16 bp, Homo sapiens
attctgttaaaatcta

SEQ ID NO: 3981963 - DNA, 17 bp, Homo sapiens
attcttaaaaattgaat

SEQ ID NO: 3981964 - DNA, 15 bp, Homo sapiens
attcttaaccatgga

SEQ ID NO: 3981965 - DNA, 23 bp, Homo sapiens
attcttaccctgtacatatgtaa

SEQ ID NO: 3981966 - DNA, 13 bp, Homo sapiens
attcttatttaat

SEQ ID NO: 3981967 - DNA, 14 bp, Homo sapiens
attcttatttaatg

SEQ ID NO: 3981968 - DNA, 16 bp, Homo sapiens
attcttatttttccta

SEQ ID NO: 3981969 - DNA, 20 bp, Homo sapiens
attcttcagttggttgtgtc

SEQ ID NO: 3981970 - DNA, 23 bp, Homo sapiens
attcttcagttggttgtgtcttt

SEQ ID NO: 3981971 - DNA, 16 bp, Homo sapiens
attcttccagaatgct

SEQ ID NO: 3981972 - DNA, 15 bp, Homo sapiens
attcttctctgttgt

SEQ ID NO: 3981973 - DNA, 13 bp, Homo sapiens
attcttctgcaac

SEQ ID NO: 3981974 - DNA, 15 bp, Homo sapiens
attcttctgtatttc

SEQ ID NO: 3981975 - DNA, 15 bp, Homo sapiens
attcttgaaggaaaa

SEQ ID NO: 3981976 - DNA, 18 bp, Homo sapiens
attcttgaaggaaaatga

SEQ ID NO: 3981977 - DNA, 12 bp, Homo sapiens
attcttgtatat

SEQ ID NO: 3981978 - DNA, 17 bp, Homo sapiens
attcttgtcacaataaa

SEQ ID NO: 3981979 - DNA, 18 bp, Homo sapiens
attcttgttttctttctt

SEQ ID NO: 3981980 - DNA, 17 bp, Homo sapiens
attctttccattatgat

SEQ ID NO: 3981981 - DNA, 22 bp, Homo sapiens
attcttttaattgtttcagaat

SEQ ID NO: 3981982 - DNA, 17 bp, Homo sapiens
attcttttgtttccatg

SEQ ID NO: 3981983 - DNA, 13 bp, Homo sapiens
attgaaaaggaca

SEQ ID NO: 3981984 - DNA, 14 bp, Homo sapiens
attgaaaatgaatg

SEQ ID NO: 3981985 - DNA, 17 bp, Homo sapiens
attgaaactagttattt

SEQ ID NO: 3981986 - DNA, 19 bp, Homo sapiens
attgaaactagttatttta

SEQ ID NO: 3981987 - DNA, 13 bp, Homo sapiens
attgaaattctga

SEQ ID NO: 3981988 - DNA, 15 bp, Homo sapiens
attgaacacaaactg

SEQ ID NO: 3981989 - DNA, 16 bp, Homo sapiens
attgaacacaaactgt

SEQ ID NO: 3981990 - DNA, 17 bp, Homo sapiens
attgaacacaaactgta

SEQ ID NO: 3981991 - DNA, 23 bp, Homo sapiens
attgaaccagctcatctccaagg

SEQ ID NO: 3981992 - DNA, 14 bp, Homo sapiens
attgaagacaattt

SEQ ID NO: 3981993 - DNA, 17 bp, Homo sapiens
attgaaggaagccaaat

SEQ ID NO: 3981994 - DNA, 19 bp, Homo sapiens
attgaataaagttgaagct

SEQ ID NO: 3981995 - DNA, 22 bp, Homo sapiens
attgaatgatatataaatatat

SEQ ID NO: 3981996 - DNA, 20 bp, Homo sapiens
attgaatgtgtgatgtgaac

SEQ ID NO: 3981997 - DNA, 15 bp, Homo sapiens
attgacacacagcac

SEQ ID NO: 3981998 - DNA, 17 bp, Homo sapiens
attgacacagaaaatgt

SEQ ID NO: 3981999 - DNA, 12 bp, Homo sapiens
attgacactgaa

SEQ ID NO: 3982000 - DNA, 18 bp, Homo sapiens
attgacatttgtagttga

SEQ ID NO: 3982001 - DNA, 14 bp, Homo sapiens
attgaccaagaact

SEQ ID NO: 3982002 - DNA, 20 bp, Homo sapiens
attgaccaagaactgcatgg

SEQ ID NO: 3982003 - DNA, 15 bp, Homo sapiens
attgaccatctgctt

SEQ ID NO: 3982004 - DNA, 22 bp, Homo sapiens
attgacctatttccagaaatac

SEQ ID NO: 3982005 - DNA, 12 bp, Homo sapiens
attgacctgctc

SEQ ID NO: 3982006 - DNA, 19 bp, Homo sapiens
attgagattagagggaggt

SEQ ID NO: 3982007 - DNA, 15 bp, Homo sapiens
attgaggctttgtgt

SEQ ID NO: 3982008 - DNA, 16 bp, Homo sapiens
attgaggctttgtgtt

SEQ ID NO: 3982009 - DNA, 17 bp, Homo sapiens
attgaggggattaatat

SEQ ID NO: 3982010 - DNA, 14 bp, Homo sapiens
attgaggtaagttt

SEQ ID NO: 3982011 - DNA, 20 bp, Homo sapiens
attgagtacctactgtgtgc

SEQ ID NO: 3982012 - DNA, 21 bp, Homo sapiens
attgatactctttctaatgct

SEQ ID NO: 3982013 - DNA, 18 bp, Homo sapiens
attgatcattttcccccc

SEQ ID NO: 3982014 - DNA, 19 bp, Homo sapiens
attgatcattttcccccca

SEQ ID NO: 3982015 - DNA, 20 bp, Homo sapiens
attgatcattttccccccac

SEQ ID NO: 3982016 - DNA, 21 bp, Homo sapiens
attgatcattttccccccact

SEQ ID NO: 3982017 - DNA, 19 bp, Homo sapiens
attgatcggagcctcctct

SEQ ID NO: 3982018 - DNA, 21 bp, Homo sapiens
attgatgataacacttaaaat

SEQ ID NO: 3982019 - DNA, 14 bp, Homo sapiens
attgatgcaaataa

SEQ ID NO: 3982020 - DNA, 14 bp, Homo sapiens
attgatttgaagaa

SEQ ID NO: 3982021 - DNA, 20 bp, Homo sapiens
atttttctcccaagaaacct

SEQ ID NO: 3982022 - DNA, 10 bp, Homo sapiens
atttttctct

SEQ ID NO: 3982023 - DNA, 18 bp, Homo sapiens
atttttcttttgaggcat

SEQ ID NO: 3982024 - DNA, 20 bp, Homo sapiens
atttttgtaatgtgaaaagt

SEQ ID NO: 3982025 - DNA, 21 bp, Homo sapiens
atttttgtaatgtgaaaagta

SEQ ID NO: 3982026 - DNA, 13 bp, Homo sapiens
atttttgtacatg

SEQ ID NO: 3982027 - DNA, 20 bp, Homo sapiens
atttttgtgaaatgaaaaca

SEQ ID NO: 3982028 - DNA, 20 bp, Homo sapiens
atttttgttagtttacaata

SEQ ID NO: 3982029 - DNA, 22 bp, Homo sapiens
atttttgttagtttacaatatt

SEQ ID NO: 3982030 - DNA, 17 bp, Homo sapiens
atttttgtttcttccaa

SEQ ID NO: 3982031 - DNA, 21 bp, Homo sapiens
attttttaaaacactaaaagc

SEQ ID NO: 3982032 - DNA, 11 bp, Homo sapiens
attttttaagt

SEQ ID NO: 3982033 - DNA, 17 bp, Homo sapiens
attttttaagtatttat

SEQ ID NO: 3982034 - DNA, 18 bp, Homo sapiens
attttttaagtatttata

SEQ ID NO: 3982035 - DNA, 22 bp, Homo sapiens
attttttaagtatttatatatt

SEQ ID NO: 3982036 - DNA, 13 bp, Homo sapiens
attttttcagaaa

SEQ ID NO: 3982037 - DNA, 23 bp, Homo sapiens
attttttccaaaatctcccattt

SEQ ID NO: 3982038 - DNA, 12 bp, Homo sapiens
attttttcttct

SEQ ID NO: 3982039 - DNA, 12 bp, Homo sapiens
attttttgactt

SEQ ID NO: 3982040 - DNA, 16 bp, Homo sapiens
atttttttaactgaaa

SEQ ID NO: 3982041 - DNA, 19 bp, Homo sapiens
atttttttaactgaaaatg

SEQ ID NO: 3982042 - DNA, 23 bp, Homo sapiens
atttttttaactgaaaatgtaaa

SEQ ID NO: 3982043 - DNA, 22 bp, Homo sapiens
atttttttcactggagttacat

SEQ ID NO: 3982044 - DNA, 17 bp, Homo sapiens
atttttttgtcattaaa

SEQ ID NO: 3982045 - DNA, 19 bp, Homo sapiens
attttttttaaaatagaaa

SEQ ID NO: 3982046 - DNA, 14 bp, Homo sapiens
attttttttacatt

SEQ ID NO: 3982047 - DNA, 16 bp, Homo sapiens
attttttttatattta

SEQ ID NO: 3982048 - DNA, 16 bp, Homo sapiens
atttttttttctttca

SEQ ID NO: 3982049 - DNA, 19 bp, Homo sapiens
attttttttttaaattatt

SEQ ID NO: 3982050 - DNA, 19 bp, Homo sapiens
atttttttttttttttcct

SEQ ID NO: 3982051 - DNA, 17 bp, Homo sapiens
caaaaaaaaagttttat

SEQ ID NO: 3982052 - DNA, 19 bp, Homo sapiens
caaaaaaaaagttttattt

SEQ ID NO: 3982053 - DNA, 22 bp, Homo sapiens
caaaaaaaaagttttatttttc

SEQ ID NO: 3982054 - DNA, 13 bp, Homo sapiens
caaaaaaacacta

SEQ ID NO: 3982055 - DNA, 13 bp, Homo sapiens
caaaaaaaggaaa

SEQ ID NO: 3982056 - DNA, 15 bp, Homo sapiens
caaaaaaaggaaaaa

SEQ ID NO: 3982057 - DNA, 16 bp, Homo sapiens
caaaaaaaggaaaaat

SEQ ID NO: 3982058 - DNA, 20 bp, Homo sapiens
caaaaaaatttaaaattacg

SEQ ID NO: 3982059 - DNA, 21 bp, Homo sapiens
caaaaaagacttgagacaatg

SEQ ID NO: 3982060 - DNA, 16 bp, Homo sapiens
caaaaaagtcaacaaa

SEQ ID NO: 3982061 - DNA, 15 bp, Homo sapiens
caaaaaataattagt

SEQ ID NO: 3982062 - DNA, 14 bp, Homo sapiens
caaaaaattaaaac

SEQ ID NO: 3982063 - DNA, 14 bp, Homo sapiens
caaaaacaaaaaga

SEQ ID NO: 3982064 - DNA, 20 bp, Homo sapiens
caaaaacaggtatatacttt

SEQ ID NO: 3982065 - DNA, 20 bp, Homo sapiens
caaaaagcaagggagaaaag

SEQ ID NO: 3982066 - DNA, 24 bp, Homo sapiens
caaaaaggagccttttgctctctg

SEQ ID NO: 3982067 - DNA, 11 bp, Homo sapiens
caaaaatataa

SEQ ID NO: 3982068 - DNA, 14 bp, Homo sapiens
caaaaatatttata

SEQ ID NO: 3982069 - DNA, 17 bp, Homo sapiens
caaaaatgaactgaagt

SEQ ID NO: 3982070 - DNA, 20 bp, Homo sapiens
caaaaatgcaacaaatgaat

SEQ ID NO: 3982071 - DNA, 17 bp, Homo sapiens
caaaaattagccgggcg

SEQ ID NO: 3982072 - DNA, 12 bp, Homo sapiens
caaaaattatta

SEQ ID NO: 3982073 - DNA, 23 bp, Homo sapiens
caaaaattcagagtccttgcaaa

SEQ ID NO: 3982074 - DNA, 17 bp, Homo sapiens
caaaacaaaaattaggt

SEQ ID NO: 3982075 - DNA, 20 bp, Homo sapiens
caaaacacctgacagcccct

SEQ ID NO: 3982076 - DNA, 16 bp, Homo sapiens
caaaaccaggcctctg

SEQ ID NO: 3982077 - DNA, 15 bp, Homo sapiens
caaaacgagggctga

SEQ ID NO: 3982078 - DNA, 15 bp, Homo sapiens
caaaacgtcttattg

SEQ ID NO: 3982079 - DNA, 20 bp, Homo sapiens
caaaacttggtatttttcag

SEQ ID NO: 3982080 - DNA, 22 bp, Homo sapiens
caaaagaaataatccctgtaat

SEQ ID NO: 3982081 - DNA, 17 bp, Homo sapiens
caaaagaagcccccagc

SEQ ID NO: 3982082 - DNA, 15 bp, Homo sapiens
caaaagaatcagaaa

SEQ ID NO: 3982083 - DNA, 19 bp, Homo sapiens
caaaagaatcagaaacagg

SEQ ID NO: 3982084 - DNA, 13 bp, Homo sapiens
caaaagagcagca

SEQ ID NO: 3982085 - DNA, 15 bp, Homo sapiens
caaaagagcagcatt

SEQ ID NO: 3982086 - DNA, 22 bp, Homo sapiens
caaaagagcagcatttttaatt

SEQ ID NO: 3982087 - DNA, 12 bp, Homo sapiens
caaaagatgaaa

SEQ ID NO: 3982088 - DNA, 15 bp, Homo sapiens
caaaagcaaatgaga

SEQ ID NO: 3982089 - DNA, 19 bp, Homo sapiens
caaaagcatttatcattct

SEQ ID NO: 3982090 - DNA, 18 bp, Homo sapiens
caaaagccttgtgtatat

SEQ ID NO: 3982091 - DNA, 20 bp, Homo sapiens
caaaagccttgtgtatattt

SEQ ID NO: 3982092 - DNA, 15 bp, Homo sapiens
caaaagcgccctcac

SEQ ID NO: 3982093 - DNA, 20 bp, Homo sapiens
caaaagcttccctccctgct

SEQ ID NO: 3982094 - DNA, 12 bp, Homo sapiens
caaaaggaaacc

SEQ ID NO: 3982095 - DNA, 11 bp, Homo sapiens
caaaaggcagc

SEQ ID NO: 3982096 - DNA, 19 bp, Homo sapiens
caaaaggcagctcacccct

SEQ ID NO: 3982097 - DNA, 17 bp, Homo sapiens
caaaaggcatttcccac

SEQ ID NO: 3982098 - DNA, 15 bp, Homo sapiens
caaaaggcttgcaga

SEQ ID NO: 3982099 - DNA, 19 bp, Homo sapiens
caaaaggttcactaaagca

SEQ ID NO: 3982100 - DNA, 19 bp, Homo sapiens
caaaagtaaatgggagggc

SEQ ID NO: 3982101 - DNA, 14 bp, Homo sapiens
caaaagtccctccc

SEQ ID NO: 3982102 - DNA, 15 bp, Homo sapiens
caaaagtctattttt

SEQ ID NO: 3982103 - DNA, 17 bp, Homo sapiens
caaaagttagctgagcg

SEQ ID NO: 3982104 - DNA, 12 bp, Homo sapiens
caaaatacaatc

SEQ ID NO: 3982105 - DNA, 17 bp, Homo sapiens
caaaatatggtttggtt

SEQ ID NO: 3982106 - DNA, 20 bp, Homo sapiens
caaaatccaaaacttctctt

SEQ ID NO: 3982107 - DNA, 19 bp, Homo sapiens
caaaatccttccaaagaat

SEQ ID NO: 3982108 - DNA, 20 bp, Homo sapiens
caaaatctaaaacaaaatct

SEQ ID NO: 3982109 - DNA, 14 bp, Homo sapiens
caaaatctgaactc

SEQ ID NO: 3982110 - DNA, 21 bp, Homo sapiens
caaaatctgaactctcaaaag

SEQ ID NO: 3982111 - DNA, 21 bp, Homo sapiens
caaaatctgtccaaaggaggc

SEQ ID NO: 3982112 - DNA, 16 bp, Homo sapiens
caaaatctgttctaac

SEQ ID NO: 3982113 - DNA, 19 bp, Homo sapiens
caaaatgagttgtgatgaa

SEQ ID NO: 3982114 - DNA, 14 bp, Homo sapiens
caaaatgtgtattt

SEQ ID NO: 3982115 - DNA, 15 bp, Homo sapiens
caaaattaaatctgt

SEQ ID NO: 3982116 - DNA, 15 bp, Homo sapiens
caaaattgatgtgtt

SEQ ID NO: 3982117 - DNA, 17 bp, Homo sapiens
caaaatttccagtacct

SEQ ID NO: 3982118 - DNA, 19 bp, Homo sapiens
caaaatttccagtaccttt

SEQ ID NO: 3982119 - DNA, 20 bp, Homo sapiens
caaaatttccagtacctttg

SEQ ID NO: 3982120 - DNA, 19 bp, Homo sapiens
caaaatttgatgccaggac

SEQ ID NO: 3982121 - DNA, 23 bp, Homo sapiens
caaaattttatagctcagtttat

SEQ ID NO: 3982122 - DNA, 22 bp, Homo sapiens
caaaattttctcattttctttt

SEQ ID NO: 3982123 - DNA, 13 bp, Homo sapiens
caaacactgaggc

SEQ ID NO: 3982124 - DNA, 12 bp, Homo sapiens
tttgctcaacag

SEQ ID NO: 3982125 - DNA, 14 bp, Homo sapiens
tttgctccgaagct

SEQ ID NO: 3982126 - DNA, 21 bp, Homo sapiens
tttgctgatttcccctcttcc

SEQ ID NO: 3982127 - DNA, 15 bp, Homo sapiens
tttgctgtgaggaat

SEQ ID NO: 3982128 - DNA, 19 bp, Homo sapiens
tttgctgtgaggctgtcct

SEQ ID NO: 3982129 - DNA, 21 bp, Homo sapiens
tttgctgttttaaacattaat

SEQ ID NO: 3982130 - DNA, 12 bp, Homo sapiens
tttgcttagaaa

SEQ ID NO: 3982131 - DNA, 16 bp, Homo sapiens
tttgcttagaaaagaa

SEQ ID NO: 3982132 - DNA, 16 bp, Homo sapiens
tttgcttattgttcca

SEQ ID NO: 3982133 - DNA, 17 bp, Homo sapiens
tttgcttattgttccaa

SEQ ID NO: 3982134 - DNA, 13 bp, Homo sapiens
tttgcttcataaa

SEQ ID NO: 3982135 - DNA, 20 bp, Homo sapiens
tttgcttcataaatgaagca

SEQ ID NO: 3982136 - DNA, 20 bp, Homo sapiens
tttgcttcatagtattggag

SEQ ID NO: 3982137 - DNA, 20 bp, Homo sapiens
tttgcttcattgtactacct

SEQ ID NO: 3982138 - DNA, 18 bp, Homo sapiens
tttgcttcccctccagga

SEQ ID NO: 3982139 - DNA, 18 bp, Homo sapiens
tttgcttggtgctggttt

SEQ ID NO: 3982140 - DNA, 19 bp, Homo sapiens
tttgctttttagttttgct

SEQ ID NO: 3982141 - DNA, 14 bp, Homo sapiens
tttgctttttgcta

SEQ ID NO: 3982142 - DNA, 20 bp, Homo sapiens
tttggaaaagtggcgtggga

SEQ ID NO: 3982143 - DNA, 12 bp, Homo sapiens
tttggaaaataa

SEQ ID NO: 3982144 - DNA, 17 bp, Homo sapiens
tttggaaactgctaaat

SEQ ID NO: 3982145 - DNA, 23 bp, Homo sapiens
tttggaaagagcaccctcgagaa

SEQ ID NO: 3982146 - DNA, 21 bp, Homo sapiens
tttggaaagtacactctgctg

SEQ ID NO: 3982147 - DNA, 13 bp, Homo sapiens
tttggaaccttgt

SEQ ID NO: 3982148 - DNA, 20 bp, Homo sapiens
tttggaagaaaaaaatcttc

SEQ ID NO: 3982149 - DNA, 22 bp, Homo sapiens
tttggagaacgccagtctccca

SEQ ID NO: 3982150 - DNA, 13 bp, Homo sapiens
tttggatatatta

SEQ ID NO: 3982151 - DNA, 14 bp, Homo sapiens
tttggatatattat

SEQ ID NO: 3982152 - DNA, 20 bp, Homo sapiens
tttggatatattattgtaag

SEQ ID NO: 3982153 - DNA, 21 bp, Homo sapiens
tttggatcatttttaactgat

SEQ ID NO: 3982154 - DNA, 15 bp, Homo sapiens
tttggatcttgaatg

SEQ ID NO: 3982155 - DNA, 22 bp, Homo sapiens
tttggattggatgaattccaaa

SEQ ID NO: 3982156 - DNA, 16 bp, Homo sapiens
tttggatttgacattg

SEQ ID NO: 3982157 - DNA, 17 bp, Homo sapiens
tttggcctgcactaatt

SEQ ID NO: 3982158 - DNA, 21 bp, Homo sapiens
tttggcctggggtgcatctcc

SEQ ID NO: 3982159 - DNA, 22 bp, Homo sapiens
tttggcctggggtgcatctcct

SEQ ID NO: 3982160 - DNA, 17 bp, Homo sapiens
tttggcgctattacaaa

SEQ ID NO: 3982161 - DNA, 16 bp, Homo sapiens
tttggctagtccttgt

SEQ ID NO: 3982162 - DNA, 18 bp, Homo sapiens
tttggctcctctagtaag

SEQ ID NO: 3982163 - DNA, 23 bp, Homo sapiens
tttggctctcctcagaagaaaga

SEQ ID NO: 3982164 - DNA, 16 bp, Homo sapiens
tttgggagacatgtga

SEQ ID NO: 3982165 - DNA, 21 bp, Homo sapiens
tttgggagacatgtgacattt

SEQ ID NO: 3982166 - DNA, 16 bp, Homo sapiens
tttgggagggaaaagg

SEQ ID NO: 3982167 - DNA, 21 bp, Homo sapiens
tttgggcagcaatttaaatgt

SEQ ID NO: 3982168 - DNA, 15 bp, Homo sapiens
tttgggcccctcaga

SEQ ID NO: 3982169 - DNA, 22 bp, Homo sapiens
tttggggaaaaaagcacataca

SEQ ID NO: 3982170 - DNA, 23 bp, Homo sapiens
tttggggaaaaaagcacatacat

SEQ ID NO: 3982171 - DNA, 20 bp, Homo sapiens
tttggggagcagagacacta

SEQ ID NO: 3982172 - DNA, 23 bp, Homo sapiens
tttggggagggaggggaaatgta

SEQ ID NO: 3982173 - DNA, 16 bp, Homo sapiens
tttggggtctttgtgg

SEQ ID NO: 3982174 - DNA, 22 bp, Homo sapiens
tttgggtatgtttaatctgtta

SEQ ID NO: 3982175 - DNA, 14 bp, Homo sapiens
tttgggttctgcct

SEQ ID NO: 3982176 - DNA, 15 bp, Homo sapiens
tttgggttctgcctg

SEQ ID NO: 3982177 - DNA, 16 bp, Homo sapiens
tttgggttctgcctgc

SEQ ID NO: 3982178 - DNA, 20 bp, Homo sapiens
tttggtaaaatacttcttga

SEQ ID NO: 3982179 - DNA, 18 bp, Homo sapiens
tttggtcgaggagtaaca

SEQ ID NO: 3982180 - DNA, 18 bp, Homo sapiens
tttggtgtggattttcta

SEQ ID NO: 3982181 - DNA, 19 bp, Homo sapiens
tttggtgtgtggagatgca

SEQ ID NO: 3982182 - DNA, 21 bp, Homo sapiens
tttggttcttagttctcactg

SEQ ID NO: 3982183 - DNA, 21 bp, Homo sapiens
tttggtttatattttttcagt

SEQ ID NO: 3982184 - DNA, 21 bp, Homo sapiens
tttgtaaaagaacagtaaaca

SEQ ID NO: 3982185 - DNA, 17 bp, Homo sapiens
tttgtaaataagagatt

SEQ ID NO: 3982186 - DNA, 22 bp, Homo sapiens
tttgtaaataagagatttggag

SEQ ID NO: 3982187 - DNA, 15 bp, Homo sapiens
tttgtaaatactgct

SEQ ID NO: 3982188 - DNA, 11 bp, Homo sapiens
tttgtaaatga

SEQ ID NO: 3982189 - DNA, 18 bp, Homo sapiens
tttgtaaattatttgcta

SEQ ID NO: 3982190 - DNA, 20 bp, Homo sapiens
tttgtaacccagattttgct

SEQ ID NO: 3982191 - DNA, 12 bp, Homo sapiens
tttgtaagagtg

SEQ ID NO: 3982192 - DNA, 16 bp, Homo sapiens
tttgtaagagtgtaga

SEQ ID NO: 3982193 - DNA, 18 bp, Homo sapiens
tttgtaagagtgtagaag

SEQ ID NO: 3982194 - DNA, 19 bp, Homo sapiens
tttgtaagagtgtagaagc

SEQ ID NO: 3982195 - DNA, 22 bp, Homo sapiens
tttgtaagagtgtagaagcatt

SEQ ID NO: 3982196 - DNA, 22 bp, Homo sapiens
tttgtaagtcagtgttgagatg

SEQ ID NO: 3982197 - DNA, 21 bp, Homo sapiens
tttgtaagtttcaggtgacat

SEQ ID NO: 3982198 - DNA, 14 bp, Homo sapiens
tttgtaataaagta

SEQ ID NO: 3982199 - DNA, 13 bp, Homo sapiens
tttgtaatgtgaa

SEQ ID NO: 3982200 - DNA, 14 bp, Homo sapiens
tttgtaattgtgta

SEQ ID NO: 3982201 - DNA, 20 bp, Homo sapiens
tttgtaatttttggggaaaa

SEQ ID NO: 3982202 - DNA, 12 bp, Homo sapiens
tttgtacactgc

SEQ ID NO: 3982203 - DNA, 15 bp, Homo sapiens
tttgtactgaatttt

SEQ ID NO: 3982204 - DNA, 20 bp, Homo sapiens
tttgtacttccacctccacc

SEQ ID NO: 3982205 - DNA, 23 bp, Homo sapiens
tttgtaggaaggtctcattcttc

SEQ ID NO: 3982206 - DNA, 16 bp, Homo sapiens
tttgtagtgaaataat

SEQ ID NO: 3982207 - DNA, 21 bp, Homo sapiens
tttgtatatacagttattttg

SEQ ID NO: 3982208 - DNA, 21 bp, Homo sapiens
tttgtatcttttatcctggga

SEQ ID NO: 3982209 - DNA, 18 bp, Homo sapiens
tttgtatgttatgaacat

SEQ ID NO: 3982210 - DNA, 19 bp, Homo sapiens
tttgtatttattaatttga

SEQ ID NO: 3982211 - DNA, 23 bp, Homo sapiens
tttgtcacaatcctaacacatta

SEQ ID NO: 3982212 - DNA, 14 bp, Homo sapiens
tttgtcagttcttg

SEQ ID NO: 3982213 - DNA, 11 bp, Homo sapiens
tttgtcccaga

SEQ ID NO: 3982214 - DNA, 17 bp, Homo sapiens
tttgtcctaaaacacct

SEQ ID NO: 3982215 - DNA, 12 bp, Homo sapiens
tttgtcctcaaa

SEQ ID NO: 3982216 - DNA, 18 bp, Homo sapiens
tttgtcctcctgctgcca

SEQ ID NO: 3982217 - DNA, 21 bp, Homo sapiens
tttgtcgggcaccagccagcg

SEQ ID NO: 3982218 - DNA, 18 bp, Homo sapiens
tttgtctgtttgtttcaa

SEQ ID NO: 3982219 - DNA, 14 bp, Homo sapiens
tttgtcttatatat

SEQ ID NO: 3982220 - DNA, 19 bp, Homo sapiens
tttgtgaatggattggatt

SEQ ID NO: 3982221 - DNA, 12 bp, Homo sapiens
tttgtgcctttg

SEQ ID NO: 3982222 - DNA, 16 bp, Homo sapiens
tttgtgcctttggcct

SEQ ID NO: 3982223 - DNA, 14 bp, Homo sapiens
tttgtggcctcaga

SEQ ID NO: 3982224 - DNA, 18 bp, Homo sapiens
tttgtgtaaatttctcaa

SEQ ID NO: 3982225 - DNA, 14 bp, Homo sapiens
tttgtgtacagtgt

SEQ ID NO: 3982226 - DNA, 20 bp, Homo sapiens
tttgtgtatctcatttaatt

SEQ ID NO: 3982227 - DNA, 15 bp, Homo sapiens
ttttatcccaaagtt

SEQ ID NO: 3982228 - DNA, 21 bp, Homo sapiens
ttttatgaagtgcgtgaatgt

SEQ ID NO: 3982229 - DNA, 13 bp, Homo sapiens
ttttatgcagata

SEQ ID NO: 3982230 - DNA, 17 bp, Homo sapiens
ttttatggttacttctt

SEQ ID NO: 3982231 - DNA, 15 bp, Homo sapiens
ttttatgtttgaata

SEQ ID NO: 3982232 - DNA, 12 bp, Homo sapiens
tttgtgtcctcc

SEQ ID NO: 3982233 - DNA, 15 bp, Homo sapiens
tttgtgtgtgtgtca

SEQ ID NO: 3982234 - DNA, 22 bp, Homo sapiens
tttgtgttgtaattcttcagtt

SEQ ID NO: 3982235 - DNA, 20 bp, Homo sapiens
tttgtgttgttggaaaaagt

SEQ ID NO: 3982236 - DNA, 13 bp, Homo sapiens
tttgtgtttgctt

SEQ ID NO: 3982237 - DNA, 17 bp, Homo sapiens
tttgtgtttggtttaca

SEQ ID NO: 3982238 - DNA, 21 bp, Homo sapiens
tttacaacttgattttttcaa

SEQ ID NO: 3982239 - DNA, 16 bp, Homo sapiens
tttacaagaagtttat

SEQ ID NO: 3982240 - DNA, 22 bp, Homo sapiens
tttacaagatccatttgccttt

SEQ ID NO: 3982241 - DNA, 17 bp, Homo sapiens
tttacaagcaggcactg

SEQ ID NO: 3982242 - DNA, 17 bp, Homo sapiens
tttacaatattatgaaa

SEQ ID NO: 3982243 - DNA, 20 bp, Homo sapiens
tttacaccgactagccagga

SEQ ID NO: 3982244 - DNA, 22 bp, Homo sapiens
tttacacggagcggattgcaaa

SEQ ID NO: 3982245 - DNA, 21 bp, Homo sapiens
tttacagctcattaaactttt

SEQ ID NO: 3982246 - DNA, 23 bp, Homo sapiens
tttacagctttcatgattagcaa

SEQ ID NO: 3982247 - DNA, 14 bp, Homo sapiens
tttacaggaacttc

SEQ ID NO: 3982248 - DNA, 19 bp, Homo sapiens
tttacaggaacttcatcat

SEQ ID NO: 3982249 - DNA, 13 bp, Homo sapiens
tttacaggccctg

SEQ ID NO: 3982250 - DNA, 19 bp, Homo sapiens
tttacagtgaccttttctt

SEQ ID NO: 3982251 - DNA, 23 bp, Homo sapiens
tttacagtgaccttttcttcatt

SEQ ID NO: 3982252 - DNA, 22 bp, Homo sapiens
tttacagttagggttttgcaat

SEQ ID NO: 3982253 - DNA, 19 bp, Homo sapiens
tttacataactgccttgaa

SEQ ID NO: 3982254 - DNA, 21 bp, Homo sapiens
tttacatgtgtagcctatgtt

SEQ ID NO: 3982255 - DNA, 20 bp, Homo sapiens
tttctttttaattattttaa

SEQ ID NO: 3982256 - DNA, 13 bp, Homo sapiens
tttctttttacat

SEQ ID NO: 3982257 - DNA, 19 bp, Homo sapiens
tttgaaaacttcagaagca

SEQ ID NO: 3982258 - DNA, 14 bp, Homo sapiens
tttgaaaagctatt

SEQ ID NO: 3982259 - DNA, 19 bp, Homo sapiens
tttgaaatagtctgtgtga

SEQ ID NO: 3982260 - DNA, 23 bp, Homo sapiens
tttgaacactggctaaagataat

SEQ ID NO: 3982261 - DNA, 13 bp, Homo sapiens
tttgaaccaataa

SEQ ID NO: 3982262 - DNA, 16 bp, Homo sapiens
tttgaactcagatctg

SEQ ID NO: 3982263 - DNA, 17 bp, Homo sapiens
tttgaactggcaattgt

SEQ ID NO: 3982264 - DNA, 22 bp, Homo sapiens
tttgaactggcaattgtctatt

SEQ ID NO: 3982265 - DNA, 18 bp, Homo sapiens
tttgaagaatatttaaga

SEQ ID NO: 3982266 - DNA, 14 bp, Homo sapiens
tttgaagcctgtgc

SEQ ID NO: 3982267 - DNA, 17 bp, Homo sapiens
tttgaagccttttgttt

SEQ ID NO: 3982268 - DNA, 12 bp, Homo sapiens
tttgaaggcaaa

SEQ ID NO: 3982269 - DNA, 20 bp, Homo sapiens
tttgaagtgtacctgtgtac

SEQ ID NO: 3982270 - DNA, 13 bp, Homo sapiens
tttgaagtttaca

SEQ ID NO: 3982271 - DNA, 15 bp, Homo sapiens
tttgaagtttacatt

SEQ ID NO: 3982272 - DNA, 12 bp, Homo sapiens
tttgaatgaaaa

SEQ ID NO: 3982273 - DNA, 16 bp, Homo sapiens
tttgaatgcttcctga

SEQ ID NO: 3982274 - DNA, 16 bp, Homo sapiens
tttgaatttaaataaa

SEQ ID NO: 3982275 - DNA, 14 bp, Homo sapiens
tttgaatttactgg

SEQ ID NO: 3982276 - DNA, 11 bp, Homo sapiens
tttgaatttct

SEQ ID NO: 3982277 - DNA, 17 bp, Homo sapiens
tttgaattttaaatcta

SEQ ID NO: 3982278 - DNA, 17 bp, Homo sapiens
tttgaattttgttttta

SEQ ID NO: 3982279 - DNA, 13 bp, Homo sapiens
tttgacaactaaa

SEQ ID NO: 3982280 - DNA, 12 bp, Homo sapiens
tttgacactgaa

SEQ ID NO: 3982281 - DNA, 13 bp, Homo sapiens
tttgacactgaaa

SEQ ID NO: 3982282 - DNA, 19 bp, Homo sapiens
tttgacactgaaagttttg

SEQ ID NO: 3982283 - DNA, 14 bp, Homo sapiens
tttgacatttaatt

SEQ ID NO: 3982284 - DNA, 19 bp, Homo sapiens
tttgactagatgatggatg

SEQ ID NO: 3982285 - DNA, 21 bp, Homo sapiens
tttgactagggattcaggctg

SEQ ID NO: 3982286 - DNA, 12 bp, Homo sapiens
tttgactctttt

SEQ ID NO: 3982287 - DNA, 19 bp, Homo sapiens
tttgactgaagatgcagct

SEQ ID NO: 3982288 - DNA, 22 bp, Homo sapiens
tttgactttttttgtatgtgtg

SEQ ID NO: 3982289 - DNA, 19 bp, Homo sapiens
tttgagacagtttcttagc

SEQ ID NO: 3982290 - DNA, 20 bp, Homo sapiens
tttgagacagtttcttagct

SEQ ID NO: 3982291 - DNA, 16 bp, Homo sapiens
tttgagaccagcctgg

SEQ ID NO: 3982292 - DNA, 23 bp, Homo sapiens
tttgagacgcaccatgtgggcac

SEQ ID NO: 3982293 - DNA, 18 bp, Homo sapiens
tttgagagaagccacgct

SEQ ID NO: 3982294 - DNA, 13 bp, Homo sapiens
tttgagagttcta

SEQ ID NO: 3982295 - DNA, 18 bp, Homo sapiens
tttgagggcccagccagg

SEQ ID NO: 3982296 - DNA, 20 bp, Homo sapiens
tttgaggtcaagtaagaaga

SEQ ID NO: 3982297 - DNA, 14 bp, Homo sapiens
tttgagtaatgtga

SEQ ID NO: 3982298 - DNA, 12 bp, Homo sapiens
tttgagttctac

SEQ ID NO: 3982299 - DNA, 16 bp, Homo sapiens
tttgagtttttcctcc

SEQ ID NO: 3982300 - DNA, 20 bp, Homo sapiens
tttgataaaaatttagaaca

SEQ ID NO: 3982301 - DNA, 19 bp, Homo sapiens
tttgataatgttaaatttg

SEQ ID NO: 3982302 - DNA, 23 bp, Homo sapiens
tttgataatgttaaatttgtaag

SEQ ID NO: 3982303 - DNA, 13 bp, Homo sapiens
tttgataattgtt

SEQ ID NO: 3982304 - DNA, 21 bp, Homo sapiens
tttgatacagttttcagaaaa

SEQ ID NO: 3982305 - DNA, 13 bp, Homo sapiens
tttgatacataat

SEQ ID NO: 3982306 - DNA, 14 bp, Homo sapiens
tttgatacataata

SEQ ID NO: 3982307 - DNA, 17 bp, Homo sapiens
tttgatacataataaaa

SEQ ID NO: 3982308 - DNA, 23 bp, Homo sapiens
tttgatacataataaaaaattat

SEQ ID NO: 3982309 - DNA, 19 bp, Homo sapiens
tttgatagggaactgggga

SEQ ID NO: 3982310 - DNA, 17 bp, Homo sapiens
tttgatatttgcattga

SEQ ID NO: 3982311 - DNA, 15 bp, Homo sapiens
tttgattctgtgtgt

SEQ ID NO: 3982312 - DNA, 17 bp, Homo sapiens
tttgatttacagcaagt

SEQ ID NO: 3982313 - DNA, 14 bp, Homo sapiens
tttgatttgtcact

SEQ ID NO: 3982314 - DNA, 15 bp, Homo sapiens
tttgcaaaatcactt

SEQ ID NO: 3982315 - DNA, 13 bp, Homo sapiens
tttgcaacattta

SEQ ID NO: 3982316 - DNA, 17 bp, Homo sapiens
tttgcaataacttctat

SEQ ID NO: 3982317 - DNA, 20 bp, Homo sapiens
tttgcaataacttctatatt

SEQ ID NO: 3982318 - DNA, 13 bp, Homo sapiens
tttgcacctgtcc

SEQ ID NO: 3982319 - DNA, 14 bp, Homo sapiens
tttgcactgagggc

SEQ ID NO: 3982320 - DNA, 22 bp, Homo sapiens
tttgcactgagggccacactat

SEQ ID NO: 3982321 - DNA, 17 bp, Homo sapiens
tttgcattcaaattaag

SEQ ID NO: 3982322 - DNA, 14 bp, Homo sapiens
tttgcattcctaca

SEQ ID NO: 3982323 - DNA, 15 bp, Homo sapiens
tttgcatttatttat

SEQ ID NO: 3982324 - DNA, 12 bp, Homo sapiens
tttgccaaaaaa

SEQ ID NO: 3982325 - DNA, 19 bp, Homo sapiens
tttgccaaaaaaaaaagaa

SEQ ID NO: 3982326 - DNA, 17 bp, Homo sapiens
tttgccaaggcaaaaaa

SEQ ID NO: 3982327 - DNA, 13 bp, Homo sapiens
tttgccacagctt

SEQ ID NO: 3982328 - DNA, 18 bp, Homo sapiens
tttgccactaattttagt

SEQ ID NO: 3982329 - DNA, 21 bp, Homo sapiens
tttgccactaattttagtatt

SEQ ID NO: 3982330 - DNA, 22 bp, Homo sapiens
tttgccactaattttagtattc

SEQ ID NO: 3982331 - DNA, 13 bp, Homo sapiens
tttgccagctgct

SEQ ID NO: 3982332 - DNA, 16 bp, Homo sapiens
tttgccagctgctgct

SEQ ID NO: 3982333 - DNA, 20 bp, Homo sapiens
tttgccagctgctgctggat

SEQ ID NO: 3982334 - DNA, 20 bp, Homo sapiens
tttgccagttttccctggaa

SEQ ID NO: 3982335 - DNA, 13 bp, Homo sapiens
tttgccatacatc

SEQ ID NO: 3982336 - DNA, 15 bp, Homo sapiens
tttgcccttaaggac

SEQ ID NO: 3982337 - DNA, 20 bp, Homo sapiens
tttgcctcttctttgtgcct

SEQ ID NO: 3982338 - DNA, 22 bp, Homo sapiens
tttgcctcttctttgtgccttt

SEQ ID NO: 3982339 - DNA, 20 bp, Homo sapiens
tttgcctcttttctctgtgc

SEQ ID NO: 3982340 - DNA, 18 bp, Homo sapiens
tttgcctggttttgtctt

SEQ ID NO: 3982341 - DNA, 22 bp, Homo sapiens
tttgccttctactccccttaat

SEQ ID NO: 3982342 - DNA, 12 bp, Homo sapiens
tttgcctttaaa

SEQ ID NO: 3982343 - DNA, 15 bp, Homo sapiens
tttgcctttctggga

SEQ ID NO: 3982344 - DNA, 17 bp, Homo sapiens
tttgcgctggtggacca

SEQ ID NO: 3982345 - DNA, 20 bp, Homo sapiens
tttgctaattaactgaaaca

SEQ ID NO: 3982346 - DNA, 17 bp, Homo sapiens
tttgctataatcattag

SEQ ID NO: 3982347 - DNA, 22 bp, Homo sapiens
tttgctataatcattagtttta

SEQ ID NO: 3982348 - DNA, 23 bp, Homo sapiens
tttgctattgacaagtcatttta

SEQ ID NO: 3982349 - DNA, 21 bp, Homo sapiens
ttcataataggtagtttggat

SEQ ID NO: 3982350 - DNA, 15 bp, Homo sapiens
ttcataatcactcta

SEQ ID NO: 3982351 - DNA, 15 bp, Homo sapiens
ttcatacctcagaat

SEQ ID NO: 3982352 - DNA, 18 bp, Homo sapiens
ttcatagagatttgtcta

SEQ ID NO: 3982353 - DNA, 17 bp, Homo sapiens
ttcatagctccttggag

SEQ ID NO: 3982354 - DNA, 19 bp, Homo sapiens
ttcatagggtctcttcagg

SEQ ID NO: 3982355 - DNA, 14 bp, Homo sapiens
ttcatagttcagaa

SEQ ID NO: 3982356 - DNA, 17 bp, Homo sapiens
ttcatagttcagaattt

SEQ ID NO: 3982357 - DNA, 20 bp, Homo sapiens
ttcatagttcagaatttagt

SEQ ID NO: 3982358 - DNA, 12 bp, Homo sapiens
ttcatagtttat

SEQ ID NO: 3982359 - DNA, 20 bp, Homo sapiens
ttcatatgtaccatgtacat

SEQ ID NO: 3982360 - DNA, 23 bp, Homo sapiens
ttcatattgttgcattgcttttt

SEQ ID NO: 3982361 - DNA, 20 bp, Homo sapiens
ttcatcaatatccctcttgt

SEQ ID NO: 3982362 - DNA, 13 bp, Homo sapiens
ttcatcactggga

SEQ ID NO: 3982363 - DNA, 22 bp, Homo sapiens
ttcatcattgtttctgcatgaa

SEQ ID NO: 3982364 - DNA, 19 bp, Homo sapiens
ttcatcccaactgtctttt

SEQ ID NO: 3982365 - DNA, 16 bp, Homo sapiens
ttcatcccttctcttc

SEQ ID NO: 3982366 - DNA, 18 bp, Homo sapiens
ttcatcccttctcttcca

SEQ ID NO: 3982367 - DNA, 17 bp, Homo sapiens
ttcatctaccttttctg

SEQ ID NO: 3982368 - DNA, 19 bp, Homo sapiens
ttcatctaccttttctggc

SEQ ID NO: 3982369 - DNA, 20 bp, Homo sapiens
ttcatcttcctgtgtcctga

SEQ ID NO: 3982370 - DNA, 22 bp, Homo sapiens
ttcatcttttgaggcttctgtt

SEQ ID NO: 3982371 - DNA, 22 bp, Homo sapiens
ttcatgaaaatagctctttcag

SEQ ID NO: 3982372 - DNA, 17 bp, Homo sapiens
ttcatgcctttcatagt

SEQ ID NO: 3982373 - DNA, 20 bp, Homo sapiens
ttcatgcctttcatagttta

SEQ ID NO: 3982374 - DNA, 14 bp, Homo sapiens
ttcatgcctttgta

SEQ ID NO: 3982375 - DNA, 14 bp, Homo sapiens
ttcatgctcagccc

SEQ ID NO: 3982376 - DNA, 22 bp, Homo sapiens
ttcatggaatggacatcctgta

SEQ ID NO: 3982377 - DNA, 21 bp, Homo sapiens
ttcatgtacaagatgaaggag

SEQ ID NO: 3982378 - DNA, 13 bp, Homo sapiens
ttcatgtgcctct

SEQ ID NO: 3982379 - DNA, 16 bp, Homo sapiens
ttcatgttcactgtga

SEQ ID NO: 3982380 - DNA, 14 bp, Homo sapiens
ttcatgtttgcttc

SEQ ID NO: 3982381 - DNA, 13 bp, Homo sapiens
ttcattaaacttg

SEQ ID NO: 3982382 - DNA, 14 bp, Homo sapiens
ttcattaaacttga

SEQ ID NO: 3982383 - DNA, 15 bp, Homo sapiens
ttcattaaacttgaa

SEQ ID NO: 3982384 - DNA, 13 bp, Homo sapiens
ttcattaaagcat

SEQ ID NO: 3982385 - DNA, 16 bp, Homo sapiens
ttcattaattctataa

SEQ ID NO: 3982386 - DNA, 21 bp, Homo sapiens
ttcattacttgattaagattt

SEQ ID NO: 3982387 - DNA, 14 bp, Homo sapiens
ttcattagctgtga

SEQ ID NO: 3982388 - DNA, 22 bp, Homo sapiens
ttcattatagacaacgatgaat

SEQ ID NO: 3982389 - DNA, 13 bp, Homo sapiens
ttcattattctct

SEQ ID NO: 3982390 - DNA, 17 bp, Homo sapiens
ttcattattggaattaa

SEQ ID NO: 3982391 - DNA, 14 bp, Homo sapiens
ttcattattttgtg

SEQ ID NO: 3982392 - DNA, 15 bp, Homo sapiens
ttcattcaatattga

SEQ ID NO: 3982393 - DNA, 17 bp, Homo sapiens
ttcattcaatattgaca

SEQ ID NO: 3982394 - DNA, 18 bp, Homo sapiens
ttcattcaatattgacat

SEQ ID NO: 3982395 - DNA, 12 bp, Homo sapiens
ttcattcatccc

SEQ ID NO: 3982396 - DNA, 20 bp, Homo sapiens
ttctaacaaaaaaatatatt

SEQ ID NO: 3982397 - DNA, 18 bp, Homo sapiens
ttctaaccccctctgctc

SEQ ID NO: 3982398 - DNA, 21 bp, Homo sapiens
ttctaaccttgaatgctgcca

SEQ ID NO: 3982399 - DNA, 18 bp, Homo sapiens
ttctaagagaagttattt

SEQ ID NO: 3982400 - DNA, 15 bp, Homo sapiens
ttctaataaaacaaa

SEQ ID NO: 3982401 - DNA, 14 bp, Homo sapiens
ttctaatagaactc

SEQ ID NO: 3982402 - DNA, 13 bp, Homo sapiens
ttctaatatcatt

SEQ ID NO: 3982403 - DNA, 14 bp, Homo sapiens
ttctaatttatatt

SEQ ID NO: 3982404 - DNA, 21 bp, Homo sapiens
ttctaatttcaaaaatataac

SEQ ID NO: 3982405 - DNA, 17 bp, Homo sapiens
ttctaattttggatgga

SEQ ID NO: 3982406 - DNA, 23 bp, Homo sapiens
ttctacaaccagagccccccaca

SEQ ID NO: 3982407 - DNA, 12 bp, Homo sapiens
ttctacaattaa

SEQ ID NO: 3982408 - DNA, 15 bp, Homo sapiens
ttctacatgactggg

SEQ ID NO: 3982409 - DNA, 22 bp, Homo sapiens
ttctacatgactgggcctccct

SEQ ID NO: 3982410 - DNA, 14 bp, Homo sapiens
ttctacatggcttt

SEQ ID NO: 3982411 - DNA, 10 bp, Homo sapiens
ttctactgta

SEQ ID NO: 3982412 - DNA, 21 bp, Homo sapiens
ttctagaaacaaacatctaat

SEQ ID NO: 3982413 - DNA, 12 bp, Homo sapiens
ttctagaaccac

SEQ ID NO: 3982414 - DNA, 14 bp, Homo sapiens
ttctagaaccactt

SEQ ID NO: 3982415 - DNA, 21 bp, Homo sapiens
ttctagaatttatcacacttc

SEQ ID NO: 3982416 - DNA, 17 bp, Homo sapiens
ttctagctagaaatatg

SEQ ID NO: 3982417 - DNA, 19 bp, Homo sapiens
ttctagctctatttacttc

SEQ ID NO: 3982418 - DNA, 21 bp, Homo sapiens
ttctagctgttgagctgtttt

SEQ ID NO: 3982419 - DNA, 18 bp, Homo sapiens
ttctaggggagaagagcc

SEQ ID NO: 3982420 - DNA, 22 bp, Homo sapiens
ttctaggggagaagagccctgg

SEQ ID NO: 3982421 - DNA, 15 bp, Homo sapiens
ttctagtggtctttg

SEQ ID NO: 3982422 - DNA, 21 bp, Homo sapiens
ttctataaggccataaaacag

SEQ ID NO: 3982423 - DNA, 12 bp, Homo sapiens
ttctatatgaat

SEQ ID NO: 3982424 - DNA, 20 bp, Homo sapiens
ttctatatgaatttaaatat

SEQ ID NO: 3982425 - DNA, 15 bp, Homo sapiens
ttctatattttaata

SEQ ID NO: 3982426 - DNA, 14 bp, Homo sapiens
ttctatcaagccca

SEQ ID NO: 3982427 - DNA, 14 bp, Homo sapiens
ttctatcacatatt

SEQ ID NO: 3982428 - DNA, 23 bp, Homo sapiens
ttctatcagtacttttattaata

SEQ ID NO: 3982429 - DNA, 18 bp, Homo sapiens
ttctatccccaatcagct

SEQ ID NO: 3982430 - DNA, 15 bp, Homo sapiens
ttctatgttaaatac

SEQ ID NO: 3982431 - DNA, 16 bp, Homo sapiens
ttctatgttaaatact

SEQ ID NO: 3982432 - DNA, 18 bp, Homo sapiens
ttctatgttaaatactgt

SEQ ID NO: 3982433 - DNA, 23 bp, Homo sapiens
ttctatgttaaatactgtgcaga

SEQ ID NO: 3982434 - DNA, 20 bp, Homo sapiens
ttctattacattttcagtga

SEQ ID NO: 3982435 - DNA, 19 bp, Homo sapiens
ttctattatggaaaactgt

SEQ ID NO: 3982436 - DNA, 19 bp, Homo sapiens
ttctattgccttctttgaa

SEQ ID NO: 3982437 - DNA, 21 bp, Homo sapiens
ttctattgccttctttgaaga

SEQ ID NO: 3982438 - DNA, 17 bp, Homo sapiens
ttctattgtattatttg

SEQ ID NO: 3982439 - DNA, 14 bp, Homo sapiens
ttctattgttactc

SEQ ID NO: 3982440 - DNA, 19 bp, Homo sapiens
ttctattgttactctggtt

SEQ ID NO: 3982441 - DNA, 14 bp, Homo sapiens
ttctatttttatca

SEQ ID NO: 3982442 - DNA, 15 bp, Homo sapiens
ttctcaaaagcattt

SEQ ID NO: 3982443 - DNA, 21 bp, Homo sapiens
ttctcaaaagcatttatcatt

SEQ ID NO: 3982444 - DNA, 17 bp, Homo sapiens
ttctcaaagttttgaaa

SEQ ID NO: 3982445 - DNA, 22 bp, Homo sapiens
ttctcaaagttttgaaaagcta

SEQ ID NO: 3982446 - DNA, 12 bp, Homo sapiens
ttctcaaatctt

SEQ ID NO: 3982447 - DNA, 14 bp, Homo sapiens
ttctcacagtgtgg

SEQ ID NO: 3982448 - DNA, 16 bp, Homo sapiens
ttctcacatccctcta

SEQ ID NO: 3982449 - DNA, 20 bp, Homo sapiens
ttctcacatccctctaaaag

SEQ ID NO: 3982450 - DNA, 13 bp, Homo sapiens
ttctcaccagctg

SEQ ID NO: 3982451 - DNA, 12 bp, Homo sapiens
ttctcaccagga

SEQ ID NO: 3982452 - DNA, 18 bp, Homo sapiens
ttctcacttcaattaatg

SEQ ID NO: 3982453 - DNA, 13 bp, Homo sapiens
ttctcagaagcac

SEQ ID NO: 3982454 - DNA, 21 bp, Homo sapiens
ttctcagaagcacagaatatt

SEQ ID NO: 3982455 - DNA, 13 bp, Homo sapiens
ttctcagaatctc

SEQ ID NO: 3982456 - DNA, 16 bp, Homo sapiens
ttctcagagcatgtgt

SEQ ID NO: 3982457 - DNA, 15 bp, Homo sapiens
ttctcagagccaagt

SEQ ID NO: 3982458 - DNA, 14 bp, Homo sapiens
ttctcagatattta

SEQ ID NO: 3982459 - DNA, 15 bp, Homo sapiens
ttctcagatatttat

SEQ ID NO: 3982460 - DNA, 16 bp, Homo sapiens
ttctcagccacaaacc

SEQ ID NO: 3982461 - DNA, 18 bp, Homo sapiens
ttctcaggaagagctatg

SEQ ID NO: 3982462 - DNA, 20 bp, Homo sapiens
tgtggatcttgccacatttc

SEQ ID NO: 3982463 - DNA, 16 bp, Homo sapiens
tgtggatcttttcatt

SEQ ID NO: 3982464 - DNA, 21 bp, Homo sapiens
tgtggatgcctgtggaagagt

SEQ ID NO: 3982465 - DNA, 15 bp, Homo sapiens
tgtggcagagagaga

SEQ ID NO: 3982466 - DNA, 13 bp, Homo sapiens
tgtggcagggggc

SEQ ID NO: 3982467 - DNA, 20 bp, Homo sapiens
tgtggcagggggccccgcca

SEQ ID NO: 3982468 - DNA, 19 bp, Homo sapiens
tgtggcagtcccttataat

SEQ ID NO: 3982469 - DNA, 15 bp, Homo sapiens
tgtggcagtggtttt

SEQ ID NO: 3982470 - DNA, 22 bp, Homo sapiens
tgtggccctggccactaaagct

SEQ ID NO: 3982471 - DNA, 13 bp, Homo sapiens
tgtggcctcagaa

SEQ ID NO: 3982472 - DNA, 15 bp, Homo sapiens
tgtggcctcagccct

SEQ ID NO: 3982473 - DNA, 16 bp, Homo sapiens
tgtggcctcagccctc

SEQ ID NO: 3982474 - DNA, 14 bp, Homo sapiens
tgtggcctgccagt

SEQ ID NO: 3982475 - DNA, 16 bp, Homo sapiens
tgtggctagtgacaaa

SEQ ID NO: 3982476 - DNA, 20 bp, Homo sapiens
tgtggctccacacacacaaa

SEQ ID NO: 3982477 - DNA, 14 bp, Homo sapiens
tgtggctccttccc

SEQ ID NO: 3982478 - DNA, 21 bp, Homo sapiens
tgtggctgaggaggcctccat

SEQ ID NO: 3982479 - DNA, 22 bp, Homo sapiens
tgtggctgaggaggcctccatc

SEQ ID NO: 3982480 - DNA, 18 bp, Homo sapiens
tgtggctgggggcaggag

SEQ ID NO: 3982481 - DNA, 20 bp, Homo sapiens
tgtggctgtagatcccaaga

SEQ ID NO: 3982482 - DNA, 11 bp, Homo sapiens
tgtggctttcc

SEQ ID NO: 3982483 - DNA, 17 bp, Homo sapiens
tgtggctttctttcttt

SEQ ID NO: 3982484 - DNA, 12 bp, Homo sapiens
tgtggctttgtt

SEQ ID NO: 3982485 - DNA, 14 bp, Homo sapiens
tgtgggcactggcc

SEQ ID NO: 3982486 - DNA, 18 bp, Homo sapiens
tgtgggcactggcccagg

SEQ ID NO: 3982487 - DNA, 13 bp, Homo sapiens
tgtgggcagcacc

SEQ ID NO: 3982488 - DNA, 14 bp, Homo sapiens
tgtgggcagcaccc

SEQ ID NO: 3982489 - DNA, 15 bp, Homo sapiens
tgtgggcagcaccct

SEQ ID NO: 3982490 - DNA, 15 bp, Homo sapiens
tgtgggcccctcaac

SEQ ID NO: 3982491 - DNA, 19 bp, Homo sapiens
tgtgggcccctcaacagcc

SEQ ID NO: 3982492 - DNA, 16 bp, Homo sapiens
tgtgggcgctgcttcc

SEQ ID NO: 3982493 - DNA, 13 bp, Homo sapiens
tgtgggctgtgag

SEQ ID NO: 3982494 - DNA, 16 bp, Homo sapiens
tgtggggattttcact

SEQ ID NO: 3982495 - DNA, 15 bp, Homo sapiens
tgtggggccaggtca

SEQ ID NO: 3982496 - DNA, 21 bp, Homo sapiens
tgtgggggaggcgcacagtgt

SEQ ID NO: 3982497 - DNA, 18 bp, Homo sapiens
tgtggggggctgggggag

SEQ ID NO: 3982498 - DNA, 13 bp, Homo sapiens
tgtgggtgagcca

SEQ ID NO: 3982499 - DNA, 13 bp, Homo sapiens
tgtgggtgtcctg

SEQ ID NO: 3982500 - DNA, 15 bp, Homo sapiens
tgtgggtgtcctgcc

SEQ ID NO: 3982501 - DNA, 23 bp, Homo sapiens
tgtgggtgtcctgcctgtctgcc

SEQ ID NO: 3982502 - DNA, 18 bp, Homo sapiens
tgtgggtgttctttcctg

SEQ ID NO: 3982503 - DNA, 22 bp, Homo sapiens
tgtgggtgttctttcctgccct

SEQ ID NO: 3982504 - DNA, 23 bp, Homo sapiens
tgtggtccatgcccactgctggt

SEQ ID NO: 3982505 - DNA, 12 bp, Homo sapiens
tgtggtgagggg

SEQ ID NO: 3982506 - DNA, 20 bp, Homo sapiens
tgtggtgaggggctttctct

SEQ ID NO: 3982507 - DNA, 23 bp, Homo sapiens
tgtggtgaggggctttctcttcc

SEQ ID NO: 3982508 - DNA, 15 bp, Homo sapiens
tgtggtgcctgaggt

SEQ ID NO: 3982509 - DNA, 17 bp, Homo sapiens
tgtggtgtaaagctggc

SEQ ID NO: 3982510 - DNA, 18 bp, Homo sapiens
tgtggtgtaaagctggcc

SEQ ID NO: 3982511 - DNA, 15 bp, Homo sapiens
tgtggtgtagactgt

SEQ ID NO: 3982512 - DNA, 13 bp, Homo sapiens
tgtggttctattt

SEQ ID NO: 3982513 - DNA, 18 bp, Homo sapiens
tgtggttctattttactt

SEQ ID NO: 3982514 - DNA, 14 bp, Homo sapiens
tgtgtaaaatgtga

SEQ ID NO: 3982515 - DNA, 14 bp, Homo sapiens
tgtgtaattcaaaa

SEQ ID NO: 3982516 - DNA, 19 bp, Homo sapiens
tgtgtacagtgtgtaaagt

SEQ ID NO: 3982517 - DNA, 18 bp, Homo sapiens
tgtgtacataactctgta

SEQ ID NO: 3982518 - DNA, 22 bp, Homo sapiens
tgtgtactcactgaagcctgcg

SEQ ID NO: 3982519 - DNA, 13 bp, Homo sapiens
tgtgtagagttaa

SEQ ID NO: 3982520 - DNA, 19 bp, Homo sapiens
tgtgtagagttaagaagct

SEQ ID NO: 3982521 - DNA, 21 bp, Homo sapiens
tgtgtagagttaagaagctgt

SEQ ID NO: 3982522 - DNA, 14 bp, Homo sapiens
tgtgtagcctatgt

SEQ ID NO: 3982523 - DNA, 17 bp, Homo sapiens
tgtgtatctctttcaca

SEQ ID NO: 3982524 - DNA, 13 bp, Homo sapiens
tgtgtattgttcc

SEQ ID NO: 3982525 - DNA, 15 bp, Homo sapiens
tgtgtattgttccca

SEQ ID NO: 3982526 - DNA, 23 bp, Homo sapiens
tgtgtatttcagttattgtccct

SEQ ID NO: 3982527 - DNA, 17 bp, Homo sapiens
tgtgtcacagttcttgg

SEQ ID NO: 3982528 - DNA, 22 bp, Homo sapiens
tgtgtcacttgtgctttgctct

SEQ ID NO: 3982529 - DNA, 14 bp, Homo sapiens
tgtgtcagctgagg

SEQ ID NO: 3982530 - DNA, 13 bp, Homo sapiens
tgtgtcatttctt

SEQ ID NO: 3982531 - DNA, 11 bp, Homo sapiens
ttccagagcat

SEQ ID NO: 3982532 - DNA, 15 bp, Homo sapiens
ttccagagctgccag

SEQ ID NO: 3982533 - DNA, 13 bp, Homo sapiens
ttccagcaataag

SEQ ID NO: 3982534 - DNA, 17 bp, Homo sapiens
ttccagcaataagaaat

SEQ ID NO: 3982535 - DNA, 22 bp, Homo sapiens
ttccagcaataagaaatgaaca

SEQ ID NO: 3982536 - DNA, 23 bp, Homo sapiens
ttccagcaataagaaatgaacaa

SEQ ID NO: 3982537 - DNA, 20 bp, Homo sapiens
ttccagcccatccaaacact

SEQ ID NO: 3982538 - DNA, 22 bp, Homo sapiens
ttccagctgctgtcttctggac

SEQ ID NO: 3982539 - DNA, 13 bp, Homo sapiens
ttccagcttcagg

SEQ ID NO: 3982540 - DNA, 14 bp, Homo sapiens
ttccagcttcaggc

SEQ ID NO: 3982541 - DNA, 16 bp, Homo sapiens
ttccagcttcaggcac

SEQ ID NO: 3982542 - DNA, 22 bp, Homo sapiens
ttccaggaaactccacatctgc

SEQ ID NO: 3982543 - DNA, 21 bp, Homo sapiens
ttccaggcaccctcagggagc

SEQ ID NO: 3982544 - DNA, 15 bp, Homo sapiens
ttccaggggaacctg

SEQ ID NO: 3982545 - DNA, 17 bp, Homo sapiens
ttccaggggaacctgcc

SEQ ID NO: 3982546 - DNA, 19 bp, Homo sapiens
ttccaggtatctccaggat

SEQ ID NO: 3982547 - DNA, 17 bp, Homo sapiens
ttccagtacctttgtca

SEQ ID NO: 3982548 - DNA, 19 bp, Homo sapiens
ttccagtctcaaaaataca

SEQ ID NO: 3982549 - DNA, 11 bp, Homo sapiens
ttccagtgcta

SEQ ID NO: 3982550 - DNA, 17 bp, Homo sapiens
ttccagttactttccaa

SEQ ID NO: 3982551 - DNA, 13 bp, Homo sapiens
ttccataattatg

SEQ ID NO: 3982552 - DNA, 16 bp, Homo sapiens
ttccataattatgaca

SEQ ID NO: 3982553 - DNA, 15 bp, Homo sapiens
ttccatacagctcta

SEQ ID NO: 3982554 - DNA, 12 bp, Homo sapiens
ttccatatttgg

SEQ ID NO: 3982555 - DNA, 19 bp, Homo sapiens
ttccatcattttacagtga

SEQ ID NO: 3982556 - DNA, 23 bp, Homo sapiens
ttccatccataaatccagttcta

SEQ ID NO: 3982557 - DNA, 21 bp, Homo sapiens
ttccatccctaccccctaaga

SEQ ID NO: 3982558 - DNA, 18 bp, Homo sapiens
ttccatgaagaccacatc

SEQ ID NO: 3982559 - DNA, 17 bp, Homo sapiens
ttccatgattctattta

SEQ ID NO: 3982560 - DNA, 22 bp, Homo sapiens
ttccatgcaactggagttcctt

SEQ ID NO: 3982561 - DNA, 23 bp, Homo sapiens
ttccatgcaactggagttcctta

SEQ ID NO: 3982562 - DNA, 16 bp, Homo sapiens
ttccatgcctgagggt

SEQ ID NO: 3982563 - DNA, 18 bp, Homo sapiens
ttccatgcctgagggtgg

SEQ ID NO: 3982564 - DNA, 23 bp, Homo sapiens
ttccatgcctgagggtggagact

SEQ ID NO: 3982565 - DNA, 17 bp, Homo sapiens
ttccatgtatcttttga

SEQ ID NO: 3982566 - DNA, 15 bp, Homo sapiens
ttccatgtgcctttc

SEQ ID NO: 3982567 - DNA, 17 bp, Homo sapiens
ttccatgtgcctttctt

SEQ ID NO: 3982568 - DNA, 14 bp, Homo sapiens
ttccattatgattc

SEQ ID NO: 3982569 - DNA, 16 bp, Homo sapiens
ttccatttcttcctca

SEQ ID NO: 3982570 - DNA, 14 bp, Homo sapiens
ttcccaacagcctt

SEQ ID NO: 3982571 - DNA, 12 bp, Homo sapiens
ttcccaataaaa

SEQ ID NO: 3982572 - DNA, 18 bp, Homo sapiens
ttcccacatctttcctca

SEQ ID NO: 3982573 - DNA, 15 bp, Homo sapiens
ttcccacatgcctgc

SEQ ID NO: 3982574 - DNA, 15 bp, Homo sapiens
ttcccacccagcctg

SEQ ID NO: 3982575 - DNA, 16 bp, Homo sapiens
ttcccacccctacaca

SEQ ID NO: 3982576 - DNA, 18 bp, Homo sapiens
ttcccacccctacacaca

SEQ ID NO: 3982577 - DNA, 23 bp, Homo sapiens
ttcccagtgacacttcagagagc

SEQ ID NO: 3982578 - DNA, 19 bp, Homo sapiens
ttcccatgactgcacccag

SEQ ID NO: 3982579 - DNA, 18 bp, Homo sapiens
ttcccatttctctacact

SEQ ID NO: 3982580 - DNA, 13 bp, Homo sapiens
ttcccatttcttc

SEQ ID NO: 3982581 - DNA, 15 bp, Homo sapiens
ttcccatttcttccc

SEQ ID NO: 3982582 - DNA, 17 bp, Homo sapiens
ttcccattttgcaaaat

SEQ ID NO: 3982583 - DNA, 13 bp, Homo sapiens
ttcccattttgga

SEQ ID NO: 3982584 - DNA, 21 bp, Homo sapiens
ttccccaccctccccttccca

SEQ ID NO: 3982585 - DNA, 15 bp, Homo sapiens
ttccccactcccccg

SEQ ID NO: 3982586 - DNA, 17 bp, Homo sapiens
ttccccactgacagcct

SEQ ID NO: 3982587 - DNA, 11 bp, Homo sapiens
ttccccagaga

SEQ ID NO: 3982588 - DNA, 12 bp, Homo sapiens
ttccccagagaa

SEQ ID NO: 3982589 - DNA, 19 bp, Homo sapiens
ttccccagctttgctgcct

SEQ ID NO: 3982590 - DNA, 17 bp, Homo sapiens
ttccccaggtgtgtgct

SEQ ID NO: 3982591 - DNA, 15 bp, Homo sapiens
ttcccccaccagctg

SEQ ID NO: 3982592 - DNA, 13 bp, Homo sapiens
ttcccccagccca

SEQ ID NO: 3982593 - DNA, 21 bp, Homo sapiens
ttcccccgagctcttggcctt

SEQ ID NO: 3982594 - DNA, 19 bp, Homo sapiens
ttccccctccaatcccacc

SEQ ID NO: 3982595 - DNA, 14 bp, Homo sapiens
ttccccctttcttc

SEQ ID NO: 3982596 - DNA, 15 bp, Homo sapiens
ttccccctttcttcc

SEQ ID NO: 3982597 - DNA, 19 bp, Homo sapiens
ttcccccttttctgcattt

SEQ ID NO: 3982598 - DNA, 16 bp, Homo sapiens
ttcccctccctggctc

SEQ ID NO: 3982599 - DNA, 15 bp, Homo sapiens
ttcccctgtgtcatc

SEQ ID NO: 3982600 - DNA, 14 bp, Homo sapiens
ttccccttccctta

SEQ ID NO: 3982601 - DNA, 14 bp, Homo sapiens
ttccccttccttct

SEQ ID NO: 3982602 - DNA, 12 bp, Homo sapiens
ttcccgcctccc

SEQ ID NO: 3982603 - DNA, 22 bp, Homo sapiens
ttcccgcgggttccgcaggcag

SEQ ID NO: 3982604 - DNA, 21 bp, Homo sapiens
ttcccgctcagccctccctgc

SEQ ID NO: 3982605 - DNA, 17 bp, Homo sapiens
ttcccgggccagggctg

SEQ ID NO: 3982606 - DNA, 13 bp, Homo sapiens
ttccctacctcag

SEQ ID NO: 3982607 - DNA, 14 bp, Homo sapiens
ttccctacctcagg

SEQ ID NO: 3982608 - DNA, 14 bp, Homo sapiens
ttccctcaccccca

SEQ ID NO: 3982609 - DNA, 12 bp, Homo sapiens
ttccctccattt

SEQ ID NO: 3982610 - DNA, 16 bp, Homo sapiens
ttccctccctgctgtc

SEQ ID NO: 3982611 - DNA, 21 bp, Homo sapiens
ttccctcctagctctcccagt

SEQ ID NO: 3982612 - DNA, 14 bp, Homo sapiens
ttccctctcatctc

SEQ ID NO: 3982613 - DNA, 12 bp, Homo sapiens
ttccctctctga

SEQ ID NO: 3982614 - DNA, 21 bp, Homo sapiens
ttccctctctgatgtcccagt

SEQ ID NO: 3982615 - DNA, 24 bp, Homo sapiens
ttccctcttctaacccaactgact

SEQ ID NO: 3982616 - DNA, 21 bp, Homo sapiens
ttccctgaatctgtgcctgca

SEQ ID NO: 3982617 - DNA, 18 bp, Homo sapiens
ttccctgactcctctaag

SEQ ID NO: 3982618 - DNA, 17 bp, Homo sapiens
ttccctgacttgcttta

SEQ ID NO: 3982619 - DNA, 19 bp, Homo sapiens
ttccctgattgacctgctc

SEQ ID NO: 3982620 - DNA, 23 bp, Homo sapiens
ttccctgcagacctcaagccatc

SEQ ID NO: 3982621 - DNA, 19 bp, Homo sapiens
ttccctgcatttctgagtt

SEQ ID NO: 3982622 - DNA, 19 bp, Homo sapiens
ttccctgcgcctgtgatgc

SEQ ID NO: 3982623 - DNA, 17 bp, Homo sapiens
ttccctgttcttcctcc

SEQ ID NO: 3982624 - DNA, 14 bp, Homo sapiens
ttcccttagtgact

SEQ ID NO: 3982625 - DNA, 22 bp, Homo sapiens
ttcccttcagtaccctctcagc

SEQ ID NO: 3982626 - DNA, 23 bp, Homo sapiens
ttcccttcagtaccctctcagct

SEQ ID NO: 3982627 - DNA, 20 bp, Homo sapiens
ttcccttgcaggggtccccc

SEQ ID NO: 3982628 - DNA, 14 bp, Homo sapiens
ttcccttggcctca

SEQ ID NO: 3982629 - DNA, 15 bp, Homo sapiens
ttccctttgtgcaca

SEQ ID NO: 3982630 - DNA, 14 bp, Homo sapiens
ttcccttttctgtt

SEQ ID NO: 3982631 - DNA, 20 bp, Homo sapiens
ttccgagatccccagggcag

SEQ ID NO: 3982632 - DNA, 13 bp, Homo sapiens
ttccgcactttcc

SEQ ID NO: 3982633 - DNA, 19 bp, Homo sapiens
ttccggtagggaggcagcc

SEQ ID NO: 3982634 - DNA, 21 bp, Homo sapiens
ttccggtagggaggcagcctc

SEQ ID NO: 3982635 - DNA, 21 bp, Homo sapiens
ttctgggagcagaaacagcca

SEQ ID NO: 3982636 - DNA, 15 bp, Homo sapiens
ttctgggcctgacca

SEQ ID NO: 3982637 - DNA, 13 bp, Homo sapiens
ttctgggctcttt

SEQ ID NO: 3982638 - DNA, 15 bp, Homo sapiens
ttctgggggaaaaag

SEQ ID NO: 3982639 - DNA, 16 bp, Homo sapiens
ttctgggggaaaaagc

SEQ ID NO: 3982640 - DNA, 17 bp, Homo sapiens
ttctggtagatagaaat

SEQ ID NO: 3982641 - DNA, 18 bp, Homo sapiens
ttctggtagatagaaata

SEQ ID NO: 3982642 - DNA, 19 bp, Homo sapiens
ttctggtgttgactggact

SEQ ID NO: 3982643 - DNA, 14 bp, Homo sapiens
ttctggttgatttg

SEQ ID NO: 3982644 - DNA, 13 bp, Homo sapiens
ttctgtaaataac

SEQ ID NO: 3982645 - DNA, 15 bp, Homo sapiens
ttctgtaaataacct

SEQ ID NO: 3982646 - DNA, 20 bp, Homo sapiens
ttctgtaaggtcttacattg

SEQ ID NO: 3982647 - DNA, 16 bp, Homo sapiens
ttctgtaggttctgtg

SEQ ID NO: 3982648 - DNA, 20 bp, Homo sapiens
ttctgtagtcatttactaaa

SEQ ID NO: 3982649 - DNA, 22 bp, Homo sapiens
ttctgtagtcatttactaaaca

SEQ ID NO: 3982650 - DNA, 16 bp, Homo sapiens
ttctgtcagtgttaaa

SEQ ID NO: 3982651 - DNA, 22 bp, Homo sapiens
ttctgtccccagccctgtcctg

SEQ ID NO: 3982652 - DNA, 16 bp, Homo sapiens
ttctgtgaaatataat

SEQ ID NO: 3982653 - DNA, 20 bp, Homo sapiens
ttctgtgaaatataattgta

SEQ ID NO: 3982654 - DNA, 13 bp, Homo sapiens
ttctgtgaagagg

SEQ ID NO: 3982655 - DNA, 17 bp, Homo sapiens
ttctgtgatcatttatt

SEQ ID NO: 3982656 - DNA, 16 bp, Homo sapiens
ttctgtgccctactca

SEQ ID NO: 3982657 - DNA, 16 bp, Homo sapiens
ttctgtggctcacaga

SEQ ID NO: 3982658 - DNA, 14 bp, Homo sapiens
ttctgtggctggct

SEQ ID NO: 3982659 - DNA, 23 bp, Homo sapiens
ttctgtggctggctctaccttcc

SEQ ID NO: 3982660 - DNA, 22 bp, Homo sapiens
ttctgtgggtccgataatatct

SEQ ID NO: 3982661 - DNA, 16 bp, Homo sapiens
ttctgtggttcctctg

SEQ ID NO: 3982662 - DNA, 21 bp, Homo sapiens
ttctgtggttcctctgctcac

SEQ ID NO: 3982663 - DNA, 22 bp, Homo sapiens
ttctgtgtctttcacagctcct

SEQ ID NO: 3982664 - DNA, 20 bp, Homo sapiens
ttctgtgtgttttcataata

SEQ ID NO: 3982665 - DNA, 14 bp, Homo sapiens
ttctgtgtttacag

SEQ ID NO: 3982666 - DNA, 15 bp, Homo sapiens
ttctgttaaaatcta

SEQ ID NO: 3982667 - DNA, 19 bp, Homo sapiens
ttctgttccaaattcagtt

SEQ ID NO: 3982668 - DNA, 11 bp, Homo sapiens
ttgaaagtgtt

SEQ ID NO: 3982669 - DNA, 14 bp, Homo sapiens
ttgaaataaagcta

SEQ ID NO: 3982670 - DNA, 18 bp, Homo sapiens
ttgaaattatgtatgttt

SEQ ID NO: 3982671 - DNA, 13 bp, Homo sapiens
ttgaaattgtgaa

SEQ ID NO: 3982672 - DNA, 21 bp, Homo sapiens
ttgaaatttttattaaattat

SEQ ID NO: 3982673 - DNA, 15 bp, Homo sapiens
ttgaacacaaactgt

SEQ ID NO: 3982674 - DNA, 20 bp, Homo sapiens
ttgaacactggctaaagata

SEQ ID NO: 3982675 - DNA, 16 bp, Homo sapiens
ttgaaccatccactta

SEQ ID NO: 3982676 - DNA, 20 bp, Homo sapiens
ttgaacctttttttttgaaa

SEQ ID NO: 3982677 - DNA, 13 bp, Homo sapiens
ttgaactccaaga

SEQ ID NO: 3982678 - DNA, 13 bp, Homo sapiens
ttgaacttttgta

SEQ ID NO: 3982679 - DNA, 19 bp, Homo sapiens
ttgaagaaaggaacctggg

SEQ ID NO: 3982680 - DNA, 20 bp, Homo sapiens
ttgaagaaaggaacctggga

SEQ ID NO: 3982681 - DNA, 18 bp, Homo sapiens
ttgaagaaggtggacctt

SEQ ID NO: 3982682 - DNA, 19 bp, Homo sapiens
ttgaagaaggtggaccttt

SEQ ID NO: 3982683 - DNA, 12 bp, Homo sapiens
ttgaagaatgaa

SEQ ID NO: 3982684 - DNA, 13 bp, Homo sapiens
ttgaagacaattt

SEQ ID NO: 3982685 - DNA, 19 bp, Homo sapiens
ttgaagacaatttgataca

SEQ ID NO: 3982686 - DNA, 20 bp, Homo sapiens
ttgaagacctaaccagggcc

SEQ ID NO: 3982687 - DNA, 17 bp, Homo sapiens
ttgaagccgactctggc

SEQ ID NO: 3982688 - DNA, 19 bp, Homo sapiens
ttgaagccgactctggccc

SEQ ID NO: 3982689 - DNA, 16 bp, Homo sapiens
ttgaagcctgctcctt

SEQ ID NO: 3982690 - DNA, 12 bp, Homo sapiens
ttgaagcctgtg

SEQ ID NO: 3982691 - DNA, 13 bp, Homo sapiens
ttgaagcctgtgc

SEQ ID NO: 3982692 - DNA, 18 bp, Homo sapiens
ttgaagggtaaagaagtt

SEQ ID NO: 3982693 - DNA, 23 bp, Homo sapiens
ttgaaggtgctgacggccaggga

SEQ ID NO: 3982694 - DNA, 18 bp, Homo sapiens
ttgaagtaatcccgccac

SEQ ID NO: 3982695 - DNA, 15 bp, Homo sapiens
ttgaagtcatgctcc

SEQ ID NO: 3982696 - DNA, 16 bp, Homo sapiens
ttgaataaaaatgcac

SEQ ID NO: 3982697 - DNA, 19 bp, Homo sapiens
ttgaataaagttgaagcta

SEQ ID NO: 3982698 - DNA, 12 bp, Homo sapiens
ttgaataaataa

SEQ ID NO: 3982699 - DNA, 19 bp, Homo sapiens
ttgaatatattataatctt

SEQ ID NO: 3982700 - DNA, 22 bp, Homo sapiens
ttgaatatctttcgataaacaa

SEQ ID NO: 3982701 - DNA, 15 bp, Homo sapiens
ttgaatatggacaag

SEQ ID NO: 3982702 - DNA, 17 bp, Homo sapiens
ttgaatatggacaagag

SEQ ID NO: 3982703 - DNA, 23 bp, Homo sapiens
ttgaatcagtttttaaaatattt

SEQ ID NO: 3982704 - DNA, 18 bp, Homo sapiens
ttgaatctatttcactta

SEQ ID NO: 3982705 - DNA, 20 bp, Homo sapiens
ttgaatgaaaaatttaagca

SEQ ID NO: 3982706 - DNA, 21 bp, Homo sapiens
ttgaatgaaaaatttaagcat

SEQ ID NO: 3982707 - DNA, 22 bp, Homo sapiens
ttgaatgaaaaatttaagcatt

SEQ ID NO: 3982708 - DNA, 15 bp, Homo sapiens
ttgaatgctgccagt

SEQ ID NO: 3982709 - DNA, 17 bp, Homo sapiens
ttgaatgttaagaattg

SEQ ID NO: 3982710 - DNA, 17 bp, Homo sapiens
ttgaatgttaagcagat

SEQ ID NO: 3982711 - DNA, 17 bp, Homo sapiens
ttgaattaaattaggaa

SEQ ID NO: 3982712 - DNA, 20 bp, Homo sapiens
ttgaattgaggggattaata

SEQ ID NO: 3982713 - DNA, 14 bp, Homo sapiens
ttgaatttaaataa

SEQ ID NO: 3982714 - DNA, 17 bp, Homo sapiens
ttgaatttaaataaagt

SEQ ID NO: 3982715 - DNA, 18 bp, Homo sapiens
ttgacaaaattttctcat

SEQ ID NO: 3982716 - DNA, 17 bp, Homo sapiens
ttgacaacctagaatgt

SEQ ID NO: 3982717 - DNA, 14 bp, Homo sapiens
ttgacaactgtgac

SEQ ID NO: 3982718 - DNA, 16 bp, Homo sapiens
ttgacaactgtgactg

SEQ ID NO: 3982719 - DNA, 18 bp, Homo sapiens
ttgacacaagtggacctt

SEQ ID NO: 3982720 - DNA, 14 bp, Homo sapiens
ttgacacacagcac

SEQ ID NO: 3982721 - DNA, 12 bp, Homo sapiens
ttgacacctgct

SEQ ID NO: 3982722 - DNA, 11 bp, Homo sapiens
ttgacactgaa

SEQ ID NO: 3982723 - DNA, 17 bp, Homo sapiens
ttgacactgaaagtttt

SEQ ID NO: 3982724 - DNA, 15 bp, Homo sapiens
ttgacactgaactta

SEQ ID NO: 3982725 - DNA, 22 bp, Homo sapiens
ttgacactgaacttaataactg

SEQ ID NO: 3982726 - DNA, 19 bp, Homo sapiens
ttgacactggtatcttatt

SEQ ID NO: 3982727 - DNA, 17 bp, Homo sapiens
ttgacagagcctgcccc

SEQ ID NO: 3982728 - DNA, 19 bp, Homo sapiens
ttgacagagcctgccccag

SEQ ID NO: 3982729 - DNA, 19 bp, Homo sapiens
ttgacaggattattggaaa

SEQ ID NO: 3982730 - DNA, 20 bp, Homo sapiens
ttgacataacactataaagg

SEQ ID NO: 3982731 - DNA, 18 bp, Homo sapiens
ttgacatcagttcctttg

SEQ ID NO: 3982732 - DNA, 22 bp, Homo sapiens
ttgacatcagttcctttgtgtg

SEQ ID NO: 3982733 - DNA, 16 bp, Homo sapiens
ttgacatgtagcttct

SEQ ID NO: 3982734 - DNA, 18 bp, Homo sapiens
ttgacattgcgtttgacc

SEQ ID NO: 3982735 - DNA, 17 bp, Homo sapiens
ttgacatttagaacttt

SEQ ID NO: 3982736 - DNA, 15 bp, Homo sapiens
ttgacatttgtagtt

SEQ ID NO: 3982737 - DNA, 15 bp, Homo sapiens
ttgaccaagaactgc

SEQ ID NO: 3982738 - DNA, 16 bp, Homo sapiens
ttgaccaagaactgca

SEQ ID NO: 3982739 - DNA, 17 bp, Homo sapiens
ttgaccattaataaaga

SEQ ID NO: 3982740 - DNA, 18 bp, Homo sapiens
ttgctctcagctgccaac

SEQ ID NO: 3982741 - DNA, 16 bp, Homo sapiens
ttgctctcctcatctc

SEQ ID NO: 3982742 - DNA, 20 bp, Homo sapiens
ttgctctgtcccccaggctg

SEQ ID NO: 3982743 - DNA, 22 bp, Homo sapiens
ttgctctgttacccaggctgga

SEQ ID NO: 3982744 - DNA, 20 bp, Homo sapiens
ttgctctttgacaactaaaa

SEQ ID NO: 3982745 - DNA, 17 bp, Homo sapiens
ttgctgaaaatggtatt

SEQ ID NO: 3982746 - DNA, 16 bp, Homo sapiens
ttgctgaacacacaca

SEQ ID NO: 3982747 - DNA, 17 bp, Homo sapiens
ttgctgagctgtttata

SEQ ID NO: 3982748 - DNA, 20 bp, Homo sapiens
ttgctgatggcttgacatgt

SEQ ID NO: 3982749 - DNA, 18 bp, Homo sapiens
ttgctgcaattttataag

SEQ ID NO: 3982750 - DNA, 20 bp, Homo sapiens
ttgctgcgcaccaatgccca

SEQ ID NO: 3982751 - DNA, 22 bp, Homo sapiens
ttgctgcgcaccaatgcccagc

SEQ ID NO: 3982752 - DNA, 20 bp, Homo sapiens
ttgctgctaccgccctgggc

SEQ ID NO: 3982753 - DNA, 15 bp, Homo sapiens
ttgctgctgcctctt

SEQ ID NO: 3982754 - DNA, 11 bp, Homo sapiens
ttgctgctgct

SEQ ID NO: 3982755 - DNA, 12 bp, Homo sapiens
ttgctgctgtct

SEQ ID NO: 3982756 - DNA, 19 bp, Homo sapiens
ttgctgctgtgcgtggaaa

SEQ ID NO: 3982757 - DNA, 22 bp, Homo sapiens
ttgctgctgtgcgtggaaaaag

SEQ ID NO: 3982758 - DNA, 23 bp, Homo sapiens
ttgctggacggggactggggatg

SEQ ID NO: 3982759 - DNA, 12 bp, Homo sapiens
ttgctgtctctg

SEQ ID NO: 3982760 - DNA, 20 bp, Homo sapiens
ttgctgtcttggggtcccac

SEQ ID NO: 3982761 - DNA, 19 bp, Homo sapiens
ttgctgtgacagtgatggc

SEQ ID NO: 3982762 - DNA, 14 bp, Homo sapiens
ttgctgtgaggctg

SEQ ID NO: 3982763 - DNA, 15 bp, Homo sapiens
ttgctgtgtttaatt

SEQ ID NO: 3982764 - DNA, 17 bp, Homo sapiens
ttgctgtgtttaatttg

SEQ ID NO: 3982765 - DNA, 13 bp, Homo sapiens
ttgctgttaactg

SEQ ID NO: 3982766 - DNA, 18 bp, Homo sapiens
ttgctgttttaaacatta

SEQ ID NO: 3982767 - DNA, 14 bp, Homo sapiens
ttgcttaaatttct

SEQ ID NO: 3982768 - DNA, 23 bp, Homo sapiens
ttgcttaaatttcttatgtgaca

SEQ ID NO: 3982769 - DNA, 13 bp, Homo sapiens
ttgcttacatttt

SEQ ID NO: 3982770 - DNA, 24 bp, Homo sapiens
ttgcttaggatgtttttcatgaaa

SEQ ID NO: 3982771 - DNA, 12 bp, Homo sapiens
ttgcttatgaat

SEQ ID NO: 3982772 - DNA, 15 bp, Homo sapiens
ttgcttattgttcca

SEQ ID NO: 3982773 - DNA, 16 bp, Homo sapiens
ttgcttattgttccaa

SEQ ID NO: 3982774 - DNA, 17 bp, Homo sapiens
ttgcttcataaatgaag

SEQ ID NO: 3982775 - DNA, 14 bp, Homo sapiens
ttgcttcccctcca

SEQ ID NO: 3982776 - DNA, 17 bp, Homo sapiens
ttgcttcccctccagga

SEQ ID NO: 3982777 - DNA, 16 bp, Homo sapiens
ttgcttccccttttgc

SEQ ID NO: 3982778 - DNA, 18 bp, Homo sapiens
ttgcttcttactgataat

SEQ ID NO: 3982779 - DNA, 12 bp, Homo sapiens
ttgctttcaatt

SEQ ID NO: 3982780 - DNA, 10 bp, Homo sapiens
ttgctttcct

SEQ ID NO: 3982781 - DNA, 16 bp, Homo sapiens
ttgctttctgaaattc

SEQ ID NO: 3982782 - DNA, 14 bp, Homo sapiens
ttgcttttaattaa

SEQ ID NO: 3982783 - DNA, 13 bp, Homo sapiens
ttgcttttttgta

SEQ ID NO: 3982784 - DNA, 19 bp, Homo sapiens
ttgcttttttgtattggtt

SEQ ID NO: 3982785 - DNA, 19 bp, Homo sapiens
ttggaaaagaatacagaaa

SEQ ID NO: 3982786 - DNA, 16 bp, Homo sapiens
ttggaaactgctaaat

SEQ ID NO: 3982787 - DNA, 20 bp, Homo sapiens
ttggaaatagaaagaagcca

SEQ ID NO: 3982788 - DNA, 14 bp, Homo sapiens
ttggaacagaatgt

SEQ ID NO: 3982789 - DNA, 14 bp, Homo sapiens
ttggaaccagcccc

SEQ ID NO: 3982790 - DNA, 19 bp, Homo sapiens
ttggaagattttcagtcta

SEQ ID NO: 3982791 - DNA, 13 bp, Homo sapiens
ttggaaggggcct

SEQ ID NO: 3982792 - DNA, 13 bp, Homo sapiens
ttggaatactttt

SEQ ID NO: 3982793 - DNA, 15 bp, Homo sapiens
ttggaatattacaat

SEQ ID NO: 3982794 - DNA, 20 bp, Homo sapiens
ttggaattaacctggtgctg

SEQ ID NO: 3982795 - DNA, 19 bp, Homo sapiens
ttggaatttgtaacctcag

SEQ ID NO: 3982796 - DNA, 23 bp, Homo sapiens
ttggacaatcatgaaatatgcat

SEQ ID NO: 3982797 - DNA, 16 bp, Homo sapiens
ttggacatagatattt

SEQ ID NO: 3982798 - DNA, 15 bp, Homo sapiens
ttggaccatgccaga

SEQ ID NO: 3982799 - DNA, 13 bp, Homo sapiens
ttggactctcagg

SEQ ID NO: 3982800 - DNA, 18 bp, Homo sapiens
ttggagacacaactattt

SEQ ID NO: 3982801 - DNA, 17 bp, Homo sapiens
ttggagagtaaaaactg

SEQ ID NO: 3982802 - DNA, 20 bp, Homo sapiens
ttggagagtaaaaactgaat

SEQ ID NO: 3982803 - DNA, 15 bp, Homo sapiens
ttggagagtttcctg

SEQ ID NO: 3982804 - DNA, 22 bp, Homo sapiens
ttggagcaggcaaaaaagggac

SEQ ID NO: 3982805 - DNA, 15 bp, Homo sapiens
ttggagcttacatag

SEQ ID NO: 3982806 - DNA, 21 bp, Homo sapiens
ttggagcttttttctttaaga

SEQ ID NO: 3982807 - DNA, 18 bp, Homo sapiens
ttggaggtcacagctgga

SEQ ID NO: 3982808 - DNA, 13 bp, Homo sapiens
ttggataaatcat

SEQ ID NO: 3982809 - DNA, 19 bp, Homo sapiens
ttggatacttggatttagt

SEQ ID NO: 3982810 - DNA, 13 bp, Homo sapiens
ttggatatttttg

SEQ ID NO: 3982811 - DNA, 18 bp, Homo sapiens
ttggatatttttgtactt

SEQ ID NO: 3982812 - DNA, 21 bp, Homo sapiens
ttggatggagtccagggaaga

SEQ ID NO: 3982813 - DNA, 21 bp, Homo sapiens
ttggatgggagtgagacagaa

SEQ ID NO: 3982814 - DNA, 18 bp, Homo sapiens
ttggatgggagtgggcac

SEQ ID NO: 3982815 - DNA, 23 bp, Homo sapiens
ttggatgggagtgggcacctcag

SEQ ID NO: 3982816 - DNA, 19 bp, Homo sapiens
ttggattatttaataacat

SEQ ID NO: 3982817 - DNA, 20 bp, Homo sapiens
ttggattatttaataacatt

SEQ ID NO: 3982818 - DNA, 23 bp, Homo sapiens
ttggattctcttagctactgtat

SEQ ID NO: 3982819 - DNA, 16 bp, Homo sapiens
ttggatttttgactct

SEQ ID NO: 3982820 - DNA, 15 bp, Homo sapiens
ttggcaaaagccttg

SEQ ID NO: 3982821 - DNA, 20 bp, Homo sapiens
ttggcaaaagccttgtgtat

SEQ ID NO: 3982822 - DNA, 13 bp, Homo sapiens
ttggcaaaatggg

SEQ ID NO: 3982823 - DNA, 16 bp, Homo sapiens
ttggcaaacgggcttg

SEQ ID NO: 3982824 - DNA, 16 bp, Homo sapiens
ttggcacagaaacaca

SEQ ID NO: 3982825 - DNA, 23 bp, Homo sapiens
ttggcacagaaacacaatatttt

SEQ ID NO: 3982826 - DNA, 17 bp, Homo sapiens
ttggcaccagacaccca

SEQ ID NO: 3982827 - DNA, 20 bp, Homo sapiens
ttggcaccagacacccagga

SEQ ID NO: 3982828 - DNA, 23 bp, Homo sapiens
ttggcaccagacacccaggactt

SEQ ID NO: 3982829 - DNA, 19 bp, Homo sapiens
ttggcacctgcacactcca

SEQ ID NO: 3982830 - DNA, 20 bp, Homo sapiens
ttggcaggtcctggccagat

SEQ ID NO: 3982831 - DNA, 12 bp, Homo sapiens
ttggcatggtga

SEQ ID NO: 3982832 - DNA, 15 bp, Homo sapiens
ttggccaaagtgtta

SEQ ID NO: 3982833 - DNA, 18 bp, Homo sapiens
ttggccaagagaagggct

SEQ ID NO: 3982834 - DNA, 13 bp, Homo sapiens
ttggccacctgta

SEQ ID NO: 3982835 - DNA, 18 bp, Homo sapiens
ttggccagcgctgttgag

SEQ ID NO: 3982836 - DNA, 11 bp, Homo sapiens
ttggcccagcg

SEQ ID NO: 3982837 - DNA, 23 bp, Homo sapiens
ttggcctgagatgcctggtgagc

SEQ ID NO: 3982838 - DNA, 14 bp, Homo sapiens
ttggcctgctgtga

SEQ ID NO: 3982839 - DNA, 22 bp, Homo sapiens
ttggcctggggtgcatctcctc

SEQ ID NO: 3982840 - DNA, 19 bp, Homo sapiens
ttggcctgtagagttgctg

SEQ ID NO: 3982841 - DNA, 23 bp, Homo sapiens
ttggcctgtctcatccccagggg

SEQ ID NO: 3982842 - DNA, 16 bp, Homo sapiens
ttggcgctattacaaa

SEQ ID NO: 3982843 - DNA, 13 bp, Homo sapiens
ttgtaattgtgta

SEQ ID NO: 3982844 - DNA, 23 bp, Homo sapiens
ttgtaatttttggggaaaaaagc

SEQ ID NO: 3982845 - DNA, 22 bp, Homo sapiens
ttgtacaaaaaaaaagttttat

SEQ ID NO: 3982846 - DNA, 11 bp, Homo sapiens
ttgtacaaatg

SEQ ID NO: 3982847 - DNA, 14 bp, Homo sapiens
ttgtacaaatgtat

SEQ ID NO: 3982848 - DNA, 16 bp, Homo sapiens
ttgtacaaatgtattt

SEQ ID NO: 3982849 - DNA, 11 bp, Homo sapiens
ttgtacataaa

SEQ ID NO: 3982850 - DNA, 23 bp, Homo sapiens
ttgtacatttatgatttaataaa

SEQ ID NO: 3982851 - DNA, 13 bp, Homo sapiens
ttgtacttgattt

SEQ ID NO: 3982852 - DNA, 19 bp, Homo sapiens
ttgtacttgtgtttgctta

SEQ ID NO: 3982853 - DNA, 19 bp, Homo sapiens
ttgtagaactcactctggg

SEQ ID NO: 3982854 - DNA, 20 bp, Homo sapiens
ttgtagaactcactctgggc

SEQ ID NO: 3982855 - DNA, 16 bp, Homo sapiens
ttgtagcactgagggt

SEQ ID NO: 3982856 - DNA, 22 bp, Homo sapiens
ttgtagcagattgtttcctctt

SEQ ID NO: 3982857 - DNA, 21 bp, Homo sapiens
ttgtaggaaggtctcattctt

SEQ ID NO: 3982858 - DNA, 16 bp, Homo sapiens
ttgtagggttacagag

SEQ ID NO: 3982859 - DNA, 14 bp, Homo sapiens
ttgtataagcatgc

SEQ ID NO: 3982860 - DNA, 22 bp, Homo sapiens
ttgtataatttcgagatttgta

SEQ ID NO: 3982861 - DNA, 20 bp, Homo sapiens
ttgtatacaccatatactgt

SEQ ID NO: 3982862 - DNA, 13 bp, Homo sapiens
ttgtatatacagt

SEQ ID NO: 3982863 - DNA, 19 bp, Homo sapiens
ttgtatattgtcagatatt

SEQ ID NO: 3982864 - DNA, 15 bp, Homo sapiens
ttgtatattgtgttt

SEQ ID NO: 3982865 - DNA, 16 bp, Homo sapiens
ttgtatatttgtacaa

SEQ ID NO: 3982866 - DNA, 19 bp, Homo sapiens
ttgtatcatttgaacaact

SEQ ID NO: 3982867 - DNA, 14 bp, Homo sapiens
ttgtatcttttatc

SEQ ID NO: 3982868 - DNA, 22 bp, Homo sapiens
ttgtatcttttatcctgggagc

SEQ ID NO: 3982869 - DNA, 17 bp, Homo sapiens
ttgtatgttatgaacat

SEQ ID NO: 3982870 - DNA, 14 bp, Homo sapiens
ttgtattacagatg

SEQ ID NO: 3982871 - DNA, 18 bp, Homo sapiens
ttgtattatttggagtta

SEQ ID NO: 3982872 - DNA, 22 bp, Homo sapiens
ttgtattcaaaaattatctata

SEQ ID NO: 3982873 - DNA, 12 bp, Homo sapiens
ttgtattcttct

SEQ ID NO: 3982874 - DNA, 13 bp, Homo sapiens
ttgtattgttttc

SEQ ID NO: 3982875 - DNA, 19 bp, Homo sapiens
ttgtcaatattaaatacag

SEQ ID NO: 3982876 - DNA, 13 bp, Homo sapiens
ttgtcacaataaa

SEQ ID NO: 3982877 - DNA, 20 bp, Homo sapiens
ttgtcacagaaatcagagga

SEQ ID NO: 3982878 - DNA, 16 bp, Homo sapiens
ttgtcacatcagataa

SEQ ID NO: 3982879 - DNA, 16 bp, Homo sapiens
ttgtcacctctgttaa

SEQ ID NO: 3982880 - DNA, 15 bp, Homo sapiens
ttgtcacctgcttct

SEQ ID NO: 3982881 - DNA, 19 bp, Homo sapiens
ttgtcacctgcttctctgc

SEQ ID NO: 3982882 - DNA, 17 bp, Homo sapiens
ttgtcactgagaagatg

SEQ ID NO: 3982883 - DNA, 14 bp, Homo sapiens
ttgtcactgcttca

SEQ ID NO: 3982884 - DNA, 14 bp, Homo sapiens
ttgtcagactttaa

SEQ ID NO: 3982885 - DNA, 13 bp, Homo sapiens
ttgtcatgtggct

SEQ ID NO: 3982886 - DNA, 15 bp, Homo sapiens
ttgtcattaaaattg

SEQ ID NO: 3982887 - DNA, 14 bp, Homo sapiens
ttgtcattaaaggt

SEQ ID NO: 3982888 - DNA, 14 bp, Homo sapiens
ttgtcattgctgtt

SEQ ID NO: 3982889 - DNA, 18 bp, Homo sapiens
ttgtccagagctgcttcc

SEQ ID NO: 3982890 - DNA, 11 bp, Homo sapiens
ttgtcccagac

SEQ ID NO: 3982891 - DNA, 17 bp, Homo sapiens
ttgtcccatttccttgg

SEQ ID NO: 3982892 - DNA, 18 bp, Homo sapiens
ttgtccctggcttcctta

SEQ ID NO: 3982893 - DNA, 17 bp, Homo sapiens
ttgtcctacgtccaagg

SEQ ID NO: 3982894 - DNA, 13 bp, Homo sapiens
ttgtcctcctgct

SEQ ID NO: 3982895 - DNA, 15 bp, Homo sapiens
ttgtcctcctgctgc

SEQ ID NO: 3982896 - DNA, 20 bp, Homo sapiens
ttgtcggctccagtccccag

SEQ ID NO: 3982897 - DNA, 20 bp, Homo sapiens
ttgtcgggcaccagccagcg

SEQ ID NO: 3982898 - DNA, 15 bp, Homo sapiens
ttgtctaaaatgtca

SEQ ID NO: 3982899 - DNA, 12 bp, Homo sapiens
ttgtctatttat

SEQ ID NO: 3982900 - DNA, 12 bp, Homo sapiens
ttgtctatttta

SEQ ID NO: 3982901 - DNA, 18 bp, Homo sapiens
ttgtctatttttgtctta

SEQ ID NO: 3982902 - DNA, 12 bp, Homo sapiens
ttgtctcagaag

SEQ ID NO: 3982903 - DNA, 16 bp, Homo sapiens
ttgtctgtttgtttca

SEQ ID NO: 3982904 - DNA, 17 bp, Homo sapiens
ttgtctgtttgtttcaa

SEQ ID NO: 3982905 - DNA, 18 bp, Homo sapiens
ttgtcttcagcagtcaat

SEQ ID NO: 3982906 - DNA, 18 bp, Homo sapiens
ttgtcttgtgtatttcag

SEQ ID NO: 3982907 - DNA, 19 bp, Homo sapiens
ttgtctttagtgccggctg

SEQ ID NO: 3982908 - DNA, 12 bp, Homo sapiens
ttgtctttattt

SEQ ID NO: 3982909 - DNA, 18 bp, Homo sapiens
ttgtcttttcaaaatatt

SEQ ID NO: 3982910 - DNA, 13 bp, Homo sapiens
ttgtcttttcaga

SEQ ID NO: 3982911 - DNA, 12 bp, Homo sapiens
ttgtctttttat

SEQ ID NO: 3982912 - DNA, 16 bp, Homo sapiens
ttgtgaaacacagctg

SEQ ID NO: 3982913 - DNA, 18 bp, Homo sapiens
ttgtgaaacacagctgtt

SEQ ID NO: 3982914 - DNA, 13 bp, Homo sapiens
ttgtgaactcatt

SEQ ID NO: 3982915 - DNA, 13 bp, Homo sapiens
ttgtgaaggcagg

SEQ ID NO: 3982916 - DNA, 18 bp, Homo sapiens
ttgtgactctaagctcag

SEQ ID NO: 3982917 - DNA, 11 bp, Homo sapiens
ttgtgagagcg

SEQ ID NO: 3982918 - DNA, 18 bp, Homo sapiens
ttgtgagccaccacgtcc

SEQ ID NO: 3982919 - DNA, 16 bp, Homo sapiens
ttgtgagggacatgct

SEQ ID NO: 3982920 - DNA, 19 bp, Homo sapiens
ttgtgatagcactttctac

SEQ ID NO: 3982921 - DNA, 23 bp, Homo sapiens
ttgtgatcagaccataatgttac

SEQ ID NO: 3982922 - DNA, 15 bp, Homo sapiens
ttgtgatgaatcaat

SEQ ID NO: 3982923 - DNA, 21 bp, Homo sapiens
ttgtgatgaatcaatgaaaaa

SEQ ID NO: 3982924 - DNA, 16 bp, Homo sapiens
ttgtgattctgtttat

SEQ ID NO: 3982925 - DNA, 16 bp, Homo sapiens
ttgtgattggcctgta

SEQ ID NO: 3982926 - DNA, 23 bp, Homo sapiens
ttgtgatttctttaaaagaatga

SEQ ID NO: 3982927 - DNA, 21 bp, Homo sapiens
ttgtgcaaaagcttcaaatta

SEQ ID NO: 3982928 - DNA, 19 bp, Homo sapiens
ttgtgcatttgttcagctc

SEQ ID NO: 3982929 - DNA, 21 bp, Homo sapiens
ttgtgcatttgttcagctccc

SEQ ID NO: 3982930 - DNA, 10 bp, Homo sapiens
ttgtgccttt

SEQ ID NO: 3982931 - DNA, 15 bp, Homo sapiens
ttgtgctcagcatga

SEQ ID NO: 3982932 - DNA, 22 bp, Homo sapiens
ttgtgctgatcgtgctaaattt

SEQ ID NO: 3982933 - DNA, 14 bp, Homo sapiens
ttgtgctgccattt

SEQ ID NO: 3982934 - DNA, 14 bp, Homo sapiens
ttgtgctgtgggca

SEQ ID NO: 3982935 - DNA, 15 bp, Homo sapiens
ttgtgctgtgggcag

SEQ ID NO: 3982936 - DNA, 17 bp, Homo sapiens
ttgtgctgtgggcagca

SEQ ID NO: 3982937 - DNA, 21 bp, Homo sapiens
ttgtggaagcatgtagactgt

SEQ ID NO: 3982938 - DNA, 13 bp, Homo sapiens
ttgtggcctcaga

SEQ ID NO: 3982939 - DNA, 17 bp, Homo sapiens
ttgtggcgtctccctcg

SEQ ID NO: 3982940 - DNA, 18 bp, Homo sapiens
ttgtggctccacacacac

SEQ ID NO: 3982941 - DNA, 15 bp, Homo sapiens
ttgtggttctatttt

SEQ ID NO: 3982942 - DNA, 16 bp, Homo sapiens
ttgtggttctatttta

SEQ ID NO: 3982943 - DNA, 15 bp, Homo sapiens
ttgtgtaaaaaatgg

SEQ ID NO: 3982944 - DNA, 22 bp, Homo sapiens
ttgtgtaacaattttaatgcta

SEQ ID NO: 3982945 - DNA, 15 bp, Homo sapiens
ttgtgtacagttatt

SEQ ID NO: 3982946 - DNA, 13 bp, Homo sapiens
ttgtgtagccttt

SEQ ID NO: 3982947 - DNA, 17 bp, Homo sapiens
ttcctctatacatctct

SEQ ID NO: 3982948 - DNA, 20 bp, Homo sapiens
ttcctctatacatctctccc

SEQ ID NO: 3982949 - DNA, 22 bp, Homo sapiens
ttcctctatacatctctcccca

SEQ ID NO: 3982950 - DNA, 19 bp, Homo sapiens
ttcctctccactgccttcg

SEQ ID NO: 3982951 - DNA, 15 bp, Homo sapiens
ttcctctctccagat

SEQ ID NO: 3982952 - DNA, 11 bp, Homo sapiens
ttcctctgagc

SEQ ID NO: 3982953 - DNA, 14 bp, Homo sapiens
ttcctctgagccca

SEQ ID NO: 3982954 - DNA, 12 bp, Homo sapiens
ttcctctgcctg

SEQ ID NO: 3982955 - DNA, 13 bp, Homo sapiens
ttcctctgcctgc

SEQ ID NO: 3982956 - DNA, 15 bp, Homo sapiens
ttcctctgcctgccc

SEQ ID NO: 3982957 - DNA, 14 bp, Homo sapiens
ttcctctgctcacc

SEQ ID NO: 3982958 - DNA, 18 bp, Homo sapiens
ttcctgaaacaacttgga

SEQ ID NO: 3982959 - DNA, 14 bp, Homo sapiens
ttcctgaaccatgt

SEQ ID NO: 3982960 - DNA, 19 bp, Homo sapiens
ttcctgaagaaccagtccc

SEQ ID NO: 3982961 - DNA, 23 bp, Homo sapiens
ttcctgacttgagtgttcctttt

SEQ ID NO: 3982962 - DNA, 19 bp, Homo sapiens
ttcctgataataattgatc

SEQ ID NO: 3982963 - DNA, 16 bp, Homo sapiens
ttcctgattggtttct

SEQ ID NO: 3982964 - DNA, 20 bp, Homo sapiens
ttcctgattggtttctcttc

SEQ ID NO: 3982965 - DNA, 21 bp, Homo sapiens
ttcctgccccagatggctttg

SEQ ID NO: 3982966 - DNA, 13 bp, Homo sapiens
ttcctgccccagg

SEQ ID NO: 3982967 - DNA, 15 bp, Homo sapiens
ttcctgcccttccct

SEQ ID NO: 3982968 - DNA, 14 bp, Homo sapiens
ttcctgctacagga

SEQ ID NO: 3982969 - DNA, 11 bp, Homo sapiens
ttcctgctgca

SEQ ID NO: 3982970 - DNA, 18 bp, Homo sapiens
ttcctgctgcaccctgcg

SEQ ID NO: 3982971 - DNA, 22 bp, Homo sapiens
ttcctgctgcaccctgcgcctc

SEQ ID NO: 3982972 - DNA, 17 bp, Homo sapiens
ttcctggaaaagaagaa

SEQ ID NO: 3982973 - DNA, 18 bp, Homo sapiens
ttcctggacaggccaggt

SEQ ID NO: 3982974 - DNA, 23 bp, Homo sapiens
ttcctggcaatagtgtgttctga

SEQ ID NO: 3982975 - DNA, 22 bp, Homo sapiens
ttcctggtttaattcagcagag

SEQ ID NO: 3982976 - DNA, 16 bp, Homo sapiens
ttcctgtccagctcca

SEQ ID NO: 3982977 - DNA, 11 bp, Homo sapiens
ttcctgtccca

SEQ ID NO: 3982978 - DNA, 23 bp, Homo sapiens
ttcctgtcccaccatacgagcac

SEQ ID NO: 3982979 - DNA, 24 bp, Homo sapiens
ttcctgtgaagtttaattgtctca

SEQ ID NO: 3982980 - DNA, 22 bp, Homo sapiens
ttcctgtgggtgttctttcctg

SEQ ID NO: 3982981 - DNA, 17 bp, Homo sapiens
ttcctgtgtgtactctg

SEQ ID NO: 3982982 - DNA, 13 bp, Homo sapiens
ttcctgtttcaag

SEQ ID NO: 3982983 - DNA, 20 bp, Homo sapiens
ttccttaagtatatcatgta

SEQ ID NO: 3982984 - DNA, 14 bp, Homo sapiens
ttccttatccctct

SEQ ID NO: 3982985 - DNA, 21 bp, Homo sapiens
ttccttatccctctcttcccc

SEQ ID NO: 3982986 - DNA, 21 bp, Homo sapiens
ttccttatgtatcagtgtcct

SEQ ID NO: 3982987 - DNA, 15 bp, Homo sapiens
ttccttatttgcctt

SEQ ID NO: 3982988 - DNA, 13 bp, Homo sapiens
ttccttcagggtt

SEQ ID NO: 3982989 - DNA, 22 bp, Homo sapiens
ttccttcagggtttaatagact

SEQ ID NO: 3982990 - DNA, 16 bp, Homo sapiens
ttccttcattcatagg

SEQ ID NO: 3982991 - DNA, 15 bp, Homo sapiens
ttccttccagcccat

SEQ ID NO: 3982992 - DNA, 18 bp, Homo sapiens
ttccttctaacatgttat

SEQ ID NO: 3982993 - DNA, 10 bp, Homo sapiens
ttccttctct

SEQ ID NO: 3982994 - DNA, 11 bp, Homo sapiens
ttccttctctg

SEQ ID NO: 3982995 - DNA, 14 bp, Homo sapiens
ttccttctttgata

SEQ ID NO: 3982996 - DNA, 19 bp, Homo sapiens
ttccttctttgataatgtt

SEQ ID NO: 3982997 - DNA, 22 bp, Homo sapiens
ttccttctttgataatgttaaa

SEQ ID NO: 3982998 - DNA, 22 bp, Homo sapiens
ttccttgagacacggagcccag

SEQ ID NO: 3982999 - DNA, 13 bp, Homo sapiens
ttccttgatcatt

SEQ ID NO: 3983000 - DNA, 14 bp, Homo sapiens
ttccttgatcattt

SEQ ID NO: 3983001 - DNA, 14 bp, Homo sapiens
ttccttgccagtct

SEQ ID NO: 3983002 - DNA, 12 bp, Homo sapiens
ttccttggaggc

SEQ ID NO: 3983003 - DNA, 15 bp, Homo sapiens
ttccttggctttatg

SEQ ID NO: 3983004 - DNA, 19 bp, Homo sapiens
ttccttgttggtcagagga

SEQ ID NO: 3983005 - DNA, 21 bp, Homo sapiens
ttccttgtttatcagatacat

SEQ ID NO: 3983006 - DNA, 16 bp, Homo sapiens
ttcctttaaaaaaatt

SEQ ID NO: 3983007 - DNA, 15 bp, Homo sapiens
ttcctttaaaaaact

SEQ ID NO: 3983008 - DNA, 17 bp, Homo sapiens
ttcctttcttttccccc

SEQ ID NO: 3983009 - DNA, 15 bp, Homo sapiens
ttcctttgctctttc

SEQ ID NO: 3983010 - DNA, 16 bp, Homo sapiens
ttcctttgtcttcaaa

SEQ ID NO: 3983011 - DNA, 19 bp, Homo sapiens
tttaaaattccattatctt

SEQ ID NO: 3983012 - DNA, 18 bp, Homo sapiens
tttaaaattgctatgtta

SEQ ID NO: 3983013 - DNA, 23 bp, Homo sapiens
tttaaaattgctatgttactatt

SEQ ID NO: 3983014 - DNA, 12 bp, Homo sapiens
tttaaacaaatt

SEQ ID NO: 3983015 - DNA, 14 bp, Homo sapiens
tttaaacacctcct

SEQ ID NO: 3983016 - DNA, 13 bp, Homo sapiens
tttaaacagcagt

SEQ ID NO: 3983017 - DNA, 15 bp, Homo sapiens
tttaaacattaatag

SEQ ID NO: 3983018 - DNA, 15 bp, Homo sapiens
tttaaacctttttct

SEQ ID NO: 3983019 - DNA, 11 bp, Homo sapiens
tttaaactttc

SEQ ID NO: 3983020 - DNA, 14 bp, Homo sapiens
tttaaagaataaag

SEQ ID NO: 3983021 - DNA, 15 bp, Homo sapiens
tttaaagcattgctg

SEQ ID NO: 3983022 - DNA, 20 bp, Homo sapiens
tttaaagcattgctgttatg

SEQ ID NO: 3983023 - DNA, 12 bp, Homo sapiens
tttaaaggaaaa

SEQ ID NO: 3983024 - DNA, 18 bp, Homo sapiens
tttaaagggacaccccta

SEQ ID NO: 3983025 - DNA, 22 bp, Homo sapiens
tttaaaggggcagaaaaactct

SEQ ID NO: 3983026 - DNA, 16 bp, Homo sapiens
tttaaataaaatcacc

SEQ ID NO: 3983027 - DNA, 13 bp, Homo sapiens
tttaaataaagtt

SEQ ID NO: 3983028 - DNA, 12 bp, Homo sapiens
tttaaatataat

SEQ ID NO: 3983029 - DNA, 13 bp, Homo sapiens
tttaaatataatt

SEQ ID NO: 3983030 - DNA, 15 bp, Homo sapiens
tttaaatataattct

SEQ ID NO: 3983031 - DNA, 21 bp, Homo sapiens
tggtttgtggcgtctccctcg

SEQ ID NO: 3983032 - DNA, 13 bp, Homo sapiens
tggtttgttctga

SEQ ID NO: 3983033 - DNA, 17 bp, Homo sapiens
tggtttgttctgacttt

SEQ ID NO: 3983034 - DNA, 13 bp, Homo sapiens
tggttttatttgt

SEQ ID NO: 3983035 - DNA, 15 bp, Homo sapiens
tggttttcaaaataa

SEQ ID NO: 3983036 - DNA, 17 bp, Homo sapiens
tggttttcaaaataaaa

SEQ ID NO: 3983037 - DNA, 19 bp, Homo sapiens
tggttttggggaaatgtgg

SEQ ID NO: 3983038 - DNA, 16 bp, Homo sapiens
tggttttgtacactgc

SEQ ID NO: 3983039 - DNA, 19 bp, Homo sapiens
tgtaaaaaaaaatgccttt

SEQ ID NO: 3983040 - DNA, 22 bp, Homo sapiens
tgtaaaatcttggcacagaaac

SEQ ID NO: 3983041 - DNA, 14 bp, Homo sapiens
tgtaaaatgaaatt

SEQ ID NO: 3983042 - DNA, 18 bp, Homo sapiens
tgtaaacacagtcaaaat

SEQ ID NO: 3983043 - DNA, 12 bp, Homo sapiens
tgtaaaccaaag

SEQ ID NO: 3983044 - DNA, 20 bp, Homo sapiens
tgtgctcctcttgattcctg

SEQ ID NO: 3983045 - DNA, 23 bp, Homo sapiens
tgtgctcctcttgattcctggtt

SEQ ID NO: 3983046 - DNA, 23 bp, Homo sapiens
tgtgctgccatttgatttttcta

SEQ ID NO: 3983047 - DNA, 16 bp, Homo sapiens
tgtgctgggggaatga

SEQ ID NO: 3983048 - DNA, 16 bp, Homo sapiens
tgtgctgtggaagcaa

SEQ ID NO: 3983049 - DNA, 13 bp, Homo sapiens
tgtgctgtgggca

SEQ ID NO: 3983050 - DNA, 16 bp, Homo sapiens
tgtgctgtgggcagca

SEQ ID NO: 3983051 - DNA, 19 bp, Homo sapiens
tgtgctgtgtttgctcccc

SEQ ID NO: 3983052 - DNA, 21 bp, Homo sapiens
tgtgctgtgtttgctcccctt

SEQ ID NO: 3983053 - DNA, 15 bp, Homo sapiens
tgtgcttggtctgtt

SEQ ID NO: 3983054 - DNA, 14 bp, Homo sapiens
tgtgcttgttttat

SEQ ID NO: 3983055 - DNA, 16 bp, Homo sapiens
tgtgctttgctcttgt

SEQ ID NO: 3983056 - DNA, 17 bp, Homo sapiens
tgtgctttgctcttgtc

SEQ ID NO: 3983057 - DNA, 21 bp, Homo sapiens
tgtgcttttcctgataaagca

SEQ ID NO: 3983058 - DNA, 16 bp, Homo sapiens
tgtggaaagcactttt

SEQ ID NO: 3983059 - DNA, 16 bp, Homo sapiens
tgtggaaagtgaattt

SEQ ID NO: 3983060 - DNA, 15 bp, Homo sapiens
tgtggacccccaccc

SEQ ID NO: 3983061 - DNA, 20 bp, Homo sapiens
tgtggaccgtggacaggccc

SEQ ID NO: 3983062 - DNA, 19 bp, Homo sapiens
tgtggagcaaaaggcagct

SEQ ID NO: 3983063 - DNA, 16 bp, Homo sapiens
tgtggagctcagcccc

SEQ ID NO: 3983064 - DNA, 12 bp, Homo sapiens
tgtggaggaagg

SEQ ID NO: 3983065 - DNA, 21 bp, Homo sapiens
tgtggaggaaggattgtaaaa

SEQ ID NO: 3983066 - DNA, 23 bp, Homo sapiens
tgtggagggcatttgctgcccca

SEQ ID NO: 3983067 - DNA, 22 bp, Homo sapiens
tgtggagtcagcctcgcaggcc

SEQ ID NO: 3983068 - DNA, 16 bp, Homo sapiens
tgtatgtgcactgtca

SEQ ID NO: 3983069 - DNA, 15 bp, Homo sapiens
tgtatgtgtgttttt

SEQ ID NO: 3983070 - DNA, 15 bp, Homo sapiens
tgtatgttatgaaca

SEQ ID NO: 3983071 - DNA, 16 bp, Homo sapiens
tgtatgttatgaacat

SEQ ID NO: 3983072 - DNA, 17 bp, Homo sapiens
tgtatgttatgaacatg

SEQ ID NO: 3983073 - DNA, 11 bp, Homo sapiens
tgtatgtttac

SEQ ID NO: 3983074 - DNA, 15 bp, Homo sapiens
tgtatgtttacatat

SEQ ID NO: 3983075 - DNA, 16 bp, Homo sapiens
tgtatgtttacatatc

SEQ ID NO: 3983076 - DNA, 16 bp, Homo sapiens
tgtatgtttgcacact

SEQ ID NO: 3983077 - DNA, 22 bp, Homo sapiens
tgtatgtttttgactcttttga

SEQ ID NO: 3983078 - DNA, 20 bp, Homo sapiens
tgtattaaaacacattatgt

SEQ ID NO: 3983079 - DNA, 15 bp, Homo sapiens
tgtattatttataat

SEQ ID NO: 3983080 - DNA, 14 bp, Homo sapiens
tgtattatttggag

SEQ ID NO: 3983081 - DNA, 22 bp, Homo sapiens
tgtattcacgccattggttgga

SEQ ID NO: 3983082 - DNA, 17 bp, Homo sapiens
tgtattcagtgagggtc

SEQ ID NO: 3983083 - DNA, 22 bp, Homo sapiens
tgtattctagctaatgtaataa

SEQ ID NO: 3983084 - DNA, 15 bp, Homo sapiens
tgtattgagatttct

SEQ ID NO: 3983085 - DNA, 14 bp, Homo sapiens
tgtattgcacattg

SEQ ID NO: 3983086 - DNA, 19 bp, Homo sapiens
tgtattgcacattgtaaaa

SEQ ID NO: 3983087 - DNA, 17 bp, Homo sapiens
tgtattgctgctgtgcg

SEQ ID NO: 3983088 - DNA, 16 bp, Homo sapiens
tgtattggttaaaact

SEQ ID NO: 3983089 - DNA, 17 bp, Homo sapiens
tgtattgtaatctttca

SEQ ID NO: 3983090 - DNA, 12 bp, Homo sapiens
tgtattgttccc

SEQ ID NO: 3983091 - DNA, 13 bp, Homo sapiens
tgtattgttccca

SEQ ID NO: 3983092 - DNA, 21 bp, Homo sapiens
tgtatttacgctttgattcat

SEQ ID NO: 3983093 - DNA, 16 bp, Homo sapiens
tgtatttatgtgtgag

SEQ ID NO: 3983094 - DNA, 13 bp, Homo sapiens
tgtatttattaat

SEQ ID NO: 3983095 - DNA, 14 bp, Homo sapiens
tgtatttattaatt

SEQ ID NO: 3983096 - DNA, 15 bp, Homo sapiens
tgtattttaactcat

SEQ ID NO: 3983097 - DNA, 18 bp, Homo sapiens
tgtattttatttagacaa

SEQ ID NO: 3983098 - DNA, 22 bp, Homo sapiens
tgtattttgaagaatatttaag

SEQ ID NO: 3983099 - DNA, 13 bp, Homo sapiens
tgtatttttgtta

SEQ ID NO: 3983100 - DNA, 21 bp, Homo sapiens
tgtattttttaaaacactaaa

SEQ ID NO: 3983101 - DNA, 21 bp, Homo sapiens
tgtattttttaattgattttt

SEQ ID NO: 3983102 - DNA, 21 bp, Homo sapiens
tgtatttttttttctaagaga

SEQ ID NO: 3983103 - DNA, 16 bp, Homo sapiens
tgtcaaagatatgtta

SEQ ID NO: 3983104 - DNA, 20 bp, Homo sapiens
tgtcaacttctggctcctca

SEQ ID NO: 3983105 - DNA, 15 bp, Homo sapiens
tgtcaagccataatt

SEQ ID NO: 3983106 - DNA, 17 bp, Homo sapiens
tgtcaagtggcaaagct

SEQ ID NO: 3983107 - DNA, 18 bp, Homo sapiens
tgtcaagtggcaaagctg

SEQ ID NO: 3983108 - DNA, 19 bp, Homo sapiens
tgtcaagtgggatctgtca

SEQ ID NO: 3983109 - DNA, 19 bp, Homo sapiens
tgtcaagttaacaaggaat

SEQ ID NO: 3983110 - DNA, 20 bp, Homo sapiens
tgtcaagttaacaaggaatg

SEQ ID NO: 3983111 - DNA, 21 bp, Homo sapiens
tgtcaagttaacaaggaatgc

SEQ ID NO: 3983112 - DNA, 18 bp, Homo sapiens
tgtcaagttcctttgggt

SEQ ID NO: 3983113 - DNA, 23 bp, Homo sapiens
tgtcaataaagctgtgcttgggg

SEQ ID NO: 3983114 - DNA, 14 bp, Homo sapiens
tgtcaatattaaat

SEQ ID NO: 3983115 - DNA, 18 bp, Homo sapiens
tgtcaatattaaatacag

SEQ ID NO: 3983116 - DNA, 23 bp, Homo sapiens
tgtcaatattaaatacagacact

SEQ ID NO: 3983117 - DNA, 22 bp, Homo sapiens
tgtcacaagtggtgtttattgc

SEQ ID NO: 3983118 - DNA, 13 bp, Homo sapiens
tgtcacaataaat

SEQ ID NO: 3983119 - DNA, 19 bp, Homo sapiens
tgtcacaatcctaacacat

SEQ ID NO: 3983120 - DNA, 21 bp, Homo sapiens
tgtcacaatcctaacacatta

SEQ ID NO: 3983121 - DNA, 13 bp, Homo sapiens
tgtcacaccagcc

SEQ ID NO: 3983122 - DNA, 11 bp, Homo sapiens
tgtcacagggc

SEQ ID NO: 3983123 - DNA, 17 bp, Homo sapiens
tgtcacattgcattcta

SEQ ID NO: 3983124 - DNA, 23 bp, Homo sapiens
tgtcaccaaggaaacgctacctc

SEQ ID NO: 3983125 - DNA, 14 bp, Homo sapiens
tgtcaccagctatc

SEQ ID NO: 3983126 - DNA, 19 bp, Homo sapiens
tgtcaccagctatctgtca

SEQ ID NO: 3983127 - DNA, 14 bp, Homo sapiens
tgtcacccccactc

SEQ ID NO: 3983128 - DNA, 16 bp, Homo sapiens
tgtcacccccactccc

SEQ ID NO: 3983129 - DNA, 17 bp, Homo sapiens
tgtcaccggtcagtgcc

SEQ ID NO: 3983130 - DNA, 22 bp, Homo sapiens
tgtcaccgtgagcagctttgga

SEQ ID NO: 3983131 - DNA, 17 bp, Homo sapiens
tgtcacctctctcagag

SEQ ID NO: 3983132 - DNA, 19 bp, Homo sapiens
tgtcacctctctcagagca

SEQ ID NO: 3983133 - DNA, 21 bp, Homo sapiens
tgtcacctctctcagagcatc

SEQ ID NO: 3983134 - DNA, 15 bp, Homo sapiens
tgtcactagaatgga

SEQ ID NO: 3983135 - DNA, 22 bp, Homo sapiens
tgtcactcattgctgagcctct

SEQ ID NO: 3983136 - DNA, 23 bp, Homo sapiens
tgtcactcattgctgagcctctg

SEQ ID NO: 3983137 - DNA, 18 bp, Homo sapiens
tgtcactggctggctcct

SEQ ID NO: 3983138 - DNA, 20 bp, Homo sapiens
tgtcactggctggctcctag

SEQ ID NO: 3983139 - DNA, 15 bp, Homo sapiens
tgtcactgtggtcct

SEQ ID NO: 3983140 - DNA, 17 bp, Homo sapiens
tgtcactgtttctctgc

SEQ ID NO: 3983141 - DNA, 14 bp, Homo sapiens
tgtcacttgtgctt

SEQ ID NO: 3983142 - DNA, 18 bp, Homo sapiens
tgtcactttgctctgggt

SEQ ID NO: 3983143 - DNA, 12 bp, Homo sapiens
tgtcacttttta

SEQ ID NO: 3983144 - DNA, 23 bp, Homo sapiens
tgtcagacagaacttgaatgtgt

SEQ ID NO: 3983145 - DNA, 12 bp, Homo sapiens
tgtcagacttta

SEQ ID NO: 3983146 - DNA, 15 bp, Homo sapiens
tgtcagatatgatat

SEQ ID NO: 3983147 - DNA, 20 bp, Homo sapiens
tgtcagatattttttcagaa

SEQ ID NO: 3983148 - DNA, 17 bp, Homo sapiens
tgtcagcatctggctgt

SEQ ID NO: 3983149 - DNA, 17 bp, Homo sapiens
tgtcagccagccgccct

SEQ ID NO: 3983150 - DNA, 19 bp, Homo sapiens
tgtcagccagccgccctgg

SEQ ID NO: 3983151 - DNA, 21 bp, Homo sapiens
tgtcagccgagccgggcctgg

SEQ ID NO: 3983152 - DNA, 20 bp, Homo sapiens
tgtcagcgttctaccaggca

SEQ ID NO: 3983153 - DNA, 15 bp, Homo sapiens
tgtctaacccccagc

SEQ ID NO: 3983154 - DNA, 20 bp, Homo sapiens
tgtctaactcagaattattt

SEQ ID NO: 3983155 - DNA, 13 bp, Homo sapiens
tgtctaattaaaa

SEQ ID NO: 3983156 - DNA, 15 bp, Homo sapiens
tgtctacaaatataa

SEQ ID NO: 3983157 - DNA, 12 bp, Homo sapiens
tgtctagaatgt

SEQ ID NO: 3983158 - DNA, 15 bp, Homo sapiens
tgtctagcacttcct

SEQ ID NO: 3983159 - DNA, 20 bp, Homo sapiens
tgtctaggtctcctcagggt

SEQ ID NO: 3983160 - DNA, 13 bp, Homo sapiens
tgtctattattat

SEQ ID NO: 3983161 - DNA, 19 bp, Homo sapiens
tgtctattcaaaatatcaa

SEQ ID NO: 3983162 - DNA, 13 bp, Homo sapiens
tgtctcactgttc

SEQ ID NO: 3983163 - DNA, 14 bp, Homo sapiens
tgtctcactgttct

SEQ ID NO: 3983164 - DNA, 16 bp, Homo sapiens
tgtctcactgttctgc

SEQ ID NO: 3983165 - DNA, 17 bp, Homo sapiens
tgtctcactgttctgca

SEQ ID NO: 3983166 - DNA, 13 bp, Homo sapiens
tgtctcagcctcc

SEQ ID NO: 3983167 - DNA, 14 bp, Homo sapiens
tgtctcagcctccc

SEQ ID NO: 3983168 - DNA, 15 bp, Homo sapiens
tgtctcagcctccca

SEQ ID NO: 3983169 - DNA, 16 bp, Homo sapiens
tgtctcatccccaggg

SEQ ID NO: 3983170 - DNA, 15 bp, Homo sapiens
tgtctcatcctcctg

SEQ ID NO: 3983171 - DNA, 17 bp, Homo sapiens
tgtctccactaaatgag

SEQ ID NO: 3983172 - DNA, 21 bp, Homo sapiens
tgtctccactaaatgagctcc

SEQ ID NO: 3983173 - DNA, 13 bp, Homo sapiens
tgtctccagctgc

SEQ ID NO: 3983174 - DNA, 17 bp, Homo sapiens
tgccactgcctgcacct

SEQ ID NO: 3983175 - DNA, 20 bp, Homo sapiens
tgccactggcaaatgtaact

SEQ ID NO: 3983176 - DNA, 20 bp, Homo sapiens
tgccacttcactccagcctg

SEQ ID NO: 3983177 - DNA, 24 bp, Homo sapiens
tgccagaaacagtgggagccctga

SEQ ID NO: 3983178 - DNA, 20 bp, Homo sapiens
tgccagaatactgggttctt

SEQ ID NO: 3983179 - DNA, 17 bp, Homo sapiens
tgccagaattttaggaa

SEQ ID NO: 3983180 - DNA, 21 bp, Homo sapiens
tgccagattctgcctctctgg

SEQ ID NO: 3983181 - DNA, 13 bp, Homo sapiens
tgccagcagcccc

SEQ ID NO: 3983182 - DNA, 15 bp, Homo sapiens
tgccagcatatactg

SEQ ID NO: 3983183 - DNA, 20 bp, Homo sapiens
tgccagccgtgatgctcagg

SEQ ID NO: 3983184 - DNA, 21 bp, Homo sapiens
tgccagccgtgatgctcaggc

SEQ ID NO: 3983185 - DNA, 22 bp, Homo sapiens
tgccagcctgaggcagccactt

SEQ ID NO: 3983186 - DNA, 17 bp, Homo sapiens
tgccagccttgagccct

SEQ ID NO: 3983187 - DNA, 19 bp, Homo sapiens
tgccagccttgagccctgg

SEQ ID NO: 3983188 - DNA, 13 bp, Homo sapiens
tgccagcttctct

SEQ ID NO: 3983189 - DNA, 15 bp, Homo sapiens
tgccagcttctctct

SEQ ID NO: 3983190 - DNA, 16 bp, Homo sapiens
tgccagcttctctctc

SEQ ID NO: 3983191 - DNA, 19 bp, Homo sapiens
tgccagcttctctctccag

SEQ ID NO: 3983192 - DNA, 21 bp, Homo sapiens
tgccaggaacctgtcctaagg

SEQ ID NO: 3983193 - DNA, 13 bp, Homo sapiens
tgccaggacacgc

SEQ ID NO: 3983194 - DNA, 16 bp, Homo sapiens
tgccaggactccccag

SEQ ID NO: 3983195 - DNA, 21 bp, Homo sapiens
tgccaggactccccaggccag

SEQ ID NO: 3983196 - DNA, 16 bp, Homo sapiens
tgccaggagcaatggg

SEQ ID NO: 3983197 - DNA, 18 bp, Homo sapiens
tgccaggagcaatgggac

SEQ ID NO: 3983198 - DNA, 20 bp, Homo sapiens
tgccaggagcaatgggactg

SEQ ID NO: 3983199 - DNA, 22 bp, Homo sapiens
tgccaggagcaatgggactgga

SEQ ID NO: 3983200 - DNA, 17 bp, Homo sapiens
tgccaggcaggggtggg

SEQ ID NO: 3983201 - DNA, 18 bp, Homo sapiens
tgccaggcaggggtgggg

SEQ ID NO: 3983202 - DNA, 14 bp, Homo sapiens
tgccaggctgcctc

SEQ ID NO: 3983203 - DNA, 16 bp, Homo sapiens
tgccaggctgcctcct

SEQ ID NO: 3983204 - DNA, 17 bp, Homo sapiens
tgccaggctgcctcctg

SEQ ID NO: 3983205 - DNA, 20 bp, Homo sapiens
tgccaggctgcctcctgccc

SEQ ID NO: 3983206 - DNA, 21 bp, Homo sapiens
tgccaggctgcctcctgccct

SEQ ID NO: 3983207 - DNA, 12 bp, Homo sapiens
tgccagggagct

SEQ ID NO: 3983208 - DNA, 16 bp, Homo sapiens
tgccagggcccacccc

SEQ ID NO: 3983209 - DNA, 21 bp, Homo sapiens
tgccagggcccaccccagcct

SEQ ID NO: 3983210 - DNA, 23 bp, Homo sapiens
tgccagggtgggtgtccatgtgc

SEQ ID NO: 3983211 - DNA, 22 bp, Homo sapiens
tgccagtaacgcgtcttcctga

SEQ ID NO: 3983212 - DNA, 13 bp, Homo sapiens
tgccagtcctggg

SEQ ID NO: 3983213 - DNA, 14 bp, Homo sapiens
tgccagtcctgggg

SEQ ID NO: 3983214 - DNA, 19 bp, Homo sapiens
tgccagtgacagacaggct

SEQ ID NO: 3983215 - DNA, 20 bp, Homo sapiens
tgccagtgacagacaggctc

SEQ ID NO: 3983216 - DNA, 13 bp, Homo sapiens
tgccagttcctgt

SEQ ID NO: 3983217 - DNA, 23 bp, Homo sapiens
tgccataattctaagttatttac

SEQ ID NO: 3983218 - DNA, 22 bp, Homo sapiens
tgccatacatcagttattcatt

SEQ ID NO: 3983219 - DNA, 16 bp, Homo sapiens
tgccatctagccagcc

SEQ ID NO: 3983220 - DNA, 23 bp, Homo sapiens
tgccatgctgggccactggggac

SEQ ID NO: 3983221 - DNA, 18 bp, Homo sapiens
tgccatgtaaatccccac

SEQ ID NO: 3983222 - DNA, 15 bp, Homo sapiens
tgccatgtgcacctt

SEQ ID NO: 3983223 - DNA, 19 bp, Homo sapiens
tgccattccactccactca

SEQ ID NO: 3983224 - DNA, 20 bp, Homo sapiens
tgccattccactccactcag

SEQ ID NO: 3983225 - DNA, 23 bp, Homo sapiens
tgccatttggtgtggattttcta

SEQ ID NO: 3983226 - DNA, 19 bp, Homo sapiens
tgcccaacccttccctcac

SEQ ID NO: 3983227 - DNA, 20 bp, Homo sapiens
tgcccaacccttccctcacc

SEQ ID NO: 3983228 - DNA, 22 bp, Homo sapiens
tgcccaagaatagatgctgact

SEQ ID NO: 3983229 - DNA, 22 bp, Homo sapiens
tgcccaagggcctcccaccaga

SEQ ID NO: 3983230 - DNA, 19 bp, Homo sapiens
tgcccaagtcacacagcta

SEQ ID NO: 3983231 - DNA, 20 bp, Homo sapiens
tgcccaatgagactctaggg

SEQ ID NO: 3983232 - DNA, 14 bp, Homo sapiens
tgcccacaggccgc

SEQ ID NO: 3983233 - DNA, 21 bp, Homo sapiens
tgcccacaggccgccctgcgg

SEQ ID NO: 3983234 - DNA, 23 bp, Homo sapiens
tgcccacatcccaggcttcaccc

SEQ ID NO: 3983235 - DNA, 11 bp, Homo sapiens
tgcccaccccc

SEQ ID NO: 3983236 - DNA, 18 bp, Homo sapiens
tgcccaccccctgccctg

SEQ ID NO: 3983237 - DNA, 23 bp, Homo sapiens
tgcccacccctcactccccaggg

SEQ ID NO: 3983238 - DNA, 22 bp, Homo sapiens
tgcccaccctgggagacagacc

SEQ ID NO: 3983239 - DNA, 17 bp, Homo sapiens
tgcccacctgcccatca

SEQ ID NO: 3983240 - DNA, 14 bp, Homo sapiens
tgcccactccctat

SEQ ID NO: 3983241 - DNA, 17 bp, Homo sapiens
tgcccactccctatctc

SEQ ID NO: 3983242 - DNA, 15 bp, Homo sapiens
tgcccactgctggtg

SEQ ID NO: 3983243 - DNA, 23 bp, Homo sapiens
tgcccagcctctttcccttccag

SEQ ID NO: 3983244 - DNA, 23 bp, Homo sapiens
tgcccagcttttcattgctgtga

SEQ ID NO: 3983245 - DNA, 19 bp, Homo sapiens
tgcccaggagacagaccac

SEQ ID NO: 3983246 - DNA, 17 bp, Homo sapiens
tgcccaggctggtctca

SEQ ID NO: 3983247 - DNA, 14 bp, Homo sapiens
tgcccaggctgtgc

SEQ ID NO: 3983248 - DNA, 19 bp, Homo sapiens
tgcccaggtcaccaagcag

SEQ ID NO: 3983249 - DNA, 18 bp, Homo sapiens
tgcccagtgttgtttgta

SEQ ID NO: 3983250 - DNA, 20 bp, Homo sapiens
tgcccagtgttgtttgtaaa

SEQ ID NO: 3983251 - DNA, 22 bp, Homo sapiens
tgcccagtgttgtttgtaaata

SEQ ID NO: 3983252 - DNA, 18 bp, Homo sapiens
tgcccatcatgtggcccc

SEQ ID NO: 3983253 - DNA, 21 bp, Homo sapiens
tgcccatcatgtggccccacc

SEQ ID NO: 3983254 - DNA, 20 bp, Homo sapiens
tgcccatcctgccatcctca

SEQ ID NO: 3983255 - DNA, 17 bp, Homo sapiens
tgcccatgctgggctcc

SEQ ID NO: 3983256 - DNA, 14 bp, Homo sapiens
tgcccatgtgtccc

SEQ ID NO: 3983257 - DNA, 19 bp, Homo sapiens
tgcccatgtgtcccctcac

SEQ ID NO: 3983258 - DNA, 18 bp, Homo sapiens
tgcccattcaccaaaatt

SEQ ID NO: 3983259 - DNA, 11 bp, Homo sapiens
tgccccaagga

SEQ ID NO: 3983260 - DNA, 12 bp, Homo sapiens
tgccccaaggac

SEQ ID NO: 3983261 - DNA, 18 bp, Homo sapiens
tgatggccttacactgaa

SEQ ID NO: 3983262 - DNA, 12 bp, Homo sapiens
tgatggcttgac

SEQ ID NO: 3983263 - DNA, 21 bp, Homo sapiens
tgatgggggccaggacaccag

SEQ ID NO: 3983264 - DNA, 18 bp, Homo sapiens
tgatggtgacagctgcaa

SEQ ID NO: 3983265 - DNA, 22 bp, Homo sapiens
tgatgtaatctctctgcagctg

SEQ ID NO: 3983266 - DNA, 13 bp, Homo sapiens
tgatgtatatgtt

SEQ ID NO: 3983267 - DNA, 13 bp, Homo sapiens
tgatgtattctag

SEQ ID NO: 3983268 - DNA, 14 bp, Homo sapiens
tgatgtattctagc

SEQ ID NO: 3983269 - DNA, 21 bp, Homo sapiens
tgatgtattctagctaatgta

SEQ ID NO: 3983270 - DNA, 13 bp, Homo sapiens
tgatgtccagaag

SEQ ID NO: 3983271 - DNA, 23 bp, Homo sapiens
tgatgtccagaagaatattcagg

SEQ ID NO: 3983272 - DNA, 20 bp, Homo sapiens
tgatgtgaagataatttgca

SEQ ID NO: 3983273 - DNA, 21 bp, Homo sapiens
tgatgtgaagataatttgcat

SEQ ID NO: 3983274 - DNA, 14 bp, Homo sapiens
tgatgtgacttttt

SEQ ID NO: 3983275 - DNA, 16 bp, Homo sapiens
tgatgtggtgcctgag

SEQ ID NO: 3983276 - DNA, 16 bp, Homo sapiens
tgatgtgttatctctt

SEQ ID NO: 3983277 - DNA, 18 bp, Homo sapiens
tgatgtgtttatttatag

SEQ ID NO: 3983278 - DNA, 17 bp, Homo sapiens
tgatgttttcaggtgtc

SEQ ID NO: 3983279 - DNA, 12 bp, Homo sapiens
tgattaaacacc

SEQ ID NO: 3983280 - DNA, 15 bp, Homo sapiens
tgattaaacacctga

SEQ ID NO: 3983281 - DNA, 16 bp, Homo sapiens
tgattaaacacctgac

SEQ ID NO: 3983282 - DNA, 14 bp, Homo sapiens
tgattaacagagag

SEQ ID NO: 3983283 - DNA, 17 bp, Homo sapiens
tgattaacatctacaat

SEQ ID NO: 3983284 - DNA, 13 bp, Homo sapiens
tgattaatcaaag

SEQ ID NO: 3983285 - DNA, 14 bp, Homo sapiens
tgattaatcaaagg

SEQ ID NO: 3983286 - DNA, 13 bp, Homo sapiens
tgattacacagtt

SEQ ID NO: 3983287 - DNA, 14 bp, Homo sapiens
tgattacacagttg

SEQ ID NO: 3983288 - DNA, 13 bp, Homo sapiens
tgattactgtcaa

SEQ ID NO: 3983289 - DNA, 24 bp, Homo sapiens
tgattactgtcaaggctgcttaga

SEQ ID NO: 3983290 - DNA, 18 bp, Homo sapiens
tggaagcaacaggaatca

SEQ ID NO: 3983291 - DNA, 17 bp, Homo sapiens
tggaagctaatttgcat

SEQ ID NO: 3983292 - DNA, 23 bp, Homo sapiens
tggaaggaacatggagctgtcat

SEQ ID NO: 3983293 - DNA, 23 bp, Homo sapiens
tggaaggcagacagcaggcagcg

SEQ ID NO: 3983294 - DNA, 13 bp, Homo sapiens
tggaaggcccagc

SEQ ID NO: 3983295 - DNA, 16 bp, Homo sapiens
tggaaggcctccctct

SEQ ID NO: 3983296 - DNA, 14 bp, Homo sapiens
tggaagggctgggt

SEQ ID NO: 3983297 - DNA, 14 bp, Homo sapiens
tggaaggggccttg

SEQ ID NO: 3983298 - DNA, 19 bp, Homo sapiens
tggaagggttctggctgcc

SEQ ID NO: 3983299 - DNA, 15 bp, Homo sapiens
tggaaggtctattgg

SEQ ID NO: 3983300 - DNA, 21 bp, Homo sapiens
tggaagtctccatgaagagct

SEQ ID NO: 3983301 - DNA, 18 bp, Homo sapiens
tggaagttattaacttta

SEQ ID NO: 3983302 - DNA, 19 bp, Homo sapiens
tggaagttttcctacactt

SEQ ID NO: 3983303 - DNA, 14 bp, Homo sapiens
tggaataatttgta

SEQ ID NO: 3983304 - DNA, 18 bp, Homo sapiens
tggaatactttttgttat

SEQ ID NO: 3983305 - DNA, 16 bp, Homo sapiens
tggaatagtgaatact

SEQ ID NO: 3983306 - DNA, 23 bp, Homo sapiens
tggaatattcccctatctctaga

SEQ ID NO: 3983307 - DNA, 20 bp, Homo sapiens
tggaatcattgtccagagct

SEQ ID NO: 3983308 - DNA, 18 bp, Homo sapiens
tggaatcgatttcctccc

SEQ ID NO: 3983309 - DNA, 16 bp, Homo sapiens
tggaatctacaagcca

SEQ ID NO: 3983310 - DNA, 17 bp, Homo sapiens
tggaatctggagaccag

SEQ ID NO: 3983311 - DNA, 21 bp, Homo sapiens
tggaatgagtgtgcatggagg

SEQ ID NO: 3983312 - DNA, 15 bp, Homo sapiens
tggaatggacatcct

SEQ ID NO: 3983313 - DNA, 14 bp, Homo sapiens
tggaatgtgcccct

SEQ ID NO: 3983314 - DNA, 23 bp, Homo sapiens
tggaatgtttttccctccccaga

SEQ ID NO: 3983315 - DNA, 18 bp, Homo sapiens
tggaattaaccatttaat

SEQ ID NO: 3983316 - DNA, 16 bp, Homo sapiens
tggaattaacctggtg

SEQ ID NO: 3983317 - DNA, 19 bp, Homo sapiens
tggaattaacctggtgctg

SEQ ID NO: 3983318 - DNA, 13 bp, Homo sapiens
tggaattctaaca

SEQ ID NO: 3983319 - DNA, 12 bp, Homo sapiens
tggaattgattt

SEQ ID NO: 3983320 - DNA, 16 bp, Homo sapiens
tggaattgcttaccaa

SEQ ID NO: 3983321 - DNA, 19 bp, Homo sapiens
tggaatttgtaacctcagc

SEQ ID NO: 3983322 - DNA, 13 bp, Homo sapiens
tggaatttgttca

SEQ ID NO: 3983323 - DNA, 20 bp, Homo sapiens
tggacaaactggagtctgga

SEQ ID NO: 3983324 - DNA, 16 bp, Homo sapiens
tggacaagaggtacag

SEQ ID NO: 3983325 - DNA, 17 bp, Homo sapiens
tggacacacaaggtgca

SEQ ID NO: 3983326 - DNA, 23 bp, Homo sapiens
tggacaccccttatccaggactc

SEQ ID NO: 3983327 - DNA, 19 bp, Homo sapiens
tggacactccagtgccagc

SEQ ID NO: 3983328 - DNA, 16 bp, Homo sapiens
tggacagcagaagcct

SEQ ID NO: 3983329 - DNA, 14 bp, Homo sapiens
tggacagccagtga

SEQ ID NO: 3983330 - DNA, 12 bp, Homo sapiens
tggacagcccca

SEQ ID NO: 3983331 - DNA, 12 bp, Homo sapiens
tggacagctgat

SEQ ID NO: 3983332 - DNA, 18 bp, Homo sapiens
tggacagctgataaattt

SEQ ID NO: 3983333 - DNA, 16 bp, Homo sapiens
tggacaggagtcagtg

SEQ ID NO: 3983334 - DNA, 15 bp, Homo sapiens
tggacaggcccagcg

SEQ ID NO: 3983335 - DNA, 14 bp, Homo sapiens
tggacaggctctgc

SEQ ID NO: 3983336 - DNA, 22 bp, Homo sapiens
tggacagtgggcatcagcagca

SEQ ID NO: 3983337 - DNA, 22 bp, Homo sapiens
tggacatagatattttcacaat

SEQ ID NO: 3983338 - DNA, 18 bp, Homo sapiens
tggacatcctcttctgct

SEQ ID NO: 3983339 - DNA, 19 bp, Homo sapiens
tggacatcctcttctgctt

SEQ ID NO: 3983340 - DNA, 18 bp, Homo sapiens
tggacatttgccttgctg

SEQ ID NO: 3983341 - DNA, 19 bp, Homo sapiens
tggacatttgccttgctgg

SEQ ID NO: 3983342 - DNA, 13 bp, Homo sapiens
tggaccacaggca

SEQ ID NO: 3983343 - DNA, 16 bp, Homo sapiens
tggaccatgccagatt

SEQ ID NO: 3983344 - DNA, 15 bp, Homo sapiens
tggaccgtggacagg

SEQ ID NO: 3983345 - DNA, 16 bp, Homo sapiens
tggaccgtggacaggc

SEQ ID NO: 3983346 - DNA, 17 bp, Homo sapiens
tggaccgtggacaggcc

SEQ ID NO: 3983347 - DNA, 20 bp, Homo sapiens
tggaccgtggacaggcccag

SEQ ID NO: 3983348 - DNA, 19 bp, Homo sapiens
tggacctgcctcctgcctg

SEQ ID NO: 3983349 - DNA, 21 bp, Homo sapiens
tggaccttttaaagtgtttca

SEQ ID NO: 3983350 - DNA, 18 bp, Homo sapiens
tggacggcaggctcactg

SEQ ID NO: 3983351 - DNA, 22 bp, Homo sapiens
tggacggcaggctcactgccag

SEQ ID NO: 3983352 - DNA, 12 bp, Homo sapiens
tggactctcagg

SEQ ID NO: 3983353 - DNA, 15 bp, Homo sapiens
tggactcttctcggc

SEQ ID NO: 3983354 - DNA, 18 bp, Homo sapiens
tggactcttctcggctca

SEQ ID NO: 3983355 - DNA, 17 bp, Homo sapiens
tggactgaagcctgcag

SEQ ID NO: 3983356 - DNA, 19 bp, Homo sapiens
tggactgaagcctgcagga

SEQ ID NO: 3983357 - DNA, 13 bp, Homo sapiens
tggactgcagaag

SEQ ID NO: 3983358 - DNA, 16 bp, Homo sapiens
tggactgcgctggacg

SEQ ID NO: 3983359 - DNA, 17 bp, Homo sapiens
tggactggaggtgggca

SEQ ID NO: 3983360 - DNA, 14 bp, Homo sapiens
tggactggcccctg

SEQ ID NO: 3983361 - DNA, 17 bp, Homo sapiens
tggactggcccctgggt

SEQ ID NO: 3983362 - DNA, 13 bp, Homo sapiens
tggactggctaga

SEQ ID NO: 3983363 - DNA, 15 bp, Homo sapiens
tggactgtgatgcca

SEQ ID NO: 3983364 - DNA, 17 bp, Homo sapiens
tggactgttttctctcg

SEQ ID NO: 3983365 - DNA, 14 bp, Homo sapiens
tggacttctgtggg

SEQ ID NO: 3983366 - DNA, 16 bp, Homo sapiens
tggacttctgtgggcc

SEQ ID NO: 3983367 - DNA, 18 bp, Homo sapiens
tggacttctgtgggcccc

SEQ ID NO: 3983368 - DNA, 13 bp, Homo sapiens
tggacttgtatat

SEQ ID NO: 3983369 - DNA, 15 bp, Homo sapiens
tggacttgtatattt

SEQ ID NO: 3983370 - DNA, 22 bp, Homo sapiens
tggacttgtatatttgtacaaa

SEQ ID NO: 3983371 - DNA, 13 bp, Homo sapiens
tggactttcctgc

SEQ ID NO: 3983372 - DNA, 18 bp, Homo sapiens
tggactttcctgcaactc

SEQ ID NO: 3983373 - DNA, 23 bp, Homo sapiens
tggactttgcttcccctccagga

SEQ ID NO: 3983374 - DNA, 23 bp, Homo sapiens
tggactttggttctctccaggaa

SEQ ID NO: 3983375 - DNA, 17 bp, Homo sapiens
tggagaaaatgggcggg

SEQ ID NO: 3983376 - DNA, 20 bp, Homo sapiens
tggagaacgccagtctccca

SEQ ID NO: 3983377 - DNA, 17 bp, Homo sapiens
tggagaatactttgctt

SEQ ID NO: 3983378 - DNA, 17 bp, Homo sapiens
tggagacacaactattt

SEQ ID NO: 3983379 - DNA, 16 bp, Homo sapiens
tggagaccctgccaca

SEQ ID NO: 3983380 - DNA, 22 bp, Homo sapiens
tggagaccctgccacagccaga

SEQ ID NO: 3983381 - DNA, 14 bp, Homo sapiens
tggagactgtctca

SEQ ID NO: 3983382 - DNA, 15 bp, Homo sapiens
tggagagaagctctt

SEQ ID NO: 3983383 - DNA, 11 bp, Homo sapiens
tggagagaagt

SEQ ID NO: 3983384 - DNA, 13 bp, Homo sapiens
tggagagaagttt

SEQ ID NO: 3983385 - DNA, 14 bp, Homo sapiens
tggagagctggtgc

SEQ ID NO: 3983386 - DNA, 16 bp, Homo sapiens
tggagagctggtgccc

SEQ ID NO: 3983387 - DNA, 19 bp, Homo sapiens
tggagagctggtgcccgga

SEQ ID NO: 3983388 - DNA, 16 bp, Homo sapiens
tggagagggggcctgg

SEQ ID NO: 3983389 - DNA, 13 bp, Homo sapiens
tggagagggtctc

SEQ ID NO: 3983390 - DNA, 15 bp, Homo sapiens
tgcgcctgcaggcag

SEQ ID NO: 3983391 - DNA, 15 bp, Homo sapiens
tgcgcctgctgcctg

SEQ ID NO: 3983392 - DNA, 14 bp, Homo sapiens
tgcgcctgtgacca

SEQ ID NO: 3983393 - DNA, 21 bp, Homo sapiens
tgcgcgccaccgtgcctggct

SEQ ID NO: 3983394 - DNA, 14 bp, Homo sapiens
tgcgctctcaagac

SEQ ID NO: 3983395 - DNA, 19 bp, Homo sapiens
tgcgctggtggaccacagg

SEQ ID NO: 3983396 - DNA, 19 bp, Homo sapiens
tgcgcttgttttaaagtgg

SEQ ID NO: 3983397 - DNA, 16 bp, Homo sapiens
tgcggaggagctgcct

SEQ ID NO: 3983398 - DNA, 13 bp, Homo sapiens
tgcggatggccgg

SEQ ID NO: 3983399 - DNA, 14 bp, Homo sapiens
tgcggccccaggag

SEQ ID NO: 3983400 - DNA, 18 bp, Homo sapiens
tgcggggagacagaagcc

SEQ ID NO: 3983401 - DNA, 13 bp, Homo sapiens
tgcggggcagggc

SEQ ID NO: 3983402 - DNA, 19 bp, Homo sapiens
tgctcctcctgccctgtcc

SEQ ID NO: 3983403 - DNA, 20 bp, Homo sapiens
tgctcctcttgattcctggt

SEQ ID NO: 3983404 - DNA, 15 bp, Homo sapiens
tgctcctgcagcatg

SEQ ID NO: 3983405 - DNA, 11 bp, Homo sapiens
tgctcctgctt

SEQ ID NO: 3983406 - DNA, 19 bp, Homo sapiens
tgctcctgcttttctgtcc

SEQ ID NO: 3983407 - DNA, 23 bp, Homo sapiens
tgctcctgcttttctgtcctggg

SEQ ID NO: 3983408 - DNA, 20 bp, Homo sapiens
tgctcctggagcctttgaat

SEQ ID NO: 3983409 - DNA, 14 bp, Homo sapiens
tgctcgccccagca

SEQ ID NO: 3983410 - DNA, 22 bp, Homo sapiens
tgctcgcctcggatcagctgag

SEQ ID NO: 3983411 - DNA, 20 bp, Homo sapiens
tgctctacaatgacacacaa

SEQ ID NO: 3983412 - DNA, 19 bp, Homo sapiens
tgctctacccatgagcctg

SEQ ID NO: 3983413 - DNA, 15 bp, Homo sapiens
tgctctaggaagaca

SEQ ID NO: 3983414 - DNA, 14 bp, Homo sapiens
tgctctagtgggac

SEQ ID NO: 3983415 - DNA, 17 bp, Homo sapiens
tgctctcagctccgggg

SEQ ID NO: 3983416 - DNA, 19 bp, Homo sapiens
tgctctccaagtctcagtg

SEQ ID NO: 3983417 - DNA, 14 bp, Homo sapiens
tgctctctccacta

SEQ ID NO: 3983418 - DNA, 15 bp, Homo sapiens
tgctctgcatgttac

SEQ ID NO: 3983419 - DNA, 17 bp, Homo sapiens
tgctctgcctcagacgt

SEQ ID NO: 3983420 - DNA, 14 bp, Homo sapiens
tgctctgctcgcct

SEQ ID NO: 3983421 - DNA, 23 bp, Homo sapiens
tgctctggaaaatgtgacccaga

SEQ ID NO: 3983422 - DNA, 12 bp, Homo sapiens
tgctctggaata

SEQ ID NO: 3983423 - DNA, 23 bp, Homo sapiens
tgctctggaataaagttgcagat

SEQ ID NO: 3983424 - DNA, 21 bp, Homo sapiens
tgctctgtcccccaggctgga

SEQ ID NO: 3983425 - DNA, 17 bp, Homo sapiens
tgctctgtgttcccaga

SEQ ID NO: 3983426 - DNA, 20 bp, Homo sapiens
tgctctgtgttcccagaggc

SEQ ID NO: 3983427 - DNA, 17 bp, Homo sapiens
tgctctgttacccaggc

SEQ ID NO: 3983428 - DNA, 14 bp, Homo sapiens
tgctctgttcccag

SEQ ID NO: 3983429 - DNA, 20 bp, Homo sapiens
tgctcttactacactgagga

SEQ ID NO: 3983430 - DNA, 15 bp, Homo sapiens
tgctcttagtcccaa

SEQ ID NO: 3983431 - DNA, 21 bp, Homo sapiens
tgctcttggctgacccctctg

SEQ ID NO: 3983432 - DNA, 23 bp, Homo sapiens
tgctcttgtcccacgtgtcttcc

SEQ ID NO: 3983433 - DNA, 18 bp, Homo sapiens
tgctcttgtcctagcttg

SEQ ID NO: 3983434 - DNA, 19 bp, Homo sapiens
tgctcttgtcctagcttgg

SEQ ID NO: 3983435 - DNA, 18 bp, Homo sapiens
tgctctttcatctctgct

SEQ ID NO: 3983436 - DNA, 16 bp, Homo sapiens
tgctctttcccaccca

SEQ ID NO: 3983437 - DNA, 14 bp, Homo sapiens
tgctctttctctgc

SEQ ID NO: 3983438 - DNA, 15 bp, Homo sapiens
tgctctttctctgcc

SEQ ID NO: 3983439 - DNA, 17 bp, Homo sapiens
tgctctttctctgccag

SEQ ID NO: 3983440 - DNA, 21 bp, Homo sapiens
tgctctttctctgccagtgac

SEQ ID NO: 3983441 - DNA, 22 bp, Homo sapiens
tgctctttctctgccagtgaca

SEQ ID NO: 3983442 - DNA, 19 bp, Homo sapiens
tgctctttgacaactaaaa

SEQ ID NO: 3983443 - DNA, 22 bp, Homo sapiens
tgctctttgacaactaaaatta

SEQ ID NO: 3983444 - DNA, 20 bp, Homo sapiens
tgctcttttcctggtgctct

SEQ ID NO: 3983445 - DNA, 11 bp, Homo sapiens
tgctgaactcc

SEQ ID NO: 3983446 - DNA, 18 bp, Homo sapiens
tgctgaatggttttcaaa

SEQ ID NO: 3983447 - DNA, 20 bp, Homo sapiens
tgctgaccaattgtgctgcc

SEQ ID NO: 3983448 - DNA, 15 bp, Homo sapiens
tgctgacggccaggg

SEQ ID NO: 3983449 - DNA, 14 bp, Homo sapiens
tgctgactgtactc

SEQ ID NO: 3983450 - DNA, 15 bp, Homo sapiens
tgctgagaaaacatg

SEQ ID NO: 3983451 - DNA, 21 bp, Homo sapiens
tgctgagatgaggaggggagc

SEQ ID NO: 3983452 - DNA, 23 bp, Homo sapiens
tgctgagtggcgcaaggccgagc

SEQ ID NO: 3983453 - DNA, 20 bp, Homo sapiens
tgctgatcagagttcctcct

SEQ ID NO: 3983454 - DNA, 23 bp, Homo sapiens
tgctgatcatcgccagaggtgct

SEQ ID NO: 3983455 - DNA, 23 bp, Homo sapiens
tgctgatggcttgacatgtgcaa

SEQ ID NO: 3983456 - DNA, 16 bp, Homo sapiens
tgctgatttcccctct

SEQ ID NO: 3983457 - DNA, 19 bp, Homo sapiens
tgctgatttcccctcttcc

SEQ ID NO: 3983458 - DNA, 21 bp, Homo sapiens
tgctgcaccctgcgcctccag

SEQ ID NO: 3983459 - DNA, 22 bp, Homo sapiens
tgctgcaccctgcgcctccaga

SEQ ID NO: 3983460 - DNA, 13 bp, Homo sapiens
tgctgcagatact

SEQ ID NO: 3983461 - DNA, 12 bp, Homo sapiens
tgctgcagcctg

SEQ ID NO: 3983462 - DNA, 15 bp, Homo sapiens
tgctgcatagctcta

SEQ ID NO: 3983463 - DNA, 20 bp, Homo sapiens
tgctgccacaaccagccagg

SEQ ID NO: 3983464 - DNA, 22 bp, Homo sapiens
tgctgccacacttcaggctctt

SEQ ID NO: 3983465 - DNA, 20 bp, Homo sapiens
tgctgccatttgatttttct

SEQ ID NO: 3983466 - DNA, 16 bp, Homo sapiens
tgctgcccatgtttca

SEQ ID NO: 3983467 - DNA, 17 bp, Homo sapiens
tgctgcccatgtttcaa

SEQ ID NO: 3983468 - DNA, 15 bp, Homo sapiens
tgctgcccctgcagt

SEQ ID NO: 3983469 - DNA, 11 bp, Homo sapiens
tgctgccctgt

SEQ ID NO: 3983470 - DNA, 20 bp, Homo sapiens
tgctgccttgctcctagcag

SEQ ID NO: 3983471 - DNA, 23 bp, Homo sapiens
tgctgcgcaccaatgcccagcag

SEQ ID NO: 3983472 - DNA, 16 bp, Homo sapiens
tgctgcgcctgcaggc

SEQ ID NO: 3983473 - DNA, 19 bp, Homo sapiens
tgctgcgcctgcaggcaga

SEQ ID NO: 3983474 - DNA, 19 bp, Homo sapiens
tgctgcggaggagctgcct

SEQ ID NO: 3983475 - DNA, 18 bp, Homo sapiens
tgctgctaccgccctggg

SEQ ID NO: 3983476 - DNA, 20 bp, Homo sapiens
tgctgctaccgccctgggct

SEQ ID NO: 3983477 - DNA, 15 bp, Homo sapiens
tgctgctccgcccgc

SEQ ID NO: 3983478 - DNA, 14 bp, Homo sapiens
tgctgctgcaccca

SEQ ID NO: 3983479 - DNA, 13 bp, Homo sapiens
tgctgctgcccct

SEQ ID NO: 3983480 - DNA, 16 bp, Homo sapiens
tgctgctgctgcgccc

SEQ ID NO: 3983481 - DNA, 18 bp, Homo sapiens
tgctgctgtgcgtggaaa

SEQ ID NO: 3983482 - DNA, 19 bp, Homo sapiens
tgctgctgtgcgtggaaaa

SEQ ID NO: 3983483 - DNA, 14 bp, Homo sapiens
tgctggaagcccag

SEQ ID NO: 3983484 - DNA, 11 bp, Homo sapiens
tgctggaagtc

SEQ ID NO: 3983485 - DNA, 20 bp, Homo sapiens
tgctggaagtctccatgaag

SEQ ID NO: 3983486 - DNA, 21 bp, Homo sapiens
tgctggacggggactggggat

SEQ ID NO: 3983487 - DNA, 13 bp, Homo sapiens
tgctggaggcctc

SEQ ID NO: 3983488 - DNA, 16 bp, Homo sapiens
tgctggaggcctcagg

SEQ ID NO: 3983489 - DNA, 20 bp, Homo sapiens
tgctggaggcctcaggtgct

SEQ ID NO: 3983490 - DNA, 20 bp, Homo sapiens
tgctggccaaatagcaaaga

SEQ ID NO: 3983491 - DNA, 20 bp, Homo sapiens
tgctggccagcaccctctcc

SEQ ID NO: 3983492 - DNA, 17 bp, Homo sapiens
tgctggcccagggccca

SEQ ID NO: 3983493 - DNA, 18 bp, Homo sapiens
tgctggccgacccactga

SEQ ID NO: 3983494 - DNA, 18 bp, Homo sapiens
tgctggcctggatctccc

SEQ ID NO: 3983495 - DNA, 15 bp, Homo sapiens
tggattggattattt

SEQ ID NO: 3983496 - DNA, 18 bp, Homo sapiens
tgaggaccgctgataagc

SEQ ID NO: 3983497 - DNA, 22 bp, Homo sapiens
tgaggagatgaccagggatgct

SEQ ID NO: 3983498 - DNA, 20 bp, Homo sapiens
tgaggagcccatactcagcc

SEQ ID NO: 3983499 - DNA, 22 bp, Homo sapiens
tgaggagcccatactcagcctg

SEQ ID NO: 3983500 - DNA, 11 bp, Homo sapiens
tgaggagcccc

SEQ ID NO: 3983501 - DNA, 15 bp, Homo sapiens
tgaggagctgctggc

SEQ ID NO: 3983502 - DNA, 13 bp, Homo sapiens
tgaggaggaaaag

SEQ ID NO: 3983503 - DNA, 15 bp, Homo sapiens
tgaggaggaaaagga

SEQ ID NO: 3983504 - DNA, 20 bp, Homo sapiens
tgaggaggaaaaggaaaaaa

SEQ ID NO: 3983505 - DNA, 13 bp, Homo sapiens
tgaggaggaggct

SEQ ID NO: 3983506 - DNA, 20 bp, Homo sapiens
tgaggaggatgtccctgggc

SEQ ID NO: 3983507 - DNA, 23 bp, Homo sapiens
tgaggaggccttgggctctgctg

SEQ ID NO: 3983508 - DNA, 18 bp, Homo sapiens
tgaggatgggtcagagct

SEQ ID NO: 3983509 - DNA, 20 bp, Homo sapiens
tgaggcaataaaaatcatag

SEQ ID NO: 3983510 - DNA, 20 bp, Homo sapiens
tgaggcaatgtcaggaacag

SEQ ID NO: 3983511 - DNA, 21 bp, Homo sapiens
tgaggcaatgtcaggaacaga

SEQ ID NO: 3983512 - DNA, 23 bp, Homo sapiens
tgaggcaggagaactacttgaac

SEQ ID NO: 3983513 - DNA, 14 bp, Homo sapiens
tgaggcaggagaat

SEQ ID NO: 3983514 - DNA, 17 bp, Homo sapiens
tgaggcatgcacatctg

SEQ ID NO: 3983515 - DNA, 17 bp, Homo sapiens
tgaggccatctcaggag

SEQ ID NO: 3983516 - DNA, 19 bp, Homo sapiens
tgaggccatctcaggagat

SEQ ID NO: 3983517 - DNA, 14 bp, Homo sapiens
tgaggccctgccca

SEQ ID NO: 3983518 - DNA, 19 bp, Homo sapiens
tgaggcctgccctcaggga

SEQ ID NO: 3983519 - DNA, 14 bp, Homo sapiens
tgaggcctggactt

SEQ ID NO: 3983520 - DNA, 20 bp, Homo sapiens
tgaggcctggactttcctgc

SEQ ID NO: 3983521 - DNA, 23 bp, Homo sapiens
tgaggcctggactttcctgcaac

SEQ ID NO: 3983522 - DNA, 15 bp, Homo sapiens
tgaggcctggccagg

SEQ ID NO: 3983523 - DNA, 23 bp, Homo sapiens
tgaggctccttagggttttctct

SEQ ID NO: 3983524 - DNA, 14 bp, Homo sapiens
tgaggctggcacag

SEQ ID NO: 3983525 - DNA, 17 bp, Homo sapiens
tgaggctggcacaggac

SEQ ID NO: 3983526 - DNA, 12 bp, Homo sapiens
tgaggctgtcct

SEQ ID NO: 3983527 - DNA, 14 bp, Homo sapiens
tgaggctgtcctgt

SEQ ID NO: 3983528 - DNA, 23 bp, Homo sapiens
tgcaaacacacaaaggtataatt

SEQ ID NO: 3983529 - DNA, 15 bp, Homo sapiens
tgcaaacagaaatca

SEQ ID NO: 3983530 - DNA, 17 bp, Homo sapiens
tgcaaacagaacagggt

SEQ ID NO: 3983531 - DNA, 16 bp, Homo sapiens
tgcaaactcactgctc

SEQ ID NO: 3983532 - DNA, 18 bp, Homo sapiens
tgcaaacttttttatatc

SEQ ID NO: 3983533 - DNA, 20 bp, Homo sapiens
tgcaaacttttttatatctt

SEQ ID NO: 3983534 - DNA, 21 bp, Homo sapiens
tgcaaaggtggcaatgcttaa

SEQ ID NO: 3983535 - DNA, 19 bp, Homo sapiens
tgcaacagactgttgagtt

SEQ ID NO: 3983536 - DNA, 14 bp, Homo sapiens
tgcaacaggcttgt

SEQ ID NO: 3983537 - DNA, 16 bp, Homo sapiens
tgcaacatttgacaaa

SEQ ID NO: 3983538 - DNA, 11 bp, Homo sapiens
tgcaaccactg

SEQ ID NO: 3983539 - DNA, 21 bp, Homo sapiens
tgcaacctctgcctcccaggt

SEQ ID NO: 3983540 - DNA, 19 bp, Homo sapiens
tgcaactaggtatttctaa

SEQ ID NO: 3983541 - DNA, 17 bp, Homo sapiens
tgcaactcaaggacttt

SEQ ID NO: 3983542 - DNA, 22 bp, Homo sapiens
tgcaacttcatgtcaacttctg

SEQ ID NO: 3983543 - DNA, 20 bp, Homo sapiens
tgcaagaaaatgatgtgtac

SEQ ID NO: 3983544 - DNA, 17 bp, Homo sapiens
tgcaagaccctcccatg

SEQ ID NO: 3983545 - DNA, 17 bp, Homo sapiens
tgcaagagtgattgcag

SEQ ID NO: 3983546 - DNA, 18 bp, Homo sapiens
tgcaagatgtgaattatt

SEQ ID NO: 3983547 - DNA, 19 bp, Homo sapiens
tgcaagcaggactttgagg

SEQ ID NO: 3983548 - DNA, 21 bp, Homo sapiens
tgcaagccagggatgaagaaa

SEQ ID NO: 3983549 - DNA, 13 bp, Homo sapiens
tgcaagctgcttg

SEQ ID NO: 3983550 - DNA, 12 bp, Homo sapiens
tgcaaggaagga

SEQ ID NO: 3983551 - DNA, 19 bp, Homo sapiens
tgcaaggaaggaaagaaag

SEQ ID NO: 3983552 - DNA, 14 bp, Homo sapiens
tgcaaggaccagga

SEQ ID NO: 3983553 - DNA, 20 bp, Homo sapiens
tgcaaggactcccggagcct

SEQ ID NO: 3983554 - DNA, 22 bp, Homo sapiens
tgcaaggactcccggagcctgt

SEQ ID NO: 3983555 - DNA, 15 bp, Homo sapiens
tgcagcacgtctcag

SEQ ID NO: 3983556 - DNA, 17 bp, Homo sapiens
tgcagcacgtctcagag

SEQ ID NO: 3983557 - DNA, 14 bp, Homo sapiens
tgcagcagggcagt

SEQ ID NO: 3983558 - DNA, 19 bp, Homo sapiens
tgcagcatgacctgtgacc

SEQ ID NO: 3983559 - DNA, 23 bp, Homo sapiens
tgcagcatgacctgtgaccagca

SEQ ID NO: 3983560 - DNA, 16 bp, Homo sapiens
tgcagcatgagacttt

SEQ ID NO: 3983561 - DNA, 21 bp, Homo sapiens
tgcagcatgagactttctgct

SEQ ID NO: 3983562 - DNA, 19 bp, Homo sapiens
tgcagcatggtccctgcct

SEQ ID NO: 3983563 - DNA, 11 bp, Homo sapiens
tgcagccagct

SEQ ID NO: 3983564 - DNA, 22 bp, Homo sapiens
tgcagcccaccagacgtcaggc

SEQ ID NO: 3983565 - DNA, 17 bp, Homo sapiens
tgcagccccagaagaaa

SEQ ID NO: 3983566 - DNA, 13 bp, Homo sapiens
tgcagcccttggg

SEQ ID NO: 3983567 - DNA, 16 bp, Homo sapiens
tgcagcccttgggcag

SEQ ID NO: 3983568 - DNA, 23 bp, Homo sapiens
tgcagcctcatactcctgggctc

SEQ ID NO: 3983569 - DNA, 12 bp, Homo sapiens
tgcagcctgctc

SEQ ID NO: 3983570 - DNA, 13 bp, Homo sapiens
tgcagcctggctg

SEQ ID NO: 3983571 - DNA, 14 bp, Homo sapiens
tgcagcctggctgg

SEQ ID NO: 3983572 - DNA, 20 bp, Homo sapiens
tgcagcctggctggtcctcc

SEQ ID NO: 3983573 - DNA, 13 bp, Homo sapiens
tgcagccttctcc

SEQ ID NO: 3983574 - DNA, 14 bp, Homo sapiens
tgcagctgatttta

SEQ ID NO: 3983575 - DNA, 18 bp, Homo sapiens
tgcagctgattttaacaa

SEQ ID NO: 3983576 - DNA, 22 bp, Homo sapiens
tgcagctgattttaacaataac

SEQ ID NO: 3983577 - DNA, 14 bp, Homo sapiens
tgcagcttgagttt

SEQ ID NO: 3983578 - DNA, 17 bp, Homo sapiens
tgcaggaataaggcctt

SEQ ID NO: 3983579 - DNA, 20 bp, Homo sapiens
tgcaggaatcaaaaattgaa

SEQ ID NO: 3983580 - DNA, 21 bp, Homo sapiens
tgcaggaatcaaaaattgaag

SEQ ID NO: 3983581 - DNA, 12 bp, Homo sapiens
tgcaggacagga

SEQ ID NO: 3983582 - DNA, 23 bp, Homo sapiens
tgcaggacaggaggcggcccggc

SEQ ID NO: 3983583 - DNA, 15 bp, Homo sapiens
tgcaggagagagcag

SEQ ID NO: 3983584 - DNA, 17 bp, Homo sapiens
tgcaggagagagcagca

SEQ ID NO: 3983585 - DNA, 22 bp, Homo sapiens
tgcaggaggccaaactgtccct

SEQ ID NO: 3983586 - DNA, 23 bp, Homo sapiens
tgcaggagttaaaaagggcaggg

SEQ ID NO: 3983587 - DNA, 14 bp, Homo sapiens
tgcaggcagagctg

SEQ ID NO: 3983588 - DNA, 16 bp, Homo sapiens
tgcaggcagagctgga

SEQ ID NO: 3983589 - DNA, 22 bp, Homo sapiens
tgcaggcagagctggagccccc

SEQ ID NO: 3983590 - DNA, 11 bp, Homo sapiens
tgcaggcaggc

SEQ ID NO: 3983591 - DNA, 13 bp, Homo sapiens
tgcaggcaggctg

SEQ ID NO: 3983592 - DNA, 11 bp, Homo sapiens
tgcaggccctt

SEQ ID NO: 3983593 - DNA, 21 bp, Homo sapiens
tgcaggcgatggggcaagaca

SEQ ID NO: 3983594 - DNA, 13 bp, Homo sapiens
tgcagggagggga

SEQ ID NO: 3983595 - DNA, 15 bp, Homo sapiens
tgcagggaggggagg

SEQ ID NO: 3983596 - DNA, 16 bp, Homo sapiens
tgcagggaggggaggc

SEQ ID NO: 3983597 - DNA, 19 bp, Homo sapiens
tgcagggccactggaagga

SEQ ID NO: 3983598 - DNA, 14 bp, Homo sapiens
tgcagggctggttt

SEQ ID NO: 3983599 - DNA, 23 bp, Homo sapiens
tgcagggttctccctcccacctt

SEQ ID NO: 3983600 - DNA, 19 bp, Homo sapiens
tgcaggttggaaggggcct

SEQ ID NO: 3983601 - DNA, 23 bp, Homo sapiens
tgcaggttggcaaacgggcttga

SEQ ID NO: 3983602 - DNA, 16 bp, Homo sapiens
tgcagtaactgttttt

SEQ ID NO: 3983603 - DNA, 18 bp, Homo sapiens
tgcagtaactgtttttta

SEQ ID NO: 3983604 - DNA, 16 bp, Homo sapiens
tgcagtatcatgccct

SEQ ID NO: 3983605 - DNA, 21 bp, Homo sapiens
tgcagtatcatgccctgtgca

SEQ ID NO: 3983606 - DNA, 17 bp, Homo sapiens
tgcagtcactggaggtt

SEQ ID NO: 3983607 - DNA, 16 bp, Homo sapiens
tgcagtcctgaggaga

SEQ ID NO: 3983608 - DNA, 14 bp, Homo sapiens
tgcagtctcatttc

SEQ ID NO: 3983609 - DNA, 13 bp, Homo sapiens
tgcagtgagctga

SEQ ID NO: 3983610 - DNA, 15 bp, Homo sapiens
tgcagttcattattt

SEQ ID NO: 3983611 - DNA, 20 bp, Homo sapiens
tgcagttcccccaacctcag

SEQ ID NO: 3983612 - DNA, 14 bp, Homo sapiens
tgcagttctgagca

SEQ ID NO: 3983613 - DNA, 16 bp, Homo sapiens
tgcagttgacagcagg

SEQ ID NO: 3983614 - DNA, 17 bp, Homo sapiens
tgcagttgacagcaggt

SEQ ID NO: 3983615 - DNA, 14 bp, Homo sapiens
tgcagttttaagaa

SEQ ID NO: 3983616 - DNA, 18 bp, Homo sapiens
tgcagttttggtgtgtaa

SEQ ID NO: 3983617 - DNA, 12 bp, Homo sapiens
tgcataaatatg

SEQ ID NO: 3983618 - DNA, 22 bp, Homo sapiens
tgcataagtgaaaatcttacaa

SEQ ID NO: 3983619 - DNA, 14 bp, Homo sapiens
tgcataagttaact

SEQ ID NO: 3983620 - DNA, 17 bp, Homo sapiens
tgcataagttaacttcc

SEQ ID NO: 3983621 - DNA, 24 bp, Homo sapiens
tgcataataagctaaagaggctga

SEQ ID NO: 3983622 - DNA, 20 bp, Homo sapiens
tgcataatgataaaataaat

SEQ ID NO: 3983623 - DNA, 17 bp, Homo sapiens
tgcatagcgaaataaaa

SEQ ID NO: 3983624 - DNA, 15 bp, Homo sapiens
tgcatagctctattt

SEQ ID NO: 3983625 - DNA, 21 bp, Homo sapiens
tgcatagtaccaatcatttta

SEQ ID NO: 3983626 - DNA, 14 bp, Homo sapiens
tgcatagtgctggg

SEQ ID NO: 3983627 - DNA, 17 bp, Homo sapiens
tgcatatcctgagccat

SEQ ID NO: 3983628 - DNA, 14 bp, Homo sapiens
tgcatatcttcatc

SEQ ID NO: 3983629 - DNA, 17 bp, Homo sapiens
tgcatatgttgaatact

SEQ ID NO: 3983630 - DNA, 18 bp, Homo sapiens
tgcatattctattgtatt

SEQ ID NO: 3983631 - DNA, 15 bp, Homo sapiens
tgcatatttatccaa

SEQ ID NO: 3983632 - DNA, 19 bp, Homo sapiens
tgcatattttgagaaactg

SEQ ID NO: 3983633 - DNA, 12 bp, Homo sapiens
tctgtgaaatat

SEQ ID NO: 3983634 - DNA, 21 bp, Homo sapiens
tctgtgaacgatttagaaaga

SEQ ID NO: 3983635 - DNA, 13 bp, Homo sapiens
tctgtgaatacaa

SEQ ID NO: 3983636 - DNA, 20 bp, Homo sapiens
tctgtgaatacaattaaagg

SEQ ID NO: 3983637 - DNA, 15 bp, Homo sapiens
tctgtgaattcagat

SEQ ID NO: 3983638 - DNA, 19 bp, Homo sapiens
tctgtgacttagtggacag

SEQ ID NO: 3983639 - DNA, 22 bp, Homo sapiens
tctgtgatttttttttttaatt

SEQ ID NO: 3983640 - DNA, 20 bp, Homo sapiens
tctgtgcagatgagcagtca

SEQ ID NO: 3983641 - DNA, 16 bp, Homo sapiens
tctgtgcagggctggt

SEQ ID NO: 3983642 - DNA, 17 bp, Homo sapiens
tctgtgcagggctggtt

SEQ ID NO: 3983643 - DNA, 20 bp, Homo sapiens
tctgtgcagggctggtttgt

SEQ ID NO: 3983644 - DNA, 16 bp, Homo sapiens
tctgtgcctgcactga

SEQ ID NO: 3983645 - DNA, 22 bp, Homo sapiens
tctgtgcctgcactgagagggc

SEQ ID NO: 3983646 - DNA, 18 bp, Homo sapiens
tctgtgccttcttttgat

SEQ ID NO: 3983647 - DNA, 13 bp, Homo sapiens
tctgtggctggct

SEQ ID NO: 3983648 - DNA, 15 bp, Homo sapiens
tctgtggctggctct

SEQ ID NO: 3983649 - DNA, 19 bp, Homo sapiens
tctgtggctggctctacct

SEQ ID NO: 3983650 - DNA, 23 bp, Homo sapiens
tctgtggctggctctaccttcct

SEQ ID NO: 3983651 - DNA, 11 bp, Homo sapiens
tctgtgtcctt

SEQ ID NO: 3983652 - DNA, 18 bp, Homo sapiens
tctgtgtccttccctgca

SEQ ID NO: 3983653 - DNA, 11 bp, Homo sapiens
tctgtgtcttt

SEQ ID NO: 3983654 - DNA, 13 bp, Homo sapiens
tctgtgtgaatgt

SEQ ID NO: 3983655 - DNA, 14 bp, Homo sapiens
tctgtgtgaatgtg

SEQ ID NO: 3983656 - DNA, 22 bp, Homo sapiens
tctgtgtgaatgtgggcactgg

SEQ ID NO: 3983657 - DNA, 21 bp, Homo sapiens
tctgtgtgtatattgagaatc

SEQ ID NO: 3983658 - DNA, 15 bp, Homo sapiens
tctgtgttcccagag

SEQ ID NO: 3983659 - DNA, 16 bp, Homo sapiens
tctgtgtttttgaaat

SEQ ID NO: 3983660 - DNA, 21 bp, Homo sapiens
tctgttaaggttgaactttgc

SEQ ID NO: 3983661 - DNA, 19 bp, Homo sapiens
tctgttaccatgtcactgt

SEQ ID NO: 3983662 - DNA, 23 bp, Homo sapiens
tctgttatgatttccttcaatgt

SEQ ID NO: 3983663 - DNA, 13 bp, Homo sapiens
tctgttcaccctg

SEQ ID NO: 3983664 - DNA, 14 bp, Homo sapiens
tctgttccaaattc

SEQ ID NO: 3983665 - DNA, 18 bp, Homo sapiens
tctgttcccccaccctcc

SEQ ID NO: 3983666 - DNA, 18 bp, Homo sapiens
tctgttctgctgggagtt

SEQ ID NO: 3983667 - DNA, 24 bp, Homo sapiens
tctgttctgctgggagttctagaa

SEQ ID NO: 3983668 - DNA, 16 bp, Homo sapiens
tctgttgcaattagga

SEQ ID NO: 3983669 - DNA, 22 bp, Homo sapiens
tctgttgcaattaggattttga

SEQ ID NO: 3983670 - DNA, 20 bp, Homo sapiens
tctgtttaagaaaagtattt

SEQ ID NO: 3983671 - DNA, 23 bp, Homo sapiens
tctgtttatggccacatttaata

SEQ ID NO: 3983672 - DNA, 18 bp, Homo sapiens
tctgtttattcttccaga

SEQ ID NO: 3983673 - DNA, 23 bp, Homo sapiens
tctgtttattcttccagaatgct

SEQ ID NO: 3983674 - DNA, 16 bp, Homo sapiens
tctgtttgattctttt

SEQ ID NO: 3983675 - DNA, 18 bp, Homo sapiens
tctgtttgctgtggaact

SEQ ID NO: 3983676 - DNA, 21 bp, Homo sapiens
tctgtttggactgcagaagca

SEQ ID NO: 3983677 - DNA, 12 bp, Homo sapiens
tctgtttgtaaa

SEQ ID NO: 3983678 - DNA, 13 bp, Homo sapiens
tctgtttgtaaat

SEQ ID NO: 3983679 - DNA, 18 bp, Homo sapiens
tctgttttagtatgtaaa

SEQ ID NO: 3983680 - DNA, 17 bp, Homo sapiens
tgaaatagtctgtgtga

SEQ ID NO: 3983681 - DNA, 13 bp, Homo sapiens
tgaaatgaaaaca

SEQ ID NO: 3983682 - DNA, 19 bp, Homo sapiens
tgaaatgaaaacatgtaat

SEQ ID NO: 3983683 - DNA, 20 bp, Homo sapiens
tgaaatgaaaacatgtaata

SEQ ID NO: 3983684 - DNA, 17 bp, Homo sapiens
tgaaatgacctctgtcc

SEQ ID NO: 3983685 - DNA, 17 bp, Homo sapiens
tgaaatgctgttagtaa

SEQ ID NO: 3983686 - DNA, 16 bp, Homo sapiens
tgaaatgttctgttca

SEQ ID NO: 3983687 - DNA, 19 bp, Homo sapiens
tgaaatgttctgttcaccc

SEQ ID NO: 3983688 - DNA, 13 bp, Homo sapiens
tgaaatgttctta

SEQ ID NO: 3983689 - DNA, 19 bp, Homo sapiens
tgaaattaacacaaaggaa

SEQ ID NO: 3983690 - DNA, 21 bp, Homo sapiens
tgaaattaacacaaaggaagt

SEQ ID NO: 3983691 - DNA, 20 bp, Homo sapiens
tgaaattactacaaaatttg

SEQ ID NO: 3983692 - DNA, 16 bp, Homo sapiens
tgaaattactgtgtaa

SEQ ID NO: 3983693 - DNA, 17 bp, Homo sapiens
tgaaattactgtgtaaa

SEQ ID NO: 3983694 - DNA, 21 bp, Homo sapiens
tgaaattatagtttcaagcca

SEQ ID NO: 3983695 - DNA, 14 bp, Homo sapiens
tgaaattatatctg

SEQ ID NO: 3983696 - DNA, 17 bp, Homo sapiens
tgaaattatgtatgttt

SEQ ID NO: 3983697 - DNA, 14 bp, Homo sapiens
tgaaattccagcaa

SEQ ID NO: 3983698 - DNA, 23 bp, Homo sapiens
tgaaattctaaagagcacttact

SEQ ID NO: 3983699 - DNA, 19 bp, Homo sapiens
tgaaattgactgatgattt

SEQ ID NO: 3983700 - DNA, 18 bp, Homo sapiens
tgaaattgtttaagtgtt

SEQ ID NO: 3983701 - DNA, 17 bp, Homo sapiens
tgaaatttattcacata

SEQ ID NO: 3983702 - DNA, 18 bp, Homo sapiens
tgaaatttattcacatat

SEQ ID NO: 3983703 - DNA, 20 bp, Homo sapiens
tgaaattttgcaaatataaa

SEQ ID NO: 3983704 - DNA, 22 bp, Homo sapiens
tgaaatttttaaaaatacactt

SEQ ID NO: 3983705 - DNA, 19 bp, Homo sapiens
tgaaatttttattaaatta

SEQ ID NO: 3983706 - DNA, 13 bp, Homo sapiens
tgaacaaactaaa

SEQ ID NO: 3983707 - DNA, 14 bp, Homo sapiens
tgaacaaagcagcc

SEQ ID NO: 3983708 - DNA, 15 bp, Homo sapiens
tgaacaaagcagcca

SEQ ID NO: 3983709 - DNA, 16 bp, Homo sapiens
tgaacaaagcagccac

SEQ ID NO: 3983710 - DNA, 20 bp, Homo sapiens
tgaacacaggcagctttcta

SEQ ID NO: 3983711 - DNA, 21 bp, Homo sapiens
tgaacagaagctcttactctt

SEQ ID NO: 3983712 - DNA, 19 bp, Homo sapiens
tgaacaggtgggtgtctgc

SEQ ID NO: 3983713 - DNA, 12 bp, Homo sapiens
tgaacagtgcac

SEQ ID NO: 3983714 - DNA, 12 bp, Homo sapiens
tgaacagtggag

SEQ ID NO: 3983715 - DNA, 16 bp, Homo sapiens
tgaacatacttcaaaa

SEQ ID NO: 3983716 - DNA, 23 bp, Homo sapiens
tgaacatacttcaaaaataatgt

SEQ ID NO: 3983717 - DNA, 22 bp, Homo sapiens
tgaacatgcagttcattatttt

SEQ ID NO: 3983718 - DNA, 18 bp, Homo sapiens
tgaacattttatcattaa

SEQ ID NO: 3983719 - DNA, 15 bp, Homo sapiens
tgaaccacttcattc

SEQ ID NO: 3983720 - DNA, 16 bp, Homo sapiens
tgaaccacttcattct

SEQ ID NO: 3983721 - DNA, 18 bp, Homo sapiens
tgaagagctggggagaat

SEQ ID NO: 3983722 - DNA, 14 bp, Homo sapiens
tgaagagcttgctt

SEQ ID NO: 3983723 - DNA, 17 bp, Homo sapiens
tgaagagcttgctttga

SEQ ID NO: 3983724 - DNA, 19 bp, Homo sapiens
tgaagagcttgctttgatt

SEQ ID NO: 3983725 - DNA, 13 bp, Homo sapiens
tgaagaggaacag

SEQ ID NO: 3983726 - DNA, 21 bp, Homo sapiens
tgaagagggagaagcatgaaa

SEQ ID NO: 3983727 - DNA, 17 bp, Homo sapiens
tgaagagtatccttcct

SEQ ID NO: 3983728 - DNA, 23 bp, Homo sapiens
tgaagataagtgtatttttcaat

SEQ ID NO: 3983729 - DNA, 16 bp, Homo sapiens
tgaagatatatttcac

SEQ ID NO: 3983730 - DNA, 20 bp, Homo sapiens
tgaagatatatttcactttt

SEQ ID NO: 3983731 - DNA, 18 bp, Homo sapiens
tgaagatgggggcctctt

SEQ ID NO: 3983732 - DNA, 20 bp, Homo sapiens
tgaagattaggagaaacaca

SEQ ID NO: 3983733 - DNA, 17 bp, Homo sapiens
tgaagcaaagcaccagc

SEQ ID NO: 3983734 - DNA, 20 bp, Homo sapiens
tgaagcaacgataaaattac

SEQ ID NO: 3983735 - DNA, 20 bp, Homo sapiens
tgaagcaaggaagatataca

SEQ ID NO: 3983736 - DNA, 21 bp, Homo sapiens
tgaagcaattagtctgaaact

SEQ ID NO: 3983737 - DNA, 23 bp, Homo sapiens
tgaagcaattagtctgaaactgg

SEQ ID NO: 3983738 - DNA, 17 bp, Homo sapiens
tgaagcagctttaaaca

SEQ ID NO: 3983739 - DNA, 21 bp, Homo sapiens
tgaagcattctccccagtgta

SEQ ID NO: 3983740 - DNA, 11 bp, Homo sapiens
tgaagccaaag

SEQ ID NO: 3983741 - DNA, 12 bp, Homo sapiens
tgaagccaaaga

SEQ ID NO: 3983742 - DNA, 21 bp, Homo sapiens
tgaagccaagtggggtgctgg

SEQ ID NO: 3983743 - DNA, 22 bp, Homo sapiens
tgaagccaagtggggtgctggg

SEQ ID NO: 3983744 - DNA, 19 bp, Homo sapiens
tgaagccaattcagacagg

SEQ ID NO: 3983745 - DNA, 16 bp, Homo sapiens
tgaagcccaagtgaaa

SEQ ID NO: 3983746 - DNA, 17 bp, Homo sapiens
tgaagccgactctggcc

SEQ ID NO: 3983747 - DNA, 20 bp, Homo sapiens
tgaagccgactctggccctg

SEQ ID NO: 3983748 - DNA, 13 bp, Homo sapiens
tgaagcctctggg

SEQ ID NO: 3983749 - DNA, 17 bp, Homo sapiens
tgaagcctgctccttcc

SEQ ID NO: 3983750 - DNA, 13 bp, Homo sapiens
tgaagcctgtgcc

SEQ ID NO: 3983751 - DNA, 14 bp, Homo sapiens
tgaagccttttgtt

SEQ ID NO: 3983752 - DNA, 21 bp, Homo sapiens
tgaagcgaaacacagagaagc

SEQ ID NO: 3983753 - DNA, 21 bp, Homo sapiens
tgaagctaataaaattcgctt

SEQ ID NO: 3983754 - DNA, 14 bp, Homo sapiens
tgaagctactgtgt

SEQ ID NO: 3983755 - DNA, 22 bp, Homo sapiens
tgaagctactgtgtgtgtgaat

SEQ ID NO: 3983756 - DNA, 19 bp, Homo sapiens
tgaagctatttatctgtag

SEQ ID NO: 3983757 - DNA, 23 bp, Homo sapiens
tgaagcttggaggtcacagctgg

SEQ ID NO: 3983758 - DNA, 15 bp, Homo sapiens
tgaaggaaaatgata

SEQ ID NO: 3983759 - DNA, 20 bp, Homo sapiens
tgaaggaagccaaatttatc

SEQ ID NO: 3983760 - DNA, 18 bp, Homo sapiens
tgacttatttctgctctg

SEQ ID NO: 3983761 - DNA, 18 bp, Homo sapiens
tgacttattttctctgtg

SEQ ID NO: 3983762 - DNA, 17 bp, Homo sapiens
tgacttcagctgcctga

SEQ ID NO: 3983763 - DNA, 16 bp, Homo sapiens
tgacttctccaggtct

SEQ ID NO: 3983764 - DNA, 12 bp, Homo sapiens
tgacttgagtgt

SEQ ID NO: 3983765 - DNA, 16 bp, Homo sapiens
tgacttgcatgaagag

SEQ ID NO: 3983766 - DNA, 23 bp, Homo sapiens
tgacttgcatgaagagaagcaat

SEQ ID NO: 3983767 - DNA, 12 bp, Homo sapiens
tgacttgcttta

SEQ ID NO: 3983768 - DNA, 15 bp, Homo sapiens
tgacttgctttagtt

SEQ ID NO: 3983769 - DNA, 12 bp, Homo sapiens
tgacttgtatat

SEQ ID NO: 3983770 - DNA, 19 bp, Homo sapiens
tgacttgtatattttaaga

SEQ ID NO: 3983771 - DNA, 15 bp, Homo sapiens
tgacttgtgtcccat

SEQ ID NO: 3983772 - DNA, 16 bp, Homo sapiens
tgactttaaaagaaaa

SEQ ID NO: 3983773 - DNA, 20 bp, Homo sapiens
tgactttaagtaatcaggat

SEQ ID NO: 3983774 - DNA, 18 bp, Homo sapiens
tgactttatatggatgat

SEQ ID NO: 3983775 - DNA, 13 bp, Homo sapiens
tgactttgcttgc

SEQ ID NO: 3983776 - DNA, 13 bp, Homo sapiens
tgactttggctga

SEQ ID NO: 3983777 - DNA, 21 bp, Homo sapiens
tgactttgtctctcctggctg

SEQ ID NO: 3983778 - DNA, 20 bp, Homo sapiens
tgacttttaaggctaaaact

SEQ ID NO: 3983779 - DNA, 22 bp, Homo sapiens
tgactttttttggtataatgtt

SEQ ID NO: 3983780 - DNA, 17 bp, Homo sapiens
tgactttttttgtatgt

SEQ ID NO: 3983781 - DNA, 18 bp, Homo sapiens
tgactttttttgtatgtg

SEQ ID NO: 3983782 - DNA, 19 bp, Homo sapiens
tgactttttttgtatgtgt

SEQ ID NO: 3983783 - DNA, 12 bp, Homo sapiens
tgagaaaacatg

SEQ ID NO: 3983784 - DNA, 15 bp, Homo sapiens
tgagaaaataaagct

SEQ ID NO: 3983785 - DNA, 23 bp, Homo sapiens
tgagaaaccttattgtacctctc

SEQ ID NO: 3983786 - DNA, 16 bp, Homo sapiens
tgagaaactgctgcag

SEQ ID NO: 3983787 - DNA, 20 bp, Homo sapiens
tgagaaatgaataatttccc

SEQ ID NO: 3983788 - DNA, 22 bp, Homo sapiens
tgagaaatgaataatttcccaa

SEQ ID NO: 3983789 - DNA, 17 bp, Homo sapiens
tgagaactgcttctaag

SEQ ID NO: 3983790 - DNA, 19 bp, Homo sapiens
tgagaagaagtggctgcca

SEQ ID NO: 3983791 - DNA, 16 bp, Homo sapiens
tgagaagaatgaaaat

SEQ ID NO: 3983792 - DNA, 17 bp, Homo sapiens
tgagaagagggcctgtg

SEQ ID NO: 3983793 - DNA, 13 bp, Homo sapiens
tgagaagctgctc

SEQ ID NO: 3983794 - DNA, 22 bp, Homo sapiens
tgagaagctgctccaggcctgc

SEQ ID NO: 3983795 - DNA, 13 bp, Homo sapiens
tgagaaggcagcc

SEQ ID NO: 3983796 - DNA, 14 bp, Homo sapiens
tgagaaggcagcca

SEQ ID NO: 3983797 - DNA, 22 bp, Homo sapiens
tgagaagtcaaacatttcaaag

SEQ ID NO: 3983798 - DNA, 17 bp, Homo sapiens
tgagaagtgccttctcc

SEQ ID NO: 3983799 - DNA, 16 bp, Homo sapiens
tgagaatagtggagga

SEQ ID NO: 3983800 - DNA, 14 bp, Homo sapiens
tgagaatcatttag

SEQ ID NO: 3983801 - DNA, 19 bp, Homo sapiens
tgagaatcatttagcatgt

SEQ ID NO: 3983802 - DNA, 13 bp, Homo sapiens
tgagaatcccaaa

SEQ ID NO: 3983803 - DNA, 22 bp, Homo sapiens
tgagaatcccaaatttgattga

SEQ ID NO: 3983804 - DNA, 21 bp, Homo sapiens
tgagaatctacccccagatcc

SEQ ID NO: 3983805 - DNA, 15 bp, Homo sapiens
tgagaatttctaaaa

SEQ ID NO: 3983806 - DNA, 20 bp, Homo sapiens
tgagaattttatattctaag

SEQ ID NO: 3983807 - DNA, 16 bp, Homo sapiens
tgagacaaaattttag

SEQ ID NO: 3983808 - DNA, 16 bp, Homo sapiens
tgagacaatgttttct

SEQ ID NO: 3983809 - DNA, 19 bp, Homo sapiens
tgagacaatgttttcttca

SEQ ID NO: 3983810 - DNA, 20 bp, Homo sapiens
tgagacaatgttttcttcaa

SEQ ID NO: 3983811 - DNA, 17 bp, Homo sapiens
tgagacacggagcccag

SEQ ID NO: 3983812 - DNA, 19 bp, Homo sapiens
tgagacagggtcttgctct

SEQ ID NO: 3983813 - DNA, 20 bp, Homo sapiens
tgagacagggtcttgctctg

SEQ ID NO: 3983814 - DNA, 14 bp, Homo sapiens
tgagacagtttctt

SEQ ID NO: 3983815 - DNA, 16 bp, Homo sapiens
tgagacagtttcttag

SEQ ID NO: 3983816 - DNA, 22 bp, Homo sapiens
tgagacattgacaccagaaagc

SEQ ID NO: 3983817 - DNA, 13 bp, Homo sapiens
tgagaccagtgta

SEQ ID NO: 3983818 - DNA, 12 bp, Homo sapiens
tgagaccagttg

SEQ ID NO: 3983819 - DNA, 23 bp, Homo sapiens
tgagaccagttgggagcactgga

SEQ ID NO: 3983820 - DNA, 14 bp, Homo sapiens
tgagacccccacac

SEQ ID NO: 3983821 - DNA, 15 bp, Homo sapiens
tgagacccccacacc

SEQ ID NO: 3983822 - DNA, 16 bp, Homo sapiens
tgagacccttttctca

SEQ ID NO: 3983823 - DNA, 23 bp, Homo sapiens
tgagacgtttttggaagagtagt

SEQ ID NO: 3983824 - DNA, 14 bp, Homo sapiens
tgagactatttaaa

SEQ ID NO: 3983825 - DNA, 21 bp, Homo sapiens
tgagactctagggtccagtgg

SEQ ID NO: 3983826 - DNA, 18 bp, Homo sapiens
tgagactctttagagcag

SEQ ID NO: 3983827 - DNA, 19 bp, Homo sapiens
tgagactctttagagcagc

SEQ ID NO: 3983828 - DNA, 19 bp, Homo sapiens
tcttcaacatcaatgttca

SEQ ID NO: 3983829 - DNA, 20 bp, Homo sapiens
tcttcaacatcaatgttcat

SEQ ID NO: 3983830 - DNA, 19 bp, Homo sapiens
tcttcaacatcctgccagc

SEQ ID NO: 3983831 - DNA, 12 bp, Homo sapiens
tcttcacctgtt

SEQ ID NO: 3983832 - DNA, 14 bp, Homo sapiens
tcttcacctgttat

SEQ ID NO: 3983833 - DNA, 18 bp, Homo sapiens
tcttcacctgttatgtat

SEQ ID NO: 3983834 - DNA, 18 bp, Homo sapiens
tcttcactctctgaagat

SEQ ID NO: 3983835 - DNA, 12 bp, Homo sapiens
tcttcagaactt

SEQ ID NO: 3983836 - DNA, 12 bp, Homo sapiens
tcttcagagtga

SEQ ID NO: 3983837 - DNA, 19 bp, Homo sapiens
tcttcagagtgaagaatct

SEQ ID NO: 3983838 - DNA, 13 bp, Homo sapiens
tcttcagccatca

SEQ ID NO: 3983839 - DNA, 17 bp, Homo sapiens
tcttcaggctctgccca

SEQ ID NO: 3983840 - DNA, 18 bp, Homo sapiens
tcttcaggctctgcccag

SEQ ID NO: 3983841 - DNA, 21 bp, Homo sapiens
tcttcagttggttgtgtcttt

SEQ ID NO: 3983842 - DNA, 16 bp, Homo sapiens
tcttcatgttcccact

SEQ ID NO: 3983843 - DNA, 15 bp, Homo sapiens
tcttcattttggttt

SEQ ID NO: 3983844 - DNA, 18 bp, Homo sapiens
tcttccaagcaaaggtga

SEQ ID NO: 3983845 - DNA, 24 bp, Homo sapiens
tcttccaagcaaaggtgaagagac

SEQ ID NO: 3983846 - DNA, 13 bp, Homo sapiens
tcttccactttgc

SEQ ID NO: 3983847 - DNA, 13 bp, Homo sapiens
tcttccaggcagc

SEQ ID NO: 3983848 - DNA, 22 bp, Homo sapiens
tcttccagtttctgtaaggtct

SEQ ID NO: 3983849 - DNA, 21 bp, Homo sapiens
tcttcccactttcatctacct

SEQ ID NO: 3983850 - DNA, 21 bp, Homo sapiens
tcttcccagtaagtttcccct

SEQ ID NO: 3983851 - DNA, 23 bp, Homo sapiens
tcttcccagtaagtttcccctct

SEQ ID NO: 3983852 - DNA, 15 bp, Homo sapiens
tcttcccataataaa

SEQ ID NO: 3983853 - DNA, 15 bp, Homo sapiens
tcttcccatgactgc

SEQ ID NO: 3983854 - DNA, 17 bp, Homo sapiens
tcttccccttcctgttt

SEQ ID NO: 3983855 - DNA, 22 bp, Homo sapiens
tcttccccttcctgtttcagac

SEQ ID NO: 3983856 - DNA, 21 bp, Homo sapiens
tcttccctacctcaggcagga

SEQ ID NO: 3983857 - DNA, 16 bp, Homo sapiens
tcttccctgctttgca

SEQ ID NO: 3983858 - DNA, 11 bp, Homo sapiens
tcttccctggg

SEQ ID NO: 3983859 - DNA, 18 bp, Homo sapiens
tcttcccttattcctaat

SEQ ID NO: 3983860 - DNA, 21 bp, Homo sapiens
tcttcccttattcctaatggc

SEQ ID NO: 3983861 - DNA, 17 bp, Homo sapiens
tcttcctacatcttctt

SEQ ID NO: 3983862 - DNA, 16 bp, Homo sapiens
tcttcctactcttctc

SEQ ID NO: 3983863 - DNA, 22 bp, Homo sapiens
tcttcctactcttctctctgct

SEQ ID NO: 3983864 - DNA, 21 bp, Homo sapiens
tcttcctatttgccatgggct

SEQ ID NO: 3983865 - DNA, 23 bp, Homo sapiens
tcttcctcaaaataaagaagtat

SEQ ID NO: 3983866 - DNA, 15 bp, Homo sapiens
tcttcctcagctggt

SEQ ID NO: 3983867 - DNA, 15 bp, Homo sapiens
tcttcctccagctgc

SEQ ID NO: 3983868 - DNA, 14 bp, Homo sapiens
tcttcctgagtggt

SEQ ID NO: 3983869 - DNA, 18 bp, Homo sapiens
tcttcctgcaaggactac

SEQ ID NO: 3983870 - DNA, 16 bp, Homo sapiens
tcttcctggtgaccct

SEQ ID NO: 3983871 - DNA, 13 bp, Homo sapiens
tcttcctgtgtcc

SEQ ID NO: 3983872 - DNA, 21 bp, Homo sapiens
tcttccttgttgtttgctttg

SEQ ID NO: 3983873 - DNA, 18 bp, Homo sapiens
tcttgtgcttttcctgat

SEQ ID NO: 3983874 - DNA, 15 bp, Homo sapiens
tcttgtggtgtaaag

SEQ ID NO: 3983875 - DNA, 22 bp, Homo sapiens
tcttgtggtgtaaagctggccc

SEQ ID NO: 3983876 - DNA, 23 bp, Homo sapiens
tcttgtggtgtaaagctggccct

SEQ ID NO: 3983877 - DNA, 24 bp, Homo sapiens
tcttgtggtgtaaagctggccctg

SEQ ID NO: 3983878 - DNA, 17 bp, Homo sapiens
tcttgtgtatttcagtt

SEQ ID NO: 3983879 - DNA, 19 bp, Homo sapiens
tcttgtgtgattaacttat

SEQ ID NO: 3983880 - DNA, 17 bp, Homo sapiens
tcttgttagaaaacaaa

SEQ ID NO: 3983881 - DNA, 14 bp, Homo sapiens
tcttgtttcaattc

SEQ ID NO: 3983882 - DNA, 21 bp, Homo sapiens
tcttgttttaagcaaatgcat

SEQ ID NO: 3983883 - DNA, 13 bp, Homo sapiens
tcttgttttgctt

SEQ ID NO: 3983884 - DNA, 13 bp, Homo sapiens
tcttgttttgtct

SEQ ID NO: 3983885 - DNA, 17 bp, Homo sapiens
tcttgtttttattaatt

SEQ ID NO: 3983886 - DNA, 16 bp, Homo sapiens
tctttaaaagaatgac

SEQ ID NO: 3983887 - DNA, 14 bp, Homo sapiens
tctttaaaagagag

SEQ ID NO: 3983888 - DNA, 15 bp, Homo sapiens
tctttaaaattacaa

SEQ ID NO: 3983889 - DNA, 20 bp, Homo sapiens
tctttaaaattacaactaag

SEQ ID NO: 3983890 - DNA, 23 bp, Homo sapiens
tctttaaacagtatttcattgcc

SEQ ID NO: 3983891 - DNA, 13 bp, Homo sapiens
tctttaaagatgt

SEQ ID NO: 3983892 - DNA, 12 bp, Homo sapiens
tctttaaatgtt

SEQ ID NO: 3983893 - DNA, 20 bp, Homo sapiens
tctttaagggcatgccttgt

SEQ ID NO: 3983894 - DNA, 23 bp, Homo sapiens
tctttaatcattttgcctctttt

SEQ ID NO: 3983895 - DNA, 15 bp, Homo sapiens
tctttagaccctcgg

SEQ ID NO: 3983896 - DNA, 20 bp, Homo sapiens
tctttataattctactttga

SEQ ID NO: 3983897 - DNA, 15 bp, Homo sapiens
tctttatagatgtac

SEQ ID NO: 3983898 - DNA, 21 bp, Homo sapiens
tctttcaagggctttcctgtg

SEQ ID NO: 3983899 - DNA, 20 bp, Homo sapiens
tctttcacagctcctcccac

SEQ ID NO: 3983900 - DNA, 23 bp, Homo sapiens
tctttcacattgtttgctgctat

SEQ ID NO: 3983901 - DNA, 22 bp, Homo sapiens
tctttccaggcttccctgactt

SEQ ID NO: 3983902 - DNA, 21 bp, Homo sapiens
tctttccagtggatcataaga

SEQ ID NO: 3983903 - DNA, 16 bp, Homo sapiens
tctttcccttccagtt

SEQ ID NO: 3983904 - DNA, 14 bp, Homo sapiens
tctttcccttcctc

SEQ ID NO: 3983905 - DNA, 16 bp, Homo sapiens
tctttcccttcctcca

SEQ ID NO: 3983906 - DNA, 14 bp, Homo sapiens
tctttcctatttca

SEQ ID NO: 3983907 - DNA, 21 bp, Homo sapiens
tctttcctcaagtatcttcta

SEQ ID NO: 3983908 - DNA, 18 bp, Homo sapiens
tctttcctgttgttgtta

SEQ ID NO: 3983909 - DNA, 14 bp, Homo sapiens
tctttctaatgctg

SEQ ID NO: 3983910 - DNA, 17 bp, Homo sapiens
tctttctacatgactgg

SEQ ID NO: 3983911 - DNA, 21 bp, Homo sapiens
tctttctacatgactgggcct

SEQ ID NO: 3983912 - DNA, 20 bp, Homo sapiens
tctttctagtggtctttgta

SEQ ID NO: 3983913 - DNA, 17 bp, Homo sapiens
tctttctccaaagttat

SEQ ID NO: 3983914 - DNA, 24 bp, Homo sapiens
tctttctccttgaatatctttcga

SEQ ID NO: 3983915 - DNA, 17 bp, Homo sapiens
tctttctctgccagtga

SEQ ID NO: 3983916 - DNA, 13 bp, Homo sapiens
tctttctttaaat

SEQ ID NO: 3983917 - DNA, 16 bp, Homo sapiens
tctttctttaaatgtt

SEQ ID NO: 3983918 - DNA, 18 bp, Homo sapiens
tctttctttaaatgtttt

SEQ ID NO: 3983919 - DNA, 22 bp, Homo sapiens
tctttgaagaaggtggaccttt

SEQ ID NO: 3983920 - DNA, 12 bp, Homo sapiens
tctttgaatttc

SEQ ID NO: 3983921 - DNA, 19 bp, Homo sapiens
tctttgacaactaaaatta

SEQ ID NO: 3983922 - DNA, 17 bp, Homo sapiens
tctttgataatgttaaa

SEQ ID NO: 3983923 - DNA, 21 bp, Homo sapiens
tctttgcccccaaacccccat

SEQ ID NO: 3983924 - DNA, 20 bp, Homo sapiens
tctttgccttgggctgctcc

SEQ ID NO: 3983925 - DNA, 21 bp, Homo sapiens
tctttgccttgggctgctcct

SEQ ID NO: 3983926 - DNA, 19 bp, Homo sapiens
tctttggaaagtacactct

SEQ ID NO: 3983927 - DNA, 15 bp, Homo sapiens
tctttgggccagaca

SEQ ID NO: 3983928 - DNA, 20 bp, Homo sapiens
tctttgtcttatctggccct

SEQ ID NO: 3983929 - DNA, 22 bp, Homo sapiens
tctttgtgacaggaaagccctc

SEQ ID NO: 3983930 - DNA, 22 bp, Homo sapiens
tctttgtgataatttaagagct

SEQ ID NO: 3983931 - DNA, 14 bp, Homo sapiens
tctttgtgcctttg

SEQ ID NO: 3983932 - DNA, 15 bp, Homo sapiens
tctttgttacaggca

SEQ ID NO: 3983933 - DNA, 14 bp, Homo sapiens
tcttttacattctg

SEQ ID NO: 3983934 - DNA, 15 bp, Homo sapiens
tcttttacttgaaaa

SEQ ID NO: 3983935 - DNA, 12 bp, Homo sapiens
tcttttagagag

SEQ ID NO: 3983936 - DNA, 15 bp, Homo sapiens
tcttttagagagggg

SEQ ID NO: 3983937 - DNA, 14 bp, Homo sapiens
tcttttatatttgt

SEQ ID NO: 3983938 - DNA, 14 bp, Homo sapiens
tcttttatctgttt

SEQ ID NO: 3983939 - DNA, 15 bp, Homo sapiens
tcttttatctgttta

SEQ ID NO: 3983940 - DNA, 14 bp, Homo sapiens
tcttttcagaagca

SEQ ID NO: 3983941 - DNA, 23 bp, Homo sapiens
tcttttcataaagggttgaaaat

SEQ ID NO: 3983942 - DNA, 19 bp, Homo sapiens
tcttttcccctttcctgtc

SEQ ID NO: 3983943 - DNA, 17 bp, Homo sapiens
tcttttctctgtgcttc

SEQ ID NO: 3983944 - DNA, 22 bp, Homo sapiens
tcttttctgtcaccaaatttgt

SEQ ID NO: 3983945 - DNA, 22 bp, Homo sapiens
tcttttcttggcaaaagccttg

SEQ ID NO: 3983946 - DNA, 13 bp, Homo sapiens
tcttttgtaattg

SEQ ID NO: 3983947 - DNA, 15 bp, Homo sapiens
tcttttgttaaataa

SEQ ID NO: 3983948 - DNA, 12 bp, Homo sapiens
tcttttgtttcc

SEQ ID NO: 3983949 - DNA, 21 bp, Homo sapiens
tctttttgccagttttccctg

SEQ ID NO: 3983950 - DNA, 20 bp, Homo sapiens
tcttttttagcataaaattt

SEQ ID NO: 3983951 - DNA, 13 bp, Homo sapiens
tcttttttatgtg

SEQ ID NO: 3983952 - DNA, 15 bp, Homo sapiens
tcttttttgctttct

SEQ ID NO: 3983953 - DNA, 23 bp, Homo sapiens
tcttttttttttttttacagtat

SEQ ID NO: 3983954 - DNA, 16 bp, Homo sapiens
tgaaaaaaaagtttca

SEQ ID NO: 3983955 - DNA, 16 bp, Homo sapiens
tgaaaaagtaaagtgt

SEQ ID NO: 3983956 - DNA, 20 bp, Homo sapiens
tgaaaaatattccaagcttc

SEQ ID NO: 3983957 - DNA, 19 bp, Homo sapiens
tgaaaaatttaagcattgt

SEQ ID NO: 3983958 - DNA, 23 bp, Homo sapiens
tgaaaacatggtagaattggaga

SEQ ID NO: 3983959 - DNA, 13 bp, Homo sapiens
tgaaaactctttg

SEQ ID NO: 3983960 - DNA, 16 bp, Homo sapiens
tgaaaacttagccaga

SEQ ID NO: 3983961 - DNA, 15 bp, Homo sapiens
tgaaaacttcagaag

SEQ ID NO: 3983962 - DNA, 18 bp, Homo sapiens
tgaaaagaaagtgtttta

SEQ ID NO: 3983963 - DNA, 13 bp, Homo sapiens
tgaaaagatgtac

SEQ ID NO: 3983964 - DNA, 17 bp, Homo sapiens
tgaaaagatttaagcac

SEQ ID NO: 3983965 - DNA, 17 bp, Homo sapiens
tgaaaagctattagcca

SEQ ID NO: 3983966 - DNA, 23 bp, Homo sapiens
tgaaaagcttcttaattaatttg

SEQ ID NO: 3983967 - DNA, 14 bp, Homo sapiens
tgaaaaggccaaga

SEQ ID NO: 3983968 - DNA, 16 bp, Homo sapiens
tgaaaaggtgaccttg

SEQ ID NO: 3983969 - DNA, 23 bp, Homo sapiens
tgaaaaggtgaccttgcaacttc

SEQ ID NO: 3983970 - DNA, 17 bp, Homo sapiens
tgaaaaggttgcctgaa

SEQ ID NO: 3983971 - DNA, 14 bp, Homo sapiens
tgaaaagtaattga

SEQ ID NO: 3983972 - DNA, 21 bp, Homo sapiens
tgaaaagtatcactctaaaaa

SEQ ID NO: 3983973 - DNA, 22 bp, Homo sapiens
tgaaaagtatcactctaaaaaa

SEQ ID NO: 3983974 - DNA, 19 bp, Homo sapiens
tgaaaatacaacttaaata

SEQ ID NO: 3983975 - DNA, 21 bp, Homo sapiens
tcacgctggggctctctgaga

SEQ ID NO: 3983976 - DNA, 19 bp, Homo sapiens
tcacgggcatgggcactcc

SEQ ID NO: 3983977 - DNA, 21 bp, Homo sapiens
tcacggggttccctcctagct

SEQ ID NO: 3983978 - DNA, 22 bp, Homo sapiens
tcacgtaagatacaagtttcag

SEQ ID NO: 3983979 - DNA, 20 bp, Homo sapiens
tcacgttaccatttacatgt

SEQ ID NO: 3983980 - DNA, 22 bp, Homo sapiens
tcacgtttcatgtaatcctcaa

SEQ ID NO: 3983981 - DNA, 23 bp, Homo sapiens
tcactaaaccgataatgcatgaa

SEQ ID NO: 3983982 - DNA, 15 bp, Homo sapiens
tcactaaccaacaag

SEQ ID NO: 3983983 - DNA, 19 bp, Homo sapiens
tcactaccctattctctct

SEQ ID NO: 3983984 - DNA, 22 bp, Homo sapiens
tcactactcacagtctctttaa

SEQ ID NO: 3983985 - DNA, 15 bp, Homo sapiens
tcactagaagaaaag

SEQ ID NO: 3983986 - DNA, 21 bp, Homo sapiens
tcactagaagaaaagcccatt

SEQ ID NO: 3983987 - DNA, 14 bp, Homo sapiens
tcactagaatggat

SEQ ID NO: 3983988 - DNA, 17 bp, Homo sapiens
tcactagatggcgagca

SEQ ID NO: 3983989 - DNA, 21 bp, Homo sapiens
tcactatcttcttcaaataca

SEQ ID NO: 3983990 - DNA, 23 bp, Homo sapiens
tcactatcttcttcaaatacaaa

SEQ ID NO: 3983991 - DNA, 18 bp, Homo sapiens
tcactatgacactgagca

SEQ ID NO: 3983992 - DNA, 20 bp, Homo sapiens
tcactatggtatgctggcca

SEQ ID NO: 3983993 - DNA, 22 bp, Homo sapiens
tcactattcttggaccatgcca

SEQ ID NO: 3983994 - DNA, 20 bp, Homo sapiens
tcactatttttatttatatt

SEQ ID NO: 3983995 - DNA, 19 bp, Homo sapiens
tcactcattgctgagcctc

SEQ ID NO: 3983996 - DNA, 14 bp, Homo sapiens
tcactccccaagga

SEQ ID NO: 3983997 - DNA, 17 bp, Homo sapiens
tcactccccaaggaaga

SEQ ID NO: 3983998 - DNA, 22 bp, Homo sapiens
tcactccccagggagctctggg

SEQ ID NO: 3983999 - DNA, 13 bp, Homo sapiens
tcactcctggggc

SEQ ID NO: 3984000 - DNA, 14 bp, Homo sapiens
tcactcggcaccct

SEQ ID NO: 3984001 - DNA, 17 bp, Homo sapiens
tcactcggcaccctgca

SEQ ID NO: 3984002 - DNA, 14 bp, Homo sapiens
tcactctaaaaaac

SEQ ID NO: 3984003 - DNA, 19 bp, Homo sapiens
tctgacccagtgcccccac

SEQ ID NO: 3984004 - DNA, 22 bp, Homo sapiens
tctgacccagtgcccccactga

SEQ ID NO: 3984005 - DNA, 18 bp, Homo sapiens
tctgacctgcactgggga

SEQ ID NO: 3984006 - DNA, 20 bp, Homo sapiens
tctgacttaagcaaaagaaa

SEQ ID NO: 3984007 - DNA, 23 bp, Homo sapiens
tctgacttaagcaaaagaaaaag

SEQ ID NO: 3984008 - DNA, 20 bp, Homo sapiens
tctgagaattccaaggagtt

SEQ ID NO: 3984009 - DNA, 16 bp, Homo sapiens
tctgagactctttaga

SEQ ID NO: 3984010 - DNA, 21 bp, Homo sapiens
tctgagactctttagagcagc

SEQ ID NO: 3984011 - DNA, 19 bp, Homo sapiens
tctgagaggctctccgtgc

SEQ ID NO: 3984012 - DNA, 21 bp, Homo sapiens
tctgagaggctctccgtgcag

SEQ ID NO: 3984013 - DNA, 15 bp, Homo sapiens
tctgagatgctcact

SEQ ID NO: 3984014 - DNA, 22 bp, Homo sapiens
tctgagatttttttgtgtatgt

SEQ ID NO: 3984015 - DNA, 16 bp, Homo sapiens
tctgagcagtgcctct

SEQ ID NO: 3984016 - DNA, 18 bp, Homo sapiens
tctgagcagtgcctcttg

SEQ ID NO: 3984017 - DNA, 14 bp, Homo sapiens
tctgagcccagctg

SEQ ID NO: 3984018 - DNA, 22 bp, Homo sapiens
tctgagcccagctgcctggaga

SEQ ID NO: 3984019 - DNA, 14 bp, Homo sapiens
tctgaggccctgcc

SEQ ID NO: 3984020 - DNA, 15 bp, Homo sapiens
tctgagtccactgct

SEQ ID NO: 3984021 - DNA, 14 bp, Homo sapiens
tctgagtttaccat

SEQ ID NO: 3984022 - DNA, 20 bp, Homo sapiens
tctgagtttaccatttgtaa

SEQ ID NO: 3984023 - DNA, 24 bp, Homo sapiens
tctgagtttcattctcctgcctgt

SEQ ID NO: 3984024 - DNA, 23 bp, Homo sapiens
tctgataggaatgtgaaagcacg

SEQ ID NO: 3984025 - DNA, 12 bp, Homo sapiens
tctgatattaat

SEQ ID NO: 3984026 - DNA, 13 bp, Homo sapiens
tctgatattaatc

SEQ ID NO: 3984027 - DNA, 17 bp, Homo sapiens
tctgatattccatgaat

SEQ ID NO: 3984028 - DNA, 20 bp, Homo sapiens
tctgatcagaggtgtacact

SEQ ID NO: 3984029 - DNA, 23 bp, Homo sapiens
tctgatggccttaatttcctttt

SEQ ID NO: 3984030 - DNA, 13 bp, Homo sapiens
tctgatgtcccag

SEQ ID NO: 3984031 - DNA, 21 bp, Homo sapiens
tctgattcagcatcactaaac

SEQ ID NO: 3984032 - DNA, 12 bp, Homo sapiens
tctgattcttct

SEQ ID NO: 3984033 - DNA, 17 bp, Homo sapiens
tctgattggctcaccca

SEQ ID NO: 3984034 - DNA, 18 bp, Homo sapiens
tctgattggctcacccaa

SEQ ID NO: 3984035 - DNA, 14 bp, Homo sapiens
tctgattttaagtt

SEQ ID NO: 3984036 - DNA, 16 bp, Homo sapiens
tctgcaattcccctct

SEQ ID NO: 3984037 - DNA, 20 bp, Homo sapiens
tctgcaattcccctctgctg

SEQ ID NO: 3984038 - DNA, 13 bp, Homo sapiens
tctgcacagatgg

SEQ ID NO: 3984039 - DNA, 15 bp, Homo sapiens
tctgcacagatggat

SEQ ID NO: 3984040 - DNA, 16 bp, Homo sapiens
tctgcacccacgtgca

SEQ ID NO: 3984041 - DNA, 15 bp, Homo sapiens
tctgcacccaggggt

SEQ ID NO: 3984042 - DNA, 15 bp, Homo sapiens
tctgcaccccttctc

SEQ ID NO: 3984043 - DNA, 21 bp, Homo sapiens
tctgcaccccttctctcctcc

SEQ ID NO: 3984044 - DNA, 24 bp, Homo sapiens
tctgcaccctggggcctggacctg

SEQ ID NO: 3984045 - DNA, 16 bp, Homo sapiens
tctgctatatataaaa

SEQ ID NO: 3984046 - DNA, 15 bp, Homo sapiens
tctgctcaccgccca

SEQ ID NO: 3984047 - DNA, 21 bp, Homo sapiens
tctgctcaccgcccatcaggg

SEQ ID NO: 3984048 - DNA, 13 bp, Homo sapiens
tctgctcacttta

SEQ ID NO: 3984049 - DNA, 12 bp, Homo sapiens
tctgctcagcca

SEQ ID NO: 3984050 - DNA, 13 bp, Homo sapiens
tctgctcagccaa

SEQ ID NO: 3984051 - DNA, 20 bp, Homo sapiens
tctgctccaccacatcctcc

SEQ ID NO: 3984052 - DNA, 12 bp, Homo sapiens
tctgctccaccc

SEQ ID NO: 3984053 - DNA, 14 bp, Homo sapiens
tctgctccaccctt

SEQ ID NO: 3984054 - DNA, 23 bp, Homo sapiens
tctgctccacccttggcctgtct

SEQ ID NO: 3984055 - DNA, 16 bp, Homo sapiens
tctgctccccagggga

SEQ ID NO: 3984056 - DNA, 11 bp, Homo sapiens
tctgctcctgc

SEQ ID NO: 3984057 - DNA, 14 bp, Homo sapiens
tctgctcctgcttt

SEQ ID NO: 3984058 - DNA, 21 bp, Homo sapiens
tctgctctggttgtttctgtt

SEQ ID NO: 3984059 - DNA, 15 bp, Homo sapiens
tctgctctttctctg

SEQ ID NO: 3984060 - DNA, 16 bp, Homo sapiens
tctgctctttctctgc

SEQ ID NO: 3984061 - DNA, 17 bp, Homo sapiens
tctgctctttctctgcc

SEQ ID NO: 3984062 - DNA, 17 bp, Homo sapiens
tctgctgagttggcctg

SEQ ID NO: 3984063 - DNA, 14 bp, Homo sapiens
tctgctgcccctgc

SEQ ID NO: 3984064 - DNA, 18 bp, Homo sapiens
tctgctgcccctgcagtt

SEQ ID NO: 3984065 - DNA, 20 bp, Homo sapiens
tctgctgccgcccttcctgg

SEQ ID NO: 3984066 - DNA, 18 bp, Homo sapiens
tctgctggataaaatgag

SEQ ID NO: 3984067 - DNA, 12 bp, Homo sapiens
tctgctggccca

SEQ ID NO: 3984068 - DNA, 14 bp, Homo sapiens
tctgctggcctgga

SEQ ID NO: 3984069 - DNA, 16 bp, Homo sapiens
tctgctggcctggatc

SEQ ID NO: 3984070 - DNA, 15 bp, Homo sapiens
tctgctgtccccttg

SEQ ID NO: 3984071 - DNA, 16 bp, Homo sapiens
tctgcttaggagagac

SEQ ID NO: 3984072 - DNA, 13 bp, Homo sapiens
tctgcttctcatc

SEQ ID NO: 3984073 - DNA, 18 bp, Homo sapiens
tctgcttgctcttgtcct

SEQ ID NO: 3984074 - DNA, 17 bp, Homo sapiens
tctgctttatcttttca

SEQ ID NO: 3984075 - DNA, 18 bp, Homo sapiens
tctgctttatcttttcat

SEQ ID NO: 3984076 - DNA, 20 bp, Homo sapiens
tctgctttatcttttcataa

SEQ ID NO: 3984077 - DNA, 22 bp, Homo sapiens
tctgctttggggtttatcagaa

SEQ ID NO: 3984078 - DNA, 20 bp, Homo sapiens
tctgcttttctgccctggct

SEQ ID NO: 3984079 - DNA, 19 bp, Homo sapiens
tctggaaaagaactgttta

SEQ ID NO: 3984080 - DNA, 17 bp, Homo sapiens
tctggaacccagactca

SEQ ID NO: 3984081 - DNA, 18 bp, Homo sapiens
tctggaacccagactcag

SEQ ID NO: 3984082 - DNA, 23 bp, Homo sapiens
tctggaacccagactcagacatt

SEQ ID NO: 3984083 - DNA, 20 bp, Homo sapiens
tctggaacctcagcctggcc

SEQ ID NO: 3984084 - DNA, 13 bp, Homo sapiens
tctggaagtccaa

SEQ ID NO: 3984085 - DNA, 15 bp, Homo sapiens
tctggaatattgtga

SEQ ID NO: 3984086 - DNA, 23 bp, Homo sapiens
tctggaatggtacatgtcttcca

SEQ ID NO: 3984087 - DNA, 21 bp, Homo sapiens
tctggaatgtttttccctccc

SEQ ID NO: 3984088 - DNA, 23 bp, Homo sapiens
tctggaatgtttttccctcccca

SEQ ID NO: 3984089 - DNA, 20 bp, Homo sapiens
tatttccccctttcttcctc

SEQ ID NO: 3984090 - DNA, 16 bp, Homo sapiens
tatttccctaaaatac

SEQ ID NO: 3984091 - DNA, 19 bp, Homo sapiens
tatttccctaaaatacatt

SEQ ID NO: 3984092 - DNA, 20 bp, Homo sapiens
tatttccctaaaatacattt

SEQ ID NO: 3984093 - DNA, 21 bp, Homo sapiens
tatttccctaaaatacattta

SEQ ID NO: 3984094 - DNA, 21 bp, Homo sapiens
tatttcctgacttgagtgttc

SEQ ID NO: 3984095 - DNA, 15 bp, Homo sapiens
tatttccttaaactg

SEQ ID NO: 3984096 - DNA, 18 bp, Homo sapiens
tatttcctttatgtgaat

SEQ ID NO: 3984097 - DNA, 15 bp, Homo sapiens
tatttcgaaactgcc

SEQ ID NO: 3984098 - DNA, 19 bp, Homo sapiens
tatttctaatccttttcct

SEQ ID NO: 3984099 - DNA, 14 bp, Homo sapiens
tatttctaggcaca

SEQ ID NO: 3984100 - DNA, 19 bp, Homo sapiens
tatttctagttctttcctc

SEQ ID NO: 3984101 - DNA, 12 bp, Homo sapiens
tatttctccttt

SEQ ID NO: 3984102 - DNA, 13 bp, Homo sapiens
tatttctgctctg

SEQ ID NO: 3984103 - DNA, 18 bp, Homo sapiens
tatttcttatacgctttt

SEQ ID NO: 3984104 - DNA, 12 bp, Homo sapiens
tatttcttccct

SEQ ID NO: 3984105 - DNA, 14 bp, Homo sapiens
tatttctttgttat

SEQ ID NO: 3984106 - DNA, 18 bp, Homo sapiens
tatttgaaatactaaaag

SEQ ID NO: 3984107 - DNA, 23 bp, Homo sapiens
tatttgaaatactaaaagcaaat

SEQ ID NO: 3984108 - DNA, 13 bp, Homo sapiens
tatttgaatgaaa

SEQ ID NO: 3984109 - DNA, 15 bp, Homo sapiens
tatttgaatgaaaac

SEQ ID NO: 3984110 - DNA, 18 bp, Homo sapiens
tatttgaatgaaaacatt

SEQ ID NO: 3984111 - DNA, 14 bp, Homo sapiens
tatttgaattaaaa

SEQ ID NO: 3984112 - DNA, 18 bp, Homo sapiens
tatttgaattttaaatct

SEQ ID NO: 3984113 - DNA, 16 bp, Homo sapiens
tatttgagactagttt

SEQ ID NO: 3984114 - DNA, 14 bp, Homo sapiens
tatttgcaacattt

SEQ ID NO: 3984115 - DNA, 15 bp, Homo sapiens
tatttgcatgttacc

SEQ ID NO: 3984116 - DNA, 19 bp, Homo sapiens
tatttgccttctgaaatgt

SEQ ID NO: 3984117 - DNA, 15 bp, Homo sapiens
tatttgctaagcata

SEQ ID NO: 3984118 - DNA, 21 bp, Homo sapiens
tatttgctaatcaaagccagg

SEQ ID NO: 3984119 - DNA, 23 bp, Homo sapiens
tatttgctaattaaaaagttaat

SEQ ID NO: 3984120 - DNA, 15 bp, Homo sapiens
tatttgcttcattgt

SEQ ID NO: 3984121 - DNA, 22 bp, Homo sapiens
tatttgggagggaaaagggaag

SEQ ID NO: 3984122 - DNA, 23 bp, Homo sapiens
tatttgggcctgctccagacctg

SEQ ID NO: 3984123 - DNA, 15 bp, Homo sapiens
tatttgtaggagaaa

SEQ ID NO: 3984124 - DNA, 15 bp, Homo sapiens
tatttgtgagactgt

SEQ ID NO: 3984125 - DNA, 12 bp, Homo sapiens
tatttgtgtttt

SEQ ID NO: 3984126 - DNA, 14 bp, Homo sapiens
tattttaaaatatt

SEQ ID NO: 3984127 - DNA, 15 bp, Homo sapiens
tattttaaaatattt

SEQ ID NO: 3984128 - DNA, 22 bp, Homo sapiens
tattttaaaatatttaaacctt

SEQ ID NO: 3984129 - DNA, 20 bp, Homo sapiens
tattttaaagtaaaagtcta

SEQ ID NO: 3984130 - DNA, 22 bp, Homo sapiens
tattttaaattactatatatgt

SEQ ID NO: 3984131 - DNA, 16 bp, Homo sapiens
tattttaagaattgtt

SEQ ID NO: 3984132 - DNA, 14 bp, Homo sapiens
tattttaatcctgt

SEQ ID NO: 3984133 - DNA, 17 bp, Homo sapiens
tattttactattggaat

SEQ ID NO: 3984134 - DNA, 17 bp, Homo sapiens
tattttatttagacaag

SEQ ID NO: 3984135 - DNA, 20 bp, Homo sapiens
tattttatttccatcatgtc

SEQ ID NO: 3984136 - DNA, 19 bp, Homo sapiens
tattttcaacgcagccctg

SEQ ID NO: 3984137 - DNA, 11 bp, Homo sapiens
tattttcacaa

SEQ ID NO: 3984138 - DNA, 20 bp, Homo sapiens
tattttcccctatcatttat

SEQ ID NO: 3984139 - DNA, 21 bp, Homo sapiens
tattttcccctatcatttatt

SEQ ID NO: 3984140 - DNA, 14 bp, Homo sapiens
tattttctacagtg

SEQ ID NO: 3984141 - DNA, 18 bp, Homo sapiens
tattttctcaatctcctc

SEQ ID NO: 3984142 - DNA, 22 bp, Homo sapiens
tattttctggtagatagaaata

SEQ ID NO: 3984143 - DNA, 12 bp, Homo sapiens
tattttcttaaa

SEQ ID NO: 3984144 - DNA, 20 bp, Homo sapiens
tattttgaaaagcttcttaa

SEQ ID NO: 3984145 - DNA, 21 bp, Homo sapiens
tattttgaagaatatttaaga

SEQ ID NO: 3984146 - DNA, 23 bp, Homo sapiens
tattttgaagaatatttaagaaa

SEQ ID NO: 3984147 - DNA, 14 bp, Homo sapiens
tattttgaagttta

SEQ ID NO: 3984148 - DNA, 19 bp, Homo sapiens
tattttgaagtttacattt

SEQ ID NO: 3984149 - DNA, 22 bp, Homo sapiens
tattttgaagtttacattttta

SEQ ID NO: 3984150 - DNA, 16 bp, Homo sapiens
tattttgagaaactgc

SEQ ID NO: 3984151 - DNA, 15 bp, Homo sapiens
tattttgataataaa

SEQ ID NO: 3984152 - DNA, 16 bp, Homo sapiens
tattttgctgatttaa

SEQ ID NO: 3984153 - DNA, 15 bp, Homo sapiens
tattttggaaactgc

SEQ ID NO: 3984154 - DNA, 15 bp, Homo sapiens
cactgcctctggaat

SEQ ID NO: 3984155 - DNA, 20 bp, Homo sapiens
cactgccttctcctctctgg

SEQ ID NO: 3984156 - DNA, 22 bp, Homo sapiens
cactgccttctcctctctgggc

SEQ ID NO: 3984157 - DNA, 12 bp, Homo sapiens
cactgctggctg

SEQ ID NO: 3984158 - DNA, 17 bp, Homo sapiens
cactgctggtgccaggg

SEQ ID NO: 3984159 - DNA, 21 bp, Homo sapiens
cactgctggtgccagggtggg

SEQ ID NO: 3984160 - DNA, 17 bp, Homo sapiens
cactgctgtacccagat

SEQ ID NO: 3984161 - DNA, 20 bp, Homo sapiens
cactgctgtacccagatgcc

SEQ ID NO: 3984162 - DNA, 18 bp, Homo sapiens
cactgcttgatgaagcaa

SEQ ID NO: 3984163 - DNA, 19 bp, Homo sapiens
cactgcttgatgaagcaag

SEQ ID NO: 3984164 - DNA, 12 bp, Homo sapiens
cactggaaaggg

SEQ ID NO: 3984165 - DNA, 16 bp, Homo sapiens
cactggagcatgcaga

SEQ ID NO: 3984166 - DNA, 20 bp, Homo sapiens
cactggaggttgaagccaag

SEQ ID NO: 3984167 - DNA, 16 bp, Homo sapiens
cactggagtgcaggga

SEQ ID NO: 3984168 - DNA, 17 bp, Homo sapiens
cactggagtgcagggag

SEQ ID NO: 3984169 - DNA, 19 bp, Homo sapiens
cactggatgcaaagaaaat

SEQ ID NO: 3984170 - DNA, 22 bp, Homo sapiens
cctccgaccacttccaggggaa

SEQ ID NO: 3984171 - DNA, 16 bp, Homo sapiens
cctccgaccctcatgg

SEQ ID NO: 3984172 - DNA, 17 bp, Homo sapiens
cctccgccttctcccac

SEQ ID NO: 3984173 - DNA, 16 bp, Homo sapiens
cctccgggtcttccta

SEQ ID NO: 3984174 - DNA, 18 bp, Homo sapiens
cctccgtagggtctttct

SEQ ID NO: 3984175 - DNA, 16 bp, Homo sapiens
cctccgtgatccatcc

SEQ ID NO: 3984176 - DNA, 18 bp, Homo sapiens
cctcctagacccaggtgg

SEQ ID NO: 3984177 - DNA, 12 bp, Homo sapiens
cctcctcacctc

SEQ ID NO: 3984178 - DNA, 16 bp, Homo sapiens
cctcctcacctctgga

SEQ ID NO: 3984179 - DNA, 21 bp, Homo sapiens
cctcctcacctctggactggc

SEQ ID NO: 3984180 - DNA, 22 bp, Homo sapiens
cctcctcacctctggactggct

SEQ ID NO: 3984181 - DNA, 19 bp, Homo sapiens
cctcctccaaaggccccct

SEQ ID NO: 3984182 - DNA, 16 bp, Homo sapiens
cctcctccagcccctg

SEQ ID NO: 3984183 - DNA, 15 bp, Homo sapiens
cctcctccaggcctg

SEQ ID NO: 3984184 - DNA, 20 bp, Homo sapiens
cctcctccagggtgatttta

SEQ ID NO: 3984185 - DNA, 13 bp, Homo sapiens
cctcctccccact

SEQ ID NO: 3984186 - DNA, 19 bp, Homo sapiens
cctcctcggagagcagcag

SEQ ID NO: 3984187 - DNA, 20 bp, Homo sapiens
cctcctcggagagcagcagc

SEQ ID NO: 3984188 - DNA, 22 bp, Homo sapiens
cctcctcgggccgaggcccagc

SEQ ID NO: 3984189 - DNA, 18 bp, Homo sapiens
cctcctcgttcctttctc

SEQ ID NO: 3984190 - DNA, 19 bp, Homo sapiens
cctcctctaaggttgggca

SEQ ID NO: 3984191 - DNA, 13 bp, Homo sapiens
cctcctctgccta

SEQ ID NO: 3984192 - DNA, 15 bp, Homo sapiens
cctcctctgcctaca

SEQ ID NO: 3984193 - DNA, 20 bp, Homo sapiens
cctcctctggacggcaggct

SEQ ID NO: 3984194 - DNA, 22 bp, Homo sapiens
cctcctctggacggcaggctca

SEQ ID NO: 3984195 - DNA, 16 bp, Homo sapiens
cctcctctgtctgccc

SEQ ID NO: 3984196 - DNA, 16 bp, Homo sapiens
cctcctcttcaccagg

SEQ ID NO: 3984197 - DNA, 17 bp, Homo sapiens
tatcacacttctgtgag

SEQ ID NO: 3984198 - DNA, 13 bp, Homo sapiens
tatcacagtatta

SEQ ID NO: 3984199 - DNA, 20 bp, Homo sapiens
tatcacagtattatctgtgt

SEQ ID NO: 3984200 - DNA, 22 bp, Homo sapiens
tatcaccccctccctacacaca

SEQ ID NO: 3984201 - DNA, 15 bp, Homo sapiens
tatcagatacatcac

SEQ ID NO: 3984202 - DNA, 16 bp, Homo sapiens
tatcagatacatcact

SEQ ID NO: 3984203 - DNA, 13 bp, Homo sapiens
tatcagcctgagt

SEQ ID NO: 3984204 - DNA, 20 bp, Homo sapiens
tatcagtcaatatttttaga

SEQ ID NO: 3984205 - DNA, 21 bp, Homo sapiens
tatcagtcaatatttttagat

SEQ ID NO: 3984206 - DNA, 22 bp, Homo sapiens
tatcagtcataactaaataaag

SEQ ID NO: 3984207 - DNA, 16 bp, Homo sapiens
tatcagtgtcctttcc

SEQ ID NO: 3984208 - DNA, 17 bp, Homo sapiens
tatcagtgttttaaatt

SEQ ID NO: 3984209 - DNA, 21 bp, Homo sapiens
tatcagtgttttaaattctga

SEQ ID NO: 3984210 - DNA, 16 bp, Homo sapiens
tatcagttacccactc

SEQ ID NO: 3984211 - DNA, 16 bp, Homo sapiens
tatcatacaaatcagt

SEQ ID NO: 3984212 - DNA, 13 bp, Homo sapiens
tatcatctccatc

SEQ ID NO: 3984213 - DNA, 23 bp, Homo sapiens
tatcatctccatcatatgcctga

SEQ ID NO: 3984214 - DNA, 13 bp, Homo sapiens
tatcatgcaaaat

SEQ ID NO: 3984215 - DNA, 15 bp, Homo sapiens
tatcatgctaaaatt

SEQ ID NO: 3984216 - DNA, 18 bp, Homo sapiens
tatcatgctaaaattcta

SEQ ID NO: 3984217 - DNA, 15 bp, Homo sapiens
tatcatggaatattt

SEQ ID NO: 3984218 - DNA, 15 bp, Homo sapiens
tatcatggagtgacg

SEQ ID NO: 3984219 - DNA, 19 bp, Homo sapiens
tatcattaatttttaattg

SEQ ID NO: 3984220 - DNA, 20 bp, Homo sapiens
tatcatttattttttacatt

SEQ ID NO: 3984221 - DNA, 22 bp, Homo sapiens
tatccaaagaacttgatttgca

SEQ ID NO: 3984222 - DNA, 19 bp, Homo sapiens
tatccaacatcaacatctt

SEQ ID NO: 3984223 - DNA, 13 bp, Homo sapiens
tatccaccacctc

SEQ ID NO: 3984224 - DNA, 15 bp, Homo sapiens
tatccaccacctccc

SEQ ID NO: 3984225 - DNA, 18 bp, Homo sapiens
tatccacgagagcgcagc

SEQ ID NO: 3984226 - DNA, 20 bp, Homo sapiens
tatccatctttttcttttta

SEQ ID NO: 3984227 - DNA, 14 bp, Homo sapiens
tatccatgtactgt

SEQ ID NO: 3984228 - DNA, 16 bp, Homo sapiens
tatccatgtactgtag

SEQ ID NO: 3984229 - DNA, 18 bp, Homo sapiens
tatccatgtactgtagtt

SEQ ID NO: 3984230 - DNA, 20 bp, Homo sapiens
tatccatgtacttgtttgca

SEQ ID NO: 3984231 - DNA, 22 bp, Homo sapiens
tatcccaaagttgttgtaacct

SEQ ID NO: 3984232 - DNA, 16 bp, Homo sapiens
tatcccaatcattgtt

SEQ ID NO: 3984233 - DNA, 15 bp, Homo sapiens
tatccctacatgtat

SEQ ID NO: 3984234 - DNA, 22 bp, Homo sapiens
tatccctctcttccccttccct

SEQ ID NO: 3984235 - DNA, 13 bp, Homo sapiens
tatcctcactgcc

SEQ ID NO: 3984236 - DNA, 15 bp, Homo sapiens
tatcctgcccagtgt

SEQ ID NO: 3984237 - DNA, 16 bp, Homo sapiens
tatcctgcccagtgtt

SEQ ID NO: 3984238 - DNA, 20 bp, Homo sapiens
tatcctgggagcactgcgtt

SEQ ID NO: 3984239 - DNA, 11 bp, Homo sapiens
tatcctggtgc

SEQ ID NO: 3984240 - DNA, 17 bp, Homo sapiens
tatcctgtgactgtctc

SEQ ID NO: 3984241 - DNA, 13 bp, Homo sapiens
tatgtcctgtcat

SEQ ID NO: 3984242 - DNA, 13 bp, Homo sapiens
tatgtctatttaa

SEQ ID NO: 3984243 - DNA, 22 bp, Homo sapiens
tatgtctgctgagttggcctgg

SEQ ID NO: 3984244 - DNA, 14 bp, Homo sapiens
tatgtctgtttaag

SEQ ID NO: 3984245 - DNA, 20 bp, Homo sapiens
tatgtgacatttctcttccc

SEQ ID NO: 3984246 - DNA, 19 bp, Homo sapiens
tatgtgacattttacatta

SEQ ID NO: 3984247 - DNA, 21 bp, Homo sapiens
tatgtgacattttacattaaa

SEQ ID NO: 3984248 - DNA, 19 bp, Homo sapiens
tatgtgagattttttattg

SEQ ID NO: 3984249 - DNA, 16 bp, Homo sapiens
tatgtgagtgcctttt

SEQ ID NO: 3984250 - DNA, 23 bp, Homo sapiens
tatgtgagtgccttttgcagaag

SEQ ID NO: 3984251 - DNA, 19 bp, Homo sapiens
tatgtggtttccacgatga

SEQ ID NO: 3984252 - DNA, 14 bp, Homo sapiens
tatgtgtaaaatgt

SEQ ID NO: 3984253 - DNA, 17 bp, Homo sapiens
tatgtgtaaaatgtgaa

SEQ ID NO: 3984254 - DNA, 20 bp, Homo sapiens
tatgtgtatgcacagtaaaa

SEQ ID NO: 3984255 - DNA, 20 bp, Homo sapiens
tatgtgtctttatagatgta

SEQ ID NO: 3984256 - DNA, 13 bp, Homo sapiens
tatgttaaatact

SEQ ID NO: 3984257 - DNA, 21 bp, Homo sapiens
tatgttaaatactgtgcagaa

SEQ ID NO: 3984258 - DNA, 19 bp, Homo sapiens
tatgttaacctcagtgtca

SEQ ID NO: 3984259 - DNA, 22 bp, Homo sapiens
tatgttaagcagctaaattttc

SEQ ID NO: 3984260 - DNA, 12 bp, Homo sapiens
tatgttactatt

SEQ ID NO: 3984261 - DNA, 16 bp, Homo sapiens
tatgttactattttct

SEQ ID NO: 3984262 - DNA, 14 bp, Homo sapiens
tatgttatatcaac

SEQ ID NO: 3984263 - DNA, 16 bp, Homo sapiens
tatgttcagattattg

SEQ ID NO: 3984264 - DNA, 15 bp, Homo sapiens
tatgttgaatacttt

SEQ ID NO: 3984265 - DNA, 21 bp, Homo sapiens
tatgttgggggggaccctgcc

SEQ ID NO: 3984266 - DNA, 23 bp, Homo sapiens
tatgttgggggggaccctgcctc

SEQ ID NO: 3984267 - DNA, 12 bp, Homo sapiens
tatgtttccttg

SEQ ID NO: 3984268 - DNA, 14 bp, Homo sapiens
tatgtttccttgtt

SEQ ID NO: 3984269 - DNA, 12 bp, Homo sapiens
tatgtttgaata

SEQ ID NO: 3984270 - DNA, 16 bp, Homo sapiens
tatgtttgaatatgga

SEQ ID NO: 3984271 - DNA, 19 bp, Homo sapiens
tatgtttgcacacttgtgt

SEQ ID NO: 3984272 - DNA, 17 bp, Homo sapiens
tatgtttttatttatga

SEQ ID NO: 3984273 - DNA, 17 bp, Homo sapiens
tatgtttttgactcttt

SEQ ID NO: 3984274 - DNA, 21 bp, Homo sapiens
tatgtttttgactcttttgag

SEQ ID NO: 3984275 - DNA, 17 bp, Homo sapiens
tatgttttttaaaatat

SEQ ID NO: 3984276 - DNA, 23 bp, Homo sapiens
tatgttttttagatcaaatactt

SEQ ID NO: 3984277 - DNA, 18 bp, Homo sapiens
tattaaaacacattatgt

SEQ ID NO: 3984278 - DNA, 23 bp, Homo sapiens
tattaaaacacattatgtatctt

SEQ ID NO: 3984279 - DNA, 22 bp, Homo sapiens
tattaaaatatggctataaata

SEQ ID NO: 3984280 - DNA, 20 bp, Homo sapiens
tattaaagtctaaacaaaat

SEQ ID NO: 3984281 - DNA, 13 bp, Homo sapiens
tattaaagtgact

SEQ ID NO: 3984282 - DNA, 16 bp, Homo sapiens
tattaaatacaaaact

SEQ ID NO: 3984283 - DNA, 17 bp, Homo sapiens
tattaaatacagacact

SEQ ID NO: 3984284 - DNA, 16 bp, Homo sapiens
tattaacaaattatgt

SEQ ID NO: 3984285 - DNA, 19 bp, Homo sapiens
tattaagcagtaaaaactg

SEQ ID NO: 3984286 - DNA, 13 bp, Homo sapiens
tattaatattatt

SEQ ID NO: 3984287 - DNA, 13 bp, Homo sapiens
tattaatatttaa

SEQ ID NO: 3984288 - DNA, 13 bp, Homo sapiens
tattaatttgaaa

SEQ ID NO: 3984289 - DNA, 14 bp, Homo sapiens
tattacaaaaacaa

SEQ ID NO: 3984290 - DNA, 11 bp, Homo sapiens
tattacaaata

SEQ ID NO: 3984291 - DNA, 15 bp, Homo sapiens
tattaccatgagaag

SEQ ID NO: 3984292 - DNA, 13 bp, Homo sapiens
tattacctctgat

SEQ ID NO: 3984293 - DNA, 22 bp, Homo sapiens
tattactatgactgctccccag

SEQ ID NO: 3984294 - DNA, 21 bp, Homo sapiens
tattactctcacccataaaca

SEQ ID NO: 3984295 - DNA, 16 bp, Homo sapiens
tattactgttgcattt

SEQ ID NO: 3984296 - DNA, 17 bp, Homo sapiens
tattactgttgcattta

SEQ ID NO: 3984297 - DNA, 19 bp, Homo sapiens
tattactgttgcatttact

SEQ ID NO: 3984298 - DNA, 22 bp, Homo sapiens
tattactgttgcatttactttt

SEQ ID NO: 3984299 - DNA, 17 bp, Homo sapiens
tattagccaggatcatg

SEQ ID NO: 3984300 - DNA, 19 bp, Homo sapiens
tattagccaggatcatggt

SEQ ID NO: 3984301 - DNA, 23 bp, Homo sapiens
tattagccaggatcatggtgtaa

SEQ ID NO: 3984302 - DNA, 16 bp, Homo sapiens
tattagggagaaaatt

SEQ ID NO: 3984303 - DNA, 22 bp, Homo sapiens
tattagttccctgtctcttgaa

SEQ ID NO: 3984304 - DNA, 23 bp, Homo sapiens
tattagttccctgtctcttgaaa

SEQ ID NO: 3984305 - DNA, 16 bp, Homo sapiens
tattataacttaaaaa

SEQ ID NO: 3984306 - DNA, 20 bp, Homo sapiens
tattataagcattgaaatta

SEQ ID NO: 3984307 - DNA, 23 bp, Homo sapiens
tattataagggagagctgagcca

SEQ ID NO: 3984308 - DNA, 23 bp, Homo sapiens
tattataatataatatggaacct

SEQ ID NO: 3984309 - DNA, 15 bp, Homo sapiens
tattatactaagaaa

SEQ ID NO: 3984310 - DNA, 15 bp, Homo sapiens
tattatcaacaatag

SEQ ID NO: 3984311 - DNA, 14 bp, Homo sapiens
tattatcataagaa

SEQ ID NO: 3984312 - DNA, 15 bp, Homo sapiens
tattatcgctttatg

SEQ ID NO: 3984313 - DNA, 12 bp, Homo sapiens
tattatctttaa

SEQ ID NO: 3984314 - DNA, 15 bp, Homo sapiens
tattatgaaatttca

SEQ ID NO: 3984315 - DNA, 13 bp, Homo sapiens
tattattagaaat

SEQ ID NO: 3984316 - DNA, 19 bp, Homo sapiens
tattattagaaattagaaa

SEQ ID NO: 3984317 - DNA, 13 bp, Homo sapiens
tattattattaaa

SEQ ID NO: 3984318 - DNA, 13 bp, Homo sapiens
tattattctgcag

SEQ ID NO: 3984319 - DNA, 16 bp, Homo sapiens
tattattgtaagttgt

SEQ ID NO: 3984320 - DNA, 22 bp, Homo sapiens
tattattgtaagttgtacaaat

SEQ ID NO: 3984321 - DNA, 15 bp, Homo sapiens
tattatttataattc

SEQ ID NO: 3984322 - DNA, 15 bp, Homo sapiens
tattatttatttctg

SEQ ID NO: 3984323 - DNA, 14 bp, Homo sapiens
tattatttgtgttt

SEQ ID NO: 3984324 - DNA, 21 bp, Homo sapiens
tattattttggggtctctttt

SEQ ID NO: 3984325 - DNA, 16 bp, Homo sapiens
tattcaattcctctgg

SEQ ID NO: 3984326 - DNA, 17 bp, Homo sapiens
tattcaattcctctggg

SEQ ID NO: 3984327 - DNA, 22 bp, Homo sapiens
tattcacatcgcttctgtgtat

SEQ ID NO: 3984328 - DNA, 22 bp, Homo sapiens
tattcacgccattggttggaag

SEQ ID NO: 3984329 - DNA, 20 bp, Homo sapiens
tattcaggagttggaatgtt

SEQ ID NO: 3984330 - DNA, 18 bp, Homo sapiens
tattcagtgaaaagattt

SEQ ID NO: 3984331 - DNA, 19 bp, Homo sapiens
tattcattctgcattgcta

SEQ ID NO: 3984332 - DNA, 22 bp, Homo sapiens
tattcattctgtgatcatttat

SEQ ID NO: 3984333 - DNA, 17 bp, Homo sapiens
tattcatttaaaatgat

SEQ ID NO: 3984334 - DNA, 23 bp, Homo sapiens
tattccagaatgctgtacatcta

SEQ ID NO: 3984335 - DNA, 12 bp, Homo sapiens
tattccagagct

SEQ ID NO: 3984336 - DNA, 11 bp, Homo sapiens
tattccatcaa

SEQ ID NO: 3984337 - DNA, 13 bp, Homo sapiens
tattccatcaata

SEQ ID NO: 3984338 - DNA, 17 bp, Homo sapiens
tattccatcaataaatg

SEQ ID NO: 3984339 - DNA, 17 bp, Homo sapiens
tattccatgaatgtatc

SEQ ID NO: 3984340 - DNA, 23 bp, Homo sapiens
tattccatgaatgtatcaggaaa

SEQ ID NO: 3984341 - DNA, 19 bp, Homo sapiens
tattccccaccctcccctt

SEQ ID NO: 3984342 - DNA, 14 bp, Homo sapiens
tattcctctgtcct

SEQ ID NO: 3984343 - DNA, 15 bp, Homo sapiens
tattcctctgtccta

SEQ ID NO: 3984344 - DNA, 19 bp, Homo sapiens
tcaaggagaccatgtatgt

SEQ ID NO: 3984345 - DNA, 17 bp, Homo sapiens
tcaaggctgcttagaat

SEQ ID NO: 3984346 - DNA, 18 bp, Homo sapiens
tcaaggctgcttagaatc

SEQ ID NO: 3984347 - DNA, 14 bp, Homo sapiens
tcaaggcttccact

SEQ ID NO: 3984348 - DNA, 17 bp, Homo sapiens
tcaagggcttactattt

SEQ ID NO: 3984349 - DNA, 18 bp, Homo sapiens
tcaagggcttactatttc

SEQ ID NO: 3984350 - DNA, 22 bp, Homo sapiens
tcaagtaagaagacatgaacca

SEQ ID NO: 3984351 - DNA, 16 bp, Homo sapiens
tcaagtatcttctatt

SEQ ID NO: 3984352 - DNA, 12 bp, Homo sapiens
tcaagtattttg

SEQ ID NO: 3984353 - DNA, 22 bp, Homo sapiens
tcaagtggcaaagctgttcttc

SEQ ID NO: 3984354 - DNA, 14 bp, Homo sapiens
tcaagttaaagtga

SEQ ID NO: 3984355 - DNA, 23 bp, Homo sapiens
tcaagttgagatttttaagaact

SEQ ID NO: 3984356 - DNA, 13 bp, Homo sapiens
tcaagttgtaaaa

SEQ ID NO: 3984357 - DNA, 16 bp, Homo sapiens
tcaagttgtaaataat

SEQ ID NO: 3984358 - DNA, 14 bp, Homo sapiens
tcaataaaatgtga

SEQ ID NO: 3984359 - DNA, 15 bp, Homo sapiens
tcaataaaatgtgat

SEQ ID NO: 3984360 - DNA, 18 bp, Homo sapiens
tcaataaaatgtgatttt

SEQ ID NO: 3984361 - DNA, 16 bp, Homo sapiens
tcaataaacaacagct

SEQ ID NO: 3984362 - DNA, 23 bp, Homo sapiens
tcaataaacagcttcatgccttt

SEQ ID NO: 3984363 - DNA, 15 bp, Homo sapiens
tcaataaagcattta

SEQ ID NO: 3984364 - DNA, 14 bp, Homo sapiens
tcaataacagccgc

SEQ ID NO: 3984365 - DNA, 16 bp, Homo sapiens
tcaataacagccgctc

SEQ ID NO: 3984366 - DNA, 15 bp, Homo sapiens
tcaatacaaatgtta

SEQ ID NO: 3984367 - DNA, 14 bp, Homo sapiens
tcaatacactagtt

SEQ ID NO: 3984368 - DNA, 16 bp, Homo sapiens
tcaatagatctccagc

SEQ ID NO: 3984369 - DNA, 15 bp, Homo sapiens
tcaatatctaatata

SEQ ID NO: 3984370 - DNA, 21 bp, Homo sapiens
tcaatatctaatatatatgaa

SEQ ID NO: 3984371 - DNA, 21 bp, Homo sapiens
tcaatattcctgaatgaaata

SEQ ID NO: 3984372 - DNA, 13 bp, Homo sapiens
tcaatattgacat

SEQ ID NO: 3984373 - DNA, 16 bp, Homo sapiens
tcaatattgacatttg

SEQ ID NO: 3984374 - DNA, 13 bp, Homo sapiens
tcaatatttaaac

SEQ ID NO: 3984375 - DNA, 17 bp, Homo sapiens
tcaatatttaaacatgg

SEQ ID NO: 3984376 - DNA, 16 bp, Homo sapiens
tcaatatttttagata

SEQ ID NO: 3984377 - DNA, 14 bp, Homo sapiens
tcaatcatttctca

SEQ ID NO: 3984378 - DNA, 15 bp, Homo sapiens
tcaatccaccttcag

SEQ ID NO: 3984379 - DNA, 13 bp, Homo sapiens
tcaatccagagag

SEQ ID NO: 3984380 - DNA, 21 bp, Homo sapiens
tcaatcctaatttctcctccc

SEQ ID NO: 3984381 - DNA, 22 bp, Homo sapiens
tcaatcctaatttctcctccct

SEQ ID NO: 3984382 - DNA, 18 bp, Homo sapiens
tcaatctcccgctgctgc

SEQ ID NO: 3984383 - DNA, 14 bp, Homo sapiens
tcaatgaatttgtt

SEQ ID NO: 3984384 - DNA, 21 bp, Homo sapiens
tcaatgaattttataatctgc

SEQ ID NO: 3984385 - DNA, 14 bp, Homo sapiens
tcaatgagttcttc

SEQ ID NO: 3984386 - DNA, 12 bp, Homo sapiens
tcaatggctttt

SEQ ID NO: 3984387 - DNA, 21 bp, Homo sapiens
tcaatgttcacgcaacttgaa

SEQ ID NO: 3984388 - DNA, 18 bp, Homo sapiens
tcaatgtttcttctaggt

SEQ ID NO: 3984389 - DNA, 15 bp, Homo sapiens
tcaattaaagtctat

SEQ ID NO: 3984390 - DNA, 12 bp, Homo sapiens
tcaattaaatgt

SEQ ID NO: 3984391 - DNA, 13 bp, Homo sapiens
tcaattaaatgta

SEQ ID NO: 3984392 - DNA, 15 bp, Homo sapiens
tcaattatttgcata

SEQ ID NO: 3984393 - DNA, 14 bp, Homo sapiens
tcaattccacctgc

SEQ ID NO: 3984394 - DNA, 13 bp, Homo sapiens
tcaattccctctc

SEQ ID NO: 3984395 - DNA, 16 bp, Homo sapiens
tcaattccctctctca

SEQ ID NO: 3984396 - DNA, 22 bp, Homo sapiens
tcaattccctctctcagcacag

SEQ ID NO: 3984397 - DNA, 19 bp, Homo sapiens
tcaattggcagtgactttg

SEQ ID NO: 3984398 - DNA, 17 bp, Homo sapiens
tcaattgtcacttttta

SEQ ID NO: 3984399 - DNA, 21 bp, Homo sapiens
tcaatttccctgactcctcta

SEQ ID NO: 3984400 - DNA, 21 bp, Homo sapiens
tcaattttatccctcacctgt

SEQ ID NO: 3984401 - DNA, 18 bp, Homo sapiens
tcaattttcattaaactt

SEQ ID NO: 3984402 - DNA, 14 bp, Homo sapiens
tcaatttttaggaa

SEQ ID NO: 3984403 - DNA, 16 bp, Homo sapiens
tcacaaaaatttgaac

SEQ ID NO: 3984404 - DNA, 20 bp, Homo sapiens
tcacaaaaatttgaacactg

SEQ ID NO: 3984405 - DNA, 22 bp, Homo sapiens
tcacaaatttcacttatacctg

SEQ ID NO: 3984406 - DNA, 12 bp, Homo sapiens
tcacaacagatc

SEQ ID NO: 3984407 - DNA, 12 bp, Homo sapiens
tcacaacctctc

SEQ ID NO: 3984408 - DNA, 17 bp, Homo sapiens
tcacaagagcccagcag

SEQ ID NO: 3984409 - DNA, 23 bp, Homo sapiens
tcacaagatggaatttatcaaac

SEQ ID NO: 3984410 - DNA, 20 bp, Homo sapiens
tcacaatacagataacatta

SEQ ID NO: 3984411 - DNA, 14 bp, Homo sapiens
tcacaatagaaact

SEQ ID NO: 3984412 - DNA, 16 bp, Homo sapiens
tcacaatagaaactca

SEQ ID NO: 3984413 - DNA, 14 bp, Homo sapiens
tcaaaatgtctaag

SEQ ID NO: 3984414 - DNA, 19 bp, Homo sapiens
tcaaaattctagctgtatg

SEQ ID NO: 3984415 - DNA, 17 bp, Homo sapiens
tcaaacaacactggtgt

SEQ ID NO: 3984416 - DNA, 20 bp, Homo sapiens
tcaaacagtaggttggcagt

SEQ ID NO: 3984417 - DNA, 13 bp, Homo sapiens
tcaaacagtgcca

SEQ ID NO: 3984418 - DNA, 18 bp, Homo sapiens
tcaaacagtgccaaatgc

SEQ ID NO: 3984419 - DNA, 20 bp, Homo sapiens
tcaaacattcgtgagctggg

SEQ ID NO: 3984420 - DNA, 22 bp, Homo sapiens
tcaaacattcgtgagctgggga

SEQ ID NO: 3984421 - DNA, 18 bp, Homo sapiens
tcaaaccctagccttgct

SEQ ID NO: 3984422 - DNA, 19 bp, Homo sapiens
tcaaaccctagccttgctt

SEQ ID NO: 3984423 - DNA, 20 bp, Homo sapiens
tcaaaccgcactcacccatg

SEQ ID NO: 3984424 - DNA, 11 bp, Homo sapiens
tcaaacctgta

SEQ ID NO: 3984425 - DNA, 21 bp, Homo sapiens
tcaaacctgtagatgcagaaa

SEQ ID NO: 3984426 - DNA, 17 bp, Homo sapiens
tcaaactaaaagacatt

SEQ ID NO: 3984427 - DNA, 18 bp, Homo sapiens
tcaaactacatattgtaa

SEQ ID NO: 3984428 - DNA, 22 bp, Homo sapiens
tcaaacttggatacttggattt

SEQ ID NO: 3984429 - DNA, 21 bp, Homo sapiens
tcaaagaaagaaagtttagaa

SEQ ID NO: 3984430 - DNA, 15 bp, Homo sapiens
tcaaagccagggtct

SEQ ID NO: 3984431 - DNA, 16 bp, Homo sapiens
tcaaagtaaggctggt

SEQ ID NO: 3984432 - DNA, 15 bp, Homo sapiens
tcaaagtatgtatgt

SEQ ID NO: 3984433 - DNA, 22 bp, Homo sapiens
tcaaagttaattcacctatgtt

SEQ ID NO: 3984434 - DNA, 15 bp, Homo sapiens
tcaaagttttgaaaa

SEQ ID NO: 3984435 - DNA, 17 bp, Homo sapiens
tcaaagttttgaaaagc

SEQ ID NO: 3984436 - DNA, 19 bp, Homo sapiens
tcaaagttttgaaaagcta

SEQ ID NO: 3984437 - DNA, 22 bp, Homo sapiens
tcaaagttttgaaaagctatta

SEQ ID NO: 3984438 - DNA, 19 bp, Homo sapiens
tcaaatacaaagtaaatac

SEQ ID NO: 3984439 - DNA, 23 bp, Homo sapiens
tcaaatactttaaaggaaaaaat

SEQ ID NO: 3984440 - DNA, 19 bp, Homo sapiens
tcaaatccttccaaaaatt

SEQ ID NO: 3984441 - DNA, 21 bp, Homo sapiens
tcaaatccttccaaaaattat

SEQ ID NO: 3984442 - DNA, 13 bp, Homo sapiens
tcaaatctattca

SEQ ID NO: 3984443 - DNA, 17 bp, Homo sapiens
tcaaatctggtccatat

SEQ ID NO: 3984444 - DNA, 21 bp, Homo sapiens
tcaaatctggtccatatttac

SEQ ID NO: 3984445 - DNA, 23 bp, Homo sapiens
tcaaatcttggcaatattcctta

SEQ ID NO: 3984446 - DNA, 18 bp, Homo sapiens
tcaaatggggccagatcc

SEQ ID NO: 3984447 - DNA, 19 bp, Homo sapiens
tcaaatggggccagatcca

SEQ ID NO: 3984448 - DNA, 22 bp, Homo sapiens
tcaaatgtaatgtggcttctgg

SEQ ID NO: 3984449 - DNA, 20 bp, Homo sapiens
tcaaattcatttttttcact

SEQ ID NO: 3984450 - DNA, 20 bp, Homo sapiens
tcaaattggactttcaaaat

SEQ ID NO: 3984451 - DNA, 12 bp, Homo sapiens
tcaaattgtatc

SEQ ID NO: 3984452 - DNA, 14 bp, Homo sapiens
tcaaattttttgac

SEQ ID NO: 3984453 - DNA, 13 bp, Homo sapiens
tcaacaaactgca

SEQ ID NO: 3984454 - DNA, 14 bp, Homo sapiens
tcaacaaactgcaa

SEQ ID NO: 3984455 - DNA, 14 bp, Homo sapiens
tcaacaaagaaata

SEQ ID NO: 3984456 - DNA, 18 bp, Homo sapiens
tcaacaaagaaatattat

SEQ ID NO: 3984457 - DNA, 21 bp, Homo sapiens
tcaacaaagaaatattatttg

SEQ ID NO: 3984458 - DNA, 18 bp, Homo sapiens
tcaacaaatattcactgg

SEQ ID NO: 3984459 - DNA, 20 bp, Homo sapiens
tcaacaagggagagacctca

SEQ ID NO: 3984460 - DNA, 22 bp, Homo sapiens
tcaacaagggagagacctcatc

SEQ ID NO: 3984461 - DNA, 15 bp, Homo sapiens
tcaacacccctgtgt

SEQ ID NO: 3984462 - DNA, 18 bp, Homo sapiens
tcaacagccaagtgtgac

SEQ ID NO: 3984463 - DNA, 13 bp, Homo sapiens
tcaacaggcccag

SEQ ID NO: 3984464 - DNA, 21 bp, Homo sapiens
tcaacaggcccagggagggaa

SEQ ID NO: 3984465 - DNA, 16 bp, Homo sapiens
tcaacatcaatgttca

SEQ ID NO: 3984466 - DNA, 16 bp, Homo sapiens
tcaacatcctgccagc

SEQ ID NO: 3984467 - DNA, 19 bp, Homo sapiens
tcaacatgttactgaccag

SEQ ID NO: 3984468 - DNA, 14 bp, Homo sapiens
tcaaccaccatgga

SEQ ID NO: 3984469 - DNA, 23 bp, Homo sapiens
tcaaccactgtaaaatgaaatta

SEQ ID NO: 3984470 - DNA, 14 bp, Homo sapiens
tcaaccactgtggc

SEQ ID NO: 3984471 - DNA, 13 bp, Homo sapiens
tcaaccagataac

SEQ ID NO: 3984472 - DNA, 13 bp, Homo sapiens
tcaaccatcctgg

SEQ ID NO: 3984473 - DNA, 22 bp, Homo sapiens
tcaaccccaccatatgaattgt

SEQ ID NO: 3984474 - DNA, 18 bp, Homo sapiens
tcaacccccatttctatt

SEQ ID NO: 3984475 - DNA, 17 bp, Homo sapiens
tcaacctcttctggctc

SEQ ID NO: 3984476 - DNA, 21 bp, Homo sapiens
tcaacctggtggcaccagatg

SEQ ID NO: 3984477 - DNA, 15 bp, Homo sapiens
tcaacgcagccctgc

SEQ ID NO: 3984478 - DNA, 19 bp, Homo sapiens
tcaacgcctcactgaaaca

SEQ ID NO: 3984479 - DNA, 15 bp, Homo sapiens
tcacaatgagattga

SEQ ID NO: 3984480 - DNA, 19 bp, Homo sapiens
tcacaatgtcagtatttca

SEQ ID NO: 3984481 - DNA, 13 bp, Homo sapiens
tcacacacacagc

SEQ ID NO: 3984482 - DNA, 15 bp, Homo sapiens
tcacacacacagctg

SEQ ID NO: 3984483 - DNA, 14 bp, Homo sapiens
tcacacatccagac

SEQ ID NO: 3984484 - DNA, 18 bp, Homo sapiens
tcacaccaacagtgtgaa

SEQ ID NO: 3984485 - DNA, 14 bp, Homo sapiens
tcacaccccaggcc

SEQ ID NO: 3984486 - DNA, 13 bp, Homo sapiens
tcacacctgcaga

SEQ ID NO: 3984487 - DNA, 23 bp, Homo sapiens
tcacacctgtaatgccagccctt

SEQ ID NO: 3984488 - DNA, 15 bp, Homo sapiens
tcacacggccacccg

SEQ ID NO: 3984489 - DNA, 18 bp, Homo sapiens
tcacactccagtggcaga

SEQ ID NO: 3984490 - DNA, 16 bp, Homo sapiens
tcacactgggtggtgg

SEQ ID NO: 3984491 - DNA, 17 bp, Homo sapiens
tcacactggtctgctgt

SEQ ID NO: 3984492 - DNA, 20 bp, Homo sapiens
tcacactgttactccacagc

SEQ ID NO: 3984493 - DNA, 16 bp, Homo sapiens
tcacacttctgtgaga

SEQ ID NO: 3984494 - DNA, 22 bp, Homo sapiens
tcacacttctgtgagaccccca

SEQ ID NO: 3984495 - DNA, 14 bp, Homo sapiens
tcacagaaatcaga

SEQ ID NO: 3984496 - DNA, 17 bp, Homo sapiens
tcacagaagcctaggag

SEQ ID NO: 3984497 - DNA, 14 bp, Homo sapiens
tcacagcagcctcc

SEQ ID NO: 3984498 - DNA, 12 bp, Homo sapiens
tcacagcctcca

SEQ ID NO: 3984499 - DNA, 14 bp, Homo sapiens
tcacagcctccagg

SEQ ID NO: 3984500 - DNA, 15 bp, Homo sapiens
tcacagcctcctctg

SEQ ID NO: 3984501 - DNA, 17 bp, Homo sapiens
tcacagcctcctctgtc

SEQ ID NO: 3984502 - DNA, 11 bp, Homo sapiens
tcacagctgct

SEQ ID NO: 3984503 - DNA, 13 bp, Homo sapiens
tcacagctgcttt

SEQ ID NO: 3984504 - DNA, 19 bp, Homo sapiens
tcacagggttgggcccaga

SEQ ID NO: 3984505 - DNA, 14 bp, Homo sapiens
tcacagtcctgagt

SEQ ID NO: 3984506 - DNA, 19 bp, Homo sapiens
tcacagtctctttaatctt

SEQ ID NO: 3984507 - DNA, 16 bp, Homo sapiens
tcacagtctggtgctt

SEQ ID NO: 3984508 - DNA, 17 bp, Homo sapiens
tcacagtgctgtgtgcc

SEQ ID NO: 3984509 - DNA, 17 bp, Homo sapiens
tcacagtgttgcccagg

SEQ ID NO: 3984510 - DNA, 18 bp, Homo sapiens
tcacagtgtttgcaatgg

SEQ ID NO: 3984511 - DNA, 19 bp, Homo sapiens
tcacagttctttgggccag

SEQ ID NO: 3984512 - DNA, 17 bp, Homo sapiens
tcacatagatgtccctt

SEQ ID NO: 3984513 - DNA, 16 bp, Homo sapiens
tcacatcagataagac

SEQ ID NO: 3984514 - DNA, 13 bp, Homo sapiens
tcacatccatccc

SEQ ID NO: 3984515 - DNA, 21 bp, Homo sapiens
tcacatcgcttctgtgtatct

SEQ ID NO: 3984516 - DNA, 14 bp, Homo sapiens
tcacatctctgcct

SEQ ID NO: 3984517 - DNA, 15 bp, Homo sapiens
tcacatgtttaactt

SEQ ID NO: 3984518 - DNA, 13 bp, Homo sapiens
tcacattagaatt

SEQ ID NO: 3984519 - DNA, 13 bp, Homo sapiens
tcacattcaggaa

SEQ ID NO: 3984520 - DNA, 16 bp, Homo sapiens
tcacattcgacatacc

SEQ ID NO: 3984521 - DNA, 19 bp, Homo sapiens
tcacattcgacatacccca

SEQ ID NO: 3984522 - DNA, 12 bp, Homo sapiens
tcacattgcatt

SEQ ID NO: 3984523 - DNA, 15 bp, Homo sapiens
tcacattgcattcta

SEQ ID NO: 3984524 - DNA, 20 bp, Homo sapiens
tcacattgcattctattgcc

SEQ ID NO: 3984525 - DNA, 22 bp, Homo sapiens
tcaccaacacagttgggaccca

SEQ ID NO: 3984526 - DNA, 21 bp, Homo sapiens
tcaccaccacccgaaatgcca

SEQ ID NO: 3984527 - DNA, 12 bp, Homo sapiens
tcaccacctgcc

SEQ ID NO: 3984528 - DNA, 14 bp, Homo sapiens
tcaccacctgcctc

SEQ ID NO: 3984529 - DNA, 15 bp, Homo sapiens
tcaccacctgcctct

SEQ ID NO: 3984530 - DNA, 13 bp, Homo sapiens
tcaccagagccca

SEQ ID NO: 3984531 - DNA, 19 bp, Homo sapiens
tcaccagagcccatgctca

SEQ ID NO: 3984532 - DNA, 21 bp, Homo sapiens
tcaccagagcccatgctcaac

SEQ ID NO: 3984533 - DNA, 18 bp, Homo sapiens
tcaccagctatctgtcat

SEQ ID NO: 3984534 - DNA, 21 bp, Homo sapiens
tcaccagtgtcccctccactg

SEQ ID NO: 3984535 - DNA, 17 bp, Homo sapiens
tcaccataacctctggg

SEQ ID NO: 3984536 - DNA, 15 bp, Homo sapiens
tcaccatcttggcca

SEQ ID NO: 3984537 - DNA, 16 bp, Homo sapiens
tcaccatgtaagcact

SEQ ID NO: 3984538 - DNA, 13 bp, Homo sapiens
tcacccacccctg

SEQ ID NO: 3984539 - DNA, 17 bp, Homo sapiens
tcacccagtcacctccc

SEQ ID NO: 3984540 - DNA, 22 bp, Homo sapiens
tcacccagtcacctccccacat

SEQ ID NO: 3984541 - DNA, 12 bp, Homo sapiens
tcacccataaac

SEQ ID NO: 3984542 - DNA, 22 bp, Homo sapiens
tcacccataaacagtaatgact

SEQ ID NO: 3984543 - DNA, 12 bp, Homo sapiens
tcacccatgtgc

SEQ ID NO: 3984544 - DNA, 12 bp, Homo sapiens
tcaccccatccc

SEQ ID NO: 3984545 - DNA, 13 bp, Homo sapiens
tcaccccatccca

SEQ ID NO: 3984546 - DNA, 15 bp, Homo sapiens
tcacccccactcccg

SEQ ID NO: 3984547 - DNA, 12 bp, Homo sapiens
tcacccccagca

SEQ ID NO: 3984548 - DNA, 15 bp, Homo sapiens
tcacccccagcacag

SEQ ID NO: 3984549 - DNA, 12 bp, Homo sapiens
tcacccccatcc

SEQ ID NO: 3984550 - DNA, 14 bp, Homo sapiens
tcacccccatccct

SEQ ID NO: 3984551 - DNA, 15 bp, Homo sapiens
tcaccccctttgctg

SEQ ID NO: 3984552 - DNA, 20 bp, Homo sapiens
tcaccccctttgctgtgagg

SEQ ID NO: 3984553 - DNA, 12 bp, Homo sapiens
tcacccctgggc

SEQ ID NO: 3984554 - DNA, 15 bp, Homo sapiens
tcaccctccacctct

SEQ ID NO: 3984555 - DNA, 19 bp, Homo sapiens
tcaccctgcattacatgtg

SEQ ID NO: 3984556 - DNA, 17 bp, Homo sapiens
tcacccttggacaagac

SEQ ID NO: 3984557 - DNA, 13 bp, Homo sapiens
tcacccttgtcct

SEQ ID NO: 3984558 - DNA, 22 bp, Homo sapiens
tcaccctttgctgtgaggctgt

SEQ ID NO: 3984559 - DNA, 20 bp, Homo sapiens
tcaccgcccatcagggttct

SEQ ID NO: 3984560 - DNA, 14 bp, Homo sapiens
tcaccgctggccct

SEQ ID NO: 3984561 - DNA, 19 bp, Homo sapiens
tcaccggccgatggagaca

SEQ ID NO: 3984562 - DNA, 16 bp, Homo sapiens
tcaccggtcagtgcct

SEQ ID NO: 3984563 - DNA, 22 bp, Homo sapiens
tcacctaatgtttatgagccag

SEQ ID NO: 3984564 - DNA, 23 bp, Homo sapiens
tcacctatgttattttgtgtaca

SEQ ID NO: 3984565 - DNA, 13 bp, Homo sapiens
tcacctcatgccc

SEQ ID NO: 3984566 - DNA, 14 bp, Homo sapiens
tcacctccccacat

SEQ ID NO: 3984567 - DNA, 15 bp, Homo sapiens
tcacctctagcctta

SEQ ID NO: 3984568 - DNA, 19 bp, Homo sapiens
tcacctctccaggtgctca

SEQ ID NO: 3984569 - DNA, 15 bp, Homo sapiens
tcacctctctcagag

SEQ ID NO: 3984570 - DNA, 14 bp, Homo sapiens
tcacctctgttaag

SEQ ID NO: 3984571 - DNA, 22 bp, Homo sapiens
tcacctgagcccggatgcttct

SEQ ID NO: 3984572 - DNA, 12 bp, Homo sapiens
tcacctggctga

SEQ ID NO: 3984573 - DNA, 15 bp, Homo sapiens
tcacctgggccctgg

SEQ ID NO: 3984574 - DNA, 19 bp, Homo sapiens
tcacctgggccctggagga

SEQ ID NO: 3984575 - DNA, 20 bp, Homo sapiens
tcacctgtttttaagctgtt

SEQ ID NO: 3984576 - DNA, 22 bp, Homo sapiens
tcacctgtttttaagctgtttc

SEQ ID NO: 3984577 - DNA, 14 bp, Homo sapiens
tcaccttcctgtgg

SEQ ID NO: 3984578 - DNA, 23 bp, Homo sapiens
tcaccttggcaccagacacccag

SEQ ID NO: 3984579 - DNA, 16 bp, Homo sapiens
tcacgcaacttgaaat

SEQ ID NO: 3984580 - DNA, 20 bp, Homo sapiens
tcacgcctgtaatcccagca

SEQ ID NO: 3984581 - DNA, 23 bp, Homo sapiens
tcacgcctgtaatcccagcactt

SEQ ID NO: 3984582 - DNA, 13 bp, Homo sapiens
tcacgctcaccca

SEQ ID NO: 3984583 - DNA, 20 bp, Homo sapiens
tcacgctggggctctctgag

SEQ ID NO: 3984584 - DNA, 18 bp, Homo sapiens
tatgaaattccagcaata

SEQ ID NO: 3984585 - DNA, 14 bp, Homo sapiens
tatgaacatgcagt

SEQ ID NO: 3984586 - DNA, 20 bp, Homo sapiens
tatgaactttatagttgttt

SEQ ID NO: 3984587 - DNA, 21 bp, Homo sapiens
tatgaagaattgccaatcttg

SEQ ID NO: 3984588 - DNA, 22 bp, Homo sapiens
tatgaagaattgccaatcttgt

SEQ ID NO: 3984589 - DNA, 20 bp, Homo sapiens
tatgaagagtattaatgtaa

SEQ ID NO: 3984590 - DNA, 21 bp, Homo sapiens
tatgaagctacctcaaacttc

SEQ ID NO: 3984591 - DNA, 20 bp, Homo sapiens
tatgaaggaatcattccagt

SEQ ID NO: 3984592 - DNA, 18 bp, Homo sapiens
tatgaagtttaaaacagt

SEQ ID NO: 3984593 - DNA, 14 bp, Homo sapiens
tatgaataagcact

SEQ ID NO: 3984594 - DNA, 18 bp, Homo sapiens
tatgaataagcacttgaa

SEQ ID NO: 3984595 - DNA, 20 bp, Homo sapiens
tatgaatgtactgcatgtta

SEQ ID NO: 3984596 - DNA, 18 bp, Homo sapiens
tatgaattcaagaaagga

SEQ ID NO: 3984597 - DNA, 14 bp, Homo sapiens
tatgaattgtacag

SEQ ID NO: 3984598 - DNA, 15 bp, Homo sapiens
tatgaattgtacaga

SEQ ID NO: 3984599 - DNA, 20 bp, Homo sapiens
tatgaatttaaatataattc

SEQ ID NO: 3984600 - DNA, 13 bp, Homo sapiens
tatgacactgagc

SEQ ID NO: 3984601 - DNA, 22 bp, Homo sapiens
tatgacagatatatttaagcct

SEQ ID NO: 3984602 - DNA, 14 bp, Homo sapiens
tatgacagtaaaca

SEQ ID NO: 3984603 - DNA, 20 bp, Homo sapiens
tatgacgcggctcaaaagga

SEQ ID NO: 3984604 - DNA, 20 bp, Homo sapiens
tatgacggaagaacatagaa

SEQ ID NO: 3984605 - DNA, 12 bp, Homo sapiens
tatgactaaaga

SEQ ID NO: 3984606 - DNA, 17 bp, Homo sapiens
tatgactaaagagagaa

SEQ ID NO: 3984607 - DNA, 21 bp, Homo sapiens
tatgactaaagagagaatgta

SEQ ID NO: 3984608 - DNA, 17 bp, Homo sapiens
tatgactgctccccagc

SEQ ID NO: 3984609 - DNA, 13 bp, Homo sapiens
tatgaggagggga

SEQ ID NO: 3984610 - DNA, 15 bp, Homo sapiens
tatgagggaaaatga

SEQ ID NO: 3984611 - DNA, 15 bp, Homo sapiens
tatgagtcaatgtgc

SEQ ID NO: 3984612 - DNA, 17 bp, Homo sapiens
tatgagtcaatgtgcag

SEQ ID NO: 3984613 - DNA, 15 bp, Homo sapiens
tatgataaaacactg

SEQ ID NO: 3984614 - DNA, 13 bp, Homo sapiens
tatgatattgttt

SEQ ID NO: 3984615 - DNA, 23 bp, Homo sapiens
tatgatattgtttaaaattcagt

SEQ ID NO: 3984616 - DNA, 13 bp, Homo sapiens
tatgatatttctt

SEQ ID NO: 3984617 - DNA, 19 bp, Homo sapiens
tatgatatttcttgctttc

SEQ ID NO: 3984618 - DNA, 17 bp, Homo sapiens
tatgatcagtgttgttg

SEQ ID NO: 3984619 - DNA, 20 bp, Homo sapiens
tatgatctctctagctttgt

SEQ ID NO: 3984620 - DNA, 18 bp, Homo sapiens
tatgatctcttctggtgt

SEQ ID NO: 3984621 - DNA, 20 bp, Homo sapiens
tatgatctgttttgtatctt

SEQ ID NO: 3984622 - DNA, 21 bp, Homo sapiens
tatgattgtttctcaaatctt

SEQ ID NO: 3984623 - DNA, 17 bp, Homo sapiens
tatgatttaataaaata

SEQ ID NO: 3984624 - DNA, 14 bp, Homo sapiens
tatgatttccttca

SEQ ID NO: 3984625 - DNA, 18 bp, Homo sapiens
tatgatttccttcaatgt

SEQ ID NO: 3984626 - DNA, 14 bp, Homo sapiens
taggagggagacac

SEQ ID NO: 3984627 - DNA, 17 bp, Homo sapiens
taggagtggttctcatt

SEQ ID NO: 3984628 - DNA, 20 bp, Homo sapiens
taggagtgtgtgacattcca

SEQ ID NO: 3984629 - DNA, 18 bp, Homo sapiens
taggcaacctttattttt

SEQ ID NO: 3984630 - DNA, 15 bp, Homo sapiens
taggcaagcaggacc

SEQ ID NO: 3984631 - DNA, 18 bp, Homo sapiens
taggcaagcaggacctgg

SEQ ID NO: 3984632 - DNA, 18 bp, Homo sapiens
taggcactcttaaatgat

SEQ ID NO: 3984633 - DNA, 13 bp, Homo sapiens
taggcagaatgga

SEQ ID NO: 3984634 - DNA, 12 bp, Homo sapiens
taggcagagcct

SEQ ID NO: 3984635 - DNA, 16 bp, Homo sapiens
taggcagagcctttgg

SEQ ID NO: 3984636 - DNA, 20 bp, Homo sapiens
taggcagattgaaaaggaca

SEQ ID NO: 3984637 - DNA, 14 bp, Homo sapiens
taggcagcagagag

SEQ ID NO: 3984638 - DNA, 17 bp, Homo sapiens
taggcatctctgtactt

SEQ ID NO: 3984639 - DNA, 16 bp, Homo sapiens
taggcattaacacaaa

SEQ ID NO: 3984640 - DNA, 18 bp, Homo sapiens
taggcattaacacaaagg

SEQ ID NO: 3984641 - DNA, 21 bp, Homo sapiens
taggccagggcatgtgtatgt

SEQ ID NO: 3984642 - DNA, 23 bp, Homo sapiens
taggcccaaggtcccctccacat

SEQ ID NO: 3984643 - DNA, 13 bp, Homo sapiens
taggcccctgggg

SEQ ID NO: 3984644 - DNA, 19 bp, Homo sapiens
taggcctgggtgctggctg

SEQ ID NO: 3984645 - DNA, 20 bp, Homo sapiens
taggcctgggtgctggctgc

SEQ ID NO: 3984646 - DNA, 17 bp, Homo sapiens
taggcctgtcccttgcc

SEQ ID NO: 3984647 - DNA, 18 bp, Homo sapiens
taggcgagtgccaggact

SEQ ID NO: 3984648 - DNA, 15 bp, Homo sapiens
taggcggcgattttt

SEQ ID NO: 3984649 - DNA, 21 bp, Homo sapiens
taggcgggcggtcaggggttc

SEQ ID NO: 3984650 - DNA, 11 bp, Homo sapiens
taggctctgca

SEQ ID NO: 3984651 - DNA, 16 bp, Homo sapiens
taggctcttaagcagc

SEQ ID NO: 3984652 - DNA, 20 bp, Homo sapiens
taggctcttaagcagcatgg

SEQ ID NO: 3984653 - DNA, 20 bp, Homo sapiens
taggctcttatgtgtgcctt

SEQ ID NO: 3984654 - DNA, 12 bp, Homo sapiens
taggctggagaa

SEQ ID NO: 3984655 - DNA, 15 bp, Homo sapiens
taggctggagaagct

SEQ ID NO: 3984656 - DNA, 17 bp, Homo sapiens
taggctggagaagctca

SEQ ID NO: 3984657 - DNA, 21 bp, Homo sapiens
taggctggagaagctcaccca

SEQ ID NO: 3984658 - DNA, 20 bp, Homo sapiens
taggctggggcggggcccag

SEQ ID NO: 3984659 - DNA, 16 bp, Homo sapiens
taggcttaaacctgga

SEQ ID NO: 3984660 - DNA, 14 bp, Homo sapiens
tagggaaaggtttt

SEQ ID NO: 3984661 - DNA, 15 bp, Homo sapiens
tagggaactggggaa

SEQ ID NO: 3984662 - DNA, 20 bp, Homo sapiens
tagggaagaaaactatcctg

SEQ ID NO: 3984663 - DNA, 16 bp, Homo sapiens
tagggattcaggctgc

SEQ ID NO: 3984664 - DNA, 14 bp, Homo sapiens
tagggcactgggct

SEQ ID NO: 3984665 - DNA, 18 bp, Homo sapiens
tagggctttagctttctt

SEQ ID NO: 3984666 - DNA, 16 bp, Homo sapiens
tagggcttttattttt

SEQ ID NO: 3984667 - DNA, 18 bp, Homo sapiens
taggggatggtccaggat

SEQ ID NO: 3984668 - DNA, 23 bp, Homo sapiens
taggggcttataataaaggactg

SEQ ID NO: 3984669 - DNA, 16 bp, Homo sapiens
taggggtagggagcct

SEQ ID NO: 3984670 - DNA, 17 bp, Homo sapiens
taggggtagggagcctc

SEQ ID NO: 3984671 - DNA, 13 bp, Homo sapiens
tagggtaaaaatt

SEQ ID NO: 3984672 - DNA, 14 bp, Homo sapiens
tagggtaaaaattg

SEQ ID NO: 3984673 - DNA, 12 bp, Homo sapiens
tagggtaaatca

SEQ ID NO: 3984674 - DNA, 22 bp, Homo sapiens
tagggtaaatcagtaagaggtg

SEQ ID NO: 3984675 - DNA, 16 bp, Homo sapiens
tagggtacatttataa

SEQ ID NO: 3984676 - DNA, 22 bp, Homo sapiens
tagggtacatttataattgcat

SEQ ID NO: 3984677 - DNA, 13 bp, Homo sapiens
tagggtcaggcgg

SEQ ID NO: 3984678 - DNA, 23 bp, Homo sapiens
tagggtcaggcggggtgctgtgg

SEQ ID NO: 3984679 - DNA, 16 bp, Homo sapiens
tagggtcttgggggtc

SEQ ID NO: 3984680 - DNA, 13 bp, Homo sapiens
tagggtctttctt

SEQ ID NO: 3984681 - DNA, 17 bp, Homo sapiens
tagggtctttcttggga

SEQ ID NO: 3984682 - DNA, 22 bp, Homo sapiens
taggtaaccttatatttacaat

SEQ ID NO: 3984683 - DNA, 19 bp, Homo sapiens
taggtaacttattagaaac

SEQ ID NO: 3984684 - DNA, 13 bp, Homo sapiens
taggtaacttcat

SEQ ID NO: 3984685 - DNA, 15 bp, Homo sapiens
taggtaatgttttgt

SEQ ID NO: 3984686 - DNA, 17 bp, Homo sapiens
taggtaatgttttgtat

SEQ ID NO: 3984687 - DNA, 16 bp, Homo sapiens
taggtagactttgctt

SEQ ID NO: 3984688 - DNA, 16 bp, Homo sapiens
taggtagtttggatat

SEQ ID NO: 3984689 - DNA, 22 bp, Homo sapiens
taggtatgatctcttctggtgt

SEQ ID NO: 3984690 - DNA, 19 bp, Homo sapiens
taggtcgttttaaaaacaa

SEQ ID NO: 3984691 - DNA, 16 bp, Homo sapiens
taggtctcctcagggt

SEQ ID NO: 3984692 - DNA, 22 bp, Homo sapiens
taggtgttgattttctgttgta

SEQ ID NO: 3984693 - DNA, 11 bp, Homo sapiens
tagtaaatgtc

SEQ ID NO: 3984694 - DNA, 16 bp, Homo sapiens
tagtaaatgtctttgt

SEQ ID NO: 3984695 - DNA, 20 bp, Homo sapiens
tagtaaatgtctttgtaagt

SEQ ID NO: 3984696 - DNA, 23 bp, Homo sapiens
tagtaccaatcattttaattatt

SEQ ID NO: 3984697 - DNA, 17 bp, Homo sapiens
tagtactcctgcaaaat

SEQ ID NO: 3984698 - DNA, 17 bp, Homo sapiens
tagtactccttaagaac

SEQ ID NO: 3984699 - DNA, 19 bp, Homo sapiens
tagtactccttaagaacac

SEQ ID NO: 3984700 - DNA, 15 bp, Homo sapiens
tagtagaaattttac

SEQ ID NO: 3984701 - DNA, 19 bp, Homo sapiens
tagtagaaattttacaata

SEQ ID NO: 3984702 - DNA, 21 bp, Homo sapiens
tagtagcgttttttaaatgta

SEQ ID NO: 3984703 - DNA, 23 bp, Homo sapiens
tagtagcgttttttaaatgtata

SEQ ID NO: 3984704 - DNA, 19 bp, Homo sapiens
tagtatatctggacaagcc

SEQ ID NO: 3984705 - DNA, 13 bp, Homo sapiens
tagtatcagtgtt

SEQ ID NO: 3984706 - DNA, 15 bp, Homo sapiens
tagtatctaacatgt

SEQ ID NO: 3984707 - DNA, 13 bp, Homo sapiens
tagtatcttcaaa

SEQ ID NO: 3984708 - DNA, 20 bp, Homo sapiens
tagtatcttcaaactttcac

SEQ ID NO: 3984709 - DNA, 15 bp, Homo sapiens
tagtatttctcagga

SEQ ID NO: 3984710 - DNA, 21 bp, Homo sapiens
tagtatttgaattaaaacttc

SEQ ID NO: 3984711 - DNA, 21 bp, Homo sapiens
tagtatttttactattataat

SEQ ID NO: 3984712 - DNA, 15 bp, Homo sapiens
tagtcaggtgctcaa

SEQ ID NO: 3984713 - DNA, 13 bp, Homo sapiens
tagtcatgtgacc

SEQ ID NO: 3984714 - DNA, 15 bp, Homo sapiens
tagtcattcttccct

SEQ ID NO: 3984715 - DNA, 18 bp, Homo sapiens
tagtcatttactaaacat

SEQ ID NO: 3984716 - DNA, 20 bp, Homo sapiens
tagtcccttcccctccctgg

SEQ ID NO: 3984717 - DNA, 13 bp, Homo sapiens
tagtccttggcat

SEQ ID NO: 3984718 - DNA, 14 bp, Homo sapiens
tagtccttggcata

SEQ ID NO: 3984719 - DNA, 18 bp, Homo sapiens
tagtccttttgggaagaa

SEQ ID NO: 3984720 - DNA, 20 bp, Homo sapiens
tagtctaagatgattcaaag

SEQ ID NO: 3984721 - DNA, 17 bp, Homo sapiens
tagtctcctttgcactg

SEQ ID NO: 3984722 - DNA, 13 bp, Homo sapiens
tagtctctgccct

SEQ ID NO: 3984723 - DNA, 18 bp, Homo sapiens
tagtctctttaaaaggaa

SEQ ID NO: 3984724 - DNA, 13 bp, Homo sapiens
tagtctggtttct

SEQ ID NO: 3984725 - DNA, 22 bp, Homo sapiens
tagtcttccacaaaaaatactt

SEQ ID NO: 3984726 - DNA, 18 bp, Homo sapiens
tagtcttctcatagcatt

SEQ ID NO: 3984727 - DNA, 14 bp, Homo sapiens
tagtgaagaccaga

SEQ ID NO: 3984728 - DNA, 16 bp, Homo sapiens
tagtgaagatggtttc

SEQ ID NO: 3984729 - DNA, 13 bp, Homo sapiens
tagtgatggttcc

SEQ ID NO: 3984730 - DNA, 20 bp, Homo sapiens
tacctctctgtcccttgctg

SEQ ID NO: 3984731 - DNA, 21 bp, Homo sapiens
tacctctctgtcccttgctgt

SEQ ID NO: 3984732 - DNA, 14 bp, Homo sapiens
tacctctgatacct

SEQ ID NO: 3984733 - DNA, 17 bp, Homo sapiens
tacctctgatacctcaa

SEQ ID NO: 3984734 - DNA, 21 bp, Homo sapiens
tacctcttactttgcttgaga

SEQ ID NO: 3984735 - DNA, 19 bp, Homo sapiens
tacctgacctcttgctgtc

SEQ ID NO: 3984736 - DNA, 15 bp, Homo sapiens
tacctgccctggaac

SEQ ID NO: 3984737 - DNA, 20 bp, Homo sapiens
tacctgcgcttgttttaaag

SEQ ID NO: 3984738 - DNA, 15 bp, Homo sapiens
taccttcaatactta

SEQ ID NO: 3984739 - DNA, 15 bp, Homo sapiens
taccttcctgtccct

SEQ ID NO: 3984740 - DNA, 22 bp, Homo sapiens
taccttgaaaataagaatagaa

SEQ ID NO: 3984741 - DNA, 17 bp, Homo sapiens
taccttgaaatgctgtt

SEQ ID NO: 3984742 - DNA, 16 bp, Homo sapiens
taccttgtatactgta

SEQ ID NO: 3984743 - DNA, 20 bp, Homo sapiens
tacctttgaattcaagaaca

SEQ ID NO: 3984744 - DNA, 12 bp, Homo sapiens
tacctttgtcac

SEQ ID NO: 3984745 - DNA, 17 bp, Homo sapiens
taccttttctcttttct

SEQ ID NO: 3984746 - DNA, 21 bp, Homo sapiens
taccttttctcttttctttct

SEQ ID NO: 3984747 - DNA, 20 bp, Homo sapiens
tacgagcacctccagcctga

SEQ ID NO: 3984748 - DNA, 22 bp, Homo sapiens
tacgagcacctccagcctgaac

SEQ ID NO: 3984749 - DNA, 19 bp, Homo sapiens
tacgccactccacaaatga

SEQ ID NO: 3984750 - DNA, 13 bp, Homo sapiens
tacgcctcttctg

SEQ ID NO: 3984751 - DNA, 14 bp, Homo sapiens
tacgctgtccagaa

SEQ ID NO: 3984752 - DNA, 17 bp, Homo sapiens
tacgcttttctttgtta

SEQ ID NO: 3984753 - DNA, 15 bp, Homo sapiens
tacggattttcagtt

SEQ ID NO: 3984754 - DNA, 14 bp, Homo sapiens
tacgtagctctctt

SEQ ID NO: 3984755 - DNA, 17 bp, Homo sapiens
tacgtagttgtgctttt

SEQ ID NO: 3984756 - DNA, 16 bp, Homo sapiens
tacgtcctgcctggca

SEQ ID NO: 3984757 - DNA, 14 bp, Homo sapiens
tacgtgagccaggt

SEQ ID NO: 3984758 - DNA, 12 bp, Homo sapiens
tacgtttgttat

SEQ ID NO: 3984759 - DNA, 13 bp, Homo sapiens
tactaaaagcaaa

SEQ ID NO: 3984760 - DNA, 21 bp, Homo sapiens
tactaaaagcaaatctacaga

SEQ ID NO: 3984761 - DNA, 12 bp, Homo sapiens
tactaaacatat

SEQ ID NO: 3984762 - DNA, 18 bp, Homo sapiens
tactaaacatatgatttc

SEQ ID NO: 3984763 - DNA, 17 bp, Homo sapiens
tactaaatttaaattta

SEQ ID NO: 3984764 - DNA, 22 bp, Homo sapiens
tactaaatttaaatttaaagat

SEQ ID NO: 3984765 - DNA, 16 bp, Homo sapiens
tactaatgatgttttc

SEQ ID NO: 3984766 - DNA, 16 bp, Homo sapiens
tactaattccacacct

SEQ ID NO: 3984767 - DNA, 15 bp, Homo sapiens
tactaattttacaca

SEQ ID NO: 3984768 - DNA, 17 bp, Homo sapiens
tactaattttacacatt

SEQ ID NO: 3984769 - DNA, 18 bp, Homo sapiens
tactaattttacacatta

SEQ ID NO: 3984770 - DNA, 16 bp, Homo sapiens
tactaattttctagat

SEQ ID NO: 3984771 - DNA, 13 bp, Homo sapiens
tactacaaaattt

SEQ ID NO: 3984772 - DNA, 13 bp, Homo sapiens
tactacactgagg

SEQ ID NO: 3984773 - DNA, 21 bp, Homo sapiens
tactacagttgttttttgaaa

SEQ ID NO: 3984774 - DNA, 16 bp, Homo sapiens
tactacccatagaaaa

SEQ ID NO: 3984775 - DNA, 15 bp, Homo sapiens
tactacctcctctcc

SEQ ID NO: 3984776 - DNA, 13 bp, Homo sapiens
tactaccttgaaa

SEQ ID NO: 3984777 - DNA, 17 bp, Homo sapiens
tactactagatgtcttt

SEQ ID NO: 3984778 - DNA, 16 bp, Homo sapiens
tactactgaccagaca

SEQ ID NO: 3984779 - DNA, 19 bp, Homo sapiens
tactagagtctgaacagct

SEQ ID NO: 3984780 - DNA, 17 bp, Homo sapiens
tactagatgcatcactg

SEQ ID NO: 3984781 - DNA, 21 bp, Homo sapiens
tactagatgcatcactgggtg

SEQ ID NO: 3984782 - DNA, 15 bp, Homo sapiens
tactaggtaacttca

SEQ ID NO: 3984783 - DNA, 15 bp, Homo sapiens
tactagtgttctgtt

SEQ ID NO: 3984784 - DNA, 13 bp, Homo sapiens
tactataaagaga

SEQ ID NO: 3984785 - DNA, 13 bp, Homo sapiens
tactatagtacca

SEQ ID NO: 3984786 - DNA, 17 bp, Homo sapiens
tagactgtgccagaggc

SEQ ID NO: 3984787 - DNA, 18 bp, Homo sapiens
tagactgtgccagaggcc

SEQ ID NO: 3984788 - DNA, 15 bp, Homo sapiens
tagacttcccaacag

SEQ ID NO: 3984789 - DNA, 20 bp, Homo sapiens
tagacttcgactcaggatcc

SEQ ID NO: 3984790 - DNA, 12 bp, Homo sapiens
tagactttgctt

SEQ ID NO: 3984791 - DNA, 17 bp, Homo sapiens
tagagaacgcagcccta

SEQ ID NO: 3984792 - DNA, 22 bp, Homo sapiens
tagagaaggacccggaggggcc

SEQ ID NO: 3984793 - DNA, 11 bp, Homo sapiens
tagagaccccg

SEQ ID NO: 3984794 - DNA, 21 bp, Homo sapiens
tagagaggacaatactggggt

SEQ ID NO: 3984795 - DNA, 16 bp, Homo sapiens
tagagataggaaactg

SEQ ID NO: 3984796 - DNA, 23 bp, Homo sapiens
tagagatgaagtttgtagttgtt

SEQ ID NO: 3984797 - DNA, 13 bp, Homo sapiens
tagagcctgcctg

SEQ ID NO: 3984798 - DNA, 22 bp, Homo sapiens
tagagccttctgatgtctctaa

SEQ ID NO: 3984799 - DNA, 18 bp, Homo sapiens
tagagcttgtaataaata

SEQ ID NO: 3984800 - DNA, 20 bp, Homo sapiens
tagaggccagccccacccag

SEQ ID NO: 3984801 - DNA, 23 bp, Homo sapiens
tagaggcttctccgccagcctcc

SEQ ID NO: 3984802 - DNA, 20 bp, Homo sapiens
tagagggaggtgtttaaaga

SEQ ID NO: 3984803 - DNA, 13 bp, Homo sapiens
tagagggttcctg

SEQ ID NO: 3984804 - DNA, 15 bp, Homo sapiens
tagaggtactagaat

SEQ ID NO: 3984805 - DNA, 18 bp, Homo sapiens
tagaggtactagaatgct

SEQ ID NO: 3984806 - DNA, 21 bp, Homo sapiens
tagagtcatctccatcagctg

SEQ ID NO: 3984807 - DNA, 14 bp, Homo sapiens
tagagtcctcactc

SEQ ID NO: 3984808 - DNA, 20 bp, Homo sapiens
tagagtcctcactcccagtc

SEQ ID NO: 3984809 - DNA, 12 bp, Homo sapiens
tagagttaagaa

SEQ ID NO: 3984810 - DNA, 16 bp, Homo sapiens
tagagttaagaagctg

SEQ ID NO: 3984811 - DNA, 19 bp, Homo sapiens
tagagttaagaagctgttg

SEQ ID NO: 3984812 - DNA, 13 bp, Homo sapiens
tagagttgctgag

SEQ ID NO: 3984813 - DNA, 20 bp, Homo sapiens
tagagtttctgtttgattct

SEQ ID NO: 3984814 - DNA, 21 bp, Homo sapiens
tagagtttctgtttgattctt

SEQ ID NO: 3984815 - DNA, 14 bp, Homo sapiens
tagatatcctctcc

SEQ ID NO: 3984816 - DNA, 21 bp, Homo sapiens
tagatattgttttctgtaaat

SEQ ID NO: 3984817 - DNA, 14 bp, Homo sapiens
tagatcaaatactt

SEQ ID NO: 3984818 - DNA, 17 bp, Homo sapiens
tagatcaaatactttaa

SEQ ID NO: 3984819 - DNA, 23 bp, Homo sapiens
tagatcaaatactttaaaggaaa

SEQ ID NO: 3984820 - DNA, 19 bp, Homo sapiens
tagatgcagaaaaagaaaa

SEQ ID NO: 3984821 - DNA, 13 bp, Homo sapiens
tagatgctggccc

SEQ ID NO: 3984822 - DNA, 22 bp, Homo sapiens
tagatgctggcccagggcccag

SEQ ID NO: 3984823 - DNA, 22 bp, Homo sapiens
tagatgggtctggctgagctga

SEQ ID NO: 3984824 - DNA, 22 bp, Homo sapiens
tagatgtccctttcttggccag

SEQ ID NO: 3984825 - DNA, 23 bp, Homo sapiens
tagatgtccctttcttggccagt

SEQ ID NO: 3984826 - DNA, 13 bp, Homo sapiens
tagatgtgcaata

SEQ ID NO: 3984827 - DNA, 19 bp, Homo sapiens
tagatgtgcaatagaaata

SEQ ID NO: 3984828 - DNA, 18 bp, Homo sapiens
tagatgttccagtaatct

SEQ ID NO: 3984829 - DNA, 20 bp, Homo sapiens
tagatgttttggtagattaa

SEQ ID NO: 3984830 - DNA, 16 bp, Homo sapiens
tagattagaaaaattc

SEQ ID NO: 3984831 - DNA, 18 bp, Homo sapiens
tagattaggtagactttg

SEQ ID NO: 3984832 - DNA, 17 bp, Homo sapiens
tagattatggagctttt

SEQ ID NO: 3984833 - DNA, 19 bp, Homo sapiens
tagatttcatagttcagaa

SEQ ID NO: 3984834 - DNA, 18 bp, Homo sapiens
tagcaaaaacatgtatgt

SEQ ID NO: 3984835 - DNA, 22 bp, Homo sapiens
tagcaaaacgcatggagtgtgt

SEQ ID NO: 3984836 - DNA, 23 bp, Homo sapiens
tagcaaaacgcatggagtgtgta

SEQ ID NO: 3984837 - DNA, 16 bp, Homo sapiens
tagcaacaacaattgg

SEQ ID NO: 3984838 - DNA, 13 bp, Homo sapiens
tagcaagctggcc

SEQ ID NO: 3984839 - DNA, 15 bp, Homo sapiens
tagcaagctggcctc

SEQ ID NO: 3984840 - DNA, 16 bp, Homo sapiens
tagcaagcttttgctc

SEQ ID NO: 3984841 - DNA, 21 bp, Homo sapiens
tagcaatccatgttagttttt

SEQ ID NO: 3984842 - DNA, 14 bp, Homo sapiens
tagcacagctccct

SEQ ID NO: 3984843 - DNA, 18 bp, Homo sapiens
tagcacataaactttggg

SEQ ID NO: 3984844 - DNA, 22 bp, Homo sapiens
tagcaccttcagggctgagttc

SEQ ID NO: 3984845 - DNA, 13 bp, Homo sapiens
tagcagacagaaa

SEQ ID NO: 3984846 - DNA, 15 bp, Homo sapiens
tagcagacagtgttt

SEQ ID NO: 3984847 - DNA, 12 bp, Homo sapiens
tagcagatggtt

SEQ ID NO: 3984848 - DNA, 21 bp, Homo sapiens
tagcagatggtttccacattt

SEQ ID NO: 3984849 - DNA, 23 bp, Homo sapiens
tagcagattgtttcctcttccaa

SEQ ID NO: 3984850 - DNA, 14 bp, Homo sapiens
tagcagattttaat

SEQ ID NO: 3984851 - DNA, 15 bp, Homo sapiens
tagcagcaactgaag

SEQ ID NO: 3984852 - DNA, 18 bp, Homo sapiens
tagcagcaactgaagaca

SEQ ID NO: 3984853 - DNA, 20 bp, Homo sapiens
tagcagcagcctttaatgca

SEQ ID NO: 3984854 - DNA, 22 bp, Homo sapiens
tagcagccccgggagggcggca

SEQ ID NO: 3984855 - DNA, 13 bp, Homo sapiens
tagcagcctttct

SEQ ID NO: 3984856 - DNA, 15 bp, Homo sapiens
tagcagcttccagat

SEQ ID NO: 3984857 - DNA, 17 bp, Homo sapiens
tagcaggctgttccatg

SEQ ID NO: 3984858 - DNA, 16 bp, Homo sapiens
tagcagtaaaagatga

SEQ ID NO: 3984859 - DNA, 20 bp, Homo sapiens
tagcataaataaaactgaat

SEQ ID NO: 3984860 - DNA, 15 bp, Homo sapiens
tagcatacatttata

SEQ ID NO: 3984861 - DNA, 12 bp, Homo sapiens
tagcatatcaat

SEQ ID NO: 3984862 - DNA, 17 bp, Homo sapiens
tagcatcctaagaaata

SEQ ID NO: 3984863 - DNA, 12 bp, Homo sapiens
tagcatgtaatg

SEQ ID NO: 3984864 - DNA, 16 bp, Homo sapiens
tagcattaactaatct

SEQ ID NO: 3984865 - DNA, 22 bp, Homo sapiens
tagcattatgcaattaggtttt

SEQ ID NO: 3984866 - DNA, 18 bp, Homo sapiens
tagccaacggccccagct

SEQ ID NO: 3984867 - DNA, 19 bp, Homo sapiens
tagccaacggccccagctt

SEQ ID NO: 3984868 - DNA, 20 bp, Homo sapiens
tagccaacggccccagcttc

SEQ ID NO: 3984869 - DNA, 19 bp, Homo sapiens
tagccacagctgctgttct

SEQ ID NO: 3984870 - DNA, 19 bp, Homo sapiens
tagccacatccctttgaaa

SEQ ID NO: 3984871 - DNA, 13 bp, Homo sapiens
tagccaccagtgt

SEQ ID NO: 3984872 - DNA, 13 bp, Homo sapiens
tagccactcagga

SEQ ID NO: 3984873 - DNA, 23 bp, Homo sapiens
tagccaggatcatggtgtaataa

SEQ ID NO: 3984874 - DNA, 23 bp, Homo sapiens
tagccagtgctccaggcacccag

SEQ ID NO: 3984875 - DNA, 11 bp, Homo sapiens
tagccatctgc

SEQ ID NO: 3984876 - DNA, 17 bp, Homo sapiens
tagccattgatcataaa

SEQ ID NO: 3984877 - DNA, 23 bp, Homo sapiens
tagcccacacttgagaggatgaa

SEQ ID NO: 3984878 - DNA, 20 bp, Homo sapiens
tagcccagcactgtgaagac

SEQ ID NO: 3984879 - DNA, 14 bp, Homo sapiens
tagccccctcttcc

SEQ ID NO: 3984880 - DNA, 23 bp, Homo sapiens
tagccctccccctcaacctcacc

SEQ ID NO: 3984881 - DNA, 12 bp, Homo sapiens
tagccctgcccg

SEQ ID NO: 3984882 - DNA, 14 bp, Homo sapiens
tagcccttcagatt

SEQ ID NO: 3984883 - DNA, 12 bp, Homo sapiens
tagcccttccct

SEQ ID NO: 3984884 - DNA, 15 bp, Homo sapiens
tagcccttccctgag

SEQ ID NO: 3984885 - DNA, 13 bp, Homo sapiens
tagccctttaaaa

SEQ ID NO: 3984886 - DNA, 16 bp, Homo sapiens
tagccgggctctgcac

SEQ ID NO: 3984887 - DNA, 21 bp, Homo sapiens
tagcctatttacctgcaggct

SEQ ID NO: 3984888 - DNA, 13 bp, Homo sapiens
tagcctccctgaa

SEQ ID NO: 3984889 - DNA, 17 bp, Homo sapiens
tagcctgggccacaggg

SEQ ID NO: 3984890 - DNA, 12 bp, Homo sapiens
tagccttgcttg

SEQ ID NO: 3984891 - DNA, 15 bp, Homo sapiens
tagcctttttgtata

SEQ ID NO: 3984892 - DNA, 19 bp, Homo sapiens
tagcgatctctcctggcct

SEQ ID NO: 3984893 - DNA, 20 bp, Homo sapiens
tagcgatctctcctggccta

SEQ ID NO: 3984894 - DNA, 13 bp, Homo sapiens
tagcgctgttttt

SEQ ID NO: 3984895 - DNA, 18 bp, Homo sapiens
tagcgttttttaaatgta

SEQ ID NO: 3984896 - DNA, 18 bp, Homo sapiens
tagctaaacggattccaa

SEQ ID NO: 3984897 - DNA, 19 bp, Homo sapiens
tagctaaacggattccaaa

SEQ ID NO: 3984898 - DNA, 22 bp, Homo sapiens
tagctaagtacacaataagcaa

SEQ ID NO: 3984899 - DNA, 12 bp, Homo sapiens
tagctaatgtaa

SEQ ID NO: 3984900 - DNA, 15 bp, Homo sapiens
tagctacaggaagca

SEQ ID NO: 3984901 - DNA, 23 bp, Homo sapiens
tagctacaggaagcaccccatgc

SEQ ID NO: 3984902 - DNA, 19 bp, Homo sapiens
tagctagaaatatgatttt

SEQ ID NO: 3984903 - DNA, 17 bp, Homo sapiens
tagctatatccatgtac

SEQ ID NO: 3984904 - DNA, 18 bp, Homo sapiens
tagctatatccatgtact

SEQ ID NO: 3984905 - DNA, 19 bp, Homo sapiens
tagctatatccatgtactg

SEQ ID NO: 3984906 - DNA, 21 bp, Homo sapiens
tagctccccgcttctgcctgc

SEQ ID NO: 3984907 - DNA, 21 bp, Homo sapiens
tagctctaggagggctggcaa

SEQ ID NO: 3984908 - DNA, 15 bp, Homo sapiens
tagctctctaggcct

SEQ ID NO: 3984909 - DNA, 22 bp, Homo sapiens
tagctcttttttgtttgtttct

SEQ ID NO: 3984910 - DNA, 21 bp, Homo sapiens
tagctgtctaacccccagctg

SEQ ID NO: 3984911 - DNA, 13 bp, Homo sapiens
tagctgtgggggt

SEQ ID NO: 3984912 - DNA, 14 bp, Homo sapiens
tagctgtgggggtg

SEQ ID NO: 3984913 - DNA, 13 bp, Homo sapiens
tagcttctgcttt

SEQ ID NO: 3984914 - DNA, 15 bp, Homo sapiens
tagcttctgcttttc

SEQ ID NO: 3984915 - DNA, 16 bp, Homo sapiens
tagcttctgcttttct

SEQ ID NO: 3984916 - DNA, 15 bp, Homo sapiens
tagcttcttctgaaa

SEQ ID NO: 3984917 - DNA, 20 bp, Homo sapiens
tagctttattttttaagtat

SEQ ID NO: 3984918 - DNA, 13 bp, Homo sapiens
tagctttccacat

SEQ ID NO: 3984919 - DNA, 23 bp, Homo sapiens
tagctttgtgtttggtttacatt

SEQ ID NO: 3984920 - DNA, 14 bp, Homo sapiens
tagcttttccttcc

SEQ ID NO: 3984921 - DNA, 15 bp, Homo sapiens
tagctttttaaaaca

SEQ ID NO: 3984922 - DNA, 14 bp, Homo sapiens
tagctttttaattg

SEQ ID NO: 3984923 - DNA, 19 bp, Homo sapiens
taggaaagcctcactgata

SEQ ID NO: 3984924 - DNA, 21 bp, Homo sapiens
taggaaagcctcactgatata

SEQ ID NO: 3984925 - DNA, 14 bp, Homo sapiens
taggaacagcagtg

SEQ ID NO: 3984926 - DNA, 15 bp, Homo sapiens
taggaacttcagaga

SEQ ID NO: 3984927 - DNA, 14 bp, Homo sapiens
taggaagagaaacc

SEQ ID NO: 3984928 - DNA, 15 bp, Homo sapiens
taggaagagaaacca

SEQ ID NO: 3984929 - DNA, 19 bp, Homo sapiens
taggaagagaaaccaggga

SEQ ID NO: 3984930 - DNA, 19 bp, Homo sapiens
taggaaggcacttctgcct

SEQ ID NO: 3984931 - DNA, 14 bp, Homo sapiens
taggaatcccagag

SEQ ID NO: 3984932 - DNA, 17 bp, Homo sapiens
taggaatgggataagaa

SEQ ID NO: 3984933 - DNA, 17 bp, Homo sapiens
taggaatgtgaaagcac

SEQ ID NO: 3984934 - DNA, 18 bp, Homo sapiens
taggaattcatcttttga

SEQ ID NO: 3984935 - DNA, 19 bp, Homo sapiens
taggacaagggaaaataaa

SEQ ID NO: 3984936 - DNA, 20 bp, Homo sapiens
taggacataaattagaggtc

SEQ ID NO: 3984937 - DNA, 18 bp, Homo sapiens
taggacatactgcatgta

SEQ ID NO: 3984938 - DNA, 22 bp, Homo sapiens
taggagaggatgagagcccaga

SEQ ID NO: 3984939 - DNA, 15 bp, Homo sapiens
taggagcctgctggt

SEQ ID NO: 3984940 - DNA, 23 bp, Homo sapiens
taggagcctgctggtcacagcct

SEQ ID NO: 3984941 - DNA, 21 bp, Homo sapiens
gttagaaaatgacttatttct

SEQ ID NO: 3984942 - DNA, 19 bp, Homo sapiens
gttagaatgagatctgaat

SEQ ID NO: 3984943 - DNA, 22 bp, Homo sapiens
gttcctgcagccccagaagaaa

SEQ ID NO: 3984944 - DNA, 12 bp, Homo sapiens
gttcctggcaat

SEQ ID NO: 3984945 - DNA, 21 bp, Homo sapiens
gttcctggcaatagtgtgttc

SEQ ID NO: 3984946 - DNA, 14 bp, Homo sapiens
gttcctggcagttt

SEQ ID NO: 3984947 - DNA, 23 bp, Homo sapiens
gttcctggcagtttaaaaaaatt

SEQ ID NO: 3984948 - DNA, 21 bp, Homo sapiens
gttcctggctgatgatccaga

SEQ ID NO: 3984949 - DNA, 12 bp, Homo sapiens
gttccttctctg

SEQ ID NO: 3984950 - DNA, 23 bp, Homo sapiens
gttcctttccttttctttaaaga

SEQ ID NO: 3984951 - DNA, 13 bp, Homo sapiens
gttcctttctttt

SEQ ID NO: 3984952 - DNA, 18 bp, Homo sapiens
gttcctttgtgtgtactc

SEQ ID NO: 3984953 - DNA, 16 bp, Homo sapiens
gttcgagaccagtctg

SEQ ID NO: 3984954 - DNA, 16 bp, Homo sapiens
gttcgatacctggagc

SEQ ID NO: 3984955 - DNA, 14 bp, Homo sapiens
gttctaagggggag

SEQ ID NO: 3984956 - DNA, 19 bp, Homo sapiens
gttctacagtcgtaaaaga

SEQ ID NO: 3984957 - DNA, 18 bp, Homo sapiens
gttctacatggctttgat

SEQ ID NO: 3984958 - DNA, 20 bp, Homo sapiens
gttctacatggctttgataa

SEQ ID NO: 3984959 - DNA, 17 bp, Homo sapiens
gttctaccaggcaaatt

SEQ ID NO: 3984960 - DNA, 21 bp, Homo sapiens
gttctacctcaggcagctcaa

SEQ ID NO: 3984961 - DNA, 15 bp, Homo sapiens
gttctagagaagagg

SEQ ID NO: 3984962 - DNA, 23 bp, Homo sapiens
gttctagagaagaggctggtgct

SEQ ID NO: 3984963 - DNA, 15 bp, Homo sapiens
gttctattttcttaa

SEQ ID NO: 3984964 - DNA, 14 bp, Homo sapiens
gttctcaaagttaa

SEQ ID NO: 3984965 - DNA, 20 bp, Homo sapiens
gttctcacagtgtggggcag

SEQ ID NO: 3984966 - DNA, 13 bp, Homo sapiens
gttctccactggg

SEQ ID NO: 3984967 - DNA, 21 bp, Homo sapiens
gttctccaggcttcacagtct

SEQ ID NO: 3984968 - DNA, 14 bp, Homo sapiens
gttctcctcgtcca

SEQ ID NO: 3984969 - DNA, 13 bp, Homo sapiens
gttctctccagga

SEQ ID NO: 3984970 - DNA, 13 bp, Homo sapiens
gttctgaaatgtt

SEQ ID NO: 3984971 - DNA, 17 bp, Homo sapiens
gttctgaaatgttctta

SEQ ID NO: 3984972 - DNA, 15 bp, Homo sapiens
gttctgacattaaca

SEQ ID NO: 3984973 - DNA, 21 bp, Homo sapiens
gttctgacattaacagttttc

SEQ ID NO: 3984974 - DNA, 20 bp, Homo sapiens
gttctgcagacacgccttcc

SEQ ID NO: 3984975 - DNA, 21 bp, Homo sapiens
gttctgctccataccttttct

SEQ ID NO: 3984976 - DNA, 11 bp, Homo sapiens
gttctgctcct

SEQ ID NO: 3984977 - DNA, 18 bp, Homo sapiens
gttctgctcctgcttttc

SEQ ID NO: 3984978 - DNA, 14 bp, Homo sapiens
gttctgctctggtt

SEQ ID NO: 3984979 - DNA, 20 bp, Homo sapiens
gttctgctgcccctgcagtt

SEQ ID NO: 3984980 - DNA, 16 bp, Homo sapiens
gttctgctggcctgga

SEQ ID NO: 3984981 - DNA, 16 bp, Homo sapiens
gttctggcctcagacc

SEQ ID NO: 3984982 - DNA, 20 bp, Homo sapiens
gttctggctgccccaacctg

SEQ ID NO: 3984983 - DNA, 22 bp, Homo sapiens
gttctggctgccccaacctgct

SEQ ID NO: 3984984 - DNA, 12 bp, Homo sapiens
gttctgtgaaga

SEQ ID NO: 3984985 - DNA, 14 bp, Homo sapiens
gttctgtggttcct

SEQ ID NO: 3984986 - DNA, 14 bp, Homo sapiens
gttctgttcaccct

SEQ ID NO: 3984987 - DNA, 15 bp, Homo sapiens
gttctgttctggggg

SEQ ID NO: 3984988 - DNA, 13 bp, Homo sapiens
gttctgtttgctg

SEQ ID NO: 3984989 - DNA, 22 bp, Homo sapiens
gttctgtttgttattgttttgt

SEQ ID NO: 3984990 - DNA, 16 bp, Homo sapiens
gttcttactgcttaat

SEQ ID NO: 3984991 - DNA, 16 bp, Homo sapiens
gttcttatagaataaa

SEQ ID NO: 3984992 - DNA, 17 bp, Homo sapiens
gttcttatagaataaaa

SEQ ID NO: 3984993 - DNA, 21 bp, Homo sapiens
gttcttatagaataaaagctg

SEQ ID NO: 3984994 - DNA, 15 bp, Homo sapiens
gttcttatgaggagg

SEQ ID NO: 3984995 - DNA, 20 bp, Homo sapiens
gttcttatgaggaggggagg

SEQ ID NO: 3984996 - DNA, 14 bp, Homo sapiens
gttcttatgcaaaa

SEQ ID NO: 3984997 - DNA, 17 bp, Homo sapiens
gttcttatgcaaaatgg

SEQ ID NO: 3984998 - DNA, 18 bp, Homo sapiens
gttcttatgcaaaatgga

SEQ ID NO: 3984999 - DNA, 19 bp, Homo sapiens
gttcttatgcaaaatggaa

SEQ ID NO: 3985000 - DNA, 12 bp, Homo sapiens
gttcttcatgat

SEQ ID NO: 3985001 - DNA, 19 bp, Homo sapiens
gttcttctcaaaaaataat

SEQ ID NO: 3985002 - DNA, 21 bp, Homo sapiens
gttcttctgttctgcagacac

SEQ ID NO: 3985003 - DNA, 14 bp, Homo sapiens
gttcttggtgactg

SEQ ID NO: 3985004 - DNA, 18 bp, Homo sapiens
gttcttggtgctctgtgt

SEQ ID NO: 3985005 - DNA, 20 bp, Homo sapiens
gttctttcctccccctgcaa

SEQ ID NO: 3985006 - DNA, 14 bp, Homo sapiens
gttctttcctgccc

SEQ ID NO: 3985007 - DNA, 13 bp, Homo sapiens
gttcttttaaagg

SEQ ID NO: 3985008 - DNA, 13 bp, Homo sapiens
gttgaaaggtttt

SEQ ID NO: 3985009 - DNA, 23 bp, Homo sapiens
gttgaaaggttttttttcagttg

SEQ ID NO: 3985010 - DNA, 19 bp, Homo sapiens
gttgaagacctaaccaggg

SEQ ID NO: 3985011 - DNA, 20 bp, Homo sapiens
gttgaatctgagctgcaggt

SEQ ID NO: 3985012 - DNA, 15 bp, Homo sapiens
gttgacaaaattttc

SEQ ID NO: 3985013 - DNA, 17 bp, Homo sapiens
gttgacaacctagaatg

SEQ ID NO: 3985014 - DNA, 19 bp, Homo sapiens
gttgacaacctagaatgtc

SEQ ID NO: 3985015 - DNA, 14 bp, Homo sapiens
gttgacaactgtga

SEQ ID NO: 3985016 - DNA, 15 bp, Homo sapiens
gttgacaactgtgac

SEQ ID NO: 3985017 - DNA, 23 bp, Homo sapiens
gttgaccagataaatagaactat

SEQ ID NO: 3985018 - DNA, 15 bp, Homo sapiens
gttgagacccaggcc

SEQ ID NO: 3985019 - DNA, 13 bp, Homo sapiens
gttgagagccagt

SEQ ID NO: 3985020 - DNA, 20 bp, Homo sapiens
gttgagatttttaagaactt

SEQ ID NO: 3985021 - DNA, 21 bp, Homo sapiens
gttgagcatgacagcctgcag

SEQ ID NO: 3985022 - DNA, 23 bp, Homo sapiens
gttgagccaggcctgggtctgtg

SEQ ID NO: 3985023 - DNA, 21 bp, Homo sapiens
gttgagtctcctctctgagac

SEQ ID NO: 3985024 - DNA, 15 bp, Homo sapiens
gttgatctggaaccc

SEQ ID NO: 3985025 - DNA, 16 bp, Homo sapiens
gttgatctggaaccca

SEQ ID NO: 3985026 - DNA, 14 bp, Homo sapiens
gttgatcttcttca

SEQ ID NO: 3985027 - DNA, 19 bp, Homo sapiens
gtttatcagatacatcact

SEQ ID NO: 3985028 - DNA, 21 bp, Homo sapiens
gtttatcagatacatcactgc

SEQ ID NO: 3985029 - DNA, 18 bp, Homo sapiens
gtttatgagatgctggtt

SEQ ID NO: 3985030 - DNA, 13 bp, Homo sapiens
gtttatgagccag

SEQ ID NO: 3985031 - DNA, 15 bp, Homo sapiens
gtttatggcctcagc

SEQ ID NO: 3985032 - DNA, 22 bp, Homo sapiens
gtttatggcctcagctgcctca

SEQ ID NO: 3985033 - DNA, 13 bp, Homo sapiens
gtttattaacaaa

SEQ ID NO: 3985034 - DNA, 23 bp, Homo sapiens
gtttattaacaaattatgttaca

SEQ ID NO: 3985035 - DNA, 19 bp, Homo sapiens
gtttattcatccagcagtg

SEQ ID NO: 3985036 - DNA, 15 bp, Homo sapiens
gtttattccagagct

SEQ ID NO: 3985037 - DNA, 16 bp, Homo sapiens
gtttattcttccagaa

SEQ ID NO: 3985038 - DNA, 14 bp, Homo sapiens
gtttatttatcagt

SEQ ID NO: 3985039 - DNA, 14 bp, Homo sapiens
gtttcaaagtgata

SEQ ID NO: 3985040 - DNA, 22 bp, Homo sapiens
gtttcaattccacctgcaatca

SEQ ID NO: 3985041 - DNA, 21 bp, Homo sapiens
gtttcacaggtcaataaactt

SEQ ID NO: 3985042 - DNA, 18 bp, Homo sapiens
gtttcactgaaatgtttg

SEQ ID NO: 3985043 - DNA, 21 bp, Homo sapiens
gtttcactgaaatgtttggat

SEQ ID NO: 3985044 - DNA, 13 bp, Homo sapiens
gtttcagacaggg

SEQ ID NO: 3985045 - DNA, 15 bp, Homo sapiens
gtttcagaccccccc

SEQ ID NO: 3985046 - DNA, 23 bp, Homo sapiens
gtttcagctaagggaagacattt

SEQ ID NO: 3985047 - DNA, 20 bp, Homo sapiens
gtttcaggtgacatgtgaaa

SEQ ID NO: 3985048 - DNA, 15 bp, Homo sapiens
gtttcatccttccca

SEQ ID NO: 3985049 - DNA, 16 bp, Homo sapiens
taaaagggtcaaacct

SEQ ID NO: 3985050 - DNA, 18 bp, Homo sapiens
taaaagggtcaaacctgt

SEQ ID NO: 3985051 - DNA, 12 bp, Homo sapiens
taaaaggtgacc

SEQ ID NO: 3985052 - DNA, 21 bp, Homo sapiens
taaaaggtggagtttctctgt

SEQ ID NO: 3985053 - DNA, 22 bp, Homo sapiens
taaaagtgggcttgattctgca

SEQ ID NO: 3985054 - DNA, 18 bp, Homo sapiens
taaaagtgtgagcagtga

SEQ ID NO: 3985055 - DNA, 15 bp, Homo sapiens
taaaataaaatgaaa

SEQ ID NO: 3985056 - DNA, 17 bp, Homo sapiens
taaaataaagtatatat

SEQ ID NO: 3985057 - DNA, 13 bp, Homo sapiens
taaaataaataat

SEQ ID NO: 3985058 - DNA, 14 bp, Homo sapiens
taaaataaataatt

SEQ ID NO: 3985059 - DNA, 16 bp, Homo sapiens
taaaataaataatttt

SEQ ID NO: 3985060 - DNA, 14 bp, Homo sapiens
taaaataaattagt

SEQ ID NO: 3985061 - DNA, 16 bp, Homo sapiens
taaaataagcaggtgg

SEQ ID NO: 3985062 - DNA, 17 bp, Homo sapiens
taaaataattctaaagg

SEQ ID NO: 3985063 - DNA, 18 bp, Homo sapiens
taaaataatttctctaca

SEQ ID NO: 3985064 - DNA, 15 bp, Homo sapiens
taaaatacatttaaa

SEQ ID NO: 3985065 - DNA, 16 bp, Homo sapiens
taaaatacatttaaaa

SEQ ID NO: 3985066 - DNA, 15 bp, Homo sapiens
taaaatactattgcc

SEQ ID NO: 3985067 - DNA, 19 bp, Homo sapiens
taaaatacttttactctgc

SEQ ID NO: 3985068 - DNA, 20 bp, Homo sapiens
taaaatacttttactctgcc

SEQ ID NO: 3985069 - DNA, 18 bp, Homo sapiens
taaaatagtctctttaaa

SEQ ID NO: 3985070 - DNA, 18 bp, Homo sapiens
taaaatatggctataaat

SEQ ID NO: 3985071 - DNA, 12 bp, Homo sapiens
taaaatatttaa

SEQ ID NO: 3985072 - DNA, 13 bp, Homo sapiens
taaaatatttagt

SEQ ID NO: 3985073 - DNA, 15 bp, Homo sapiens
taaaatctattctgt

SEQ ID NO: 3985074 - DNA, 16 bp, Homo sapiens
taaaatctattctgtg

SEQ ID NO: 3985075 - DNA, 17 bp, Homo sapiens
taaaatcttggaagtac

SEQ ID NO: 3985076 - DNA, 24 bp, Homo sapiens
taaaatcttggaagtacatgaata

SEQ ID NO: 3985077 - DNA, 20 bp, Homo sapiens
taaaatcttggcacagaaac

SEQ ID NO: 3985078 - DNA, 15 bp, Homo sapiens
taaaatgaaaattgt

SEQ ID NO: 3985079 - DNA, 16 bp, Homo sapiens
taaaatgaaaattgta

SEQ ID NO: 3985080 - DNA, 15 bp, Homo sapiens
taaaatgactactta

SEQ ID NO: 3985081 - DNA, 23 bp, Homo sapiens
taaaatgatttgtagtggaaaca

SEQ ID NO: 3985082 - DNA, 21 bp, Homo sapiens
taaaatggtgaagaactagca

SEQ ID NO: 3985083 - DNA, 15 bp, Homo sapiens
taaaattaagtagaa

SEQ ID NO: 3985084 - DNA, 18 bp, Homo sapiens
taaaattaagtagaacaa

SEQ ID NO: 3985085 - DNA, 13 bp, Homo sapiens
taaaattacaaaa

SEQ ID NO: 3985086 - DNA, 15 bp, Homo sapiens
taaaattacaactaa

SEQ ID NO: 3985087 - DNA, 19 bp, Homo sapiens
taaaattcaagaaaataaa

SEQ ID NO: 3985088 - DNA, 21 bp, Homo sapiens
taaaattcagtttttgtatct

SEQ ID NO: 3985089 - DNA, 23 bp, Homo sapiens
taaaattcagtttttgtatcttg

SEQ ID NO: 3985090 - DNA, 19 bp, Homo sapiens
taaaattccattatcttat

SEQ ID NO: 3985091 - DNA, 21 bp, Homo sapiens
taaaattctctagatttatta

SEQ ID NO: 3985092 - DNA, 17 bp, Homo sapiens
taaaattggcaccatgt

SEQ ID NO: 3985093 - DNA, 21 bp, Homo sapiens
taaaattgtcacctctgttaa

SEQ ID NO: 3985094 - DNA, 23 bp, Homo sapiens
taaaattgtcacctctgttaagg

SEQ ID NO: 3985095 - DNA, 21 bp, Homo sapiens
taaaatttatcttaagttcta

SEQ ID NO: 3985096 - DNA, 22 bp, Homo sapiens
taaaattttaggcactcttaaa

SEQ ID NO: 3985097 - DNA, 22 bp, Homo sapiens
taaacaaattcatattctgtct

SEQ ID NO: 3985098 - DNA, 20 bp, Homo sapiens
taaacaattcatgcctttca

SEQ ID NO: 3985099 - DNA, 14 bp, Homo sapiens
taaacacacagata

SEQ ID NO: 3985100 - DNA, 21 bp, Homo sapiens
taaacacacagatacacacac

SEQ ID NO: 3985101 - DNA, 15 bp, Homo sapiens
taaacacaggctgtc

SEQ ID NO: 3985102 - DNA, 18 bp, Homo sapiens
taaacacaggctgtcctt

SEQ ID NO: 3985103 - DNA, 19 bp, Homo sapiens
taaacacaggctgtcctta

SEQ ID NO: 3985104 - DNA, 21 bp, Homo sapiens
taaacacagtcaaaataattc

SEQ ID NO: 3985105 - DNA, 11 bp, Homo sapiens
taaacacctga

SEQ ID NO: 3985106 - DNA, 16 bp, Homo sapiens
taaacactcaccttct

SEQ ID NO: 3985107 - DNA, 17 bp, Homo sapiens
taaacactcaccttcta

SEQ ID NO: 3985108 - DNA, 18 bp, Homo sapiens
taaacagcttcatgcctt

SEQ ID NO: 3985109 - DNA, 21 bp, Homo sapiens
taaacagtagttgtattcttc

SEQ ID NO: 3985110 - DNA, 14 bp, Homo sapiens
taaacataaaacaa

SEQ ID NO: 3985111 - DNA, 15 bp, Homo sapiens
taaacataagttgca

SEQ ID NO: 3985112 - DNA, 19 bp, Homo sapiens
taaacataagttgcattta

SEQ ID NO: 3985113 - DNA, 15 bp, Homo sapiens
taaacataataaatc

SEQ ID NO: 3985114 - DNA, 16 bp, Homo sapiens
taaacataataaatca

SEQ ID NO: 3985115 - DNA, 22 bp, Homo sapiens
taaacataataaatcacacatt

SEQ ID NO: 3985116 - DNA, 16 bp, Homo sapiens
taaacataatgaaaat

SEQ ID NO: 3985117 - DNA, 15 bp, Homo sapiens
taaacataattcttg

SEQ ID NO: 3985118 - DNA, 16 bp, Homo sapiens
taaacatatacagaaa

SEQ ID NO: 3985119 - DNA, 16 bp, Homo sapiens
taaacatatgatttca

SEQ ID NO: 3985120 - DNA, 22 bp, Homo sapiens
taaacatatgatttcactagaa

SEQ ID NO: 3985121 - DNA, 17 bp, Homo sapiens
taaacatccaatatttt

SEQ ID NO: 3985122 - DNA, 17 bp, Homo sapiens
taaacatccttcaagaa

SEQ ID NO: 3985123 - DNA, 21 bp, Homo sapiens
taaacattaatagcagccttt

SEQ ID NO: 3985124 - DNA, 12 bp, Homo sapiens
taacagctgaat

SEQ ID NO: 3985125 - DNA, 19 bp, Homo sapiens
taacagctgaattatctat

SEQ ID NO: 3985126 - DNA, 15 bp, Homo sapiens
taacagctgaggtct

SEQ ID NO: 3985127 - DNA, 14 bp, Homo sapiens
taacagttcatgtt

SEQ ID NO: 3985128 - DNA, 14 bp, Homo sapiens
taacagttttccat

SEQ ID NO: 3985129 - DNA, 20 bp, Homo sapiens
taacagttttccatgaaaac

SEQ ID NO: 3985130 - DNA, 14 bp, Homo sapiens
taacatataatgtt

SEQ ID NO: 3985131 - DNA, 17 bp, Homo sapiens
taacatatgtacataaa

SEQ ID NO: 3985132 - DNA, 14 bp, Homo sapiens
taacatctaaaaat

SEQ ID NO: 3985133 - DNA, 18 bp, Homo sapiens
taacatgaggggacattt

SEQ ID NO: 3985134 - DNA, 20 bp, Homo sapiens
taacatgaggggacattttg

SEQ ID NO: 3985135 - DNA, 19 bp, Homo sapiens
taacattaccttactgtgg

SEQ ID NO: 3985136 - DNA, 21 bp, Homo sapiens
taacatttcccccgagctctt

SEQ ID NO: 3985137 - DNA, 16 bp, Homo sapiens
taaccaagctgagttt

SEQ ID NO: 3985138 - DNA, 13 bp, Homo sapiens
taaccaagtttat

SEQ ID NO: 3985139 - DNA, 18 bp, Homo sapiens
taaccacagctccttttc

SEQ ID NO: 3985140 - DNA, 15 bp, Homo sapiens
taaccacggaaaaga

SEQ ID NO: 3985141 - DNA, 19 bp, Homo sapiens
taaccacttaaaaaatgtc

SEQ ID NO: 3985142 - DNA, 20 bp, Homo sapiens
taaccacttaaaaaatgtcc

SEQ ID NO: 3985143 - DNA, 22 bp, Homo sapiens
taaccagttaccacacatctat

SEQ ID NO: 3985144 - DNA, 16 bp, Homo sapiens
taaccattaagtcatg

SEQ ID NO: 3985145 - DNA, 16 bp, Homo sapiens
taacccacctctcctg

SEQ ID NO: 3985146 - DNA, 22 bp, Homo sapiens
taacccacctctcctgccctgt

SEQ ID NO: 3985147 - DNA, 13 bp, Homo sapiens
taaccccagctcc

SEQ ID NO: 3985148 - DNA, 19 bp, Homo sapiens
taaccccagctccctagga

SEQ ID NO: 3985149 - DNA, 20 bp, Homo sapiens
taacccttcatcttcctgtg

SEQ ID NO: 3985150 - DNA, 12 bp, Homo sapiens
taacctattttt

SEQ ID NO: 3985151 - DNA, 15 bp, Homo sapiens
taacctcagctctgg

SEQ ID NO: 3985152 - DNA, 19 bp, Homo sapiens
taacctcagctctgggaga

SEQ ID NO: 3985153 - DNA, 14 bp, Homo sapiens
taacctctgttcag

SEQ ID NO: 3985154 - DNA, 18 bp, Homo sapiens
taacctctgttcaggaag

SEQ ID NO: 3985155 - DNA, 15 bp, Homo sapiens
taacctggtgctgga

SEQ ID NO: 3985156 - DNA, 15 bp, Homo sapiens
taaccttatatttac

SEQ ID NO: 3985157 - DNA, 20 bp, Homo sapiens
taaccttgaatgctgccagt

SEQ ID NO: 3985158 - DNA, 15 bp, Homo sapiens
taacgcgtcttcctg

SEQ ID NO: 3985159 - DNA, 15 bp, Homo sapiens
taacgtaaatacaca

SEQ ID NO: 3985160 - DNA, 17 bp, Homo sapiens
taacgtgtgctgtgttt

SEQ ID NO: 3985161 - DNA, 19 bp, Homo sapiens
taacgtttttcctttaaaa

SEQ ID NO: 3985162 - DNA, 15 bp, Homo sapiens
taactaaaaggtatg

SEQ ID NO: 3985163 - DNA, 23 bp, Homo sapiens
taactaatatgggcattgtagtt

SEQ ID NO: 3985164 - DNA, 23 bp, Homo sapiens
taactaatctattgggttcatta

SEQ ID NO: 3985165 - DNA, 14 bp, Homo sapiens
taactacatttatg

SEQ ID NO: 3985166 - DNA, 15 bp, Homo sapiens
taactactgtgttcc

SEQ ID NO: 3985167 - DNA, 15 bp, Homo sapiens
taactaggctcagag

SEQ ID NO: 3985168 - DNA, 14 bp, Homo sapiens
taactatgacagat

SEQ ID NO: 3985169 - DNA, 14 bp, Homo sapiens
taactcagaattat

SEQ ID NO: 3985170 - DNA, 16 bp, Homo sapiens
taactcatcataaaat

SEQ ID NO: 3985171 - DNA, 17 bp, Homo sapiens
taactcatcataaaata

SEQ ID NO: 3985172 - DNA, 20 bp, Homo sapiens
taactcatttgttaaaatta

SEQ ID NO: 3985173 - DNA, 19 bp, Homo sapiens
taactccagatagagaaat

SEQ ID NO: 3985174 - DNA, 17 bp, Homo sapiens
taactcctgagaaatgt

SEQ ID NO: 3985175 - DNA, 14 bp, Homo sapiens
taactcctgtccct

SEQ ID NO: 3985176 - DNA, 17 bp, Homo sapiens
taactcctgtccctttt

SEQ ID NO: 3985177 - DNA, 22 bp, Homo sapiens
taactctaattcccattttgca

SEQ ID NO: 3985178 - DNA, 18 bp, Homo sapiens
taactctgtaaaaacact

SEQ ID NO: 3985179 - DNA, 16 bp, Homo sapiens
taactcttgtctattt

SEQ ID NO: 3985180 - DNA, 17 bp, Homo sapiens
taactgaaaatgtaaat

SEQ ID NO: 3985181 - DNA, 13 bp, Homo sapiens
taactgcagacca

SEQ ID NO: 3985182 - DNA, 21 bp, Homo sapiens
taactgccttgaacctgtgag

SEQ ID NO: 3985183 - DNA, 22 bp, Homo sapiens
taactgccttgaacctgtgagt

SEQ ID NO: 3985184 - DNA, 14 bp, Homo sapiens
taactgctttctgt

SEQ ID NO: 3985185 - DNA, 17 bp, Homo sapiens
taactgctttctgttcc

SEQ ID NO: 3985186 - DNA, 20 bp, Homo sapiens
taactgctttctgttccaaa

SEQ ID NO: 3985187 - DNA, 11 bp, Homo sapiens
taactgtcctg

SEQ ID NO: 3985188 - DNA, 12 bp, Homo sapiens
taactgtcctgt

SEQ ID NO: 3985189 - DNA, 14 bp, Homo sapiens
taactgtcctgtcc

SEQ ID NO: 3985190 - DNA, 13 bp, Homo sapiens
taactgtgaagtt

SEQ ID NO: 3985191 - DNA, 18 bp, Homo sapiens
taatacaaagaaaaagcc

SEQ ID NO: 3985192 - DNA, 19 bp, Homo sapiens
taatacagcagtgtcatca

SEQ ID NO: 3985193 - DNA, 23 bp, Homo sapiens
taatacagcagtgtcatcagaag

SEQ ID NO: 3985194 - DNA, 15 bp, Homo sapiens
taatactaccttgaa

SEQ ID NO: 3985195 - DNA, 16 bp, Homo sapiens
taatactcaaatgagt

SEQ ID NO: 3985196 - DNA, 20 bp, Homo sapiens
taatactcaaatgagtaaca

SEQ ID NO: 3985197 - DNA, 21 bp, Homo sapiens
taatactcaaatgagtaacat

SEQ ID NO: 3985198 - DNA, 20 bp, Homo sapiens
taatactggaataatttgta

SEQ ID NO: 3985199 - DNA, 21 bp, Homo sapiens
taatactggaataatttgtaa

SEQ ID NO: 3985200 - DNA, 21 bp, Homo sapiens
taatactggtatttttactta

SEQ ID NO: 3985201 - DNA, 20 bp, Homo sapiens
taatagaaataaattcctaa

SEQ ID NO: 3985202 - DNA, 12 bp, Homo sapiens
taatagagcaaa

SEQ ID NO: 3985203 - DNA, 21 bp, Homo sapiens
taatagagcaaaattgatgtg

SEQ ID NO: 3985204 - DNA, 13 bp, Homo sapiens
taatagtgctttt

SEQ ID NO: 3985205 - DNA, 17 bp, Homo sapiens
taatagtttgtctattt

SEQ ID NO: 3985206 - DNA, 21 bp, Homo sapiens
taatataaaaagcttccatga

SEQ ID NO: 3985207 - DNA, 18 bp, Homo sapiens
taatatatatgaataaag

SEQ ID NO: 3985208 - DNA, 20 bp, Homo sapiens
taatatatgtattatttata

SEQ ID NO: 3985209 - DNA, 14 bp, Homo sapiens
taatatcattcact

SEQ ID NO: 3985210 - DNA, 13 bp, Homo sapiens
taatatggaacct

SEQ ID NO: 3985211 - DNA, 22 bp, Homo sapiens
taatatggaaccttccctccaa

SEQ ID NO: 3985212 - DNA, 18 bp, Homo sapiens
taatatggctatgcttaa

SEQ ID NO: 3985213 - DNA, 21 bp, Homo sapiens
taatatgttaacctcagtgtc

SEQ ID NO: 3985214 - DNA, 20 bp, Homo sapiens
taatatgttcttttaaatga

SEQ ID NO: 3985215 - DNA, 22 bp, Homo sapiens
taatattactgtttatttctgt

SEQ ID NO: 3985216 - DNA, 18 bp, Homo sapiens
taatattgacttgtatat

SEQ ID NO: 3985217 - DNA, 14 bp, Homo sapiens
taatattgtattgc

SEQ ID NO: 3985218 - DNA, 21 bp, Homo sapiens
taatattgtattgctgctgtg

SEQ ID NO: 3985219 - DNA, 23 bp, Homo sapiens
taatattgtattgctgctgtgcg

SEQ ID NO: 3985220 - DNA, 21 bp, Homo sapiens
taatattgttgtataatttcg

SEQ ID NO: 3985221 - DNA, 14 bp, Homo sapiens
taatatttaatgga

SEQ ID NO: 3985222 - DNA, 16 bp, Homo sapiens
taatatttagctgtaa

SEQ ID NO: 3985223 - DNA, 16 bp, Homo sapiens
taatatttatatattt

SEQ ID NO: 3985224 - DNA, 23 bp, Homo sapiens
taatatttatgtctatttaagcc

SEQ ID NO: 3985225 - DNA, 21 bp, Homo sapiens
taatcaaaagggaaaagaaga

SEQ ID NO: 3985226 - DNA, 22 bp, Homo sapiens
taatcaagcctttatggctgct

SEQ ID NO: 3985227 - DNA, 21 bp, Homo sapiens
taatcaagttgtaacttatat

SEQ ID NO: 3985228 - DNA, 20 bp, Homo sapiens
taatcaatgaatattgaagt

SEQ ID NO: 3985229 - DNA, 20 bp, Homo sapiens
taatcaccatgtaagcactc

SEQ ID NO: 3985230 - DNA, 20 bp, Homo sapiens
taatgtagcgtgtttacatg

SEQ ID NO: 3985231 - DNA, 15 bp, Homo sapiens
taatgtcagaacaga

SEQ ID NO: 3985232 - DNA, 16 bp, Homo sapiens
taatgtctcactgttc

SEQ ID NO: 3985233 - DNA, 16 bp, Homo sapiens
taatgttaaatttgta

SEQ ID NO: 3985234 - DNA, 22 bp, Homo sapiens
taatgttaaatttgtaagtttc

SEQ ID NO: 3985235 - DNA, 12 bp, Homo sapiens
taatgttactga

SEQ ID NO: 3985236 - DNA, 14 bp, Homo sapiens
taatgttactgatc

SEQ ID NO: 3985237 - DNA, 21 bp, Homo sapiens
taatgttactgatcatgcatt

SEQ ID NO: 3985238 - DNA, 18 bp, Homo sapiens
taatgttatatcatatgt

SEQ ID NO: 3985239 - DNA, 17 bp, Homo sapiens
taatgttcatattttca

SEQ ID NO: 3985240 - DNA, 23 bp, Homo sapiens
taatgttcttatgcaaaatggaa

SEQ ID NO: 3985241 - DNA, 21 bp, Homo sapiens
taatgttgggtagaaagagat

SEQ ID NO: 3985242 - DNA, 19 bp, Homo sapiens
taatgtttaaatcatgtat

SEQ ID NO: 3985243 - DNA, 21 bp, Homo sapiens
taatgtttaaatcatgtatgt

SEQ ID NO: 3985244 - DNA, 15 bp, Homo sapiens
taatgtttatgagcc

SEQ ID NO: 3985245 - DNA, 16 bp, Homo sapiens
taatgtttatgagcca

SEQ ID NO: 3985246 - DNA, 18 bp, Homo sapiens
taatgtttatgagccaga

SEQ ID NO: 3985247 - DNA, 13 bp, Homo sapiens
taatgtttgctat

SEQ ID NO: 3985248 - DNA, 14 bp, Homo sapiens
taatgttttgtata

SEQ ID NO: 3985249 - DNA, 15 bp, Homo sapiens
taatgttttgtatat

SEQ ID NO: 3985250 - DNA, 16 bp, Homo sapiens
taatgttttgtatata

SEQ ID NO: 3985251 - DNA, 22 bp, Homo sapiens
taatgttttgtatatacagtta

SEQ ID NO: 3985252 - DNA, 23 bp, Homo sapiens
taatgttttgtatatacagttat

SEQ ID NO: 3985253 - DNA, 23 bp, Homo sapiens
taatgttttttgccacagctttt

SEQ ID NO: 3985254 - DNA, 18 bp, Homo sapiens
taattaaaaagttaatct

SEQ ID NO: 3985255 - DNA, 15 bp, Homo sapiens
taattaaaatttatc

SEQ ID NO: 3985256 - DNA, 17 bp, Homo sapiens
taattaaaatttatctt

SEQ ID NO: 3985257 - DNA, 21 bp, Homo sapiens
taattaaacattgtgatcatt

SEQ ID NO: 3985258 - DNA, 13 bp, Homo sapiens
taattaaatttaa

SEQ ID NO: 3985259 - DNA, 17 bp, Homo sapiens
taattaagtactatgta

SEQ ID NO: 3985260 - DNA, 18 bp, Homo sapiens
taattacaatatttctga

SEQ ID NO: 3985261 - DNA, 21 bp, Homo sapiens
taattactggaattcttctgc

SEQ ID NO: 3985262 - DNA, 15 bp, Homo sapiens
taattagggtacatt

SEQ ID NO: 3985263 - DNA, 18 bp, Homo sapiens
taattagggtacatttat

SEQ ID NO: 3985264 - DNA, 20 bp, Homo sapiens
taattagggtacatttataa

SEQ ID NO: 3985265 - DNA, 19 bp, Homo sapiens
taattatcggaagcagtgc

SEQ ID NO: 3985266 - DNA, 20 bp, Homo sapiens
taattatcgggaacagtgtt

SEQ ID NO: 3985267 - DNA, 23 bp, Homo sapiens
taattatcgggaacagtgtttcc

SEQ ID NO: 3985268 - DNA, 13 bp, Homo sapiens
taattatgacagt

SEQ ID NO: 3985269 - DNA, 21 bp, Homo sapiens
taattatgacagttatactgt

SEQ ID NO: 3985270 - DNA, 14 bp, Homo sapiens
taattatgatttgg

SEQ ID NO: 3985271 - DNA, 15 bp, Homo sapiens
gttttctgtagtcat

SEQ ID NO: 3985272 - DNA, 18 bp, Homo sapiens
gttttctgtagtcattta

SEQ ID NO: 3985273 - DNA, 18 bp, Homo sapiens
gttttctgtttgtaaatt

SEQ ID NO: 3985274 - DNA, 22 bp, Homo sapiens
gttttctgtttgtaaattattt

SEQ ID NO: 3985275 - DNA, 19 bp, Homo sapiens
gttttcttcaggaaaataa

SEQ ID NO: 3985276 - DNA, 17 bp, Homo sapiens
gttttctttctttaaat

SEQ ID NO: 3985277 - DNA, 13 bp, Homo sapiens
gttttgaaatgct

SEQ ID NO: 3985278 - DNA, 18 bp, Homo sapiens
gttttgaagctactgtgt

SEQ ID NO: 3985279 - DNA, 15 bp, Homo sapiens
gttttgaaggcaaaa

SEQ ID NO: 3985280 - DNA, 16 bp, Homo sapiens
gttttgacggatgatt

SEQ ID NO: 3985281 - DNA, 20 bp, Homo sapiens
gttttgcaaagggaaacagg

SEQ ID NO: 3985282 - DNA, 13 bp, Homo sapiens
gttttgcaataac

SEQ ID NO: 3985283 - DNA, 22 bp, Homo sapiens
gttttgcactcttgtttctccc

SEQ ID NO: 3985284 - DNA, 15 bp, Homo sapiens
gttttgcttcccctc

SEQ ID NO: 3985285 - DNA, 16 bp, Homo sapiens
gttttggactccatct

SEQ ID NO: 3985286 - DNA, 19 bp, Homo sapiens
gttttggatcttgaatgtg

SEQ ID NO: 3985287 - DNA, 20 bp, Homo sapiens
gttttggcaaacgctaaaga

SEQ ID NO: 3985288 - DNA, 20 bp, Homo sapiens
gttttggggaaatgtggaga

SEQ ID NO: 3985289 - DNA, 15 bp, Homo sapiens
gttttgtaaaagaaa

SEQ ID NO: 3985290 - DNA, 14 bp, Homo sapiens
gttttgtacactgc

SEQ ID NO: 3985291 - DNA, 18 bp, Homo sapiens
gttttgtacactgctgta

SEQ ID NO: 3985292 - DNA, 22 bp, Homo sapiens
gttttgtattttttaaaacact

SEQ ID NO: 3985293 - DNA, 21 bp, Homo sapiens
gttttgtcccatttccttgga

SEQ ID NO: 3985294 - DNA, 23 bp, Homo sapiens
gttttgtggtagtccttttggga

SEQ ID NO: 3985295 - DNA, 15 bp, Homo sapiens
gttttgttctttaaa

SEQ ID NO: 3985296 - DNA, 12 bp, Homo sapiens
gttttgttgcta

SEQ ID NO: 3985297 - DNA, 18 bp, Homo sapiens
gtttttaatataaagcct

SEQ ID NO: 3985298 - DNA, 17 bp, Homo sapiens
gtttttacagctgtgtt

SEQ ID NO: 3985299 - DNA, 17 bp, Homo sapiens
gtttttacagttagggt

SEQ ID NO: 3985300 - DNA, 22 bp, Homo sapiens
gtttttacctaccacagtgtct

SEQ ID NO: 3985301 - DNA, 16 bp, Homo sapiens
gtttttactacagttg

SEQ ID NO: 3985302 - DNA, 17 bp, Homo sapiens
gtttttatattaatgta

SEQ ID NO: 3985303 - DNA, 14 bp, Homo sapiens
gtttttattagtac

SEQ ID NO: 3985304 - DNA, 16 bp, Homo sapiens
gtttttattccttgtg

SEQ ID NO: 3985305 - DNA, 18 bp, Homo sapiens
gtttttattgtaaaacaa

SEQ ID NO: 3985306 - DNA, 17 bp, Homo sapiens
gtttttatttctccttt

SEQ ID NO: 3985307 - DNA, 15 bp, Homo sapiens
gtttttccctcccca

SEQ ID NO: 3985308 - DNA, 16 bp, Homo sapiens
gtttttccctccccag

SEQ ID NO: 3985309 - DNA, 14 bp, Homo sapiens
gtttttcctttaaa

SEQ ID NO: 3985310 - DNA, 15 bp, Homo sapiens
gtttttcctttaaaa

SEQ ID NO: 3985311 - DNA, 14 bp, Homo sapiens
gtttttctgccagg

SEQ ID NO: 3985312 - DNA, 12 bp, Homo sapiens
gtttttcttcaa

SEQ ID NO: 3985313 - DNA, 14 bp, Homo sapiens
gtttttgactcttt

SEQ ID NO: 3985314 - DNA, 13 bp, Homo sapiens
gtttttgtattta

SEQ ID NO: 3985315 - DNA, 17 bp, Homo sapiens
gtttttgtgctgtgggc

SEQ ID NO: 3985316 - DNA, 17 bp, Homo sapiens
gtttttgtttggagagc

SEQ ID NO: 3985317 - DNA, 12 bp, Homo sapiens
gttttttaagtc

SEQ ID NO: 3985318 - DNA, 19 bp, Homo sapiens
gtttttttcttctgtattt

SEQ ID NO: 3985319 - DNA, 19 bp, Homo sapiens
gtttttttgtatagaccaa

SEQ ID NO: 3985320 - DNA, 20 bp, Homo sapiens
gttttttttgactaaagcta

SEQ ID NO: 3985321 - DNA, 14 bp, Homo sapiens
gtttttttttcatt

SEQ ID NO: 3985322 - DNA, 21 bp, Homo sapiens
taaaaaaaaaagttacagaaa

SEQ ID NO: 3985323 - DNA, 14 bp, Homo sapiens
taaaaaaaaaggca

SEQ ID NO: 3985324 - DNA, 16 bp, Homo sapiens
taaaaaaaaatgcctt

SEQ ID NO: 3985325 - DNA, 11 bp, Homo sapiens
taaaaaacaac

SEQ ID NO: 3985326 - DNA, 23 bp, Homo sapiens
taaaaaagcctggtttttctcaa

SEQ ID NO: 3985327 - DNA, 13 bp, Homo sapiens
taaaaaatgaaat

SEQ ID NO: 3985328 - DNA, 11 bp, Homo sapiens
taaaaaatgga

SEQ ID NO: 3985329 - DNA, 16 bp, Homo sapiens
taaaaaatggaaaaaa

SEQ ID NO: 3985330 - DNA, 17 bp, Homo sapiens
taaaaacaaatgagttt

SEQ ID NO: 3985331 - DNA, 19 bp, Homo sapiens
taaaaacagcattgctttc

SEQ ID NO: 3985332 - DNA, 22 bp, Homo sapiens
taaaaacagcattgctttctga

SEQ ID NO: 3985333 - DNA, 21 bp, Homo sapiens
taaaaagacattcttccaaaa

SEQ ID NO: 3985334 - DNA, 15 bp, Homo sapiens
taaaaagattagcaa

SEQ ID NO: 3985335 - DNA, 13 bp, Homo sapiens
taaaaagatttgt

SEQ ID NO: 3985336 - DNA, 23 bp, Homo sapiens
taaaaagcagaattttaatgtga

SEQ ID NO: 3985337 - DNA, 13 bp, Homo sapiens
taaaaaggaacaa

SEQ ID NO: 3985338 - DNA, 18 bp, Homo sapiens
taaaaaggacatcagcaa

SEQ ID NO: 3985339 - DNA, 17 bp, Homo sapiens
taaaaagtcttcactct

SEQ ID NO: 3985340 - DNA, 15 bp, Homo sapiens
taaaaagtgacacag

SEQ ID NO: 3985341 - DNA, 18 bp, Homo sapiens
taaaaagtttcacgtctt

SEQ ID NO: 3985342 - DNA, 20 bp, Homo sapiens
taaaaagttttagttttgat

SEQ ID NO: 3985343 - DNA, 17 bp, Homo sapiens
taaaaataaatttggtt

SEQ ID NO: 3985344 - DNA, 22 bp, Homo sapiens
taaaaatattgtgttgtgaatg

SEQ ID NO: 3985345 - DNA, 15 bp, Homo sapiens
taaaaatatttcaga

SEQ ID NO: 3985346 - DNA, 15 bp, Homo sapiens
taaaaatcatagtac

SEQ ID NO: 3985347 - DNA, 17 bp, Homo sapiens
taaaaatcattgattgt

SEQ ID NO: 3985348 - DNA, 13 bp, Homo sapiens
taattattattaa

SEQ ID NO: 3985349 - DNA, 13 bp, Homo sapiens
taattattattta

SEQ ID NO: 3985350 - DNA, 19 bp, Homo sapiens
taattattttaaaatattt

SEQ ID NO: 3985351 - DNA, 18 bp, Homo sapiens
taattcaatcctactttt

SEQ ID NO: 3985352 - DNA, 19 bp, Homo sapiens
taattcacagaatagcaca

SEQ ID NO: 3985353 - DNA, 21 bp, Homo sapiens
taattcacagaatagcacaaa

SEQ ID NO: 3985354 - DNA, 12 bp, Homo sapiens
taattcactcaa

SEQ ID NO: 3985355 - DNA, 21 bp, Homo sapiens
taattcactcaagcactgata

SEQ ID NO: 3985356 - DNA, 12 bp, Homo sapiens
taattcagcact

SEQ ID NO: 3985357 - DNA, 18 bp, Homo sapiens
taattcagcactgatttc

SEQ ID NO: 3985358 - DNA, 22 bp, Homo sapiens
taattcagcactgatttcacaa

SEQ ID NO: 3985359 - DNA, 16 bp, Homo sapiens
taattcccattttgca

SEQ ID NO: 3985360 - DNA, 23 bp, Homo sapiens
taattcccattttgcaaaatttc

SEQ ID NO: 3985361 - DNA, 13 bp, Homo sapiens
taattcctacagc

SEQ ID NO: 3985362 - DNA, 21 bp, Homo sapiens
taattcctacagcactactgg

SEQ ID NO: 3985363 - DNA, 19 bp, Homo sapiens
taattcctcaacgtattgt

SEQ ID NO: 3985364 - DNA, 11 bp, Homo sapiens
taattctaaag

SEQ ID NO: 3985365 - DNA, 12 bp, Homo sapiens
taattctaagtt

SEQ ID NO: 3985366 - DNA, 17 bp, Homo sapiens
taattctcatttgttct

SEQ ID NO: 3985367 - DNA, 16 bp, Homo sapiens
taattctctttcaaag

SEQ ID NO: 3985368 - DNA, 13 bp, Homo sapiens
taattcttcagtt

SEQ ID NO: 3985369 - DNA, 17 bp, Homo sapiens
taattgatcagttttca

SEQ ID NO: 3985370 - DNA, 12 bp, Homo sapiens
taattgattttt

SEQ ID NO: 3985371 - DNA, 16 bp, Homo sapiens
taattgcttacatttt

SEQ ID NO: 3985372 - DNA, 12 bp, Homo sapiens
taattgttgaaa

SEQ ID NO: 3985373 - DNA, 15 bp, Homo sapiens
taattgtttcagaat

SEQ ID NO: 3985374 - DNA, 19 bp, Homo sapiens
taatttaaacacctcctca

SEQ ID NO: 3985375 - DNA, 23 bp, Homo sapiens
taatttaaacatttgttcctgga

SEQ ID NO: 3985376 - DNA, 15 bp, Homo sapiens
taatttaacaaacta

SEQ ID NO: 3985377 - DNA, 19 bp, Homo sapiens
taatttaacaaactaaaaa

SEQ ID NO: 3985378 - DNA, 12 bp, Homo sapiens
taatttaacacc

SEQ ID NO: 3985379 - DNA, 19 bp, Homo sapiens
taatttaacaccctttaga

SEQ ID NO: 3985380 - DNA, 19 bp, Homo sapiens
taatttagaaactgatttc

SEQ ID NO: 3985381 - DNA, 23 bp, Homo sapiens
taatttagaaactgatttcttca

SEQ ID NO: 3985382 - DNA, 19 bp, Homo sapiens
taatttagggtactaaatt

SEQ ID NO: 3985383 - DNA, 21 bp, Homo sapiens
taatttatctaaattaaagcc

SEQ ID NO: 3985384 - DNA, 14 bp, Homo sapiens
taatttatgagttt

SEQ ID NO: 3985385 - DNA, 11 bp, Homo sapiens
taatttatgca

SEQ ID NO: 3985386 - DNA, 19 bp, Homo sapiens
taatttatttattaagatg

SEQ ID NO: 3985387 - DNA, 13 bp, Homo sapiens
taatttatttcaa

SEQ ID NO: 3985388 - DNA, 15 bp, Homo sapiens
taatttatttcatcc

SEQ ID NO: 3985389 - DNA, 18 bp, Homo sapiens
taatttcaaaaatataac

SEQ ID NO: 3985390 - DNA, 21 bp, Homo sapiens
taatttcaaaaatataactta

SEQ ID NO: 3985391 - DNA, 12 bp, Homo sapiens
taatttcaaaat

SEQ ID NO: 3985392 - DNA, 19 bp, Homo sapiens
taatttcctttttgacact

SEQ ID NO: 3985393 - DNA, 21 bp, Homo sapiens
taatttcctttttgacactga

SEQ ID NO: 3985394 - DNA, 17 bp, Homo sapiens
taatttctaagtgtaag

SEQ ID NO: 3985395 - DNA, 22 bp, Homo sapiens
taatttctactctgtcttaaat

SEQ ID NO: 3985396 - DNA, 20 bp, Homo sapiens
taatttctagaaacaaacat

SEQ ID NO: 3985397 - DNA, 20 bp, Homo sapiens
taatttgaatgtggttactt

SEQ ID NO: 3985398 - DNA, 12 bp, Homo sapiens
taatttgatctt

SEQ ID NO: 3985399 - DNA, 19 bp, Homo sapiens
taatttgatgaaagctgat

SEQ ID NO: 3985400 - DNA, 20 bp, Homo sapiens
taatttgatgaaagctgatt

SEQ ID NO: 3985401 - DNA, 18 bp, Homo sapiens
taatttgattaacaaata

SEQ ID NO: 3985402 - DNA, 15 bp, Homo sapiens
taatttgtaaatgat

SEQ ID NO: 3985403 - DNA, 17 bp, Homo sapiens
taattttaatattcttt

SEQ ID NO: 3985404 - DNA, 18 bp, Homo sapiens
taattttctcaaaagcat

SEQ ID NO: 3985405 - DNA, 23 bp, Homo sapiens
taattttcttcatgcaatgacat

SEQ ID NO: 3985406 - DNA, 17 bp, Homo sapiens
taattttgaaaagatgt

SEQ ID NO: 3985407 - DNA, 13 bp, Homo sapiens
taatttttaaagt

SEQ ID NO: 3985408 - DNA, 13 bp, Homo sapiens
tacacacacacac

SEQ ID NO: 3985409 - DNA, 13 bp, Homo sapiens
tacacacacactc

SEQ ID NO: 3985410 - DNA, 16 bp, Homo sapiens
tacacactcaggcctg

SEQ ID NO: 3985411 - DNA, 18 bp, Homo sapiens
tacacactggtacttaga

SEQ ID NO: 3985412 - DNA, 18 bp, Homo sapiens
tacacagaggagtgcagc

SEQ ID NO: 3985413 - DNA, 13 bp, Homo sapiens
tacacagtcagct

SEQ ID NO: 3985414 - DNA, 23 bp, Homo sapiens
tacacatagcatgtaatggtatc

SEQ ID NO: 3985415 - DNA, 17 bp, Homo sapiens
tacacatctcagaccct

SEQ ID NO: 3985416 - DNA, 13 bp, Homo sapiens
tacacattagatt

SEQ ID NO: 3985417 - DNA, 17 bp, Homo sapiens
tacacatttttaaattg

SEQ ID NO: 3985418 - DNA, 19 bp, Homo sapiens
tacacccagaccccaggct

SEQ ID NO: 3985419 - DNA, 16 bp, Homo sapiens
tacaccgactagccag

SEQ ID NO: 3985420 - DNA, 23 bp, Homo sapiens
tacacctttatctttccatggga

SEQ ID NO: 3985421 - DNA, 21 bp, Homo sapiens
tacacgaccatttgataggga

SEQ ID NO: 3985422 - DNA, 12 bp, Homo sapiens
tacactaacatt

SEQ ID NO: 3985423 - DNA, 16 bp, Homo sapiens
tacactgaggagagat

SEQ ID NO: 3985424 - DNA, 13 bp, Homo sapiens
tacactttatgca

SEQ ID NO: 3985425 - DNA, 17 bp, Homo sapiens
tacagaaaaatatatat

SEQ ID NO: 3985426 - DNA, 15 bp, Homo sapiens
tacagaacttcagaa

SEQ ID NO: 3985427 - DNA, 18 bp, Homo sapiens
tacagaacttcagaaaga

SEQ ID NO: 3985428 - DNA, 16 bp, Homo sapiens
tacagaataatccagt

SEQ ID NO: 3985429 - DNA, 13 bp, Homo sapiens
tacagaatatttc

SEQ ID NO: 3985430 - DNA, 14 bp, Homo sapiens
tacagactccatct

SEQ ID NO: 3985431 - DNA, 20 bp, Homo sapiens
tacagactccatctcttctg

SEQ ID NO: 3985432 - DNA, 14 bp, Homo sapiens
tacagacttctcca

SEQ ID NO: 3985433 - DNA, 17 bp, Homo sapiens
tacagagaggagaaaca

SEQ ID NO: 3985434 - DNA, 21 bp, Homo sapiens
tacagagaggagaaacacatc

SEQ ID NO: 3985435 - DNA, 22 bp, Homo sapiens
tacagagatgtctcttatatct

SEQ ID NO: 3985436 - DNA, 18 bp, Homo sapiens
tacagagcagctccccag

SEQ ID NO: 3985437 - DNA, 11 bp, Homo sapiens
tacagaggaaa

SEQ ID NO: 3985438 - DNA, 18 bp, Homo sapiens
tacagaggaaatctgtaa

SEQ ID NO: 3985439 - DNA, 20 bp, Homo sapiens
tacagatcctttttccatca

SEQ ID NO: 3985440 - DNA, 17 bp, Homo sapiens
tacagcactactgggtg

SEQ ID NO: 3985441 - DNA, 14 bp, Homo sapiens
tacagccacatccc

SEQ ID NO: 3985442 - DNA, 23 bp, Homo sapiens
tacagccacatccccaagcccac

SEQ ID NO: 3985443 - DNA, 13 bp, Homo sapiens
tacagcctggacc

SEQ ID NO: 3985444 - DNA, 18 bp, Homo sapiens
tacagctcattaaacttt

SEQ ID NO: 3985445 - DNA, 16 bp, Homo sapiens
tacagctcccccagct

SEQ ID NO: 3985446 - DNA, 10 bp, Homo sapiens
tacagctggg

SEQ ID NO: 3985447 - DNA, 15 bp, Homo sapiens
tacagcttcaccctg

SEQ ID NO: 3985448 - DNA, 18 bp, Homo sapiens
tacagctttcatgattag

SEQ ID NO: 3985449 - DNA, 18 bp, Homo sapiens
tacaggaaggtagaaata

SEQ ID NO: 3985450 - DNA, 19 bp, Homo sapiens
tacaggcaccgagaatgtt

SEQ ID NO: 3985451 - DNA, 19 bp, Homo sapiens
tacaggccctgctcctgca

SEQ ID NO: 3985452 - DNA, 19 bp, Homo sapiens
tacagggtaactgtgctga

SEQ ID NO: 3985453 - DNA, 24 bp, Homo sapiens
tacagggtaactgtgctgaatgct

SEQ ID NO: 3985454 - DNA, 13 bp, Homo sapiens
tacagggttttta

SEQ ID NO: 3985455 - DNA, 17 bp, Homo sapiens
tacagggtttttacctg

SEQ ID NO: 3985456 - DNA, 23 bp, Homo sapiens
tacagggtttttacctgtcacat

SEQ ID NO: 3985457 - DNA, 19 bp, Homo sapiens
tacaggttaacctgcagaa

SEQ ID NO: 3985458 - DNA, 16 bp, Homo sapiens
tacagtcgtaaaagag

SEQ ID NO: 3985459 - DNA, 12 bp, Homo sapiens
tacagtgccttg

SEQ ID NO: 3985460 - DNA, 22 bp, Homo sapiens
tacagtggttttatactgaagg

SEQ ID NO: 3985461 - DNA, 12 bp, Homo sapiens
tacagtgttacc

SEQ ID NO: 3985462 - DNA, 16 bp, Homo sapiens
tacagtgttattttct

SEQ ID NO: 3985463 - DNA, 15 bp, Homo sapiens
tacagttttcagaaa

SEQ ID NO: 3985464 - DNA, 16 bp, Homo sapiens
tacataaaagaatttt

SEQ ID NO: 3985465 - DNA, 21 bp, Homo sapiens
tacataaattgcataaagcat

SEQ ID NO: 3985466 - DNA, 20 bp, Homo sapiens
tacataactcctgtcccttt

SEQ ID NO: 3985467 - DNA, 15 bp, Homo sapiens
tacccagagaatata

SEQ ID NO: 3985468 - DNA, 12 bp, Homo sapiens
tacccagatgcc

SEQ ID NO: 3985469 - DNA, 20 bp, Homo sapiens
tacccaggctggagtgcagt

SEQ ID NO: 3985470 - DNA, 21 bp, Homo sapiens
tacccattcgtggtgatcaat

SEQ ID NO: 3985471 - DNA, 15 bp, Homo sapiens
tacccattctgtttt

SEQ ID NO: 3985472 - DNA, 15 bp, Homo sapiens
taccccactgggcac

SEQ ID NO: 3985473 - DNA, 18 bp, Homo sapiens
taccccagggccctggcc

SEQ ID NO: 3985474 - DNA, 21 bp, Homo sapiens
tacccccaggtggaaggcaga

SEQ ID NO: 3985475 - DNA, 16 bp, Homo sapiens
taccccctccttcaga

SEQ ID NO: 3985476 - DNA, 22 bp, Homo sapiens
tacccctcccggccctgcctgc

SEQ ID NO: 3985477 - DNA, 19 bp, Homo sapiens
taccccttagcctccctga

SEQ ID NO: 3985478 - DNA, 16 bp, Homo sapiens
taccctaatgtcttca

SEQ ID NO: 3985479 - DNA, 12 bp, Homo sapiens
taccctcctggc

SEQ ID NO: 3985480 - DNA, 13 bp, Homo sapiens
taccctctcagct

SEQ ID NO: 3985481 - DNA, 17 bp, Homo sapiens
taccctctcagctccag

SEQ ID NO: 3985482 - DNA, 12 bp, Homo sapiens
taccctctggag

SEQ ID NO: 3985483 - DNA, 22 bp, Homo sapiens
taccctctggaggggtgtggct

SEQ ID NO: 3985484 - DNA, 15 bp, Homo sapiens
taccctctttgctgc

SEQ ID NO: 3985485 - DNA, 20 bp, Homo sapiens
taccctgctccctgctttgg

SEQ ID NO: 3985486 - DNA, 20 bp, Homo sapiens
taccctggcactataatgta

SEQ ID NO: 3985487 - DNA, 15 bp, Homo sapiens
tacccttccctgcac

SEQ ID NO: 3985488 - DNA, 17 bp, Homo sapiens
tacccttccctgcacta

SEQ ID NO: 3985489 - DNA, 21 bp, Homo sapiens
tacccttgtgagagcccattc

SEQ ID NO: 3985490 - DNA, 20 bp, Homo sapiens
tacccttttcccccttccca

SEQ ID NO: 3985491 - DNA, 18 bp, Homo sapiens
taccctttttctccagct

SEQ ID NO: 3985492 - DNA, 15 bp, Homo sapiens
taccgacaagcacag

SEQ ID NO: 3985493 - DNA, 18 bp, Homo sapiens
taccgagtctcttctcca

SEQ ID NO: 3985494 - DNA, 22 bp, Homo sapiens
taccgagtctcttctccactgg

SEQ ID NO: 3985495 - DNA, 12 bp, Homo sapiens
taccgccctggg

SEQ ID NO: 3985496 - DNA, 15 bp, Homo sapiens
taccgcctgtctctt

SEQ ID NO: 3985497 - DNA, 17 bp, Homo sapiens
taccgcctgtctcttta

SEQ ID NO: 3985498 - DNA, 20 bp, Homo sapiens
taccgtaggctttgtattca

SEQ ID NO: 3985499 - DNA, 20 bp, Homo sapiens
tacctaaagtatttttataa

SEQ ID NO: 3985500 - DNA, 19 bp, Homo sapiens
tacctaagtgacatttgta

SEQ ID NO: 3985501 - DNA, 15 bp, Homo sapiens
tacctacatacaatt

SEQ ID NO: 3985502 - DNA, 14 bp, Homo sapiens
tacctacctgtgtg

SEQ ID NO: 3985503 - DNA, 17 bp, Homo sapiens
tacctactattggccct

SEQ ID NO: 3985504 - DNA, 19 bp, Homo sapiens
tacctataaagtaaagcta

SEQ ID NO: 3985505 - DNA, 23 bp, Homo sapiens
tacctatataataaagctactga

SEQ ID NO: 3985506 - DNA, 22 bp, Homo sapiens
tacctcaagccccatttcctca

SEQ ID NO: 3985507 - DNA, 18 bp, Homo sapiens
tacctcaggcagctcaag

SEQ ID NO: 3985508 - DNA, 12 bp, Homo sapiens
tacctccctccc

SEQ ID NO: 3985509 - DNA, 13 bp, Homo sapiens
tacctcctctcag

SEQ ID NO: 3985510 - DNA, 19 bp, Homo sapiens
tacctcctctcagtgtttt

SEQ ID NO: 3985511 - DNA, 21 bp, Homo sapiens
tacctctaaatttccatatcc

SEQ ID NO: 3985512 - DNA, 21 bp, Homo sapiens
tacctctcaagctagtgtttc

SEQ ID NO: 3985513 - DNA, 13 bp, Homo sapiens
gtggtagagaagc

SEQ ID NO: 3985514 - DNA, 21 bp, Homo sapiens
gtggtatgtaatttatgcaag

SEQ ID NO: 3985515 - DNA, 14 bp, Homo sapiens
gtggtatgtctgcc

SEQ ID NO: 3985516 - DNA, 21 bp, Homo sapiens
gtggtcactgtgcactgccct

SEQ ID NO: 3985517 - DNA, 14 bp, Homo sapiens
gtggtcagatgcag

SEQ ID NO: 3985518 - DNA, 16 bp, Homo sapiens
gtggtcattaagcatt

SEQ ID NO: 3985519 - DNA, 16 bp, Homo sapiens
gtggtccagctcttgg

SEQ ID NO: 3985520 - DNA, 21 bp, Homo sapiens
gtgccccccacccctggaaga

SEQ ID NO: 3985521 - DNA, 13 bp, Homo sapiens
gtgccccctcacc

SEQ ID NO: 3985522 - DNA, 20 bp, Homo sapiens
gtgccctactcattggggtt

SEQ ID NO: 3985523 - DNA, 21 bp, Homo sapiens
gtgccctggtgaatcacctgg

SEQ ID NO: 3985524 - DNA, 13 bp, Homo sapiens
gtgccgagccctt

SEQ ID NO: 3985525 - DNA, 19 bp, Homo sapiens
gtgccgtgtgagtgtgaca

SEQ ID NO: 3985526 - DNA, 19 bp, Homo sapiens
gtgcctatttgtgtggaca

SEQ ID NO: 3985527 - DNA, 10 bp, Homo sapiens
gtgcctcaga

SEQ ID NO: 3985528 - DNA, 12 bp, Homo sapiens
gtgcctcagact

SEQ ID NO: 3985529 - DNA, 17 bp, Homo sapiens
gtgcctcagactccgcc

SEQ ID NO: 3985530 - DNA, 19 bp, Homo sapiens
gtgcctcctcagaggacag

SEQ ID NO: 3985531 - DNA, 12 bp, Homo sapiens
gtgcctctggga

SEQ ID NO: 3985532 - DNA, 17 bp, Homo sapiens
gtgcctgagaggcaggc

SEQ ID NO: 3985533 - DNA, 15 bp, Homo sapiens
gtgcctgccaccttc

SEQ ID NO: 3985534 - DNA, 14 bp, Homo sapiens
gtgcctggccagat

SEQ ID NO: 3985535 - DNA, 16 bp, Homo sapiens
gtgcctggccccagcc

SEQ ID NO: 3985536 - DNA, 16 bp, Homo sapiens
gtgcctggcctctgcc

SEQ ID NO: 3985537 - DNA, 16 bp, Homo sapiens
gtgcctgggggagaga

SEQ ID NO: 3985538 - DNA, 16 bp, Homo sapiens
gtgcctgggggagttt

SEQ ID NO: 3985539 - DNA, 15 bp, Homo sapiens
gtgccttcagctcta

SEQ ID NO: 3985540 - DNA, 18 bp, Homo sapiens
gtgccttcagctgttgca

SEQ ID NO: 3985541 - DNA, 12 bp, Homo sapiens
gtgccttccata

SEQ ID NO: 3985542 - DNA, 15 bp, Homo sapiens
gtgccttccataatt

SEQ ID NO: 3985543 - DNA, 22 bp, Homo sapiens
gtgccttctccttccccaggat

SEQ ID NO: 3985544 - DNA, 18 bp, Homo sapiens
gtgccttttgcagaagag

SEQ ID NO: 3985545 - DNA, 15 bp, Homo sapiens
gtgccttttgtgtga

SEQ ID NO: 3985546 - DNA, 21 bp, Homo sapiens
gtgcgtgaaacacaccaggct

SEQ ID NO: 3985547 - DNA, 15 bp, Homo sapiens
gtgcgtggaaaaaga

SEQ ID NO: 3985548 - DNA, 13 bp, Homo sapiens
gtgcgtgtgtaga

SEQ ID NO: 3985549 - DNA, 22 bp, Homo sapiens
gtgctaaatggtcgcccaggag

SEQ ID NO: 3985550 - DNA, 21 bp, Homo sapiens
gtgctagaaaatttagccctt

SEQ ID NO: 3985551 - DNA, 21 bp, Homo sapiens
gtgctagcttgacacagtcag

SEQ ID NO: 3985552 - DNA, 19 bp, Homo sapiens
gtgctatggatggcttcta

SEQ ID NO: 3985553 - DNA, 20 bp, Homo sapiens
gtgctcaccagccctgcagc

SEQ ID NO: 3985554 - DNA, 14 bp, Homo sapiens
gtgctcgccccagc

SEQ ID NO: 3985555 - DNA, 21 bp, Homo sapiens
gtgctgaacagtggaggaaga

SEQ ID NO: 3985556 - DNA, 21 bp, Homo sapiens
gtgctgacggccagggagaag

SEQ ID NO: 3985557 - DNA, 14 bp, Homo sapiens
gtgctgaggccagg

SEQ ID NO: 3985558 - DNA, 20 bp, Homo sapiens
gtgctgatcgtgctaaattt

SEQ ID NO: 3985559 - DNA, 21 bp, Homo sapiens
gtgctgccacacttcaggctc

SEQ ID NO: 3985560 - DNA, 13 bp, Homo sapiens
gtgctgccctgtg

SEQ ID NO: 3985561 - DNA, 20 bp, Homo sapiens
gtgctgcgcctgcaggcaga

SEQ ID NO: 3985562 - DNA, 14 bp, Homo sapiens
gtgctgctgctgct

SEQ ID NO: 3985563 - DNA, 15 bp, Homo sapiens
gtgctgctgctgctg

SEQ ID NO: 3985564 - DNA, 18 bp, Homo sapiens
gtgctggaattctaacaa

SEQ ID NO: 3985565 - DNA, 20 bp, Homo sapiens
gtgctggatggacagtgggc

SEQ ID NO: 3985566 - DNA, 15 bp, Homo sapiens
gtgctggcaaccact

SEQ ID NO: 3985567 - DNA, 16 bp, Homo sapiens
gtgctgggaccagagc

SEQ ID NO: 3985568 - DNA, 20 bp, Homo sapiens
gtgctgggaccagagccaga

SEQ ID NO: 3985569 - DNA, 17 bp, Homo sapiens
gtgctgggaggagggag

SEQ ID NO: 3985570 - DNA, 16 bp, Homo sapiens
gtgctgtgagggaggg

SEQ ID NO: 3985571 - DNA, 14 bp, Homo sapiens
gtgctgtggaagca

SEQ ID NO: 3985572 - DNA, 14 bp, Homo sapiens
gtgctgtggccagg

SEQ ID NO: 3985573 - DNA, 20 bp, Homo sapiens
gtgctgtgggcagcaccctc

SEQ ID NO: 3985574 - DNA, 19 bp, Homo sapiens
gtgctgtgtttgctcccct

SEQ ID NO: 3985575 - DNA, 15 bp, Homo sapiens
gtgcttagttggctt

SEQ ID NO: 3985576 - DNA, 20 bp, Homo sapiens
gtgcttgaaggccctgctga

SEQ ID NO: 3985577 - DNA, 21 bp, Homo sapiens
gtgcttgggagagtcaggcag

SEQ ID NO: 3985578 - DNA, 13 bp, Homo sapiens
gtgcttgttttat

SEQ ID NO: 3985579 - DNA, 21 bp, Homo sapiens
gtggaaaaagacgatgtttat

SEQ ID NO: 3985580 - DNA, 16 bp, Homo sapiens
gtggaaaacttatgct

SEQ ID NO: 3985581 - DNA, 21 bp, Homo sapiens
gtggaaaacttatgctgattt

SEQ ID NO: 3985582 - DNA, 19 bp, Homo sapiens
gtggaacataaaaaggaca

SEQ ID NO: 3985583 - DNA, 15 bp, Homo sapiens
gtggaacctctgtct

SEQ ID NO: 3985584 - DNA, 20 bp, Homo sapiens
gtggaacctctgtctcatcc

SEQ ID NO: 3985585 - DNA, 18 bp, Homo sapiens
gtggaagttccaagtcca

SEQ ID NO: 3985586 - DNA, 18 bp, Homo sapiens
gtggaatataaggaaagc

SEQ ID NO: 3985587 - DNA, 17 bp, Homo sapiens
gtggacaaactggagtc

SEQ ID NO: 3985588 - DNA, 14 bp, Homo sapiens
gtggacaggcccag

SEQ ID NO: 3985589 - DNA, 15 bp, Homo sapiens
gtggacaggcccagc

SEQ ID NO: 3985590 - DNA, 23 bp, Homo sapiens
gtggacaggcccagcgcggccag

SEQ ID NO: 3985591 - DNA, 22 bp, Homo sapiens
gtggaccctgtcttctgggcac

SEQ ID NO: 3985592 - DNA, 15 bp, Homo sapiens
gtggaccgtggacag

SEQ ID NO: 3985593 - DNA, 16 bp, Homo sapiens
gtggactcagggcagc

SEQ ID NO: 3985594 - DNA, 15 bp, Homo sapiens
gtggagaaaatcaaa

SEQ ID NO: 3985595 - DNA, 18 bp, Homo sapiens
gtggagaccctgccacag

SEQ ID NO: 3985596 - DNA, 12 bp, Homo sapiens
gtggagagctgg

SEQ ID NO: 3985597 - DNA, 16 bp, Homo sapiens
gtggagagctggtgcc

SEQ ID NO: 3985598 - DNA, 22 bp, Homo sapiens
gtggagagggacagcccactga

SEQ ID NO: 3985599 - DNA, 18 bp, Homo sapiens
gtggagcaaaaggcagct

SEQ ID NO: 3985600 - DNA, 17 bp, Homo sapiens
gtggagcatgggcctgg

SEQ ID NO: 3985601 - DNA, 15 bp, Homo sapiens
gtggagccagggagc

SEQ ID NO: 3985602 - DNA, 14 bp, Homo sapiens
gtggagcccaggag

SEQ ID NO: 3985603 - DNA, 22 bp, Homo sapiens
gtggagcctgacagccagaact

SEQ ID NO: 3985604 - DNA, 19 bp, Homo sapiens
gtggagcggggtatgaaga

SEQ ID NO: 3985605 - DNA, 15 bp, Homo sapiens
gtggagctcagcccc

SEQ ID NO: 3985606 - DNA, 15 bp, Homo sapiens
gtggaggaaggattg

SEQ ID NO: 3985607 - DNA, 14 bp, Homo sapiens
gtggaggcacttta

SEQ ID NO: 3985608 - DNA, 16 bp, Homo sapiens
gtggaggctgcagtga

SEQ ID NO: 3985609 - DNA, 23 bp, Homo sapiens
gtggagggacaagtggactcagg

SEQ ID NO: 3985610 - DNA, 13 bp, Homo sapiens
gtggagggcacag

SEQ ID NO: 3985611 - DNA, 16 bp, Homo sapiens
gtggaggggtgtggca

SEQ ID NO: 3985612 - DNA, 10 bp, Homo sapiens
gtcagatgca

SEQ ID NO: 3985613 - DNA, 21 bp, Homo sapiens
gtcagatggaggttctcagag

SEQ ID NO: 3985614 - DNA, 16 bp, Homo sapiens
gtcagcaatttaacta

SEQ ID NO: 3985615 - DNA, 15 bp, Homo sapiens
gtcagcatctggctg

SEQ ID NO: 3985616 - DNA, 22 bp, Homo sapiens
gtcagcatctggctgtctagaa

SEQ ID NO: 3985617 - DNA, 18 bp, Homo sapiens
gtcagcatgcttcccaga

SEQ ID NO: 3985618 - DNA, 21 bp, Homo sapiens
gtcagcatgcttcccagaggg

SEQ ID NO: 3985619 - DNA, 20 bp, Homo sapiens
gtcagccaggagctgtcacc

SEQ ID NO: 3985620 - DNA, 12 bp, Homo sapiens
gtcagccagggc

SEQ ID NO: 3985621 - DNA, 15 bp, Homo sapiens
gtcagccagggccag

SEQ ID NO: 3985622 - DNA, 16 bp, Homo sapiens
gtcagccagggccagg

SEQ ID NO: 3985623 - DNA, 16 bp, Homo sapiens
gtcagccgagccgggc

SEQ ID NO: 3985624 - DNA, 20 bp, Homo sapiens
gtcagccgagccgggcctgg

SEQ ID NO: 3985625 - DNA, 21 bp, Homo sapiens
gtcagccgagccgggcctggg

SEQ ID NO: 3985626 - DNA, 16 bp, Homo sapiens
gtcagcctcgcaggcc

SEQ ID NO: 3985627 - DNA, 15 bp, Homo sapiens
gtcagctctctgccc

SEQ ID NO: 3985628 - DNA, 20 bp, Homo sapiens
gtcagctgctccctggcatt

SEQ ID NO: 3985629 - DNA, 19 bp, Homo sapiens
gtcaggaacagtggctggg

SEQ ID NO: 3985630 - DNA, 23 bp, Homo sapiens
gtcaggacggctcctcagagcgc

SEQ ID NO: 3985631 - DNA, 15 bp, Homo sapiens
gtcaggaggcagaag

SEQ ID NO: 3985632 - DNA, 22 bp, Homo sapiens
gtcaggagttgtttctgaccca

SEQ ID NO: 3985633 - DNA, 17 bp, Homo sapiens
gtcaggcccccagtggg

SEQ ID NO: 3985634 - DNA, 14 bp, Homo sapiens
gtcaggccgggcag

SEQ ID NO: 3985635 - DNA, 13 bp, Homo sapiens
gtcaggcctgtgt

SEQ ID NO: 3985636 - DNA, 15 bp, Homo sapiens
gtcaggcctgtgtgt

SEQ ID NO: 3985637 - DNA, 19 bp, Homo sapiens
gtcaggcggggtgctgtgg

SEQ ID NO: 3985638 - DNA, 14 bp, Homo sapiens
gtcagggacttgga

SEQ ID NO: 3985639 - DNA, 16 bp, Homo sapiens
gtcagggacttggaca

SEQ ID NO: 3985640 - DNA, 17 bp, Homo sapiens
gtcagggttggtgtgct

SEQ ID NO: 3985641 - DNA, 18 bp, Homo sapiens
gtcagggttggtgtgctg

SEQ ID NO: 3985642 - DNA, 14 bp, Homo sapiens
gtcaggtgaccctg

SEQ ID NO: 3985643 - DNA, 14 bp, Homo sapiens
gtcagtatgacatt

SEQ ID NO: 3985644 - DNA, 13 bp, Homo sapiens
gtcagtcacagcc

SEQ ID NO: 3985645 - DNA, 12 bp, Homo sapiens
gtcagtctttag

SEQ ID NO: 3985646 - DNA, 15 bp, Homo sapiens
gtcagtgtctggctt

SEQ ID NO: 3985647 - DNA, 19 bp, Homo sapiens
gtcagtgttaaagattttg

SEQ ID NO: 3985648 - DNA, 14 bp, Homo sapiens
gtcagttcttggtg

SEQ ID NO: 3985649 - DNA, 19 bp, Homo sapiens
gtcagttcttggtgctctg

SEQ ID NO: 3985650 - DNA, 17 bp, Homo sapiens
gtcatagagctgcaggg

SEQ ID NO: 3985651 - DNA, 21 bp, Homo sapiens
gtcatagcaagcttttgctca

SEQ ID NO: 3985652 - DNA, 18 bp, Homo sapiens
gtcatatgtaggtgtctg

SEQ ID NO: 3985653 - DNA, 21 bp, Homo sapiens
gtcatcatcagggcctggggc

SEQ ID NO: 3985654 - DNA, 18 bp, Homo sapiens
gtcatcggaggctgggcc

SEQ ID NO: 3985655 - DNA, 17 bp, Homo sapiens
gtcatctccatcagctg

SEQ ID NO: 3985656 - DNA, 19 bp, Homo sapiens
gtcatctccatcagctgta

SEQ ID NO: 3985657 - DNA, 15 bp, Homo sapiens
gtcatctctctgggg

SEQ ID NO: 3985658 - DNA, 17 bp, Homo sapiens
gtcatctctctggggcc

SEQ ID NO: 3985659 - DNA, 22 bp, Homo sapiens
gtcatctctctggggccctggg

SEQ ID NO: 3985660 - DNA, 16 bp, Homo sapiens
gtcatctggtagattt

SEQ ID NO: 3985661 - DNA, 17 bp, Homo sapiens
gtcatgcataaatatgc

SEQ ID NO: 3985662 - DNA, 23 bp, Homo sapiens
gtcatgctcccctgtgccagccc

SEQ ID NO: 3985663 - DNA, 12 bp, Homo sapiens
gtcatgcttcat

SEQ ID NO: 3985664 - DNA, 17 bp, Homo sapiens
gtcatggactgttgcca

SEQ ID NO: 3985665 - DNA, 12 bp, Homo sapiens
gtcatgtctgct

SEQ ID NO: 3985666 - DNA, 12 bp, Homo sapiens
gtcatgtggcta

SEQ ID NO: 3985667 - DNA, 16 bp, Homo sapiens
gtcatgtgtgaacaca

SEQ ID NO: 3985668 - DNA, 13 bp, Homo sapiens
gtcattgcttctt

SEQ ID NO: 3985669 - DNA, 14 bp, Homo sapiens
gtcattgcttcttc

SEQ ID NO: 3985670 - DNA, 15 bp, Homo sapiens
gtcattgtatgttat

SEQ ID NO: 3985671 - DNA, 13 bp, Homo sapiens
gtcattgttctcc

SEQ ID NO: 3985672 - DNA, 14 bp, Homo sapiens
gtcatttaaatgtg

SEQ ID NO: 3985673 - DNA, 16 bp, Homo sapiens
gtcatttatgagcaga

SEQ ID NO: 3985674 - DNA, 21 bp, Homo sapiens
gtcatttcattccattgccta

SEQ ID NO: 3985675 - DNA, 14 bp, Homo sapiens
gtcatttcccccaa

SEQ ID NO: 3985676 - DNA, 17 bp, Homo sapiens
gtcatttcccccaaagg

SEQ ID NO: 3985677 - DNA, 20 bp, Homo sapiens
gtccaaaagcgccctcacta

SEQ ID NO: 3985678 - DNA, 16 bp, Homo sapiens
gtccaaagaggctgcc

SEQ ID NO: 3985679 - DNA, 19 bp, Homo sapiens
gtccaaagaggctgcccct

SEQ ID NO: 3985680 - DNA, 16 bp, Homo sapiens
gtccaaaggaggctgg

SEQ ID NO: 3985681 - DNA, 22 bp, Homo sapiens
gtccaacaagaatgcattccct

SEQ ID NO: 3985682 - DNA, 12 bp, Homo sapiens
gtccaagcagag

SEQ ID NO: 3985683 - DNA, 17 bp, Homo sapiens
gtccaaggtggcagatg

SEQ ID NO: 3985684 - DNA, 20 bp, Homo sapiens
gtccaagttcttcacctcta

SEQ ID NO: 3985685 - DNA, 17 bp, Homo sapiens
gtccaattagtttcctt

SEQ ID NO: 3985686 - DNA, 14 bp, Homo sapiens
gtccacccagcaaa

SEQ ID NO: 3985687 - DNA, 16 bp, Homo sapiens
gtccaccccccacaca

SEQ ID NO: 3985688 - DNA, 16 bp, Homo sapiens
gtccacgtgcgtgttt

SEQ ID NO: 3985689 - DNA, 23 bp, Homo sapiens
gtccacgtgcgtgttttctgact

SEQ ID NO: 3985690 - DNA, 15 bp, Homo sapiens
gtccactccctgctc

SEQ ID NO: 3985691 - DNA, 20 bp, Homo sapiens
gtccactccctgctccacga

SEQ ID NO: 3985692 - DNA, 12 bp, Homo sapiens
gtccactgtcac

SEQ ID NO: 3985693 - DNA, 17 bp, Homo sapiens
gtccagaaactcctgtt

SEQ ID NO: 3985694 - DNA, 15 bp, Homo sapiens
gtccagaagaatatt

SEQ ID NO: 3985695 - DNA, 17 bp, Homo sapiens
gtccagaagaatattca

SEQ ID NO: 3985696 - DNA, 14 bp, Homo sapiens
gtccagacccaagt

SEQ ID NO: 3985697 - DNA, 15 bp, Homo sapiens
gtccagacccaagtc

SEQ ID NO: 3985698 - DNA, 21 bp, Homo sapiens
gtccagagcggaggctgtgtg

SEQ ID NO: 3985699 - DNA, 12 bp, Homo sapiens
gtctccctggct

SEQ ID NO: 3985700 - DNA, 19 bp, Homo sapiens
gtctcctcagggtgggggg

SEQ ID NO: 3985701 - DNA, 12 bp, Homo sapiens
gtctcctccctc

SEQ ID NO: 3985702 - DNA, 15 bp, Homo sapiens
gtctcctccctcagc

SEQ ID NO: 3985703 - DNA, 15 bp, Homo sapiens
gtctcctttgcactg

SEQ ID NO: 3985704 - DNA, 18 bp, Homo sapiens
gtctcctttgcactgagg

SEQ ID NO: 3985705 - DNA, 22 bp, Homo sapiens
gtctcctttgcactgagggcca

SEQ ID NO: 3985706 - DNA, 22 bp, Homo sapiens
gtctcgctgtcactggctggct

SEQ ID NO: 3985707 - DNA, 23 bp, Homo sapiens
gtctcgctgtcactggctggctc

SEQ ID NO: 3985708 - DNA, 16 bp, Homo sapiens
gtctcgctttgttgcc

SEQ ID NO: 3985709 - DNA, 23 bp, Homo sapiens
gtctcgctttgttgcccaggctg

SEQ ID NO: 3985710 - DNA, 16 bp, Homo sapiens
gtctcggactaagcct

SEQ ID NO: 3985711 - DNA, 23 bp, Homo sapiens
gtctcgttttgttgccaaagctg

SEQ ID NO: 3985712 - DNA, 13 bp, Homo sapiens
gtctctaaagcac

SEQ ID NO: 3985713 - DNA, 14 bp, Homo sapiens
gtctctaaagcact

SEQ ID NO: 3985714 - DNA, 23 bp, Homo sapiens
gtctctatgccagctcagtccca

SEQ ID NO: 3985715 - DNA, 16 bp, Homo sapiens
gtctctcctggctggg

SEQ ID NO: 3985716 - DNA, 20 bp, Homo sapiens
gtctctcctggctgggccat

SEQ ID NO: 3985717 - DNA, 13 bp, Homo sapiens
gtctctctgtgaa

SEQ ID NO: 3985718 - DNA, 14 bp, Homo sapiens
gtctctctgtgaat

SEQ ID NO: 3985719 - DNA, 21 bp, Homo sapiens
gtctctctgtgaatacaatta

SEQ ID NO: 3985720 - DNA, 16 bp, Homo sapiens
gtctctcttaaagttg

SEQ ID NO: 3985721 - DNA, 13 bp, Homo sapiens
gtgacctgtttat

SEQ ID NO: 3985722 - DNA, 13 bp, Homo sapiens
gtgaccttttctt

SEQ ID NO: 3985723 - DNA, 19 bp, Homo sapiens
gtgaccttttcttcatttt

SEQ ID NO: 3985724 - DNA, 14 bp, Homo sapiens
gtgacggccctcat

SEQ ID NO: 3985725 - DNA, 21 bp, Homo sapiens
gtgactctaagctcagtgctc

SEQ ID NO: 3985726 - DNA, 22 bp, Homo sapiens
gtgactctaagctcagtgctct

SEQ ID NO: 3985727 - DNA, 22 bp, Homo sapiens
gtgactctttttagggccaggc

SEQ ID NO: 3985728 - DNA, 10 bp, Homo sapiens
gtgactgaaa

SEQ ID NO: 3985729 - DNA, 18 bp, Homo sapiens
gtgactgaaaccattttc

SEQ ID NO: 3985730 - DNA, 19 bp, Homo sapiens
gtgactgaaaccattttcc

SEQ ID NO: 3985731 - DNA, 13 bp, Homo sapiens
gtgactgtcccac

SEQ ID NO: 3985732 - DNA, 13 bp, Homo sapiens
gtgactttaaaag

SEQ ID NO: 3985733 - DNA, 22 bp, Homo sapiens
gtgagaaagaaagtaaaaaagg

SEQ ID NO: 3985734 - DNA, 23 bp, Homo sapiens
gtgagaaagaaagtaaaaaaggt

SEQ ID NO: 3985735 - DNA, 16 bp, Homo sapiens
gtgagacccccacacc

SEQ ID NO: 3985736 - DNA, 14 bp, Homo sapiens
gtgagattttttat

SEQ ID NO: 3985737 - DNA, 14 bp, Homo sapiens
gtgagcacagccta

SEQ ID NO: 3985738 - DNA, 21 bp, Homo sapiens
gtgagcagtcgcctgcctgca

SEQ ID NO: 3985739 - DNA, 20 bp, Homo sapiens
gtgagccacagaccacctgc

SEQ ID NO: 3985740 - DNA, 19 bp, Homo sapiens
gtgagccaccgtgcctggc

SEQ ID NO: 3985741 - DNA, 18 bp, Homo sapiens
gtgagcccagctgggtca

SEQ ID NO: 3985742 - DNA, 20 bp, Homo sapiens
gtgagcccagctgggtcagg

SEQ ID NO: 3985743 - DNA, 17 bp, Homo sapiens
gtgagcctcctgtgcct

SEQ ID NO: 3985744 - DNA, 20 bp, Homo sapiens
gtgagcctcctgtgcctggc

SEQ ID NO: 3985745 - DNA, 15 bp, Homo sapiens
gtgagctctgaccct

SEQ ID NO: 3985746 - DNA, 19 bp, Homo sapiens
gtgagctgctgccatgaac

SEQ ID NO: 3985747 - DNA, 19 bp, Homo sapiens
gtgagctggggactcaggg

SEQ ID NO: 3985748 - DNA, 21 bp, Homo sapiens
gtaggatttttttcctcccca

SEQ ID NO: 3985749 - DNA, 14 bp, Homo sapiens
gtaggctggggcgg

SEQ ID NO: 3985750 - DNA, 12 bp, Homo sapiens
gtagggagcctc

SEQ ID NO: 3985751 - DNA, 13 bp, Homo sapiens
gtagggaggcagc

SEQ ID NO: 3985752 - DNA, 14 bp, Homo sapiens
gtagggaggcagcc

SEQ ID NO: 3985753 - DNA, 14 bp, Homo sapiens
gtagggtctttctt

SEQ ID NO: 3985754 - DNA, 19 bp, Homo sapiens
gtaggttgggacaccaggg

SEQ ID NO: 3985755 - DNA, 19 bp, Homo sapiens
gtagtactccttaagaaca

SEQ ID NO: 3985756 - DNA, 13 bp, Homo sapiens
gtagtactgattt

SEQ ID NO: 3985757 - DNA, 13 bp, Homo sapiens
gtagtcaggtgct

SEQ ID NO: 3985758 - DNA, 20 bp, Homo sapiens
gtagtcccagctactcggga

SEQ ID NO: 3985759 - DNA, 22 bp, Homo sapiens
gtagtcctcataaaaagcaaaa

SEQ ID NO: 3985760 - DNA, 12 bp, Homo sapiens
gtagtcttgatg

SEQ ID NO: 3985761 - DNA, 17 bp, Homo sapiens
gtagtgttcagaaaaaa

SEQ ID NO: 3985762 - DNA, 16 bp, Homo sapiens
gtagttagtagcatgt

SEQ ID NO: 3985763 - DNA, 17 bp, Homo sapiens
gtagttgccttaaaata

SEQ ID NO: 3985764 - DNA, 20 bp, Homo sapiens
gtagttgtattcttctgtat

SEQ ID NO: 3985765 - DNA, 19 bp, Homo sapiens
gtagtttatggcagaaggg

SEQ ID NO: 3985766 - DNA, 19 bp, Homo sapiens
gtagtttctccaagtactt

SEQ ID NO: 3985767 - DNA, 13 bp, Homo sapiens
gtagttttgttta

SEQ ID NO: 3985768 - DNA, 17 bp, Homo sapiens
gtagtttttcttcaaca

SEQ ID NO: 3985769 - DNA, 23 bp, Homo sapiens
gtagttttttttttttttatgtg

SEQ ID NO: 3985770 - DNA, 13 bp, Homo sapiens
gtataaagaaaag

SEQ ID NO: 3985771 - DNA, 18 bp, Homo sapiens
gtataaataggagaggat

SEQ ID NO: 3985772 - DNA, 11 bp, Homo sapiens
gtataaatgtc

SEQ ID NO: 3985773 - DNA, 20 bp, Homo sapiens
gtataacaactatttacata

SEQ ID NO: 3985774 - DNA, 20 bp, Homo sapiens
gtataacacaatatgaatac

SEQ ID NO: 3985775 - DNA, 14 bp, Homo sapiens
gtataagaaatgca

SEQ ID NO: 3985776 - DNA, 18 bp, Homo sapiens
gtataagcatgctttctt

SEQ ID NO: 3985777 - DNA, 19 bp, Homo sapiens
gtataagtggaggcacttt

SEQ ID NO: 3985778 - DNA, 21 bp, Homo sapiens
gtataagttatttttgtacat

SEQ ID NO: 3985779 - DNA, 22 bp, Homo sapiens
gtataagttatttttgtacatg

SEQ ID NO: 3985780 - DNA, 16 bp, Homo sapiens
gtataatgtttaaatc

SEQ ID NO: 3985781 - DNA, 19 bp, Homo sapiens
gtataatgtttaaatcatg

SEQ ID NO: 3985782 - DNA, 18 bp, Homo sapiens
gtataatttcgagatttg

SEQ ID NO: 3985783 - DNA, 22 bp, Homo sapiens
gtataattttttaaagttactt

SEQ ID NO: 3985784 - DNA, 19 bp, Homo sapiens
gtatacagttcaataaact

SEQ ID NO: 3985785 - DNA, 15 bp, Homo sapiens
gtatactatagtacc

SEQ ID NO: 3985786 - DNA, 14 bp, Homo sapiens
gtatagatgcaaga

SEQ ID NO: 3985787 - DNA, 21 bp, Homo sapiens
gtatataagtactgaccactg

SEQ ID NO: 3985788 - DNA, 19 bp, Homo sapiens
gtatatacagttattttgg

SEQ ID NO: 3985789 - DNA, 23 bp, Homo sapiens
gtatatactttgaaaggagatgt

SEQ ID NO: 3985790 - DNA, 20 bp, Homo sapiens
gtatatcattctacagaata

SEQ ID NO: 3985791 - DNA, 14 bp, Homo sapiens
gtatatccttttct

SEQ ID NO: 3985792 - DNA, 18 bp, Homo sapiens
gtatatctggacaagcca

SEQ ID NO: 3985793 - DNA, 19 bp, Homo sapiens
gtatatgtgaaaaaaatga

SEQ ID NO: 3985794 - DNA, 17 bp, Homo sapiens
gtatatgtttatatact

SEQ ID NO: 3985795 - DNA, 19 bp, Homo sapiens
gtatattgcacaattataa

SEQ ID NO: 3985796 - DNA, 13 bp, Homo sapiens
gtatattgtgttt

SEQ ID NO: 3985797 - DNA, 20 bp, Homo sapiens
gtatattgtgtttgtgtatt

SEQ ID NO: 3985798 - DNA, 13 bp, Homo sapiens
gtatatttatagt

SEQ ID NO: 3985799 - DNA, 12 bp, Homo sapiens
gtatatttgaaa

SEQ ID NO: 3985800 - DNA, 13 bp, Homo sapiens
gtatatttgtaca

SEQ ID NO: 3985801 - DNA, 23 bp, Homo sapiens
gtatatttgtgatagcactttct

SEQ ID NO: 3985802 - DNA, 23 bp, Homo sapiens
gtatatttttatattgtttttgt

SEQ ID NO: 3985803 - DNA, 19 bp, Homo sapiens
gtatcaagtggcatgtgct

SEQ ID NO: 3985804 - DNA, 19 bp, Homo sapiens
gtatcaatctttagaaaag

SEQ ID NO: 3985805 - DNA, 15 bp, Homo sapiens
gtatcactctaaaaa

SEQ ID NO: 3985806 - DNA, 17 bp, Homo sapiens
gtatcaggtcagggact

SEQ ID NO: 3985807 - DNA, 17 bp, Homo sapiens
gtatcagtgtcctttcc

SEQ ID NO: 3985808 - DNA, 16 bp, Homo sapiens
gtatcattcaactctc

SEQ ID NO: 3985809 - DNA, 19 bp, Homo sapiens
gtatcccaactcctataat

SEQ ID NO: 3985810 - DNA, 18 bp, Homo sapiens
gtatcctgggggacccaa

SEQ ID NO: 3985811 - DNA, 15 bp, Homo sapiens
gtatcgatgttttat

SEQ ID NO: 3985812 - DNA, 14 bp, Homo sapiens
gtatcggagacagt

SEQ ID NO: 3985813 - DNA, 16 bp, Homo sapiens
gtatcgtaaccagcca

SEQ ID NO: 3985814 - DNA, 13 bp, Homo sapiens
gtatctagtgcag

SEQ ID NO: 3985815 - DNA, 14 bp, Homo sapiens
gtatctcagaaagt

SEQ ID NO: 3985816 - DNA, 18 bp, Homo sapiens
gtatctcagaaagtgcct

SEQ ID NO: 3985817 - DNA, 13 bp, Homo sapiens
gtatcttaaattt

SEQ ID NO: 3985818 - DNA, 17 bp, Homo sapiens
gtatcttccatatttgg

SEQ ID NO: 3985819 - DNA, 21 bp, Homo sapiens
gtatcttggggcaagactgca

SEQ ID NO: 3985820 - DNA, 21 bp, Homo sapiens
gtatctttaaaaagcagtcct

SEQ ID NO: 3985821 - DNA, 19 bp, Homo sapiens
gtatcttttatcctgggag

SEQ ID NO: 3985822 - DNA, 18 bp, Homo sapiens
gtatgactaaagagagaa

SEQ ID NO: 3985823 - DNA, 20 bp, Homo sapiens
gtatgactaaagagagaatg

SEQ ID NO: 3985824 - DNA, 16 bp, Homo sapiens
gtatgatttgttttga

SEQ ID NO: 3985825 - DNA, 18 bp, Homo sapiens
gtatgatttgttttgaat

SEQ ID NO: 3985826 - DNA, 23 bp, Homo sapiens
gtatgatttgttttgaattttgt

SEQ ID NO: 3985827 - DNA, 21 bp, Homo sapiens
gtatgctgatcatcgccagag

SEQ ID NO: 3985828 - DNA, 14 bp, Homo sapiens
gtatggtaatcttt

SEQ ID NO: 3985829 - DNA, 13 bp, Homo sapiens
gtatggtctaaca

SEQ ID NO: 3985830 - DNA, 22 bp, Homo sapiens
gtatgtcaataaacaacagctg

SEQ ID NO: 3985831 - DNA, 21 bp, Homo sapiens
gtatgttatgatattgtttaa

SEQ ID NO: 3985832 - DNA, 16 bp, Homo sapiens
gtattattctgcagca

SEQ ID NO: 3985833 - DNA, 15 bp, Homo sapiens
gtattattctgtttt

SEQ ID NO: 3985834 - DNA, 19 bp, Homo sapiens
gtattcaaaaattatctat

SEQ ID NO: 3985835 - DNA, 21 bp, Homo sapiens
gtattcacgccattggttgga

SEQ ID NO: 3985836 - DNA, 18 bp, Homo sapiens
gtattctagttttgtcaa

SEQ ID NO: 3985837 - DNA, 18 bp, Homo sapiens
gtattctcagagcatgtg

SEQ ID NO: 3985838 - DNA, 17 bp, Homo sapiens
gtattctgttctggagg

SEQ ID NO: 3985839 - DNA, 15 bp, Homo sapiens
gtattcttatttaat

SEQ ID NO: 3985840 - DNA, 16 bp, Homo sapiens
ggtgggggtggaggct

SEQ ID NO: 3985841 - DNA, 14 bp, Homo sapiens
ggtggggtcctgga

SEQ ID NO: 3985842 - DNA, 15 bp, Homo sapiens
ggtgggtgaaaggaa

SEQ ID NO: 3985843 - DNA, 12 bp, Homo sapiens
ggtgggtgctca

SEQ ID NO: 3985844 - DNA, 13 bp, Homo sapiens
ggtgggtgctgcc

SEQ ID NO: 3985845 - DNA, 19 bp, Homo sapiens
ggtgggtgctgccctgtgt

SEQ ID NO: 3985846 - DNA, 17 bp, Homo sapiens
ggtgggtgtccatgtgc

SEQ ID NO: 3985847 - DNA, 17 bp, Homo sapiens
ggtggtcctgagacctg

SEQ ID NO: 3985848 - DNA, 18 bp, Homo sapiens
ggtggtcctgagacctga

SEQ ID NO: 3985849 - DNA, 20 bp, Homo sapiens
ggtggtgggaaccatgaaga

SEQ ID NO: 3985850 - DNA, 14 bp, Homo sapiens
ggtgtaaagctggc

SEQ ID NO: 3985851 - DNA, 18 bp, Homo sapiens
ggtgtaatcatgaaggag

SEQ ID NO: 3985852 - DNA, 18 bp, Homo sapiens
ggtgtacactaacatttc

SEQ ID NO: 3985853 - DNA, 16 bp, Homo sapiens
ggtgtatttaaactat

SEQ ID NO: 3985854 - DNA, 12 bp, Homo sapiens
ggtgtcaataaa

SEQ ID NO: 3985855 - DNA, 17 bp, Homo sapiens
ggtgtcagtatccaggc

SEQ ID NO: 3985856 - DNA, 12 bp, Homo sapiens
ggtgtcctgagc

SEQ ID NO: 3985857 - DNA, 15 bp, Homo sapiens
gtatttatatattta

SEQ ID NO: 3985858 - DNA, 16 bp, Homo sapiens
gtatttattaatttga

SEQ ID NO: 3985859 - DNA, 19 bp, Homo sapiens
gtatttattcctctgtcct

SEQ ID NO: 3985860 - DNA, 17 bp, Homo sapiens
gtatttattttgtaatt

SEQ ID NO: 3985861 - DNA, 13 bp, Homo sapiens
gtatttcagtgta

SEQ ID NO: 3985862 - DNA, 10 bp, Homo sapiens
gtatttcctt

SEQ ID NO: 3985863 - DNA, 22 bp, Homo sapiens
gtatttcttatacgcttttctt

SEQ ID NO: 3985864 - DNA, 14 bp, Homo sapiens
gtatttgaattaaa

SEQ ID NO: 3985865 - DNA, 21 bp, Homo sapiens
gtatttgaattaaaacttctt

SEQ ID NO: 3985866 - DNA, 22 bp, Homo sapiens
gtatttgaattaaaacttctta

SEQ ID NO: 3985867 - DNA, 23 bp, Homo sapiens
gtatttgaattaaaacttcttaa

SEQ ID NO: 3985868 - DNA, 21 bp, Homo sapiens
gtatttgagagttctaaattt

SEQ ID NO: 3985869 - DNA, 20 bp, Homo sapiens
gtatttgggaagtgaagact

SEQ ID NO: 3985870 - DNA, 21 bp, Homo sapiens
gtatttggtccaaaaaaagga

SEQ ID NO: 3985871 - DNA, 22 bp, Homo sapiens
gtattttcccccttttctgcat

SEQ ID NO: 3985872 - DNA, 14 bp, Homo sapiens
gtattttgaagttt

SEQ ID NO: 3985873 - DNA, 18 bp, Homo sapiens
gtattttgtagatgtgat

SEQ ID NO: 3985874 - DNA, 21 bp, Homo sapiens
gtatttttgttagtttacaat

SEQ ID NO: 3985875 - DNA, 22 bp, Homo sapiens
gtattttttaaaacactaaaag

SEQ ID NO: 3985876 - DNA, 23 bp, Homo sapiens
gtatttttttattcgccatctga

SEQ ID NO: 3985877 - DNA, 17 bp, Homo sapiens
gtatttttttgtaattg

SEQ ID NO: 3985878 - DNA, 19 bp, Homo sapiens
gtcaaacagtgccaaatgc

SEQ ID NO: 3985879 - DNA, 13 bp, Homo sapiens
gtcaaaccgcact

SEQ ID NO: 3985880 - DNA, 17 bp, Homo sapiens
gtcaaactaattctcac

SEQ ID NO: 3985881 - DNA, 19 bp, Homo sapiens
gtcaaactaattctcacat

SEQ ID NO: 3985882 - DNA, 17 bp, Homo sapiens
gtcaaacttggatactt

SEQ ID NO: 3985883 - DNA, 20 bp, Homo sapiens
gtcaaagacagaatggtgga

SEQ ID NO: 3985884 - DNA, 20 bp, Homo sapiens
gtcaaagatgccccattcct

SEQ ID NO: 3985885 - DNA, 22 bp, Homo sapiens
gtcaaatggtaggcatttccta

SEQ ID NO: 3985886 - DNA, 19 bp, Homo sapiens
gtcaacacttaagggtttt

SEQ ID NO: 3985887 - DNA, 17 bp, Homo sapiens
gtcaactctttgttatt

SEQ ID NO: 3985888 - DNA, 12 bp, Homo sapiens
gtcaacttctgg

SEQ ID NO: 3985889 - DNA, 15 bp, Homo sapiens
gtcaagaagaaaaag

SEQ ID NO: 3985890 - DNA, 16 bp, Homo sapiens
gtcaagaagaatgaac

SEQ ID NO: 3985891 - DNA, 14 bp, Homo sapiens
gtcaagattttgaa

SEQ ID NO: 3985892 - DNA, 13 bp, Homo sapiens
gtcaagctgctct

SEQ ID NO: 3985893 - DNA, 17 bp, Homo sapiens
gtcaagctgctctgagc

SEQ ID NO: 3985894 - DNA, 18 bp, Homo sapiens
gtcaagctgctctgagcc

SEQ ID NO: 3985895 - DNA, 15 bp, Homo sapiens
gtcaaggaagctggg

SEQ ID NO: 3985896 - DNA, 15 bp, Homo sapiens
gtcaagtaagaagac

SEQ ID NO: 3985897 - DNA, 22 bp, Homo sapiens
gtcaagtggcaaagctgttctt

SEQ ID NO: 3985898 - DNA, 17 bp, Homo sapiens
gtcaagttcctttgggt

SEQ ID NO: 3985899 - DNA, 18 bp, Homo sapiens
gtcaataaacaacagctg

SEQ ID NO: 3985900 - DNA, 20 bp, Homo sapiens
gtcaataaacagcttcatgc

SEQ ID NO: 3985901 - DNA, 18 bp, Homo sapiens
gtcaataaacttagagga

SEQ ID NO: 3985902 - DNA, 22 bp, Homo sapiens
gtcaataaacttagaggaaaat

SEQ ID NO: 3985903 - DNA, 17 bp, Homo sapiens
gtcaatattaaatacag

SEQ ID NO: 3985904 - DNA, 22 bp, Homo sapiens
gtcaatattaaatacagacact

SEQ ID NO: 3985905 - DNA, 12 bp, Homo sapiens
gtcaatatttaa

SEQ ID NO: 3985906 - DNA, 13 bp, Homo sapiens
gtcaatatttaaa

SEQ ID NO: 3985907 - DNA, 21 bp, Homo sapiens
gtcacaaatcctaaaagaagc

SEQ ID NO: 3985908 - DNA, 17 bp, Homo sapiens
gtcacaagagcccagca

SEQ ID NO: 3985909 - DNA, 12 bp, Homo sapiens
gtcacaataaat

SEQ ID NO: 3985910 - DNA, 12 bp, Homo sapiens
gtcacacagcta

SEQ ID NO: 3985911 - DNA, 21 bp, Homo sapiens
gtcacagcctcctctgtctgc

SEQ ID NO: 3985912 - DNA, 11 bp, Homo sapiens
gtcacagctgg

SEQ ID NO: 3985913 - DNA, 15 bp, Homo sapiens
gtcacagggccaact

SEQ ID NO: 3985914 - DNA, 18 bp, Homo sapiens
gtcacagggcctggggag

SEQ ID NO: 3985915 - DNA, 19 bp, Homo sapiens
gtcacagtgataccagttc

SEQ ID NO: 3985916 - DNA, 15 bp, Homo sapiens
gtcacatcacaggac

SEQ ID NO: 3985917 - DNA, 16 bp, Homo sapiens
gtcacatcagataaga

SEQ ID NO: 3985918 - DNA, 22 bp, Homo sapiens
gtcacatcccaccccatcctcc

SEQ ID NO: 3985919 - DNA, 14 bp, Homo sapiens
gtcacattcaggaa

SEQ ID NO: 3985920 - DNA, 22 bp, Homo sapiens
gtcaccaaatcagctgctacta

SEQ ID NO: 3985921 - DNA, 15 bp, Homo sapiens
gtcaccaaatttgta

SEQ ID NO: 3985922 - DNA, 17 bp, Homo sapiens
gtcaccaagcagtggcc

SEQ ID NO: 3985923 - DNA, 16 bp, Homo sapiens
gtcaccacgactggcc

SEQ ID NO: 3985924 - DNA, 12 bp, Homo sapiens
gtcaccaggact

SEQ ID NO: 3985925 - DNA, 13 bp, Homo sapiens
gtcaccaggactt

SEQ ID NO: 3985926 - DNA, 15 bp, Homo sapiens
gtcaccaggacttgg

SEQ ID NO: 3985927 - DNA, 16 bp, Homo sapiens
gtcaccaggacttggg

SEQ ID NO: 3985928 - DNA, 15 bp, Homo sapiens
gtcacccaacatcaa

SEQ ID NO: 3985929 - DNA, 14 bp, Homo sapiens
gtcacccatgacag

SEQ ID NO: 3985930 - DNA, 16 bp, Homo sapiens
gtcacccccactcccg

SEQ ID NO: 3985931 - DNA, 18 bp, Homo sapiens
gtcacccccactcccgcc

SEQ ID NO: 3985932 - DNA, 16 bp, Homo sapiens
gtcaccggtcagtgcc

SEQ ID NO: 3985933 - DNA, 18 bp, Homo sapiens
gtcaccggtcagtgcctt

SEQ ID NO: 3985934 - DNA, 16 bp, Homo sapiens
gtcacctagcaagctg

SEQ ID NO: 3985935 - DNA, 16 bp, Homo sapiens
gtcacctccccacatc

SEQ ID NO: 3985936 - DNA, 13 bp, Homo sapiens
gtcacctctctca

SEQ ID NO: 3985937 - DNA, 17 bp, Homo sapiens
gtcacctctctcagagc

SEQ ID NO: 3985938 - DNA, 16 bp, Homo sapiens
gtcacctgcttctctg

SEQ ID NO: 3985939 - DNA, 20 bp, Homo sapiens
gtcacgctggggctctctga

SEQ ID NO: 3985940 - DNA, 14 bp, Homo sapiens
gtcactactcacag

SEQ ID NO: 3985941 - DNA, 12 bp, Homo sapiens
gtcactagaatg

SEQ ID NO: 3985942 - DNA, 19 bp, Homo sapiens
gtcactcttcctgcaagga

SEQ ID NO: 3985943 - DNA, 12 bp, Homo sapiens
gtcactggaaag

SEQ ID NO: 3985944 - DNA, 20 bp, Homo sapiens
gtcactggaaaggggagagc

SEQ ID NO: 3985945 - DNA, 23 bp, Homo sapiens
gtcactggaggttgaagccaagt

SEQ ID NO: 3985946 - DNA, 15 bp, Homo sapiens
gtccagtgctctgcc

SEQ ID NO: 3985947 - DNA, 16 bp, Homo sapiens
gtccagtgctctgcct

SEQ ID NO: 3985948 - DNA, 18 bp, Homo sapiens
gtccagtgctctgcctca

SEQ ID NO: 3985949 - DNA, 21 bp, Homo sapiens
gtccagtgtcacctctctcag

SEQ ID NO: 3985950 - DNA, 23 bp, Homo sapiens
gtccagtgtcacctctctcagag

SEQ ID NO: 3985951 - DNA, 13 bp, Homo sapiens
gtccatatttaca

SEQ ID NO: 3985952 - DNA, 22 bp, Homo sapiens
gtccatgcccactgctggtgcc

SEQ ID NO: 3985953 - DNA, 18 bp, Homo sapiens
gtccatgctaacaaagac

SEQ ID NO: 3985954 - DNA, 15 bp, Homo sapiens
gtccatgctgatgat

SEQ ID NO: 3985955 - DNA, 15 bp, Homo sapiens
gtccatggcctttct

SEQ ID NO: 3985956 - DNA, 16 bp, Homo sapiens
gtccatggcctttcta

SEQ ID NO: 3985957 - DNA, 19 bp, Homo sapiens
gtccatggcctttctaata

SEQ ID NO: 3985958 - DNA, 16 bp, Homo sapiens
gtccatgtgcacccgg

SEQ ID NO: 3985959 - DNA, 19 bp, Homo sapiens
gtccatttcccacatcttt

SEQ ID NO: 3985960 - DNA, 15 bp, Homo sapiens
gtccatttgttcctg

SEQ ID NO: 3985961 - DNA, 23 bp, Homo sapiens
gtcccaaggaaagccccagcact

SEQ ID NO: 3985962 - DNA, 19 bp, Homo sapiens
gtcccacccccttccccca

SEQ ID NO: 3985963 - DNA, 22 bp, Homo sapiens
gtcccacgaatttgctggggaa

SEQ ID NO: 3985964 - DNA, 13 bp, Homo sapiens
gtcccacgtgtct

SEQ ID NO: 3985965 - DNA, 13 bp, Homo sapiens
gtcccactccaag

SEQ ID NO: 3985966 - DNA, 19 bp, Homo sapiens
gtcccactccaagccagca

SEQ ID NO: 3985967 - DNA, 22 bp, Homo sapiens
gtcccagcatccctggagcagg

SEQ ID NO: 3985968 - DNA, 16 bp, Homo sapiens
gtcccagccaccccgg

SEQ ID NO: 3985969 - DNA, 21 bp, Homo sapiens
gtcccagccaccccgggctct

SEQ ID NO: 3985970 - DNA, 12 bp, Homo sapiens
gtcccaggcaga

SEQ ID NO: 3985971 - DNA, 17 bp, Homo sapiens
gtcccaggccggcccag

SEQ ID NO: 3985972 - DNA, 15 bp, Homo sapiens
gtcccagttttgttg

SEQ ID NO: 3985973 - DNA, 22 bp, Homo sapiens
gtcccatggacactccagtgcc

SEQ ID NO: 3985974 - DNA, 17 bp, Homo sapiens
gtcccatgtgagctgct

SEQ ID NO: 3985975 - DNA, 17 bp, Homo sapiens
gtcccatttccttggag

SEQ ID NO: 3985976 - DNA, 16 bp, Homo sapiens
gtcccatttctcactg

SEQ ID NO: 3985977 - DNA, 12 bp, Homo sapiens
gtccccacccct

SEQ ID NO: 3985978 - DNA, 15 bp, Homo sapiens
gtccccacccctgcc

SEQ ID NO: 3985979 - DNA, 16 bp, Homo sapiens
gtccccacccctgccc

SEQ ID NO: 3985980 - DNA, 17 bp, Homo sapiens
gtccccacccctgcccc

SEQ ID NO: 3985981 - DNA, 16 bp, Homo sapiens
gtccccaccctccact

SEQ ID NO: 3985982 - DNA, 14 bp, Homo sapiens
gtccccacctggga

SEQ ID NO: 3985983 - DNA, 23 bp, Homo sapiens
gtccccagaactctgcctgccct

SEQ ID NO: 3985984 - DNA, 13 bp, Homo sapiens
gtccccagaccct

SEQ ID NO: 3985985 - DNA, 15 bp, Homo sapiens
gtccccagccctgtc

SEQ ID NO: 3985986 - DNA, 17 bp, Homo sapiens
gtccccagccctgtcct

SEQ ID NO: 3985987 - DNA, 15 bp, Homo sapiens
gtcccccaggctgga

SEQ ID NO: 3985988 - DNA, 20 bp, Homo sapiens
gtcccccaggctggagtgca

SEQ ID NO: 3985989 - DNA, 13 bp, Homo sapiens
gtccccccaccct

SEQ ID NO: 3985990 - DNA, 22 bp, Homo sapiens
gtccccccaccctcattctact

SEQ ID NO: 3985991 - DNA, 22 bp, Homo sapiens
gtccccctacccaccgatggag

SEQ ID NO: 3985992 - DNA, 16 bp, Homo sapiens
gtcccctcactctgtc

SEQ ID NO: 3985993 - DNA, 18 bp, Homo sapiens
gtcccctcactctgtcag

SEQ ID NO: 3985994 - DNA, 14 bp, Homo sapiens
gtcccctccttccc

SEQ ID NO: 3985995 - DNA, 21 bp, Homo sapiens
gtcccctccttccctcacccc

SEQ ID NO: 3985996 - DNA, 15 bp, Homo sapiens
gtcccggggccagca

SEQ ID NO: 3985997 - DNA, 22 bp, Homo sapiens
gtcccggggccagcacttccat

SEQ ID NO: 3985998 - DNA, 23 bp, Homo sapiens
gtcccggttcagacccctgcctg

SEQ ID NO: 3985999 - DNA, 22 bp, Homo sapiens
gtccctaccgagtctcttctcc

SEQ ID NO: 3986000 - DNA, 22 bp, Homo sapiens
gtccctatctattaaagtgact

SEQ ID NO: 3986001 - DNA, 16 bp, Homo sapiens
gtccctcccccttgtc

SEQ ID NO: 3986002 - DNA, 18 bp, Homo sapiens
gtccctccctgcctgagg

SEQ ID NO: 3986003 - DNA, 20 bp, Homo sapiens
gtccctcccttgctgaacac

SEQ ID NO: 3986004 - DNA, 12 bp, Homo sapiens
gtccctgaggat

SEQ ID NO: 3986005 - DNA, 17 bp, Homo sapiens
gtccctggcgcaggtgg

SEQ ID NO: 3986006 - DNA, 15 bp, Homo sapiens
gtccctggcttcctt

SEQ ID NO: 3986007 - DNA, 19 bp, Homo sapiens
gtccctgggccagggtctg

SEQ ID NO: 3986008 - DNA, 15 bp, Homo sapiens
gtccctggggctagg

SEQ ID NO: 3986009 - DNA, 22 bp, Homo sapiens
gtccctggggctagggggagcc

SEQ ID NO: 3986010 - DNA, 18 bp, Homo sapiens
gtccctgtcatttgaacc

SEQ ID NO: 3986011 - DNA, 19 bp, Homo sapiens
gtccctgtgtgtaggctgg

SEQ ID NO: 3986012 - DNA, 14 bp, Homo sapiens
gtcccttcccctcc

SEQ ID NO: 3986013 - DNA, 19 bp, Homo sapiens
gtcccttgcctcaatgcca

SEQ ID NO: 3986014 - DNA, 13 bp, Homo sapiens
gtcccttgcctct

SEQ ID NO: 3986015 - DNA, 14 bp, Homo sapiens
gtcccttgcctctg

SEQ ID NO: 3986016 - DNA, 20 bp, Homo sapiens
gtcccttgcctctgccctgg

SEQ ID NO: 3986017 - DNA, 22 bp, Homo sapiens
gtcccttgcctctgccctggat

SEQ ID NO: 3986018 - DNA, 11 bp, Homo sapiens
gtcccttgctg

SEQ ID NO: 3986019 - DNA, 16 bp, Homo sapiens
gtcccttgctgtatgc

SEQ ID NO: 3986020 - DNA, 15 bp, Homo sapiens
gtccctttcttctcc

SEQ ID NO: 3986021 - DNA, 15 bp, Homo sapiens
gtccctttcttggcc

SEQ ID NO: 3986022 - DNA, 17 bp, Homo sapiens
gtccctttcttggccag

SEQ ID NO: 3986023 - DNA, 15 bp, Homo sapiens
gtccgataatatctt

SEQ ID NO: 3986024 - DNA, 15 bp, Homo sapiens
gtccgatctttgact

SEQ ID NO: 3986025 - DNA, 15 bp, Homo sapiens
gtcctaaggaacctt

SEQ ID NO: 3986026 - DNA, 15 bp, Homo sapiens
gtcctaagtgtcaag

SEQ ID NO: 3986027 - DNA, 20 bp, Homo sapiens
gtcctactatcactgaacaa

SEQ ID NO: 3986028 - DNA, 15 bp, Homo sapiens
gtcctagcccttccc

SEQ ID NO: 3986029 - DNA, 16 bp, Homo sapiens
gtcctcactcccagtc

SEQ ID NO: 3986030 - DNA, 18 bp, Homo sapiens
gtcctcactcccagtcca

SEQ ID NO: 3986031 - DNA, 14 bp, Homo sapiens
gtcctcagccttgc

SEQ ID NO: 3986032 - DNA, 16 bp, Homo sapiens
gtcctcagccttgcca

SEQ ID NO: 3986033 - DNA, 20 bp, Homo sapiens
gtcctcagccttgccagaga

SEQ ID NO: 3986034 - DNA, 13 bp, Homo sapiens
gtcctcagggagc

SEQ ID NO: 3986035 - DNA, 16 bp, Homo sapiens
gtcctcagtccattta

SEQ ID NO: 3986036 - DNA, 23 bp, Homo sapiens
gtcctccaagtgccccctcacct

SEQ ID NO: 3986037 - DNA, 13 bp, Homo sapiens
gtcctccagaact

SEQ ID NO: 3986038 - DNA, 18 bp, Homo sapiens
gtcctccagaagcctctg

SEQ ID NO: 3986039 - DNA, 21 bp, Homo sapiens
gtcctccagaagcctctggct

SEQ ID NO: 3986040 - DNA, 22 bp, Homo sapiens
gtcctccatcccaacagccatg

SEQ ID NO: 3986041 - DNA, 14 bp, Homo sapiens
gtcctcccatttct

SEQ ID NO: 3986042 - DNA, 14 bp, Homo sapiens
gtcctcctgctgcc

SEQ ID NO: 3986043 - DNA, 14 bp, Homo sapiens
gtcctcctgggagc

SEQ ID NO: 3986044 - DNA, 15 bp, Homo sapiens
gtcctcctgggagcc

SEQ ID NO: 3986045 - DNA, 17 bp, Homo sapiens
gtcctctagcaggccta

SEQ ID NO: 3986046 - DNA, 19 bp, Homo sapiens
gtcctctcagttctctccc

SEQ ID NO: 3986047 - DNA, 19 bp, Homo sapiens
gtcctctcccctccagcct

SEQ ID NO: 3986048 - DNA, 20 bp, Homo sapiens
gtcctctcccctccagcctt

SEQ ID NO: 3986049 - DNA, 12 bp, Homo sapiens
ggcagccccaga

SEQ ID NO: 3986050 - DNA, 13 bp, Homo sapiens
ggcagccccagag

SEQ ID NO: 3986051 - DNA, 19 bp, Homo sapiens
ggcagccccagagagagga

SEQ ID NO: 3986052 - DNA, 23 bp, Homo sapiens
ggcagcccccatgggctcctgcc

SEQ ID NO: 3986053 - DNA, 15 bp, Homo sapiens
ggcagccccctccac

SEQ ID NO: 3986054 - DNA, 21 bp, Homo sapiens
ggcagccgtccttctaatgaa

SEQ ID NO: 3986055 - DNA, 22 bp, Homo sapiens
ggcagccgtccttctaatgaag

SEQ ID NO: 3986056 - DNA, 22 bp, Homo sapiens
ggcagcctatgggggctctcgg

SEQ ID NO: 3986057 - DNA, 14 bp, Homo sapiens
ggcagcctcccatc

SEQ ID NO: 3986058 - DNA, 23 bp, Homo sapiens
ggcagcctctgggcccacatccg

SEQ ID NO: 3986059 - DNA, 22 bp, Homo sapiens
ggcagcgccaagtgcgtgccgt

SEQ ID NO: 3986060 - DNA, 21 bp, Homo sapiens
ggcagcgccaggctgaccaca

SEQ ID NO: 3986061 - DNA, 15 bp, Homo sapiens
ggcagctagtgcctt

SEQ ID NO: 3986062 - DNA, 16 bp, Homo sapiens
ggcagctagtgccttt

SEQ ID NO: 3986063 - DNA, 14 bp, Homo sapiens
ggcagctcacccct

SEQ ID NO: 3986064 - DNA, 17 bp, Homo sapiens
ggcagctcacccctggg

SEQ ID NO: 3986065 - DNA, 21 bp, Homo sapiens
ggcagctcacccctgggcagg

SEQ ID NO: 3986066 - DNA, 20 bp, Homo sapiens
ggcagctctggacagcccca

SEQ ID NO: 3986067 - DNA, 16 bp, Homo sapiens
ggcagctgttgtctct

SEQ ID NO: 3986068 - DNA, 16 bp, Homo sapiens
ggcagctgtttctcat

SEQ ID NO: 3986069 - DNA, 19 bp, Homo sapiens
ggcagctgtttctcatgaa

SEQ ID NO: 3986070 - DNA, 15 bp, Homo sapiens
ggcaggaccaggact

SEQ ID NO: 3986071 - DNA, 17 bp, Homo sapiens
ggcaggactgagtcccc

SEQ ID NO: 3986072 - DNA, 17 bp, Homo sapiens
ggcaggatggcctttcc

SEQ ID NO: 3986073 - DNA, 19 bp, Homo sapiens
ggcaggatggcctttcctt

SEQ ID NO: 3986074 - DNA, 23 bp, Homo sapiens
ggcaggatggcctttccttccct

SEQ ID NO: 3986075 - DNA, 13 bp, Homo sapiens
ggcaggcattgag

SEQ ID NO: 3986076 - DNA, 14 bp, Homo sapiens
ggcaggctgggacg

SEQ ID NO: 3986077 - DNA, 13 bp, Homo sapiens
ggcaggctgggcc

SEQ ID NO: 3986078 - DNA, 22 bp, Homo sapiens
ggcaggctgggccatgtccaaa

SEQ ID NO: 3986079 - DNA, 23 bp, Homo sapiens
ggcagggaaggggaggcagccgg

SEQ ID NO: 3986080 - DNA, 15 bp, Homo sapiens
ggcagggcatctcct

SEQ ID NO: 3986081 - DNA, 21 bp, Homo sapiens
ggcagggcccttggggctggg

SEQ ID NO: 3986082 - DNA, 12 bp, Homo sapiens
ggcagggccttc

SEQ ID NO: 3986083 - DNA, 14 bp, Homo sapiens
ggcagggccttcct

SEQ ID NO: 3986084 - DNA, 14 bp, Homo sapiens
ggcagggctctgat

SEQ ID NO: 3986085 - DNA, 21 bp, Homo sapiens
ggcagggctggccccagggca

SEQ ID NO: 3986086 - DNA, 20 bp, Homo sapiens
ggcaggggccctgcagctct

SEQ ID NO: 3986087 - DNA, 14 bp, Homo sapiens
ggcagggtgaccct

SEQ ID NO: 3986088 - DNA, 23 bp, Homo sapiens
ggcagggttaaactgcaggagca

SEQ ID NO: 3986089 - DNA, 19 bp, Homo sapiens
ggcaggttggatgggagtg

SEQ ID NO: 3986090 - DNA, 20 bp, Homo sapiens
ggcaggttggatgggagtgg

SEQ ID NO: 3986091 - DNA, 22 bp, Homo sapiens
gtaaaaacactgaaaaattata

SEQ ID NO: 3986092 - DNA, 21 bp, Homo sapiens
gtaaaaacagcattgctttct

SEQ ID NO: 3986093 - DNA, 18 bp, Homo sapiens
gtaaaagagataataaga

SEQ ID NO: 3986094 - DNA, 17 bp, Homo sapiens
gtaaaatactattgcct

SEQ ID NO: 3986095 - DNA, 22 bp, Homo sapiens
gtaaaatgtgaagtgaatgaaa

SEQ ID NO: 3986096 - DNA, 23 bp, Homo sapiens
gtaaacataattcttgtatatta

SEQ ID NO: 3986097 - DNA, 14 bp, Homo sapiens
gtaaacgacactct

SEQ ID NO: 3986098 - DNA, 19 bp, Homo sapiens
gtaaagaacttaaattatg

SEQ ID NO: 3986099 - DNA, 20 bp, Homo sapiens
gtaaagaacttaaattatgt

SEQ ID NO: 3986100 - DNA, 18 bp, Homo sapiens
gtaaagactggttttctg

SEQ ID NO: 3986101 - DNA, 12 bp, Homo sapiens
gtaaagctggcc

SEQ ID NO: 3986102 - DNA, 16 bp, Homo sapiens
gtaaagctggccctgc

SEQ ID NO: 3986103 - DNA, 18 bp, Homo sapiens
gtaaataaccacaaggtc

SEQ ID NO: 3986104 - DNA, 17 bp, Homo sapiens
gtaaatacaagactgtt

SEQ ID NO: 3986105 - DNA, 16 bp, Homo sapiens
ggccagggagaagctc

SEQ ID NO: 3986106 - DNA, 23 bp, Homo sapiens
ggccagggcccctcaccctgcct

SEQ ID NO: 3986107 - DNA, 22 bp, Homo sapiens
ggccagggtctgtgtgaatgtg

SEQ ID NO: 3986108 - DNA, 13 bp, Homo sapiens
ggccagtccccat

SEQ ID NO: 3986109 - DNA, 16 bp, Homo sapiens
ggccagtctgggctgc

SEQ ID NO: 3986110 - DNA, 17 bp, Homo sapiens
ggccagtggggaactga

SEQ ID NO: 3986111 - DNA, 14 bp, Homo sapiens
ggccagtgtctggg

SEQ ID NO: 3986112 - DNA, 16 bp, Homo sapiens
ggccagtgtctgggtt

SEQ ID NO: 3986113 - DNA, 14 bp, Homo sapiens
ggccatactgcctt

SEQ ID NO: 3986114 - DNA, 14 bp, Homo sapiens
ggccatccctgggc

SEQ ID NO: 3986115 - DNA, 20 bp, Homo sapiens
ggccatccctgggcccctcc

SEQ ID NO: 3986116 - DNA, 21 bp, Homo sapiens
ggccatccctgggcccctcca

SEQ ID NO: 3986117 - DNA, 22 bp, Homo sapiens
ggccatccttccgccaatctgg

SEQ ID NO: 3986118 - DNA, 17 bp, Homo sapiens
ggccatctcaggagatg

SEQ ID NO: 3986119 - DNA, 22 bp, Homo sapiens
ggccatgagggacagggtcttt

SEQ ID NO: 3986120 - DNA, 16 bp, Homo sapiens
ggccatgctgaaggga

SEQ ID NO: 3986121 - DNA, 13 bp, Homo sapiens
ggccatggcagaa

SEQ ID NO: 3986122 - DNA, 17 bp, Homo sapiens
ggccatggggccctccc

SEQ ID NO: 3986123 - DNA, 18 bp, Homo sapiens
ggccatggggccctccca

SEQ ID NO: 3986124 - DNA, 22 bp, Homo sapiens
ggccatgtccaaagaggctgcc

SEQ ID NO: 3986125 - DNA, 21 bp, Homo sapiens
ggccatgtgagccaccgctgc

SEQ ID NO: 3986126 - DNA, 16 bp, Homo sapiens
ggccatttccttttct

SEQ ID NO: 3986127 - DNA, 22 bp, Homo sapiens
ggccatttccttttctctgccc

SEQ ID NO: 3986128 - DNA, 20 bp, Homo sapiens
ggcccacagggaaccctgct

SEQ ID NO: 3986129 - DNA, 15 bp, Homo sapiens
ggcccaccccagcct

SEQ ID NO: 3986130 - DNA, 16 bp, Homo sapiens
ggcccagaactgcccc

SEQ ID NO: 3986131 - DNA, 13 bp, Homo sapiens
ggcccagagccca

SEQ ID NO: 3986132 - DNA, 15 bp, Homo sapiens
ggcccagagcccagc

SEQ ID NO: 3986133 - DNA, 16 bp, Homo sapiens
ggcccagagcccagct

SEQ ID NO: 3986134 - DNA, 18 bp, Homo sapiens
ggcccagccaggagcaga

SEQ ID NO: 3986135 - DNA, 12 bp, Homo sapiens
ggcccagcccag

SEQ ID NO: 3986136 - DNA, 16 bp, Homo sapiens
ggcccagcgcggccag

SEQ ID NO: 3986137 - DNA, 21 bp, Homo sapiens
ggcccaggatatttctgagag

SEQ ID NO: 3986138 - DNA, 15 bp, Homo sapiens
ggcccaggcctcacc

SEQ ID NO: 3986139 - DNA, 16 bp, Homo sapiens
ggcccaggcctcacca

SEQ ID NO: 3986140 - DNA, 14 bp, Homo sapiens
ggcccaggctggga

SEQ ID NO: 3986141 - DNA, 21 bp, Homo sapiens
ggcccagggcccagagcccag

SEQ ID NO: 3986142 - DNA, 14 bp, Homo sapiens
ggcccatcactgta

SEQ ID NO: 3986143 - DNA, 14 bp, Homo sapiens
ggcccatctcagcc

SEQ ID NO: 3986144 - DNA, 21 bp, Homo sapiens
ggcccattcagagctatggtg

SEQ ID NO: 3986145 - DNA, 13 bp, Homo sapiens
ggccccacaccag

SEQ ID NO: 3986146 - DNA, 13 bp, Homo sapiens
ggccccacctgca

SEQ ID NO: 3986147 - DNA, 20 bp, Homo sapiens
ggccccagaccccagggcag

SEQ ID NO: 3986148 - DNA, 13 bp, Homo sapiens
ggccccagcctcc

SEQ ID NO: 3986149 - DNA, 21 bp, Homo sapiens
ggccccaggacctggctgcca

SEQ ID NO: 3986150 - DNA, 11 bp, Homo sapiens
ggccccaggag

SEQ ID NO: 3986151 - DNA, 13 bp, Homo sapiens
ggccccaggaggg

SEQ ID NO: 3986152 - DNA, 13 bp, Homo sapiens
ggccccaggcccc

SEQ ID NO: 3986153 - DNA, 23 bp, Homo sapiens
ggccccagtgcggttcctcatct

SEQ ID NO: 3986154 - DNA, 17 bp, Homo sapiens
ggccccatcctcatccc

SEQ ID NO: 3986155 - DNA, 19 bp, Homo sapiens
ggtcacacgaccggggcca

SEQ ID NO: 3986156 - DNA, 15 bp, Homo sapiens
ggtcacagcctcctc

SEQ ID NO: 3986157 - DNA, 17 bp, Homo sapiens
ggtcacagcctcctctg

SEQ ID NO: 3986158 - DNA, 14 bp, Homo sapiens
ggtcacatccatcc

SEQ ID NO: 3986159 - DNA, 15 bp, Homo sapiens
ggtcaccaagcagtg

SEQ ID NO: 3986160 - DNA, 20 bp, Homo sapiens
ggtcactaaccaacaaggtt

SEQ ID NO: 3986161 - DNA, 13 bp, Homo sapiens
ggtcactcctggg

SEQ ID NO: 3986162 - DNA, 21 bp, Homo sapiens
ggtcactcttcctgcaaggac

SEQ ID NO: 3986163 - DNA, 22 bp, Homo sapiens
ggtcactcttcctgcaaggact

SEQ ID NO: 3986164 - DNA, 18 bp, Homo sapiens
ggtcactgtgcactgccc

SEQ ID NO: 3986165 - DNA, 15 bp, Homo sapiens
ggtcacttcttctgt

SEQ ID NO: 3986166 - DNA, 14 bp, Homo sapiens
ggtcagaggagtga

SEQ ID NO: 3986167 - DNA, 12 bp, Homo sapiens
ggtcagccaggg

SEQ ID NO: 3986168 - DNA, 19 bp, Homo sapiens
ggtcaggacggctcctcag

SEQ ID NO: 3986169 - DNA, 13 bp, Homo sapiens
ggtcaggcagggt

SEQ ID NO: 3986170 - DNA, 17 bp, Homo sapiens
ggtcaggccgggcagag

SEQ ID NO: 3986171 - DNA, 20 bp, Homo sapiens
ggtcaggctgggcagcccca

SEQ ID NO: 3986172 - DNA, 23 bp, Homo sapiens
ggtcagggagtgctggctcacag

SEQ ID NO: 3986173 - DNA, 15 bp, Homo sapiens
ggtcaggggggagaa

SEQ ID NO: 3986174 - DNA, 19 bp, Homo sapiens
ggtcatgatgctctttccc

SEQ ID NO: 3986175 - DNA, 14 bp, Homo sapiens
ggtcatgtttgcag

SEQ ID NO: 3986176 - DNA, 16 bp, Homo sapiens
ggtcattgacctctca

SEQ ID NO: 3986177 - DNA, 23 bp, Homo sapiens
ggtcattgacctctcagggcctg

SEQ ID NO: 3986178 - DNA, 24 bp, Homo sapiens
ggtcattgacctctcagggcctgg

SEQ ID NO: 3986179 - DNA, 20 bp, Homo sapiens
ggtcatttcttcagtcagaa

SEQ ID NO: 3986180 - DNA, 18 bp, Homo sapiens
ggtccaattagtttcctt

SEQ ID NO: 3986181 - DNA, 17 bp, Homo sapiens
ggtccactccctgctcc

SEQ ID NO: 3986182 - DNA, 18 bp, Homo sapiens
ggtccagaaactcctgtt

SEQ ID NO: 3986183 - DNA, 21 bp, Homo sapiens
ggtccagaaactcctgtttct

SEQ ID NO: 3986184 - DNA, 19 bp, Homo sapiens
ggtccagctcttggcccct

SEQ ID NO: 3986185 - DNA, 14 bp, Homo sapiens
ggtccagggcctga

SEQ ID NO: 3986186 - DNA, 15 bp, Homo sapiens
ggtccagggcctgac

SEQ ID NO: 3986187 - DNA, 21 bp, Homo sapiens
ggtccagggttgatcacactc

SEQ ID NO: 3986188 - DNA, 15 bp, Homo sapiens
ggtccatagctgtgg

SEQ ID NO: 3986189 - DNA, 12 bp, Homo sapiens
ggtccatgccca

SEQ ID NO: 3986190 - DNA, 18 bp, Homo sapiens
ggtccatttgttcctgct

SEQ ID NO: 3986191 - DNA, 13 bp, Homo sapiens
ggtcccacactgg

SEQ ID NO: 3986192 - DNA, 22 bp, Homo sapiens
ggtcccattgttggcgctgagg

SEQ ID NO: 3986193 - DNA, 17 bp, Homo sapiens
ggtcccatttctcactg

SEQ ID NO: 3986194 - DNA, 23 bp, Homo sapiens
ggtccccagcccttcctctgctc

SEQ ID NO: 3986195 - DNA, 22 bp, Homo sapiens
ggtccccatccccaccagctcg

SEQ ID NO: 3986196 - DNA, 23 bp, Homo sapiens
ggtccccatccccaccagctcgt

SEQ ID NO: 3986197 - DNA, 12 bp, Homo sapiens
ggtcccctccac

SEQ ID NO: 3986198 - DNA, 18 bp, Homo sapiens
ggtcccctccctctgtct

SEQ ID NO: 3986199 - DNA, 17 bp, Homo sapiens
ggtccctccaccccaca

SEQ ID NO: 3986200 - DNA, 13 bp, Homo sapiens
ggtccctgggagg

SEQ ID NO: 3986201 - DNA, 21 bp, Homo sapiens
ggtccgagtgtgtttcatcct

SEQ ID NO: 3986202 - DNA, 17 bp, Homo sapiens
ggtccggacactcctag

SEQ ID NO: 3986203 - DNA, 17 bp, Homo sapiens
ggtcctagcccttccct

SEQ ID NO: 3986204 - DNA, 18 bp, Homo sapiens
ggtcctagcccttccctg

SEQ ID NO: 3986205 - DNA, 19 bp, Homo sapiens
ggtcctagcccttccctga

SEQ ID NO: 3986206 - DNA, 12 bp, Homo sapiens
ggtcctctcagt

SEQ ID NO: 3986207 - DNA, 21 bp, Homo sapiens
ggtcctctgatacccagagca

SEQ ID NO: 3986208 - DNA, 13 bp, Homo sapiens
ggtcctgagacct

SEQ ID NO: 3986209 - DNA, 11 bp, Homo sapiens
ggtcctgccct

SEQ ID NO: 3986210 - DNA, 13 bp, Homo sapiens
ggtcctgctcagc

SEQ ID NO: 3986211 - DNA, 21 bp, Homo sapiens
ggtcctggagcagaccacccc

SEQ ID NO: 3986212 - DNA, 22 bp, Homo sapiens
ggtcctggccagatggcccgga

SEQ ID NO: 3986213 - DNA, 14 bp, Homo sapiens
ggtcctggctcctg

SEQ ID NO: 3986214 - DNA, 16 bp, Homo sapiens
ggtccttgcacccctc

SEQ ID NO: 3986215 - DNA, 12 bp, Homo sapiens
ggtcgcccagga

SEQ ID NO: 3986216 - DNA, 15 bp, Homo sapiens
ggtcggccctgccca

SEQ ID NO: 3986217 - DNA, 16 bp, Homo sapiens
ggtctaatccttctca

SEQ ID NO: 3986218 - DNA, 16 bp, Homo sapiens
ggtctatgttccccag

SEQ ID NO: 3986219 - DNA, 18 bp, Homo sapiens
ggtctcacagtgttgccc

SEQ ID NO: 3986220 - DNA, 19 bp, Homo sapiens
ggtctcacagtgttgccca

SEQ ID NO: 3986221 - DNA, 20 bp, Homo sapiens
ggtctcacagtgttgcccag

SEQ ID NO: 3986222 - DNA, 23 bp, Homo sapiens
ggtctcagcttgtatatagagat

SEQ ID NO: 3986223 - DNA, 22 bp, Homo sapiens
ggtctcaggatatccttatcag

SEQ ID NO: 3986224 - DNA, 14 bp, Homo sapiens
ggtctccctggctc

SEQ ID NO: 3986225 - DNA, 15 bp, Homo sapiens
ggtctccctggctcc

SEQ ID NO: 3986226 - DNA, 20 bp, Homo sapiens
ggtctcgctttgttgcccag

SEQ ID NO: 3986227 - DNA, 16 bp, Homo sapiens
ggtctctccctcaggt

SEQ ID NO: 3986228 - DNA, 10 bp, Homo sapiens
ggtctctttt

SEQ ID NO: 3986229 - DNA, 15 bp, Homo sapiens
ggtctgaaggactgg

SEQ ID NO: 3986230 - DNA, 17 bp, Homo sapiens
ggtctgaatgttctgac

SEQ ID NO: 3986231 - DNA, 21 bp, Homo sapiens
ggtctgaatgttctgacatta

SEQ ID NO: 3986232 - DNA, 15 bp, Homo sapiens
ggtctgatattaatc

SEQ ID NO: 3986233 - DNA, 17 bp, Homo sapiens
ggtctgattttctcact

SEQ ID NO: 3986234 - DNA, 18 bp, Homo sapiens
ggtctgcgccttgggatg

SEQ ID NO: 3986235 - DNA, 22 bp, Homo sapiens
ggatttgattcattttcctgtt

SEQ ID NO: 3986236 - DNA, 13 bp, Homo sapiens
ggattttcctgaa

SEQ ID NO: 3986237 - DNA, 10 bp, Homo sapiens
ggattttcta

SEQ ID NO: 3986238 - DNA, 22 bp, Homo sapiens
ggattttctattgttactctgg

SEQ ID NO: 3986239 - DNA, 15 bp, Homo sapiens
ggcaaaagccttgtg

SEQ ID NO: 3986240 - DNA, 14 bp, Homo sapiens
ggcaaacctttccc

SEQ ID NO: 3986241 - DNA, 18 bp, Homo sapiens
ggcaaagataatttattt

SEQ ID NO: 3986242 - DNA, 19 bp, Homo sapiens
ggcaaagccacaaggctgg

SEQ ID NO: 3986243 - DNA, 20 bp, Homo sapiens
ggcaaagccacaaggctggc

SEQ ID NO: 3986244 - DNA, 23 bp, Homo sapiens
ggcaaagccacaaggctggccag

SEQ ID NO: 3986245 - DNA, 23 bp, Homo sapiens
ggcaaagtttaaatgtattttac

SEQ ID NO: 3986246 - DNA, 20 bp, Homo sapiens
ggcaaattaacttgagtttt

SEQ ID NO: 3986247 - DNA, 21 bp, Homo sapiens
ggcaacactggaacatggcta

SEQ ID NO: 3986248 - DNA, 12 bp, Homo sapiens
ggcaacagagca

SEQ ID NO: 3986249 - DNA, 19 bp, Homo sapiens
ggcaacagagcaagatcct

SEQ ID NO: 3986250 - DNA, 16 bp, Homo sapiens
ggcaaccactaagaat

SEQ ID NO: 3986251 - DNA, 19 bp, Homo sapiens
ggcaaccactaagaattca

SEQ ID NO: 3986252 - DNA, 17 bp, Homo sapiens
ggcaagacagaaaagtg

SEQ ID NO: 3986253 - DNA, 20 bp, Homo sapiens
ggcaagactgcaaacttttt

SEQ ID NO: 3986254 - DNA, 21 bp, Homo sapiens
ggcaagactgcaaactttttt

SEQ ID NO: 3986255 - DNA, 14 bp, Homo sapiens
ggcaagagactggg

SEQ ID NO: 3986256 - DNA, 19 bp, Homo sapiens
ggcaagagcccccttgaca

SEQ ID NO: 3986257 - DNA, 14 bp, Homo sapiens
ggcaagcaggacct

SEQ ID NO: 3986258 - DNA, 16 bp, Homo sapiens
ggcaagcaggacctgg

SEQ ID NO: 3986259 - DNA, 19 bp, Homo sapiens
ggcaagcaggacctggcat

SEQ ID NO: 3986260 - DNA, 23 bp, Homo sapiens
ggcaagctgtgacttctccaggt

SEQ ID NO: 3986261 - DNA, 10 bp, Homo sapiens
ggcaaggaaa

SEQ ID NO: 3986262 - DNA, 11 bp, Homo sapiens
ggcaaggaaag

SEQ ID NO: 3986263 - DNA, 21 bp, Homo sapiens
ggcaagggccatgctgaaggg

SEQ ID NO: 3986264 - DNA, 16 bp, Homo sapiens
ggcaaggggaatctgg

SEQ ID NO: 3986265 - DNA, 17 bp, Homo sapiens
ggcaagtggatgggaat

SEQ ID NO: 3986266 - DNA, 18 bp, Homo sapiens
ggcaatgcttaaactaaa

SEQ ID NO: 3986267 - DNA, 14 bp, Homo sapiens
ggcacacacagccc

SEQ ID NO: 3986268 - DNA, 13 bp, Homo sapiens
ggcacacagcagc

SEQ ID NO: 3986269 - DNA, 16 bp, Homo sapiens
ggcacacagcagcccc

SEQ ID NO: 3986270 - DNA, 18 bp, Homo sapiens
ggcacacagcagcccccc

SEQ ID NO: 3986271 - DNA, 23 bp, Homo sapiens
ggcacacctagacaaacaaggga

SEQ ID NO: 3986272 - DNA, 20 bp, Homo sapiens
ggcacacgcacaaacacaca

SEQ ID NO: 3986273 - DNA, 21 bp, Homo sapiens
ggcacacgcacaaacacacac

SEQ ID NO: 3986274 - DNA, 22 bp, Homo sapiens
ggcacacgcacaaacacacaca

SEQ ID NO: 3986275 - DNA, 20 bp, Homo sapiens
ggcacactacagagcagctc

SEQ ID NO: 3986276 - DNA, 11 bp, Homo sapiens
ggccaccagga

SEQ ID NO: 3986277 - DNA, 18 bp, Homo sapiens
ggccacctgtagccatct

SEQ ID NO: 3986278 - DNA, 22 bp, Homo sapiens
ggccacctgtagccatctgcac

SEQ ID NO: 3986279 - DNA, 23 bp, Homo sapiens
ggccacctgtagccatctgcaca

SEQ ID NO: 3986280 - DNA, 23 bp, Homo sapiens
ggccacgcactgggccacggagg

SEQ ID NO: 3986281 - DNA, 24 bp, Homo sapiens
ggccacgcactgggccacggagga

SEQ ID NO: 3986282 - DNA, 22 bp, Homo sapiens
ggccacggaggagggatgctgc

SEQ ID NO: 3986283 - DNA, 23 bp, Homo sapiens
ggccacggaggagggatgctgct

SEQ ID NO: 3986284 - DNA, 18 bp, Homo sapiens
ggccacggctgagccttc

SEQ ID NO: 3986285 - DNA, 16 bp, Homo sapiens
ggccactaaagcttca

SEQ ID NO: 3986286 - DNA, 19 bp, Homo sapiens
ggccactaaagcttcagac

SEQ ID NO: 3986287 - DNA, 12 bp, Homo sapiens
ggccactgggga

SEQ ID NO: 3986288 - DNA, 13 bp, Homo sapiens
ggccactggggac

SEQ ID NO: 3986289 - DNA, 14 bp, Homo sapiens
ggccactggggact

SEQ ID NO: 3986290 - DNA, 19 bp, Homo sapiens
ggccagaagtagctttgca

SEQ ID NO: 3986291 - DNA, 15 bp, Homo sapiens
ggccagacatgccac

SEQ ID NO: 3986292 - DNA, 12 bp, Homo sapiens
ggccagagccag

SEQ ID NO: 3986293 - DNA, 13 bp, Homo sapiens
ggccagagccagg

SEQ ID NO: 3986294 - DNA, 16 bp, Homo sapiens
ggccagagctgggagg

SEQ ID NO: 3986295 - DNA, 17 bp, Homo sapiens
ggccagagctgggaggc

SEQ ID NO: 3986296 - DNA, 13 bp, Homo sapiens
ggccagaggctgg

SEQ ID NO: 3986297 - DNA, 14 bp, Homo sapiens
ggccagagtggcct

SEQ ID NO: 3986298 - DNA, 15 bp, Homo sapiens
ggccagagtggcctg

SEQ ID NO: 3986299 - DNA, 20 bp, Homo sapiens
ggccagagtggcctggccag

SEQ ID NO: 3986300 - DNA, 13 bp, Homo sapiens
ggccagatccagc

SEQ ID NO: 3986301 - DNA, 20 bp, Homo sapiens
ggccagatgcacatccctgg

SEQ ID NO: 3986302 - DNA, 23 bp, Homo sapiens
ggccagatgcacatccctggaag

SEQ ID NO: 3986303 - DNA, 16 bp, Homo sapiens
ggccagcaccctctcc

SEQ ID NO: 3986304 - DNA, 17 bp, Homo sapiens
ggccagcaccctctcct

SEQ ID NO: 3986305 - DNA, 19 bp, Homo sapiens
ggccagcaccctctcctgg

SEQ ID NO: 3986306 - DNA, 23 bp, Homo sapiens
ggccagcaccctctcctgggggt

SEQ ID NO: 3986307 - DNA, 22 bp, Homo sapiens
ggccagccagtgccattccact

SEQ ID NO: 3986308 - DNA, 13 bp, Homo sapiens
ggccagccccacc

SEQ ID NO: 3986309 - DNA, 21 bp, Homo sapiens
ggccagccccacccaggaggg

SEQ ID NO: 3986310 - DNA, 22 bp, Homo sapiens
ggccagcccctggggcccagcc

SEQ ID NO: 3986311 - DNA, 19 bp, Homo sapiens
ggccagccctgcagcccaa

SEQ ID NO: 3986312 - DNA, 14 bp, Homo sapiens
ggccagcggggctg

SEQ ID NO: 3986313 - DNA, 18 bp, Homo sapiens
ggccagcggggctgctca

SEQ ID NO: 3986314 - DNA, 22 bp, Homo sapiens
ggccagcggggctgctcaccca

SEQ ID NO: 3986315 - DNA, 13 bp, Homo sapiens
ggccaggagctct

SEQ ID NO: 3986316 - DNA, 15 bp, Homo sapiens
ggccaggagctcttc

SEQ ID NO: 3986317 - DNA, 18 bp, Homo sapiens
ggccaggcacagggcccg

SEQ ID NO: 3986318 - DNA, 14 bp, Homo sapiens
ggccaggcccaggc

SEQ ID NO: 3986319 - DNA, 16 bp, Homo sapiens
ggccaggcccaggcct

SEQ ID NO: 3986320 - DNA, 22 bp, Homo sapiens
ggccaggccctgagagtctggt

SEQ ID NO: 3986321 - DNA, 23 bp, Homo sapiens
ggaccaacctgctctgtccccaa

SEQ ID NO: 3986322 - DNA, 21 bp, Homo sapiens
ggaccaataaaatttctaaga

SEQ ID NO: 3986323 - DNA, 22 bp, Homo sapiens
ggaccacatgccactgcctgca

SEQ ID NO: 3986324 - DNA, 13 bp, Homo sapiens
ggaccacatttta

SEQ ID NO: 3986325 - DNA, 19 bp, Homo sapiens
ggaccagctcaggacagat

SEQ ID NO: 3986326 - DNA, 17 bp, Homo sapiens
ggaccaggactccctcc

SEQ ID NO: 3986327 - DNA, 22 bp, Homo sapiens
ggaccatgtgtcacttgtgctt

SEQ ID NO: 3986328 - DNA, 20 bp, Homo sapiens
ggaccccaacctcagaggca

SEQ ID NO: 3986329 - DNA, 22 bp, Homo sapiens
ggacccctgctcccagcctgct

SEQ ID NO: 3986330 - DNA, 21 bp, Homo sapiens
ggacccggaggggcctggcag

SEQ ID NO: 3986331 - DNA, 23 bp, Homo sapiens
ggaccctgtgacatggtgcctga

SEQ ID NO: 3986332 - DNA, 16 bp, Homo sapiens
ggaccggtgctgcagg

SEQ ID NO: 3986333 - DNA, 19 bp, Homo sapiens
ggaccgtccaggggagatg

SEQ ID NO: 3986334 - DNA, 18 bp, Homo sapiens
ggaccgtggacaggccca

SEQ ID NO: 3986335 - DNA, 19 bp, Homo sapiens
ggaccgtggacaggcccag

SEQ ID NO: 3986336 - DNA, 20 bp, Homo sapiens
ggaccgtggacaggcccagc

SEQ ID NO: 3986337 - DNA, 14 bp, Homo sapiens
ggacctgagctggc

SEQ ID NO: 3986338 - DNA, 19 bp, Homo sapiens
ggacctgcctcctgcctgc

SEQ ID NO: 3986339 - DNA, 23 bp, Homo sapiens
ggacctgcctcctgcctgcccct

SEQ ID NO: 3986340 - DNA, 14 bp, Homo sapiens
ggacctggcatcat

SEQ ID NO: 3986341 - DNA, 17 bp, Homo sapiens
ggacctggcatcatggt

SEQ ID NO: 3986342 - DNA, 14 bp, Homo sapiens
ggacctggctgcca

SEQ ID NO: 3986343 - DNA, 18 bp, Homo sapiens
ggaccttaggccttcctc

SEQ ID NO: 3986344 - DNA, 13 bp, Homo sapiens
ggacgcttctgaa

SEQ ID NO: 3986345 - DNA, 15 bp, Homo sapiens
ggacggaccagcatc

SEQ ID NO: 3986346 - DNA, 21 bp, Homo sapiens
ggacggcctgatgctccctcc

SEQ ID NO: 3986347 - DNA, 22 bp, Homo sapiens
ggacggcctgatgctccctccc

SEQ ID NO: 3986348 - DNA, 14 bp, Homo sapiens
ggacggctcctcag

SEQ ID NO: 3986349 - DNA, 21 bp, Homo sapiens
ggacgtcatcggaggctgggc

SEQ ID NO: 3986350 - DNA, 19 bp, Homo sapiens
ggacgtggctcagccagca

SEQ ID NO: 3986351 - DNA, 14 bp, Homo sapiens
ggacgtgtgtaaat

SEQ ID NO: 3986352 - DNA, 21 bp, Homo sapiens
ggactaagcctacctgctctc

SEQ ID NO: 3986353 - DNA, 18 bp, Homo sapiens
ggactagaagattagaaa

SEQ ID NO: 3986354 - DNA, 14 bp, Homo sapiens
ggactatctttgct

SEQ ID NO: 3986355 - DNA, 19 bp, Homo sapiens
ggactattgtgccaactgc

SEQ ID NO: 3986356 - DNA, 17 bp, Homo sapiens
ggactcagccctgaggt

SEQ ID NO: 3986357 - DNA, 11 bp, Homo sapiens
ggactcaggga

SEQ ID NO: 3986358 - DNA, 20 bp, Homo sapiens
ggactcagggccatgcctgc

SEQ ID NO: 3986359 - DNA, 24 bp, Homo sapiens
ggactcatttcattcctaacacag

SEQ ID NO: 3986360 - DNA, 15 bp, Homo sapiens
ggactccaggcccaa

SEQ ID NO: 3986361 - DNA, 22 bp, Homo sapiens
ggactccaggcccaaggctccc

SEQ ID NO: 3986362 - DNA, 18 bp, Homo sapiens
ggactccccaggccaggc

SEQ ID NO: 3986363 - DNA, 14 bp, Homo sapiens
ggactcccggagcc

SEQ ID NO: 3986364 - DNA, 18 bp, Homo sapiens
ggactcccggagcctgtg

SEQ ID NO: 3986365 - DNA, 20 bp, Homo sapiens
ggactccctcctcacctctg

SEQ ID NO: 3986366 - DNA, 22 bp, Homo sapiens
ggactccctcctcacctctgga

SEQ ID NO: 3986367 - DNA, 15 bp, Homo sapiens
ggactctcagggatt

SEQ ID NO: 3986368 - DNA, 15 bp, Homo sapiens
ggactctgagcggga

SEQ ID NO: 3986369 - DNA, 21 bp, Homo sapiens
ggactctgagcgggaggcaga

SEQ ID NO: 3986370 - DNA, 21 bp, Homo sapiens
ggactctgcatcccagcacct

SEQ ID NO: 3986371 - DNA, 12 bp, Homo sapiens
ggactctgcccc

SEQ ID NO: 3986372 - DNA, 16 bp, Homo sapiens
ggactctgcccctgga

SEQ ID NO: 3986373 - DNA, 19 bp, Homo sapiens
ggactcttctcggctcagg

SEQ ID NO: 3986374 - DNA, 22 bp, Homo sapiens
ggactcttctcggctcaggctc

SEQ ID NO: 3986375 - DNA, 17 bp, Homo sapiens
ggactgaagcctgcagg

SEQ ID NO: 3986376 - DNA, 16 bp, Homo sapiens
ggactgcgctggacga

SEQ ID NO: 3986377 - DNA, 15 bp, Homo sapiens
ggactggaaccaggg

SEQ ID NO: 3986378 - DNA, 22 bp, Homo sapiens
ggactggaaccagggagaccga

SEQ ID NO: 3986379 - DNA, 17 bp, Homo sapiens
ggactggaggcccctgg

SEQ ID NO: 3986380 - DNA, 17 bp, Homo sapiens
ggactggaggtgggcat

SEQ ID NO: 3986381 - DNA, 14 bp, Homo sapiens
ggactggcccctgg

SEQ ID NO: 3986382 - DNA, 15 bp, Homo sapiens
ggactggcccctggg

SEQ ID NO: 3986383 - DNA, 16 bp, Homo sapiens
ggactggcccctgggt

SEQ ID NO: 3986384 - DNA, 20 bp, Homo sapiens
ggactggctagagtcctcac

SEQ ID NO: 3986385 - DNA, 17 bp, Homo sapiens
ggactgggagtcagagc

SEQ ID NO: 3986386 - DNA, 17 bp, Homo sapiens
ggactggggatgtggga

SEQ ID NO: 3986387 - DNA, 22 bp, Homo sapiens
ggactgggggactgggagtcag

SEQ ID NO: 3986388 - DNA, 20 bp, Homo sapiens
ggactgggttgcgtcctgac

SEQ ID NO: 3986389 - DNA, 17 bp, Homo sapiens
ggactgttccaaagcca

SEQ ID NO: 3986390 - DNA, 19 bp, Homo sapiens
ggacttattacaatttgtt

SEQ ID NO: 3986391 - DNA, 23 bp, Homo sapiens
ggacttctacctgccctcaaggg

SEQ ID NO: 3986392 - DNA, 14 bp, Homo sapiens
ggacttctgcagct

SEQ ID NO: 3986393 - DNA, 14 bp, Homo sapiens
ggacttctgtgggc

SEQ ID NO: 3986394 - DNA, 16 bp, Homo sapiens
ggactttatttatttc

SEQ ID NO: 3986395 - DNA, 18 bp, Homo sapiens
ggactttgcttcccctcc

SEQ ID NO: 3986396 - DNA, 18 bp, Homo sapiens
ggagctcctctcctggag

SEQ ID NO: 3986397 - DNA, 20 bp, Homo sapiens
ggagctcctctcctggagga

SEQ ID NO: 3986398 - DNA, 21 bp, Homo sapiens
ggagctctaccctgctccctg

SEQ ID NO: 3986399 - DNA, 23 bp, Homo sapiens
ggagctctgggaatttggagtga

SEQ ID NO: 3986400 - DNA, 18 bp, Homo sapiens
ggagctcttcaggcctcc

SEQ ID NO: 3986401 - DNA, 22 bp, Homo sapiens
ggagctgaagacctaaagtgct

SEQ ID NO: 3986402 - DNA, 15 bp, Homo sapiens
ggagctgatggcagc

SEQ ID NO: 3986403 - DNA, 21 bp, Homo sapiens
ggagctgccttggctcagaca

SEQ ID NO: 3986404 - DNA, 21 bp, Homo sapiens
ggagctgggacacttaacaga

SEQ ID NO: 3986405 - DNA, 19 bp, Homo sapiens
ggagctgtcaccaaggaaa

SEQ ID NO: 3986406 - DNA, 12 bp, Homo sapiens
ggagctgtcatc

SEQ ID NO: 3986407 - DNA, 13 bp, Homo sapiens
ggagctttctgta

SEQ ID NO: 3986408 - DNA, 14 bp, Homo sapiens
ggagctttctgtat

SEQ ID NO: 3986409 - DNA, 20 bp, Homo sapiens
ggaggaaaaccaagccgtgg

SEQ ID NO: 3986410 - DNA, 19 bp, Homo sapiens
ggaggaaccagagtgctga

SEQ ID NO: 3986411 - DNA, 13 bp, Homo sapiens
ggaggaaggattg

SEQ ID NO: 3986412 - DNA, 16 bp, Homo sapiens
ggaggaatgctggact

SEQ ID NO: 3986413 - DNA, 22 bp, Homo sapiens
ggaggacaggcgggaggaggtg

SEQ ID NO: 3986414 - DNA, 22 bp, Homo sapiens
ggaggacctgaccctactccct

SEQ ID NO: 3986415 - DNA, 18 bp, Homo sapiens
ggaggagaccagctcaga

SEQ ID NO: 3986416 - DNA, 14 bp, Homo sapiens
ggaggagcagcagc

SEQ ID NO: 3986417 - DNA, 13 bp, Homo sapiens
ggaggaggaaggc

SEQ ID NO: 3986418 - DNA, 17 bp, Homo sapiens
ggaggaggcctgtccca

SEQ ID NO: 3986419 - DNA, 15 bp, Homo sapiens
ggaggagggatgctg

SEQ ID NO: 3986420 - DNA, 15 bp, Homo sapiens
ggaggagggggaggg

SEQ ID NO: 3986421 - DNA, 15 bp, Homo sapiens
ggaggagggggccgg

SEQ ID NO: 3986422 - DNA, 20 bp, Homo sapiens
ggaggcaagagactgggagc

SEQ ID NO: 3986423 - DNA, 12 bp, Homo sapiens
ggaggcagagtt

SEQ ID NO: 3986424 - DNA, 15 bp, Homo sapiens
ggaggcagccccctc

SEQ ID NO: 3986425 - DNA, 13 bp, Homo sapiens
ggaggcagggctc

SEQ ID NO: 3986426 - DNA, 21 bp, Homo sapiens
ggaggccaaactgtccctccc

SEQ ID NO: 3986427 - DNA, 15 bp, Homo sapiens
ggaagcttggggaac

SEQ ID NO: 3986428 - DNA, 13 bp, Homo sapiens
ggaaggagtgaga

SEQ ID NO: 3986429 - DNA, 13 bp, Homo sapiens
ggaaggattgtaa

SEQ ID NO: 3986430 - DNA, 16 bp, Homo sapiens
ggaaggattgtaaaaa

SEQ ID NO: 3986431 - DNA, 23 bp, Homo sapiens
ggaaggattgtaaaaaaaaatgc

SEQ ID NO: 3986432 - DNA, 18 bp, Homo sapiens
ggaaggcacttctgcctg

SEQ ID NO: 3986433 - DNA, 17 bp, Homo sapiens
ggaaggcagacagcagg

SEQ ID NO: 3986434 - DNA, 14 bp, Homo sapiens
ggaaggccctgagg

SEQ ID NO: 3986435 - DNA, 11 bp, Homo sapiens
ggaagggccag

SEQ ID NO: 3986436 - DNA, 20 bp, Homo sapiens
ggaagggctttggttccttc

SEQ ID NO: 3986437 - DNA, 24 bp, Homo sapiens
ggaagggctttggttccttctctg

SEQ ID NO: 3986438 - DNA, 14 bp, Homo sapiens
ggaaggggccttgc

SEQ ID NO: 3986439 - DNA, 17 bp, Homo sapiens
ggaaggggccttgctga

SEQ ID NO: 3986440 - DNA, 19 bp, Homo sapiens
ggaagggggggctacatta

SEQ ID NO: 3986441 - DNA, 20 bp, Homo sapiens
ggaagggggggctacattat

SEQ ID NO: 3986442 - DNA, 23 bp, Homo sapiens
ggaaggtagcccagcactgtgaa

SEQ ID NO: 3986443 - DNA, 13 bp, Homo sapiens
ggaaggtctcatt

SEQ ID NO: 3986444 - DNA, 16 bp, Homo sapiens
ggaaggttcttcatga

SEQ ID NO: 3986445 - DNA, 18 bp, Homo sapiens
ggaagtagtccttggcat

SEQ ID NO: 3986446 - DNA, 16 bp, Homo sapiens
ggaagtccaatgtggc

SEQ ID NO: 3986447 - DNA, 17 bp, Homo sapiens
ggaagtccaatgtggca

SEQ ID NO: 3986448 - DNA, 18 bp, Homo sapiens
ggaagtgtgagcgccttg

SEQ ID NO: 3986449 - DNA, 18 bp, Homo sapiens
ggaagttgacttatagta

SEQ ID NO: 3986450 - DNA, 11 bp, Homo sapiens
ggaagttttca

SEQ ID NO: 3986451 - DNA, 18 bp, Homo sapiens
ggaagttttgcatttatg

SEQ ID NO: 3986452 - DNA, 20 bp, Homo sapiens
ggaataaactagagaaggga

SEQ ID NO: 3986453 - DNA, 15 bp, Homo sapiens
ggaataaagttgcag

SEQ ID NO: 3986454 - DNA, 17 bp, Homo sapiens
ggaataaagttgcagat

SEQ ID NO: 3986455 - DNA, 18 bp, Homo sapiens
ggaataacatgtaattaa

SEQ ID NO: 3986456 - DNA, 15 bp, Homo sapiens
ggaataatttgtaaa

SEQ ID NO: 3986457 - DNA, 17 bp, Homo sapiens
ggaatactttttgttat

SEQ ID NO: 3986458 - DNA, 14 bp, Homo sapiens
ggaatagggagaca

SEQ ID NO: 3986459 - DNA, 20 bp, Homo sapiens
ggaatagggagacagggtag

SEQ ID NO: 3986460 - DNA, 22 bp, Homo sapiens
ggaatatttataggccagggca

SEQ ID NO: 3986461 - DNA, 23 bp, Homo sapiens
ggaatccagctccctagactgca

SEQ ID NO: 3986462 - DNA, 13 bp, Homo sapiens
ggaatcctggacc

SEQ ID NO: 3986463 - DNA, 13 bp, Homo sapiens
ggaatgagcccag

SEQ ID NO: 3986464 - DNA, 20 bp, Homo sapiens
ggaatgagcccagagaacag

SEQ ID NO: 3986465 - DNA, 15 bp, Homo sapiens
ggaatgtgtggcctg

SEQ ID NO: 3986466 - DNA, 20 bp, Homo sapiens
ggaatgtttttccctcccca

SEQ ID NO: 3986467 - DNA, 19 bp, Homo sapiens
ggaattacatgtaaaacat

SEQ ID NO: 3986468 - DNA, 18 bp, Homo sapiens
ggaattgatttgcattga

SEQ ID NO: 3986469 - DNA, 20 bp, Homo sapiens
ggaattgcttaccaaaggat

SEQ ID NO: 3986470 - DNA, 16 bp, Homo sapiens
ggaatttcccaggacc

SEQ ID NO: 3986471 - DNA, 19 bp, Homo sapiens
ggaatttcccaggaccctg

SEQ ID NO: 3986472 - DNA, 13 bp, Homo sapiens
ggaatttgtcagc

SEQ ID NO: 3986473 - DNA, 21 bp, Homo sapiens
ggaatttgttcaagttttggg

SEQ ID NO: 3986474 - DNA, 16 bp, Homo sapiens
ggacaacagtgctttg

SEQ ID NO: 3986475 - DNA, 14 bp, Homo sapiens
ggacaacttattta

SEQ ID NO: 3986476 - DNA, 22 bp, Homo sapiens
ggacaacttatttaaaaatatt

SEQ ID NO: 3986477 - DNA, 20 bp, Homo sapiens
ggacaagtggactcagggca

SEQ ID NO: 3986478 - DNA, 19 bp, Homo sapiens
ggacaatcatgaaatatgc

SEQ ID NO: 3986479 - DNA, 13 bp, Homo sapiens
ggacacacaaggt

SEQ ID NO: 3986480 - DNA, 17 bp, Homo sapiens
ggacacagacccaggac

SEQ ID NO: 3986481 - DNA, 18 bp, Homo sapiens
ggacacagacccaggacc

SEQ ID NO: 3986482 - DNA, 18 bp, Homo sapiens
ggacacatgaaaggcatc

SEQ ID NO: 3986483 - DNA, 18 bp, Homo sapiens
ggacaccagtccaggtag

SEQ ID NO: 3986484 - DNA, 18 bp, Homo sapiens
ggacacccctacacacac

SEQ ID NO: 3986485 - DNA, 15 bp, Homo sapiens
ggacacccctgctct

SEQ ID NO: 3986486 - DNA, 19 bp, Homo sapiens
ggacaccccttatccagga

SEQ ID NO: 3986487 - DNA, 16 bp, Homo sapiens
ggacacctgccctgcc

SEQ ID NO: 3986488 - DNA, 22 bp, Homo sapiens
ggacacggggcagtggcaacct

SEQ ID NO: 3986489 - DNA, 17 bp, Homo sapiens
ggacactagggtcaggc

SEQ ID NO: 3986490 - DNA, 21 bp, Homo sapiens
ggacactccagtgccagcaat

SEQ ID NO: 3986491 - DNA, 18 bp, Homo sapiens
ggacacttaacagatgca

SEQ ID NO: 3986492 - DNA, 19 bp, Homo sapiens
ggacacttatccacgagag

SEQ ID NO: 3986493 - DNA, 14 bp, Homo sapiens
ggacagaaagagac

SEQ ID NO: 3986494 - DNA, 18 bp, Homo sapiens
ggacagaaggctcctgcc

SEQ ID NO: 3986495 - DNA, 20 bp, Homo sapiens
ggacagaaggctcctgcccc

SEQ ID NO: 3986496 - DNA, 14 bp, Homo sapiens
ggacagaggcccca

SEQ ID NO: 3986497 - DNA, 16 bp, Homo sapiens
ggacagaggccccagc

SEQ ID NO: 3986498 - DNA, 18 bp, Homo sapiens
ggacagaggccccagcct

SEQ ID NO: 3986499 - DNA, 23 bp, Homo sapiens
ggacagaggccccagcctccctg

SEQ ID NO: 3986500 - DNA, 15 bp, Homo sapiens
ggacagaggcctgcc

SEQ ID NO: 3986501 - DNA, 15 bp, Homo sapiens
ggacagagttcacag

SEQ ID NO: 3986502 - DNA, 16 bp, Homo sapiens
ggacagagttcacagg

SEQ ID NO: 3986503 - DNA, 17 bp, Homo sapiens
ggacagagttcacagga

SEQ ID NO: 3986504 - DNA, 20 bp, Homo sapiens
ggacagagttcacaggaggc

SEQ ID NO: 3986505 - DNA, 12 bp, Homo sapiens
ggagtgcagtgg

SEQ ID NO: 3986506 - DNA, 19 bp, Homo sapiens
ggagtgcccaccctgggag

SEQ ID NO: 3986507 - DNA, 13 bp, Homo sapiens
ggagtgctgtgct

SEQ ID NO: 3986508 - DNA, 14 bp, Homo sapiens
ggagtgctgtgctg

SEQ ID NO: 3986509 - DNA, 16 bp, Homo sapiens
ggagtgggcacctcag

SEQ ID NO: 3986510 - DNA, 16 bp, Homo sapiens
ggagtggtgcagacag

SEQ ID NO: 3986511 - DNA, 20 bp, Homo sapiens
ggagtggttaggcagcaagc

SEQ ID NO: 3986512 - DNA, 13 bp, Homo sapiens
ggagtgtcctctt

SEQ ID NO: 3986513 - DNA, 14 bp, Homo sapiens
ggagtgtcctgccc

SEQ ID NO: 3986514 - DNA, 18 bp, Homo sapiens
ggagtgtgtattgttccc

SEQ ID NO: 3986515 - DNA, 16 bp, Homo sapiens
ggagttaagacctggc

SEQ ID NO: 3986516 - DNA, 22 bp, Homo sapiens
ggagttacattaatgttaattc

SEQ ID NO: 3986517 - DNA, 12 bp, Homo sapiens
ggagttatctaa

SEQ ID NO: 3986518 - DNA, 14 bp, Homo sapiens
ggagttccatgaag

SEQ ID NO: 3986519 - DNA, 19 bp, Homo sapiens
ggagttcctaacaggatga

SEQ ID NO: 3986520 - DNA, 22 bp, Homo sapiens
ggagttgatctggaacccagac

SEQ ID NO: 3986521 - DNA, 12 bp, Homo sapiens
ggagtttctctg

SEQ ID NO: 3986522 - DNA, 17 bp, Homo sapiens
ggataaaataatgctgc

SEQ ID NO: 3986523 - DNA, 12 bp, Homo sapiens
ggataaatcatt

SEQ ID NO: 3986524 - DNA, 20 bp, Homo sapiens
ggataaggagactgaggctt

SEQ ID NO: 3986525 - DNA, 14 bp, Homo sapiens
ggataatgaaataa

SEQ ID NO: 3986526 - DNA, 15 bp, Homo sapiens
ggatagaggggctgc

SEQ ID NO: 3986527 - DNA, 21 bp, Homo sapiens
ggatagatgctggcccagggc

SEQ ID NO: 3986528 - DNA, 14 bp, Homo sapiens
ggataggggcagag

SEQ ID NO: 3986529 - DNA, 16 bp, Homo sapiens
ggatagtgttctgctc

SEQ ID NO: 3986530 - DNA, 22 bp, Homo sapiens
ggatatctttacaagcaggcac

SEQ ID NO: 3986531 - DNA, 13 bp, Homo sapiens
ggatatgaccagt

SEQ ID NO: 3986532 - DNA, 14 bp, Homo sapiens
ggatatggctgccc

SEQ ID NO: 3986533 - DNA, 11 bp, Homo sapiens
ggatatttaag

SEQ ID NO: 3986534 - DNA, 13 bp, Homo sapiens
ggatattttcaaa

SEQ ID NO: 3986535 - DNA, 16 bp, Homo sapiens
ggatcccaccctgggg

SEQ ID NO: 3986536 - DNA, 23 bp, Homo sapiens
ggatcctattctcaccaggaagg

SEQ ID NO: 3986537 - DNA, 13 bp, Homo sapiens
ggatccttgggcc

SEQ ID NO: 3986538 - DNA, 16 bp, Homo sapiens
ggatctctcaggagca

SEQ ID NO: 3986539 - DNA, 18 bp, Homo sapiens
ggatctggggctctggga

SEQ ID NO: 3986540 - DNA, 13 bp, Homo sapiens
gctgcaccagagc

SEQ ID NO: 3986541 - DNA, 23 bp, Homo sapiens
gctgcacccaactactgagctga

SEQ ID NO: 3986542 - DNA, 14 bp, Homo sapiens
gctgcacccctggg

SEQ ID NO: 3986543 - DNA, 17 bp, Homo sapiens
gctgcacccctgggcca

SEQ ID NO: 3986544 - DNA, 15 bp, Homo sapiens
gctgcaccctgcgcc

SEQ ID NO: 3986545 - DNA, 23 bp, Homo sapiens
gctgcaccctgcgcctccagagg

SEQ ID NO: 3986546 - DNA, 20 bp, Homo sapiens
gctgcactgatgctgcccct

SEQ ID NO: 3986547 - DNA, 20 bp, Homo sapiens
gctgcagagaaacttaagca

SEQ ID NO: 3986548 - DNA, 22 bp, Homo sapiens
gctgcagatactactgaccaga

SEQ ID NO: 3986549 - DNA, 14 bp, Homo sapiens
gccccagagctgtt

SEQ ID NO: 3986550 - DNA, 19 bp, Homo sapiens
gccccagcactaacgtaaa

SEQ ID NO: 3986551 - DNA, 16 bp, Homo sapiens
gccccagcagccctca

SEQ ID NO: 3986552 - DNA, 12 bp, Homo sapiens
gccccagcccga

SEQ ID NO: 3986553 - DNA, 10 bp, Homo sapiens
gccccagcct

SEQ ID NO: 3986554 - DNA, 18 bp, Homo sapiens
gccccagcctccctgaag

SEQ ID NO: 3986555 - DNA, 15 bp, Homo sapiens
gccccagcctgggcc

SEQ ID NO: 3986556 - DNA, 19 bp, Homo sapiens
gccccagctgactgtggcc

SEQ ID NO: 3986557 - DNA, 22 bp, Homo sapiens
gccccaggaccagctcaggaca

SEQ ID NO: 3986558 - DNA, 20 bp, Homo sapiens
gccccaggacctggctgcca

SEQ ID NO: 3986559 - DNA, 22 bp, Homo sapiens
gccccaggacctggctgccata

SEQ ID NO: 3986560 - DNA, 11 bp, Homo sapiens
gccccaggccc

SEQ ID NO: 3986561 - DNA, 18 bp, Homo sapiens
gccccaggccccagacag

SEQ ID NO: 3986562 - DNA, 14 bp, Homo sapiens
gccccaggcctctg

SEQ ID NO: 3986563 - DNA, 15 bp, Homo sapiens
gccccaggcctgaaa

SEQ ID NO: 3986564 - DNA, 19 bp, Homo sapiens
gccccatcagaacctgagc

SEQ ID NO: 3986565 - DNA, 12 bp, Homo sapiens
gccccatcctca

SEQ ID NO: 3986566 - DNA, 20 bp, Homo sapiens
gccccatcctcatccctgac

SEQ ID NO: 3986567 - DNA, 16 bp, Homo sapiens
gccccatcggccaaga

SEQ ID NO: 3986568 - DNA, 23 bp, Homo sapiens
gccccatgcctgtccagcctggg

SEQ ID NO: 3986569 - DNA, 16 bp, Homo sapiens
gcccccaaacccccat

SEQ ID NO: 3986570 - DNA, 16 bp, Homo sapiens
gcccccaacctcaggg

SEQ ID NO: 3986571 - DNA, 23 bp, Homo sapiens
gcccccaacctcagggctcccag

SEQ ID NO: 3986572 - DNA, 17 bp, Homo sapiens
gcccccaccgtgggcag

SEQ ID NO: 3986573 - DNA, 22 bp, Homo sapiens
gcccccaccgtgggcagggagc

SEQ ID NO: 3986574 - DNA, 19 bp, Homo sapiens
gcccccagatagagctggg

SEQ ID NO: 3986575 - DNA, 21 bp, Homo sapiens
gcccccagatagagctgggtg

SEQ ID NO: 3986576 - DNA, 17 bp, Homo sapiens
gcccccagcagaggcag

SEQ ID NO: 3986577 - DNA, 15 bp, Homo sapiens
gcccccagcccctcc

SEQ ID NO: 3986578 - DNA, 19 bp, Homo sapiens
gcccccagcccctccccca

SEQ ID NO: 3986579 - DNA, 21 bp, Homo sapiens
gcccccagctaagaacctgga

SEQ ID NO: 3986580 - DNA, 12 bp, Homo sapiens
gcccccagggcc

SEQ ID NO: 3986581 - DNA, 21 bp, Homo sapiens
gcccccagggcctccagggcc

SEQ ID NO: 3986582 - DNA, 22 bp, Homo sapiens
gctccaggcctgcagcaggagt

SEQ ID NO: 3986583 - DNA, 18 bp, Homo sapiens
gctccaggtggctctgag

SEQ ID NO: 3986584 - DNA, 18 bp, Homo sapiens
gctccagtccccagaact

SEQ ID NO: 3986585 - DNA, 16 bp, Homo sapiens
gctccataccttttct

SEQ ID NO: 3986586 - DNA, 23 bp, Homo sapiens
gctggcacccaccgtggaggagg

SEQ ID NO: 3986587 - DNA, 18 bp, Homo sapiens
gctggccagcaaggcagg

SEQ ID NO: 3986588 - DNA, 19 bp, Homo sapiens
gctggccagcaaggcaggt

SEQ ID NO: 3986589 - DNA, 21 bp, Homo sapiens
gctggccagcaaggcaggttg

SEQ ID NO: 3986590 - DNA, 12 bp, Homo sapiens
gctggccagcac

SEQ ID NO: 3986591 - DNA, 14 bp, Homo sapiens
gctggccagcaccc

SEQ ID NO: 3986592 - DNA, 16 bp, Homo sapiens
gctggccagcaccctc

SEQ ID NO: 3986593 - DNA, 18 bp, Homo sapiens
gctggccagcaccctctc

SEQ ID NO: 3986594 - DNA, 21 bp, Homo sapiens
gctggccagcaccctctcctg

SEQ ID NO: 3986595 - DNA, 17 bp, Homo sapiens
gctggccatggggccct

SEQ ID NO: 3986596 - DNA, 14 bp, Homo sapiens
gctggcccagccaa

SEQ ID NO: 3986597 - DNA, 18 bp, Homo sapiens
gctggcccagggcccaga

SEQ ID NO: 3986598 - DNA, 22 bp, Homo sapiens
gcttccttctgtgaaagtacat

SEQ ID NO: 3986599 - DNA, 23 bp, Homo sapiens
gcttcggttctccagaatgtaag

SEQ ID NO: 3986600 - DNA, 19 bp, Homo sapiens
gcttctaaatggtgctgca

SEQ ID NO: 3986601 - DNA, 16 bp, Homo sapiens
gcttctcagctcgctg

SEQ ID NO: 3986602 - DNA, 16 bp, Homo sapiens
gcttctccagtggtga

SEQ ID NO: 3986603 - DNA, 19 bp, Homo sapiens
gcttctccgccagcctcct

SEQ ID NO: 3986604 - DNA, 21 bp, Homo sapiens
gcttctccgccagcctcctct

SEQ ID NO: 3986605 - DNA, 16 bp, Homo sapiens
gcttctgaactcaagc

SEQ ID NO: 3986606 - DNA, 13 bp, Homo sapiens
gcttctgcttttc

SEQ ID NO: 3986607 - DNA, 19 bp, Homo sapiens
gcttctgcttttctgccct

SEQ ID NO: 3986608 - DNA, 23 bp, Homo sapiens
gcttctgcttttctgccctggct

SEQ ID NO: 3986609 - DNA, 15 bp, Homo sapiens
gcttcttaaagagtt

SEQ ID NO: 3986610 - DNA, 18 bp, Homo sapiens
gcttcttactattaagca

SEQ ID NO: 3986611 - DNA, 15 bp, Homo sapiens
gcttcttcctaggtc

SEQ ID NO: 3986612 - DNA, 22 bp, Homo sapiens
gcttcttcctaggtccaagccc

SEQ ID NO: 3986613 - DNA, 16 bp, Homo sapiens
gcttcttgtttccttg

SEQ ID NO: 3986614 - DNA, 16 bp, Homo sapiens
gcttgaaggccctgct

SEQ ID NO: 3986615 - DNA, 16 bp, Homo sapiens
gcttgacacagtcagc

SEQ ID NO: 3986616 - DNA, 20 bp, Homo sapiens
gcttgaccaggcttggcctt

SEQ ID NO: 3986617 - DNA, 20 bp, Homo sapiens
gcttgaccgtactctcacat

SEQ ID NO: 3986618 - DNA, 14 bp, Homo sapiens
gcttgactgcattg

SEQ ID NO: 3986619 - DNA, 15 bp, Homo sapiens
gcttgatccagaaga

SEQ ID NO: 3986620 - DNA, 13 bp, Homo sapiens
gcttgatgaagca

SEQ ID NO: 3986621 - DNA, 21 bp, Homo sapiens
gcttgatggtgacagctgcaa

SEQ ID NO: 3986622 - DNA, 13 bp, Homo sapiens
gcttgattttaat

SEQ ID NO: 3986623 - DNA, 18 bp, Homo sapiens
gcttgcactctcttggct

SEQ ID NO: 3986624 - DNA, 15 bp, Homo sapiens
gcttgcaggaggcca

SEQ ID NO: 3986625 - DNA, 19 bp, Homo sapiens
gcttgcagtgagccgagat

SEQ ID NO: 3986626 - DNA, 15 bp, Homo sapiens
gcttgcataataagc

SEQ ID NO: 3986627 - DNA, 22 bp, Homo sapiens
gcttgcccaagtcacacagcta

SEQ ID NO: 3986628 - DNA, 15 bp, Homo sapiens
gcttggcccagcgcc

SEQ ID NO: 3986629 - DNA, 16 bp, Homo sapiens
gcttggcccggccggc

SEQ ID NO: 3986630 - DNA, 19 bp, Homo sapiens
gcttggcccggccggcctg

SEQ ID NO: 3986631 - DNA, 23 bp, Homo sapiens
gcttggcccggccggcctggcac

SEQ ID NO: 3986632 - DNA, 21 bp, Homo sapiens
gcttgggagagtcaggcaggg

SEQ ID NO: 3986633 - DNA, 14 bp, Homo sapiens
gcttgggatttgct

SEQ ID NO: 3986634 - DNA, 17 bp, Homo sapiens
gcttgggatttgctgtg

SEQ ID NO: 3986635 - DNA, 14 bp, Homo sapiens
gcttgggccctgca

SEQ ID NO: 3986636 - DNA, 20 bp, Homo sapiens
gcttggggtgtggggtgggg

SEQ ID NO: 3986637 - DNA, 15 bp, Homo sapiens
gcttggtctgtttga

SEQ ID NO: 3986638 - DNA, 16 bp, Homo sapiens
gcttgtcatagccagt

SEQ ID NO: 3986639 - DNA, 18 bp, Homo sapiens
gcttgtcctgggcctgcc

SEQ ID NO: 3986640 - DNA, 21 bp, Homo sapiens
gcttgtcgctttctcagtgtg

SEQ ID NO: 3986641 - DNA, 23 bp, Homo sapiens
gcttgtggattgagggtaggagg

SEQ ID NO: 3986642 - DNA, 19 bp, Homo sapiens
gcttgtggctccacacaca

SEQ ID NO: 3986643 - DNA, 13 bp, Homo sapiens
gcttgtgggctgg

SEQ ID NO: 3986644 - DNA, 22 bp, Homo sapiens
gcttgtgggctggtgccccaca

SEQ ID NO: 3986645 - DNA, 15 bp, Homo sapiens
gcttgtgtcctgtcc

SEQ ID NO: 3986646 - DNA, 17 bp, Homo sapiens
gcttgttatcagctttc

SEQ ID NO: 3986647 - DNA, 23 bp, Homo sapiens
gcttgttttataaaattttgctt

SEQ ID NO: 3986648 - DNA, 13 bp, Homo sapiens
gctttaaaaagaa

SEQ ID NO: 3986649 - DNA, 14 bp, Homo sapiens
gctttaaaaagaaa

SEQ ID NO: 3986650 - DNA, 20 bp, Homo sapiens
gctttaaaaagggaagaaac

SEQ ID NO: 3986651 - DNA, 17 bp, Homo sapiens
gctttagaccctgggtg

SEQ ID NO: 3986652 - DNA, 22 bp, Homo sapiens
gctttattcttcagatacaaac

SEQ ID NO: 3986653 - DNA, 17 bp, Homo sapiens
gctttattttttaagta

SEQ ID NO: 3986654 - DNA, 19 bp, Homo sapiens
gctttattttttaagtatt

SEQ ID NO: 3986655 - DNA, 18 bp, Homo sapiens
gctttcatgattagcaag

SEQ ID NO: 3986656 - DNA, 20 bp, Homo sapiens
gctttccaggcaccctcagg

SEQ ID NO: 3986657 - DNA, 23 bp, Homo sapiens
gctttccaggcaccctcagggag

SEQ ID NO: 3986658 - DNA, 12 bp, Homo sapiens
gctttcctgccc

SEQ ID NO: 3986659 - DNA, 19 bp, Homo sapiens
gctttcctgccccaggcct

SEQ ID NO: 3986660 - DNA, 12 bp, Homo sapiens
gctttcctgggc

SEQ ID NO: 3986661 - DNA, 18 bp, Homo sapiens
gctttcctgtgccaggtg

SEQ ID NO: 3986662 - DNA, 18 bp, Homo sapiens
gctttctatgctgtttgt

SEQ ID NO: 3986663 - DNA, 14 bp, Homo sapiens
gctttctcagtgtg

SEQ ID NO: 3986664 - DNA, 13 bp, Homo sapiens
gctttctcttccc

SEQ ID NO: 3986665 - DNA, 22 bp, Homo sapiens
gctttctggaaaagaggagttt

SEQ ID NO: 3986666 - DNA, 23 bp, Homo sapiens
gctttctggggcctagcgatctc

SEQ ID NO: 3986667 - DNA, 14 bp, Homo sapiens
gctttctgttccaa

SEQ ID NO: 3986668 - DNA, 15 bp, Homo sapiens
gctttcttacctact

SEQ ID NO: 3986669 - DNA, 15 bp, Homo sapiens
gctttcttgctccct

SEQ ID NO: 3986670 - DNA, 21 bp, Homo sapiens
gctttcttgctcccttcagcc

SEQ ID NO: 3986671 - DNA, 13 bp, Homo sapiens
gctttcttgctgg

SEQ ID NO: 3986672 - DNA, 14 bp, Homo sapiens
gctttcttgctggt

SEQ ID NO: 3986673 - DNA, 16 bp, Homo sapiens
gctttgaaacctcagg

SEQ ID NO: 3986674 - DNA, 16 bp, Homo sapiens
gctttgataattgttt

SEQ ID NO: 3986675 - DNA, 20 bp, Homo sapiens
gctttgattcatagtaactt

SEQ ID NO: 3986676 - DNA, 13 bp, Homo sapiens
gctttgcactttt

SEQ ID NO: 3986677 - DNA, 18 bp, Homo sapiens
gctttgcccacccctcac

SEQ ID NO: 3986678 - DNA, 11 bp, Homo sapiens
gctttgcctct

SEQ ID NO: 3986679 - DNA, 13 bp, Homo sapiens
gctttgcctcttc

SEQ ID NO: 3986680 - DNA, 17 bp, Homo sapiens
gctttgccttgcagcca

SEQ ID NO: 3986681 - DNA, 22 bp, Homo sapiens
gctttgctgctaccgccctggg

SEQ ID NO: 3986682 - DNA, 15 bp, Homo sapiens
gcttttcctcccttg

SEQ ID NO: 3986683 - DNA, 16 bp, Homo sapiens
gcttttctgtcctggg

SEQ ID NO: 3986684 - DNA, 21 bp, Homo sapiens
gcttttgtctaattaaaacac

SEQ ID NO: 3986685 - DNA, 14 bp, Homo sapiens
gcttttgttgttta

SEQ ID NO: 3986686 - DNA, 16 bp, Homo sapiens
gcttttgttttgcttt

SEQ ID NO: 3986687 - DNA, 22 bp, Homo sapiens
gctttttaattgttgtttcttt

SEQ ID NO: 3986688 - DNA, 17 bp, Homo sapiens
gctttttatttctgcat

SEQ ID NO: 3986689 - DNA, 16 bp, Homo sapiens
gctttttcctcctgga

SEQ ID NO: 3986690 - DNA, 14 bp, Homo sapiens
ggaaaaaaatgact

SEQ ID NO: 3986691 - DNA, 11 bp, Homo sapiens
ggaaaaaagca

SEQ ID NO: 3986692 - DNA, 13 bp, Homo sapiens
ggaaaaaagcaca

SEQ ID NO: 3986693 - DNA, 13 bp, Homo sapiens
ggaaaaatggttg

SEQ ID NO: 3986694 - DNA, 15 bp, Homo sapiens
ggaaaaatggttgat

SEQ ID NO: 3986695 - DNA, 21 bp, Homo sapiens
ggaaaaatggttgatggaaaa

SEQ ID NO: 3986696 - DNA, 17 bp, Homo sapiens
ggaaaacacccagggaa

SEQ ID NO: 3986697 - DNA, 21 bp, Homo sapiens
ggaaaaccaagccgtggcttc

SEQ ID NO: 3986698 - DNA, 12 bp, Homo sapiens
ggaaaaccagac

SEQ ID NO: 3986699 - DNA, 17 bp, Homo sapiens
ggaaaagggagaaaaag

SEQ ID NO: 3986700 - DNA, 15 bp, Homo sapiens
ggaaaagtacattta

SEQ ID NO: 3986701 - DNA, 14 bp, Homo sapiens
ggaaaataaattat

SEQ ID NO: 3986702 - DNA, 15 bp, Homo sapiens
ggaaacaggaccaca

SEQ ID NO: 3986703 - DNA, 14 bp, Homo sapiens
ggaaacctgtctga

SEQ ID NO: 3986704 - DNA, 23 bp, Homo sapiens
ggaaacgctacctctctgtccct

SEQ ID NO: 3986705 - DNA, 20 bp, Homo sapiens
ggaaactccacatctgcctt

SEQ ID NO: 3986706 - DNA, 16 bp, Homo sapiens
ggaaagacgtttttgt

SEQ ID NO: 3986707 - DNA, 14 bp, Homo sapiens
ggaaagatggataa

SEQ ID NO: 3986708 - DNA, 22 bp, Homo sapiens
ggaaagatggataaactgagcc

SEQ ID NO: 3986709 - DNA, 15 bp, Homo sapiens
ggaaagcaataaatg

SEQ ID NO: 3986710 - DNA, 14 bp, Homo sapiens
ggaaagcacagagg

SEQ ID NO: 3986711 - DNA, 18 bp, Homo sapiens
ggaaagcagcattctgga

SEQ ID NO: 3986712 - DNA, 20 bp, Homo sapiens
ggaaagccacctctccctca

SEQ ID NO: 3986713 - DNA, 23 bp, Homo sapiens
ggaaagccacctctccctcaaca

SEQ ID NO: 3986714 - DNA, 12 bp, Homo sapiens
ggaaagggagga

SEQ ID NO: 3986715 - DNA, 20 bp, Homo sapiens
ggaaagggctggctccccct

SEQ ID NO: 3986716 - DNA, 12 bp, Homo sapiens
ggaaaggggaga

SEQ ID NO: 3986717 - DNA, 14 bp, Homo sapiens
ggaaaggttttgta

SEQ ID NO: 3986718 - DNA, 19 bp, Homo sapiens
ggaaagtacactctgctgt

SEQ ID NO: 3986719 - DNA, 19 bp, Homo sapiens
ggaaagtgaatttgaatga

SEQ ID NO: 3986720 - DNA, 20 bp, Homo sapiens
ggaaagtgtgagctcttccc

SEQ ID NO: 3986721 - DNA, 20 bp, Homo sapiens
ggaaatccattgtttaaaga

SEQ ID NO: 3986722 - DNA, 17 bp, Homo sapiens
ggaaatccgagcggcta

SEQ ID NO: 3986723 - DNA, 19 bp, Homo sapiens
ggaaatggtatgagctgag

SEQ ID NO: 3986724 - DNA, 15 bp, Homo sapiens
ggaaatgtaatactg

SEQ ID NO: 3986725 - DNA, 17 bp, Homo sapiens
ggaaattggaagagcac

SEQ ID NO: 3986726 - DNA, 14 bp, Homo sapiens
ggaacacacttgga

SEQ ID NO: 3986727 - DNA, 22 bp, Homo sapiens
ggaacactggtgggcagctgag

SEQ ID NO: 3986728 - DNA, 12 bp, Homo sapiens
ggaacagaagga

SEQ ID NO: 3986729 - DNA, 19 bp, Homo sapiens
ggaacagaatgttttactg

SEQ ID NO: 3986730 - DNA, 14 bp, Homo sapiens
ggaacagaccagtg

SEQ ID NO: 3986731 - DNA, 15 bp, Homo sapiens
ggaacagaccagtga

SEQ ID NO: 3986732 - DNA, 21 bp, Homo sapiens
ggaacagcactggggagtctt

SEQ ID NO: 3986733 - DNA, 20 bp, Homo sapiens
ggaacagctatgggagcccc

SEQ ID NO: 3986734 - DNA, 18 bp, Homo sapiens
ggaacatggagctgtcat

SEQ ID NO: 3986735 - DNA, 19 bp, Homo sapiens
ggaaccacagggccagagg

SEQ ID NO: 3986736 - DNA, 22 bp, Homo sapiens
ggaaccagccccatcagaacct

SEQ ID NO: 3986737 - DNA, 11 bp, Homo sapiens
ggaacccagac

SEQ ID NO: 3986738 - DNA, 18 bp, Homo sapiens
ggaaccccgagctggggg

SEQ ID NO: 3986739 - DNA, 12 bp, Homo sapiens
ggaacctcagcc

SEQ ID NO: 3986740 - DNA, 23 bp, Homo sapiens
ggaacctctgtctcatcctcctg

SEQ ID NO: 3986741 - DNA, 18 bp, Homo sapiens
ggaacctgtgagctgcac

SEQ ID NO: 3986742 - DNA, 12 bp, Homo sapiens
ggaaccttccct

SEQ ID NO: 3986743 - DNA, 16 bp, Homo sapiens
ggaaccttccctccaa

SEQ ID NO: 3986744 - DNA, 19 bp, Homo sapiens
ggaaccttccttcctgctt

SEQ ID NO: 3986745 - DNA, 21 bp, Homo sapiens
ggaaccttccttcctgcttga

SEQ ID NO: 3986746 - DNA, 15 bp, Homo sapiens
ggaacgatgtgtctg

SEQ ID NO: 3986747 - DNA, 23 bp, Homo sapiens
ggaacgtagtcggcacagcctgg

SEQ ID NO: 3986748 - DNA, 14 bp, Homo sapiens
ggaactaaagcaaa

SEQ ID NO: 3986749 - DNA, 23 bp, Homo sapiens
ggaactaggctcttatgtgtgcc

SEQ ID NO: 3986750 - DNA, 19 bp, Homo sapiens
ggaactcagatccagggac

SEQ ID NO: 3986751 - DNA, 16 bp, Homo sapiens
ggaactcctggccttt

SEQ ID NO: 3986752 - DNA, 20 bp, Homo sapiens
ggaactctggcttccaggta

SEQ ID NO: 3986753 - DNA, 23 bp, Homo sapiens
ggaactgagtcacgctggggctc

SEQ ID NO: 3986754 - DNA, 20 bp, Homo sapiens
ggaactggggctttgccttg

SEQ ID NO: 3986755 - DNA, 18 bp, Homo sapiens
ggaactgtccagagagca

SEQ ID NO: 3986756 - DNA, 22 bp, Homo sapiens
ggaacttgcgagtccaaggcca

SEQ ID NO: 3986757 - DNA, 15 bp, Homo sapiens
ggaagaaactgctga

SEQ ID NO: 3986758 - DNA, 13 bp, Homo sapiens
ggaagaagggaga

SEQ ID NO: 3986759 - DNA, 15 bp, Homo sapiens
ggaagaagggagaag

SEQ ID NO: 3986760 - DNA, 16 bp, Homo sapiens
ggaagaagggagaaga

SEQ ID NO: 3986761 - DNA, 17 bp, Homo sapiens
ggaagaatccagtatta

SEQ ID NO: 3986762 - DNA, 13 bp, Homo sapiens
ggaagacatttct

SEQ ID NO: 3986763 - DNA, 16 bp, Homo sapiens
gcagtgttctcacagt

SEQ ID NO: 3986764 - DNA, 19 bp, Homo sapiens
gcagttcagcaccacccta

SEQ ID NO: 3986765 - DNA, 23 bp, Homo sapiens
gcagttcccccaacctcagactt

SEQ ID NO: 3986766 - DNA, 18 bp, Homo sapiens
gcagttctcactcctagg

SEQ ID NO: 3986767 - DNA, 18 bp, Homo sapiens
gcagttgaatttttatat

SEQ ID NO: 3986768 - DNA, 15 bp, Homo sapiens
gcagttgcccagcct

SEQ ID NO: 3986769 - DNA, 16 bp, Homo sapiens
gcagttgcccagcctc

SEQ ID NO: 3986770 - DNA, 16 bp, Homo sapiens
gcagttggcagaaagg

SEQ ID NO: 3986771 - DNA, 13 bp, Homo sapiens
gcagttttaagaa

SEQ ID NO: 3986772 - DNA, 13 bp, Homo sapiens
gcataaatatgca

SEQ ID NO: 3986773 - DNA, 20 bp, Homo sapiens
gcataaatcacttcaactgc

SEQ ID NO: 3986774 - DNA, 18 bp, Homo sapiens
gcataataagctaaagag

SEQ ID NO: 3986775 - DNA, 16 bp, Homo sapiens
gcataatagtcaattt

SEQ ID NO: 3986776 - DNA, 22 bp, Homo sapiens
gcataatgataaaataaataat

SEQ ID NO: 3986777 - DNA, 19 bp, Homo sapiens
gcatacatgcaaaaagaaa

SEQ ID NO: 3986778 - DNA, 18 bp, Homo sapiens
gcatacccaaaccaggtg

SEQ ID NO: 3986779 - DNA, 16 bp, Homo sapiens
gcatagaggcttctcc

SEQ ID NO: 3986780 - DNA, 16 bp, Homo sapiens
gcataggcctgctttg

SEQ ID NO: 3986781 - DNA, 12 bp, Homo sapiens
gcatagtgctgg

SEQ ID NO: 3986782 - DNA, 14 bp, Homo sapiens
gcatatagagatga

SEQ ID NO: 3986783 - DNA, 15 bp, Homo sapiens
gcatatcctgagcca

SEQ ID NO: 3986784 - DNA, 16 bp, Homo sapiens
gcatatcctgagccat

SEQ ID NO: 3986785 - DNA, 23 bp, Homo sapiens
gcatatgggtgggattttgcaaa

SEQ ID NO: 3986786 - DNA, 12 bp, Homo sapiens
gcatatgttgaa

SEQ ID NO: 3986787 - DNA, 15 bp, Homo sapiens
gcatattttgagaaa

SEQ ID NO: 3986788 - DNA, 18 bp, Homo sapiens
gcatcaaccaccatggat

SEQ ID NO: 3986789 - DNA, 21 bp, Homo sapiens
gcatcaaggtcagcatgagga

SEQ ID NO: 3986790 - DNA, 17 bp, Homo sapiens
gcatcaatgtattttat

SEQ ID NO: 3986791 - DNA, 17 bp, Homo sapiens
gcatcacctcaccaagg

SEQ ID NO: 3986792 - DNA, 22 bp, Homo sapiens
gcatcactaaaccgataatgca

SEQ ID NO: 3986793 - DNA, 17 bp, Homo sapiens
gcatcactgggtgttga

SEQ ID NO: 3986794 - DNA, 19 bp, Homo sapiens
gcatcagtccccctgtgca

SEQ ID NO: 3986795 - DNA, 15 bp, Homo sapiens
gcatcattccaggcc

SEQ ID NO: 3986796 - DNA, 12 bp, Homo sapiens
gcatccatacca

SEQ ID NO: 3986797 - DNA, 17 bp, Homo sapiens
gcatccataccagctcg

SEQ ID NO: 3986798 - DNA, 17 bp, Homo sapiens
gcatccatgtgtggact

SEQ ID NO: 3986799 - DNA, 21 bp, Homo sapiens
gcatcccagcacctgcctcct

SEQ ID NO: 3986800 - DNA, 15 bp, Homo sapiens
gcatcccccctgctc

SEQ ID NO: 3986801 - DNA, 17 bp, Homo sapiens
gcatcccccctgctcag

SEQ ID NO: 3986802 - DNA, 12 bp, Homo sapiens
gcatccctgaga

SEQ ID NO: 3986803 - DNA, 13 bp, Homo sapiens
gcatccctggagc

SEQ ID NO: 3986804 - DNA, 17 bp, Homo sapiens
gcatcccttcccacatg

SEQ ID NO: 3986805 - DNA, 14 bp, Homo sapiens
gatttataaacaga

SEQ ID NO: 3986806 - DNA, 16 bp, Homo sapiens
gatttatataaatgta

SEQ ID NO: 3986807 - DNA, 15 bp, Homo sapiens
gatttcagaagccta

SEQ ID NO: 3986808 - DNA, 20 bp, Homo sapiens
gatttcatttcaactgtttg

SEQ ID NO: 3986809 - DNA, 18 bp, Homo sapiens
gatttccctgcagacctc

SEQ ID NO: 3986810 - DNA, 22 bp, Homo sapiens
gatttcctgctttgggaagccg

SEQ ID NO: 3986811 - DNA, 19 bp, Homo sapiens
gatttcctttatactgtga

SEQ ID NO: 3986812 - DNA, 20 bp, Homo sapiens
gatttcctttatactgtgaa

SEQ ID NO: 3986813 - DNA, 14 bp, Homo sapiens
gatttctaatcaaa

SEQ ID NO: 3986814 - DNA, 15 bp, Homo sapiens
gatttcttcagaatt

SEQ ID NO: 3986815 - DNA, 19 bp, Homo sapiens
gatttgaagaacatgtgag

SEQ ID NO: 3986816 - DNA, 20 bp, Homo sapiens
gatttgaagaacatgtgaga

SEQ ID NO: 3986817 - DNA, 13 bp, Homo sapiens
gatttgacattgc

SEQ ID NO: 3986818 - DNA, 15 bp, Homo sapiens
gatttgattcatttt

SEQ ID NO: 3986819 - DNA, 16 bp, Homo sapiens
gatttgattcattttc

SEQ ID NO: 3986820 - DNA, 18 bp, Homo sapiens
gatttgcatggattttgg

SEQ ID NO: 3986821 - DNA, 23 bp, Homo sapiens
gatttgtaggaaggtctcattct

SEQ ID NO: 3986822 - DNA, 17 bp, Homo sapiens
gatttgttgattctctc

SEQ ID NO: 3986823 - DNA, 22 bp, Homo sapiens
gatttgttgccatgtgcacctt

SEQ ID NO: 3986824 - DNA, 12 bp, Homo sapiens
gattttaacaat

SEQ ID NO: 3986825 - DNA, 15 bp, Homo sapiens
gattttaacaataac

SEQ ID NO: 3986826 - DNA, 17 bp, Homo sapiens
gattttaacaataacta

SEQ ID NO: 3986827 - DNA, 17 bp, Homo sapiens
gattttaatcaagttga

SEQ ID NO: 3986828 - DNA, 18 bp, Homo sapiens
gattttaatcaagttgaa

SEQ ID NO: 3986829 - DNA, 22 bp, Homo sapiens
gattttaattttatattcagtg

SEQ ID NO: 3986830 - DNA, 16 bp, Homo sapiens
gattttacaaaagatg

SEQ ID NO: 3986831 - DNA, 19 bp, Homo sapiens
gattttatgatcagtgttg

SEQ ID NO: 3986832 - DNA, 14 bp, Homo sapiens
gattttcatgttct

SEQ ID NO: 3986833 - DNA, 15 bp, Homo sapiens
gattttcatttcatg

SEQ ID NO: 3986834 - DNA, 16 bp, Homo sapiens
gattttcatttcatga

SEQ ID NO: 3986835 - DNA, 23 bp, Homo sapiens
gattttctattatggaaaactgt

SEQ ID NO: 3986836 - DNA, 21 bp, Homo sapiens
gattttctgggcctaaaggat

SEQ ID NO: 3986837 - DNA, 15 bp, Homo sapiens
gatttttaagaactt

SEQ ID NO: 3986838 - DNA, 17 bp, Homo sapiens
gatttttacaagatcca

SEQ ID NO: 3986839 - DNA, 23 bp, Homo sapiens
gatttttctaaccttgaatgctg

SEQ ID NO: 3986840 - DNA, 12 bp, Homo sapiens
gatttttctcaa

SEQ ID NO: 3986841 - DNA, 14 bp, Homo sapiens
gattttttattgct

SEQ ID NO: 3986842 - DNA, 12 bp, Homo sapiens
gattttttccaa

SEQ ID NO: 3986843 - DNA, 14 bp, Homo sapiens
gattttttccaaaa

SEQ ID NO: 3986844 - DNA, 21 bp, Homo sapiens
gatttttttcccaattgagaa

SEQ ID NO: 3986845 - DNA, 13 bp, Homo sapiens
gatttttttcctg

SEQ ID NO: 3986846 - DNA, 22 bp, Homo sapiens
gatttttttgtcattaaaattg

SEQ ID NO: 3986847 - DNA, 18 bp, Homo sapiens
gcaaaaagcaagggagaa

SEQ ID NO: 3986848 - DNA, 18 bp, Homo sapiens
gcaaaaatccgaggtgct

SEQ ID NO: 3986849 - DNA, 20 bp, Homo sapiens
gcaaaacgcatggagtgtgt

SEQ ID NO: 3986850 - DNA, 13 bp, Homo sapiens
gcaaaaggcagct

SEQ ID NO: 3986851 - DNA, 14 bp, Homo sapiens
gcaaaaggcagctc

SEQ ID NO: 3986852 - DNA, 20 bp, Homo sapiens
gcaaaaggttcactaaagca

SEQ ID NO: 3986853 - DNA, 18 bp, Homo sapiens
gcaaaatatgccccttct

SEQ ID NO: 3986854 - DNA, 13 bp, Homo sapiens
gcaaaatatgttt

SEQ ID NO: 3986855 - DNA, 21 bp, Homo sapiens
gcaaaatttgatgccaggaca

SEQ ID NO: 3986856 - DNA, 16 bp, Homo sapiens
gcaaacagaacagggt

SEQ ID NO: 3986857 - DNA, 23 bp, Homo sapiens
gcaaaccagcttgttctgggctc

SEQ ID NO: 3986858 - DNA, 21 bp, Homo sapiens
gcaaacctagccggaaggccg

SEQ ID NO: 3986859 - DNA, 13 bp, Homo sapiens
gcaaacctttccc

SEQ ID NO: 3986860 - DNA, 14 bp, Homo sapiens
gcaaacgctaaaga

SEQ ID NO: 3986861 - DNA, 17 bp, Homo sapiens
gcaaactcactgctcaa

SEQ ID NO: 3986862 - DNA, 21 bp, Homo sapiens
gcaaagataatttatttcaat

SEQ ID NO: 3986863 - DNA, 12 bp, Homo sapiens
gcaaagatcaaa

SEQ ID NO: 3986864 - DNA, 18 bp, Homo sapiens
gcaaagatcaaaataaaa

SEQ ID NO: 3986865 - DNA, 21 bp, Homo sapiens
gcaaagcaccagcttctccag

SEQ ID NO: 3986866 - DNA, 22 bp, Homo sapiens
gcaaagcaccagcttctccagg

SEQ ID NO: 3986867 - DNA, 17 bp, Homo sapiens
gcaaagctgttcttcct

SEQ ID NO: 3986868 - DNA, 19 bp, Homo sapiens
gcaaagggctgaaagccat

SEQ ID NO: 3986869 - DNA, 18 bp, Homo sapiens
gcaaaggtggctctccag

SEQ ID NO: 3986870 - DNA, 13 bp, Homo sapiens
gcaaatcagaaac

SEQ ID NO: 3986871 - DNA, 15 bp, Homo sapiens
gcaaatcagaaactt

SEQ ID NO: 3986872 - DNA, 21 bp, Homo sapiens
gcaaatgggagctgagcagcc

SEQ ID NO: 3986873 - DNA, 22 bp, Homo sapiens
gcaacaacaattggtaaaactc

SEQ ID NO: 3986874 - DNA, 20 bp, Homo sapiens
gcaacaaggtcctctgtcag

SEQ ID NO: 3986875 - DNA, 16 bp, Homo sapiens
gcaacacgcatggtca

SEQ ID NO: 3986876 - DNA, 20 bp, Homo sapiens
gcaacagatctggaacctca

SEQ ID NO: 3986877 - DNA, 21 bp, Homo sapiens
gcaacaggaatcaagagctgc

SEQ ID NO: 3986878 - DNA, 12 bp, Homo sapiens
gcaacaggacag

SEQ ID NO: 3986879 - DNA, 19 bp, Homo sapiens
gcaagactgcaaacttttt

SEQ ID NO: 3986880 - DNA, 22 bp, Homo sapiens
gcaagagggggtggaggggtgt

SEQ ID NO: 3986881 - DNA, 16 bp, Homo sapiens
gcaagatatttatata

SEQ ID NO: 3986882 - DNA, 15 bp, Homo sapiens
gcaagatgtgaatta

SEQ ID NO: 3986883 - DNA, 19 bp, Homo sapiens
gcaagcaacacagaggaat

SEQ ID NO: 3986884 - DNA, 14 bp, Homo sapiens
gcaagcagcgggct

SEQ ID NO: 3986885 - DNA, 13 bp, Homo sapiens
gcaagccacagga

SEQ ID NO: 3986886 - DNA, 11 bp, Homo sapiens
gcaagccagac

SEQ ID NO: 3986887 - DNA, 21 bp, Homo sapiens
gcaagccctacagagctgtgg

SEQ ID NO: 3986888 - DNA, 22 bp, Homo sapiens
gcaagctgccgaaccaaaagaa

SEQ ID NO: 3986889 - DNA, 9 bp, Homo sapiens
gcaaggaaa

SEQ ID NO: 3986890 - DNA, 16 bp, Homo sapiens
gcaaggaaaaacaggt

SEQ ID NO: 3986891 - DNA, 15 bp, Homo sapiens
gcaaggaaggaaaga

SEQ ID NO: 3986892 - DNA, 19 bp, Homo sapiens
gcaaggacattgccccaag

SEQ ID NO: 3986893 - DNA, 22 bp, Homo sapiens
gcaaggacattgccccaagata

SEQ ID NO: 3986894 - DNA, 15 bp, Homo sapiens
gcaaggaccaggact

SEQ ID NO: 3986895 - DNA, 20 bp, Homo sapiens
gcaaggaccaggactccctc

SEQ ID NO: 3986896 - DNA, 18 bp, Homo sapiens
gcaaggactcccggagcc

SEQ ID NO: 3986897 - DNA, 16 bp, Homo sapiens
gcaaggagcacaagcc

SEQ ID NO: 3986898 - DNA, 16 bp, Homo sapiens
gcaaggccctgctgcc

SEQ ID NO: 3986899 - DNA, 22 bp, Homo sapiens
gcaagggcacaagtcctggatg

SEQ ID NO: 3986900 - DNA, 18 bp, Homo sapiens
gcaagggttaaggcctga

SEQ ID NO: 3986901 - DNA, 14 bp, Homo sapiens
gcaagtagataaat

SEQ ID NO: 3986902 - DNA, 11 bp, Homo sapiens
gcaagtcttaa

SEQ ID NO: 3986903 - DNA, 13 bp, Homo sapiens
gcaagtcttaaca

SEQ ID NO: 3986904 - DNA, 22 bp, Homo sapiens
gcaagtgagagagatgggagct

SEQ ID NO: 3986905 - DNA, 14 bp, Homo sapiens
gcaagtgggaccag

SEQ ID NO: 3986906 - DNA, 14 bp, Homo sapiens
gcaagttaagagaa

SEQ ID NO: 3986907 - DNA, 16 bp, Homo sapiens
gcaagttaagagaaac

SEQ ID NO: 3986908 - DNA, 20 bp, Homo sapiens
gcaagttaagagaaacttta

SEQ ID NO: 3986909 - DNA, 16 bp, Homo sapiens
gcaataaatctgaccc

SEQ ID NO: 3986910 - DNA, 18 bp, Homo sapiens
gcaataaatctgacccag

SEQ ID NO: 3986911 - DNA, 21 bp, Homo sapiens
gcaataacttctatattttaa

SEQ ID NO: 3986912 - DNA, 22 bp, Homo sapiens
gcaataacttctatattttaat

SEQ ID NO: 3986913 - DNA, 14 bp, Homo sapiens
gcaataacttctga

SEQ ID NO: 3986914 - DNA, 17 bp, Homo sapiens
gcaataacttctgacct

SEQ ID NO: 3986915 - DNA, 15 bp, Homo sapiens
gcaataagaaatgaa

SEQ ID NO: 3986916 - DNA, 23 bp, Homo sapiens
gcaataagaaatgaacaaaagat

SEQ ID NO: 3986917 - DNA, 13 bp, Homo sapiens
gcaatagtgtgtt

SEQ ID NO: 3986918 - DNA, 20 bp, Homo sapiens
gcaatagtgtgttctgatta

SEQ ID NO: 3986919 - DNA, 15 bp, Homo sapiens
gcaatcaaatctgct

SEQ ID NO: 3986920 - DNA, 19 bp, Homo sapiens
gcaatcaaggttataattt

SEQ ID NO: 3986921 - DNA, 19 bp, Homo sapiens
gcaatcagacaccctctcc

SEQ ID NO: 3986922 - DNA, 15 bp, Homo sapiens
gcaatccacctgcct

SEQ ID NO: 3986923 - DNA, 13 bp, Homo sapiens
gcaatccatgtta

SEQ ID NO: 3986924 - DNA, 21 bp, Homo sapiens
gcaatctccccttgatttaaa

SEQ ID NO: 3986925 - DNA, 23 bp, Homo sapiens
gcaatctcttcattattctctgc

SEQ ID NO: 3986926 - DNA, 19 bp, Homo sapiens
gcaatgacatctcaggggc

SEQ ID NO: 3986927 - DNA, 17 bp, Homo sapiens
gcaatgcttaaactaaa

SEQ ID NO: 3986928 - DNA, 14 bp, Homo sapiens
gcaatgggactgga

SEQ ID NO: 3986929 - DNA, 15 bp, Homo sapiens
gcaatgggactggag

SEQ ID NO: 3986930 - DNA, 23 bp, Homo sapiens
gcaatgggactggagtcagatga

SEQ ID NO: 3986931 - DNA, 20 bp, Homo sapiens
gcaatgggagctgaggccac

SEQ ID NO: 3986932 - DNA, 22 bp, Homo sapiens
gcaatgtcaggaacagaaggat

SEQ ID NO: 3986933 - DNA, 16 bp, Homo sapiens
gcaattaggattttga

SEQ ID NO: 3986934 - DNA, 19 bp, Homo sapiens
gcaattaggtttttcctta

SEQ ID NO: 3986935 - DNA, 18 bp, Homo sapiens
gcaattagtctgaaactg

SEQ ID NO: 3986936 - DNA, 21 bp, Homo sapiens
gcaattcccctctgctgctgt

SEQ ID NO: 3986937 - DNA, 17 bp, Homo sapiens
gcaattccgcatttaat

SEQ ID NO: 3986938 - DNA, 23 bp, Homo sapiens
gcaattctcctgcctcagcctcc

SEQ ID NO: 3986939 - DNA, 17 bp, Homo sapiens
gcaatttctaattttta

SEQ ID NO: 3986940 - DNA, 18 bp, Homo sapiens
gcaatttgtttaaagaat

SEQ ID NO: 3986941 - DNA, 23 bp, Homo sapiens
gcacaaaacccagacctgttagc

SEQ ID NO: 3986942 - DNA, 14 bp, Homo sapiens
gcacaaacacacac

SEQ ID NO: 3986943 - DNA, 17 bp, Homo sapiens
gcacaaacacacacact

SEQ ID NO: 3986944 - DNA, 16 bp, Homo sapiens
gcacaagaatggatca

SEQ ID NO: 3986945 - DNA, 22 bp, Homo sapiens
gcacaagcagagtgcacagctg

SEQ ID NO: 3986946 - DNA, 12 bp, Homo sapiens
gcacacagcagc

SEQ ID NO: 3986947 - DNA, 16 bp, Homo sapiens
gcacacagcagccccc

SEQ ID NO: 3986948 - DNA, 17 bp, Homo sapiens
gcacacagcagcccccc

SEQ ID NO: 3986949 - DNA, 19 bp, Homo sapiens
gcacacagcagccccccag

SEQ ID NO: 3986950 - DNA, 18 bp, Homo sapiens
gcagatacctcaccctgc

SEQ ID NO: 3986951 - DNA, 22 bp, Homo sapiens
gcagatactactgaccagacaa

SEQ ID NO: 3986952 - DNA, 13 bp, Homo sapiens
gcagatctgtgcc

SEQ ID NO: 3986953 - DNA, 22 bp, Homo sapiens
gcagatctgtgccccatgcctg

SEQ ID NO: 3986954 - DNA, 17 bp, Homo sapiens
gcagatgcagagagcca

SEQ ID NO: 3986955 - DNA, 18 bp, Homo sapiens
gcagatgcagagagccat

SEQ ID NO: 3986956 - DNA, 18 bp, Homo sapiens
gcagatgtcttccctggg

SEQ ID NO: 3986957 - DNA, 19 bp, Homo sapiens
gcagatgtcttccctgggc

SEQ ID NO: 3986958 - DNA, 16 bp, Homo sapiens
gcagatgtttgcctca

SEQ ID NO: 3986959 - DNA, 16 bp, Homo sapiens
gcagattttacaaaag

SEQ ID NO: 3986960 - DNA, 16 bp, Homo sapiens
gcagcaaacactccac

SEQ ID NO: 3986961 - DNA, 19 bp, Homo sapiens
gcagcaaggccctgctgcc

SEQ ID NO: 3986962 - DNA, 16 bp, Homo sapiens
gcagcacagtgtgtga

SEQ ID NO: 3986963 - DNA, 17 bp, Homo sapiens
gcagcaccaaccacagc

SEQ ID NO: 3986964 - DNA, 12 bp, Homo sapiens
gcagcaccctcc

SEQ ID NO: 3986965 - DNA, 17 bp, Homo sapiens
gcagcaccgttctgtgc

SEQ ID NO: 3986966 - DNA, 18 bp, Homo sapiens
gcagcaccgttctgtgca

SEQ ID NO: 3986967 - DNA, 12 bp, Homo sapiens
gcagcacctcct

SEQ ID NO: 3986968 - DNA, 21 bp, Homo sapiens
gcagcactccgcatcacctca

SEQ ID NO: 3986969 - DNA, 21 bp, Homo sapiens
gcagcaggaatatatgtgtgc

SEQ ID NO: 3986970 - DNA, 16 bp, Homo sapiens
gcagcatggcatagcc

SEQ ID NO: 3986971 - DNA, 23 bp, Homo sapiens
gcagcattctggaggggagagct

SEQ ID NO: 3986972 - DNA, 13 bp, Homo sapiens
gcagcatttttaa

SEQ ID NO: 3986973 - DNA, 18 bp, Homo sapiens
gcagccacatggccccat

SEQ ID NO: 3986974 - DNA, 19 bp, Homo sapiens
gcagccacgattggagaat

SEQ ID NO: 3986975 - DNA, 12 bp, Homo sapiens
gcagccagcaga

SEQ ID NO: 3986976 - DNA, 13 bp, Homo sapiens
gcagccaggctgc

SEQ ID NO: 3986977 - DNA, 17 bp, Homo sapiens
gcagccaggctgccaag

SEQ ID NO: 3986978 - DNA, 16 bp, Homo sapiens
gcagcccactgcaccg

SEQ ID NO: 3986979 - DNA, 18 bp, Homo sapiens
gcagcccactgcaccgcc

SEQ ID NO: 3986980 - DNA, 13 bp, Homo sapiens
gcagcccagcagt

SEQ ID NO: 3986981 - DNA, 18 bp, Homo sapiens
gcagcccagcagtgtgga

SEQ ID NO: 3986982 - DNA, 22 bp, Homo sapiens
gcagcccatgcccacctgccca

SEQ ID NO: 3986983 - DNA, 13 bp, Homo sapiens
gcagccccagaga

SEQ ID NO: 3986984 - DNA, 15 bp, Homo sapiens
gcagccccagagaga

SEQ ID NO: 3986985 - DNA, 16 bp, Homo sapiens
gcagccccagagagag

SEQ ID NO: 3986986 - DNA, 14 bp, Homo sapiens
gcagccccccagca

SEQ ID NO: 3986987 - DNA, 17 bp, Homo sapiens
gcattgtttgcttattg

SEQ ID NO: 3986988 - DNA, 20 bp, Homo sapiens
gcattgtttgcttattgttc

SEQ ID NO: 3986989 - DNA, 23 bp, Homo sapiens
gcatttaatggcagctagtgcct

SEQ ID NO: 3986990 - DNA, 17 bp, Homo sapiens
gcatttatcattcttgt

SEQ ID NO: 3986991 - DNA, 16 bp, Homo sapiens
gcatttcataaactaa

SEQ ID NO: 3986992 - DNA, 22 bp, Homo sapiens
gcatttccaacaccacagacac

SEQ ID NO: 3986993 - DNA, 15 bp, Homo sapiens
gcatttccagctgtg

SEQ ID NO: 3986994 - DNA, 18 bp, Homo sapiens
gcatttccagctgtgcag

SEQ ID NO: 3986995 - DNA, 21 bp, Homo sapiens
gcatttcctatcacctatttc

SEQ ID NO: 3986996 - DNA, 16 bp, Homo sapiens
gcatttccttgtcccg

SEQ ID NO: 3986997 - DNA, 19 bp, Homo sapiens
gcatttctgaatagaaatg

SEQ ID NO: 3986998 - DNA, 13 bp, Homo sapiens
gcatttgtcaatg

SEQ ID NO: 3986999 - DNA, 12 bp, Homo sapiens
gcatttgttcac

SEQ ID NO: 3987000 - DNA, 17 bp, Homo sapiens
gcatttgttcagctccc

SEQ ID NO: 3987001 - DNA, 18 bp, Homo sapiens
gcatttgttcagctcccc

SEQ ID NO: 3987002 - DNA, 13 bp, Homo sapiens
gcattttgctatt

SEQ ID NO: 3987003 - DNA, 23 bp, Homo sapiens
gcatttttaattttcacaaaatg

SEQ ID NO: 3987004 - DNA, 16 bp, Homo sapiens
gcatttttttattcag

SEQ ID NO: 3987005 - DNA, 19 bp, Homo sapiens
gccaaaaccaggcctctgc

SEQ ID NO: 3987006 - DNA, 22 bp, Homo sapiens
gccaaaaccaggcctctgctgc

SEQ ID NO: 3987007 - DNA, 14 bp, Homo sapiens
gccaaaagcttccc

SEQ ID NO: 3987008 - DNA, 17 bp, Homo sapiens
gccaaacccttgctttc

SEQ ID NO: 3987009 - DNA, 20 bp, Homo sapiens
gccaaactgtccctcccttg

SEQ ID NO: 3987010 - DNA, 23 bp, Homo sapiens
gccaaactgtccctcccttgctg

SEQ ID NO: 3987011 - DNA, 19 bp, Homo sapiens
gccaaagacttagtatatt

SEQ ID NO: 3987012 - DNA, 19 bp, Homo sapiens
gccaaagggaaatatcatt

SEQ ID NO: 3987013 - DNA, 12 bp, Homo sapiens
gccaaagtgtta

SEQ ID NO: 3987014 - DNA, 12 bp, Homo sapiens
gccaaatgctgg

SEQ ID NO: 3987015 - DNA, 16 bp, Homo sapiens
gccaacaggtggcagg

SEQ ID NO: 3987016 - DNA, 22 bp, Homo sapiens
gccaacatcgtgaaaccctgtc

SEQ ID NO: 3987017 - DNA, 14 bp, Homo sapiens
gccaaccctgggct

SEQ ID NO: 3987018 - DNA, 19 bp, Homo sapiens
gccaaccctgggctattgc

SEQ ID NO: 3987019 - DNA, 14 bp, Homo sapiens
gccaactcctcaca

SEQ ID NO: 3987020 - DNA, 17 bp, Homo sapiens
gccaactgccaggctgc

SEQ ID NO: 3987021 - DNA, 22 bp, Homo sapiens
gccaacttgagggcccagagca

SEQ ID NO: 3987022 - DNA, 23 bp, Homo sapiens
gccaacttgagggcccagagcag

SEQ ID NO: 3987023 - DNA, 13 bp, Homo sapiens
gccaacttgtaaa

SEQ ID NO: 3987024 - DNA, 20 bp, Homo sapiens
gccaagaaaagggctgacat

SEQ ID NO: 3987025 - DNA, 22 bp, Homo sapiens
gccaagaaacgtcttctaaact

SEQ ID NO: 3987026 - DNA, 14 bp, Homo sapiens
gccaagaatacttg

SEQ ID NO: 3987027 - DNA, 16 bp, Homo sapiens
gccaagacaaggaggt

SEQ ID NO: 3987028 - DNA, 15 bp, Homo sapiens
gccaagattttcctc

SEQ ID NO: 3987029 - DNA, 23 bp, Homo sapiens
gccaagattttcctcttgtgatt

SEQ ID NO: 3987030 - DNA, 12 bp, Homo sapiens
gccaaggcagcg

SEQ ID NO: 3987031 - DNA, 20 bp, Homo sapiens
gccaaggccagagtggcctg

SEQ ID NO: 3987032 - DNA, 23 bp, Homo sapiens
gccaaggggtgggcctgtgaatc

SEQ ID NO: 3987033 - DNA, 16 bp, Homo sapiens
gccaagtaaacagggt

SEQ ID NO: 3987034 - DNA, 19 bp, Homo sapiens
gccaagtaaacagggtacc

SEQ ID NO: 3987035 - DNA, 20 bp, Homo sapiens
gccaagtaaacagggtacct

SEQ ID NO: 3987036 - DNA, 16 bp, Homo sapiens
gccaagtataattttt

SEQ ID NO: 3987037 - DNA, 19 bp, Homo sapiens
gccaagtgcgtgccgtgtg

SEQ ID NO: 3987038 - DNA, 23 bp, Homo sapiens
gccaagtgcgtgccgtgtgagtg

SEQ ID NO: 3987039 - DNA, 19 bp, Homo sapiens
gccaagtggggtgctggga

SEQ ID NO: 3987040 - DNA, 20 bp, Homo sapiens
gccaagtggggtgctgggag

SEQ ID NO: 3987041 - DNA, 10 bp, Homo sapiens
gccaataaaa

SEQ ID NO: 3987042 - DNA, 14 bp, Homo sapiens
gccaataaaaagtt

SEQ ID NO: 3987043 - DNA, 14 bp, Homo sapiens
gccagcaaggcagg

SEQ ID NO: 3987044 - DNA, 13 bp, Homo sapiens
gccagcacacagg

SEQ ID NO: 3987045 - DNA, 18 bp, Homo sapiens
gccagcacacagggcagt

SEQ ID NO: 3987046 - DNA, 18 bp, Homo sapiens
gccagcaccacttccttt

SEQ ID NO: 3987047 - DNA, 12 bp, Homo sapiens
gccagcaccctc

SEQ ID NO: 3987048 - DNA, 13 bp, Homo sapiens
gccagcaccctct

SEQ ID NO: 3987049 - DNA, 15 bp, Homo sapiens
gccagcaccctctcc

SEQ ID NO: 3987050 - DNA, 16 bp, Homo sapiens
gccagcaccctctcct

SEQ ID NO: 3987051 - DNA, 20 bp, Homo sapiens
gccagcaccctctcctgggg

SEQ ID NO: 3987052 - DNA, 21 bp, Homo sapiens
gccagcaccctctcctggggg

SEQ ID NO: 3987053 - DNA, 14 bp, Homo sapiens
gccagcacttgtcc

SEQ ID NO: 3987054 - DNA, 22 bp, Homo sapiens
gccagcagccccgtctgcccac

SEQ ID NO: 3987055 - DNA, 13 bp, Homo sapiens
gccagcccagaac

SEQ ID NO: 3987056 - DNA, 16 bp, Homo sapiens
gccagcccagaacacc

SEQ ID NO: 3987057 - DNA, 16 bp, Homo sapiens
gccagcccagaggccg

SEQ ID NO: 3987058 - DNA, 11 bp, Homo sapiens
gccagcccagc

SEQ ID NO: 3987059 - DNA, 15 bp, Homo sapiens
gccagcccagccagg

SEQ ID NO: 3987060 - DNA, 13 bp, Homo sapiens
gccagccccaccc

SEQ ID NO: 3987061 - DNA, 19 bp, Homo sapiens
gccagccccacccaggagg

SEQ ID NO: 3987062 - DNA, 21 bp, Homo sapiens
gccagccccggccctgggctc

SEQ ID NO: 3987063 - DNA, 20 bp, Homo sapiens
gccagcccctcttccccaat

SEQ ID NO: 3987064 - DNA, 11 bp, Homo sapiens
gccagcccctg

SEQ ID NO: 3987065 - DNA, 20 bp, Homo sapiens
gccagcccctggccccagga

SEQ ID NO: 3987066 - DNA, 15 bp, Homo sapiens
gccagcccctggggc

SEQ ID NO: 3987067 - DNA, 18 bp, Homo sapiens
gccagcccctggggccca

SEQ ID NO: 3987068 - DNA, 16 bp, Homo sapiens
gccagccgccctgggc

SEQ ID NO: 3987069 - DNA, 18 bp, Homo sapiens
gccagccgtgatgctcag

SEQ ID NO: 3987070 - DNA, 20 bp, Homo sapiens
gccagccgtgatgctcaggc

SEQ ID NO: 3987071 - DNA, 22 bp, Homo sapiens
gccagccttgagccctggctgt

SEQ ID NO: 3987072 - DNA, 14 bp, Homo sapiens
gccagcgggcacag

SEQ ID NO: 3987073 - DNA, 16 bp, Homo sapiens
gccagcgggcacaggg

SEQ ID NO: 3987074 - DNA, 14 bp, Homo sapiens
gccagcgtcccagg

SEQ ID NO: 3987075 - DNA, 15 bp, Homo sapiens
gccagcgtcccaggg

SEQ ID NO: 3987076 - DNA, 19 bp, Homo sapiens
gccagcgtcccagggtacc

SEQ ID NO: 3987077 - DNA, 17 bp, Homo sapiens
gccagctcacagtgctg

SEQ ID NO: 3987078 - DNA, 14 bp, Homo sapiens
gccagctgcactga

SEQ ID NO: 3987079 - DNA, 20 bp, Homo sapiens
gccagctgcactgatgctgc

SEQ ID NO: 3987080 - DNA, 20 bp, Homo sapiens
gccagctgcaggaatcaaaa

SEQ ID NO: 3987081 - DNA, 21 bp, Homo sapiens
gccagctgccctatgggcctg

SEQ ID NO: 3987082 - DNA, 14 bp, Homo sapiens
gccagctgggagca

SEQ ID NO: 3987083 - DNA, 14 bp, Homo sapiens
gccagctgtgtcct

SEQ ID NO: 3987084 - DNA, 13 bp, Homo sapiens
gccagcttctctc

SEQ ID NO: 3987085 - DNA, 15 bp, Homo sapiens
gccagcttctctctc

SEQ ID NO: 3987086 - DNA, 16 bp, Homo sapiens
gccagcttctctctcc

SEQ ID NO: 3987087 - DNA, 18 bp, Homo sapiens
gccagcttctctctccag

SEQ ID NO: 3987088 - DNA, 19 bp, Homo sapiens
gccagcttctctctccagg

SEQ ID NO: 3987089 - DNA, 21 bp, Homo sapiens
gccaggaatttcccaggaccc

SEQ ID NO: 3987090 - DNA, 22 bp, Homo sapiens
gccaggaatttcccaggaccct

SEQ ID NO: 3987091 - DNA, 23 bp, Homo sapiens
gccaggaatttcccaggaccctg

SEQ ID NO: 3987092 - DNA, 21 bp, Homo sapiens
gcccaagcttaatagccctcc

SEQ ID NO: 3987093 - DNA, 22 bp, Homo sapiens
gcccaagcttaatagccctccc

SEQ ID NO: 3987094 - DNA, 23 bp, Homo sapiens
gcccaagcttaatagccctcccc

SEQ ID NO: 3987095 - DNA, 18 bp, Homo sapiens
gcccaagcttccctccat

SEQ ID NO: 3987096 - DNA, 15 bp, Homo sapiens
gcccaaggcggcccc

SEQ ID NO: 3987097 - DNA, 18 bp, Homo sapiens
gcccaaggcggcccctcc

SEQ ID NO: 3987098 - DNA, 14 bp, Homo sapiens
gcccaaggctcccg

SEQ ID NO: 3987099 - DNA, 18 bp, Homo sapiens
gcccaatattataatttt

SEQ ID NO: 3987100 - DNA, 14 bp, Homo sapiens
gcccaattggagga

SEQ ID NO: 3987101 - DNA, 18 bp, Homo sapiens
gcccacagacagatccca

SEQ ID NO: 3987102 - DNA, 19 bp, Homo sapiens
gcccacagggaaccctgct

SEQ ID NO: 3987103 - DNA, 22 bp, Homo sapiens
gcccacatccggggccagctcc

SEQ ID NO: 3987104 - DNA, 14 bp, Homo sapiens
gcccaccagacgtc

SEQ ID NO: 3987105 - DNA, 21 bp, Homo sapiens
gcccaccagacgtcaggccct

SEQ ID NO: 3987106 - DNA, 13 bp, Homo sapiens
gcccaccattccc

SEQ ID NO: 3987107 - DNA, 22 bp, Homo sapiens
gcccaccccagcctcgcctgtc

SEQ ID NO: 3987108 - DNA, 17 bp, Homo sapiens
gcccaccccctgccctg

SEQ ID NO: 3987109 - DNA, 22 bp, Homo sapiens
gcccaccccctgccctgcacgt

SEQ ID NO: 3987110 - DNA, 11 bp, Homo sapiens
gcccacccctc

SEQ ID NO: 3987111 - DNA, 12 bp, Homo sapiens
gcccacccctca

SEQ ID NO: 3987112 - DNA, 16 bp, Homo sapiens
gcccacccctcactcc

SEQ ID NO: 3987113 - DNA, 18 bp, Homo sapiens
gcccacccctcactcccc

SEQ ID NO: 3987114 - DNA, 14 bp, Homo sapiens
gcccacctgcccat

SEQ ID NO: 3987115 - DNA, 20 bp, Homo sapiens
gcccacctgcccatcacagg

SEQ ID NO: 3987116 - DNA, 15 bp, Homo sapiens
gcccactcctgctct

SEQ ID NO: 3987117 - DNA, 21 bp, Homo sapiens
gcccactgctggtgccagggt

SEQ ID NO: 3987118 - DNA, 23 bp, Homo sapiens
gcccactgctggtgccagggtgg

SEQ ID NO: 3987119 - DNA, 21 bp, Homo sapiens
gcccactgtcctgggcctgca

SEQ ID NO: 3987120 - DNA, 11 bp, Homo sapiens
gcccagaactg

SEQ ID NO: 3987121 - DNA, 18 bp, Homo sapiens
gcccagaactgcccccac

SEQ ID NO: 3987122 - DNA, 16 bp, Homo sapiens
gcccagacccctctgg

SEQ ID NO: 3987123 - DNA, 15 bp, Homo sapiens
gcccagactacaggg

SEQ ID NO: 3987124 - DNA, 20 bp, Homo sapiens
gcccagactctgagctgctc

SEQ ID NO: 3987125 - DNA, 10 bp, Homo sapiens
gcccagagac

SEQ ID NO: 3987126 - DNA, 12 bp, Homo sapiens
gcccagagccac

SEQ ID NO: 3987127 - DNA, 14 bp, Homo sapiens
gcccagagccacct

SEQ ID NO: 3987128 - DNA, 15 bp, Homo sapiens
gcccagagccacctg

SEQ ID NO: 3987129 - DNA, 16 bp, Homo sapiens
gcccagagccacctgg

SEQ ID NO: 3987130 - DNA, 15 bp, Homo sapiens
gcccagagcccagct

SEQ ID NO: 3987131 - DNA, 17 bp, Homo sapiens
gcccagagcccagctcc

SEQ ID NO: 3987132 - DNA, 20 bp, Homo sapiens
gcccagatgtgtccccccca

SEQ ID NO: 3987133 - DNA, 22 bp, Homo sapiens
gcccagcagtgtggagaccctg

SEQ ID NO: 3987134 - DNA, 11 bp, Homo sapiens
gcccagccagg

SEQ ID NO: 3987135 - DNA, 17 bp, Homo sapiens
gcccagccaggagcaga

SEQ ID NO: 3987136 - DNA, 14 bp, Homo sapiens
gacacacatgggca

SEQ ID NO: 3987137 - DNA, 21 bp, Homo sapiens
gacacaccccacaccccagcc

SEQ ID NO: 3987138 - DNA, 15 bp, Homo sapiens
gacacagacccagga

SEQ ID NO: 3987139 - DNA, 21 bp, Homo sapiens
gacacagcagcttcaccagag

SEQ ID NO: 3987140 - DNA, 23 bp, Homo sapiens
gacacagcagcttcaccagagca

SEQ ID NO: 3987141 - DNA, 19 bp, Homo sapiens
gacacattggaatgccttg

SEQ ID NO: 3987142 - DNA, 20 bp, Homo sapiens
gacacattggaatgccttgg

SEQ ID NO: 3987143 - DNA, 15 bp, Homo sapiens
gacaccaaagccacc

SEQ ID NO: 3987144 - DNA, 23 bp, Homo sapiens
gacaccaaccgacaggccctggc

SEQ ID NO: 3987145 - DNA, 18 bp, Homo sapiens
gacaccagaaagccctct

SEQ ID NO: 3987146 - DNA, 13 bp, Homo sapiens
gacaccagagcag

SEQ ID NO: 3987147 - DNA, 14 bp, Homo sapiens
gacaccagagcaga

SEQ ID NO: 3987148 - DNA, 18 bp, Homo sapiens
gacaccagagcagatgca

SEQ ID NO: 3987149 - DNA, 18 bp, Homo sapiens
gacacccaccctgtgcca

SEQ ID NO: 3987150 - DNA, 23 bp, Homo sapiens
gacacccaccctgtgccatcacc

SEQ ID NO: 3987151 - DNA, 12 bp, Homo sapiens
gacacccagaaa

SEQ ID NO: 3987152 - DNA, 13 bp, Homo sapiens
gacaccccctccc

SEQ ID NO: 3987153 - DNA, 18 bp, Homo sapiens
gacacccctacacacacc

SEQ ID NO: 3987154 - DNA, 14 bp, Homo sapiens
gacacccctgctct

SEQ ID NO: 3987155 - DNA, 21 bp, Homo sapiens
gacaccccttatccaggactc

SEQ ID NO: 3987156 - DNA, 21 bp, Homo sapiens
gacaccctggcctgaactgag

SEQ ID NO: 3987157 - DNA, 13 bp, Homo sapiens
gacacctcttttt

SEQ ID NO: 3987158 - DNA, 15 bp, Homo sapiens
gacacctgccctgcc

SEQ ID NO: 3987159 - DNA, 16 bp, Homo sapiens
gacacctttaacacag

SEQ ID NO: 3987160 - DNA, 23 bp, Homo sapiens
gacacctttaacacagaccccta

SEQ ID NO: 3987161 - DNA, 16 bp, Homo sapiens
gacacgctcgcgggca

SEQ ID NO: 3987162 - DNA, 22 bp, Homo sapiens
gacactaccccatatacacctg

SEQ ID NO: 3987163 - DNA, 20 bp, Homo sapiens
gacactatagtttaaaacac

SEQ ID NO: 3987164 - DNA, 16 bp, Homo sapiens
gacactccagtgccag

SEQ ID NO: 3987165 - DNA, 21 bp, Homo sapiens
gacactccccgaagtcttttg

SEQ ID NO: 3987166 - DNA, 14 bp, Homo sapiens
gacactcctagaga

SEQ ID NO: 3987167 - DNA, 19 bp, Homo sapiens
gacactgaaagttttgtaa

SEQ ID NO: 3987168 - DNA, 22 bp, Homo sapiens
gacactgagccccacctctcca

SEQ ID NO: 3987169 - DNA, 13 bp, Homo sapiens
gacactggcccct

SEQ ID NO: 3987170 - DNA, 17 bp, Homo sapiens
gagggggagtagccaag

SEQ ID NO: 3987171 - DNA, 17 bp, Homo sapiens
gagggggcttgaagcca

SEQ ID NO: 3987172 - DNA, 22 bp, Homo sapiens
gaggggggccaaggtcctgctc

SEQ ID NO: 3987173 - DNA, 13 bp, Homo sapiens
gagggggtggagg

SEQ ID NO: 3987174 - DNA, 18 bp, Homo sapiens
gaggggtaggcagagcct

SEQ ID NO: 3987175 - DNA, 16 bp, Homo sapiens
gaggggtctcggatga

SEQ ID NO: 3987176 - DNA, 15 bp, Homo sapiens
gaggggtgggctggt

SEQ ID NO: 3987177 - DNA, 14 bp, Homo sapiens
gaggggtgtggcag

SEQ ID NO: 3987178 - DNA, 17 bp, Homo sapiens
gaggggtgtggcagtgg

SEQ ID NO: 3987179 - DNA, 19 bp, Homo sapiens
gagtccagggtttctctgc

SEQ ID NO: 3987180 - DNA, 14 bp, Homo sapiens
gagtccagtgctct

SEQ ID NO: 3987181 - DNA, 19 bp, Homo sapiens
gagtccagtgctctgcctc

SEQ ID NO: 3987182 - DNA, 15 bp, Homo sapiens
gagtccattctccca

SEQ ID NO: 3987183 - DNA, 17 bp, Homo sapiens
gagtccattctcccagg

SEQ ID NO: 3987184 - DNA, 16 bp, Homo sapiens
gagtcccaaggaaagc

SEQ ID NO: 3987185 - DNA, 16 bp, Homo sapiens
gagtcccctcacctcc

SEQ ID NO: 3987186 - DNA, 19 bp, Homo sapiens
gagtcccctcacctcctct

SEQ ID NO: 3987187 - DNA, 20 bp, Homo sapiens
gagtccctacctgcttcacg

SEQ ID NO: 3987188 - DNA, 22 bp, Homo sapiens
gagtcctccagaactcttcctc

SEQ ID NO: 3987189 - DNA, 17 bp, Homo sapiens
gagtcctctagcaggcc

SEQ ID NO: 3987190 - DNA, 20 bp, Homo sapiens
gagtctagcactcattttct

SEQ ID NO: 3987191 - DNA, 15 bp, Homo sapiens
gataatttatttcaa

SEQ ID NO: 3987192 - DNA, 13 bp, Homo sapiens
gatacacacacac

SEQ ID NO: 3987193 - DNA, 22 bp, Homo sapiens
gatacactgaagttaacagaga

SEQ ID NO: 3987194 - DNA, 19 bp, Homo sapiens
gatacagttttcagaaaaa

SEQ ID NO: 3987195 - DNA, 13 bp, Homo sapiens
gatacataataaa

SEQ ID NO: 3987196 - DNA, 16 bp, Homo sapiens
gatacatatactgatt

SEQ ID NO: 3987197 - DNA, 21 bp, Homo sapiens
gatacatcactgcttgatgaa

SEQ ID NO: 3987198 - DNA, 17 bp, Homo sapiens
gatacatccaaagcaga

SEQ ID NO: 3987199 - DNA, 20 bp, Homo sapiens
gatacatccaaagcagacag

SEQ ID NO: 3987200 - DNA, 23 bp, Homo sapiens
gatacatccaaagcagacagctc

SEQ ID NO: 3987201 - DNA, 14 bp, Homo sapiens
gataccagaaggga

SEQ ID NO: 3987202 - DNA, 18 bp, Homo sapiens
gatacccaggaccaagcc

SEQ ID NO: 3987203 - DNA, 20 bp, Homo sapiens
gatacccatagcttccatga

SEQ ID NO: 3987204 - DNA, 13 bp, Homo sapiens
gatacctggagca

SEQ ID NO: 3987205 - DNA, 22 bp, Homo sapiens
gatacgctactataaagagaag

SEQ ID NO: 3987206 - DNA, 19 bp, Homo sapiens
gatacgtagttgtgctttt

SEQ ID NO: 3987207 - DNA, 23 bp, Homo sapiens
gatactgctactgtaattttata

SEQ ID NO: 3987208 - DNA, 14 bp, Homo sapiens
gatactggaagttt

SEQ ID NO: 3987209 - DNA, 16 bp, Homo sapiens
gatactggaagttttg

SEQ ID NO: 3987210 - DNA, 16 bp, Homo sapiens
gatacttatttttctg

SEQ ID NO: 3987211 - DNA, 18 bp, Homo sapiens
gatacttcatttaaaaaa

SEQ ID NO: 3987212 - DNA, 20 bp, Homo sapiens
gatacttggatttagtttca

SEQ ID NO: 3987213 - DNA, 20 bp, Homo sapiens
gatagaaataaatagctata

SEQ ID NO: 3987214 - DNA, 14 bp, Homo sapiens
gatagagctgggtg

SEQ ID NO: 3987215 - DNA, 15 bp, Homo sapiens
gatagagctgggtgg

SEQ ID NO: 3987216 - DNA, 13 bp, Homo sapiens
gatagagttccat

SEQ ID NO: 3987217 - DNA, 17 bp, Homo sapiens
gatagatgctggcccag

SEQ ID NO: 3987218 - DNA, 19 bp, Homo sapiens
gatagctgcatgtggcttt

SEQ ID NO: 3987219 - DNA, 20 bp, Homo sapiens
gatagctttattttttaagt

SEQ ID NO: 3987220 - DNA, 15 bp, Homo sapiens
gataggaaactgaag

SEQ ID NO: 3987221 - DNA, 21 bp, Homo sapiens
gataggcccaaggtcccctcc

SEQ ID NO: 3987222 - DNA, 12 bp, Homo sapiens
gataggctctgc

SEQ ID NO: 3987223 - DNA, 13 bp, Homo sapiens
gataggctctgca

SEQ ID NO: 3987224 - DNA, 20 bp, Homo sapiens
gataggctctgcacagatgg

SEQ ID NO: 3987225 - DNA, 15 bp, Homo sapiens
gatataaatggctgg

SEQ ID NO: 3987226 - DNA, 17 bp, Homo sapiens
gatatacagatgaaaat

SEQ ID NO: 3987227 - DNA, 19 bp, Homo sapiens
gatatacagatgaaaattt

SEQ ID NO: 3987228 - DNA, 18 bp, Homo sapiens
gatatacttttttcttat

SEQ ID NO: 3987229 - DNA, 21 bp, Homo sapiens
gatataggtttttctcatgta

SEQ ID NO: 3987230 - DNA, 20 bp, Homo sapiens
gatatagtgatggggctcag

SEQ ID NO: 3987231 - DNA, 21 bp, Homo sapiens
gatatatcatgagtgaataaa

SEQ ID NO: 3987232 - DNA, 17 bp, Homo sapiens
gatatcaaaattctagc

SEQ ID NO: 3987233 - DNA, 14 bp, Homo sapiens
gatatccatctttt

SEQ ID NO: 3987234 - DNA, 16 bp, Homo sapiens
gatatccttatcagag

SEQ ID NO: 3987235 - DNA, 20 bp, Homo sapiens
gatatctagctagtaatata

SEQ ID NO: 3987236 - DNA, 14 bp, Homo sapiens
gatatgattggcaa

SEQ ID NO: 3987237 - DNA, 12 bp, Homo sapiens
gatatggctgcc

SEQ ID NO: 3987238 - DNA, 15 bp, Homo sapiens
gatatggctgcccag

SEQ ID NO: 3987239 - DNA, 20 bp, Homo sapiens
gatatggctgcccaggagac

SEQ ID NO: 3987240 - DNA, 16 bp, Homo sapiens
gatatggtgcagagaa

SEQ ID NO: 3987241 - DNA, 24 bp, Homo sapiens
gatatggtgcagagaagctggact

SEQ ID NO: 3987242 - DNA, 19 bp, Homo sapiens
gatatgtaaacataattct

SEQ ID NO: 3987243 - DNA, 16 bp, Homo sapiens
gatattaaaggagtta

SEQ ID NO: 3987244 - DNA, 20 bp, Homo sapiens
gatattagttaatgagccat

SEQ ID NO: 3987245 - DNA, 18 bp, Homo sapiens
gatattataagggagagc

SEQ ID NO: 3987246 - DNA, 19 bp, Homo sapiens
gatattccatgaatgtatc

SEQ ID NO: 3987247 - DNA, 21 bp, Homo sapiens
gatattccatgaatgtatcag

SEQ ID NO: 3987248 - DNA, 20 bp, Homo sapiens
gatattccccccacttaaga

SEQ ID NO: 3987249 - DNA, 18 bp, Homo sapiens
gatattgtacataaaaga

SEQ ID NO: 3987250 - DNA, 17 bp, Homo sapiens
gatattgtgaagtacat

SEQ ID NO: 3987251 - DNA, 13 bp, Homo sapiens
gatattgttcaaa

SEQ ID NO: 3987252 - DNA, 21 bp, Homo sapiens
gatattgttttctgtaaataa

SEQ ID NO: 3987253 - DNA, 22 bp, Homo sapiens
gatattgttttctgtaaataac

SEQ ID NO: 3987254 - DNA, 16 bp, Homo sapiens
gatatttaagaaaata

SEQ ID NO: 3987255 - DNA, 19 bp, Homo sapiens
gatatttccatttcttcct

SEQ ID NO: 3987256 - DNA, 20 bp, Homo sapiens
gatatttccatttcttcctc

SEQ ID NO: 3987257 - DNA, 22 bp, Homo sapiens
gatatttccatttcttcctcac

SEQ ID NO: 3987258 - DNA, 18 bp, Homo sapiens
gatattttcaaattgtat

SEQ ID NO: 3987259 - DNA, 23 bp, Homo sapiens
gatattttcaacgcagccctgct

SEQ ID NO: 3987260 - DNA, 11 bp, Homo sapiens
gatatttttgt

SEQ ID NO: 3987261 - DNA, 17 bp, Homo sapiens
gatatttttgtacttga

SEQ ID NO: 3987262 - DNA, 21 bp, Homo sapiens
gatatttttgtacttgatttg

SEQ ID NO: 3987263 - DNA, 14 bp, Homo sapiens
gatcaaaaggccca

SEQ ID NO: 3987264 - DNA, 23 bp, Homo sapiens
gatcaaaaggttaataaagtaat

SEQ ID NO: 3987265 - DNA, 17 bp, Homo sapiens
gatcaaaataaaaagtg

SEQ ID NO: 3987266 - DNA, 22 bp, Homo sapiens
gatcaaaataaaaagtgacaca

SEQ ID NO: 3987267 - DNA, 18 bp, Homo sapiens
gatcaacgcctcactgaa

SEQ ID NO: 3987268 - DNA, 19 bp, Homo sapiens
gatcaataaaatgtgattt

SEQ ID NO: 3987269 - DNA, 18 bp, Homo sapiens
gatcaattccctctctca

SEQ ID NO: 3987270 - DNA, 14 bp, Homo sapiens
gatcacagcctcca

SEQ ID NO: 3987271 - DNA, 17 bp, Homo sapiens
gatcacagcctccaggg

SEQ ID NO: 3987272 - DNA, 19 bp, Homo sapiens
gatcacagcctccagggcc

SEQ ID NO: 3987273 - DNA, 14 bp, Homo sapiens
gatcaccagcccgg

SEQ ID NO: 3987274 - DNA, 22 bp, Homo sapiens
gatcaccagcccggcctgctcc

SEQ ID NO: 3987275 - DNA, 17 bp, Homo sapiens
gatcacgacgctgcaga

SEQ ID NO: 3987276 - DNA, 17 bp, Homo sapiens
gatcactgaatttataa

SEQ ID NO: 3987277 - DNA, 18 bp, Homo sapiens
gatcactggctggcctga

SEQ ID NO: 3987278 - DNA, 16 bp, Homo sapiens
gatcagaggtgtacac

SEQ ID NO: 3987279 - DNA, 14 bp, Homo sapiens
gatcagcatctgtg

SEQ ID NO: 3987280 - DNA, 18 bp, Homo sapiens
gatcagggaatccagctc

SEQ ID NO: 3987281 - DNA, 19 bp, Homo sapiens
gatcagggaatccagctcc

SEQ ID NO: 3987282 - DNA, 15 bp, Homo sapiens
gatcataagtgaatt

SEQ ID NO: 3987283 - DNA, 17 bp, Homo sapiens
gatcataagtgaattta

SEQ ID NO: 3987284 - DNA, 15 bp, Homo sapiens
gatcatagctcactg

SEQ ID NO: 3987285 - DNA, 17 bp, Homo sapiens
gatcatagctcactgca

SEQ ID NO: 3987286 - DNA, 22 bp, Homo sapiens
gatcatagctcactgcagcctc

SEQ ID NO: 3987287 - DNA, 14 bp, Homo sapiens
gatcatcgccagag

SEQ ID NO: 3987288 - DNA, 19 bp, Homo sapiens
gatcatcgccagaggtgct

SEQ ID NO: 3987289 - DNA, 13 bp, Homo sapiens
gatcatgcattgt

SEQ ID NO: 3987290 - DNA, 15 bp, Homo sapiens
gatcatgcattgttg

SEQ ID NO: 3987291 - DNA, 18 bp, Homo sapiens
gatcatggtgtaataaga

SEQ ID NO: 3987292 - DNA, 21 bp, Homo sapiens
gatcatggtgtaataagacat

SEQ ID NO: 3987293 - DNA, 14 bp, Homo sapiens
gatcattttccccc

SEQ ID NO: 3987294 - DNA, 23 bp, Homo sapiens
gatgtaatttagggtactaaatt

SEQ ID NO: 3987295 - DNA, 17 bp, Homo sapiens
gatgtagagagaacagg

SEQ ID NO: 3987296 - DNA, 22 bp, Homo sapiens
gatgtcccagtgctcaccagcc

SEQ ID NO: 3987297 - DNA, 20 bp, Homo sapiens
gatgtccctgggccagggtc

SEQ ID NO: 3987298 - DNA, 21 bp, Homo sapiens
gatgtccctttcttggccagt

SEQ ID NO: 3987299 - DNA, 14 bp, Homo sapiens
gatgtctaatagtt

SEQ ID NO: 3987300 - DNA, 13 bp, Homo sapiens
gatgtctctgggg

SEQ ID NO: 3987301 - DNA, 13 bp, Homo sapiens
gatgtcttggaac

SEQ ID NO: 3987302 - DNA, 14 bp, Homo sapiens
gatgtcttttcttg

SEQ ID NO: 3987303 - DNA, 13 bp, Homo sapiens
gatgtgaagccaa

SEQ ID NO: 3987304 - DNA, 18 bp, Homo sapiens
gatgtgaattattgacac

SEQ ID NO: 3987305 - DNA, 22 bp, Homo sapiens
gatgtgaattattgacactgaa

SEQ ID NO: 3987306 - DNA, 23 bp, Homo sapiens
gatgtgaattgcctgcagagaga

SEQ ID NO: 3987307 - DNA, 11 bp, Homo sapiens
gatgtgacttt

SEQ ID NO: 3987308 - DNA, 21 bp, Homo sapiens
gatgtgagccaccgtgcctgg

SEQ ID NO: 3987309 - DNA, 11 bp, Homo sapiens
gatgtgatata

SEQ ID NO: 3987310 - DNA, 23 bp, Homo sapiens
gatgtgcatttttgtgaaatgaa

SEQ ID NO: 3987311 - DNA, 14 bp, Homo sapiens
gatgtggaaagcac

SEQ ID NO: 3987312 - DNA, 22 bp, Homo sapiens
gatgtgggagggagcagacagg

SEQ ID NO: 3987313 - DNA, 22 bp, Homo sapiens
gatgtggtgcctgaggtctgta

SEQ ID NO: 3987314 - DNA, 13 bp, Homo sapiens
gatgtgtcctcag

SEQ ID NO: 3987315 - DNA, 18 bp, Homo sapiens
gatgttgaagaatacagt

SEQ ID NO: 3987316 - DNA, 23 bp, Homo sapiens
gatgtttacaggtggacacacaa

SEQ ID NO: 3987317 - DNA, 20 bp, Homo sapiens
gatgtttatgttcttataga

SEQ ID NO: 3987318 - DNA, 15 bp, Homo sapiens
gaaattctgttaaaa

SEQ ID NO: 3987319 - DNA, 24 bp, Homo sapiens
gaaattctgttaaaatctattctg

SEQ ID NO: 3987320 - DNA, 22 bp, Homo sapiens
gaaattggaacagaatgtttta

SEQ ID NO: 3987321 - DNA, 16 bp, Homo sapiens
gaaatttattcacata

SEQ ID NO: 3987322 - DNA, 16 bp, Homo sapiens
gaaattttgcaaatat

SEQ ID NO: 3987323 - DNA, 13 bp, Homo sapiens
gaaattttgtaag

SEQ ID NO: 3987324 - DNA, 17 bp, Homo sapiens
gaaattttgtaagaagg

SEQ ID NO: 3987325 - DNA, 19 bp, Homo sapiens
gaacaactaggcttcagca

SEQ ID NO: 3987326 - DNA, 21 bp, Homo sapiens
gaacaactaggcttcagcata

SEQ ID NO: 3987327 - DNA, 20 bp, Homo sapiens
gaacaattgaagtaaacttt

SEQ ID NO: 3987328 - DNA, 17 bp, Homo sapiens
gaacacaaactgtaaat

SEQ ID NO: 3987329 - DNA, 15 bp, Homo sapiens
gaacacacacacaca

SEQ ID NO: 3987330 - DNA, 14 bp, Homo sapiens
gaacacaggcagct

SEQ ID NO: 3987331 - DNA, 16 bp, Homo sapiens
gaacacaggcagcttt

SEQ ID NO: 3987332 - DNA, 21 bp, Homo sapiens
gaacactactgctaaatcctc

SEQ ID NO: 3987333 - DNA, 12 bp, Homo sapiens
gaacagaatgtt

SEQ ID NO: 3987334 - DNA, 14 bp, Homo sapiens
gaacagaatgtttt

SEQ ID NO: 3987335 - DNA, 18 bp, Homo sapiens
gaacagacaacagaagtc

SEQ ID NO: 3987336 - DNA, 14 bp, Homo sapiens
gaacagaccagtga

SEQ ID NO: 3987337 - DNA, 20 bp, Homo sapiens
gaacagagagacccttgtgg

SEQ ID NO: 3987338 - DNA, 22 bp, Homo sapiens
gaacagatgacccctgcccaga

SEQ ID NO: 3987339 - DNA, 19 bp, Homo sapiens
gaacagcagtgttctcaca

SEQ ID NO: 3987340 - DNA, 23 bp, Homo sapiens
gaacagctatgggagccccaggg

SEQ ID NO: 3987341 - DNA, 16 bp, Homo sapiens
gaacagcttcaggtta

SEQ ID NO: 3987342 - DNA, 13 bp, Homo sapiens
gaacagtggctgg

SEQ ID NO: 3987343 - DNA, 15 bp, Homo sapiens
gaacagtggctgggt

SEQ ID NO: 3987344 - DNA, 14 bp, Homo sapiens
gaacataaaaagga

SEQ ID NO: 3987345 - DNA, 22 bp, Homo sapiens
gaacataaaaaggacatcagca

SEQ ID NO: 3987346 - DNA, 15 bp, Homo sapiens
gaacatatgttgcaa

SEQ ID NO: 3987347 - DNA, 19 bp, Homo sapiens
gaacatcctttgcagggca

SEQ ID NO: 3987348 - DNA, 19 bp, Homo sapiens
gaacatctaacccactaga

SEQ ID NO: 3987349 - DNA, 21 bp, Homo sapiens
gaacatgcagttcattatttt

SEQ ID NO: 3987350 - DNA, 17 bp, Homo sapiens
gaacatggacttgtata

SEQ ID NO: 3987351 - DNA, 22 bp, Homo sapiens
gaacatggacttgtatatttgt

SEQ ID NO: 3987352 - DNA, 15 bp, Homo sapiens
gaacatggagctgtc

SEQ ID NO: 3987353 - DNA, 17 bp, Homo sapiens
gaacatggagctgtcat

SEQ ID NO: 3987354 - DNA, 22 bp, Homo sapiens
gaacatggctagcctttcttgt

SEQ ID NO: 3987355 - DNA, 22 bp, Homo sapiens
gaacatgtcctaattcttctgt

SEQ ID NO: 3987356 - DNA, 14 bp, Homo sapiens
gaacatgttctcca

SEQ ID NO: 3987357 - DNA, 23 bp, Homo sapiens
gaaccaaaaatcccaccttccca

SEQ ID NO: 3987358 - DNA, 24 bp, Homo sapiens
gaaccaagtggaccttgagaccac

SEQ ID NO: 3987359 - DNA, 21 bp, Homo sapiens
gaaccacgcgggggccttgag

SEQ ID NO: 3987360 - DNA, 18 bp, Homo sapiens
gaaccagccggggcctta

SEQ ID NO: 3987361 - DNA, 19 bp, Homo sapiens
gaaccagctcatctccaag

SEQ ID NO: 3987362 - DNA, 15 bp, Homo sapiens
gaacccaagagcaag

SEQ ID NO: 3987363 - DNA, 23 bp, Homo sapiens
gaacccaatctgcacactccagg

SEQ ID NO: 3987364 - DNA, 15 bp, Homo sapiens
gaaccctctgtccca

SEQ ID NO: 3987365 - DNA, 17 bp, Homo sapiens
gaaccctggggcctgac

SEQ ID NO: 3987366 - DNA, 14 bp, Homo sapiens
gaagtttaaaacag

SEQ ID NO: 3987367 - DNA, 17 bp, Homo sapiens
gaagtttacattgtaaa

SEQ ID NO: 3987368 - DNA, 14 bp, Homo sapiens
gaagtttacatttt

SEQ ID NO: 3987369 - DNA, 17 bp, Homo sapiens
gaagtttattctcattt

SEQ ID NO: 3987370 - DNA, 14 bp, Homo sapiens
gaagtttcacatga

SEQ ID NO: 3987371 - DNA, 19 bp, Homo sapiens
gaagtttgatattaaagga

SEQ ID NO: 3987372 - DNA, 17 bp, Homo sapiens
gaagttttgcatttatg

SEQ ID NO: 3987373 - DNA, 18 bp, Homo sapiens
gaataaactagagaaggg

SEQ ID NO: 3987374 - DNA, 12 bp, Homo sapiens
gaataaactgaa

SEQ ID NO: 3987375 - DNA, 21 bp, Homo sapiens
gaataaactgaatattttgga

SEQ ID NO: 3987376 - DNA, 14 bp, Homo sapiens
gaataaagacacct

SEQ ID NO: 3987377 - DNA, 14 bp, Homo sapiens
gaataaaggcagct

SEQ ID NO: 3987378 - DNA, 15 bp, Homo sapiens
gaataaagttgcaga

SEQ ID NO: 3987379 - DNA, 18 bp, Homo sapiens
gaataaattaatattgta

SEQ ID NO: 3987380 - DNA, 15 bp, Homo sapiens
gaataagcacttgaa

SEQ ID NO: 3987381 - DNA, 22 bp, Homo sapiens
gaataatctttgggtaacttca

SEQ ID NO: 3987382 - DNA, 23 bp, Homo sapiens
gaataatttgtaaatgattttaa

SEQ ID NO: 3987383 - DNA, 20 bp, Homo sapiens
gaatacagtgttattttctt

SEQ ID NO: 3987384 - DNA, 15 bp, Homo sapiens
gaatactgggttctt

SEQ ID NO: 3987385 - DNA, 16 bp, Homo sapiens
gaatactgggttctta

SEQ ID NO: 3987386 - DNA, 14 bp, Homo sapiens
gaatactttttaca

SEQ ID NO: 3987387 - DNA, 17 bp, Homo sapiens
gaatataaaaacatttg

SEQ ID NO: 3987388 - DNA, 22 bp, Homo sapiens
gaatatacagcaggtgctcaat

SEQ ID NO: 3987389 - DNA, 11 bp, Homo sapiens
gaatatattat

SEQ ID NO: 3987390 - DNA, 19 bp, Homo sapiens
gaatatccatgtacttgtt

SEQ ID NO: 3987391 - DNA, 17 bp, Homo sapiens
gaatatctattaatata

SEQ ID NO: 3987392 - DNA, 17 bp, Homo sapiens
gaatatctgtaatggta

SEQ ID NO: 3987393 - DNA, 17 bp, Homo sapiens
gaatatgacggaagaac

SEQ ID NO: 3987394 - DNA, 19 bp, Homo sapiens
gaatatgtttccttgttta

SEQ ID NO: 3987395 - DNA, 13 bp, Homo sapiens
gaatattgtgatt

SEQ ID NO: 3987396 - DNA, 18 bp, Homo sapiens
gaatatttaagaaaagca

SEQ ID NO: 3987397 - DNA, 19 bp, Homo sapiens
gaatatttaagaaaagcac

SEQ ID NO: 3987398 - DNA, 20 bp, Homo sapiens
gaatatttaagaaaagcact

SEQ ID NO: 3987399 - DNA, 13 bp, Homo sapiens
gaatatttataac

SEQ ID NO: 3987400 - DNA, 18 bp, Homo sapiens
gaatatttatatttcact

SEQ ID NO: 3987401 - DNA, 19 bp, Homo sapiens
gaatatttatatttcacta

SEQ ID NO: 3987402 - DNA, 15 bp, Homo sapiens
gaatatttattacct

SEQ ID NO: 3987403 - DNA, 17 bp, Homo sapiens
gaatatttattacctct

SEQ ID NO: 3987404 - DNA, 16 bp, Homo sapiens
gaatattttggaaact

SEQ ID NO: 3987405 - DNA, 20 bp, Homo sapiens
gaatattttggaaactgcta

SEQ ID NO: 3987406 - DNA, 20 bp, Homo sapiens
gaatatttttatatttcctt

SEQ ID NO: 3987407 - DNA, 18 bp, Homo sapiens
gaatgtaatcaatgtttc

SEQ ID NO: 3987408 - DNA, 14 bp, Homo sapiens
gaatgtactctgtt

SEQ ID NO: 3987409 - DNA, 15 bp, Homo sapiens
gaatgtagctggttt

SEQ ID NO: 3987410 - DNA, 15 bp, Homo sapiens
gaatgtatcaggaaa

SEQ ID NO: 3987411 - DNA, 19 bp, Homo sapiens
gaatgtcagatttctggtt

SEQ ID NO: 3987412 - DNA, 15 bp, Homo sapiens
gaatgtgggcactgg

SEQ ID NO: 3987413 - DNA, 15 bp, Homo sapiens
gaatgtggtctcagg

SEQ ID NO: 3987414 - DNA, 17 bp, Homo sapiens
gaatgtggtctcaggat

SEQ ID NO: 3987415 - DNA, 15 bp, Homo sapiens
gaatgttctgacatt

SEQ ID NO: 3987416 - DNA, 16 bp, Homo sapiens
gaatgttctgacatta

SEQ ID NO: 3987417 - DNA, 16 bp, Homo sapiens
gaatgttgaaaagtaa

SEQ ID NO: 3987418 - DNA, 18 bp, Homo sapiens
gaatgttttatttatcaa

SEQ ID NO: 3987419 - DNA, 14 bp, Homo sapiens
gaattaaaacttct

SEQ ID NO: 3987420 - DNA, 16 bp, Homo sapiens
gaattaaaacttctta

SEQ ID NO: 3987421 - DNA, 18 bp, Homo sapiens
gaattaaaacttcttaaa

SEQ ID NO: 3987422 - DNA, 21 bp, Homo sapiens
gaattaaattaggaataaata

SEQ ID NO: 3987423 - DNA, 22 bp, Homo sapiens
gaattaaccatttaataaagaa

SEQ ID NO: 3987424 - DNA, 18 bp, Homo sapiens
gaattaacctggtgctgg

SEQ ID NO: 3987425 - DNA, 15 bp, Homo sapiens
gaattaatttctaaa

SEQ ID NO: 3987426 - DNA, 21 bp, Homo sapiens
gaattacatgtaaaacattat

SEQ ID NO: 3987427 - DNA, 16 bp, Homo sapiens
gaattaccaagagaag

SEQ ID NO: 3987428 - DNA, 15 bp, Homo sapiens
gaattagattatatt

SEQ ID NO: 3987429 - DNA, 14 bp, Homo sapiens
gaattatatatttc

SEQ ID NO: 3987430 - DNA, 22 bp, Homo sapiens
gaattatctatacatatcttta

SEQ ID NO: 3987431 - DNA, 16 bp, Homo sapiens
gaattattgacactga

SEQ ID NO: 3987432 - DNA, 20 bp, Homo sapiens
gaattattgtaccattttct

SEQ ID NO: 3987433 - DNA, 14 bp, Homo sapiens
gaattatttttgtg

SEQ ID NO: 3987434 - DNA, 19 bp, Homo sapiens
gaattatttttttaaagtg

SEQ ID NO: 3987435 - DNA, 22 bp, Homo sapiens
gaattcaaactggggcctccag

SEQ ID NO: 3987436 - DNA, 23 bp, Homo sapiens
gaattcaaactggggcctccaga

SEQ ID NO: 3987437 - DNA, 23 bp, Homo sapiens
gaattcagaagacccctgactca

SEQ ID NO: 3987438 - DNA, 15 bp, Homo sapiens
gaattcccttttaat

SEQ ID NO: 3987439 - DNA, 13 bp, Homo sapiens
gaattcctctttt

SEQ ID NO: 3987440 - DNA, 21 bp, Homo sapiens
gaattcctcttttgcttaaat

SEQ ID NO: 3987441 - DNA, 17 bp, Homo sapiens
gaattctcagaatctca

SEQ ID NO: 3987442 - DNA, 18 bp, Homo sapiens
gaattcttctgcaacatt

SEQ ID NO: 3987443 - DNA, 18 bp, Homo sapiens
gaattcttgaaggaaaat

SEQ ID NO: 3987444 - DNA, 15 bp, Homo sapiens
ctttctccttagtct

SEQ ID NO: 3987445 - DNA, 20 bp, Homo sapiens
ctttctccttagtcttctca

SEQ ID NO: 3987446 - DNA, 20 bp, Homo sapiens
ctttctctcagccttacatt

SEQ ID NO: 3987447 - DNA, 13 bp, Homo sapiens
ctttctctcttcc

SEQ ID NO: 3987448 - DNA, 15 bp, Homo sapiens
ctttctctcttccct

SEQ ID NO: 3987449 - DNA, 14 bp, Homo sapiens
ctttctctgccagt

SEQ ID NO: 3987450 - DNA, 16 bp, Homo sapiens
ctttctctgccagtga

SEQ ID NO: 3987451 - DNA, 23 bp, Homo sapiens
ctttctcttttcccctttcctgt

SEQ ID NO: 3987452 - DNA, 22 bp, Homo sapiens
ctttctgccatctagccagccc

SEQ ID NO: 3987453 - DNA, 19 bp, Homo sapiens
ctttctgctgggatccttg

SEQ ID NO: 3987454 - DNA, 16 bp, Homo sapiens
ctttctgcttgtgtta

SEQ ID NO: 3987455 - DNA, 19 bp, Homo sapiens
ctttctgtatatacttttt

SEQ ID NO: 3987456 - DNA, 20 bp, Homo sapiens
ctttctgtatatactttttt

SEQ ID NO: 3987457 - DNA, 12 bp, Homo sapiens
ctttctgtccca

SEQ ID NO: 3987458 - DNA, 13 bp, Homo sapiens
ctttctgttccaa

SEQ ID NO: 3987459 - DNA, 20 bp, Homo sapiens
ctttctgttccaaattcagt

SEQ ID NO: 3987460 - DNA, 16 bp, Homo sapiens
ctttctgttgccacaa

SEQ ID NO: 3987461 - DNA, 21 bp, Homo sapiens
ctttcttctacaaccagagcc

SEQ ID NO: 3987462 - DNA, 13 bp, Homo sapiens
ctttcttgcagat

SEQ ID NO: 3987463 - DNA, 14 bp, Homo sapiens
ctttcttgctccct

SEQ ID NO: 3987464 - DNA, 19 bp, Homo sapiens
ctttcttgctcccttcagc

SEQ ID NO: 3987465 - DNA, 21 bp, Homo sapiens
ctttcttgggatagtgttctg

SEQ ID NO: 3987466 - DNA, 21 bp, Homo sapiens
ctttcttggttcataaatgaa

SEQ ID NO: 3987467 - DNA, 16 bp, Homo sapiens
ctttctttaaatgttt

SEQ ID NO: 3987468 - DNA, 22 bp, Homo sapiens
ctttgaaacaagataactgaga

SEQ ID NO: 3987469 - DNA, 17 bp, Homo sapiens
ctttgaagtagctcttt

SEQ ID NO: 3987470 - DNA, 17 bp, Homo sapiens
ctttgaataaaaatgca

SEQ ID NO: 3987471 - DNA, 22 bp, Homo sapiens
ctttgaatttcttgatttttca

SEQ ID NO: 3987472 - DNA, 14 bp, Homo sapiens
ctttgacaaaagta

SEQ ID NO: 3987473 - DNA, 18 bp, Homo sapiens
ctttgacaaaagtaaatg

SEQ ID NO: 3987474 - DNA, 19 bp, Homo sapiens
ctttgacaaaagtaaatgg

SEQ ID NO: 3987475 - DNA, 14 bp, Homo sapiens
ctttgacatttaat

SEQ ID NO: 3987476 - DNA, 18 bp, Homo sapiens
ctttgacatttaatttag

SEQ ID NO: 3987477 - DNA, 15 bp, Homo sapiens
ctttgacttcagctg

SEQ ID NO: 3987478 - DNA, 17 bp, Homo sapiens
ctttgactttatctcct

SEQ ID NO: 3987479 - DNA, 15 bp, Homo sapiens
ctttgagacagtttc

SEQ ID NO: 3987480 - DNA, 17 bp, Homo sapiens
ctttgagactgggtctc

SEQ ID NO: 3987481 - DNA, 22 bp, Homo sapiens
ctttgagagacgccactccctg

SEQ ID NO: 3987482 - DNA, 22 bp, Homo sapiens
ctttgagggtggaaggatggga

SEQ ID NO: 3987483 - DNA, 14 bp, Homo sapiens
ctttgataatgtta

SEQ ID NO: 3987484 - DNA, 15 bp, Homo sapiens
ctttgataatgttaa

SEQ ID NO: 3987485 - DNA, 22 bp, Homo sapiens
ctttgatattttcaacgcagcc

SEQ ID NO: 3987486 - DNA, 19 bp, Homo sapiens
ctttgattcatagtaactt

SEQ ID NO: 3987487 - DNA, 13 bp, Homo sapiens
ctttgatttacag

SEQ ID NO: 3987488 - DNA, 22 bp, Homo sapiens
ctttgcaaacatcaacctggca

SEQ ID NO: 3987489 - DNA, 15 bp, Homo sapiens
ctttgcaagatgctt

SEQ ID NO: 3987490 - DNA, 22 bp, Homo sapiens
ctttgcagccggcacagggtct

SEQ ID NO: 3987491 - DNA, 14 bp, Homo sapiens
ctttgcagggcagc

SEQ ID NO: 3987492 - DNA, 15 bp, Homo sapiens
ctttgcagggcagcc

SEQ ID NO: 3987493 - DNA, 19 bp, Homo sapiens
ctttgcagggcagccccac

SEQ ID NO: 3987494 - DNA, 22 bp, Homo sapiens
ctttgcagttggactctcaggg

SEQ ID NO: 3987495 - DNA, 19 bp, Homo sapiens
ctttgccaaaaaaaaaaga

SEQ ID NO: 3987496 - DNA, 13 bp, Homo sapiens
ctttgccagcttt

SEQ ID NO: 3987497 - DNA, 20 bp, Homo sapiens
ctttgccagcttttcctccc

SEQ ID NO: 3987498 - DNA, 18 bp, Homo sapiens
ctttgcccacccctcact

SEQ ID NO: 3987499 - DNA, 16 bp, Homo sapiens
ctttgcccaggcatga

SEQ ID NO: 3987500 - DNA, 23 bp, Homo sapiens
ctttgcccccaaacccccattct

SEQ ID NO: 3987501 - DNA, 10 bp, Homo sapiens
ctttgcctca

SEQ ID NO: 3987502 - DNA, 11 bp, Homo sapiens
ctttgcctcaa

SEQ ID NO: 3987503 - DNA, 15 bp, Homo sapiens
ctttgcctcttcttt

SEQ ID NO: 3987504 - DNA, 21 bp, Homo sapiens
ctttgcctcttctttgtgcct

SEQ ID NO: 3987505 - DNA, 22 bp, Homo sapiens
ctttgccttgcagccacatggc

SEQ ID NO: 3987506 - DNA, 18 bp, Homo sapiens
ctttgccttgggctgctc

SEQ ID NO: 3987507 - DNA, 15 bp, Homo sapiens
ctttgcggacgggct

SEQ ID NO: 3987508 - DNA, 14 bp, Homo sapiens
ctttgctgccttaa

SEQ ID NO: 3987509 - DNA, 21 bp, Homo sapiens
ctttgctgtgaggctgtcctg

SEQ ID NO: 3987510 - DNA, 22 bp, Homo sapiens
ctttgctgtgaggctgtcctgt

SEQ ID NO: 3987511 - DNA, 20 bp, Homo sapiens
ctttgcttatgaatatttat

SEQ ID NO: 3987512 - DNA, 15 bp, Homo sapiens
ctttgcttcccctcc

SEQ ID NO: 3987513 - DNA, 16 bp, Homo sapiens
cttttcccctacagaa

SEQ ID NO: 3987514 - DNA, 20 bp, Homo sapiens
cttttcccctacagaatttt

SEQ ID NO: 3987515 - DNA, 19 bp, Homo sapiens
cttttcccctgttaaacag

SEQ ID NO: 3987516 - DNA, 17 bp, Homo sapiens
cttttcccctttcctgt

SEQ ID NO: 3987517 - DNA, 22 bp, Homo sapiens
cttttcccctttcctgtcccac

SEQ ID NO: 3987518 - DNA, 20 bp, Homo sapiens
cttttccctgcttccaggaa

SEQ ID NO: 3987519 - DNA, 13 bp, Homo sapiens
cttttcctccctt

SEQ ID NO: 3987520 - DNA, 16 bp, Homo sapiens
cttttcctcgcttctt

SEQ ID NO: 3987521 - DNA, 16 bp, Homo sapiens
cttttcctgttgtatt

SEQ ID NO: 3987522 - DNA, 19 bp, Homo sapiens
cttttccttcattcatagg

SEQ ID NO: 3987523 - DNA, 20 bp, Homo sapiens
cttttccttcccttttctgt

SEQ ID NO: 3987524 - DNA, 22 bp, Homo sapiens
cttttccttcccttttctgttc

SEQ ID NO: 3987525 - DNA, 15 bp, Homo sapiens
cttttcgttaacatt

SEQ ID NO: 3987526 - DNA, 20 bp, Homo sapiens
cttttcgttaacattgacca

SEQ ID NO: 3987527 - DNA, 11 bp, Homo sapiens
cttttctcagg

SEQ ID NO: 3987528 - DNA, 17 bp, Homo sapiens
cttttctctggtaatat

SEQ ID NO: 3987529 - DNA, 20 bp, Homo sapiens
cttttctcttttctttctgt

SEQ ID NO: 3987530 - DNA, 23 bp, Homo sapiens
cttttctgcatcatctgtagata

SEQ ID NO: 3987531 - DNA, 15 bp, Homo sapiens
cttttctgccctggc

SEQ ID NO: 3987532 - DNA, 13 bp, Homo sapiens
cttttctggaatt

SEQ ID NO: 3987533 - DNA, 19 bp, Homo sapiens
cttttctggccaaaagcag

SEQ ID NO: 3987534 - DNA, 13 bp, Homo sapiens
cttttctgtcctg

SEQ ID NO: 3987535 - DNA, 13 bp, Homo sapiens
cttttctgtgttt

SEQ ID NO: 3987536 - DNA, 18 bp, Homo sapiens
cttttctgtgtttacaga

SEQ ID NO: 3987537 - DNA, 22 bp, Homo sapiens
cttttctgtgtttacagagatg

SEQ ID NO: 3987538 - DNA, 16 bp, Homo sapiens
cttttctgttctagtt

SEQ ID NO: 3987539 - DNA, 21 bp, Homo sapiens
cttttcttggcaaaagccttg

SEQ ID NO: 3987540 - DNA, 17 bp, Homo sapiens
cttttctttaaagaagt

SEQ ID NO: 3987541 - DNA, 15 bp, Homo sapiens
cttttctttttacat

SEQ ID NO: 3987542 - DNA, 19 bp, Homo sapiens
cttttctttttcccttgaa

SEQ ID NO: 3987543 - DNA, 18 bp, Homo sapiens
cttttgacttaaagcaga

SEQ ID NO: 3987544 - DNA, 20 bp, Homo sapiens
cttttgagtggtaatcatat

SEQ ID NO: 3987545 - DNA, 15 bp, Homo sapiens
cttttgagtgtgtgt

SEQ ID NO: 3987546 - DNA, 20 bp, Homo sapiens
cttttgagtgtgtgtgtgca

SEQ ID NO: 3987547 - DNA, 18 bp, Homo sapiens
cttttgcaacttaatact

SEQ ID NO: 3987548 - DNA, 18 bp, Homo sapiens
cttttgcagaagagggtg

SEQ ID NO: 3987549 - DNA, 15 bp, Homo sapiens
cttttgcaggataat

SEQ ID NO: 3987550 - DNA, 17 bp, Homo sapiens
cttttgccattaaactt

SEQ ID NO: 3987551 - DNA, 21 bp, Homo sapiens
cttttgcccttcacagtgttt

SEQ ID NO: 3987552 - DNA, 14 bp, Homo sapiens
cttttgctctctgt

SEQ ID NO: 3987553 - DNA, 18 bp, Homo sapiens
ctgtcaatttccctgact

SEQ ID NO: 3987554 - DNA, 14 bp, Homo sapiens
ctgtcacattgcat

SEQ ID NO: 3987555 - DNA, 15 bp, Homo sapiens
ctgtcacattgcatt

SEQ ID NO: 3987556 - DNA, 16 bp, Homo sapiens
ctgtcacccccactcc

SEQ ID NO: 3987557 - DNA, 20 bp, Homo sapiens
ctgtcacggggttccctcct

SEQ ID NO: 3987558 - DNA, 14 bp, Homo sapiens
ctgtcactcattgc

SEQ ID NO: 3987559 - DNA, 14 bp, Homo sapiens
ctgtcactggctgg

SEQ ID NO: 3987560 - DNA, 17 bp, Homo sapiens
ctgtcactggctggctc

SEQ ID NO: 3987561 - DNA, 21 bp, Homo sapiens
ctgtcactggctggctcctag

SEQ ID NO: 3987562 - DNA, 12 bp, Homo sapiens
ctgtcactttgc

SEQ ID NO: 3987563 - DNA, 15 bp, Homo sapiens
ctgtcactttgctct

SEQ ID NO: 3987564 - DNA, 18 bp, Homo sapiens
ctgtcactttgctctggg

SEQ ID NO: 3987565 - DNA, 14 bp, Homo sapiens
ctgtcagcatctgg

SEQ ID NO: 3987566 - DNA, 16 bp, Homo sapiens
ctgtcagcatctggct

SEQ ID NO: 3987567 - DNA, 16 bp, Homo sapiens
ctgtcagccagccgcc

SEQ ID NO: 3987568 - DNA, 18 bp, Homo sapiens
ctgtcagccagccgccct

SEQ ID NO: 3987569 - DNA, 19 bp, Homo sapiens
ctgtcagccagccgccctg

SEQ ID NO: 3987570 - DNA, 22 bp, Homo sapiens
ctgtcagccagccgccctgggc

SEQ ID NO: 3987571 - DNA, 23 bp, Homo sapiens
ctgtcagccagccgccctgggct

SEQ ID NO: 3987572 - DNA, 15 bp, Homo sapiens
ctgtcagtcacagcc

SEQ ID NO: 3987573 - DNA, 18 bp, Homo sapiens
ctgtcagtcacagccacc

SEQ ID NO: 3987574 - DNA, 22 bp, Homo sapiens
ctgtcagtgttaaagattttgt

SEQ ID NO: 3987575 - DNA, 18 bp, Homo sapiens
ctgtcatgaaatcagcaa

SEQ ID NO: 3987576 - DNA, 19 bp, Homo sapiens
ctgtcattgcttcttctga

SEQ ID NO: 3987577 - DNA, 22 bp, Homo sapiens
ctgtccaaaggaggctggcagg

SEQ ID NO: 3987578 - DNA, 12 bp, Homo sapiens
ctgtccagaaag

SEQ ID NO: 3987579 - DNA, 15 bp, Homo sapiens
ctgtccagcctgggc

SEQ ID NO: 3987580 - DNA, 17 bp, Homo sapiens
ctgtccagcctgggcag

SEQ ID NO: 3987581 - DNA, 18 bp, Homo sapiens
ctgtccagcctgggcagc

SEQ ID NO: 3987582 - DNA, 12 bp, Homo sapiens
ctgtccagctcc

SEQ ID NO: 3987583 - DNA, 16 bp, Homo sapiens
ctgtccatggcctttc

SEQ ID NO: 3987584 - DNA, 17 bp, Homo sapiens
ctgtccatggcctttct

SEQ ID NO: 3987585 - DNA, 18 bp, Homo sapiens
ctgtccatggcctttcta

SEQ ID NO: 3987586 - DNA, 21 bp, Homo sapiens
ctgtccattttcttttaaagt

SEQ ID NO: 3987587 - DNA, 21 bp, Homo sapiens
ctgtcccacccacacagctgc

SEQ ID NO: 3987588 - DNA, 16 bp, Homo sapiens
ctgtcccacccccacc

SEQ ID NO: 3987589 - DNA, 20 bp, Homo sapiens
ctgtcccacccctagccacc

SEQ ID NO: 3987590 - DNA, 21 bp, Homo sapiens
ctgtcccaccgggagcctccc

SEQ ID NO: 3987591 - DNA, 12 bp, Homo sapiens
ctgtcccaggcc

SEQ ID NO: 3987592 - DNA, 20 bp, Homo sapiens
ctgtcccaggccggcccaga

SEQ ID NO: 3987593 - DNA, 18 bp, Homo sapiens
ctgtcccatggacactcc

SEQ ID NO: 3987594 - DNA, 14 bp, Homo sapiens
ctgtccccaaaatg

SEQ ID NO: 3987595 - DNA, 17 bp, Homo sapiens
ctgtccccaaaatgtga

SEQ ID NO: 3987596 - DNA, 13 bp, Homo sapiens
ctgtccccaaagg

SEQ ID NO: 3987597 - DNA, 18 bp, Homo sapiens
ctgtccccaccctccact

SEQ ID NO: 3987598 - DNA, 14 bp, Homo sapiens
ctgtccccagccct

SEQ ID NO: 3987599 - DNA, 15 bp, Homo sapiens
ctgtccccagccctg

SEQ ID NO: 3987600 - DNA, 17 bp, Homo sapiens
ctgtccccagccctgtc

SEQ ID NO: 3987601 - DNA, 16 bp, Homo sapiens
ctgtcccccaggctgg

SEQ ID NO: 3987602 - DNA, 17 bp, Homo sapiens
ctgtcccccaggctgga

SEQ ID NO: 3987603 - DNA, 18 bp, Homo sapiens
ctgtccccctacccaccg

SEQ ID NO: 3987604 - DNA, 22 bp, Homo sapiens
ctgtccccctcccctcccagtc

SEQ ID NO: 3987605 - DNA, 23 bp, Homo sapiens
ctgtccctcccttgctgaacaca

SEQ ID NO: 3987606 - DNA, 18 bp, Homo sapiens
ctgtccctgtccccctcc

SEQ ID NO: 3987607 - DNA, 20 bp, Homo sapiens
ctgtcccttgcctcaatgcc

SEQ ID NO: 3987608 - DNA, 21 bp, Homo sapiens
ctgtcccttgcctcaatgcca

SEQ ID NO: 3987609 - DNA, 22 bp, Homo sapiens
ctgtcccttgcctctgccctgg

SEQ ID NO: 3987610 - DNA, 16 bp, Homo sapiens
ctgtcccttttccctt

SEQ ID NO: 3987611 - DNA, 15 bp, Homo sapiens
ctgtccgtggaaaat

SEQ ID NO: 3987612 - DNA, 20 bp, Homo sapiens
ctgtcctaccagttgcccta

SEQ ID NO: 3987613 - DNA, 15 bp, Homo sapiens
ctgtctcatcctcct

SEQ ID NO: 3987614 - DNA, 16 bp, Homo sapiens
ctgtctcatcctcctg

SEQ ID NO: 3987615 - DNA, 22 bp, Homo sapiens
ctgtctcatcctcctggaacct

SEQ ID NO: 3987616 - DNA, 12 bp, Homo sapiens
ctgtctccagct

SEQ ID NO: 3987617 - DNA, 16 bp, Homo sapiens
ctgtctccagctgcct

SEQ ID NO: 3987618 - DNA, 16 bp, Homo sapiens
ctgtctctaacttatt

SEQ ID NO: 3987619 - DNA, 13 bp, Homo sapiens
ctgtctctgctcg

SEQ ID NO: 3987620 - DNA, 18 bp, Homo sapiens
ctgtctcttgaaaaatgc

SEQ ID NO: 3987621 - DNA, 15 bp, Homo sapiens
ctgtctgagactcac

SEQ ID NO: 3987622 - DNA, 19 bp, Homo sapiens
ctgtctgccccagcccaga

SEQ ID NO: 3987623 - DNA, 17 bp, Homo sapiens
ctgtctgctccagctct

SEQ ID NO: 3987624 - DNA, 12 bp, Homo sapiens
ctgtctggggcc

SEQ ID NO: 3987625 - DNA, 13 bp, Homo sapiens
ctgtctggggcct

SEQ ID NO: 3987626 - DNA, 16 bp, Homo sapiens
ctgtctgtcaccagct

SEQ ID NO: 3987627 - DNA, 19 bp, Homo sapiens
ctgtctgtcaccagctatc

SEQ ID NO: 3987628 - DNA, 12 bp, Homo sapiens
ctgtctgtggct

SEQ ID NO: 3987629 - DNA, 16 bp, Homo sapiens
ctgtctgttatgattt

SEQ ID NO: 3987630 - DNA, 21 bp, Homo sapiens
ctgtcttatggtccagaaact

SEQ ID NO: 3987631 - DNA, 18 bp, Homo sapiens
ctgtcttcaggctctgcc

SEQ ID NO: 3987632 - DNA, 19 bp, Homo sapiens
ctgtcttcatagcagattt

SEQ ID NO: 3987633 - DNA, 22 bp, Homo sapiens
ctgtcttcatagcagattttaa

SEQ ID NO: 3987634 - DNA, 14 bp, Homo sapiens
ctgtcttccccacc

SEQ ID NO: 3987635 - DNA, 13 bp, Homo sapiens
ctgtcttcctcaa

SEQ ID NO: 3987636 - DNA, 14 bp, Homo sapiens
ctgtcttcctcaaa

SEQ ID NO: 3987637 - DNA, 13 bp, Homo sapiens
ctgtcttctgggc

SEQ ID NO: 3987638 - DNA, 15 bp, Homo sapiens
ctgtctttcagatac

SEQ ID NO: 3987639 - DNA, 18 bp, Homo sapiens
ctgtctttcctgaaccat

SEQ ID NO: 3987640 - DNA, 22 bp, Homo sapiens
ctgtgaacgatttagaaagaag

SEQ ID NO: 3987641 - DNA, 15 bp, Homo sapiens
ctgtgaagacccagc

SEQ ID NO: 3987642 - DNA, 16 bp, Homo sapiens
ctgtgaagacccagca

SEQ ID NO: 3987643 - DNA, 18 bp, Homo sapiens
ctgtgaagacccagcagg

SEQ ID NO: 3987644 - DNA, 12 bp, Homo sapiens
ctgtgaatacaa

SEQ ID NO: 3987645 - DNA, 13 bp, Homo sapiens
ctgtgaatacaat

SEQ ID NO: 3987646 - DNA, 17 bp, Homo sapiens
ctgtgaatacaattaaa

SEQ ID NO: 3987647 - DNA, 18 bp, Homo sapiens
ctgtgaatacaattaaag

SEQ ID NO: 3987648 - DNA, 20 bp, Homo sapiens
ctgtgaatacaattaaaggt

SEQ ID NO: 3987649 - DNA, 21 bp, Homo sapiens
ctgtgaatacaattaaaggtc

SEQ ID NO: 3987650 - DNA, 16 bp, Homo sapiens
ctgtgacaataagttt

SEQ ID NO: 3987651 - DNA, 17 bp, Homo sapiens
ctgtgacatggtgcctg

SEQ ID NO: 3987652 - DNA, 22 bp, Homo sapiens
ctgtgacatggtgcctgagagg

SEQ ID NO: 3987653 - DNA, 23 bp, Homo sapiens
ctgtgacatggtgcctgagaggc

SEQ ID NO: 3987654 - DNA, 14 bp, Homo sapiens
ctgtgaccagcact

SEQ ID NO: 3987655 - DNA, 14 bp, Homo sapiens
ctgtgactcttttt

SEQ ID NO: 3987656 - DNA, 16 bp, Homo sapiens
ctgtgacttctccagg

SEQ ID NO: 3987657 - DNA, 14 bp, Homo sapiens
ctgtgagcccagct

SEQ ID NO: 3987658 - DNA, 15 bp, Homo sapiens
ctgtgagcccagctg

SEQ ID NO: 3987659 - DNA, 13 bp, Homo sapiens
ctgtgagcccctg

SEQ ID NO: 3987660 - DNA, 14 bp, Homo sapiens
ctgtgagcccctgg

SEQ ID NO: 3987661 - DNA, 16 bp, Homo sapiens
ctgtgagcccctggtc

SEQ ID NO: 3987662 - DNA, 13 bp, Homo sapiens
ctgtgagctgcac

SEQ ID NO: 3987663 - DNA, 20 bp, Homo sapiens
ctgtgaggaatgctctgtgc

SEQ ID NO: 3987664 - DNA, 17 bp, Homo sapiens
ctgtgaggcccctggac

SEQ ID NO: 3987665 - DNA, 12 bp, Homo sapiens
ctgtgaggctgt

SEQ ID NO: 3987666 - DNA, 19 bp, Homo sapiens
ctgtgaggtgctgatgagt

SEQ ID NO: 3987667 - DNA, 21 bp, Homo sapiens
ctgtgaggtgctgatgagtga

SEQ ID NO: 3987668 - DNA, 14 bp, Homo sapiens
ctgtgagtgtaagt

SEQ ID NO: 3987669 - DNA, 19 bp, Homo sapiens
ctgtgagtgtaagtgtgag

SEQ ID NO: 3987670 - DNA, 17 bp, Homo sapiens
ctgtgagttctccctgt

SEQ ID NO: 3987671 - DNA, 17 bp, Homo sapiens
ctgtgatcttttaaagt

SEQ ID NO: 3987672 - DNA, 21 bp, Homo sapiens
ctgtgcaacctcttggcctga

SEQ ID NO: 3987673 - DNA, 14 bp, Homo sapiens
ctgtgcactgccca

SEQ ID NO: 3987674 - DNA, 18 bp, Homo sapiens
ctgtgcagaataatggaa

SEQ ID NO: 3987675 - DNA, 18 bp, Homo sapiens
ctgtgcagatgagcagtc

SEQ ID NO: 3987676 - DNA, 15 bp, Homo sapiens
ctgtgcagcgcagct

SEQ ID NO: 3987677 - DNA, 16 bp, Homo sapiens
ctgtgcagggctggtt

SEQ ID NO: 3987678 - DNA, 18 bp, Homo sapiens
ctgtgcagggctggtttg

SEQ ID NO: 3987679 - DNA, 16 bp, Homo sapiens
ctgtgcatagtgctgg

SEQ ID NO: 3987680 - DNA, 20 bp, Homo sapiens
ctgtgcatgggtgaagggag

SEQ ID NO: 3987681 - DNA, 14 bp, Homo sapiens
ctgtgccagaggcc

SEQ ID NO: 3987682 - DNA, 16 bp, Homo sapiens
ctgtgccagaggccag

SEQ ID NO: 3987683 - DNA, 14 bp, Homo sapiens
ctgtgccagcccag

SEQ ID NO: 3987684 - DNA, 17 bp, Homo sapiens
ctgtgccagggcagcat

SEQ ID NO: 3987685 - DNA, 23 bp, Homo sapiens
ctgtgccatcaccataacctctg

SEQ ID NO: 3987686 - DNA, 19 bp, Homo sapiens
ctgtgcccacatcccaggc

SEQ ID NO: 3987687 - DNA, 16 bp, Homo sapiens
ctgtgcccactcccta

SEQ ID NO: 3987688 - DNA, 16 bp, Homo sapiens
ctgtgcctctgggact

SEQ ID NO: 3987689 - DNA, 16 bp, Homo sapiens
ctgtgcctggccccag

SEQ ID NO: 3987690 - DNA, 20 bp, Homo sapiens
ctgtgcctggccccagcctg

SEQ ID NO: 3987691 - DNA, 22 bp, Homo sapiens
ctgtgccttcagctgttgcaga

SEQ ID NO: 3987692 - DNA, 20 bp, Homo sapiens
ctgtgcgcataggcctgctt

SEQ ID NO: 3987693 - DNA, 16 bp, Homo sapiens
ctgtgcgtgaaacaca

SEQ ID NO: 3987694 - DNA, 16 bp, Homo sapiens
ctgtgcgtggaaaaag

SEQ ID NO: 3987695 - DNA, 18 bp, Homo sapiens
ctgtgcgtggaaaaagac

SEQ ID NO: 3987696 - DNA, 17 bp, Homo sapiens
ctgtgcgttactaattg

SEQ ID NO: 3987697 - DNA, 20 bp, Homo sapiens
ctgtgctagttttacagatt

SEQ ID NO: 3987698 - DNA, 13 bp, Homo sapiens
ctgtgctggagcc

SEQ ID NO: 3987699 - DNA, 17 bp, Homo sapiens
ctgtgctgtgtttaatc

SEQ ID NO: 3987700 - DNA, 17 bp, Homo sapiens
ctgtgcttgaaggccct

SEQ ID NO: 3987701 - DNA, 18 bp, Homo sapiens
ctgtgcttgaaggccctg

SEQ ID NO: 3987702 - DNA, 22 bp, Homo sapiens
ctgtgcttgaaggccctgctga

SEQ ID NO: 3987703 - DNA, 21 bp, Homo sapiens
ctgtggaacataaaaaggaca

SEQ ID NO: 3987704 - DNA, 20 bp, Homo sapiens
ctgtggaatgaagcttttta

SEQ ID NO: 3987705 - DNA, 21 bp, Homo sapiens
ctgtggaatgagtgtgcatgg

SEQ ID NO: 3987706 - DNA, 19 bp, Homo sapiens
ctgtggaccgtggacaggc

SEQ ID NO: 3987707 - DNA, 20 bp, Homo sapiens
ctgtggaccgtggacaggcc

SEQ ID NO: 3987708 - DNA, 22 bp, Homo sapiens
ctgtggagcaaaaggcagctca

SEQ ID NO: 3987709 - DNA, 22 bp, Homo sapiens
ctgtggccagcttgttatttat

SEQ ID NO: 3987710 - DNA, 22 bp, Homo sapiens
cttaatgtgattactgctctat

SEQ ID NO: 3987711 - DNA, 13 bp, Homo sapiens
cttaattaatttg

SEQ ID NO: 3987712 - DNA, 18 bp, Homo sapiens
cttaattaatttgattaa

SEQ ID NO: 3987713 - DNA, 12 bp, Homo sapiens
cttaatttcctt

SEQ ID NO: 3987714 - DNA, 14 bp, Homo sapiens
cttaatttcctttt

SEQ ID NO: 3987715 - DNA, 21 bp, Homo sapiens
cttaatttcctttttgacact

SEQ ID NO: 3987716 - DNA, 20 bp, Homo sapiens
cttaatttttttttcataga

SEQ ID NO: 3987717 - DNA, 15 bp, Homo sapiens
cttacaaagccttac

SEQ ID NO: 3987718 - DNA, 21 bp, Homo sapiens
cttacaacccagggtgtgaac

SEQ ID NO: 3987719 - DNA, 22 bp, Homo sapiens
cttacacactcaggcctgtgcc

SEQ ID NO: 3987720 - DNA, 16 bp, Homo sapiens
cttacactgaaaatgt

SEQ ID NO: 3987721 - DNA, 23 bp, Homo sapiens
cttacagccctaagtggctgcct

SEQ ID NO: 3987722 - DNA, 22 bp, Homo sapiens
cttacatagttttaaactcatt

SEQ ID NO: 3987723 - DNA, 16 bp, Homo sapiens
cttacatcttctgtga

SEQ ID NO: 3987724 - DNA, 21 bp, Homo sapiens
cttacatcttctgtgaaatat

SEQ ID NO: 3987725 - DNA, 15 bp, Homo sapiens
ctgggctcctccagg

SEQ ID NO: 3987726 - DNA, 20 bp, Homo sapiens
ctgggctcctggaaccaatc

SEQ ID NO: 3987727 - DNA, 20 bp, Homo sapiens
ctgggctgactgggccaggg

SEQ ID NO: 3987728 - DNA, 19 bp, Homo sapiens
ctgggctgctacccagaaa

SEQ ID NO: 3987729 - DNA, 15 bp, Homo sapiens
ctgggctgctggagg

SEQ ID NO: 3987730 - DNA, 12 bp, Homo sapiens
ctgggctggact

SEQ ID NO: 3987731 - DNA, 14 bp, Homo sapiens
ctgggctggactgg

SEQ ID NO: 3987732 - DNA, 12 bp, Homo sapiens
ctgggctggggc

SEQ ID NO: 3987733 - DNA, 14 bp, Homo sapiens
ctgggctggggcca

SEQ ID NO: 3987734 - DNA, 17 bp, Homo sapiens
ctgggctggggccacca

SEQ ID NO: 3987735 - DNA, 21 bp, Homo sapiens
ctgggctggggccaccatccc

SEQ ID NO: 3987736 - DNA, 22 bp, Homo sapiens
ctgggctgtaacgtggcactgg

SEQ ID NO: 3987737 - DNA, 17 bp, Homo sapiens
ctgggctgtctgtcacc

SEQ ID NO: 3987738 - DNA, 15 bp, Homo sapiens
ctgggcttggcctgc

SEQ ID NO: 3987739 - DNA, 18 bp, Homo sapiens
ctgggcttggcctgctgt

SEQ ID NO: 3987740 - DNA, 17 bp, Homo sapiens
ctgggcttggggtgtgg

SEQ ID NO: 3987741 - DNA, 23 bp, Homo sapiens
ctgggcttggggtgtggggtggg

SEQ ID NO: 3987742 - DNA, 16 bp, Homo sapiens
ctggggaaggagccag

SEQ ID NO: 3987743 - DNA, 13 bp, Homo sapiens
ctggggacagagg

SEQ ID NO: 3987744 - DNA, 17 bp, Homo sapiens
ctggggacccccacgat

SEQ ID NO: 3987745 - DNA, 13 bp, Homo sapiens
ctggggactcagg

SEQ ID NO: 3987746 - DNA, 18 bp, Homo sapiens
ctggggaggaatcctgga

SEQ ID NO: 3987747 - DNA, 14 bp, Homo sapiens
ctggggaggacctg

SEQ ID NO: 3987748 - DNA, 20 bp, Homo sapiens
ctggggagtggttaggcagc

SEQ ID NO: 3987749 - DNA, 16 bp, Homo sapiens
ctggggatgtgggagg

SEQ ID NO: 3987750 - DNA, 17 bp, Homo sapiens
ctggggatgtgggaggg

SEQ ID NO: 3987751 - DNA, 22 bp, Homo sapiens
ctggggatgtgggagggagcag

SEQ ID NO: 3987752 - DNA, 14 bp, Homo sapiens
ctggggcagcctct

SEQ ID NO: 3987753 - DNA, 12 bp, Homo sapiens
ctggggcaggct

SEQ ID NO: 3987754 - DNA, 17 bp, Homo sapiens
ctggggcagggggtgaa

SEQ ID NO: 3987755 - DNA, 17 bp, Homo sapiens
ctggggccaccatccct

SEQ ID NO: 3987756 - DNA, 18 bp, Homo sapiens
ctggggccaccatccctg

SEQ ID NO: 3987757 - DNA, 15 bp, Homo sapiens
ctggggccagaggct

SEQ ID NO: 3987758 - DNA, 14 bp, Homo sapiens
ctggggccctgggc

SEQ ID NO: 3987759 - DNA, 11 bp, Homo sapiens
ctggggcctcc

SEQ ID NO: 3987760 - DNA, 12 bp, Homo sapiens
ctggggcctcca

SEQ ID NO: 3987761 - DNA, 17 bp, Homo sapiens
ctggggcctccagaact

SEQ ID NO: 3987762 - DNA, 12 bp, Homo sapiens
ctggggcctctt

SEQ ID NO: 3987763 - DNA, 18 bp, Homo sapiens
ctggggcctgactgctca

SEQ ID NO: 3987764 - DNA, 14 bp, Homo sapiens
ctggggcctggacc

SEQ ID NO: 3987765 - DNA, 17 bp, Homo sapiens
ctggggcctggacctgc

SEQ ID NO: 3987766 - DNA, 19 bp, Homo sapiens
ctggggcctggacctgcct

SEQ ID NO: 3987767 - DNA, 18 bp, Homo sapiens
ctggggcggggcccagga

SEQ ID NO: 3987768 - DNA, 17 bp, Homo sapiens
ctggggctctctgagac

SEQ ID NO: 3987769 - DNA, 14 bp, Homo sapiens
ctggggctctggga

SEQ ID NO: 3987770 - DNA, 18 bp, Homo sapiens
ctggggctggcctcccaa

SEQ ID NO: 3987771 - DNA, 12 bp, Homo sapiens
ctggggctgggg

SEQ ID NO: 3987772 - DNA, 12 bp, Homo sapiens
ctggggctgtgc

SEQ ID NO: 3987773 - DNA, 19 bp, Homo sapiens
ctggggctttgccttgcag

SEQ ID NO: 3987774 - DNA, 18 bp, Homo sapiens
ctgggggaacagatgcta

SEQ ID NO: 3987775 - DNA, 15 bp, Homo sapiens
ctgggggacagagaa

SEQ ID NO: 3987776 - DNA, 13 bp, Homo sapiens
ctgggggactggg

SEQ ID NO: 3987777 - DNA, 17 bp, Homo sapiens
ctgggggactgggagtc

SEQ ID NO: 3987778 - DNA, 17 bp, Homo sapiens
ctgggggactggggggc

SEQ ID NO: 3987779 - DNA, 19 bp, Homo sapiens
ctgggggcaggagggccct

SEQ ID NO: 3987780 - DNA, 17 bp, Homo sapiens
ctgggggccagtgggga

SEQ ID NO: 3987781 - DNA, 18 bp, Homo sapiens
ctggggtaagcggaataa

SEQ ID NO: 3987782 - DNA, 13 bp, Homo sapiens
ctggggtctgagc

SEQ ID NO: 3987783 - DNA, 18 bp, Homo sapiens
ctggggtctgagcatgat

SEQ ID NO: 3987784 - DNA, 20 bp, Homo sapiens
ctggggtgctgcctgaatcc

SEQ ID NO: 3987785 - DNA, 14 bp, Homo sapiens
ctggggtgggaggt

SEQ ID NO: 3987786 - DNA, 23 bp, Homo sapiens
ctggggtgggggtggggagacct

SEQ ID NO: 3987787 - DNA, 15 bp, Homo sapiens
ctgggtacttcttga

SEQ ID NO: 3987788 - DNA, 20 bp, Homo sapiens
ctgggtacttcttgaaggtg

SEQ ID NO: 3987789 - DNA, 15 bp, Homo sapiens
ctgggtaggaaagag

SEQ ID NO: 3987790 - DNA, 19 bp, Homo sapiens
ctgggtaggaaagaggaag

SEQ ID NO: 3987791 - DNA, 17 bp, Homo sapiens
ctgggtcagtctggtgg

SEQ ID NO: 3987792 - DNA, 18 bp, Homo sapiens
ctgggtcagtctggtggg

SEQ ID NO: 3987793 - DNA, 19 bp, Homo sapiens
ctgggtctaatccttctca

SEQ ID NO: 3987794 - DNA, 22 bp, Homo sapiens
ctgggtctcgctttgttgccca

SEQ ID NO: 3987795 - DNA, 17 bp, Homo sapiens
ctgggtcttttgctact

SEQ ID NO: 3987796 - DNA, 22 bp, Homo sapiens
ctgggtgacagagcaagactct

SEQ ID NO: 3987797 - DNA, 19 bp, Homo sapiens
ctgggtgacagagtgagtg

SEQ ID NO: 3987798 - DNA, 14 bp, Homo sapiens
ctgggtgagaccca

SEQ ID NO: 3987799 - DNA, 14 bp, Homo sapiens
ctgggtgcaggagc

SEQ ID NO: 3987800 - DNA, 22 bp, Homo sapiens
ctggcagcctcccatccagggc

SEQ ID NO: 3987801 - DNA, 23 bp, Homo sapiens
ctggcagcctcccatccagggcc

SEQ ID NO: 3987802 - DNA, 21 bp, Homo sapiens
ctggcagctctggacagcccc

SEQ ID NO: 3987803 - DNA, 21 bp, Homo sapiens
ctggcaggcaggggccctgca

SEQ ID NO: 3987804 - DNA, 11 bp, Homo sapiens
ctggcaggcca

SEQ ID NO: 3987805 - DNA, 13 bp, Homo sapiens
ctggcagggctgg

SEQ ID NO: 3987806 - DNA, 19 bp, Homo sapiens
ctggcaggggagacaggag

SEQ ID NO: 3987807 - DNA, 20 bp, Homo sapiens
ctggcaggggagacaggagc

SEQ ID NO: 3987808 - DNA, 22 bp, Homo sapiens
ctggcaggggagacaggagcct

SEQ ID NO: 3987809 - DNA, 15 bp, Homo sapiens
ctggcagtttaaaaa

SEQ ID NO: 3987810 - DNA, 13 bp, Homo sapiens
ctggcatcatggt

SEQ ID NO: 3987811 - DNA, 22 bp, Homo sapiens
ctggcattagaattatttaaac

SEQ ID NO: 3987812 - DNA, 17 bp, Homo sapiens
ctggccaaatagcaaag

SEQ ID NO: 3987813 - DNA, 15 bp, Homo sapiens
ctggccaccagccat

SEQ ID NO: 3987814 - DNA, 20 bp, Homo sapiens
ctggccaccagccatcctcc

SEQ ID NO: 3987815 - DNA, 15 bp, Homo sapiens
ctggccactaaagct

SEQ ID NO: 3987816 - DNA, 18 bp, Homo sapiens
ctggccactaaagcttca

SEQ ID NO: 3987817 - DNA, 13 bp, Homo sapiens
ctggccagaatgc

SEQ ID NO: 3987818 - DNA, 18 bp, Homo sapiens
ctggccagatggcccgga

SEQ ID NO: 3987819 - DNA, 12 bp, Homo sapiens
ctggccagcacc

SEQ ID NO: 3987820 - DNA, 16 bp, Homo sapiens
ctggccagcaccctct

SEQ ID NO: 3987821 - DNA, 11 bp, Homo sapiens
ctggccagccg

SEQ ID NO: 3987822 - DNA, 17 bp, Homo sapiens
ctggccaggagctcttc

SEQ ID NO: 3987823 - DNA, 22 bp, Homo sapiens
ctggccaggcagatctgtgccc

SEQ ID NO: 3987824 - DNA, 17 bp, Homo sapiens
ctggccagggccacgct

SEQ ID NO: 3987825 - DNA, 20 bp, Homo sapiens
ctggccagggccacgctcca

SEQ ID NO: 3987826 - DNA, 22 bp, Homo sapiens
ctggccagggccacgctccagc

SEQ ID NO: 3987827 - DNA, 11 bp, Homo sapiens
ctggccatggg

SEQ ID NO: 3987828 - DNA, 15 bp, Homo sapiens
ctggccatggggccc

SEQ ID NO: 3987829 - DNA, 16 bp, Homo sapiens
ctggccatggggccct

SEQ ID NO: 3987830 - DNA, 18 bp, Homo sapiens
ctggccatggggccctcc

SEQ ID NO: 3987831 - DNA, 22 bp, Homo sapiens
ctggccatggggccctcccaga

SEQ ID NO: 3987832 - DNA, 23 bp, Homo sapiens
ctggcccagccaaaccctgtctg

SEQ ID NO: 3987833 - DNA, 15 bp, Homo sapiens
ctggcccagggccca

SEQ ID NO: 3987834 - DNA, 17 bp, Homo sapiens
ctggcccagggcccaga

SEQ ID NO: 3987835 - DNA, 21 bp, Homo sapiens
ctggcccagggcccagagccc

SEQ ID NO: 3987836 - DNA, 22 bp, Homo sapiens
ctggcccagggcccagagccca

SEQ ID NO: 3987837 - DNA, 23 bp, Homo sapiens
ctggcccagggcccagagcccag

SEQ ID NO: 3987838 - DNA, 16 bp, Homo sapiens
ctggcccatctcagcc

SEQ ID NO: 3987839 - DNA, 20 bp, Homo sapiens
ctggcccatctcagcctcct

SEQ ID NO: 3987840 - DNA, 18 bp, Homo sapiens
ctggccccagcctgggcc

SEQ ID NO: 3987841 - DNA, 12 bp, Homo sapiens
ctggccccaggc

SEQ ID NO: 3987842 - DNA, 15 bp, Homo sapiens
ctggccccaggcccc

SEQ ID NO: 3987843 - DNA, 16 bp, Homo sapiens
ctggccccagggcacc

SEQ ID NO: 3987844 - DNA, 22 bp, Homo sapiens
ctggccccagtgcggttcctca

SEQ ID NO: 3987845 - DNA, 23 bp, Homo sapiens
ctggccccagtgcggttcctcat

SEQ ID NO: 3987846 - DNA, 17 bp, Homo sapiens
ctggcccccaacctcag

SEQ ID NO: 3987847 - DNA, 24 bp, Homo sapiens
ctggcccctcgcctgtggagctca

SEQ ID NO: 3987848 - DNA, 13 bp, Homo sapiens
ctggcccctgggt

SEQ ID NO: 3987849 - DNA, 14 bp, Homo sapiens
ctggcccctgggtc

SEQ ID NO: 3987850 - DNA, 14 bp, Homo sapiens
ctggccctatttag

SEQ ID NO: 3987851 - DNA, 20 bp, Homo sapiens
ctggccctgcctcctgggaa

SEQ ID NO: 3987852 - DNA, 14 bp, Homo sapiens
ctggcccttacaca

SEQ ID NO: 3987853 - DNA, 18 bp, Homo sapiens
ctggcccttacacactca

SEQ ID NO: 3987854 - DNA, 23 bp, Homo sapiens
ctggcccttacacactcaggcct

SEQ ID NO: 3987855 - DNA, 13 bp, Homo sapiens
ctggcccttagag

SEQ ID NO: 3987856 - DNA, 20 bp, Homo sapiens
ctggccgagggtcctggctc

SEQ ID NO: 3987857 - DNA, 17 bp, Homo sapiens
ctggccgagtccaagct

SEQ ID NO: 3987858 - DNA, 18 bp, Homo sapiens
ctggccgagtccaagctg

SEQ ID NO: 3987859 - DNA, 23 bp, Homo sapiens
ctggccgagtccaagctgggaga

SEQ ID NO: 3987860 - DNA, 17 bp, Homo sapiens
ctggccgggggaggtgg

SEQ ID NO: 3987861 - DNA, 19 bp, Homo sapiens
ctggcctaaaatcttggaa

SEQ ID NO: 3987862 - DNA, 19 bp, Homo sapiens
ctggcctatccgctgccag

SEQ ID NO: 3987863 - DNA, 13 bp, Homo sapiens
ctggcctctgtgc

SEQ ID NO: 3987864 - DNA, 15 bp, Homo sapiens
ctggcctctgtgcct

SEQ ID NO: 3987865 - DNA, 16 bp, Homo sapiens
ctggcctctgtgcctt

SEQ ID NO: 3987866 - DNA, 20 bp, Homo sapiens
ctggcctctgtgccttcttt

SEQ ID NO: 3987867 - DNA, 15 bp, Homo sapiens
ctggcctgagagtca

SEQ ID NO: 3987868 - DNA, 19 bp, Homo sapiens
ctggcctgagagtcagctc

SEQ ID NO: 3987869 - DNA, 18 bp, Homo sapiens
ctggcctggactgttttc

SEQ ID NO: 3987870 - DNA, 21 bp, Homo sapiens
ctggcctggatctccccactc

SEQ ID NO: 3987871 - DNA, 16 bp, Homo sapiens
ctggcctggggtcagg

SEQ ID NO: 3987872 - DNA, 18 bp, Homo sapiens
ctggcctggggtcaggcc

SEQ ID NO: 3987873 - DNA, 13 bp, Homo sapiens
ctggcgcaggtgg

SEQ ID NO: 3987874 - DNA, 20 bp, Homo sapiens
ctggctaaagataattgcta

SEQ ID NO: 3987875 - DNA, 23 bp, Homo sapiens
ctggctagaggccagccccaccc

SEQ ID NO: 3987876 - DNA, 18 bp, Homo sapiens
ctggctagagtcctcact

SEQ ID NO: 3987877 - DNA, 21 bp, Homo sapiens
ctggctagagtcctcactccc

SEQ ID NO: 3987878 - DNA, 19 bp, Homo sapiens
ctggctcacagtacagcat

SEQ ID NO: 3987879 - DNA, 24 bp, Homo sapiens
ctggctcacagtacagcatgtgcc

SEQ ID NO: 3987880 - DNA, 20 bp, Homo sapiens
ctggctcagggtcaaagaca

SEQ ID NO: 3987881 - DNA, 15 bp, Homo sapiens
ctggctccactcttg

SEQ ID NO: 3987882 - DNA, 23 bp, Homo sapiens
ctggctccactcttgatctctct

SEQ ID NO: 3987883 - DNA, 13 bp, Homo sapiens
ctggctccagcct

SEQ ID NO: 3987884 - DNA, 19 bp, Homo sapiens
ctggctcccacaggccctt

SEQ ID NO: 3987885 - DNA, 20 bp, Homo sapiens
ctggctccccctccccaggc

SEQ ID NO: 3987886 - DNA, 22 bp, Homo sapiens
ctggctccccctccccaggctg

SEQ ID NO: 3987887 - DNA, 23 bp, Homo sapiens
ctggctccccctccccaggctgg

SEQ ID NO: 3987888 - DNA, 16 bp, Homo sapiens
ctgggccactggggac

SEQ ID NO: 3987889 - DNA, 17 bp, Homo sapiens
ctgggccagcggggctg

SEQ ID NO: 3987890 - DNA, 21 bp, Homo sapiens
ctgggccataatgttgcttct

SEQ ID NO: 3987891 - DNA, 12 bp, Homo sapiens
ctgggccatcct

SEQ ID NO: 3987892 - DNA, 22 bp, Homo sapiens
ctgggccatgtccaaagaggct

SEQ ID NO: 3987893 - DNA, 15 bp, Homo sapiens
ctgggcccacatccg

SEQ ID NO: 3987894 - DNA, 21 bp, Homo sapiens
ctgggcccctccacgcctcct

SEQ ID NO: 3987895 - DNA, 21 bp, Homo sapiens
ctgggcccctcttattcctct

SEQ ID NO: 3987896 - DNA, 19 bp, Homo sapiens
ctgggcccggaagggcttt

SEQ ID NO: 3987897 - DNA, 11 bp, Homo sapiens
ctgggccctct

SEQ ID NO: 3987898 - DNA, 14 bp, Homo sapiens
ctgggccctctctt

SEQ ID NO: 3987899 - DNA, 15 bp, Homo sapiens
ctgggccctctcttc

SEQ ID NO: 3987900 - DNA, 23 bp, Homo sapiens
ctgggccctggaggaattcagct

SEQ ID NO: 3987901 - DNA, 15 bp, Homo sapiens
ctgggcctcccttgg

SEQ ID NO: 3987902 - DNA, 18 bp, Homo sapiens
ctgggcctcccttgggct

SEQ ID NO: 3987903 - DNA, 11 bp, Homo sapiens
ctgggcctctg

SEQ ID NO: 3987904 - DNA, 16 bp, Homo sapiens
ctgggcctgcccctgt

SEQ ID NO: 3987905 - DNA, 23 bp, Homo sapiens
ctgggcctttgcaagatgcttgg

SEQ ID NO: 3987906 - DNA, 18 bp, Homo sapiens
ctgggctcagggagggag

SEQ ID NO: 3987907 - DNA, 16 bp, Homo sapiens
ctgggctccccccagt

SEQ ID NO: 3987908 - DNA, 16 bp, Homo sapiens
ctgggctccctgatga

SEQ ID NO: 3987909 - DNA, 22 bp, Homo sapiens
cctggctaataaggctttagtg

SEQ ID NO: 3987910 - DNA, 14 bp, Homo sapiens
cctggctacatccc

SEQ ID NO: 3987911 - DNA, 16 bp, Homo sapiens
ctccactcccacctca

SEQ ID NO: 3987912 - DNA, 19 bp, Homo sapiens
ctccactcgacccagaatg

SEQ ID NO: 3987913 - DNA, 22 bp, Homo sapiens
ctccactcttgatctctcttgt

SEQ ID NO: 3987914 - DNA, 23 bp, Homo sapiens
ctccactcttgatctctcttgtc

SEQ ID NO: 3987915 - DNA, 11 bp, Homo sapiens
ctccactgcct

SEQ ID NO: 3987916 - DNA, 13 bp, Homo sapiens
ctccactgccttc

SEQ ID NO: 3987917 - DNA, 13 bp, Homo sapiens
ctccactggatgg

SEQ ID NO: 3987918 - DNA, 14 bp, Homo sapiens
ctccactggatgga

SEQ ID NO: 3987919 - DNA, 16 bp, Homo sapiens
ctccactggatggagg

SEQ ID NO: 3987920 - DNA, 14 bp, Homo sapiens
ctccagaagatgcc

SEQ ID NO: 3987921 - DNA, 17 bp, Homo sapiens
ctccagaagatgccagc

SEQ ID NO: 3987922 - DNA, 21 bp, Homo sapiens
ctccagaagatgccagcttct

SEQ ID NO: 3987923 - DNA, 22 bp, Homo sapiens
ctccagaagatgccagcttctc

SEQ ID NO: 3987924 - DNA, 23 bp, Homo sapiens
ctccagaagatgccagcttctct

SEQ ID NO: 3987925 - DNA, 14 bp, Homo sapiens
ctccagaagcctct

SEQ ID NO: 3987926 - DNA, 19 bp, Homo sapiens
ctccagaagcctctggcta

SEQ ID NO: 3987927 - DNA, 16 bp, Homo sapiens
ctatgactgctcccca

SEQ ID NO: 3987928 - DNA, 17 bp, Homo sapiens
ctatgactgctccccag

SEQ ID NO: 3987929 - DNA, 12 bp, Homo sapiens
ctatgaggaaag

SEQ ID NO: 3987930 - DNA, 22 bp, Homo sapiens
ctatgcatggtgccccaggacc

SEQ ID NO: 3987931 - DNA, 23 bp, Homo sapiens
ctatgcatggtgccccaggacca

SEQ ID NO: 3987932 - DNA, 20 bp, Homo sapiens
ctatgcccaggtaccaccct

SEQ ID NO: 3987933 - DNA, 15 bp, Homo sapiens
ctatggaaagatggc

SEQ ID NO: 3987934 - DNA, 14 bp, Homo sapiens
ctatggcctgtgcg

SEQ ID NO: 3987935 - DNA, 14 bp, Homo sapiens
ctatgggagcccca

SEQ ID NO: 3987936 - DNA, 15 bp, Homo sapiens
ctatgggagccccag

SEQ ID NO: 3987937 - DNA, 16 bp, Homo sapiens
ctatgggagccccagg

SEQ ID NO: 3987938 - DNA, 17 bp, Homo sapiens
ctatgggagccccaggg

SEQ ID NO: 3987939 - DNA, 19 bp, Homo sapiens
ctatgggcctgccgggctg

SEQ ID NO: 3987940 - DNA, 15 bp, Homo sapiens
ctatggggatggtcc

SEQ ID NO: 3987941 - DNA, 18 bp, Homo sapiens
ctatggtatgctggccag

SEQ ID NO: 3987942 - DNA, 19 bp, Homo sapiens
ctatggtatgctggccagc

SEQ ID NO: 3987943 - DNA, 21 bp, Homo sapiens
ctatggtgctgccttgcttct

SEQ ID NO: 3987944 - DNA, 14 bp, Homo sapiens
ctatggttatgaaa

SEQ ID NO: 3987945 - DNA, 15 bp, Homo sapiens
ctatggttatgaaag

SEQ ID NO: 3987946 - DNA, 21 bp, Homo sapiens
ctatgtaagaattcagaagac

SEQ ID NO: 3987947 - DNA, 13 bp, Homo sapiens
ctatgtatcaatg

SEQ ID NO: 3987948 - DNA, 14 bp, Homo sapiens
ctatgtcctaagga

SEQ ID NO: 3987949 - DNA, 21 bp, Homo sapiens
ctatgtgacatttctcttccc

SEQ ID NO: 3987950 - DNA, 22 bp, Homo sapiens
ctatgtgacatttctcttcccc

SEQ ID NO: 3987951 - DNA, 17 bp, Homo sapiens
ctatgtgccagttcctg

SEQ ID NO: 3987952 - DNA, 13 bp, Homo sapiens
ctatgtgctgggt

SEQ ID NO: 3987953 - DNA, 14 bp, Homo sapiens
ctatgttaaatact

SEQ ID NO: 3987954 - DNA, 18 bp, Homo sapiens
ctatgttaaatactgtgc

SEQ ID NO: 3987955 - DNA, 12 bp, Homo sapiens
ctatgttcccca

SEQ ID NO: 3987956 - DNA, 17 bp, Homo sapiens
ctattaaagtgactttc

SEQ ID NO: 3987957 - DNA, 22 bp, Homo sapiens
ctattaaatagttatataattc

SEQ ID NO: 3987958 - DNA, 19 bp, Homo sapiens
ctattaatcacctctctgt

SEQ ID NO: 3987959 - DNA, 12 bp, Homo sapiens
ctattagacttt

SEQ ID NO: 3987960 - DNA, 18 bp, Homo sapiens
ctattagactttagaaat

SEQ ID NO: 3987961 - DNA, 22 bp, Homo sapiens
ctattagactttagaaataaat

SEQ ID NO: 3987962 - DNA, 14 bp, Homo sapiens
ctattatagccaca

SEQ ID NO: 3987963 - DNA, 23 bp, Homo sapiens
ctattcaagaggaaatgtcacag

SEQ ID NO: 3987964 - DNA, 13 bp, Homo sapiens
ctattcagacaag

SEQ ID NO: 3987965 - DNA, 17 bp, Homo sapiens
ctattcagtaataactc

SEQ ID NO: 3987966 - DNA, 15 bp, Homo sapiens
ctattccaaaaaggt

SEQ ID NO: 3987967 - DNA, 23 bp, Homo sapiens
ctattccctttgacttcagctgc

SEQ ID NO: 3987968 - DNA, 17 bp, Homo sapiens
ctattccgagcccttag

SEQ ID NO: 3987969 - DNA, 17 bp, Homo sapiens
ctattccttttctgtat

SEQ ID NO: 3987970 - DNA, 16 bp, Homo sapiens
ctattctcaccaggaa

SEQ ID NO: 3987971 - DNA, 21 bp, Homo sapiens
ctattctgatgaatctcaaag

SEQ ID NO: 3987972 - DNA, 19 bp, Homo sapiens
ctattctgtcagtgttaaa

SEQ ID NO: 3987973 - DNA, 20 bp, Homo sapiens
ctattgaattcggaactgtc

SEQ ID NO: 3987974 - DNA, 18 bp, Homo sapiens
ctattgatactctttcta

SEQ ID NO: 3987975 - DNA, 19 bp, Homo sapiens
ctattgccttctttgaaga

SEQ ID NO: 3987976 - DNA, 19 bp, Homo sapiens
ctattgcgctctcaagacc

SEQ ID NO: 3987977 - DNA, 14 bp, Homo sapiens
ctattgcttcacca

SEQ ID NO: 3987978 - DNA, 21 bp, Homo sapiens
ctattggccaacaatcctttc

SEQ ID NO: 3987979 - DNA, 13 bp, Homo sapiens
ctattgtaaatat

SEQ ID NO: 3987980 - DNA, 14 bp, Homo sapiens
ctattgtcattaaa

SEQ ID NO: 3987981 - DNA, 16 bp, Homo sapiens
ctatttaaaacttgta

SEQ ID NO: 3987982 - DNA, 21 bp, Homo sapiens
ctatttaagttatcaacttta

SEQ ID NO: 3987983 - DNA, 14 bp, Homo sapiens
ctatttaatattta

SEQ ID NO: 3987984 - DNA, 15 bp, Homo sapiens
ctatttaatatttat

SEQ ID NO: 3987985 - DNA, 22 bp, Homo sapiens
ctatttagtgttagttataaat

SEQ ID NO: 3987986 - DNA, 19 bp, Homo sapiens
ctcactgaaggacctgagc

SEQ ID NO: 3987987 - DNA, 21 bp, Homo sapiens
ctcactgaaggacctgagctg

SEQ ID NO: 3987988 - DNA, 15 bp, Homo sapiens
ctcactgatatattt

SEQ ID NO: 3987989 - DNA, 12 bp, Homo sapiens
ctcactgcagcc

SEQ ID NO: 3987990 - DNA, 22 bp, Homo sapiens
ctcactgcagtcttatttccaa

SEQ ID NO: 3987991 - DNA, 11 bp, Homo sapiens
ctcactgccag

SEQ ID NO: 3987992 - DNA, 21 bp, Homo sapiens
ctcactgccaggccagcctcc

SEQ ID NO: 3987993 - DNA, 13 bp, Homo sapiens
ctcactgcctccc

SEQ ID NO: 3987994 - DNA, 14 bp, Homo sapiens
ctcactgcctcccc

SEQ ID NO: 3987995 - DNA, 16 bp, Homo sapiens
ctcactgctcaagaag

SEQ ID NO: 3987996 - DNA, 19 bp, Homo sapiens
ctcactgctcaagaagaca

SEQ ID NO: 3987997 - DNA, 12 bp, Homo sapiens
ctcactgggtgg

SEQ ID NO: 3987998 - DNA, 10 bp, Homo sapiens
ctcactgtga

SEQ ID NO: 3987999 - DNA, 12 bp, Homo sapiens
ctcactgttccc

SEQ ID NO: 3988000 - DNA, 20 bp, Homo sapiens
ctcactgttccctctgctcc

SEQ ID NO: 3988001 - DNA, 16 bp, Homo sapiens
ctcactgttctgcaaa

SEQ ID NO: 3988002 - DNA, 15 bp, Homo sapiens
ctcactgttgaattt

SEQ ID NO: 3988003 - DNA, 21 bp, Homo sapiens
ctcactgttgaattttctcta

SEQ ID NO: 3988004 - DNA, 14 bp, Homo sapiens
ctcacttcaccctg

SEQ ID NO: 3988005 - DNA, 13 bp, Homo sapiens
ctcactttaaacc

SEQ ID NO: 3988006 - DNA, 16 bp, Homo sapiens
ctcactttaaacctgt

SEQ ID NO: 3988007 - DNA, 21 bp, Homo sapiens
ctcagaaactcccctgggggt

SEQ ID NO: 3988008 - DNA, 10 bp, Homo sapiens
ctcagaaagt

SEQ ID NO: 3988009 - DNA, 17 bp, Homo sapiens
ctcagaaagtcaccagg

SEQ ID NO: 3988010 - DNA, 21 bp, Homo sapiens
ctcagaaagtcaccaggactt

SEQ ID NO: 3988011 - DNA, 18 bp, Homo sapiens
ctcagaaagtgcctgaca

SEQ ID NO: 3988012 - DNA, 20 bp, Homo sapiens
ctcagaacttgctgctgtct

SEQ ID NO: 3988013 - DNA, 23 bp, Homo sapiens
ctcagaacttgctgctgtcttgt

SEQ ID NO: 3988014 - DNA, 17 bp, Homo sapiens
ctcagaataaggcaggc

SEQ ID NO: 3988015 - DNA, 19 bp, Homo sapiens
ctcagaataaggcaggcat

SEQ ID NO: 3988016 - DNA, 12 bp, Homo sapiens
ctcagaatattg

SEQ ID NO: 3988017 - DNA, 16 bp, Homo sapiens
ctcagaatctcaaata

SEQ ID NO: 3988018 - DNA, 17 bp, Homo sapiens
ctcagaatctcaaataa

SEQ ID NO: 3988019 - DNA, 14 bp, Homo sapiens
ctcagaattatttt

SEQ ID NO: 3988020 - DNA, 13 bp, Homo sapiens
ctcagacattggc

SEQ ID NO: 3988021 - DNA, 17 bp, Homo sapiens
ctcagacggcggccagg

SEQ ID NO: 3988022 - DNA, 19 bp, Homo sapiens
ctcagacggcggccaggca

SEQ ID NO: 3988023 - DNA, 18 bp, Homo sapiens
ctcagacgttgcctgaga

SEQ ID NO: 3988024 - DNA, 22 bp, Homo sapiens
ctcagacgttgcctgagaagaa

SEQ ID NO: 3988025 - DNA, 16 bp, Homo sapiens
ctcagacttaccagga

SEQ ID NO: 3988026 - DNA, 21 bp, Homo sapiens
ctcagagaaaaatgctcccca

SEQ ID NO: 3988027 - DNA, 20 bp, Homo sapiens
ctcagagaaggaaaagactg

SEQ ID NO: 3988028 - DNA, 22 bp, Homo sapiens
ctcagagactgcaagctgcttg

SEQ ID NO: 3988029 - DNA, 23 bp, Homo sapiens
ctcagagattcttgaagaatgaa

SEQ ID NO: 3988030 - DNA, 14 bp, Homo sapiens
ctcagagcatctgg

SEQ ID NO: 3988031 - DNA, 16 bp, Homo sapiens
ctcagagcatctggct

SEQ ID NO: 3988032 - DNA, 18 bp, Homo sapiens
ctcagagcatctggctgt

SEQ ID NO: 3988033 - DNA, 14 bp, Homo sapiens
ctcagagcatgtgt

SEQ ID NO: 3988034 - DNA, 16 bp, Homo sapiens
ctcagagcatgtgtca

SEQ ID NO: 3988035 - DNA, 19 bp, Homo sapiens
ctcagagccctgccctgca

SEQ ID NO: 3988036 - DNA, 18 bp, Homo sapiens
ctcagagcgccaggaagc

SEQ ID NO: 3988037 - DNA, 20 bp, Homo sapiens
ctcagaggagctctaccctg

SEQ ID NO: 3988038 - DNA, 22 bp, Homo sapiens
ctcagaggagctctaccctgct

SEQ ID NO: 3988039 - DNA, 16 bp, Homo sapiens
ctcagaggcccaggaa

SEQ ID NO: 3988040 - DNA, 18 bp, Homo sapiens
ctcagaggcccaggaatc

SEQ ID NO: 3988041 - DNA, 15 bp, Homo sapiens
ctcagaggcctgctg

SEQ ID NO: 3988042 - DNA, 22 bp, Homo sapiens
ctcagaggcctgctgccagtgc

SEQ ID NO: 3988043 - DNA, 17 bp, Homo sapiens
ctcagaggcgcactgtg

SEQ ID NO: 3988044 - DNA, 18 bp, Homo sapiens
ctcagaggcgcactgtga

SEQ ID NO: 3988045 - DNA, 17 bp, Homo sapiens
ctcagatatttatattt

SEQ ID NO: 3988046 - DNA, 10 bp, Homo sapiens
ctcagatcca

SEQ ID NO: 3988047 - DNA, 17 bp, Homo sapiens
ctcagatccagggacag

SEQ ID NO: 3988048 - DNA, 18 bp, Homo sapiens
ctcagatctgtctgatag

SEQ ID NO: 3988049 - DNA, 18 bp, Homo sapiens
ctcagatgcagtttggag

SEQ ID NO: 3988050 - DNA, 18 bp, Homo sapiens
ctcagatggactgggagg

SEQ ID NO: 3988051 - DNA, 16 bp, Homo sapiens
ctcagattcttcattg

SEQ ID NO: 3988052 - DNA, 14 bp, Homo sapiens
cctggtgggccaac

SEQ ID NO: 3988053 - DNA, 23 bp, Homo sapiens
cctggtgggccaacaaagaacac

SEQ ID NO: 3988054 - DNA, 16 bp, Homo sapiens
cctggtggtcagatgc

SEQ ID NO: 3988055 - DNA, 17 bp, Homo sapiens
cctggtggtcagatgca

SEQ ID NO: 3988056 - DNA, 22 bp, Homo sapiens
cctggttcccgtttctccacct

SEQ ID NO: 3988057 - DNA, 20 bp, Homo sapiens
cctggttccttcctatgccc

SEQ ID NO: 3988058 - DNA, 17 bp, Homo sapiens
cctggttttgtacactg

SEQ ID NO: 3988059 - DNA, 21 bp, Homo sapiens
cctggttttgtacactgctgt

SEQ ID NO: 3988060 - DNA, 19 bp, Homo sapiens
cctgtaacatactggcctg

SEQ ID NO: 3988061 - DNA, 23 bp, Homo sapiens
cctgtaacatactggcctggact

SEQ ID NO: 3988062 - DNA, 21 bp, Homo sapiens
cctgtacactgaatatttata

SEQ ID NO: 3988063 - DNA, 16 bp, Homo sapiens
cctgtaccaaatctga

SEQ ID NO: 3988064 - DNA, 14 bp, Homo sapiens
cctgtagactagtg

SEQ ID NO: 3988065 - DNA, 13 bp, Homo sapiens
cctgtagagttgc

SEQ ID NO: 3988066 - DNA, 14 bp, Homo sapiens
cctgtagagttgct

SEQ ID NO: 3988067 - DNA, 20 bp, Homo sapiens
cctgtagatgcagaaaaaga

SEQ ID NO: 3988068 - DNA, 21 bp, Homo sapiens
cctgtagatgcagaaaaagaa

SEQ ID NO: 3988069 - DNA, 22 bp, Homo sapiens
cctgtagatgcagaaaaagaaa

SEQ ID NO: 3988070 - DNA, 15 bp, Homo sapiens
cctgtagccatctgc

SEQ ID NO: 3988071 - DNA, 13 bp, Homo sapiens
cctgtataagcac

SEQ ID NO: 3988072 - DNA, 17 bp, Homo sapiens
cctgtataagcactgaa

SEQ ID NO: 3988073 - DNA, 16 bp, Homo sapiens
cctgtataagtggagg

SEQ ID NO: 3988074 - DNA, 23 bp, Homo sapiens
cctgtcaagttaacaaggaatgc

SEQ ID NO: 3988075 - DNA, 15 bp, Homo sapiens
cctgtcacattgcat

SEQ ID NO: 3988076 - DNA, 21 bp, Homo sapiens
cctgtcacattgcattctatt

SEQ ID NO: 3988077 - DNA, 20 bp, Homo sapiens
cctgtcatagagctgcaggg

SEQ ID NO: 3988078 - DNA, 20 bp, Homo sapiens
cctgtcatttgaacctggat

SEQ ID NO: 3988079 - DNA, 14 bp, Homo sapiens
cctgtccagcctgg

SEQ ID NO: 3988080 - DNA, 16 bp, Homo sapiens
cctgtccagcctgggc

SEQ ID NO: 3988081 - DNA, 14 bp, Homo sapiens
cctgtccagctcca

SEQ ID NO: 3988082 - DNA, 23 bp, Homo sapiens
cctgtcccacccacacagctgcc

SEQ ID NO: 3988083 - DNA, 22 bp, Homo sapiens
cctgtcccacccccttccccca

SEQ ID NO: 3988084 - DNA, 20 bp, Homo sapiens
cctgtcccaggccggcccag

SEQ ID NO: 3988085 - DNA, 19 bp, Homo sapiens
cctgtcccatgcaggccct

SEQ ID NO: 3988086 - DNA, 16 bp, Homo sapiens
cctgtcccatggacac

SEQ ID NO: 3988087 - DNA, 23 bp, Homo sapiens
cctgtccccctcccctcccagtc

SEQ ID NO: 3988088 - DNA, 13 bp, Homo sapiens
cctgtccctctag

SEQ ID NO: 3988089 - DNA, 14 bp, Homo sapiens
cctgtcccttgcct

SEQ ID NO: 3988090 - DNA, 17 bp, Homo sapiens
cctgtcccttgcctctg

SEQ ID NO: 3988091 - DNA, 19 bp, Homo sapiens
cctgtcccttgcctctgcc

SEQ ID NO: 3988092 - DNA, 15 bp, Homo sapiens
cctgtcccttttccc

SEQ ID NO: 3988093 - DNA, 18 bp, Homo sapiens
cctgtcctaaggaacctt

SEQ ID NO: 3988094 - DNA, 18 bp, Homo sapiens
cctgtcctcatgacccct

SEQ ID NO: 3988095 - DNA, 22 bp, Homo sapiens
cctgtcctcccatcccctggac

SEQ ID NO: 3988096 - DNA, 15 bp, Homo sapiens
cctgtcctttcttgc

SEQ ID NO: 3988097 - DNA, 14 bp, Homo sapiens
cctgtcgagacact

SEQ ID NO: 3988098 - DNA, 15 bp, Homo sapiens
cctgtcgagacactt

SEQ ID NO: 3988099 - DNA, 18 bp, Homo sapiens
cctgtcgagacacttgcc

SEQ ID NO: 3988100 - DNA, 14 bp, Homo sapiens
cctgtcgtgccagt

SEQ ID NO: 3988101 - DNA, 16 bp, Homo sapiens
cctgtcgtgccagtcc

SEQ ID NO: 3988102 - DNA, 19 bp, Homo sapiens
cctgtctaggtctcctcag

SEQ ID NO: 3988103 - DNA, 21 bp, Homo sapiens
cctgtctaggtctcctcaggg

SEQ ID NO: 3988104 - DNA, 14 bp, Homo sapiens
cctgtctcagcctc

SEQ ID NO: 3988105 - DNA, 17 bp, Homo sapiens
cctgtctcatccccagg

SEQ ID NO: 3988106 - DNA, 13 bp, Homo sapiens
cctgtctccagct

SEQ ID NO: 3988107 - DNA, 15 bp, Homo sapiens
cctgtctccagctgc

SEQ ID NO: 3988108 - DNA, 20 bp, Homo sapiens
cctgtctccagctgcctggg

SEQ ID NO: 3988109 - DNA, 23 bp, Homo sapiens
cctgtctccagctgcctgggccc

SEQ ID NO: 3988110 - DNA, 23 bp, Homo sapiens
cctgtctgagactcacaggaagg

SEQ ID NO: 3988111 - DNA, 18 bp, Homo sapiens
cctgtctgctccagctct

SEQ ID NO: 3988112 - DNA, 19 bp, Homo sapiens
cctgtcttcggccgagctg

SEQ ID NO: 3988113 - DNA, 15 bp, Homo sapiens
cctgtcttctgggca

SEQ ID NO: 3988114 - DNA, 19 bp, Homo sapiens
cctgtgacatggtgcctga

SEQ ID NO: 3988115 - DNA, 16 bp, Homo sapiens
cctgtgaccagcactg

SEQ ID NO: 3988116 - DNA, 17 bp, Homo sapiens
cctgtgaccagcactgt

SEQ ID NO: 3988117 - DNA, 16 bp, Homo sapiens
cctgtgactgtctcac

SEQ ID NO: 3988118 - DNA, 15 bp, Homo sapiens
cctgtgccagcccag

SEQ ID NO: 3988119 - DNA, 17 bp, Homo sapiens
cctgtgccagcccagag

SEQ ID NO: 3988120 - DNA, 19 bp, Homo sapiens
cctgtgcccactccctatc

SEQ ID NO: 3988121 - DNA, 13 bp, Homo sapiens
cctgtgcctccca

SEQ ID NO: 3988122 - DNA, 14 bp, Homo sapiens
cctgtgcctcccag

SEQ ID NO: 3988123 - DNA, 13 bp, Homo sapiens
cctgtgctagttt

SEQ ID NO: 3988124 - DNA, 23 bp, Homo sapiens
cctgtggcatctttgccttgggc

SEQ ID NO: 3988125 - DNA, 18 bp, Homo sapiens
cctgtggccccaccgagc

SEQ ID NO: 3988126 - DNA, 17 bp, Homo sapiens
cctgtgggtccccactc

SEQ ID NO: 3988127 - DNA, 17 bp, Homo sapiens
cctgtgggtgtagccag

SEQ ID NO: 3988128 - DNA, 23 bp, Homo sapiens
cctgtgggtgtagccaggtatgg

SEQ ID NO: 3988129 - DNA, 15 bp, Homo sapiens
cctgtggttacagtg

SEQ ID NO: 3988130 - DNA, 14 bp, Homo sapiens
cctgtgtatggaaa

SEQ ID NO: 3988131 - DNA, 16 bp, Homo sapiens
cctgtgtgagttgagt

SEQ ID NO: 3988132 - DNA, 19 bp, Homo sapiens
cctgtgtgtaggctggggc

SEQ ID NO: 3988133 - DNA, 22 bp, Homo sapiens
cctgtgtgtgttgccctggcat

SEQ ID NO: 3988134 - DNA, 12 bp, Homo sapiens
cctgttaaacag

SEQ ID NO: 3988135 - DNA, 23 bp, Homo sapiens
cctgttagacgtcctccgtccat

SEQ ID NO: 3988136 - DNA, 18 bp, Homo sapiens
cctgttcatgtgcctctg

SEQ ID NO: 3988137 - DNA, 19 bp, Homo sapiens
cctgttcatgtgcctctgc

SEQ ID NO: 3988138 - DNA, 15 bp, Homo sapiens
cctgttccccagaga

SEQ ID NO: 3988139 - DNA, 23 bp, Homo sapiens
cctgttccccagagaaaggggag

SEQ ID NO: 3988140 - DNA, 18 bp, Homo sapiens
cctgttcccctcactgga

SEQ ID NO: 3988141 - DNA, 13 bp, Homo sapiens
cctgttctgaaat

SEQ ID NO: 3988142 - DNA, 14 bp, Homo sapiens
cctgttcttcctcc

SEQ ID NO: 3988143 - DNA, 16 bp, Homo sapiens
cctgttcttcctccag

SEQ ID NO: 3988144 - DNA, 17 bp, Homo sapiens
cctgttgctgtgtttaa

SEQ ID NO: 3988145 - DNA, 14 bp, Homo sapiens
cctgtttaatattt

SEQ ID NO: 3988146 - DNA, 21 bp, Homo sapiens
cctgtttataatctgaagata

SEQ ID NO: 3988147 - DNA, 23 bp, Homo sapiens
cctgtttcaagttcacacctgca

SEQ ID NO: 3988148 - DNA, 12 bp, Homo sapiens
cgtgacctggtc

SEQ ID NO: 3988149 - DNA, 14 bp, Homo sapiens
cgtgagccaccgcg

SEQ ID NO: 3988150 - DNA, 18 bp, Homo sapiens
cgtgagctggggactcag

SEQ ID NO: 3988151 - DNA, 19 bp, Homo sapiens
cgtgagctggggactcagg

SEQ ID NO: 3988152 - DNA, 19 bp, Homo sapiens
cgtgagtgaaccatcatta

SEQ ID NO: 3988153 - DNA, 22 bp, Homo sapiens
cgtgatccatccatctccaggg

SEQ ID NO: 3988154 - DNA, 13 bp, Homo sapiens
cgtgatcttggct

SEQ ID NO: 3988155 - DNA, 13 bp, Homo sapiens
cgtgcaaggactc

SEQ ID NO: 3988156 - DNA, 21 bp, Homo sapiens
cgtgcacgtggagagctggtg

SEQ ID NO: 3988157 - DNA, 14 bp, Homo sapiens
cgtgcactctgcta

SEQ ID NO: 3988158 - DNA, 20 bp, Homo sapiens
cgtgcatcccccctgctcag

SEQ ID NO: 3988159 - DNA, 13 bp, Homo sapiens
cgtgccaggagca

SEQ ID NO: 3988160 - DNA, 15 bp, Homo sapiens
cgtgccagtcctggg

SEQ ID NO: 3988161 - DNA, 16 bp, Homo sapiens
cgtgccttcagctcta

SEQ ID NO: 3988162 - DNA, 17 bp, Homo sapiens
cgtgctactgcactcca

SEQ ID NO: 3988163 - DNA, 16 bp, Homo sapiens
cgtggaacctctgtct

SEQ ID NO: 3988164 - DNA, 19 bp, Homo sapiens
cgtggaacctctgtctcat

SEQ ID NO: 3988165 - DNA, 16 bp, Homo sapiens
cgtggacaggcccagc

SEQ ID NO: 3988166 - DNA, 20 bp, Homo sapiens
cgtggagagctggtgcccgg

SEQ ID NO: 3988167 - DNA, 16 bp, Homo sapiens
cgtggagccagggagc

SEQ ID NO: 3988168 - DNA, 17 bp, Homo sapiens
cgtggaggaggaaggca

SEQ ID NO: 3988169 - DNA, 23 bp, Homo sapiens
cgtggcctcttgagcagtggctg

SEQ ID NO: 3988170 - DNA, 15 bp, Homo sapiens
cgtggctcagccagc

SEQ ID NO: 3988171 - DNA, 18 bp, Homo sapiens
cgtggcttcccgctcagc

SEQ ID NO: 3988172 - DNA, 19 bp, Homo sapiens
cgtggcttcccgctcagcc

SEQ ID NO: 3988173 - DNA, 21 bp, Homo sapiens
cgtggcttcccgctcagccct

SEQ ID NO: 3988174 - DNA, 17 bp, Homo sapiens
cgtggtatgtctgccat

SEQ ID NO: 3988175 - DNA, 19 bp, Homo sapiens
cgtggtcactgtgcactgc

SEQ ID NO: 3988176 - DNA, 20 bp, Homo sapiens
cgtggtccatgctgatgatt

SEQ ID NO: 3988177 - DNA, 23 bp, Homo sapiens
cgtggttattagcaaggctgggt

SEQ ID NO: 3988178 - DNA, 19 bp, Homo sapiens
cctctctcttctgctccac

SEQ ID NO: 3988179 - DNA, 18 bp, Homo sapiens
cctctctctttcctccac

SEQ ID NO: 3988180 - DNA, 19 bp, Homo sapiens
cctctctgagactgctaag

SEQ ID NO: 3988181 - DNA, 12 bp, Homo sapiens
cctctctgagtc

SEQ ID NO: 3988182 - DNA, 13 bp, Homo sapiens
cctctctgagtct

SEQ ID NO: 3988183 - DNA, 18 bp, Homo sapiens
cctctctgagtctggact

SEQ ID NO: 3988184 - DNA, 18 bp, Homo sapiens
cctctctgatgtcccagt

SEQ ID NO: 3988185 - DNA, 22 bp, Homo sapiens
cctctctgcagacttcccagct

SEQ ID NO: 3988186 - DNA, 23 bp, Homo sapiens
cctctctgcagacttcccagcta

SEQ ID NO: 3988187 - DNA, 13 bp, Homo sapiens
cctctctgcccca

SEQ ID NO: 3988188 - DNA, 18 bp, Homo sapiens
cctctctgccccacccaa

SEQ ID NO: 3988189 - DNA, 22 bp, Homo sapiens
cctctctggaaagaggctctgg

SEQ ID NO: 3988190 - DNA, 19 bp, Homo sapiens
cctctctgtagtttatggc

SEQ ID NO: 3988191 - DNA, 13 bp, Homo sapiens
cctctctgtccct

SEQ ID NO: 3988192 - DNA, 16 bp, Homo sapiens
cctctcttccccttcc

SEQ ID NO: 3988193 - DNA, 19 bp, Homo sapiens
cctctgacgtccacctcct

SEQ ID NO: 3988194 - DNA, 14 bp, Homo sapiens
cctctgagcccagc

SEQ ID NO: 3988195 - DNA, 19 bp, Homo sapiens
cctctgatacccagagcat

SEQ ID NO: 3988196 - DNA, 14 bp, Homo sapiens
cctctgatacctca

SEQ ID NO: 3988197 - DNA, 21 bp, Homo sapiens
cctctgattggttttggggaa

SEQ ID NO: 3988198 - DNA, 21 bp, Homo sapiens
cctctgcaagcttcttgctga

SEQ ID NO: 3988199 - DNA, 13 bp, Homo sapiens
cctctgcagtctc

SEQ ID NO: 3988200 - DNA, 19 bp, Homo sapiens
cctctgcagtctcatttct

SEQ ID NO: 3988201 - DNA, 22 bp, Homo sapiens
cctctgccaaaggatgtgatat

SEQ ID NO: 3988202 - DNA, 12 bp, Homo sapiens
cctctgcccctc

SEQ ID NO: 3988203 - DNA, 15 bp, Homo sapiens
cctctgccctggatt

SEQ ID NO: 3988204 - DNA, 19 bp, Homo sapiens
cctctgccggtcgggcagc

SEQ ID NO: 3988205 - DNA, 23 bp, Homo sapiens
cctctgccggtcgggcagccagc

SEQ ID NO: 3988206 - DNA, 10 bp, Homo sapiens
cctctgccta

SEQ ID NO: 3988207 - DNA, 15 bp, Homo sapiens
cctctgcctacagcc

SEQ ID NO: 3988208 - DNA, 15 bp, Homo sapiens
cctctgcctccaccc

SEQ ID NO: 3988209 - DNA, 11 bp, Homo sapiens
cctctgcctgc

SEQ ID NO: 3988210 - DNA, 16 bp, Homo sapiens
cctctgcctgccccgc

SEQ ID NO: 3988211 - DNA, 17 bp, Homo sapiens
cctctgcggggcagggc

SEQ ID NO: 3988212 - DNA, 18 bp, Homo sapiens
cctctgcggggcagggcc

SEQ ID NO: 3988213 - DNA, 13 bp, Homo sapiens
cctctgctcaccg

SEQ ID NO: 3988214 - DNA, 14 bp, Homo sapiens
cctctgctcagcca

SEQ ID NO: 3988215 - DNA, 17 bp, Homo sapiens
cctctgctcagccaagc

SEQ ID NO: 3988216 - DNA, 14 bp, Homo sapiens
cctctgctccccag

SEQ ID NO: 3988217 - DNA, 22 bp, Homo sapiens
cctctgctcctggagcctttga

SEQ ID NO: 3988218 - DNA, 20 bp, Homo sapiens
cctctgctgaatgcagggaa

SEQ ID NO: 3988219 - DNA, 22 bp, Homo sapiens
cctctgctgccgcccttcctgg

SEQ ID NO: 3988220 - DNA, 23 bp, Homo sapiens
cctctgctgccgcccttcctgga

SEQ ID NO: 3988221 - DNA, 19 bp, Homo sapiens
cctctgctgctgtccctcc

SEQ ID NO: 3988222 - DNA, 15 bp, Homo sapiens
cctctgcttctcatc

SEQ ID NO: 3988223 - DNA, 16 bp, Homo sapiens
cctctggacggcaggc

SEQ ID NO: 3988224 - DNA, 14 bp, Homo sapiens
cctctggactggct

SEQ ID NO: 3988225 - DNA, 23 bp, Homo sapiens
cctctggcattagaattatttaa

SEQ ID NO: 3988226 - DNA, 22 bp, Homo sapiens
cctctggctagaggccagcccc

SEQ ID NO: 3988227 - DNA, 23 bp, Homo sapiens
cctctggctagaggccagcccca

SEQ ID NO: 3988228 - DNA, 16 bp, Homo sapiens
cctctggctagagtgg

SEQ ID NO: 3988229 - DNA, 15 bp, Homo sapiens
cctctggctttccca

SEQ ID NO: 3988230 - DNA, 16 bp, Homo sapiens
cctctggctttcccag

SEQ ID NO: 3988231 - DNA, 19 bp, Homo sapiens
cctctgggcacgcctgctg

SEQ ID NO: 3988232 - DNA, 20 bp, Homo sapiens
cctctgtaggcagcagagag

SEQ ID NO: 3988233 - DNA, 16 bp, Homo sapiens
cctctgtcagtcacag

SEQ ID NO: 3988234 - DNA, 15 bp, Homo sapiens
cctctgtcatttgtt

SEQ ID NO: 3988235 - DNA, 15 bp, Homo sapiens
cctctgtcccacccc

SEQ ID NO: 3988236 - DNA, 12 bp, Homo sapiens
cctctgtctcat

SEQ ID NO: 3988237 - DNA, 14 bp, Homo sapiens
cctctgtctcatcc

SEQ ID NO: 3988238 - DNA, 20 bp, Homo sapiens
cctctgtctcatcctcctgg

SEQ ID NO: 3988239 - DNA, 14 bp, Homo sapiens
cctctgtctgccct

SEQ ID NO: 3988240 - DNA, 18 bp, Homo sapiens
cctctgtgccagggcagc

SEQ ID NO: 3988241 - DNA, 14 bp, Homo sapiens
cctctgtgccttct

SEQ ID NO: 3988242 - DNA, 13 bp, Homo sapiens
cctctgtgtcctt

SEQ ID NO: 3988243 - DNA, 19 bp, Homo sapiens
cctctgtgtccttccctgc

SEQ ID NO: 3988244 - DNA, 17 bp, Homo sapiens
cctcttactttgcttga

SEQ ID NO: 3988245 - DNA, 13 bp, Homo sapiens
cctcttattccta

SEQ ID NO: 3988246 - DNA, 16 bp, Homo sapiens
cctcttattcctaagg

SEQ ID NO: 3988247 - DNA, 18 bp, Homo sapiens
cctcttattcctctaggc

SEQ ID NO: 3988248 - DNA, 17 bp, Homo sapiens
cctcttcaccaggtgca

SEQ ID NO: 3988249 - DNA, 14 bp, Homo sapiens
cctcttcactcccc

SEQ ID NO: 3988250 - DNA, 22 bp, Homo sapiens
cctcttccccagaaaggagact

SEQ ID NO: 3988251 - DNA, 21 bp, Homo sapiens
cctcttctaacccaactgact

SEQ ID NO: 3988252 - DNA, 14 bp, Homo sapiens
cctcttctgctctt

SEQ ID NO: 3988253 - DNA, 19 bp, Homo sapiens
cctcttctgctcttttcct

SEQ ID NO: 3988254 - DNA, 15 bp, Homo sapiens
cctcttctggctcaa

SEQ ID NO: 3988255 - DNA, 16 bp, Homo sapiens
cctcttctgggcctga

SEQ ID NO: 3988256 - DNA, 15 bp, Homo sapiens
cctcttcttcttcag

SEQ ID NO: 3988257 - DNA, 17 bp, Homo sapiens
cctcttcttcttcagaa

SEQ ID NO: 3988258 - DNA, 12 bp, Homo sapiens
cctcttctttgt

SEQ ID NO: 3988259 - DNA, 17 bp, Homo sapiens
cctcttctttgtgcctt

SEQ ID NO: 3988260 - DNA, 20 bp, Homo sapiens
cctcttctttgtgcctttgg

SEQ ID NO: 3988261 - DNA, 22 bp, Homo sapiens
cctcttctttgtgcctttggcc

SEQ ID NO: 3988262 - DNA, 15 bp, Homo sapiens
cctcttgagcagtgg

SEQ ID NO: 3988263 - DNA, 24 bp, Homo sapiens
cctcttgagcagtggctggtccag

SEQ ID NO: 3988264 - DNA, 12 bp, Homo sapiens
cctcttgctcaa

SEQ ID NO: 3988265 - DNA, 12 bp, Homo sapiens
cctcttgctgtc

SEQ ID NO: 3988266 - DNA, 18 bp, Homo sapiens
cctcttgctgtctctgct

SEQ ID NO: 3988267 - DNA, 20 bp, Homo sapiens
cctcttgctgtctctgctcg

SEQ ID NO: 3988268 - DNA, 16 bp, Homo sapiens
cctcttgtaaagactg

SEQ ID NO: 3988269 - DNA, 21 bp, Homo sapiens
cctcttgtgcaaggtggcctt

SEQ ID NO: 3988270 - DNA, 18 bp, Homo sapiens
cctggtgctgccacactt

SEQ ID NO: 3988271 - DNA, 12 bp, Homo sapiens
cctggtgctgct

SEQ ID NO: 3988272 - DNA, 17 bp, Homo sapiens
cctggtggcaccagatg

SEQ ID NO: 3988273 - DNA, 23 bp, Homo sapiens
cctggtggcaccagatgcaacct

SEQ ID NO: 3988274 - DNA, 22 bp, Homo sapiens
cctcatgcccaccccctgccct

SEQ ID NO: 3988275 - DNA, 20 bp, Homo sapiens
cctcatggcccccaggggca

SEQ ID NO: 3988276 - DNA, 23 bp, Homo sapiens
cctcatggcccccaggggcagga

SEQ ID NO: 3988277 - DNA, 16 bp, Homo sapiens
cctcatggcccctctg

SEQ ID NO: 3988278 - DNA, 19 bp, Homo sapiens
cctcatggtgggttcaggg

SEQ ID NO: 3988279 - DNA, 16 bp, Homo sapiens
cctcattactgggcct

SEQ ID NO: 3988280 - DNA, 13 bp, Homo sapiens
cctcattcctgaa

SEQ ID NO: 3988281 - DNA, 16 bp, Homo sapiens
cctccaaacctccagc

SEQ ID NO: 3988282 - DNA, 18 bp, Homo sapiens
cctccaaacctccagcct

SEQ ID NO: 3988283 - DNA, 16 bp, Homo sapiens
cctccaagcacagagc

SEQ ID NO: 3988284 - DNA, 21 bp, Homo sapiens
cctccaagcacagagcctggc

SEQ ID NO: 3988285 - DNA, 20 bp, Homo sapiens
cctccaagtgccccctcacc

SEQ ID NO: 3988286 - DNA, 23 bp, Homo sapiens
cctccaatcccaccaaccctcag

SEQ ID NO: 3988287 - DNA, 13 bp, Homo sapiens
cctccacaccagt

SEQ ID NO: 3988288 - DNA, 18 bp, Homo sapiens
cctccacaccagtggcct

SEQ ID NO: 3988289 - DNA, 22 bp, Homo sapiens
cctccacaccagtggcctcgtg

SEQ ID NO: 3988290 - DNA, 17 bp, Homo sapiens
cctccacatcccagcag

SEQ ID NO: 3988291 - DNA, 22 bp, Homo sapiens
cctccaccacatctgccagacc

SEQ ID NO: 3988292 - DNA, 16 bp, Homo sapiens
cctccaccaccctttc

SEQ ID NO: 3988293 - DNA, 16 bp, Homo sapiens
cctccacccagcccct

SEQ ID NO: 3988294 - DNA, 19 bp, Homo sapiens
cctccacctcaagaccccc

SEQ ID NO: 3988295 - DNA, 23 bp, Homo sapiens
cctccacctcttcaccccccact

SEQ ID NO: 3988296 - DNA, 14 bp, Homo sapiens
cctccacgcctcct

SEQ ID NO: 3988297 - DNA, 17 bp, Homo sapiens
cctccacgcctcctggc

SEQ ID NO: 3988298 - DNA, 13 bp, Homo sapiens
cctccactcccac

SEQ ID NO: 3988299 - DNA, 15 bp, Homo sapiens
cctccactcgaccca

SEQ ID NO: 3988300 - DNA, 12 bp, Homo sapiens
cctccactgtca

SEQ ID NO: 3988301 - DNA, 13 bp, Homo sapiens
cctccactgtcac

SEQ ID NO: 3988302 - DNA, 21 bp, Homo sapiens
cctccagaactcactggggcc

SEQ ID NO: 3988303 - DNA, 20 bp, Homo sapiens
cctccagaactcttcctcca

SEQ ID NO: 3988304 - DNA, 14 bp, Homo sapiens
ccctttctgtccca

SEQ ID NO: 3988305 - DNA, 15 bp, Homo sapiens
ccctttctgtcccac

SEQ ID NO: 3988306 - DNA, 12 bp, Homo sapiens
ccctttcttcct

SEQ ID NO: 3988307 - DNA, 17 bp, Homo sapiens
ccctttcttctccccca

SEQ ID NO: 3988308 - DNA, 15 bp, Homo sapiens
ccctttcttggccag

SEQ ID NO: 3988309 - DNA, 18 bp, Homo sapiens
ccctttgaagcctcagct

SEQ ID NO: 3988310 - DNA, 21 bp, Homo sapiens
ccctttgacttcagctgcctg

SEQ ID NO: 3988311 - DNA, 23 bp, Homo sapiens
ccctttgcctttcttctgccctt

SEQ ID NO: 3988312 - DNA, 22 bp, Homo sapiens
ccctttggggagcaggaggcca

SEQ ID NO: 3988313 - DNA, 17 bp, Homo sapiens
ccctttgtcctcctgct

SEQ ID NO: 3988314 - DNA, 20 bp, Homo sapiens
cccttttcagctgagccctg

SEQ ID NO: 3988315 - DNA, 23 bp, Homo sapiens
cccttttcagctgagccctgggg

SEQ ID NO: 3988316 - DNA, 15 bp, Homo sapiens
cccttttcccccttc

SEQ ID NO: 3988317 - DNA, 16 bp, Homo sapiens
cccttttcccccttcc

SEQ ID NO: 3988318 - DNA, 16 bp, Homo sapiens
cccttttctacagtta

SEQ ID NO: 3988319 - DNA, 15 bp, Homo sapiens
ccctttttctccagc

SEQ ID NO: 3988320 - DNA, 16 bp, Homo sapiens
ccctttttctccagct

SEQ ID NO: 3988321 - DNA, 23 bp, Homo sapiens
ccgaacatcaccgacgcgtctcc

SEQ ID NO: 3988322 - DNA, 21 bp, Homo sapiens
ccgaactgttcaagtgtcccc

SEQ ID NO: 3988323 - DNA, 15 bp, Homo sapiens
ccgaaggtgcctcag

SEQ ID NO: 3988324 - DNA, 17 bp, Homo sapiens
ccgaaggtgcctcagac

SEQ ID NO: 3988325 - DNA, 13 bp, Homo sapiens
ccgaagtcttttg

SEQ ID NO: 3988326 - DNA, 22 bp, Homo sapiens
ccgaattcgctgttaccgcctg

SEQ ID NO: 3988327 - DNA, 17 bp, Homo sapiens
ccgacagctttccagta

SEQ ID NO: 3988328 - DNA, 14 bp, Homo sapiens
ccgacaggccctgg

SEQ ID NO: 3988329 - DNA, 15 bp, Homo sapiens
ccgacaggccctggc

SEQ ID NO: 3988330 - DNA, 16 bp, Homo sapiens
ccgaccaactgcccta

SEQ ID NO: 3988331 - DNA, 17 bp, Homo sapiens
ccgacctggctgcccct

SEQ ID NO: 3988332 - DNA, 17 bp, Homo sapiens
ccgacgcgtctcctgtt

SEQ ID NO: 3988333 - DNA, 14 bp, Homo sapiens
ccgactagacacac

SEQ ID NO: 3988334 - DNA, 23 bp, Homo sapiens
ccgactgcacagcggcccctgca

SEQ ID NO: 3988335 - DNA, 14 bp, Homo sapiens
ccgactgggctcaa

SEQ ID NO: 3988336 - DNA, 19 bp, Homo sapiens
ccgacttgtgcacaggcag

SEQ ID NO: 3988337 - DNA, 13 bp, Homo sapiens
ccgagaagaacag

SEQ ID NO: 3988338 - DNA, 18 bp, Homo sapiens
ccgagatccccagggcag

SEQ ID NO: 3988339 - DNA, 15 bp, Homo sapiens
ccgagcaaagatcaa

SEQ ID NO: 3988340 - DNA, 22 bp, Homo sapiens
ccgagcaatatttatggatgca

SEQ ID NO: 3988341 - DNA, 18 bp, Homo sapiens
ccgagcgctttctggaaa

SEQ ID NO: 3988342 - DNA, 17 bp, Homo sapiens
ccgagcgttcccagcag

SEQ ID NO: 3988343 - DNA, 14 bp, Homo sapiens
ccgagctggaaaac

SEQ ID NO: 3988344 - DNA, 17 bp, Homo sapiens
ccgagctggtgcattac

SEQ ID NO: 3988345 - DNA, 16 bp, Homo sapiens
ccgagctggtttcctg

SEQ ID NO: 3988346 - DNA, 18 bp, Homo sapiens
ccgaggcccagcgggcag

SEQ ID NO: 3988347 - DNA, 16 bp, Homo sapiens
ccgagggtcctggctc

SEQ ID NO: 3988348 - DNA, 19 bp, Homo sapiens
ccgagggtcctggctcctg

SEQ ID NO: 3988349 - DNA, 23 bp, Homo sapiens
ccgagggtcctggctcctgaggg

SEQ ID NO: 3988350 - DNA, 20 bp, Homo sapiens
ccgagtagctgggactacag

SEQ ID NO: 3988351 - DNA, 19 bp, Homo sapiens
ccgagtcattcgttctgtg

SEQ ID NO: 3988352 - DNA, 20 bp, Homo sapiens
ccgagtcattcgttctgtgg

SEQ ID NO: 3988353 - DNA, 13 bp, Homo sapiens
ccgagtccaagct

SEQ ID NO: 3988354 - DNA, 15 bp, Homo sapiens
ccgagtccaagctgg

SEQ ID NO: 3988355 - DNA, 14 bp, Homo sapiens
ccgagtctcttctc

SEQ ID NO: 3988356 - DNA, 20 bp, Homo sapiens
ccgagtctcttctccactgg

SEQ ID NO: 3988357 - DNA, 11 bp, Homo sapiens
ccgagtcttgc

SEQ ID NO: 3988358 - DNA, 20 bp, Homo sapiens
ccgataatgcatgaagcaac

SEQ ID NO: 3988359 - DNA, 15 bp, Homo sapiens
ccgatcgccagcaaa

SEQ ID NO: 3988360 - DNA, 13 bp, Homo sapiens
ccgatggagcccc

SEQ ID NO: 3988361 - DNA, 17 bp, Homo sapiens
ccgatggagcccccaga

SEQ ID NO: 3988362 - DNA, 12 bp, Homo sapiens
ccgcaaggagca

SEQ ID NO: 3988363 - DNA, 17 bp, Homo sapiens
ccgcacatggtgtgggg

SEQ ID NO: 3988364 - DNA, 18 bp, Homo sapiens
ccgcaccccggcctcagg

SEQ ID NO: 3988365 - DNA, 21 bp, Homo sapiens
ccgcactttccacttcttcct

SEQ ID NO: 3988366 - DNA, 14 bp, Homo sapiens
ccgcagaagccctg

SEQ ID NO: 3988367 - DNA, 13 bp, Homo sapiens
ccgcagacgggca

SEQ ID NO: 3988368 - DNA, 22 bp, Homo sapiens
ccgcaggcagactacacaggat

SEQ ID NO: 3988369 - DNA, 20 bp, Homo sapiens
ccgcagtgctgggaccagag

SEQ ID NO: 3988370 - DNA, 22 bp, Homo sapiens
ccgcagtgctgggaccagagcc

SEQ ID NO: 3988371 - DNA, 17 bp, Homo sapiens
ccgccacctatctcgtg

SEQ ID NO: 3988372 - DNA, 16 bp, Homo sapiens
ccgccagactgttaga

SEQ ID NO: 3988373 - DNA, 15 bp, Homo sapiens
ccgccagcctcctct

SEQ ID NO: 3988374 - DNA, 12 bp, Homo sapiens
ccgccagctggg

SEQ ID NO: 3988375 - DNA, 15 bp, Homo sapiens
ccgccagctgggagc

SEQ ID NO: 3988376 - DNA, 14 bp, Homo sapiens
ccgccagggctggg

SEQ ID NO: 3988377 - DNA, 17 bp, Homo sapiens
ccgccagggctggggac

SEQ ID NO: 3988378 - DNA, 14 bp, Homo sapiens
ccgccatccttcac

SEQ ID NO: 3988379 - DNA, 13 bp, Homo sapiens
ccgccccagagtg

SEQ ID NO: 3988380 - DNA, 17 bp, Homo sapiens
ccgccccagccccttct

SEQ ID NO: 3988381 - DNA, 24 bp, Homo sapiens
ccgccccgcgcaccccacgccctg

SEQ ID NO: 3988382 - DNA, 12 bp, Homo sapiens
ccgcccgctcct

SEQ ID NO: 3988383 - DNA, 20 bp, Homo sapiens
ccgccctcctcgggccgagg

SEQ ID NO: 3988384 - DNA, 22 bp, Homo sapiens
ccgccctcctcgggccgaggcc

SEQ ID NO: 3988385 - DNA, 15 bp, Homo sapiens
ccgcccttcctggag

SEQ ID NO: 3988386 - DNA, 15 bp, Homo sapiens
ccgcctcagggccag

SEQ ID NO: 3988387 - DNA, 22 bp, Homo sapiens
ccgcctcagggccaggcccagg

SEQ ID NO: 3988388 - DNA, 23 bp, Homo sapiens
ccgcctcagggttttggggtcct

SEQ ID NO: 3988389 - DNA, 21 bp, Homo sapiens
ccgctcagccctccctgcccc

SEQ ID NO: 3988390 - DNA, 12 bp, Homo sapiens
ccgctccagagt

SEQ ID NO: 3988391 - DNA, 17 bp, Homo sapiens
ccgctcccgctcccagg

SEQ ID NO: 3988392 - DNA, 18 bp, Homo sapiens
ccgctcccgctcccaggt

SEQ ID NO: 3988393 - DNA, 18 bp, Homo sapiens
ccgctgaggggtctcgga

SEQ ID NO: 3988394 - DNA, 13 bp, Homo sapiens
ccgctgcaccacg

SEQ ID NO: 3988395 - DNA, 12 bp, Homo sapiens
ccgctgccagca

SEQ ID NO: 3988396 - DNA, 13 bp, Homo sapiens
ccgctgccagcac

SEQ ID NO: 3988397 - DNA, 13 bp, Homo sapiens
ccgctgccagcct

SEQ ID NO: 3988398 - DNA, 17 bp, Homo sapiens
ccgctgccgctgcacca

SEQ ID NO: 3988399 - DNA, 14 bp, Homo sapiens
ccgctggcccttag

SEQ ID NO: 3988400 - DNA, 19 bp, Homo sapiens
ccggacatactctctgcct

SEQ ID NO: 3988401 - DNA, 12 bp, Homo sapiens
ccggactggtgc

SEQ ID NO: 3988402 - DNA, 13 bp, Homo sapiens
ccggactggtgcc

SEQ ID NO: 3988403 - DNA, 16 bp, Homo sapiens
ccggagagggagtcag

SEQ ID NO: 3988404 - DNA, 17 bp, Homo sapiens
ccggagcctgtgcagcc

SEQ ID NO: 3988405 - DNA, 14 bp, Homo sapiens
ccggaggggcctgg

SEQ ID NO: 3988406 - DNA, 19 bp, Homo sapiens
ccggcaagccacaggaagg

SEQ ID NO: 3988407 - DNA, 13 bp, Homo sapiens
ccggccagcgggc

SEQ ID NO: 3988408 - DNA, 18 bp, Homo sapiens
ccggccagcgggcacagg

SEQ ID NO: 3988409 - DNA, 19 bp, Homo sapiens
ccggccagcgggcacaggg

SEQ ID NO: 3988410 - DNA, 20 bp, Homo sapiens
ccggccagcgggcacagggc

SEQ ID NO: 3988411 - DNA, 16 bp, Homo sapiens
ccggccatactgcctt

SEQ ID NO: 3988412 - DNA, 18 bp, Homo sapiens
ccggcccagatgtgtccc

SEQ ID NO: 3988413 - DNA, 19 bp, Homo sapiens
ccggccccctggtctctgg

SEQ ID NO: 3988414 - DNA, 19 bp, Homo sapiens
ccggccctgggctcggagg

SEQ ID NO: 3988415 - DNA, 14 bp, Homo sapiens
ccggccgatggaga

SEQ ID NO: 3988416 - DNA, 17 bp, Homo sapiens
ccggcctcagggcgctc

SEQ ID NO: 3988417 - DNA, 14 bp, Homo sapiens
ccggcctctctgcc

SEQ ID NO: 3988418 - DNA, 21 bp, Homo sapiens
ccggcctgatgacagagcgag

SEQ ID NO: 3988419 - DNA, 12 bp, Homo sapiens
ccggcctggcac

SEQ ID NO: 3988420 - DNA, 13 bp, Homo sapiens
ccggcctggcacc

SEQ ID NO: 3988421 - DNA, 19 bp, Homo sapiens
ccggcctggctgcagctgg

SEQ ID NO: 3988422 - DNA, 18 bp, Homo sapiens
ccggctaatttttgtaat

SEQ ID NO: 3988423 - DNA, 23 bp, Homo sapiens
ccggctgtggagcaaaaggcagc

SEQ ID NO: 3988424 - DNA, 17 bp, Homo sapiens
ccgggaaccaagcagga

SEQ ID NO: 3988425 - DNA, 23 bp, Homo sapiens
ccgggagaaggcatgagaaagaa

SEQ ID NO: 3988426 - DNA, 16 bp, Homo sapiens
ccgggagcctccccct

SEQ ID NO: 3988427 - DNA, 18 bp, Homo sapiens
ccgggagcctccccctca

SEQ ID NO: 3988428 - DNA, 18 bp, Homo sapiens
ccgggcacggtcacacgg

SEQ ID NO: 3988429 - DNA, 20 bp, Homo sapiens
ccgggcagagcacagcgggg

SEQ ID NO: 3988430 - DNA, 15 bp, Homo sapiens
ccgggcaggtcctgc

SEQ ID NO: 3988431 - DNA, 14 bp, Homo sapiens
ccgggccagggctg

SEQ ID NO: 3988432 - DNA, 16 bp, Homo sapiens
ccgggcccctgggctt

SEQ ID NO: 3988433 - DNA, 17 bp, Homo sapiens
ccgggcgcggccagccc

SEQ ID NO: 3988434 - DNA, 18 bp, Homo sapiens
ccgggctgagggcctgct

SEQ ID NO: 3988435 - DNA, 17 bp, Homo sapiens
ccgggcttgggccctgc

SEQ ID NO: 3988436 - DNA, 20 bp, Homo sapiens
ccggggaagctgccagccca

SEQ ID NO: 3988437 - DNA, 21 bp, Homo sapiens
ccggggaagctgccagcccag

SEQ ID NO: 3988438 - DNA, 15 bp, Homo sapiens
ccgggggagcccagt

SEQ ID NO: 3988439 - DNA, 19 bp, Homo sapiens
ccggggtgtaacttcctgc

SEQ ID NO: 3988440 - DNA, 20 bp, Homo sapiens
ccggggtgtaacttcctgct

SEQ ID NO: 3988441 - DNA, 22 bp, Homo sapiens
ccggggtgtaacttcctgctgc

SEQ ID NO: 3988442 - DNA, 20 bp, Homo sapiens
ccgggtgtggcctcagccct

SEQ ID NO: 3988443 - DNA, 13 bp, Homo sapiens
ccgggttcagcct

SEQ ID NO: 3988444 - DNA, 18 bp, Homo sapiens
ccggtagggaggcagcct

SEQ ID NO: 3988445 - DNA, 12 bp, Homo sapiens
ccggtcagtgcc

SEQ ID NO: 3988446 - DNA, 15 bp, Homo sapiens
ccggtcagtgccttt

SEQ ID NO: 3988447 - DNA, 14 bp, Homo sapiens
ccggtgctgcagga

SEQ ID NO: 3988448 - DNA, 16 bp, Homo sapiens
ccggtgctgcaggagt

SEQ ID NO: 3988449 - DNA, 17 bp, Homo sapiens
ccggtgcttctggaaac

SEQ ID NO: 3988450 - DNA, 18 bp, Homo sapiens
ccggtgcttctggaaact

SEQ ID NO: 3988451 - DNA, 14 bp, Homo sapiens
ccggtggctgggca

SEQ ID NO: 3988452 - DNA, 16 bp, Homo sapiens
ccggtggctgggcaga

SEQ ID NO: 3988453 - DNA, 16 bp, Homo sapiens
ccggtgggggggcaga

SEQ ID NO: 3988454 - DNA, 17 bp, Homo sapiens
ccggtgggggggcagag

SEQ ID NO: 3988455 - DNA, 21 bp, Homo sapiens
ccggtgggggggcagagccct

SEQ ID NO: 3988456 - DNA, 12 bp, Homo sapiens
ccggtgtgtcag

SEQ ID NO: 3988457 - DNA, 17 bp, Homo sapiens
ccggtgtgtcagatttt

SEQ ID NO: 3988458 - DNA, 19 bp, Homo sapiens
ccggttcagacccctgcct

SEQ ID NO: 3988459 - DNA, 23 bp, Homo sapiens
ccggtttagtcatccaacaagaa

SEQ ID NO: 3988460 - DNA, 17 bp, Homo sapiens
ccgtaataattattatt

SEQ ID NO: 3988461 - DNA, 17 bp, Homo sapiens
ccgtactctcacatgtg

SEQ ID NO: 3988462 - DNA, 18 bp, Homo sapiens
ccgtagggagtacctgct

SEQ ID NO: 3988463 - DNA, 13 bp, Homo sapiens
ccgtcacatccca

SEQ ID NO: 3988464 - DNA, 20 bp, Homo sapiens
ccgtcaccacgactggccag

SEQ ID NO: 3988465 - DNA, 15 bp, Homo sapiens
ccgtccaggggagat

SEQ ID NO: 3988466 - DNA, 21 bp, Homo sapiens
ccgtccatatcagaactgtgc

SEQ ID NO: 3988467 - DNA, 17 bp, Homo sapiens
ccgtcccaccagcttca

SEQ ID NO: 3988468 - DNA, 13 bp, Homo sapiens
ccgtctcctccct

SEQ ID NO: 3988469 - DNA, 14 bp, Homo sapiens
ccgtctcctccctc

SEQ ID NO: 3988470 - DNA, 18 bp, Homo sapiens
ccgtgaaaacggagctga

SEQ ID NO: 3988471 - DNA, 16 bp, Homo sapiens
ccgtgaactgtgcata

SEQ ID NO: 3988472 - DNA, 12 bp, Homo sapiens
ccgtgagccctt

SEQ ID NO: 3988473 - DNA, 20 bp, Homo sapiens
ccgtgatccatccatctcca

SEQ ID NO: 3988474 - DNA, 23 bp, Homo sapiens
ccgtgatccatccatctccaggg

SEQ ID NO: 3988475 - DNA, 22 bp, Homo sapiens
ccgtgcatcccccctgctcagc

SEQ ID NO: 3988476 - DNA, 14 bp, Homo sapiens
ccgtgcctggccag

SEQ ID NO: 3988477 - DNA, 15 bp, Homo sapiens
ccgtgccttcagctc

SEQ ID NO: 3988478 - DNA, 12 bp, Homo sapiens
ccgtggacaggc

SEQ ID NO: 3988479 - DNA, 14 bp, Homo sapiens
ccgtggacaggccc

SEQ ID NO: 3988480 - DNA, 15 bp, Homo sapiens
ccgtggacaggccca

SEQ ID NO: 3988481 - DNA, 16 bp, Homo sapiens
ccgtggacaggcccag

SEQ ID NO: 3988482 - DNA, 11 bp, Homo sapiens
ccgtggcttcc

SEQ ID NO: 3988483 - DNA, 14 bp, Homo sapiens
ccgtggcttcccgc

SEQ ID NO: 3988484 - DNA, 13 bp, Homo sapiens
ccgtggtccagct

SEQ ID NO: 3988485 - DNA, 22 bp, Homo sapiens
ccgtggtggcggtggctgcccc

SEQ ID NO: 3988486 - DNA, 13 bp, Homo sapiens
ccgtgtccagcac

SEQ ID NO: 3988487 - DNA, 15 bp, Homo sapiens
ccgtgtccagcacag

SEQ ID NO: 3988488 - DNA, 16 bp, Homo sapiens
ccgtgtctgtctggca

SEQ ID NO: 3988489 - DNA, 22 bp, Homo sapiens
ccgtgtgagtgtgacagggcca

SEQ ID NO: 3988490 - DNA, 19 bp, Homo sapiens
ccgtgtttgtctcttctgg

SEQ ID NO: 3988491 - DNA, 17 bp, Homo sapiens
ccgttacatctgtgcag

SEQ ID NO: 3988492 - DNA, 22 bp, Homo sapiens
ccgttcctgacatcacagcagc

SEQ ID NO: 3988493 - DNA, 24 bp, Homo sapiens
ccgttcctgacatcacagcagcct

SEQ ID NO: 3988494 - DNA, 14 bp, Homo sapiens
ccgtttctcctttt

SEQ ID NO: 3988495 - DNA, 16 bp, Homo sapiens
cctaaaactggcctga

SEQ ID NO: 3988496 - DNA, 20 bp, Homo sapiens
cctaaaactggcctgacttg

SEQ ID NO: 3988497 - DNA, 12 bp, Homo sapiens
cctaaaactggg

SEQ ID NO: 3988498 - DNA, 23 bp, Homo sapiens
cctaaaaggaaatctcaccccat

SEQ ID NO: 3988499 - DNA, 17 bp, Homo sapiens
cctaaaatataattttt

SEQ ID NO: 3988500 - DNA, 23 bp, Homo sapiens
cctaaacagatataaatggctgg

SEQ ID NO: 3988501 - DNA, 21 bp, Homo sapiens
cctaaagtacagcctggacca

SEQ ID NO: 3988502 - DNA, 18 bp, Homo sapiens
cctaaagtgcttgctttt

SEQ ID NO: 3988503 - DNA, 18 bp, Homo sapiens
cctaacacagcatgtgta

SEQ ID NO: 3988504 - DNA, 15 bp, Homo sapiens
cctaagactgtgaca

SEQ ID NO: 3988505 - DNA, 20 bp, Homo sapiens
cctaagagatgggactagga

SEQ ID NO: 3988506 - DNA, 15 bp, Homo sapiens
cctaagcccccaggg

SEQ ID NO: 3988507 - DNA, 23 bp, Homo sapiens
cctaagcccccagggcctccagg

SEQ ID NO: 3988508 - DNA, 13 bp, Homo sapiens
cctaaggacacac

SEQ ID NO: 3988509 - DNA, 17 bp, Homo sapiens
cctaaggacacactaat

SEQ ID NO: 3988510 - DNA, 23 bp, Homo sapiens
cctaaggatctctcaggagcaca

SEQ ID NO: 3988511 - DNA, 16 bp, Homo sapiens
cctaagtggctgcctt

SEQ ID NO: 3988512 - DNA, 22 bp, Homo sapiens
cctaatcagaaatttttatcag

SEQ ID NO: 3988513 - DNA, 13 bp, Homo sapiens
cctaatccaggca

SEQ ID NO: 3988514 - DNA, 14 bp, Homo sapiens
cctaatccaggcag

SEQ ID NO: 3988515 - DNA, 22 bp, Homo sapiens
cctaatccctgggcattgcttt

SEQ ID NO: 3988516 - DNA, 13 bp, Homo sapiens
cctaatgagggtg

SEQ ID NO: 3988517 - DNA, 18 bp, Homo sapiens
cctaatggctatttttga

SEQ ID NO: 3988518 - DNA, 19 bp, Homo sapiens
cctaatgtttatgagccag

SEQ ID NO: 3988519 - DNA, 14 bp, Homo sapiens
cctaattcaatcct

SEQ ID NO: 3988520 - DNA, 18 bp, Homo sapiens
cctaattcgatgaaggct

SEQ ID NO: 3988521 - DNA, 18 bp, Homo sapiens
cctaattttaaataattt

SEQ ID NO: 3988522 - DNA, 15 bp, Homo sapiens
cctacacacacactc

SEQ ID NO: 3988523 - DNA, 14 bp, Homo sapiens
cctacacactgtca

SEQ ID NO: 3988524 - DNA, 22 bp, Homo sapiens
cctacacactgtcatgcttcat

SEQ ID NO: 3988525 - DNA, 17 bp, Homo sapiens
cctacacccagacccca

SEQ ID NO: 3988526 - DNA, 19 bp, Homo sapiens
cctacacccagaccccagg

SEQ ID NO: 3988527 - DNA, 21 bp, Homo sapiens
cctacagactccatctcttct

SEQ ID NO: 3988528 - DNA, 14 bp, Homo sapiens
cctacagccacatc

SEQ ID NO: 3988529 - DNA, 15 bp, Homo sapiens
cctacagccacatcc

SEQ ID NO: 3988530 - DNA, 17 bp, Homo sapiens
cctacagctttgatccc

SEQ ID NO: 3988531 - DNA, 19 bp, Homo sapiens
cctacatcttcttcccagt

SEQ ID NO: 3988532 - DNA, 15 bp, Homo sapiens
cctaccacagtgtct

SEQ ID NO: 3988533 - DNA, 16 bp, Homo sapiens
cctaccatcagggaca

SEQ ID NO: 3988534 - DNA, 13 bp, Homo sapiens
cctacccacacct

SEQ ID NO: 3988535 - DNA, 20 bp, Homo sapiens
cctacccacacctctgccag

SEQ ID NO: 3988536 - DNA, 20 bp, Homo sapiens
cctaccccagggccctggcc

SEQ ID NO: 3988537 - DNA, 20 bp, Homo sapiens
cctaccgagtctcttctcca

SEQ ID NO: 3988538 - DNA, 14 bp, Homo sapiens
cctacctctgtgcc

SEQ ID NO: 3988539 - DNA, 12 bp, Homo sapiens
cctacctgctct

SEQ ID NO: 3988540 - DNA, 16 bp, Homo sapiens
cctacgcgccttgtct

SEQ ID NO: 3988541 - DNA, 19 bp, Homo sapiens
cctactaggagaggggggc

SEQ ID NO: 3988542 - DNA, 17 bp, Homo sapiens
cctactcattggggttc

SEQ ID NO: 3988543 - DNA, 11 bp, Homo sapiens
cctactcctga

SEQ ID NO: 3988544 - DNA, 15 bp, Homo sapiens
cctactcttcagggt

SEQ ID NO: 3988545 - DNA, 18 bp, Homo sapiens
cctcactctgtcagccag

SEQ ID NO: 3988546 - DNA, 22 bp, Homo sapiens
cctcactctgtcagccagccgc

SEQ ID NO: 3988547 - DNA, 22 bp, Homo sapiens
cctcactgaaggacctgagctg

SEQ ID NO: 3988548 - DNA, 17 bp, Homo sapiens
cctcactgaatgcctca

SEQ ID NO: 3988549 - DNA, 13 bp, Homo sapiens
cctcactgggtgg

SEQ ID NO: 3988550 - DNA, 14 bp, Homo sapiens
cctcactgggtggg

SEQ ID NO: 3988551 - DNA, 21 bp, Homo sapiens
cctcactgggtggggtgagga

SEQ ID NO: 3988552 - DNA, 16 bp, Homo sapiens
cctcactgttgaattt

SEQ ID NO: 3988553 - DNA, 19 bp, Homo sapiens
cctcacttccatacagctc

SEQ ID NO: 3988554 - DNA, 21 bp, Homo sapiens
cctcagaaagtcaccaggact

SEQ ID NO: 3988555 - DNA, 19 bp, Homo sapiens
cctcagacttaccaggaag

SEQ ID NO: 3988556 - DNA, 16 bp, Homo sapiens
cctcagagccacccct

SEQ ID NO: 3988557 - DNA, 22 bp, Homo sapiens
cctcagaggagctctaccctgc

SEQ ID NO: 3988558 - DNA, 23 bp, Homo sapiens
cctcagaggcagcttcaagtgcc

SEQ ID NO: 3988559 - DNA, 19 bp, Homo sapiens
cctcagatgatctctccac

SEQ ID NO: 3988560 - DNA, 22 bp, Homo sapiens
cctcagcatttccttccagccc

SEQ ID NO: 3988561 - DNA, 14 bp, Homo sapiens
cctcagccctcaga

SEQ ID NO: 3988562 - DNA, 23 bp, Homo sapiens
cctcagccgactgcacagcggcc

SEQ ID NO: 3988563 - DNA, 14 bp, Homo sapiens
cctcagcctcagag

SEQ ID NO: 3988564 - DNA, 22 bp, Homo sapiens
cctcagcctcccaagtagctgg

SEQ ID NO: 3988565 - DNA, 12 bp, Homo sapiens
cctcagcctccg

SEQ ID NO: 3988566 - DNA, 20 bp, Homo sapiens
cctcagcctggccagacaca

SEQ ID NO: 3988567 - DNA, 19 bp, Homo sapiens
cctcagccttgccagagat

SEQ ID NO: 3988568 - DNA, 21 bp, Homo sapiens
cctcagccttgccagagatcc

SEQ ID NO: 3988569 - DNA, 15 bp, Homo sapiens
cctcagctctctggg

SEQ ID NO: 3988570 - DNA, 12 bp, Homo sapiens
cctcagctctgg

SEQ ID NO: 3988571 - DNA, 20 bp, Homo sapiens
cctcagctctgggagaggat

SEQ ID NO: 3988572 - DNA, 22 bp, Homo sapiens
cctcagctgacccggcctctct

SEQ ID NO: 3988573 - DNA, 17 bp, Homo sapiens
cctcagctgcctcactt

SEQ ID NO: 3988574 - DNA, 18 bp, Homo sapiens
cctcagctgcctcacttc

SEQ ID NO: 3988575 - DNA, 16 bp, Homo sapiens
cctcaggcacacagct

SEQ ID NO: 3988576 - DNA, 20 bp, Homo sapiens
cctcaggcacacagctactc

SEQ ID NO: 3988577 - DNA, 15 bp, Homo sapiens
cctcaggcagctcaa

SEQ ID NO: 3988578 - DNA, 13 bp, Homo sapiens
cctcaggcaggaa

SEQ ID NO: 3988579 - DNA, 15 bp, Homo sapiens
cctcaggcaggaagg

SEQ ID NO: 3988580 - DNA, 12 bp, Homo sapiens
cctcaggctctg

SEQ ID NO: 3988581 - DNA, 22 bp, Homo sapiens
cctcagggagcagggaaggcct

SEQ ID NO: 3988582 - DNA, 23 bp, Homo sapiens
cctcagggagcagggaaggcctg

SEQ ID NO: 3988583 - DNA, 15 bp, Homo sapiens
cctcagggagcctcc

SEQ ID NO: 3988584 - DNA, 16 bp, Homo sapiens
cctcagggagcctccc

SEQ ID NO: 3988585 - DNA, 23 bp, Homo sapiens
cctcagggatcttgcattcccag

SEQ ID NO: 3988586 - DNA, 11 bp, Homo sapiens
cctcagggcac

SEQ ID NO: 3988587 - DNA, 21 bp, Homo sapiens
cctcagggcacgcaggaccag

SEQ ID NO: 3988588 - DNA, 22 bp, Homo sapiens
cctcagggcacgcaggaccagt

SEQ ID NO: 3988589 - DNA, 17 bp, Homo sapiens
cctcagggccaggccca

SEQ ID NO: 3988590 - DNA, 18 bp, Homo sapiens
cctcagggcgctcagacg

SEQ ID NO: 3988591 - DNA, 15 bp, Homo sapiens
cctcagggctcccag

SEQ ID NO: 3988592 - DNA, 17 bp, Homo sapiens
cctcagggctcccaggg

SEQ ID NO: 3988593 - DNA, 18 bp, Homo sapiens
cctcaggggaaaactgtt

SEQ ID NO: 3988594 - DNA, 23 bp, Homo sapiens
cctcagggttttggggtcctggg

SEQ ID NO: 3988595 - DNA, 20 bp, Homo sapiens
cctcaggttctattttctta

SEQ ID NO: 3988596 - DNA, 20 bp, Homo sapiens
cctcagtccatttatatatg

SEQ ID NO: 3988597 - DNA, 17 bp, Homo sapiens
cctcagttcccttggcc

SEQ ID NO: 3988598 - DNA, 21 bp, Homo sapiens
cctcagttcccttggcctcag

SEQ ID NO: 3988599 - DNA, 14 bp, Homo sapiens
cctcagttccttca

SEQ ID NO: 3988600 - DNA, 19 bp, Homo sapiens
cctcagttttatcattttc

SEQ ID NO: 3988601 - DNA, 12 bp, Homo sapiens
cctcatatttaa

SEQ ID NO: 3988602 - DNA, 14 bp, Homo sapiens
cctcatcaggatga

SEQ ID NO: 3988603 - DNA, 15 bp, Homo sapiens
cctcatcaggatgaa

SEQ ID NO: 3988604 - DNA, 21 bp, Homo sapiens
cctcatcaggatgaacccagg

SEQ ID NO: 3988605 - DNA, 21 bp, Homo sapiens
cctcatctatgaggaaaggtt

SEQ ID NO: 3988606 - DNA, 13 bp, Homo sapiens
cctcatctcattc

SEQ ID NO: 3988607 - DNA, 17 bp, Homo sapiens
cctcatctcccgagcaa

SEQ ID NO: 3988608 - DNA, 17 bp, Homo sapiens
cctcatctctctgccca

SEQ ID NO: 3988609 - DNA, 19 bp, Homo sapiens
cctcatctctctgcccaac

SEQ ID NO: 3988610 - DNA, 18 bp, Homo sapiens
cctcatctgagaggctct

SEQ ID NO: 3988611 - DNA, 20 bp, Homo sapiens
cctcatgccaaccctgggct

SEQ ID NO: 3988612 - DNA, 13 bp, Homo sapiens
cctcatgcccacc

SEQ ID NO: 3988613 - DNA, 14 bp, Homo sapiens
cctcatgcccaccc

SEQ ID NO: 3988614 - DNA, 15 bp, Homo sapiens
cctcatgcccacccc

SEQ ID NO: 3988615 - DNA, 20 bp, Homo sapiens
cctcatgcccaccccctgcc

SEQ ID NO: 3988616 - DNA, 15 bp, Homo sapiens
cccggcctggatgcc

SEQ ID NO: 3988617 - DNA, 23 bp, Homo sapiens
cccgggacgcaggggttgcagtg

SEQ ID NO: 3988618 - DNA, 18 bp, Homo sapiens
cccgggccacgccccagc

SEQ ID NO: 3988619 - DNA, 14 bp, Homo sapiens
cccgggccagggct

SEQ ID NO: 3988620 - DNA, 16 bp, Homo sapiens
cccgggctctctgctg

SEQ ID NO: 3988621 - DNA, 16 bp, Homo sapiens
cccggggacccccaac

SEQ ID NO: 3988622 - DNA, 16 bp, Homo sapiens
cccggggccagcactt

SEQ ID NO: 3988623 - DNA, 21 bp, Homo sapiens
cccggggtgcccacaggccgc

SEQ ID NO: 3988624 - DNA, 15 bp, Homo sapiens
cccgggttcagcctg

SEQ ID NO: 3988625 - DNA, 18 bp, Homo sapiens
cccgggttcagcctggcc

SEQ ID NO: 3988626 - DNA, 20 bp, Homo sapiens
cccgggttcagcctggcctg

SEQ ID NO: 3988627 - DNA, 14 bp, Homo sapiens
cccggtaccttcca

SEQ ID NO: 3988628 - DNA, 20 bp, Homo sapiens
cccgtcgaggggctctcagc

SEQ ID NO: 3988629 - DNA, 12 bp, Homo sapiens
cccgtctcagtg

SEQ ID NO: 3988630 - DNA, 13 bp, Homo sapiens
cccgtctcagtgt

SEQ ID NO: 3988631 - DNA, 13 bp, Homo sapiens
cccgtgacctggt

SEQ ID NO: 3988632 - DNA, 15 bp, Homo sapiens
cccgtgacctggtca

SEQ ID NO: 3988633 - DNA, 15 bp, Homo sapiens
cccgtgccaggagca

SEQ ID NO: 3988634 - DNA, 19 bp, Homo sapiens
cccgtgccaggagcaatgg

SEQ ID NO: 3988635 - DNA, 12 bp, Homo sapiens
cccgtttctcca

SEQ ID NO: 3988636 - DNA, 16 bp, Homo sapiens
cccgtttctccaccta

SEQ ID NO: 3988637 - DNA, 18 bp, Homo sapiens
ccctaaacccctgtccca

SEQ ID NO: 3988638 - DNA, 17 bp, Homo sapiens
ccctaaactttggcctt

SEQ ID NO: 3988639 - DNA, 16 bp, Homo sapiens
ccctaagcccccaggg

SEQ ID NO: 3988640 - DNA, 17 bp, Homo sapiens
ccctaagcccccagggc

SEQ ID NO: 3988641 - DNA, 20 bp, Homo sapiens
ccctaagtggctgccttctt

SEQ ID NO: 3988642 - DNA, 12 bp, Homo sapiens
ccctaatcttcc

SEQ ID NO: 3988643 - DNA, 23 bp, Homo sapiens
ccctaatctttcacttgaaagat

SEQ ID NO: 3988644 - DNA, 20 bp, Homo sapiens
ccctaatgagggtgtgagaa

SEQ ID NO: 3988645 - DNA, 14 bp, Homo sapiens
ccctacacacacac

SEQ ID NO: 3988646 - DNA, 15 bp, Homo sapiens
ccctacacacacact

SEQ ID NO: 3988647 - DNA, 16 bp, Homo sapiens
ccctacacacacactc

SEQ ID NO: 3988648 - DNA, 17 bp, Homo sapiens
ccctacacacacactcc

SEQ ID NO: 3988649 - DNA, 20 bp, Homo sapiens
ccctacacacacactccctg

SEQ ID NO: 3988650 - DNA, 22 bp, Homo sapiens
ccctacacacacactccctgct

SEQ ID NO: 3988651 - DNA, 17 bp, Homo sapiens
ccctacacccagacccc

SEQ ID NO: 3988652 - DNA, 18 bp, Homo sapiens
ccctacacccagacccca

SEQ ID NO: 3988653 - DNA, 21 bp, Homo sapiens
ccctaccgagtctcttctcca

SEQ ID NO: 3988654 - DNA, 11 bp, Homo sapiens
ccctagccttg

SEQ ID NO: 3988655 - DNA, 13 bp, Homo sapiens
ccctagctgaccc

SEQ ID NO: 3988656 - DNA, 21 bp, Homo sapiens
ccctcctccagcccctgtccc

SEQ ID NO: 3988657 - DNA, 19 bp, Homo sapiens
ccctcctctagctgtgggg

SEQ ID NO: 3988658 - DNA, 13 bp, Homo sapiens
ccctccttcccac

SEQ ID NO: 3988659 - DNA, 18 bp, Homo sapiens
ccctccttgtccacccac

SEQ ID NO: 3988660 - DNA, 18 bp, Homo sapiens
ccctcgacagcgcccctg

SEQ ID NO: 3988661 - DNA, 21 bp, Homo sapiens
ccctcgacagcgcccctgctg

SEQ ID NO: 3988662 - DNA, 22 bp, Homo sapiens
ccctcgcagagcccttctcgtt

SEQ ID NO: 3988663 - DNA, 14 bp, Homo sapiens
ccctcgctgcttct

SEQ ID NO: 3988664 - DNA, 17 bp, Homo sapiens
ccctcgctgcttctgtg

SEQ ID NO: 3988665 - DNA, 19 bp, Homo sapiens
ccctcgggaagcagccagc

SEQ ID NO: 3988666 - DNA, 19 bp, Homo sapiens
ccctcgggccccatcctca

SEQ ID NO: 3988667 - DNA, 21 bp, Homo sapiens
ccctcgtctttcccaaaggca

SEQ ID NO: 3988668 - DNA, 13 bp, Homo sapiens
ccctctcaccaaa

SEQ ID NO: 3988669 - DNA, 20 bp, Homo sapiens
ccctctcagaggcctgctgc

SEQ ID NO: 3988670 - DNA, 20 bp, Homo sapiens
ccctctcccaaaaaactact

SEQ ID NO: 3988671 - DNA, 19 bp, Homo sapiens
ccctctctcccatttcagg

SEQ ID NO: 3988672 - DNA, 17 bp, Homo sapiens
ccctctctcttctgctc

SEQ ID NO: 3988673 - DNA, 18 bp, Homo sapiens
ccctctctcttctgctcc

SEQ ID NO: 3988674 - DNA, 23 bp, Homo sapiens
ccctctctcttctgctccaccct

SEQ ID NO: 3988675 - DNA, 22 bp, Homo sapiens
ccctctggccaggatggagggg

SEQ ID NO: 3988676 - DNA, 20 bp, Homo sapiens
ccctctggcttgacagcatg

SEQ ID NO: 3988677 - DNA, 21 bp, Homo sapiens
ccctctgggcacgcctgctgg

SEQ ID NO: 3988678 - DNA, 22 bp, Homo sapiens
ccctctgggcacgcctgctggc

SEQ ID NO: 3988679 - DNA, 16 bp, Homo sapiens
ccctctgtcccacccc

SEQ ID NO: 3988680 - DNA, 14 bp, Homo sapiens
ccctcttccctggt

SEQ ID NO: 3988681 - DNA, 15 bp, Homo sapiens
ccctcttgcccatcc

SEQ ID NO: 3988682 - DNA, 17 bp, Homo sapiens
ccctcttgcccatcctg

SEQ ID NO: 3988683 - DNA, 22 bp, Homo sapiens
ccctcttgcccatcctgactga

SEQ ID NO: 3988684 - DNA, 12 bp, Homo sapiens
ccctcttggggg

SEQ ID NO: 3988685 - DNA, 19 bp, Homo sapiens
ccctcttgggggcactgct

SEQ ID NO: 3988686 - DNA, 21 bp, Homo sapiens
ccctcttgggggcactgctcc

SEQ ID NO: 3988687 - DNA, 12 bp, Homo sapiens
ccctctttccct

SEQ ID NO: 3988688 - DNA, 17 bp, Homo sapiens
ccctctttggctcccct

SEQ ID NO: 3988689 - DNA, 19 bp, Homo sapiens
ccctctttggctcccctgt

SEQ ID NO: 3988690 - DNA, 22 bp, Homo sapiens
ccctgaaaatgtttttctgcca

SEQ ID NO: 3988691 - DNA, 24 bp, Homo sapiens
ccctgaaaatgtttttctgccagg

SEQ ID NO: 3988692 - DNA, 23 bp, Homo sapiens
ccctgaaggaacattccttagtc

SEQ ID NO: 3988693 - DNA, 20 bp, Homo sapiens
ccctgaatcccccttgccac

SEQ ID NO: 3988694 - DNA, 21 bp, Homo sapiens
ccctgaatcccccttgccacc

SEQ ID NO: 3988695 - DNA, 23 bp, Homo sapiens
ccctgaatcccccttgccacccc

SEQ ID NO: 3988696 - DNA, 20 bp, Homo sapiens
ccctgacagtccctcctctc

SEQ ID NO: 3988697 - DNA, 14 bp, Homo sapiens
ccctgacccccttc

SEQ ID NO: 3988698 - DNA, 17 bp, Homo sapiens
ccctgacctccctctaa

SEQ ID NO: 3988699 - DNA, 18 bp, Homo sapiens
ccctgacctccgcccctg

SEQ ID NO: 3988700 - DNA, 14 bp, Homo sapiens
ccctgaccttggct

SEQ ID NO: 3988701 - DNA, 15 bp, Homo sapiens
cccagaatggagcct

SEQ ID NO: 3988702 - DNA, 19 bp, Homo sapiens
cccagaatggagcctgctc

SEQ ID NO: 3988703 - DNA, 20 bp, Homo sapiens
cccagaatttaccatcatct

SEQ ID NO: 3988704 - DNA, 20 bp, Homo sapiens
cccagacagacatctctgca

SEQ ID NO: 3988705 - DNA, 14 bp, Homo sapiens
cccagaccccaggg

SEQ ID NO: 3988706 - DNA, 19 bp, Homo sapiens
cccagacccctctggccag

SEQ ID NO: 3988707 - DNA, 21 bp, Homo sapiens
cccagacccctctggccagga

SEQ ID NO: 3988708 - DNA, 17 bp, Homo sapiens
cccagaccctggaggaa

SEQ ID NO: 3988709 - DNA, 17 bp, Homo sapiens
cccagactactattttc

SEQ ID NO: 3988710 - DNA, 18 bp, Homo sapiens
cccagactactattttct

SEQ ID NO: 3988711 - DNA, 22 bp, Homo sapiens
cccagagaaaggggagcccact

SEQ ID NO: 3988712 - DNA, 17 bp, Homo sapiens
cccagagaacagcgaag

SEQ ID NO: 3988713 - DNA, 23 bp, Homo sapiens
cccagagacatacttgaagggcc

SEQ ID NO: 3988714 - DNA, 22 bp, Homo sapiens
cccagagagaggatgtggaaag

SEQ ID NO: 3988715 - DNA, 13 bp, Homo sapiens
cccagagaggcac

SEQ ID NO: 3988716 - DNA, 16 bp, Homo sapiens
cccagagcaggaagca

SEQ ID NO: 3988717 - DNA, 21 bp, Homo sapiens
cccagagcattacgtgagcca

SEQ ID NO: 3988718 - DNA, 13 bp, Homo sapiens
cccagagcccagc

SEQ ID NO: 3988719 - DNA, 15 bp, Homo sapiens
cccagagcccagctc

SEQ ID NO: 3988720 - DNA, 22 bp, Homo sapiens
cccagagctgtttatggcctca

SEQ ID NO: 3988721 - DNA, 23 bp, Homo sapiens
cccagagctgtttatggcctcag

SEQ ID NO: 3988722 - DNA, 13 bp, Homo sapiens
cccagaggcaggc

SEQ ID NO: 3988723 - DNA, 13 bp, Homo sapiens
cccagagggagca

SEQ ID NO: 3988724 - DNA, 14 bp, Homo sapiens
cccagagggagcag

SEQ ID NO: 3988725 - DNA, 18 bp, Homo sapiens
cccagaggtaacagaaca

SEQ ID NO: 3988726 - DNA, 20 bp, Homo sapiens
cccagaggtaacagaacagc

SEQ ID NO: 3988727 - DNA, 19 bp, Homo sapiens
cccagatcagtcagagccc

SEQ ID NO: 3988728 - DNA, 18 bp, Homo sapiens
cccagattttgctgtata

SEQ ID NO: 3988729 - DNA, 15 bp, Homo sapiens
cccagcaacacaagc

SEQ ID NO: 3988730 - DNA, 20 bp, Homo sapiens
cccagcaacacaagctggaa

SEQ ID NO: 3988731 - DNA, 20 bp, Homo sapiens
cccagcaacgcccctccaaa

SEQ ID NO: 3988732 - DNA, 22 bp, Homo sapiens
cccagcaagcgggagcccgtgg

SEQ ID NO: 3988733 - DNA, 20 bp, Homo sapiens
cccagcactaaggccgtgtc

SEQ ID NO: 3988734 - DNA, 12 bp, Homo sapiens
cccagcactttg

SEQ ID NO: 3988735 - DNA, 15 bp, Homo sapiens
cccagcactttggga

SEQ ID NO: 3988736 - DNA, 22 bp, Homo sapiens
cccagcactttgggaggccaag

SEQ ID NO: 3988737 - DNA, 13 bp, Homo sapiens
cccagcagaggca

SEQ ID NO: 3988738 - DNA, 18 bp, Homo sapiens
cccagcagcccaagctta

SEQ ID NO: 3988739 - DNA, 23 bp, Homo sapiens
cccagcagccctcaacaggccca

SEQ ID NO: 3988740 - DNA, 16 bp, Homo sapiens
cccagcaggaagccag

SEQ ID NO: 3988741 - DNA, 18 bp, Homo sapiens
cccagcatccctggagca

SEQ ID NO: 3988742 - DNA, 17 bp, Homo sapiens
cccagccaaaccctgtc

SEQ ID NO: 3988743 - DNA, 23 bp, Homo sapiens
cccagcccaccctgctcctcctg

SEQ ID NO: 3988744 - DNA, 13 bp, Homo sapiens
cccagcccagaga

SEQ ID NO: 3988745 - DNA, 14 bp, Homo sapiens
cccagcccagagac

SEQ ID NO: 3988746 - DNA, 15 bp, Homo sapiens
cccagccccatccct

SEQ ID NO: 3988747 - DNA, 15 bp, Homo sapiens
cccagccccggggtg

SEQ ID NO: 3988748 - DNA, 17 bp, Homo sapiens
cccagccccttctccca

SEQ ID NO: 3988749 - DNA, 17 bp, Homo sapiens
cccagccctgtcctggt

SEQ ID NO: 3988750 - DNA, 18 bp, Homo sapiens
cccagcctccctgaagcc

SEQ ID NO: 3988751 - DNA, 17 bp, Homo sapiens
cccagcctcgcctgtca

SEQ ID NO: 3988752 - DNA, 18 bp, Homo sapiens
cccagcctcgcctgtcac

SEQ ID NO: 3988753 - DNA, 15 bp, Homo sapiens
cccagcctgacctga

SEQ ID NO: 3988754 - DNA, 20 bp, Homo sapiens
cccagcctgacctgagactg

SEQ ID NO: 3988755 - DNA, 12 bp, Homo sapiens
cccagcctgctg

SEQ ID NO: 3988756 - DNA, 20 bp, Homo sapiens
cccagcctgctgagagcccc

SEQ ID NO: 3988757 - DNA, 11 bp, Homo sapiens
cccagcctggg

SEQ ID NO: 3988758 - DNA, 12 bp, Homo sapiens
cccagcctggga

SEQ ID NO: 3988759 - DNA, 18 bp, Homo sapiens
cccagcctgggagcccag

SEQ ID NO: 3988760 - DNA, 13 bp, Homo sapiens
cccagcctgggcc

SEQ ID NO: 3988761 - DNA, 22 bp, Homo sapiens
cccagcctgggggccagtgggg

SEQ ID NO: 3988762 - DNA, 13 bp, Homo sapiens
cccagcgcggcca

SEQ ID NO: 3988763 - DNA, 22 bp, Homo sapiens
cccagcgggcaggttctgcctg

SEQ ID NO: 3988764 - DNA, 17 bp, Homo sapiens
cccagctaagaacctgg

SEQ ID NO: 3988765 - DNA, 18 bp, Homo sapiens
cccagctaagaacctgga

SEQ ID NO: 3988766 - DNA, 19 bp, Homo sapiens
cccagctaagaacctggaa

SEQ ID NO: 3988767 - DNA, 13 bp, Homo sapiens
cccagctacccct

SEQ ID NO: 3988768 - DNA, 15 bp, Homo sapiens
cccagctacttggga

SEQ ID NO: 3988769 - DNA, 13 bp, Homo sapiens
cccagctccaggg

SEQ ID NO: 3988770 - DNA, 16 bp, Homo sapiens
cccagctccaggggcc

SEQ ID NO: 3988771 - DNA, 17 bp, Homo sapiens
cccagctgactgtggcc

SEQ ID NO: 3988772 - DNA, 21 bp, Homo sapiens
cccagctgactgtggccccct

SEQ ID NO: 3988773 - DNA, 12 bp, Homo sapiens
cccagctgcctg

SEQ ID NO: 3988774 - DNA, 20 bp, Homo sapiens
cccagcttaaatcctagcag

SEQ ID NO: 3988775 - DNA, 23 bp, Homo sapiens
cccagcttaaatcctagcaggag

SEQ ID NO: 3988776 - DNA, 17 bp, Homo sapiens
cccagctttaaaaagaa

SEQ ID NO: 3988777 - DNA, 21 bp, Homo sapiens
cccagctttaaaaagaaaaaa

SEQ ID NO: 3988778 - DNA, 23 bp, Homo sapiens
cccaggaactcgcacctgtgctg

SEQ ID NO: 3988779 - DNA, 21 bp, Homo sapiens
cccaggaagcccaggagggca

SEQ ID NO: 3988780 - DNA, 15 bp, Homo sapiens
cccaggaccaagcca

SEQ ID NO: 3988781 - DNA, 20 bp, Homo sapiens
cccaggaccaagccacagca

SEQ ID NO: 3988782 - DNA, 21 bp, Homo sapiens
cccaggaccagctcaggacag

SEQ ID NO: 3988783 - DNA, 17 bp, Homo sapiens
cccaggacgcttctgaa

SEQ ID NO: 3988784 - DNA, 18 bp, Homo sapiens
cccaggacgcttctgaat

SEQ ID NO: 3988785 - DNA, 19 bp, Homo sapiens
cccaggacgcttctgaatg

SEQ ID NO: 3988786 - DNA, 21 bp, Homo sapiens
cccaggagacagaccacttgc

SEQ ID NO: 3988787 - DNA, 19 bp, Homo sapiens
cccaggagatgggtccagg

SEQ ID NO: 3988788 - DNA, 20 bp, Homo sapiens
cccaggagatgggtccaggg

SEQ ID NO: 3988789 - DNA, 15 bp, Homo sapiens
cccaggatggactct

SEQ ID NO: 3988790 - DNA, 22 bp, Homo sapiens
cccaggccaggccaccaggatg

SEQ ID NO: 3988791 - DNA, 14 bp, Homo sapiens
cccaggccctccct

SEQ ID NO: 3988792 - DNA, 17 bp, Homo sapiens
cccaggccctccctgac

SEQ ID NO: 3988793 - DNA, 16 bp, Homo sapiens
cccaggccggcccaga

SEQ ID NO: 3988794 - DNA, 14 bp, Homo sapiens
cccaggcctcacca

SEQ ID NO: 3988795 - DNA, 15 bp, Homo sapiens
cccaggcctcaccac

SEQ ID NO: 3988796 - DNA, 13 bp, Homo sapiens
cccaggcctctgt

SEQ ID NO: 3988797 - DNA, 22 bp, Homo sapiens
cccaggctggacatgctgactg

SEQ ID NO: 3988798 - DNA, 14 bp, Homo sapiens
cccaggctgggaac

SEQ ID NO: 3988799 - DNA, 15 bp, Homo sapiens
cccaggctgttctcc

SEQ ID NO: 3988800 - DNA, 16 bp, Homo sapiens
cccaggctgttctcca

SEQ ID NO: 3988801 - DNA, 14 bp, Homo sapiens
cccagggagtccag

SEQ ID NO: 3988802 - DNA, 15 bp, Homo sapiens
cccagggagtccagg

SEQ ID NO: 3988803 - DNA, 12 bp, Homo sapiens
cccagggcaccc

SEQ ID NO: 3988804 - DNA, 16 bp, Homo sapiens
ccagattctgcctctc

SEQ ID NO: 3988805 - DNA, 19 bp, Homo sapiens
ccagattctgcctctctgg

SEQ ID NO: 3988806 - DNA, 15 bp, Homo sapiens
ccagattttgctgta

SEQ ID NO: 3988807 - DNA, 22 bp, Homo sapiens
ccagatttttcggaggccccac

SEQ ID NO: 3988808 - DNA, 21 bp, Homo sapiens
caggcttatgaatatatttaa

SEQ ID NO: 3988809 - DNA, 22 bp, Homo sapiens
caggcttcctgcaattttctaa

SEQ ID NO: 3988810 - DNA, 22 bp, Homo sapiens
cagggaagagcagaacggagcc

SEQ ID NO: 3988811 - DNA, 13 bp, Homo sapiens
cagggaagctggc

SEQ ID NO: 3988812 - DNA, 14 bp, Homo sapiens
cagggaagctggcc

SEQ ID NO: 3988813 - DNA, 19 bp, Homo sapiens
cagggaaggggaggcagcc

SEQ ID NO: 3988814 - DNA, 19 bp, Homo sapiens
cagggaaggtggccacagc

SEQ ID NO: 3988815 - DNA, 13 bp, Homo sapiens
cagggacagagcc

SEQ ID NO: 3988816 - DNA, 14 bp, Homo sapiens
cagggacagagcca

SEQ ID NO: 3988817 - DNA, 16 bp, Homo sapiens
cagggacagagccatg

SEQ ID NO: 3988818 - DNA, 14 bp, Homo sapiens
cagggacagaggcc

SEQ ID NO: 3988819 - DNA, 19 bp, Homo sapiens
cagggacagaggccccagc

SEQ ID NO: 3988820 - DNA, 15 bp, Homo sapiens
cagggaccccagaat

SEQ ID NO: 3988821 - DNA, 15 bp, Homo sapiens
cagggaccgtccagg

SEQ ID NO: 3988822 - DNA, 17 bp, Homo sapiens
cagggaccgtccagggg

SEQ ID NO: 3988823 - DNA, 14 bp, Homo sapiens
cagggacttggaca

SEQ ID NO: 3988824 - DNA, 17 bp, Homo sapiens
cagggacttggacagga

SEQ ID NO: 3988825 - DNA, 21 bp, Homo sapiens
cagggacttggacaggagtca

SEQ ID NO: 3988826 - DNA, 13 bp, Homo sapiens
cagggagaagctc

SEQ ID NO: 3988827 - DNA, 17 bp, Homo sapiens
cagggagcaagacagag

SEQ ID NO: 3988828 - DNA, 19 bp, Homo sapiens
cagggagcaagacagagac

SEQ ID NO: 3988829 - DNA, 18 bp, Homo sapiens
cagggagcagggaaggcc

SEQ ID NO: 3988830 - DNA, 20 bp, Homo sapiens
cagggagcagggaaggcctg

SEQ ID NO: 3988831 - DNA, 22 bp, Homo sapiens
cagggagcctttggttctggcc

SEQ ID NO: 3988832 - DNA, 15 bp, Homo sapiens
cagggagcggccggc

SEQ ID NO: 3988833 - DNA, 23 bp, Homo sapiens
cagggagcggccggccagcccct

SEQ ID NO: 3988834 - DNA, 12 bp, Homo sapiens
cagggaggccac

SEQ ID NO: 3988835 - DNA, 13 bp, Homo sapiens
cagggaggccaca

SEQ ID NO: 3988836 - DNA, 16 bp, Homo sapiens
cagggagggaagtgtg

SEQ ID NO: 3988837 - DNA, 17 bp, Homo sapiens
cagggagggaagtgtga

SEQ ID NO: 3988838 - DNA, 19 bp, Homo sapiens
cagggagggagggcggtgg

SEQ ID NO: 3988839 - DNA, 21 bp, Homo sapiens
cagggagggagggcggtggac

SEQ ID NO: 3988840 - DNA, 16 bp, Homo sapiens
cagggaggggaggcag

SEQ ID NO: 3988841 - DNA, 18 bp, Homo sapiens
cagggaggggaggcagat

SEQ ID NO: 3988842 - DNA, 16 bp, Homo sapiens
cagggaggtcattttg

SEQ ID NO: 3988843 - DNA, 18 bp, Homo sapiens
ccccagcttcacttctga

SEQ ID NO: 3988844 - DNA, 12 bp, Homo sapiens
ccccaggacaag

SEQ ID NO: 3988845 - DNA, 11 bp, Homo sapiens
ccccaggacca

SEQ ID NO: 3988846 - DNA, 15 bp, Homo sapiens
ccccaggccaggcca

SEQ ID NO: 3988847 - DNA, 22 bp, Homo sapiens
ccccaggccaggccaccaggat

SEQ ID NO: 3988848 - DNA, 14 bp, Homo sapiens
ccccaggccccaga

SEQ ID NO: 3988849 - DNA, 15 bp, Homo sapiens
ccccaggcctctgtg

SEQ ID NO: 3988850 - DNA, 15 bp, Homo sapiens
ccccaggctggagac

SEQ ID NO: 3988851 - DNA, 19 bp, Homo sapiens
ccccaggctggagtgcagt

SEQ ID NO: 3988852 - DNA, 11 bp, Homo sapiens
ccccaggctgt

SEQ ID NO: 3988853 - DNA, 18 bp, Homo sapiens
ccccagggagctctgggg

SEQ ID NO: 3988854 - DNA, 14 bp, Homo sapiens
ccccagggcaccct

SEQ ID NO: 3988855 - DNA, 12 bp, Homo sapiens
ccccagggcagc

SEQ ID NO: 3988856 - DNA, 16 bp, Homo sapiens
ccccagggccctggcc

SEQ ID NO: 3988857 - DNA, 17 bp, Homo sapiens
ccccagggccctggcca

SEQ ID NO: 3988858 - DNA, 16 bp, Homo sapiens
ccccaggggaaaatga

SEQ ID NO: 3988859 - DNA, 15 bp, Homo sapiens
ccccaggggcaggac

SEQ ID NO: 3988860 - DNA, 19 bp, Homo sapiens
ccccaggggtcccagccac

SEQ ID NO: 3988861 - DNA, 17 bp, Homo sapiens
ccccaggtggaaggcag

SEQ ID NO: 3988862 - DNA, 20 bp, Homo sapiens
ccccagtacctccaagcaag

SEQ ID NO: 3988863 - DNA, 21 bp, Homo sapiens
ccccagtgggaccacatgcca

SEQ ID NO: 3988864 - DNA, 21 bp, Homo sapiens
ccccatagataggcccctggg

SEQ ID NO: 3988865 - DNA, 16 bp, Homo sapiens
ccccatatacacctgg

SEQ ID NO: 3988866 - DNA, 15 bp, Homo sapiens
ccccatcaggtagct

SEQ ID NO: 3988867 - DNA, 16 bp, Homo sapiens
ccccatcctcatccct

SEQ ID NO: 3988868 - DNA, 14 bp, Homo sapiens
ccccatcctccaga

SEQ ID NO: 3988869 - DNA, 19 bp, Homo sapiens
ccccatctccctgcctggc

SEQ ID NO: 3988870 - DNA, 15 bp, Homo sapiens
ccccatctctcatcc

SEQ ID NO: 3988871 - DNA, 13 bp, Homo sapiens
ccccatgcactgt

SEQ ID NO: 3988872 - DNA, 13 bp, Homo sapiens
ccccatgcctgtc

SEQ ID NO: 3988873 - DNA, 22 bp, Homo sapiens
ccccatgcctgtccagcctggg

SEQ ID NO: 3988874 - DNA, 13 bp, Homo sapiens
ccccatgggctcc

SEQ ID NO: 3988875 - DNA, 23 bp, Homo sapiens
ccccatgtgtcctggttcccgtt

SEQ ID NO: 3988876 - DNA, 18 bp, Homo sapiens
ccccatttcccatctgca

SEQ ID NO: 3988877 - DNA, 20 bp, Homo sapiens
ccccatttcccatctgcacc

SEQ ID NO: 3988878 - DNA, 18 bp, Homo sapiens
ccagcctgggccatctct

SEQ ID NO: 3988879 - DNA, 18 bp, Homo sapiens
ccagcctgggggccagtg

SEQ ID NO: 3988880 - DNA, 19 bp, Homo sapiens
ccagcctgggggccagtgg

SEQ ID NO: 3988881 - DNA, 19 bp, Homo sapiens
ccagcctgtcccatggaca

SEQ ID NO: 3988882 - DNA, 21 bp, Homo sapiens
ccagccttgagccctggctgt

SEQ ID NO: 3988883 - DNA, 19 bp, Homo sapiens
ccagcctttggccttggct

SEQ ID NO: 3988884 - DNA, 24 bp, Homo sapiens
ccagcgccaagtaaacagggtacc

SEQ ID NO: 3988885 - DNA, 14 bp, Homo sapiens
ccagcgcggccagc

SEQ ID NO: 3988886 - DNA, 17 bp, Homo sapiens
ccagcgcggccagcgtc

SEQ ID NO: 3988887 - DNA, 13 bp, Homo sapiens
ccagcgggcagat

SEQ ID NO: 3988888 - DNA, 12 bp, Homo sapiens
ccagcggggctg

SEQ ID NO: 3988889 - DNA, 23 bp, Homo sapiens
ccagcgtcagctgctccctggca

SEQ ID NO: 3988890 - DNA, 15 bp, Homo sapiens
ccagcgtcccagggt

SEQ ID NO: 3988891 - DNA, 18 bp, Homo sapiens
ccagcgtcccagggtacc

SEQ ID NO: 3988892 - DNA, 13 bp, Homo sapiens
ccagctaagaacc

SEQ ID NO: 3988893 - DNA, 21 bp, Homo sapiens
ccagctaaggacatttcccag

SEQ ID NO: 3988894 - DNA, 21 bp, Homo sapiens
ccagctaatctgtagggctgg

SEQ ID NO: 3988895 - DNA, 18 bp, Homo sapiens
ccagctaccccttctttg

SEQ ID NO: 3988896 - DNA, 23 bp, Homo sapiens
ccagctaccccttctttgcaggg

SEQ ID NO: 3988897 - DNA, 20 bp, Homo sapiens
ccagctactcagatggctga

SEQ ID NO: 3988898 - DNA, 16 bp, Homo sapiens
ccagctacttgggaag

SEQ ID NO: 3988899 - DNA, 17 bp, Homo sapiens
ccagctacttgggaagc

SEQ ID NO: 3988900 - DNA, 19 bp, Homo sapiens
ccagctacttgggaggctg

SEQ ID NO: 3988901 - DNA, 23 bp, Homo sapiens
ccagctaggaagagcaggactcc

SEQ ID NO: 3988902 - DNA, 14 bp, Homo sapiens
ccagctatctgtca

SEQ ID NO: 3988903 - DNA, 22 bp, Homo sapiens
ccagctcaatggactggaaggg

SEQ ID NO: 3988904 - DNA, 13 bp, Homo sapiens
ccagctcacagtg

SEQ ID NO: 3988905 - DNA, 15 bp, Homo sapiens
ccagctcagaggccc

SEQ ID NO: 3988906 - DNA, 22 bp, Homo sapiens
ccagctcagaggcccaggaatc

SEQ ID NO: 3988907 - DNA, 19 bp, Homo sapiens
ccagctcaggacagatgcc

SEQ ID NO: 3988908 - DNA, 20 bp, Homo sapiens
ccagctcaggacagatgcca

SEQ ID NO: 3988909 - DNA, 23 bp, Homo sapiens
ccagctcaggacagatgccacac

SEQ ID NO: 3988910 - DNA, 12 bp, Homo sapiens
ccagctcatctc

SEQ ID NO: 3988911 - DNA, 16 bp, Homo sapiens
ccagctcatctccaag

SEQ ID NO: 3988912 - DNA, 20 bp, Homo sapiens
ccagctccaacctgcaaaga

SEQ ID NO: 3988913 - DNA, 12 bp, Homo sapiens
ccagctccaggg

SEQ ID NO: 3988914 - DNA, 15 bp, Homo sapiens
ccagctccaggggcc

SEQ ID NO: 3988915 - DNA, 13 bp, Homo sapiens
ccagctccctaga

SEQ ID NO: 3988916 - DNA, 21 bp, Homo sapiens
ccagctcttggcccctgtgtg

SEQ ID NO: 3988917 - DNA, 15 bp, Homo sapiens
ccagctgactgtggc

SEQ ID NO: 3988918 - DNA, 19 bp, Homo sapiens
ccagctgcactgatgctgc

SEQ ID NO: 3988919 - DNA, 20 bp, Homo sapiens
ccagctgcagccccttgctc

SEQ ID NO: 3988920 - DNA, 16 bp, Homo sapiens
ccagctgccctatggg

SEQ ID NO: 3988921 - DNA, 19 bp, Homo sapiens
ccagctgcctgggcccgga

SEQ ID NO: 3988922 - DNA, 17 bp, Homo sapiens
ccagctgcgcttgcttt

SEQ ID NO: 3988923 - DNA, 19 bp, Homo sapiens
ccagctgcgcttgcttttc

SEQ ID NO: 3988924 - DNA, 21 bp, Homo sapiens
ccagctgcgcttgcttttctg

SEQ ID NO: 3988925 - DNA, 12 bp, Homo sapiens
ccagctgctttt

SEQ ID NO: 3988926 - DNA, 17 bp, Homo sapiens
ccagctggggccagagg

SEQ ID NO: 3988927 - DNA, 18 bp, Homo sapiens
ccagctgggtcaggcagg

SEQ ID NO: 3988928 - DNA, 23 bp, Homo sapiens
ccagctgggtctaatccttctca

SEQ ID NO: 3988929 - DNA, 19 bp, Homo sapiens
ccagcttcaggcaccagca

SEQ ID NO: 3988930 - DNA, 20 bp, Homo sapiens
ccagcttcaggcaccagcat

SEQ ID NO: 3988931 - DNA, 24 bp, Homo sapiens
ccagcttcaggcaccagcatccac

SEQ ID NO: 3988932 - DNA, 21 bp, Homo sapiens
ccagcttcggagggcccctgc

SEQ ID NO: 3988933 - DNA, 18 bp, Homo sapiens
ccagcttctccaggctct

SEQ ID NO: 3988934 - DNA, 18 bp, Homo sapiens
ccagcttctctctccagg

SEQ ID NO: 3988935 - DNA, 20 bp, Homo sapiens
ccagcttctctctccagggt

SEQ ID NO: 3988936 - DNA, 15 bp, Homo sapiens
ccagcttgttattta

SEQ ID NO: 3988937 - DNA, 20 bp, Homo sapiens
ccagctttaaaaagaaaaaa

SEQ ID NO: 3988938 - DNA, 19 bp, Homo sapiens
ccaggaaactccacatctg

SEQ ID NO: 3988939 - DNA, 21 bp, Homo sapiens
ccaggaaactccacatctgcc

SEQ ID NO: 3988940 - DNA, 23 bp, Homo sapiens
ccaggaaagagcagtcagagtcc

SEQ ID NO: 3988941 - DNA, 13 bp, Homo sapiens
ccaggaagccaga

SEQ ID NO: 3988942 - DNA, 15 bp, Homo sapiens
ccaggaagccagagc

SEQ ID NO: 3988943 - DNA, 18 bp, Homo sapiens
ccaggaagccagagcccc

SEQ ID NO: 3988944 - DNA, 19 bp, Homo sapiens
ccaggaatgcctcctccct

SEQ ID NO: 3988945 - DNA, 16 bp, Homo sapiens
ccaggacaccagtcca

SEQ ID NO: 3988946 - DNA, 16 bp, Homo sapiens
ccaggaccagctcagg

SEQ ID NO: 3988947 - DNA, 20 bp, Homo sapiens
ccaggaccagctcaggacag

SEQ ID NO: 3988948 - DNA, 21 bp, Homo sapiens
ccaggaccctgacctccgccc

SEQ ID NO: 3988949 - DNA, 19 bp, Homo sapiens
ccaggacgcttctgaatgc

SEQ ID NO: 3988950 - DNA, 20 bp, Homo sapiens
ccaggacgtctggggtgtgg

SEQ ID NO: 3988951 - DNA, 19 bp, Homo sapiens
ccaggactatagcccaggt

SEQ ID NO: 3988952 - DNA, 18 bp, Homo sapiens
ccaggacttggggtcagg

SEQ ID NO: 3988953 - DNA, 19 bp, Homo sapiens
ccaggacttggggtcagga

SEQ ID NO: 3988954 - DNA, 23 bp, Homo sapiens
ccaggagacagaccacttgccac

SEQ ID NO: 3988955 - DNA, 15 bp, Homo sapiens
ccaggagatgggtcc

SEQ ID NO: 3988956 - DNA, 21 bp, Homo sapiens
ccaggagatgggtccaggggt

SEQ ID NO: 3988957 - DNA, 14 bp, Homo sapiens
ccaggagcaatggg

SEQ ID NO: 3988958 - DNA, 23 bp, Homo sapiens
ccaggagcaatgggactggagtc

SEQ ID NO: 3988959 - DNA, 19 bp, Homo sapiens
ccaggagcagatggacagc

SEQ ID NO: 3988960 - DNA, 17 bp, Homo sapiens
ccaggagctcaggtggg

SEQ ID NO: 3988961 - DNA, 21 bp, Homo sapiens
ccaggagctcaggtggggagt

SEQ ID NO: 3988962 - DNA, 13 bp, Homo sapiens
ccaggagctcttc

SEQ ID NO: 3988963 - DNA, 19 bp, Homo sapiens
ccaggagggaccaccctcc

SEQ ID NO: 3988964 - DNA, 17 bp, Homo sapiens
ccaggagggagcagagg

SEQ ID NO: 3988965 - DNA, 17 bp, Homo sapiens
ccaggagggcatccata

SEQ ID NO: 3988966 - DNA, 16 bp, Homo sapiens
ccaggatatttctgag

SEQ ID NO: 3988967 - DNA, 18 bp, Homo sapiens
ccaggatatttctgagag

SEQ ID NO: 3988968 - DNA, 19 bp, Homo sapiens
ccaggatcccaagcctcct

SEQ ID NO: 3988969 - DNA, 21 bp, Homo sapiens
ccaggatcccaagcctcctgc

SEQ ID NO: 3988970 - DNA, 22 bp, Homo sapiens
ccaggatcccaagcctcctgct

SEQ ID NO: 3988971 - DNA, 23 bp, Homo sapiens
ccaggatggactcttctcggctc

SEQ ID NO: 3988972 - DNA, 22 bp, Homo sapiens
ccaggatggaggggtggtcctg

SEQ ID NO: 3988973 - DNA, 17 bp, Homo sapiens
ccatttgatttttctaa

SEQ ID NO: 3988974 - DNA, 14 bp, Homo sapiens
ccatttgcctttct

SEQ ID NO: 3988975 - DNA, 15 bp, Homo sapiens
ccatttgtaataaag

SEQ ID NO: 3988976 - DNA, 13 bp, Homo sapiens
ccatttgttcctg

SEQ ID NO: 3988977 - DNA, 20 bp, Homo sapiens
ccatttgttcctgcttccga

SEQ ID NO: 3988978 - DNA, 10 bp, Homo sapiens
ccattttcta

SEQ ID NO: 3988979 - DNA, 23 bp, Homo sapiens
ccattttcttattgcgctgctac

SEQ ID NO: 3988980 - DNA, 21 bp, Homo sapiens
ccattttgcaaaatttccagt

SEQ ID NO: 3988981 - DNA, 12 bp, Homo sapiens
ccattttgtgaa

SEQ ID NO: 3988982 - DNA, 13 bp, Homo sapiens
ccattttgtgaat

SEQ ID NO: 3988983 - DNA, 17 bp, Homo sapiens
cccaaaacccagggcaa

SEQ ID NO: 3988984 - DNA, 21 bp, Homo sapiens
cccaaacaccttccagctcct

SEQ ID NO: 3988985 - DNA, 15 bp, Homo sapiens
cccaaacctttcccc

SEQ ID NO: 3988986 - DNA, 16 bp, Homo sapiens
cccaaacgccctttcc

SEQ ID NO: 3988987 - DNA, 23 bp, Homo sapiens
cccaaacgccctttcctcctcag

SEQ ID NO: 3988988 - DNA, 18 bp, Homo sapiens
cccaaaggcatcccagcc

SEQ ID NO: 3988989 - DNA, 20 bp, Homo sapiens
cccaaaggcatcccagcctg

SEQ ID NO: 3988990 - DNA, 16 bp, Homo sapiens
cccactcccgcctcag

SEQ ID NO: 3988991 - DNA, 21 bp, Homo sapiens
cccactcccgcctcagggcca

SEQ ID NO: 3988992 - DNA, 22 bp, Homo sapiens
cccactccctggctctcagaag

SEQ ID NO: 3988993 - DNA, 12 bp, Homo sapiens
cccactcctgct

SEQ ID NO: 3988994 - DNA, 14 bp, Homo sapiens
cccactctccccac

SEQ ID NO: 3988995 - DNA, 15 bp, Homo sapiens
cccactctccccaca

SEQ ID NO: 3988996 - DNA, 22 bp, Homo sapiens
cccactgatctctactaccaca

SEQ ID NO: 3988997 - DNA, 16 bp, Homo sapiens
cccactgcaccgcctc

SEQ ID NO: 3988998 - DNA, 17 bp, Homo sapiens
cccactgcaccgcctca

SEQ ID NO: 3988999 - DNA, 23 bp, Homo sapiens
cccactgcggggagacagaagcc

SEQ ID NO: 3989000 - DNA, 23 bp, Homo sapiens
cccactgggcacacgcacaaaca

SEQ ID NO: 3989001 - DNA, 21 bp, Homo sapiens
cccactgtccccctacccacc

SEQ ID NO: 3989002 - DNA, 14 bp, Homo sapiens
cccactgtcctacc

SEQ ID NO: 3989003 - DNA, 15 bp, Homo sapiens
cccactgtcctgggc

SEQ ID NO: 3989004 - DNA, 16 bp, Homo sapiens
cccactgtcctgggcc

SEQ ID NO: 3989005 - DNA, 18 bp, Homo sapiens
cccactttcatctacctt

SEQ ID NO: 3989006 - DNA, 15 bp, Homo sapiens
cccagaaaggagact

SEQ ID NO: 3989007 - DNA, 14 bp, Homo sapiens
cccagaactctgcc

SEQ ID NO: 3989008 - DNA, 15 bp, Homo sapiens
cccagaactgccccc

SEQ ID NO: 3989009 - DNA, 15 bp, Homo sapiens
catgactgggcctcc

SEQ ID NO: 3989010 - DNA, 16 bp, Homo sapiens
catgagaagagggcct

SEQ ID NO: 3989011 - DNA, 18 bp, Homo sapiens
catgagaagagggcctgt

SEQ ID NO: 3989012 - DNA, 22 bp, Homo sapiens
catgagaagagggcctgtggga

SEQ ID NO: 3989013 - DNA, 20 bp, Homo sapiens
catgagaataagagaaagaa

SEQ ID NO: 3989014 - DNA, 19 bp, Homo sapiens
catgagacacatctcctcc

SEQ ID NO: 3989015 - DNA, 18 bp, Homo sapiens
catgagacattgacacca

SEQ ID NO: 3989016 - DNA, 22 bp, Homo sapiens
catgagaccctggtgcctggct

SEQ ID NO: 3989017 - DNA, 14 bp, Homo sapiens
catgagactttctg

SEQ ID NO: 3989018 - DNA, 18 bp, Homo sapiens
catgagcattcataatta

SEQ ID NO: 3989019 - DNA, 12 bp, Homo sapiens
catgagcctgcc

SEQ ID NO: 3989020 - DNA, 23 bp, Homo sapiens
catgagcctgctggaagcccagc

SEQ ID NO: 3989021 - DNA, 22 bp, Homo sapiens
catgagctatttccattccaga

SEQ ID NO: 3989022 - DNA, 15 bp, Homo sapiens
catgaggaaggaaca

SEQ ID NO: 3989023 - DNA, 12 bp, Homo sapiens
catgaggagggt

SEQ ID NO: 3989024 - DNA, 19 bp, Homo sapiens
catttgagggcccagccag

SEQ ID NO: 3989025 - DNA, 21 bp, Homo sapiens
catttgagggcccagccagga

SEQ ID NO: 3989026 - DNA, 15 bp, Homo sapiens
catttgattctgtgt

SEQ ID NO: 3989027 - DNA, 14 bp, Homo sapiens
catttgccttgctg

SEQ ID NO: 3989028 - DNA, 19 bp, Homo sapiens
catttgctctttcatctct

SEQ ID NO: 3989029 - DNA, 17 bp, Homo sapiens
catttgctgttttaaac

SEQ ID NO: 3989030 - DNA, 20 bp, Homo sapiens
catttggtcaagattttgaa

SEQ ID NO: 3989031 - DNA, 21 bp, Homo sapiens
ccaaattgtcacctgcttctc

SEQ ID NO: 3989032 - DNA, 20 bp, Homo sapiens
ccaaatttgattgatttgaa

SEQ ID NO: 3989033 - DNA, 22 bp, Homo sapiens
ccaacaagaagaaatatgaaat

SEQ ID NO: 3989034 - DNA, 21 bp, Homo sapiens
ccaacaagaataaaggcagct

SEQ ID NO: 3989035 - DNA, 18 bp, Homo sapiens
ccaacaaggttggcaccc

SEQ ID NO: 3989036 - DNA, 22 bp, Homo sapiens
ccaacaaggttggcaccccagc

SEQ ID NO: 3989037 - DNA, 12 bp, Homo sapiens
ccaacacagttg

SEQ ID NO: 3989038 - DNA, 23 bp, Homo sapiens
ccaacaccacagacacacacacg

SEQ ID NO: 3989039 - DNA, 17 bp, Homo sapiens
ccaacacgcacctgcct

SEQ ID NO: 3989040 - DNA, 16 bp, Homo sapiens
ccaacagcacctcccc

SEQ ID NO: 3989041 - DNA, 12 bp, Homo sapiens
ccaacagccatg

SEQ ID NO: 3989042 - DNA, 13 bp, Homo sapiens
ccaacagccatgc

SEQ ID NO: 3989043 - DNA, 15 bp, Homo sapiens
ccaacagccatgccc

SEQ ID NO: 3989044 - DNA, 17 bp, Homo sapiens
ccaacaggggctccatg

SEQ ID NO: 3989045 - DNA, 23 bp, Homo sapiens
ccaacaggtggcaggaccaggac

SEQ ID NO: 3989046 - DNA, 17 bp, Homo sapiens
ccaacatatatttattg

SEQ ID NO: 3989047 - DNA, 22 bp, Homo sapiens
ccaacatatatttattgagtac

SEQ ID NO: 3989048 - DNA, 15 bp, Homo sapiens
ccaacatggtgaaac

SEQ ID NO: 3989049 - DNA, 21 bp, Homo sapiens
ccaaccacacttgtcggctcc

SEQ ID NO: 3989050 - DNA, 13 bp, Homo sapiens
ccaaccacagaga

SEQ ID NO: 3989051 - DNA, 13 bp, Homo sapiens
ccaacccccaccc

SEQ ID NO: 3989052 - DNA, 17 bp, Homo sapiens
ccaacccccaccccaca

SEQ ID NO: 3989053 - DNA, 22 bp, Homo sapiens
ccaaccctaggttccctgttct

SEQ ID NO: 3989054 - DNA, 15 bp, Homo sapiens
ccaaccctcagagcc

SEQ ID NO: 3989055 - DNA, 13 bp, Homo sapiens
ccaaccctgggct

SEQ ID NO: 3989056 - DNA, 20 bp, Homo sapiens
ccaaccctggggaaggagcc

SEQ ID NO: 3989057 - DNA, 16 bp, Homo sapiens
ccaaccgtgtctgtct

SEQ ID NO: 3989058 - DNA, 15 bp, Homo sapiens
ccaacctcagaggca

SEQ ID NO: 3989059 - DNA, 22 bp, Homo sapiens
ccaacctcagggctcccagggg

SEQ ID NO: 3989060 - DNA, 21 bp, Homo sapiens
ccaacctcggcttgtgggctg

SEQ ID NO: 3989061 - DNA, 18 bp, Homo sapiens
ccaacctctttttcctcc

SEQ ID NO: 3989062 - DNA, 20 bp, Homo sapiens
ccaacctctttttcctcctg

SEQ ID NO: 3989063 - DNA, 18 bp, Homo sapiens
ccaacctgcaaagatctg

SEQ ID NO: 3989064 - DNA, 12 bp, Homo sapiens
ccaacctgctct

SEQ ID NO: 3989065 - DNA, 14 bp, Homo sapiens
ccaacctgctctgt

SEQ ID NO: 3989066 - DNA, 18 bp, Homo sapiens
ccaacctgctctgtcccc

SEQ ID NO: 3989067 - DNA, 20 bp, Homo sapiens
ccaacggccctgcagccagc

SEQ ID NO: 3989068 - DNA, 13 bp, Homo sapiens
ccaactactgagc

SEQ ID NO: 3989069 - DNA, 17 bp, Homo sapiens
ccaactagcccctgggg

SEQ ID NO: 3989070 - DNA, 16 bp, Homo sapiens
ccaactcctaatttta

SEQ ID NO: 3989071 - DNA, 21 bp, Homo sapiens
ccaactgacttgtatctgtcc

SEQ ID NO: 3989072 - DNA, 19 bp, Homo sapiens
ccaactgccaggctgcctc

SEQ ID NO: 3989073 - DNA, 14 bp, Homo sapiens
ccaagaaaatgaag

SEQ ID NO: 3989074 - DNA, 13 bp, Homo sapiens
ccaagaaagcagg

SEQ ID NO: 3989075 - DNA, 21 bp, Homo sapiens
ccaagaaagctcactgtagct

SEQ ID NO: 3989076 - DNA, 19 bp, Homo sapiens
ccaagaaagcttcttcaga

SEQ ID NO: 3989077 - DNA, 18 bp, Homo sapiens
ccaagacagatgccccag

SEQ ID NO: 3989078 - DNA, 22 bp, Homo sapiens
ccaagacagatgccccagagct

SEQ ID NO: 3989079 - DNA, 16 bp, Homo sapiens
ccaagacattgtcaat

SEQ ID NO: 3989080 - DNA, 21 bp, Homo sapiens
ccaagaggtttggctcctgcc

SEQ ID NO: 3989081 - DNA, 17 bp, Homo sapiens
ccaagagtaactttact

SEQ ID NO: 3989082 - DNA, 23 bp, Homo sapiens
ccaagatcaattccctctctcag

SEQ ID NO: 3989083 - DNA, 16 bp, Homo sapiens
ccaagattttcctctt

SEQ ID NO: 3989084 - DNA, 20 bp, Homo sapiens
ccaagattttcctcttgtga

SEQ ID NO: 3989085 - DNA, 13 bp, Homo sapiens
ccaagcaacattt

SEQ ID NO: 3989086 - DNA, 16 bp, Homo sapiens
ccaagcaacatttgta

SEQ ID NO: 3989087 - DNA, 15 bp, Homo sapiens
ccaagcacagagcct

SEQ ID NO: 3989088 - DNA, 16 bp, Homo sapiens
ccaagcacagagcctg

SEQ ID NO: 3989089 - DNA, 17 bp, Homo sapiens
ccaagcacagagcctgg

SEQ ID NO: 3989090 - DNA, 18 bp, Homo sapiens
ccaagcacagagcctggc

SEQ ID NO: 3989091 - DNA, 20 bp, Homo sapiens
ccaagcacagagcctggccc

SEQ ID NO: 3989092 - DNA, 13 bp, Homo sapiens
ccaagcacagcag

SEQ ID NO: 3989093 - DNA, 17 bp, Homo sapiens
ccaagcaggagacgaca

SEQ ID NO: 3989094 - DNA, 20 bp, Homo sapiens
ccaagcaggagacgacaggc

SEQ ID NO: 3989095 - DNA, 13 bp, Homo sapiens
ccaagcaggaggc

SEQ ID NO: 3989096 - DNA, 14 bp, Homo sapiens
ccaagcaggaggct

SEQ ID NO: 3989097 - DNA, 14 bp, Homo sapiens
ccaagcccaaactt

SEQ ID NO: 3989098 - DNA, 12 bp, Homo sapiens
ccaagcccacca

SEQ ID NO: 3989099 - DNA, 16 bp, Homo sapiens
ccaagcccaccaggtg

SEQ ID NO: 3989100 - DNA, 17 bp, Homo sapiens
ccaagcccaccaggtgt

SEQ ID NO: 3989101 - DNA, 18 bp, Homo sapiens
ccaagcccaccaggtgtc

SEQ ID NO: 3989102 - DNA, 17 bp, Homo sapiens
ccaagccgaccttccct

SEQ ID NO: 3989103 - DNA, 13 bp, Homo sapiens
ccaagccgtggct

SEQ ID NO: 3989104 - DNA, 19 bp, Homo sapiens
ccaagccttaaactgtaca

SEQ ID NO: 3989105 - DNA, 20 bp, Homo sapiens
ccaagctgcctctgggccat

SEQ ID NO: 3989106 - DNA, 19 bp, Homo sapiens
ccaagcttaatagccctcc

SEQ ID NO: 3989107 - DNA, 11 bp, Homo sapiens
ccaagcttccc

SEQ ID NO: 3989108 - DNA, 22 bp, Homo sapiens
ccaagcttggtttgtggcgtct

SEQ ID NO: 3989109 - DNA, 14 bp, Homo sapiens
ccaaggaccaggtt

SEQ ID NO: 3989110 - DNA, 21 bp, Homo sapiens
ccaaggagaccaagtcctggc

SEQ ID NO: 3989111 - DNA, 23 bp, Homo sapiens
ccaaggaggtgaggagcagagca

SEQ ID NO: 3989112 - DNA, 20 bp, Homo sapiens
ccaaggatcctctccactcc

SEQ ID NO: 3989113 - DNA, 22 bp, Homo sapiens
ccaaggatcctctccactccat

SEQ ID NO: 3989114 - DNA, 23 bp, Homo sapiens
ccaaggatcggactctgcccctg

SEQ ID NO: 3989115 - DNA, 19 bp, Homo sapiens
ccaaggccagagtggcctg

SEQ ID NO: 3989116 - DNA, 20 bp, Homo sapiens
ccaaggccccctgcctgccc

SEQ ID NO: 3989117 - DNA, 16 bp, Homo sapiens
ccaaggcctccctcag

SEQ ID NO: 3989118 - DNA, 16 bp, Homo sapiens
ccaaggccttctcctc

SEQ ID NO: 3989119 - DNA, 15 bp, Homo sapiens
ccaaggcggcccctc

SEQ ID NO: 3989120 - DNA, 17 bp, Homo sapiens
ccaagggaaaggggtgc

SEQ ID NO: 3989121 - DNA, 22 bp, Homo sapiens
ccaagggaaaggggtgctttta

SEQ ID NO: 3989122 - DNA, 14 bp, Homo sapiens
ccaaggtcccctcc

SEQ ID NO: 3989123 - DNA, 15 bp, Homo sapiens
ccaaggtcccctcca

SEQ ID NO: 3989124 - DNA, 16 bp, Homo sapiens
ccaaggtcccctccac

SEQ ID NO: 3989125 - DNA, 14 bp, Homo sapiens
ccaaggtcctgctc

SEQ ID NO: 3989126 - DNA, 16 bp, Homo sapiens
ccaaggtcctgctcaa

SEQ ID NO: 3989127 - DNA, 17 bp, Homo sapiens
ccaaggtcttcagccat

SEQ ID NO: 3989128 - DNA, 22 bp, Homo sapiens
ccaaggtggcagatgtcttccc

SEQ ID NO: 3989129 - DNA, 14 bp, Homo sapiens
cagttggcagacag

SEQ ID NO: 3989130 - DNA, 16 bp, Homo sapiens
cagttggccagagagc

SEQ ID NO: 3989131 - DNA, 20 bp, Homo sapiens
cagttgggagcactggagtg

SEQ ID NO: 3989132 - DNA, 14 bp, Homo sapiens
cagttggttgtgtc

SEQ ID NO: 3989133 - DNA, 17 bp, Homo sapiens
cagttggttgtgtcttt

SEQ ID NO: 3989134 - DNA, 18 bp, Homo sapiens
cagttggttgtgtctttt

SEQ ID NO: 3989135 - DNA, 20 bp, Homo sapiens
cagttgtgttagcctcttgc

SEQ ID NO: 3989136 - DNA, 12 bp, Homo sapiens
cagttgttcttt

SEQ ID NO: 3989137 - DNA, 19 bp, Homo sapiens
cagttgttctttttagaaa

SEQ ID NO: 3989138 - DNA, 20 bp, Homo sapiens
cagtttaagagcagaacaga

SEQ ID NO: 3989139 - DNA, 23 bp, Homo sapiens
cagtttaccagttgccttttatc

SEQ ID NO: 3989140 - DNA, 16 bp, Homo sapiens
cagtttatgttgtaca

SEQ ID NO: 3989141 - DNA, 23 bp, Homo sapiens
cagtttattccagagctgccagt

SEQ ID NO: 3989142 - DNA, 19 bp, Homo sapiens
cagtttatttgaaccaata

SEQ ID NO: 3989143 - DNA, 21 bp, Homo sapiens
cagtttatttttaaagataga

SEQ ID NO: 3989144 - DNA, 16 bp, Homo sapiens
cagtttcatctggttg

SEQ ID NO: 3989145 - DNA, 18 bp, Homo sapiens
cagtttcttagcttttta

SEQ ID NO: 3989146 - DNA, 18 bp, Homo sapiens
cagtttgaaaatattttg

SEQ ID NO: 3989147 - DNA, 18 bp, Homo sapiens
cagtttgaagcctgtgcc

SEQ ID NO: 3989148 - DNA, 21 bp, Homo sapiens
cagtttgaagcctgtgcctcc

SEQ ID NO: 3989149 - DNA, 20 bp, Homo sapiens
cagtttgattgaggagctgc

SEQ ID NO: 3989150 - DNA, 20 bp, Homo sapiens
cagtttgggtaaaatacttt

SEQ ID NO: 3989151 - DNA, 13 bp, Homo sapiens
cagtttgtcagac

SEQ ID NO: 3989152 - DNA, 16 bp, Homo sapiens
cagtttgtgtgtctta

SEQ ID NO: 3989153 - DNA, 23 bp, Homo sapiens
cagtttgtgtgtcttaattatta

SEQ ID NO: 3989154 - DNA, 16 bp, Homo sapiens
cagttttatgccccat

SEQ ID NO: 3989155 - DNA, 13 bp, Homo sapiens
cagttttccatga

SEQ ID NO: 3989156 - DNA, 17 bp, Homo sapiens
cagttttccatgaaaac

SEQ ID NO: 3989157 - DNA, 18 bp, Homo sapiens
cagttttccatgaaaacg

SEQ ID NO: 3989158 - DNA, 19 bp, Homo sapiens
cagttttccatgaaaacgt

SEQ ID NO: 3989159 - DNA, 18 bp, Homo sapiens
cataaaaagcagaatttt

SEQ ID NO: 3989160 - DNA, 22 bp, Homo sapiens
cataaaaaggacatcagcaaac

SEQ ID NO: 3989161 - DNA, 12 bp, Homo sapiens
cataaaacaggt

SEQ ID NO: 3989162 - DNA, 14 bp, Homo sapiens
cataaaagaatttt

SEQ ID NO: 3989163 - DNA, 21 bp, Homo sapiens
cataaaagggtcaaacctgta

SEQ ID NO: 3989164 - DNA, 22 bp, Homo sapiens
cataaaagggtcaaacctgtag

SEQ ID NO: 3989165 - DNA, 15 bp, Homo sapiens
cataaactgacttta

SEQ ID NO: 3989166 - DNA, 17 bp, Homo sapiens
cataaactgactttatc

SEQ ID NO: 3989167 - DNA, 20 bp, Homo sapiens
cataaagggttgaaaatgtg

SEQ ID NO: 3989168 - DNA, 20 bp, Homo sapiens
cataaatatgcagtgatatg

SEQ ID NO: 3989169 - DNA, 13 bp, Homo sapiens
cataaatgaagca

SEQ ID NO: 3989170 - DNA, 20 bp, Homo sapiens
cataacattttcagaatagt

SEQ ID NO: 3989171 - DNA, 15 bp, Homo sapiens
cataaccaacaatat

SEQ ID NO: 3989172 - DNA, 13 bp, Homo sapiens
cataacggaaagt

SEQ ID NO: 3989173 - DNA, 20 bp, Homo sapiens
cataacgtttttcctttaaa

SEQ ID NO: 3989174 - DNA, 12 bp, Homo sapiens
cataactgcctt

SEQ ID NO: 3989175 - DNA, 19 bp, Homo sapiens
cataactgccttgaacctg

SEQ ID NO: 3989176 - DNA, 11 bp, Homo sapiens
cataagaccat

SEQ ID NO: 3989177 - DNA, 19 bp, Homo sapiens
cataaggacgtgtgtaaat

SEQ ID NO: 3989178 - DNA, 16 bp, Homo sapiens
cataagtaattcaaga

SEQ ID NO: 3989179 - DNA, 22 bp, Homo sapiens
cataagtaattcaagaaaacaa

SEQ ID NO: 3989180 - DNA, 14 bp, Homo sapiens
cataagtgaattta

SEQ ID NO: 3989181 - DNA, 18 bp, Homo sapiens
cataagtggttttcttca

SEQ ID NO: 3989182 - DNA, 15 bp, Homo sapiens
cataagttgcattta

SEQ ID NO: 3989183 - DNA, 18 bp, Homo sapiens
cataataaagcaatctga

SEQ ID NO: 3989184 - DNA, 21 bp, Homo sapiens
cataataaagcaatctgattc

SEQ ID NO: 3989185 - DNA, 18 bp, Homo sapiens
cataatgataaaataaat

SEQ ID NO: 3989186 - DNA, 20 bp, Homo sapiens
cataatgcattcttctctgt

SEQ ID NO: 3989187 - DNA, 21 bp, Homo sapiens
cataatgcattcttctctgtt

SEQ ID NO: 3989188 - DNA, 22 bp, Homo sapiens
cataatgcattcttctctgttg

SEQ ID NO: 3989189 - DNA, 22 bp, Homo sapiens
cataatgctaatttaaagagac

SEQ ID NO: 3989190 - DNA, 18 bp, Homo sapiens
cataatgttacattatta

SEQ ID NO: 3989191 - DNA, 16 bp, Homo sapiens
cataattaaaatttat

SEQ ID NO: 3989192 - DNA, 17 bp, Homo sapiens
cataattatgacagtta

SEQ ID NO: 3989193 - DNA, 18 bp, Homo sapiens
cataattcagcacttaac

SEQ ID NO: 3989194 - DNA, 16 bp, Homo sapiens
cataattcctacagca

SEQ ID NO: 3989195 - DNA, 22 bp, Homo sapiens
cataattctaagttatttactt

SEQ ID NO: 3989196 - DNA, 16 bp, Homo sapiens
cataattcttgtatat

SEQ ID NO: 3989197 - DNA, 18 bp, Homo sapiens
cataattcttgtatatta

SEQ ID NO: 3989198 - DNA, 15 bp, Homo sapiens
catacaattccaaac

SEQ ID NO: 3989199 - DNA, 14 bp, Homo sapiens
catacacacagcag

SEQ ID NO: 3989200 - DNA, 18 bp, Homo sapiens
catacacgttaactgcag

SEQ ID NO: 3989201 - DNA, 12 bp, Homo sapiens
catacagctcta

SEQ ID NO: 3989202 - DNA, 17 bp, Homo sapiens
catacatgcaaaaagaa

SEQ ID NO: 3989203 - DNA, 12 bp, Homo sapiens
catacattaaaa

SEQ ID NO: 3989204 - DNA, 22 bp, Homo sapiens
catacatttataatgtttgcta

SEQ ID NO: 3989205 - DNA, 23 bp, Homo sapiens
cataccagctcgcacccccctgt

SEQ ID NO: 3989206 - DNA, 18 bp, Homo sapiens
catacccaaaccaggtgg

SEQ ID NO: 3989207 - DNA, 18 bp, Homo sapiens
cataccttttctcttttc

SEQ ID NO: 3989208 - DNA, 17 bp, Homo sapiens
catactcagcctgctgc

SEQ ID NO: 3989209 - DNA, 14 bp, Homo sapiens
catggctcagagct

SEQ ID NO: 3989210 - DNA, 23 bp, Homo sapiens
catggctgtgtttgcagcctgct

SEQ ID NO: 3989211 - DNA, 15 bp, Homo sapiens
catggcttaatgttt

SEQ ID NO: 3989212 - DNA, 20 bp, Homo sapiens
catggcttaatgtttattcc

SEQ ID NO: 3989213 - DNA, 18 bp, Homo sapiens
catgggaaagccacctct

SEQ ID NO: 3989214 - DNA, 17 bp, Homo sapiens
catgggaagcatgtgga

SEQ ID NO: 3989215 - DNA, 13 bp, Homo sapiens
catgggagccagc

SEQ ID NO: 3989216 - DNA, 16 bp, Homo sapiens
catgggctcctgcccc

SEQ ID NO: 3989217 - DNA, 13 bp, Homo sapiens
catgggctctgac

SEQ ID NO: 3989218 - DNA, 13 bp, Homo sapiens
catgggcttcact

SEQ ID NO: 3989219 - DNA, 16 bp, Homo sapiens
catgggcttcactgta

SEQ ID NO: 3989220 - DNA, 19 bp, Homo sapiens
catgggggcacttgagttt

SEQ ID NO: 3989221 - DNA, 15 bp, Homo sapiens
catgggtccagggcc

SEQ ID NO: 3989222 - DNA, 17 bp, Homo sapiens
cattaccttactgtgga

SEQ ID NO: 3989223 - DNA, 13 bp, Homo sapiens
cattactgggcct

SEQ ID NO: 3989224 - DNA, 17 bp, Homo sapiens
cattagaaatagacagt

SEQ ID NO: 3989225 - DNA, 16 bp, Homo sapiens
cattagactcctcctc

SEQ ID NO: 3989226 - DNA, 21 bp, Homo sapiens
cattagattttattttactat

SEQ ID NO: 3989227 - DNA, 16 bp, Homo sapiens
cattagtaaatgtctt

SEQ ID NO: 3989228 - DNA, 17 bp, Homo sapiens
cattagtaaatgtcttt

SEQ ID NO: 3989229 - DNA, 21 bp, Homo sapiens
cattagtaaatgtctttgtaa

SEQ ID NO: 3989230 - DNA, 13 bp, Homo sapiens
cattagttttaga

SEQ ID NO: 3989231 - DNA, 19 bp, Homo sapiens
cattatagattttcatgtt

SEQ ID NO: 3989232 - DNA, 16 bp, Homo sapiens
cattatcgggagcagt

SEQ ID NO: 3989233 - DNA, 18 bp, Homo sapiens
cattatcgggagcagtgt

SEQ ID NO: 3989234 - DNA, 13 bp, Homo sapiens
cattatctggaat

SEQ ID NO: 3989235 - DNA, 12 bp, Homo sapiens
cattatcttatg

SEQ ID NO: 3989236 - DNA, 15 bp, Homo sapiens
cattatcttatgaat

SEQ ID NO: 3989237 - DNA, 22 bp, Homo sapiens
cattattctctgctatatataa

SEQ ID NO: 3989238 - DNA, 12 bp, Homo sapiens
cattattggaat

SEQ ID NO: 3989239 - DNA, 20 bp, Homo sapiens
cattattggaattaacctgg

SEQ ID NO: 3989240 - DNA, 22 bp, Homo sapiens
cattattggaattaacctggtg

SEQ ID NO: 3989241 - DNA, 14 bp, Homo sapiens
cattatttatatgg

SEQ ID NO: 3989242 - DNA, 23 bp, Homo sapiens
cattatttatatggggaatatat

SEQ ID NO: 3989243 - DNA, 13 bp, Homo sapiens
cattatttgcatg

SEQ ID NO: 3989244 - DNA, 15 bp, Homo sapiens
cattattttgtggtt

SEQ ID NO: 3989245 - DNA, 12 bp, Homo sapiens
cattcaaattaa

SEQ ID NO: 3989246 - DNA, 17 bp, Homo sapiens
cattcaatctttggagg

SEQ ID NO: 3989247 - DNA, 13 bp, Homo sapiens
cattcaatgttta

SEQ ID NO: 3989248 - DNA, 22 bp, Homo sapiens
cattcacagttctttgggccag

SEQ ID NO: 3989249 - DNA, 18 bp, Homo sapiens
cattcacttgcatttctt

SEQ ID NO: 3989250 - DNA, 17 bp, Homo sapiens
cattcagatcactgaat

SEQ ID NO: 3989251 - DNA, 21 bp, Homo sapiens
cattcagatcactgaatttat

SEQ ID NO: 3989252 - DNA, 23 bp, Homo sapiens
cattcagatcactgaatttataa

SEQ ID NO: 3989253 - DNA, 20 bp, Homo sapiens
cattcagtgattactgtcaa

SEQ ID NO: 3989254 - DNA, 21 bp, Homo sapiens
cattcagtgattactgtcaag

SEQ ID NO: 3989255 - DNA, 13 bp, Homo sapiens
cattcatctcatt

SEQ ID NO: 3989256 - DNA, 16 bp, Homo sapiens
cattcattttctgaca

SEQ ID NO: 3989257 - DNA, 16 bp, Homo sapiens
cattcatttttatagc

SEQ ID NO: 3989258 - DNA, 16 bp, Homo sapiens
cattccaaagctttat

SEQ ID NO: 3989259 - DNA, 14 bp, Homo sapiens
cattccaagcctga

SEQ ID NO: 3989260 - DNA, 13 bp, Homo sapiens
cattccagaatct

SEQ ID NO: 3989261 - DNA, 13 bp, Homo sapiens
cattccagagtgc

SEQ ID NO: 3989262 - DNA, 12 bp, Homo sapiens
cattccaggccc

SEQ ID NO: 3989263 - DNA, 20 bp, Homo sapiens
cattccagtgctagaaaatt

SEQ ID NO: 3989264 - DNA, 20 bp, Homo sapiens
cattcccccaccagctgcag

SEQ ID NO: 3989265 - DNA, 22 bp, Homo sapiens
cattcccccaccagctgcagcc

SEQ ID NO: 3989266 - DNA, 23 bp, Homo sapiens
cattcccctcccacctctccttt

SEQ ID NO: 3989267 - DNA, 14 bp, Homo sapiens
cattccctgaatct

SEQ ID NO: 3989268 - DNA, 21 bp, Homo sapiens
cattcctaacacagcatgtgt

SEQ ID NO: 3989269 - DNA, 21 bp, Homo sapiens
cattcctgaagaaccagtccc

SEQ ID NO: 3989270 - DNA, 14 bp, Homo sapiens
cattccttctttga

SEQ ID NO: 3989271 - DNA, 18 bp, Homo sapiens
cattccttctttgataat

SEQ ID NO: 3989272 - DNA, 19 bp, Homo sapiens
cattccttctttgataatg

SEQ ID NO: 3989273 - DNA, 17 bp, Homo sapiens
cattcgacataccccac

SEQ ID NO: 3989274 - DNA, 20 bp, Homo sapiens
cattcgacataccccactgg

SEQ ID NO: 3989275 - DNA, 16 bp, Homo sapiens
cattcgatctcattca

SEQ ID NO: 3989276 - DNA, 15 bp, Homo sapiens
cattcgggccacagg

SEQ ID NO: 3989277 - DNA, 16 bp, Homo sapiens
cattcgggccacaggg

SEQ ID NO: 3989278 - DNA, 17 bp, Homo sapiens
cattcgggccacagggc

SEQ ID NO: 3989279 - DNA, 18 bp, Homo sapiens
cattcgtgagctggggac

SEQ ID NO: 3989280 - DNA, 19 bp, Homo sapiens
cattcgtggcatgttttga

SEQ ID NO: 3989281 - DNA, 14 bp, Homo sapiens
cattcgttctgtgg

SEQ ID NO: 3989282 - DNA, 21 bp, Homo sapiens
cattctatccccaatcagctc

SEQ ID NO: 3989283 - DNA, 22 bp, Homo sapiens
cattctatccccaatcagctcc

SEQ ID NO: 3989284 - DNA, 18 bp, Homo sapiens
cattctattgccttcttt

SEQ ID NO: 3989285 - DNA, 23 bp, Homo sapiens
cattctattgccttctttgaaga

SEQ ID NO: 3989286 - DNA, 16 bp, Homo sapiens
cattctcactcctacc

SEQ ID NO: 3989287 - DNA, 19 bp, Homo sapiens
cattctcataattcctaca

SEQ ID NO: 3989288 - DNA, 18 bp, Homo sapiens
cattctccacagcaaccc

SEQ ID NO: 3989289 - DNA, 12 bp, Homo sapiens
cattctcccagg

SEQ ID NO: 3989290 - DNA, 23 bp, Homo sapiens
cattctcccaggtaccagctgcg

SEQ ID NO: 3989291 - DNA, 22 bp, Homo sapiens
cattctcctgcctgtagcagtg

SEQ ID NO: 3989292 - DNA, 18 bp, Homo sapiens
cattctctatgtactatg

SEQ ID NO: 3989293 - DNA, 19 bp, Homo sapiens
cattctgcattgctagata

SEQ ID NO: 3989294 - DNA, 17 bp, Homo sapiens
cattctgttttccccca

SEQ ID NO: 3989295 - DNA, 18 bp, Homo sapiens
cattcttctctgttgtcg

SEQ ID NO: 3989296 - DNA, 17 bp, Homo sapiens
cattcttgaaagctgtg

SEQ ID NO: 3989297 - DNA, 18 bp, Homo sapiens
cattctttatcttgacat

SEQ ID NO: 3989298 - DNA, 18 bp, Homo sapiens
cattgaaagaagagatga

SEQ ID NO: 3989299 - DNA, 16 bp, Homo sapiens
cattgaaagagaacca

SEQ ID NO: 3989300 - DNA, 16 bp, Homo sapiens
cattgaaatgagcacc

SEQ ID NO: 3989301 - DNA, 20 bp, Homo sapiens
cattgaaatgagcacctcca

SEQ ID NO: 3989302 - DNA, 21 bp, Homo sapiens
cattgaagccgactctggccc

SEQ ID NO: 3989303 - DNA, 18 bp, Homo sapiens
cattgaagtaatgaattt

SEQ ID NO: 3989304 - DNA, 19 bp, Homo sapiens
cattgaagtaatgaatttt

SEQ ID NO: 3989305 - DNA, 15 bp, Homo sapiens
cattgaccaagaact

SEQ ID NO: 3989306 - DNA, 17 bp, Homo sapiens
cattgacctctcagggc

SEQ ID NO: 3989307 - DNA, 18 bp, Homo sapiens
cattgacctctcagggcc

SEQ ID NO: 3989308 - DNA, 18 bp, Homo sapiens
cattgacgattccttctc

SEQ ID NO: 3989309 - DNA, 23 bp, Homo sapiens
cattgactggtttacaggccctg

SEQ ID NO: 3989310 - DNA, 19 bp, Homo sapiens
cattgaggaaatattaatt

SEQ ID NO: 3989311 - DNA, 16 bp, Homo sapiens
cattgaggaagagtct

SEQ ID NO: 3989312 - DNA, 16 bp, Homo sapiens
cattgagttggttact

SEQ ID NO: 3989313 - DNA, 16 bp, Homo sapiens
cattgattgtcagcta

SEQ ID NO: 3989314 - DNA, 16 bp, Homo sapiens
cagtacctccaagcaa

SEQ ID NO: 3989315 - DNA, 16 bp, Homo sapiens
cagtacctctcaagct

SEQ ID NO: 3989316 - DNA, 22 bp, Homo sapiens
cagtacttgtgaaacacagctg

SEQ ID NO: 3989317 - DNA, 23 bp, Homo sapiens
cagtacttgtgaaacacagctgt

SEQ ID NO: 3989318 - DNA, 20 bp, Homo sapiens
cagtacttttattaatattt

SEQ ID NO: 3989319 - DNA, 18 bp, Homo sapiens
cagtagaaataatatgca

SEQ ID NO: 3989320 - DNA, 15 bp, Homo sapiens
cagtagaactgtctg

SEQ ID NO: 3989321 - DNA, 18 bp, Homo sapiens
cagtagattgcagaaaat

SEQ ID NO: 3989322 - DNA, 15 bp, Homo sapiens
cagtaggttggcagt

SEQ ID NO: 3989323 - DNA, 23 bp, Homo sapiens
cagtagtcttgatgaccaaagtc

SEQ ID NO: 3989324 - DNA, 22 bp, Homo sapiens
cagtatatttatagtcacaaga

SEQ ID NO: 3989325 - DNA, 17 bp, Homo sapiens
cagtatcatgccctgtg

SEQ ID NO: 3989326 - DNA, 19 bp, Homo sapiens
cagtattaaaggggggagg

SEQ ID NO: 3989327 - DNA, 20 bp, Homo sapiens
cagtattaaaggggggaggg

SEQ ID NO: 3989328 - DNA, 22 bp, Homo sapiens
cagtattatgcatatataagtt

SEQ ID NO: 3989329 - DNA, 20 bp, Homo sapiens
cagtattgccccctctcact

SEQ ID NO: 3989330 - DNA, 17 bp, Homo sapiens
cagtatttattttgtaa

SEQ ID NO: 3989331 - DNA, 18 bp, Homo sapiens
cagtatttattttgtaat

SEQ ID NO: 3989332 - DNA, 22 bp, Homo sapiens
cagtatttattttgtaattatg

SEQ ID NO: 3989333 - DNA, 19 bp, Homo sapiens
cagtatttcattgcctgtg

SEQ ID NO: 3989334 - DNA, 17 bp, Homo sapiens
cagtattttgtgtcctc

SEQ ID NO: 3989335 - DNA, 15 bp, Homo sapiens
cagtcaaaacagaga

SEQ ID NO: 3989336 - DNA, 12 bp, Homo sapiens
cagtcacactgt

SEQ ID NO: 3989337 - DNA, 20 bp, Homo sapiens
cagtcacactgtggccagta

SEQ ID NO: 3989338 - DNA, 13 bp, Homo sapiens
cagtcacactgtt

SEQ ID NO: 3989339 - DNA, 18 bp, Homo sapiens
cagtcacactgttactcc

SEQ ID NO: 3989340 - DNA, 14 bp, Homo sapiens
cagtcactggaggt

SEQ ID NO: 3989341 - DNA, 19 bp, Homo sapiens
cagtcagcatgcttcccag

SEQ ID NO: 3989342 - DNA, 20 bp, Homo sapiens
cagtcagcatgcttcccaga

SEQ ID NO: 3989343 - DNA, 16 bp, Homo sapiens
cagtcaggctctctgg

SEQ ID NO: 3989344 - DNA, 19 bp, Homo sapiens
cagtcaggctctctgggct

SEQ ID NO: 3989345 - DNA, 20 bp, Homo sapiens
cagtcaggctgcagaggcac

SEQ ID NO: 3989346 - DNA, 21 bp, Homo sapiens
cagtcaggtagttgcaattga

SEQ ID NO: 3989347 - DNA, 15 bp, Homo sapiens
cagtcaggttgaaga

SEQ ID NO: 3989348 - DNA, 16 bp, Homo sapiens
cagtcatcatcagggc

SEQ ID NO: 3989349 - DNA, 17 bp, Homo sapiens
cagtcatcatcagggcc

SEQ ID NO: 3989350 - DNA, 18 bp, Homo sapiens
cagtcatcatcagggcct

SEQ ID NO: 3989351 - DNA, 23 bp, Homo sapiens
cagtcatcatcagggcctggggc

SEQ ID NO: 3989352 - DNA, 17 bp, Homo sapiens
cagtcatgcaaaccgtt

SEQ ID NO: 3989353 - DNA, 18 bp, Homo sapiens
cagtcatgcataaatatg

SEQ ID NO: 3989354 - DNA, 17 bp, Homo sapiens
cagtcattggctgtctc

SEQ ID NO: 3989355 - DNA, 22 bp, Homo sapiens
cagtccaaggggtcccctccag

SEQ ID NO: 3989356 - DNA, 18 bp, Homo sapiens
cagtccagaagaattgac

SEQ ID NO: 3989357 - DNA, 17 bp, Homo sapiens
cagtccagtgtcacctc

SEQ ID NO: 3989358 - DNA, 19 bp, Homo sapiens
cagtccagtgtcacctctc

SEQ ID NO: 3989359 - DNA, 22 bp, Homo sapiens
cagtcccagacaattccattca

SEQ ID NO: 3989360 - DNA, 22 bp, Homo sapiens
cagtcccagtattctcagagca

SEQ ID NO: 3989361 - DNA, 14 bp, Homo sapiens
cagtccccacccct

SEQ ID NO: 3989362 - DNA, 19 bp, Homo sapiens
cagtccccacccctgcccc

SEQ ID NO: 3989363 - DNA, 20 bp, Homo sapiens
cagtccccacccctgccccc

SEQ ID NO: 3989364 - DNA, 21 bp, Homo sapiens
cagtccccacccctgccccca

SEQ ID NO: 3989365 - DNA, 21 bp, Homo sapiens
cagtcctccagaccaccagcc

SEQ ID NO: 3989366 - DNA, 14 bp, Homo sapiens
cagtcctcctggga

SEQ ID NO: 3989367 - DNA, 12 bp, Homo sapiens
cagtcctgcctg

SEQ ID NO: 3989368 - DNA, 16 bp, Homo sapiens
cagtccttaaaaatca

SEQ ID NO: 3989369 - DNA, 15 bp, Homo sapiens
cagtcgcctgcctgc

SEQ ID NO: 3989370 - DNA, 19 bp, Homo sapiens
cagtcgcctgcctgcagca

SEQ ID NO: 3989371 - DNA, 21 bp, Homo sapiens
cagtcgcctttcagcaggcag

SEQ ID NO: 3989372 - DNA, 19 bp, Homo sapiens
cagtctaaaatgcttcagt

SEQ ID NO: 3989373 - DNA, 19 bp, Homo sapiens
cagtctcccccacccttgt

SEQ ID NO: 3989374 - DNA, 22 bp, Homo sapiens
cagtctccctttcccttcttgg

SEQ ID NO: 3989375 - DNA, 17 bp, Homo sapiens
cagtctctcttaaagtt

SEQ ID NO: 3989376 - DNA, 19 bp, Homo sapiens
cagtctctttaatcttcag

SEQ ID NO: 3989377 - DNA, 20 bp, Homo sapiens
cagtctgaatgctgccacaa

SEQ ID NO: 3989378 - DNA, 21 bp, Homo sapiens
cagtctgttccccatggccac

SEQ ID NO: 3989379 - DNA, 19 bp, Homo sapiens
cagtcttatcaactggttg

SEQ ID NO: 3989380 - DNA, 19 bp, Homo sapiens
cagtcttatgcttccagaa

SEQ ID NO: 3989381 - DNA, 23 bp, Homo sapiens
cagtcttgaatttctaaaaaaca

SEQ ID NO: 3989382 - DNA, 11 bp, Homo sapiens
cagtcttgctc

SEQ ID NO: 3989383 - DNA, 17 bp, Homo sapiens
cagtgaaaagattttat

SEQ ID NO: 3989384 - DNA, 21 bp, Homo sapiens
cagtgaaaagattttatttat

SEQ ID NO: 3989385 - DNA, 14 bp, Homo sapiens
cagtgaactcctgc

SEQ ID NO: 3989386 - DNA, 20 bp, Homo sapiens
cagtgaactcctgccaggca

SEQ ID NO: 3989387 - DNA, 22 bp, Homo sapiens
caggggtctccctggctccctc

SEQ ID NO: 3989388 - DNA, 20 bp, Homo sapiens
caggggtgatttcagagagg

SEQ ID NO: 3989389 - DNA, 15 bp, Homo sapiens
caggggtggggggtg

SEQ ID NO: 3989390 - DNA, 16 bp, Homo sapiens
caggggtggggggtgc

SEQ ID NO: 3989391 - DNA, 20 bp, Homo sapiens
caggggtgggggtggaggct

SEQ ID NO: 3989392 - DNA, 22 bp, Homo sapiens
caggggtgggggtggaggcttc

SEQ ID NO: 3989393 - DNA, 21 bp, Homo sapiens
caggggttcgagaccagtctg

SEQ ID NO: 3989394 - DNA, 22 bp, Homo sapiens
caggggttgcagtgagcggaga

SEQ ID NO: 3989395 - DNA, 18 bp, Homo sapiens
cagggtacccgcctgagc

SEQ ID NO: 3989396 - DNA, 22 bp, Homo sapiens
cagggtacccgcctgagctcct

SEQ ID NO: 3989397 - DNA, 15 bp, Homo sapiens
cagggtaggaaaggg

SEQ ID NO: 3989398 - DNA, 19 bp, Homo sapiens
cagggtcaaagacagaatg

SEQ ID NO: 3989399 - DNA, 18 bp, Homo sapiens
cagggtctctccctcagg

SEQ ID NO: 3989400 - DNA, 20 bp, Homo sapiens
cagggtctctccctcaggtg

SEQ ID NO: 3989401 - DNA, 21 bp, Homo sapiens
cagggtctctccctcaggtgt

SEQ ID NO: 3989402 - DNA, 13 bp, Homo sapiens
cagggtctgctct

SEQ ID NO: 3989403 - DNA, 17 bp, Homo sapiens
cagggtctgctctttct

SEQ ID NO: 3989404 - DNA, 22 bp, Homo sapiens
cagggtctgctctttctctgcc

SEQ ID NO: 3989405 - DNA, 15 bp, Homo sapiens
cagggtctgtgtgaa

SEQ ID NO: 3989406 - DNA, 20 bp, Homo sapiens
cagggtctgtgtgaatgtgg

SEQ ID NO: 3989407 - DNA, 17 bp, Homo sapiens
cagggtcttccctacct

SEQ ID NO: 3989408 - DNA, 16 bp, Homo sapiens
cagggtcttgctctgt

SEQ ID NO: 3989409 - DNA, 18 bp, Homo sapiens
cagggtcttgctctgtcc

SEQ ID NO: 3989410 - DNA, 15 bp, Homo sapiens
cagggtcttttttca

SEQ ID NO: 3989411 - DNA, 19 bp, Homo sapiens
cagggtcttttttcatttc

SEQ ID NO: 3989412 - DNA, 20 bp, Homo sapiens
cagggtcttttttcatttct

SEQ ID NO: 3989413 - DNA, 22 bp, Homo sapiens
cagggtgagagctgctctggaa

SEQ ID NO: 3989414 - DNA, 18 bp, Homo sapiens
cagggtgagcccatgtgg

SEQ ID NO: 3989415 - DNA, 18 bp, Homo sapiens
cagggtgggcttcctgcc

SEQ ID NO: 3989416 - DNA, 12 bp, Homo sapiens
cagggtgggggg

SEQ ID NO: 3989417 - DNA, 16 bp, Homo sapiens
cagggtgtctgccccc

SEQ ID NO: 3989418 - DNA, 22 bp, Homo sapiens
cagggtgtgaacatgttctcca

SEQ ID NO: 3989419 - DNA, 16 bp, Homo sapiens
cagggttcatctgtcc

SEQ ID NO: 3989420 - DNA, 23 bp, Homo sapiens
cagggttctccctcccaccttaa

SEQ ID NO: 3989421 - DNA, 18 bp, Homo sapiens
cagggttgatcacactct

SEQ ID NO: 3989422 - DNA, 13 bp, Homo sapiens
cagggttgggccc

SEQ ID NO: 3989423 - DNA, 20 bp, Homo sapiens
cagggttgggcccagatctg

SEQ ID NO: 3989424 - DNA, 14 bp, Homo sapiens
cagggtttaataga

SEQ ID NO: 3989425 - DNA, 14 bp, Homo sapiens
cagggtttctctgc

SEQ ID NO: 3989426 - DNA, 13 bp, Homo sapiens
cagggtttttacc

SEQ ID NO: 3989427 - DNA, 19 bp, Homo sapiens
caggtaatgtgaataaatt

SEQ ID NO: 3989428 - DNA, 16 bp, Homo sapiens
caggtaccagctgcgc

SEQ ID NO: 3989429 - DNA, 23 bp, Homo sapiens
caggtagtgttgagacccaggcc

SEQ ID NO: 3989430 - DNA, 16 bp, Homo sapiens
caggtatctccaggat

SEQ ID NO: 3989431 - DNA, 22 bp, Homo sapiens
caggtatctccaggattgaaga

SEQ ID NO: 3989432 - DNA, 18 bp, Homo sapiens
caggtattattatcttta

SEQ ID NO: 3989433 - DNA, 22 bp, Homo sapiens
caggtcaataaacttagaggaa

SEQ ID NO: 3989434 - DNA, 23 bp, Homo sapiens
caggtcaataaacttagaggaaa

SEQ ID NO: 3989435 - DNA, 15 bp, Homo sapiens
caggtcagggacttg

SEQ ID NO: 3989436 - DNA, 20 bp, Homo sapiens
caggtcccacgtctggccag

SEQ ID NO: 3989437 - DNA, 12 bp, Homo sapiens
caggtcctgccc

SEQ ID NO: 3989438 - DNA, 21 bp, Homo sapiens
caggtcctgcccatgtgtccc

SEQ ID NO: 3989439 - DNA, 12 bp, Homo sapiens
caggtcctgctc

SEQ ID NO: 3989440 - DNA, 20 bp, Homo sapiens
caggtcttgactcatggcag

SEQ ID NO: 3989441 - DNA, 22 bp, Homo sapiens
caggtcttgactcatggcagct

SEQ ID NO: 3989442 - DNA, 19 bp, Homo sapiens
caggtgaaggaggctccag

SEQ ID NO: 3989443 - DNA, 19 bp, Homo sapiens
caggtgccagggcccaccc

SEQ ID NO: 3989444 - DNA, 22 bp, Homo sapiens
caggtgccagggcccaccccag

SEQ ID NO: 3989445 - DNA, 12 bp, Homo sapiens
caggtgcctgga

SEQ ID NO: 3989446 - DNA, 22 bp, Homo sapiens
caggtgctcaatggagaatata

SEQ ID NO: 3989447 - DNA, 14 bp, Homo sapiens
caggtgctcccctg

SEQ ID NO: 3989448 - DNA, 23 bp, Homo sapiens
caggtgctcccctgacagtccct

SEQ ID NO: 3989449 - DNA, 18 bp, Homo sapiens
caggtggaaggcagacag

SEQ ID NO: 3989450 - DNA, 16 bp, Homo sapiens
caggtggagggcacag

SEQ ID NO: 3989451 - DNA, 17 bp, Homo sapiens
caggtggagggcacagc

SEQ ID NO: 3989452 - DNA, 19 bp, Homo sapiens
caggtggagggcacagccc

SEQ ID NO: 3989453 - DNA, 21 bp, Homo sapiens
caggtggagggcacagccctc

SEQ ID NO: 3989454 - DNA, 22 bp, Homo sapiens
caggtggatctatttcatgttt

SEQ ID NO: 3989455 - DNA, 15 bp, Homo sapiens
caggtggcaggacca

SEQ ID NO: 3989456 - DNA, 21 bp, Homo sapiens
caggtggccactccagacccc

SEQ ID NO: 3989457 - DNA, 22 bp, Homo sapiens
caggtggctctgaggtgcctgt

SEQ ID NO: 3989458 - DNA, 19 bp, Homo sapiens
cagatggacagcgatgagg

SEQ ID NO: 3989459 - DNA, 14 bp, Homo sapiens
cagatggactggga

SEQ ID NO: 3989460 - DNA, 17 bp, Homo sapiens
cagatggactgggagga

SEQ ID NO: 3989461 - DNA, 19 bp, Homo sapiens
cagatggaggttctcagag

SEQ ID NO: 3989462 - DNA, 15 bp, Homo sapiens
cagatggatttgcct

SEQ ID NO: 3989463 - DNA, 12 bp, Homo sapiens
cagatggcactt

SEQ ID NO: 3989464 - DNA, 20 bp, Homo sapiens
cagatgggccacggctgagc

SEQ ID NO: 3989465 - DNA, 23 bp, Homo sapiens
cagatgggccacggctgagcctt

SEQ ID NO: 3989466 - DNA, 21 bp, Homo sapiens
cagatgggtctgatattaatc

SEQ ID NO: 3989467 - DNA, 18 bp, Homo sapiens
cagatgtcttccctgggc

SEQ ID NO: 3989468 - DNA, 20 bp, Homo sapiens
cagatgtcttccctgggctg

SEQ ID NO: 3989469 - DNA, 16 bp, Homo sapiens
cagatgtgagccaccg

SEQ ID NO: 3989470 - DNA, 21 bp, Homo sapiens
cagatgtgtcccccccaggcc

SEQ ID NO: 3989471 - DNA, 17 bp, Homo sapiens
cagattagatgtgccaa

SEQ ID NO: 3989472 - DNA, 21 bp, Homo sapiens
cagattagatgtgccaataac

SEQ ID NO: 3989473 - DNA, 18 bp, Homo sapiens
cagattagttctttttgc

SEQ ID NO: 3989474 - DNA, 15 bp, Homo sapiens
cagattcaggccagc

SEQ ID NO: 3989475 - DNA, 16 bp, Homo sapiens
cagattcaggccagcc

SEQ ID NO: 3989476 - DNA, 17 bp, Homo sapiens
cagattcaggccagccc

SEQ ID NO: 3989477 - DNA, 19 bp, Homo sapiens
cagattcaggccagcccag

SEQ ID NO: 3989478 - DNA, 17 bp, Homo sapiens
cagattcccctgtgtca

SEQ ID NO: 3989479 - DNA, 19 bp, Homo sapiens
cagattcgtggtcttttcc

SEQ ID NO: 3989480 - DNA, 21 bp, Homo sapiens
cagattcgtggtcttttcctc

SEQ ID NO: 3989481 - DNA, 14 bp, Homo sapiens
cagattctgcctct

SEQ ID NO: 3989482 - DNA, 16 bp, Homo sapiens
cagattctgcctctct

SEQ ID NO: 3989483 - DNA, 21 bp, Homo sapiens
cagattgaggtaataatgaca

SEQ ID NO: 3989484 - DNA, 13 bp, Homo sapiens
cagattgtttcct

SEQ ID NO: 3989485 - DNA, 13 bp, Homo sapiens
cagatttaataca

SEQ ID NO: 3989486 - DNA, 12 bp, Homo sapiens
cagatttattta

SEQ ID NO: 3989487 - DNA, 16 bp, Homo sapiens
cagatttcatacctca

SEQ ID NO: 3989488 - DNA, 14 bp, Homo sapiens
cagatttctggttg

SEQ ID NO: 3989489 - DNA, 22 bp, Homo sapiens
cagatttctggttgatttgtaa

SEQ ID NO: 3989490 - DNA, 22 bp, Homo sapiens
cagattttaaaaagtcttcact

SEQ ID NO: 3989491 - DNA, 15 bp, Homo sapiens
cagattttaattttg

SEQ ID NO: 3989492 - DNA, 14 bp, Homo sapiens
cagattttacaaaa

SEQ ID NO: 3989493 - DNA, 13 bp, Homo sapiens
cacttgtgtgtgg

SEQ ID NO: 3989494 - DNA, 14 bp, Homo sapiens
cacttgtgtgtggg

SEQ ID NO: 3989495 - DNA, 15 bp, Homo sapiens
cacttgttccagctc

SEQ ID NO: 3989496 - DNA, 17 bp, Homo sapiens
cacttgttccagctctt

SEQ ID NO: 3989497 - DNA, 17 bp, Homo sapiens
cactttagggctgtaaa

SEQ ID NO: 3989498 - DNA, 12 bp, Homo sapiens
cactttcaaaac

SEQ ID NO: 3989499 - DNA, 14 bp, Homo sapiens
cactttccaagtca

SEQ ID NO: 3989500 - DNA, 12 bp, Homo sapiens
cactttccactt

SEQ ID NO: 3989501 - DNA, 19 bp, Homo sapiens
cactttccacttcttcctt

SEQ ID NO: 3989502 - DNA, 16 bp, Homo sapiens
cactttctaatgtttc

SEQ ID NO: 3989503 - DNA, 18 bp, Homo sapiens
cactttcttattctgtat

SEQ ID NO: 3989504 - DNA, 19 bp, Homo sapiens
cactttgcactgatatatc

SEQ ID NO: 3989505 - DNA, 22 bp, Homo sapiens
cactttgcactgatatatcatg

SEQ ID NO: 3989506 - DNA, 12 bp, Homo sapiens
cactttgctctg

SEQ ID NO: 3989507 - DNA, 14 bp, Homo sapiens
cactttgttcttta

SEQ ID NO: 3989508 - DNA, 18 bp, Homo sapiens
cactttgttctttaggag

SEQ ID NO: 3989509 - DNA, 22 bp, Homo sapiens
cactttgttgcaagatgtgaat

SEQ ID NO: 3989510 - DNA, 20 bp, Homo sapiens
cacttttgttattccatcaa

SEQ ID NO: 3989511 - DNA, 15 bp, Homo sapiens
cacttttgttctgct

SEQ ID NO: 3989512 - DNA, 19 bp, Homo sapiens
cacttttgttctgctttat

SEQ ID NO: 3989513 - DNA, 14 bp, Homo sapiens
cactttttatgcta

SEQ ID NO: 3989514 - DNA, 20 bp, Homo sapiens
cactttttggctgacttcat

SEQ ID NO: 3989515 - DNA, 13 bp, Homo sapiens
cagaaaaagcatg

SEQ ID NO: 3989516 - DNA, 21 bp, Homo sapiens
cagaaaaagcatgatgggaaa

SEQ ID NO: 3989517 - DNA, 12 bp, Homo sapiens
cagaaaagcata

SEQ ID NO: 3989518 - DNA, 10 bp, Homo sapiens
cagaaaagtg

SEQ ID NO: 3989519 - DNA, 19 bp, Homo sapiens
cagaaaagtgcctgagctg

SEQ ID NO: 3989520 - DNA, 16 bp, Homo sapiens
cagaaaattagccggg

SEQ ID NO: 3989521 - DNA, 13 bp, Homo sapiens
cagaaaattctgt

SEQ ID NO: 3989522 - DNA, 15 bp, Homo sapiens
cagaaaattctgtgc

SEQ ID NO: 3989523 - DNA, 16 bp, Homo sapiens
cagaaacaacagggga

SEQ ID NO: 3989524 - DNA, 22 bp, Homo sapiens
cagaaacaggtgcatctgggga

SEQ ID NO: 3989525 - DNA, 14 bp, Homo sapiens
cagaaaccagttat

SEQ ID NO: 3989526 - DNA, 21 bp, Homo sapiens
cagaaacctatcctcactgcc

SEQ ID NO: 3989527 - DNA, 22 bp, Homo sapiens
cagaaacctatcctcactgccc

SEQ ID NO: 3989528 - DNA, 20 bp, Homo sapiens
cagaaacttgtgaagtggaa

SEQ ID NO: 3989529 - DNA, 19 bp, Homo sapiens
cagaaagatggatgtgctt

SEQ ID NO: 3989530 - DNA, 18 bp, Homo sapiens
cagaaagctgtgaacagg

SEQ ID NO: 3989531 - DNA, 15 bp, Homo sapiens
cagaaaggaaaacct

SEQ ID NO: 3989532 - DNA, 18 bp, Homo sapiens
cagaaaggaaaacctgaa

SEQ ID NO: 3989533 - DNA, 17 bp, Homo sapiens
cagaaaggttctgcccg

SEQ ID NO: 3989534 - DNA, 15 bp, Homo sapiens
cagaaagtcaccagg

SEQ ID NO: 3989535 - DNA, 12 bp, Homo sapiens
cagaaagtgcct

SEQ ID NO: 3989536 - DNA, 23 bp, Homo sapiens
cagaaagtggccatgccaccctg

SEQ ID NO: 3989537 - DNA, 19 bp, Homo sapiens
cagaaatctagaagactgt

SEQ ID NO: 3989538 - DNA, 22 bp, Homo sapiens
cagaaatgtccctttcttctcc

SEQ ID NO: 3989539 - DNA, 21 bp, Homo sapiens
cagaaatgtctaaatgctgaa

SEQ ID NO: 3989540 - DNA, 15 bp, Homo sapiens
cagaaatttttattt

SEQ ID NO: 3989541 - DNA, 15 bp, Homo sapiens
cagaacaacaactat

SEQ ID NO: 3989542 - DNA, 21 bp, Homo sapiens
cagaacacccctaatgagggt

SEQ ID NO: 3989543 - DNA, 12 bp, Homo sapiens
cagaacagcttc

SEQ ID NO: 3989544 - DNA, 15 bp, Homo sapiens
cagaacagcttcagg

SEQ ID NO: 3989545 - DNA, 19 bp, Homo sapiens
cagaacagcttcaggttat

SEQ ID NO: 3989546 - DNA, 14 bp, Homo sapiens
cagaacagggtcat

SEQ ID NO: 3989547 - DNA, 20 bp, Homo sapiens
cagaacatcgatatgtatat

SEQ ID NO: 3989548 - DNA, 16 bp, Homo sapiens
cagaaccaaagctcaa

SEQ ID NO: 3989549 - DNA, 23 bp, Homo sapiens
cagaacctcagcatttccttcca

SEQ ID NO: 3989550 - DNA, 18 bp, Homo sapiens
cagaacctcttccccaga

SEQ ID NO: 3989551 - DNA, 18 bp, Homo sapiens
cagaacctgagctatttt

SEQ ID NO: 3989552 - DNA, 17 bp, Homo sapiens
cagaaccttcaacccag

SEQ ID NO: 3989553 - DNA, 21 bp, Homo sapiens
cagaaccttcaacccagtggg

SEQ ID NO: 3989554 - DNA, 14 bp, Homo sapiens
cagaactaaatgtt

SEQ ID NO: 3989555 - DNA, 12 bp, Homo sapiens
cagaactcccac

SEQ ID NO: 3989556 - DNA, 15 bp, Homo sapiens
cagaactctgcctgc

SEQ ID NO: 3989557 - DNA, 13 bp, Homo sapiens
cagaactcttcct

SEQ ID NO: 3989558 - DNA, 14 bp, Homo sapiens
cagaactcttcctc

SEQ ID NO: 3989559 - DNA, 15 bp, Homo sapiens
cagaactgcccccac

SEQ ID NO: 3989560 - DNA, 17 bp, Homo sapiens
cagaactgcccccactg

SEQ ID NO: 3989561 - DNA, 17 bp, Homo sapiens
cagaacttcagaaagac

SEQ ID NO: 3989562 - DNA, 19 bp, Homo sapiens
cagaacttcagaaagactt

SEQ ID NO: 3989563 - DNA, 16 bp, Homo sapiens
cagaacttgaatgtgt

SEQ ID NO: 3989564 - DNA, 19 bp, Homo sapiens
cagaagaagagaagctgct

SEQ ID NO: 3989565 - DNA, 16 bp, Homo sapiens
cagaagaatattcagg

SEQ ID NO: 3989566 - DNA, 18 bp, Homo sapiens
cagaagacaaaaagacaa

SEQ ID NO: 3989567 - DNA, 14 bp, Homo sapiens
cagaagacaccaga

SEQ ID NO: 3989568 - DNA, 15 bp, Homo sapiens
cagaagacaccagag

SEQ ID NO: 3989569 - DNA, 19 bp, Homo sapiens
cagaagacactgcaaaggc

SEQ ID NO: 3989570 - DNA, 23 bp, Homo sapiens
cagaagagggtgtgtttgaaatc

SEQ ID NO: 3989571 - DNA, 18 bp, Homo sapiens
cagaagatcccctcagga

SEQ ID NO: 3989572 - DNA, 20 bp, Homo sapiens
cagaagatgccagcttctct

SEQ ID NO: 3989573 - DNA, 21 bp, Homo sapiens
cagaagatgccagcttctctc

SEQ ID NO: 3989574 - DNA, 14 bp, Homo sapiens
cagaagcaagccag

SEQ ID NO: 3989575 - DNA, 16 bp, Homo sapiens
cagaagcctccaagca

SEQ ID NO: 3989576 - DNA, 20 bp, Homo sapiens
cagaagcctccaagcacaga

SEQ ID NO: 3989577 - DNA, 13 bp, Homo sapiens
cagaagcctctgg

SEQ ID NO: 3989578 - DNA, 18 bp, Homo sapiens
cagaagcctggactctgc

SEQ ID NO: 3989579 - DNA, 20 bp, Homo sapiens
cagaagccttggaaccagcc

SEQ ID NO: 3989580 - DNA, 22 bp, Homo sapiens
cagaagccttggaaccagcccc

SEQ ID NO: 3989581 - DNA, 15 bp, Homo sapiens
cagaagggaattgct

SEQ ID NO: 3989582 - DNA, 19 bp, Homo sapiens
cagaagggagctggctcca

SEQ ID NO: 3989583 - DNA, 15 bp, Homo sapiens
cagaagtcaataggc

SEQ ID NO: 3989584 - DNA, 13 bp, Homo sapiens
cagaagtgaaaat

SEQ ID NO: 3989585 - DNA, 16 bp, Homo sapiens
cagaagtggagctggg

SEQ ID NO: 3989586 - DNA, 20 bp, Homo sapiens
cagaagtttgcaaataggca

SEQ ID NO: 3989587 - DNA, 17 bp, Homo sapiens
cagaataatctttgggt

SEQ ID NO: 3989588 - DNA, 12 bp, Homo sapiens
cagaataatgga

SEQ ID NO: 3989589 - DNA, 17 bp, Homo sapiens
cagaatactgggttctt

SEQ ID NO: 3989590 - DNA, 21 bp, Homo sapiens
cagaatactgggttcttagtt

SEQ ID NO: 3989591 - DNA, 15 bp, Homo sapiens
cagaatagccacatt

SEQ ID NO: 3989592 - DNA, 15 bp, Homo sapiens
cagaatatctgggat

SEQ ID NO: 3989593 - DNA, 13 bp, Homo sapiens
cagaatatttcta

SEQ ID NO: 3989594 - DNA, 19 bp, Homo sapiens
cagaatatttctattgaat

SEQ ID NO: 3989595 - DNA, 13 bp, Homo sapiens
cagaatattttta

SEQ ID NO: 3989596 - DNA, 15 bp, Homo sapiens
cagacaacagaagtc

SEQ ID NO: 3989597 - DNA, 11 bp, Homo sapiens
cagacaaggtt

SEQ ID NO: 3989598 - DNA, 20 bp, Homo sapiens
cagacaagttggaaaaacaa

SEQ ID NO: 3989599 - DNA, 14 bp, Homo sapiens
cagacaatcttctg

SEQ ID NO: 3989600 - DNA, 15 bp, Homo sapiens
cagacaattccattc

SEQ ID NO: 3989601 - DNA, 14 bp, Homo sapiens
cagacacacacaca

SEQ ID NO: 3989602 - DNA, 15 bp, Homo sapiens
cagacacacacacgc

SEQ ID NO: 3989603 - DNA, 18 bp, Homo sapiens
cagacacacacacgcacg

SEQ ID NO: 3989604 - DNA, 22 bp, Homo sapiens
cagacacacacacgcacgcaca

SEQ ID NO: 3989605 - DNA, 19 bp, Homo sapiens
cagacacacatgggcagcc

SEQ ID NO: 3989606 - DNA, 21 bp, Homo sapiens
cagacacacatgggcagccca

SEQ ID NO: 3989607 - DNA, 12 bp, Homo sapiens
cagacacccagg

SEQ ID NO: 3989608 - DNA, 13 bp, Homo sapiens
cagacacccagga

SEQ ID NO: 3989609 - DNA, 15 bp, Homo sapiens
cagacacccaggact

SEQ ID NO: 3989610 - DNA, 17 bp, Homo sapiens
cagacacccaggactta

SEQ ID NO: 3989611 - DNA, 18 bp, Homo sapiens
cagacaccctctccttaa

SEQ ID NO: 3989612 - DNA, 19 bp, Homo sapiens
cagacacctgttcacagaa

SEQ ID NO: 3989613 - DNA, 23 bp, Homo sapiens
cagacacgctcgcgggcagcggg

SEQ ID NO: 3989614 - DNA, 11 bp, Homo sapiens
cagacactaag

SEQ ID NO: 3989615 - DNA, 12 bp, Homo sapiens
cagacactaagt

SEQ ID NO: 3989616 - DNA, 18 bp, Homo sapiens
cagacactaagttatagt

SEQ ID NO: 3989617 - DNA, 21 bp, Homo sapiens
cagacagaaactggattaaaa

SEQ ID NO: 3989618 - DNA, 15 bp, Homo sapiens
cagacagggtctgaa

SEQ ID NO: 3989619 - DNA, 20 bp, Homo sapiens
cagacagggtctgaaggact

SEQ ID NO: 3989620 - DNA, 23 bp, Homo sapiens
cagacagggtgggcttcctgccc

SEQ ID NO: 3989621 - DNA, 19 bp, Homo sapiens
cagacagtgttttctggga

SEQ ID NO: 3989622 - DNA, 22 bp, Homo sapiens
cagacatccaaactaaaaggaa

SEQ ID NO: 3989623 - DNA, 15 bp, Homo sapiens
cagacatctctgcac

SEQ ID NO: 3989624 - DNA, 18 bp, Homo sapiens
cagacatgttttccgtga

SEQ ID NO: 3989625 - DNA, 17 bp, Homo sapiens
cagaccaccagccgccc

SEQ ID NO: 3989626 - DNA, 21 bp, Homo sapiens
cagaccaccagccgccccagc

SEQ ID NO: 3989627 - DNA, 12 bp, Homo sapiens
cagaccacctgc

SEQ ID NO: 3989628 - DNA, 16 bp, Homo sapiens
cagaccagccctgcag

SEQ ID NO: 3989629 - DNA, 23 bp, Homo sapiens
cagaccatgaagtaaattatgta

SEQ ID NO: 3989630 - DNA, 14 bp, Homo sapiens
cagaccccagggca

SEQ ID NO: 3989631 - DNA, 22 bp, Homo sapiens
cagacccccccatttcccgcac

SEQ ID NO: 3989632 - DNA, 14 bp, Homo sapiens
cagacccctaggga

SEQ ID NO: 3989633 - DNA, 21 bp, Homo sapiens
cagacccctctggccaggatg

SEQ ID NO: 3989634 - DNA, 14 bp, Homo sapiens
cagacccctgcctg

SEQ ID NO: 3989635 - DNA, 18 bp, Homo sapiens
cagacccctggcttttca

SEQ ID NO: 3989636 - DNA, 22 bp, Homo sapiens
cagacctaggatttcatgattt

SEQ ID NO: 3989637 - DNA, 23 bp, Homo sapiens
cagacctgatcctggaggcccag

SEQ ID NO: 3989638 - DNA, 15 bp, Homo sapiens
cagacctgcattgaa

SEQ ID NO: 3989639 - DNA, 12 bp, Homo sapiens
cagacctggaca

SEQ ID NO: 3989640 - DNA, 19 bp, Homo sapiens
cagacctggacactagggt

SEQ ID NO: 3989641 - DNA, 11 bp, Homo sapiens
cagacctggct

SEQ ID NO: 3989642 - DNA, 23 bp, Homo sapiens
cagacctgtcttccaaggagacc

SEQ ID NO: 3989643 - DNA, 19 bp, Homo sapiens
cagacctgttagcagacag

SEQ ID NO: 3989644 - DNA, 16 bp, Homo sapiens
cagacggcggccaggc

SEQ ID NO: 3989645 - DNA, 21 bp, Homo sapiens
cagacggcggccaggcacagg

SEQ ID NO: 3989646 - DNA, 16 bp, Homo sapiens
cagacgggcacagaca

SEQ ID NO: 3989647 - DNA, 15 bp, Homo sapiens
cagacgtcaggccct

SEQ ID NO: 3989648 - DNA, 18 bp, Homo sapiens
cagacgttgcctgagaag

SEQ ID NO: 3989649 - DNA, 22 bp, Homo sapiens
cagactaaaggatccagagagc

SEQ ID NO: 3989650 - DNA, 20 bp, Homo sapiens
cagactactattttcttttt

SEQ ID NO: 3989651 - DNA, 14 bp, Homo sapiens
cagactccatctct

SEQ ID NO: 3989652 - DNA, 20 bp, Homo sapiens
cagactcccattcctgaaga

SEQ ID NO: 3989653 - DNA, 16 bp, Homo sapiens
cagactccgccctcct

SEQ ID NO: 3989654 - DNA, 21 bp, Homo sapiens
cagactctgagctgctcaccg

SEQ ID NO: 3989655 - DNA, 22 bp, Homo sapiens
cagactctttcgatacccagga

SEQ ID NO: 3989656 - DNA, 14 bp, Homo sapiens
cagactggggcatc

SEQ ID NO: 3989657 - DNA, 18 bp, Homo sapiens
cagactggggcatcctgt

SEQ ID NO: 3989658 - DNA, 22 bp, Homo sapiens
cagactggggcatcctgtgcca

SEQ ID NO: 3989659 - DNA, 17 bp, Homo sapiens
cagactgtgaacttgac

SEQ ID NO: 3989660 - DNA, 21 bp, Homo sapiens
cagactgtgaacttgactggg

SEQ ID NO: 3989661 - DNA, 16 bp, Homo sapiens
cagactgttaattata

SEQ ID NO: 3989662 - DNA, 18 bp, Homo sapiens
cagacttaccaggaagca

SEQ ID NO: 3989663 - DNA, 14 bp, Homo sapiens
cagacttcccagct

SEQ ID NO: 3989664 - DNA, 15 bp, Homo sapiens
cagacttcccagcta

SEQ ID NO: 3989665 - DNA, 14 bp, Homo sapiens
cagacttctccaga

SEQ ID NO: 3989666 - DNA, 15 bp, Homo sapiens
cagacttctccagac

SEQ ID NO: 3989667 - DNA, 16 bp, Homo sapiens
cagagaaacccaggga

SEQ ID NO: 3989668 - DNA, 20 bp, Homo sapiens
cagagaaagaagagacagga

SEQ ID NO: 3989669 - DNA, 21 bp, Homo sapiens
cagagaaagaagagacaggag

SEQ ID NO: 3989670 - DNA, 23 bp, Homo sapiens
cagagaaagaagagacaggaggg

SEQ ID NO: 3989671 - DNA, 21 bp, Homo sapiens
cagagaagattcttgtattta

SEQ ID NO: 3989672 - DNA, 23 bp, Homo sapiens
cagaggctgcacccctgggccag

SEQ ID NO: 3989673 - DNA, 13 bp, Homo sapiens
cagaggctgcctc

SEQ ID NO: 3989674 - DNA, 23 bp, Homo sapiens
cagaggctgcctctcccatcact

SEQ ID NO: 3989675 - DNA, 23 bp, Homo sapiens
cagagggaaagtaaatatttcag

SEQ ID NO: 3989676 - DNA, 19 bp, Homo sapiens
cagagggactttgtataga

SEQ ID NO: 3989677 - DNA, 15 bp, Homo sapiens
cagagggagaatcca

SEQ ID NO: 3989678 - DNA, 13 bp, Homo sapiens
cagagggagcagg

SEQ ID NO: 3989679 - DNA, 20 bp, Homo sapiens
cagagggctggaggcccagg

SEQ ID NO: 3989680 - DNA, 19 bp, Homo sapiens
cagagggcttgtgaacaga

SEQ ID NO: 3989681 - DNA, 19 bp, Homo sapiens
cagagggggagtagccaag

SEQ ID NO: 3989682 - DNA, 19 bp, Homo sapiens
cagaggggtaagagaggat

SEQ ID NO: 3989683 - DNA, 15 bp, Homo sapiens
cagaggggtaggcag

SEQ ID NO: 3989684 - DNA, 16 bp, Homo sapiens
cagagggtgtcaaaca

SEQ ID NO: 3989685 - DNA, 18 bp, Homo sapiens
cagaggtaacagaacagc

SEQ ID NO: 3989686 - DNA, 22 bp, Homo sapiens
cagaggtaacagaacagcttca

SEQ ID NO: 3989687 - DNA, 23 bp, Homo sapiens
cagaggtaacagaacagcttcag

SEQ ID NO: 3989688 - DNA, 21 bp, Homo sapiens
cagaggtggccagagctggga

SEQ ID NO: 3989689 - DNA, 20 bp, Homo sapiens
cagaggtgggatcctccctc

SEQ ID NO: 3989690 - DNA, 23 bp, Homo sapiens
cagaggtgtacactaacatttcc

SEQ ID NO: 3989691 - DNA, 21 bp, Homo sapiens
cagagtacgtcctgcctggca

SEQ ID NO: 3989692 - DNA, 12 bp, Homo sapiens
cagagtccagtg

SEQ ID NO: 3989693 - DNA, 20 bp, Homo sapiens
cagagtccagtgctctgcct

SEQ ID NO: 3989694 - DNA, 21 bp, Homo sapiens
cagagtccagtgctctgcctc

SEQ ID NO: 3989695 - DNA, 22 bp, Homo sapiens
cagagtccatttcccacatctt

SEQ ID NO: 3989696 - DNA, 23 bp, Homo sapiens
cagagtccatttcccacatcttt

SEQ ID NO: 3989697 - DNA, 14 bp, Homo sapiens
cagagtctgggcct

SEQ ID NO: 3989698 - DNA, 20 bp, Homo sapiens
cagagtctgggcctctgact

SEQ ID NO: 3989699 - DNA, 15 bp, Homo sapiens
cagagtgctggcact

SEQ ID NO: 3989700 - DNA, 18 bp, Homo sapiens
caacccccagctcccgct

SEQ ID NO: 3989701 - DNA, 19 bp, Homo sapiens
caaccctaggttccctgtt

SEQ ID NO: 3989702 - DNA, 15 bp, Homo sapiens
caacccttacccctt

SEQ ID NO: 3989703 - DNA, 13 bp, Homo sapiens
caacctaaatttg

SEQ ID NO: 3989704 - DNA, 13 bp, Homo sapiens
caacctagaatgt

SEQ ID NO: 3989705 - DNA, 19 bp, Homo sapiens
caacctcagaggcagcttc

SEQ ID NO: 3989706 - DNA, 14 bp, Homo sapiens
caacctcagggctc

SEQ ID NO: 3989707 - DNA, 17 bp, Homo sapiens
caacctcagggctccca

SEQ ID NO: 3989708 - DNA, 18 bp, Homo sapiens
caacctcagggctcccag

SEQ ID NO: 3989709 - DNA, 20 bp, Homo sapiens
caacctccgcatccggggtt

SEQ ID NO: 3989710 - DNA, 15 bp, Homo sapiens
caacctctctgatct

SEQ ID NO: 3989711 - DNA, 21 bp, Homo sapiens
caacctctctgatcttgtgct

SEQ ID NO: 3989712 - DNA, 16 bp, Homo sapiens
caacctcttctggctc

SEQ ID NO: 3989713 - DNA, 16 bp, Homo sapiens
caacctctttttcctc

SEQ ID NO: 3989714 - DNA, 13 bp, Homo sapiens
caacctgctctgt

SEQ ID NO: 3989715 - DNA, 16 bp, Homo sapiens
caacctgctctgtccc

SEQ ID NO: 3989716 - DNA, 19 bp, Homo sapiens
caacctgctctgtccccaa

SEQ ID NO: 3989717 - DNA, 14 bp, Homo sapiens
caacctggtggcac

SEQ ID NO: 3989718 - DNA, 18 bp, Homo sapiens
caacctggtggcaccaga

SEQ ID NO: 3989719 - DNA, 20 bp, Homo sapiens
caaccttctgtggctcacag

SEQ ID NO: 3989720 - DNA, 14 bp, Homo sapiens
caacctttaaaatt

SEQ ID NO: 3989721 - DNA, 13 bp, Homo sapiens
caacgcagccctg

SEQ ID NO: 3989722 - DNA, 15 bp, Homo sapiens
caacgcagccctgct

SEQ ID NO: 3989723 - DNA, 22 bp, Homo sapiens
caacgcccctccaaacctccag

SEQ ID NO: 3989724 - DNA, 16 bp, Homo sapiens
caacgcctccccctcc

SEQ ID NO: 3989725 - DNA, 23 bp, Homo sapiens
caacgcttgtagaactcactctg

SEQ ID NO: 3989726 - DNA, 15 bp, Homo sapiens
caactaaaattagga

SEQ ID NO: 3989727 - DNA, 22 bp, Homo sapiens
caactaaatgagattatatgtg

SEQ ID NO: 3989728 - DNA, 13 bp, Homo sapiens
caactagctggga

SEQ ID NO: 3989729 - DNA, 15 bp, Homo sapiens
caactagctgggact

SEQ ID NO: 3989730 - DNA, 19 bp, Homo sapiens
caactatcctgacttctaa

SEQ ID NO: 3989731 - DNA, 16 bp, Homo sapiens
caactatggatcagaa

SEQ ID NO: 3989732 - DNA, 23 bp, Homo sapiens
caactcagagaaaaatgctcccc

SEQ ID NO: 3989733 - DNA, 15 bp, Homo sapiens
caactcctaatttta

SEQ ID NO: 3989734 - DNA, 15 bp, Homo sapiens
caactctacccctgc

SEQ ID NO: 3989735 - DNA, 16 bp, Homo sapiens
caactctacccctgct

SEQ ID NO: 3989736 - DNA, 15 bp, Homo sapiens
caactctctcctgta

SEQ ID NO: 3989737 - DNA, 18 bp, Homo sapiens
caactcttgattatccat

SEQ ID NO: 3989738 - DNA, 14 bp, Homo sapiens
caactctttgttat

SEQ ID NO: 3989739 - DNA, 14 bp, Homo sapiens
caactgaaaagact

SEQ ID NO: 3989740 - DNA, 23 bp, Homo sapiens
caactgcaataacttctgacctt

SEQ ID NO: 3989741 - DNA, 11 bp, Homo sapiens
caactgcccta

SEQ ID NO: 3989742 - DNA, 12 bp, Homo sapiens
caactgccctaa

SEQ ID NO: 3989743 - DNA, 21 bp, Homo sapiens
caactgcctcgaaacacagaa

SEQ ID NO: 3989744 - DNA, 19 bp, Homo sapiens
caactggacattgtctgcg

SEQ ID NO: 3989745 - DNA, 24 bp, Homo sapiens
caactggttgtatatttttatatt

SEQ ID NO: 3989746 - DNA, 16 bp, Homo sapiens
caactgtcttcctcaa

SEQ ID NO: 3989747 - DNA, 12 bp, Homo sapiens
caactgtgactg

SEQ ID NO: 3989748 - DNA, 19 bp, Homo sapiens
caacttattctttgagtaa

SEQ ID NO: 3989749 - DNA, 14 bp, Homo sapiens
caacttatttaaaa

SEQ ID NO: 3989750 - DNA, 19 bp, Homo sapiens
caacttatttaaaaatatt

SEQ ID NO: 3989751 - DNA, 18 bp, Homo sapiens
caacttcagcagtaccta

SEQ ID NO: 3989752 - DNA, 19 bp, Homo sapiens
caacttcatgtcaacttct

SEQ ID NO: 3989753 - DNA, 16 bp, Homo sapiens
caacttccaagacaag

SEQ ID NO: 3989754 - DNA, 18 bp, Homo sapiens
caacttcttcctgtgaag

SEQ ID NO: 3989755 - DNA, 19 bp, Homo sapiens
caacttggcttcctttctt

SEQ ID NO: 3989756 - DNA, 16 bp, Homo sapiens
caacttgtacttgttt

SEQ ID NO: 3989757 - DNA, 18 bp, Homo sapiens
caactttagctagtatct

SEQ ID NO: 3989758 - DNA, 15 bp, Homo sapiens
caagaaaacaacttc

SEQ ID NO: 3989759 - DNA, 10 bp, Homo sapiens
caagaaaagg

SEQ ID NO: 3989760 - DNA, 15 bp, Homo sapiens
caagaaacagccagc

SEQ ID NO: 3989761 - DNA, 18 bp, Homo sapiens
caagaaacagccagcaag

SEQ ID NO: 3989762 - DNA, 20 bp, Homo sapiens
caagaaagctcactgtagct

SEQ ID NO: 3989763 - DNA, 13 bp, Homo sapiens
caagaaataaaag

SEQ ID NO: 3989764 - DNA, 15 bp, Homo sapiens
caagaaataaatcag

SEQ ID NO: 3989765 - DNA, 18 bp, Homo sapiens
caagaaataaatcagaga

SEQ ID NO: 3989766 - DNA, 14 bp, Homo sapiens
caagaactctgggc

SEQ ID NO: 3989767 - DNA, 16 bp, Homo sapiens
caagaactgcatggac

SEQ ID NO: 3989768 - DNA, 19 bp, Homo sapiens
caagaactgcatggaccta

SEQ ID NO: 3989769 - DNA, 16 bp, Homo sapiens
caagaagaaatatgaa

SEQ ID NO: 3989770 - DNA, 17 bp, Homo sapiens
caagaagaaatatgaaa

SEQ ID NO: 3989771 - DNA, 19 bp, Homo sapiens
caagaataaaggcagctgt

SEQ ID NO: 3989772 - DNA, 23 bp, Homo sapiens
caagaataattcaattttaaaga

SEQ ID NO: 3989773 - DNA, 18 bp, Homo sapiens
caagaatagatgctgact

SEQ ID NO: 3989774 - DNA, 16 bp, Homo sapiens
caagaatattgtccct

SEQ ID NO: 3989775 - DNA, 18 bp, Homo sapiens
caagaatgcattccctga

SEQ ID NO: 3989776 - DNA, 22 bp, Homo sapiens
caagaatggatcacaagatgga

SEQ ID NO: 3989777 - DNA, 22 bp, Homo sapiens
caagaatttgatcgttccagtt

SEQ ID NO: 3989778 - DNA, 14 bp, Homo sapiens
caagacagaaaagt

SEQ ID NO: 3989779 - DNA, 15 bp, Homo sapiens
caagacagaaaagtg

SEQ ID NO: 3989780 - DNA, 19 bp, Homo sapiens
caagacagaaaagtgcctg

SEQ ID NO: 3989781 - DNA, 20 bp, Homo sapiens
caagacagaaaagtgcctga

SEQ ID NO: 3989782 - DNA, 22 bp, Homo sapiens
caagacagagacgcaggaatgg

SEQ ID NO: 3989783 - DNA, 21 bp, Homo sapiens
caagacagatgccccagagct

SEQ ID NO: 3989784 - DNA, 22 bp, Homo sapiens
caagacagatgccccagagctg

SEQ ID NO: 3989785 - DNA, 11 bp, Homo sapiens
caagacattgt

SEQ ID NO: 3989786 - DNA, 17 bp, Homo sapiens
caagacattgtcaataa

SEQ ID NO: 3989787 - DNA, 18 bp, Homo sapiens
caagacattgtcaataaa

SEQ ID NO: 3989788 - DNA, 19 bp, Homo sapiens
caagaccaccacttcgaaa

SEQ ID NO: 3989789 - DNA, 13 bp, Homo sapiens
caagacccccagc

SEQ ID NO: 3989790 - DNA, 20 bp, Homo sapiens
caagacccccatttgtccca

SEQ ID NO: 3989791 - DNA, 22 bp, Homo sapiens
caagacccccatttgtcccaga

SEQ ID NO: 3989792 - DNA, 15 bp, Homo sapiens
caagactctgtctca

SEQ ID NO: 3989793 - DNA, 13 bp, Homo sapiens
caagactgcaaac

SEQ ID NO: 3989794 - DNA, 16 bp, Homo sapiens
caagactgcaaacttt

SEQ ID NO: 3989795 - DNA, 18 bp, Homo sapiens
caagactgcaaacttttt

SEQ ID NO: 3989796 - DNA, 20 bp, Homo sapiens
caagactttagcttttcctt

SEQ ID NO: 3989797 - DNA, 12 bp, Homo sapiens
caagagaaaatg

SEQ ID NO: 3989798 - DNA, 12 bp, Homo sapiens
caagagaagggc

SEQ ID NO: 3989799 - DNA, 22 bp, Homo sapiens
caagagaaggggacttctcttc

SEQ ID NO: 3989800 - DNA, 22 bp, Homo sapiens
caagagaattgcttgaacccag

SEQ ID NO: 3989801 - DNA, 13 bp, Homo sapiens
caagagagatgtt

SEQ ID NO: 3989802 - DNA, 15 bp, Homo sapiens
caagagagcagcaag

SEQ ID NO: 3989803 - DNA, 14 bp, Homo sapiens
caagagcaagggct

SEQ ID NO: 3989804 - DNA, 20 bp, Homo sapiens
caatgatgattaaacacctg

SEQ ID NO: 3989805 - DNA, 14 bp, Homo sapiens
caatgatggtcacc

SEQ ID NO: 3989806 - DNA, 23 bp, Homo sapiens
caatgatgtgaccctcaatccca

SEQ ID NO: 3989807 - DNA, 17 bp, Homo sapiens
cacatcccagcagccca

SEQ ID NO: 3989808 - DNA, 18 bp, Homo sapiens
cacatccccaagcccacc

SEQ ID NO: 3989809 - DNA, 19 bp, Homo sapiens
cacatccccaagcccacca

SEQ ID NO: 3989810 - DNA, 15 bp, Homo sapiens
cacatctcacctccg

SEQ ID NO: 3989811 - DNA, 22 bp, Homo sapiens
cacatctcctccatactcagga

SEQ ID NO: 3989812 - DNA, 13 bp, Homo sapiens
cacatctgcctta

SEQ ID NO: 3989813 - DNA, 21 bp, Homo sapiens
cacatctttcctcaagtatct

SEQ ID NO: 3989814 - DNA, 21 bp, Homo sapiens
cacatgaaacctacacactgt

SEQ ID NO: 3989815 - DNA, 23 bp, Homo sapiens
cacatgaatgcagtcatgcaaac

SEQ ID NO: 3989816 - DNA, 13 bp, Homo sapiens
caccttgccttgc

SEQ ID NO: 3989817 - DNA, 21 bp, Homo sapiens
caccttggctctgccagtgga

SEQ ID NO: 3989818 - DNA, 22 bp, Homo sapiens
caccttgggctgggggactggg

SEQ ID NO: 3989819 - DNA, 16 bp, Homo sapiens
cacctttaacacagac

SEQ ID NO: 3989820 - DNA, 14 bp, Homo sapiens
cacctttcccatct

SEQ ID NO: 3989821 - DNA, 18 bp, Homo sapiens
cacctttgcacaggatgc

SEQ ID NO: 3989822 - DNA, 23 bp, Homo sapiens
cacctttgtggggtttttggaga

SEQ ID NO: 3989823 - DNA, 23 bp, Homo sapiens
caccttttccccaaccacagaga

SEQ ID NO: 3989824 - DNA, 13 bp, Homo sapiens
cacgaaatgttat

SEQ ID NO: 3989825 - DNA, 15 bp, Homo sapiens
cacgaaatgttattt

SEQ ID NO: 3989826 - DNA, 17 bp, Homo sapiens
cacgaaatgttattttt

SEQ ID NO: 3989827 - DNA, 12 bp, Homo sapiens
cacgaagcctta

SEQ ID NO: 3989828 - DNA, 21 bp, Homo sapiens
cacgaaggtaaaaagtatttt

SEQ ID NO: 3989829 - DNA, 18 bp, Homo sapiens
caataaaagtgactctca

SEQ ID NO: 3989830 - DNA, 20 bp, Homo sapiens
caataaaatgtgatttttct

SEQ ID NO: 3989831 - DNA, 17 bp, Homo sapiens
attttcacaaaatgtct

SEQ ID NO: 3989832 - DNA, 23 bp, Homo sapiens
attttcacaaaatgtctcagttt

SEQ ID NO: 3989833 - DNA, 11 bp, Homo sapiens
attttcagtat

SEQ ID NO: 3989834 - DNA, 22 bp, Homo sapiens
attttcagttacaagattgtaa

SEQ ID NO: 3989835 - DNA, 18 bp, Homo sapiens
attttcatgtatatgtgt

SEQ ID NO: 3989836 - DNA, 23 bp, Homo sapiens
attttcccatcatcctttgttct

SEQ ID NO: 3989837 - DNA, 15 bp, Homo sapiens
attttccccccactc

SEQ ID NO: 3989838 - DNA, 20 bp, Homo sapiens
attttccccccactctcccc

SEQ ID NO: 3989839 - DNA, 16 bp, Homo sapiens
attttcctcctctgcc

SEQ ID NO: 3989840 - DNA, 12 bp, Homo sapiens
attttcctctga

SEQ ID NO: 3989841 - DNA, 13 bp, Homo sapiens
attttcctctggc

SEQ ID NO: 3989842 - DNA, 17 bp, Homo sapiens
attttcctttgtagcta

SEQ ID NO: 3989843 - DNA, 18 bp, Homo sapiens
attttctaagcaatttct

SEQ ID NO: 3989844 - DNA, 20 bp, Homo sapiens
caaacactgcagtttcctgg

SEQ ID NO: 3989845 - DNA, 13 bp, Homo sapiens
caaacagaacagg

SEQ ID NO: 3989846 - DNA, 17 bp, Homo sapiens
caaacagaacagggtca

SEQ ID NO: 3989847 - DNA, 16 bp, Homo sapiens
caaacagatgctctga

SEQ ID NO: 3989848 - DNA, 20 bp, Homo sapiens
caaacagccaactagcccct

SEQ ID NO: 3989849 - DNA, 20 bp, Homo sapiens
caaacaggatcagttaacta

SEQ ID NO: 3989850 - DNA, 17 bp, Homo sapiens
caaacagtctcccttcc

SEQ ID NO: 3989851 - DNA, 17 bp, Homo sapiens
caaacagtgccaaatgc

SEQ ID NO: 3989852 - DNA, 22 bp, Homo sapiens
caaacagtgccaaatgctgggg

SEQ ID NO: 3989853 - DNA, 14 bp, Homo sapiens
attataaatgaaat

SEQ ID NO: 3989854 - DNA, 19 bp, Homo sapiens
attataaatgaaatttgca

SEQ ID NO: 3989855 - DNA, 20 bp, Homo sapiens
attataaatgaaatttgcaa

SEQ ID NO: 3989856 - DNA, 12 bp, Homo sapiens
attataaatgtt

SEQ ID NO: 3989857 - DNA, 17 bp, Homo sapiens
attataacaagtgtgtc

SEQ ID NO: 3989858 - DNA, 22 bp, Homo sapiens
attataacttaaaaaaatgaca

SEQ ID NO: 3989859 - DNA, 12 bp, Homo sapiens
attataagcatt

SEQ ID NO: 3989860 - DNA, 22 bp, Homo sapiens
attataagggagagctgagcca

SEQ ID NO: 3989861 - DNA, 15 bp, Homo sapiens
attataagtcacaaa

SEQ ID NO: 3989862 - DNA, 22 bp, Homo sapiens
attataatatactatatttatg

SEQ ID NO: 3989863 - DNA, 23 bp, Homo sapiens
attataatttttttcaatattta

SEQ ID NO: 3989864 - DNA, 19 bp, Homo sapiens
attatactaagaaaagata

SEQ ID NO: 3989865 - DNA, 19 bp, Homo sapiens
attataggtaatcaatgaa

SEQ ID NO: 3989866 - DNA, 14 bp, Homo sapiens
attatattaaaata

SEQ ID NO: 3989867 - DNA, 22 bp, Homo sapiens
attatattggtgcgtttttaca

SEQ ID NO: 3989868 - DNA, 20 bp, Homo sapiens
attatattggtggttctcag

SEQ ID NO: 3989869 - DNA, 21 bp, Homo sapiens
attatattttgttgctttctt

SEQ ID NO: 3989870 - DNA, 19 bp, Homo sapiens
attatcaatatctaatata

SEQ ID NO: 3989871 - DNA, 13 bp, Homo sapiens
attatcataagaa

SEQ ID NO: 3989872 - DNA, 14 bp, Homo sapiens
attatcataagaat

SEQ ID NO: 3989873 - DNA, 18 bp, Homo sapiens
attatcataagaattttt

SEQ ID NO: 3989874 - DNA, 23 bp, Homo sapiens
attatccctatttttaaagtaca

SEQ ID NO: 3989875 - DNA, 20 bp, Homo sapiens
attatcgggaacagtgtttc

SEQ ID NO: 3989876 - DNA, 20 bp, Homo sapiens
attatcgggagcagtgtctt

SEQ ID NO: 3989877 - DNA, 21 bp, Homo sapiens
attatcgggagcagtgtcttc

SEQ ID NO: 3989878 - DNA, 22 bp, Homo sapiens
attatctatacatatctttatt

SEQ ID NO: 3989879 - DNA, 19 bp, Homo sapiens
attatctatagctaagtac

SEQ ID NO: 3989880 - DNA, 22 bp, Homo sapiens
attatgaaagcaacaaagaaat

SEQ ID NO: 3989881 - DNA, 12 bp, Homo sapiens
attatgacagtt

SEQ ID NO: 3989882 - DNA, 16 bp, Homo sapiens
agactgtgattcagaa

SEQ ID NO: 3989883 - DNA, 16 bp, Homo sapiens
agactgtgccagaggc

SEQ ID NO: 3989884 - DNA, 14 bp, Homo sapiens
agactgttgagtta

SEQ ID NO: 3989885 - DNA, 18 bp, Homo sapiens
agactgtttttaagtaac

SEQ ID NO: 3989886 - DNA, 18 bp, Homo sapiens
agacttagtatattttct

SEQ ID NO: 3989887 - DNA, 17 bp, Homo sapiens
agacttcccaacagcct

SEQ ID NO: 3989888 - DNA, 14 bp, Homo sapiens
agacttccttgaga

SEQ ID NO: 3989889 - DNA, 18 bp, Homo sapiens
agacttgagacaatgttt

SEQ ID NO: 3989890 - DNA, 23 bp, Homo sapiens
agactttgagttgatgggggcca

SEQ ID NO: 3989891 - DNA, 18 bp, Homo sapiens
agagaaaaaaaaaatagt

SEQ ID NO: 3989892 - DNA, 15 bp, Homo sapiens
agagaaagaagagac

SEQ ID NO: 3989893 - DNA, 23 bp, Homo sapiens
agagaaaggggagcccactgtcc

SEQ ID NO: 3989894 - DNA, 18 bp, Homo sapiens
agagaaatcagctgctat

SEQ ID NO: 3989895 - DNA, 12 bp, Homo sapiens
agagaaattctg

SEQ ID NO: 3989896 - DNA, 17 bp, Homo sapiens
agagaaattctgttaaa

SEQ ID NO: 3989897 - DNA, 13 bp, Homo sapiens
agagaacaggtgg

SEQ ID NO: 3989898 - DNA, 17 bp, Homo sapiens
agagaaccgagcaaaga

SEQ ID NO: 3989899 - DNA, 21 bp, Homo sapiens
agagaaccgagcaaagatcaa

SEQ ID NO: 3989900 - DNA, 15 bp, Homo sapiens
agagaacgcagccct

SEQ ID NO: 3989901 - DNA, 16 bp, Homo sapiens
agagaagagggcccag

SEQ ID NO: 3989902 - DNA, 18 bp, Homo sapiens
agagaagagggcccagcc

SEQ ID NO: 3989903 - DNA, 15 bp, Homo sapiens
agagaagataattgt

SEQ ID NO: 3989904 - DNA, 20 bp, Homo sapiens
agagaagataattgttgaaa

SEQ ID NO: 3989905 - DNA, 13 bp, Homo sapiens
agagaagcaattt

SEQ ID NO: 3989906 - DNA, 17 bp, Homo sapiens
agagaagccacgctgtc

SEQ ID NO: 3989907 - DNA, 14 bp, Homo sapiens
agagaagctgctga

SEQ ID NO: 3989908 - DNA, 21 bp, Homo sapiens
agagaagctggacttctgtgg

SEQ ID NO: 3989909 - DNA, 18 bp, Homo sapiens
agagaagtatacataagt

SEQ ID NO: 3989910 - DNA, 20 bp, Homo sapiens
agagaatgtgtgtgtgtggc

SEQ ID NO: 3989911 - DNA, 15 bp, Homo sapiens
agagaatgttcctac

SEQ ID NO: 3989912 - DNA, 16 bp, Homo sapiens
agagaattagattata

SEQ ID NO: 3989913 - DNA, 12 bp, Homo sapiens
agagaattggct

SEQ ID NO: 3989914 - DNA, 14 bp, Homo sapiens
agagacaggagggc

SEQ ID NO: 3989915 - DNA, 13 bp, Homo sapiens
agagacaggcagc

SEQ ID NO: 3989916 - DNA, 17 bp, Homo sapiens
agagacaggcagcccag

SEQ ID NO: 3989917 - DNA, 22 bp, Homo sapiens
agagacatacttgaagggccag

SEQ ID NO: 3989918 - DNA, 21 bp, Homo sapiens
agagaccgtcgggggctgagg

SEQ ID NO: 3989919 - DNA, 18 bp, Homo sapiens
agagacgccactccctgg

SEQ ID NO: 3989920 - DNA, 15 bp, Homo sapiens
agagacgcccagccc

SEQ ID NO: 3989921 - DNA, 16 bp, Homo sapiens
agagacgcccagcccc

SEQ ID NO: 3989922 - DNA, 16 bp, Homo sapiens
agagactgagcagccg

SEQ ID NO: 3989923 - DNA, 17 bp, Homo sapiens
agagactgagcagccgc

SEQ ID NO: 3989924 - DNA, 14 bp, Homo sapiens
agagactgtagatt

SEQ ID NO: 3989925 - DNA, 22 bp, Homo sapiens
agagactgtagattgcttctgt

SEQ ID NO: 3989926 - DNA, 16 bp, Homo sapiens
agagacttaaaggaca

SEQ ID NO: 3989927 - DNA, 14 bp, Homo sapiens
atgcttccagaaac

SEQ ID NO: 3989928 - DNA, 14 bp, Homo sapiens
atgcttcccagagg

SEQ ID NO: 3989929 - DNA, 19 bp, Homo sapiens
atgcttcccagagggagca

SEQ ID NO: 3989930 - DNA, 16 bp, Homo sapiens
atgcttcctgacaatc

SEQ ID NO: 3989931 - DNA, 22 bp, Homo sapiens
atgcttcctgacaatcaactct

SEQ ID NO: 3989932 - DNA, 12 bp, Homo sapiens
atgcttgtaatt

SEQ ID NO: 3989933 - DNA, 17 bp, Homo sapiens
atgcttgtttatgatat

SEQ ID NO: 3989934 - DNA, 22 bp, Homo sapiens
atgcttgtttatgatatttctt

SEQ ID NO: 3989935 - DNA, 22 bp, Homo sapiens
atgcttttatatggcccagcct

SEQ ID NO: 3989936 - DNA, 22 bp, Homo sapiens
atgcttttatatttttttaaaa

SEQ ID NO: 3989937 - DNA, 16 bp, Homo sapiens
atgctttttatttctg

SEQ ID NO: 3989938 - DNA, 12 bp, Homo sapiens
atggaaaaggaa

SEQ ID NO: 3989939 - DNA, 18 bp, Homo sapiens
atggaaaagtgtccttct

SEQ ID NO: 3989940 - DNA, 12 bp, Homo sapiens
atggaaaataaa

SEQ ID NO: 3989941 - DNA, 14 bp, Homo sapiens
atggaaaataaaca

SEQ ID NO: 3989942 - DNA, 16 bp, Homo sapiens
atggaaacactgattt

SEQ ID NO: 3989943 - DNA, 16 bp, Homo sapiens
atggaaagtaactcat

SEQ ID NO: 3989944 - DNA, 17 bp, Homo sapiens
atggaaggtttgtatat

SEQ ID NO: 3989945 - DNA, 14 bp, Homo sapiens
atggaataacatgt

SEQ ID NO: 3989946 - DNA, 15 bp, Homo sapiens
atggaatacagtgtt

SEQ ID NO: 3989947 - DNA, 17 bp, Homo sapiens
atggaatacagtgttat

SEQ ID NO: 3989948 - DNA, 21 bp, Homo sapiens
atggaatcccactgtatgatt

SEQ ID NO: 3989949 - DNA, 17 bp, Homo sapiens
atggaatcgatttcctc

SEQ ID NO: 3989950 - DNA, 17 bp, Homo sapiens
atggaatgctgtgttaa

SEQ ID NO: 3989951 - DNA, 14 bp, Homo sapiens
atggaatgtgcccc

SEQ ID NO: 3989952 - DNA, 13 bp, Homo sapiens
atggaattgattt

SEQ ID NO: 3989953 - DNA, 15 bp, Homo sapiens
atggaattgatttgc

SEQ ID NO: 3989954 - DNA, 16 bp, Homo sapiens
atggaattgatttgca

SEQ ID NO: 3989955 - DNA, 17 bp, Homo sapiens
atggacaacttatttaa

SEQ ID NO: 3989956 - DNA, 21 bp, Homo sapiens
atggacaacttatttaaaaat

SEQ ID NO: 3989957 - DNA, 16 bp, Homo sapiens
atggacactaatgcag

SEQ ID NO: 3989958 - DNA, 18 bp, Homo sapiens
atggacagggcatgccac

SEQ ID NO: 3989959 - DNA, 14 bp, Homo sapiens
atggacatggtggc

SEQ ID NO: 3989960 - DNA, 22 bp, Homo sapiens
atggaccaacctgctctgtccc

SEQ ID NO: 3989961 - DNA, 14 bp, Homo sapiens
atggacctaacatt

SEQ ID NO: 3989962 - DNA, 15 bp, Homo sapiens
atggacctaacattc

SEQ ID NO: 3989963 - DNA, 23 bp, Homo sapiens
atggactcttctcggctcaggct

SEQ ID NO: 3989964 - DNA, 14 bp, Homo sapiens
atggactgggagga

SEQ ID NO: 3989965 - DNA, 13 bp, Homo sapiens
atggactgttgcc

SEQ ID NO: 3989966 - DNA, 19 bp, Homo sapiens
atggacttatttcttcaaa

SEQ ID NO: 3989967 - DNA, 23 bp, Homo sapiens
atggacttgtatatttgtacaaa

SEQ ID NO: 3989968 - DNA, 16 bp, Homo sapiens
atggagaggcggcctc

SEQ ID NO: 3989969 - DNA, 18 bp, Homo sapiens
atggagaggcggcctcgt

SEQ ID NO: 3989970 - DNA, 19 bp, Homo sapiens
atggagattcagttttcat

SEQ ID NO: 3989971 - DNA, 11 bp, Homo sapiens
atggagccagc

SEQ ID NO: 3989972 - DNA, 15 bp, Homo sapiens
atggagccagctccc

SEQ ID NO: 3989973 - DNA, 18 bp, Homo sapiens
atggagccagctccctct

SEQ ID NO: 3989974 - DNA, 23 bp, Homo sapiens
atttattttcttttgaattgttt

SEQ ID NO: 3989975 - DNA, 19 bp, Homo sapiens
atttattttgtaattatga

SEQ ID NO: 3989976 - DNA, 18 bp, Homo sapiens
atttattttttacattat

SEQ ID NO: 3989977 - DNA, 14 bp, Homo sapiens
atttcaaaaatata

SEQ ID NO: 3989978 - DNA, 13 bp, Homo sapiens
atttcaaaatgct

SEQ ID NO: 3989979 - DNA, 16 bp, Homo sapiens
atttcaataaatcttt

SEQ ID NO: 3989980 - DNA, 15 bp, Homo sapiens
atttcacaacagatc

SEQ ID NO: 3989981 - DNA, 23 bp, Homo sapiens
atttcacgcttttaattctcatt

SEQ ID NO: 3989982 - DNA, 16 bp, Homo sapiens
atttcactagaaaagc

SEQ ID NO: 3989983 - DNA, 21 bp, Homo sapiens
atttcactatcttcttcaaat

SEQ ID NO: 3989984 - DNA, 22 bp, Homo sapiens
atttcactgtctttaattctgt

SEQ ID NO: 3989985 - DNA, 18 bp, Homo sapiens
atttcacttttgttctgc

SEQ ID NO: 3989986 - DNA, 19 bp, Homo sapiens
atttcagatatcaaaattc

SEQ ID NO: 3989987 - DNA, 16 bp, Homo sapiens
atttcaggaatttaaa

SEQ ID NO: 3989988 - DNA, 18 bp, Homo sapiens
atttcaggaatttaaaat

SEQ ID NO: 3989989 - DNA, 19 bp, Homo sapiens
atttcagtaaacctgtctg

SEQ ID NO: 3989990 - DNA, 18 bp, Homo sapiens
atttcagtatcatctcca

SEQ ID NO: 3989991 - DNA, 18 bp, Homo sapiens
atgtgaaaccttttttaa

SEQ ID NO: 3989992 - DNA, 19 bp, Homo sapiens
atgtgaaaccttttttaag

SEQ ID NO: 3989993 - DNA, 21 bp, Homo sapiens
atgtgaaaccttttttaagat

SEQ ID NO: 3989994 - DNA, 17 bp, Homo sapiens
atgtgaactttattaaa

SEQ ID NO: 3989995 - DNA, 12 bp, Homo sapiens
atgtgaagccaa

SEQ ID NO: 3989996 - DNA, 16 bp, Homo sapiens
atgtgaattattgaca

SEQ ID NO: 3989997 - DNA, 18 bp, Homo sapiens
atgtgaattattgacact

SEQ ID NO: 3989998 - DNA, 19 bp, Homo sapiens
atgtgaattattgacactg

SEQ ID NO: 3989999 - DNA, 12 bp, Homo sapiens
atgtgaattttt

SEQ ID NO: 3990000 - DNA, 19 bp, Homo sapiens
atgtgaatttttatttctt

SEQ ID NO: 3990001 - DNA, 18 bp, Homo sapiens
atgtgacaattttgtaca

SEQ ID NO: 3990002 - DNA, 20 bp, Homo sapiens
atgtgacaattttgtacaaa

SEQ ID NO: 3990003 - DNA, 14 bp, Homo sapiens
atgtgacatttata

SEQ ID NO: 3990004 - DNA, 16 bp, Homo sapiens
atgtgacattttacat

SEQ ID NO: 3990005 - DNA, 16 bp, Homo sapiens
atgtgagaggtttgac

SEQ ID NO: 3990006 - DNA, 15 bp, Homo sapiens
atgtgaggaggaaaa

SEQ ID NO: 3990007 - DNA, 17 bp, Homo sapiens
atgtgaggaggaaaagg

SEQ ID NO: 3990008 - DNA, 23 bp, Homo sapiens
atgtgagtgccttttgcagaaga

SEQ ID NO: 3990009 - DNA, 13 bp, Homo sapiens
atgtgatatataa

SEQ ID NO: 3990010 - DNA, 22 bp, Homo sapiens
atgtgatatataagtgtacata

SEQ ID NO: 3990011 - DNA, 23 bp, Homo sapiens
atgtgatatataagtgtacatat

SEQ ID NO: 3990012 - DNA, 19 bp, Homo sapiens
atgtgatcatgtgtggaag

SEQ ID NO: 3990013 - DNA, 22 bp, Homo sapiens
atgtgatctgggcattttcctc

SEQ ID NO: 3990014 - DNA, 23 bp, Homo sapiens
atgtgattaacatctacaatcag

SEQ ID NO: 3990015 - DNA, 15 bp, Homo sapiens
atgtgattgtggaat

SEQ ID NO: 3990016 - DNA, 22 bp, Homo sapiens
atgtgattgtggaatggagatt

SEQ ID NO: 3990017 - DNA, 11 bp, Homo sapiens
atgtgattttc

SEQ ID NO: 3990018 - DNA, 15 bp, Homo sapiens
atgtgatttttctga

SEQ ID NO: 3990019 - DNA, 14 bp, Homo sapiens
atgtgcaaatgcaa

SEQ ID NO: 3990020 - DNA, 15 bp, Homo sapiens
atgtgcaatagaaat

SEQ ID NO: 3990021 - DNA, 22 bp, Homo sapiens
atgtgcacccatgggctctgac

SEQ ID NO: 3990022 - DNA, 13 bp, Homo sapiens
atgtgccaaggtg

SEQ ID NO: 3990023 - DNA, 21 bp, Homo sapiens
atgtgccagggcaatgatgaa

SEQ ID NO: 3990024 - DNA, 17 bp, Homo sapiens
atgtgccagttcctgta

SEQ ID NO: 3990025 - DNA, 18 bp, Homo sapiens
atgtgccattttaaaaaa

SEQ ID NO: 3990026 - DNA, 13 bp, Homo sapiens
atgtgcccctggc

SEQ ID NO: 3990027 - DNA, 21 bp, Homo sapiens
atgtgccgtgttattgtatta

SEQ ID NO: 3990028 - DNA, 20 bp, Homo sapiens
atgtttatgagccagacaaa

SEQ ID NO: 3990029 - DNA, 22 bp, Homo sapiens
atgtttatgcaaggaaggaaag

SEQ ID NO: 3990030 - DNA, 21 bp, Homo sapiens
atgtttcacaccggaaggttt

SEQ ID NO: 3990031 - DNA, 21 bp, Homo sapiens
atgtttcatttacctctaaat

SEQ ID NO: 3990032 - DNA, 24 bp, Homo sapiens
atgtttccagcagaagacaaaaag

SEQ ID NO: 3990033 - DNA, 13 bp, Homo sapiens
atgtttctatctg

SEQ ID NO: 3990034 - DNA, 15 bp, Homo sapiens
atgtttctgcatagc

SEQ ID NO: 3990035 - DNA, 20 bp, Homo sapiens
atgtttctgggtcctgaaga

SEQ ID NO: 3990036 - DNA, 22 bp, Homo sapiens
atgtttgaaatgaggtctgttt

SEQ ID NO: 3990037 - DNA, 17 bp, Homo sapiens
atgtttgaatatggaca

SEQ ID NO: 3990038 - DNA, 23 bp, Homo sapiens
atgtttgtcctgaacacttttgt

SEQ ID NO: 3990039 - DNA, 17 bp, Homo sapiens
atgtttgtggcctcaga

SEQ ID NO: 3990040 - DNA, 21 bp, Homo sapiens
atgttttaaacatagaaagtt

SEQ ID NO: 3990041 - DNA, 18 bp, Homo sapiens
atgttttattatttctat

SEQ ID NO: 3990042 - DNA, 20 bp, Homo sapiens
atgttttctgaaaatataac

SEQ ID NO: 3990043 - DNA, 14 bp, Homo sapiens
atgttttcttcaac

SEQ ID NO: 3990044 - DNA, 22 bp, Homo sapiens
atgttttggtagattaaatata

SEQ ID NO: 3990045 - DNA, 17 bp, Homo sapiens
atgttttgtatatacag

SEQ ID NO: 3990046 - DNA, 23 bp, Homo sapiens
atgttttgtgcatttgtaaatgc

SEQ ID NO: 3990047 - DNA, 20 bp, Homo sapiens
atgttttgtttctgaaaatt

SEQ ID NO: 3990048 - DNA, 14 bp, Homo sapiens
atgtttttccctcc

SEQ ID NO: 3990049 - DNA, 15 bp, Homo sapiens
atgtttttccctccc

SEQ ID NO: 3990050 - DNA, 22 bp, Homo sapiens
atgtttttctgccagggagctt

SEQ ID NO: 3990051 - DNA, 22 bp, Homo sapiens
atgttttttaaaatatttatct

SEQ ID NO: 3990052 - DNA, 19 bp, Homo sapiens
atgttttttgccacagctt

SEQ ID NO: 3990053 - DNA, 13 bp, Homo sapiens
attaaaacacagc

SEQ ID NO: 3990054 - DNA, 15 bp, Homo sapiens
attaaaacacagctt

SEQ ID NO: 3990055 - DNA, 15 bp, Homo sapiens
attaaaacacattat

SEQ ID NO: 3990056 - DNA, 17 bp, Homo sapiens
attaaaacacattatgt

SEQ ID NO: 3990057 - DNA, 19 bp, Homo sapiens
attaaaactaggtaatgtt

SEQ ID NO: 3990058 - DNA, 18 bp, Homo sapiens
attaaaactatttagtgt

SEQ ID NO: 3990059 - DNA, 21 bp, Homo sapiens
attaaaacttcttaaatatct

SEQ ID NO: 3990060 - DNA, 22 bp, Homo sapiens
attaaaacttcttaaatatctt

SEQ ID NO: 3990061 - DNA, 22 bp, Homo sapiens
attaaaatatggctataaatat

SEQ ID NO: 3990062 - DNA, 20 bp, Homo sapiens
attaaaatttatcttaagtt

SEQ ID NO: 3990063 - DNA, 12 bp, Homo sapiens
attaaacacctg

SEQ ID NO: 3990064 - DNA, 14 bp, Homo sapiens
attaaacacctgac

SEQ ID NO: 3990065 - DNA, 17 bp, Homo sapiens
attaaacacctgacaca

SEQ ID NO: 3990066 - DNA, 20 bp, Homo sapiens
attaaacacctgacacatct

SEQ ID NO: 3990067 - DNA, 21 bp, Homo sapiens
attaaacagatgatgagaatt

SEQ ID NO: 3990068 - DNA, 19 bp, Homo sapiens
attaaacagatgtgaatat

SEQ ID NO: 3990069 - DNA, 15 bp, Homo sapiens
attaaacataaaaca

SEQ ID NO: 3990070 - DNA, 15 bp, Homo sapiens
attaaacttccttct

SEQ ID NO: 3990071 - DNA, 18 bp, Homo sapiens
attaaacttttaattcat

SEQ ID NO: 3990072 - DNA, 19 bp, Homo sapiens
attaaacttttaattcatt

SEQ ID NO: 3990073 - DNA, 16 bp, Homo sapiens
attaaagcatttccta

SEQ ID NO: 3990074 - DNA, 13 bp, Homo sapiens
attaaagtattct

SEQ ID NO: 3990075 - DNA, 14 bp, Homo sapiens
attaaagtctgaat

SEQ ID NO: 3990076 - DNA, 16 bp, Homo sapiens
attaaagtctgaatca

SEQ ID NO: 3990077 - DNA, 12 bp, Homo sapiens
attaaagtgact

SEQ ID NO: 3990078 - DNA, 14 bp, Homo sapiens
attaaagtgacttt

SEQ ID NO: 3990079 - DNA, 16 bp, Homo sapiens
attaaatacaaaactt

SEQ ID NO: 3990080 - DNA, 17 bp, Homo sapiens
attaaatacaaaacttc

SEQ ID NO: 3990081 - DNA, 14 bp, Homo sapiens
attaaatacagaca

SEQ ID NO: 3990082 - DNA, 18 bp, Homo sapiens
attaaatctcaaatttat

SEQ ID NO: 3990083 - DNA, 18 bp, Homo sapiens
attaaattaggaataaat

SEQ ID NO: 3990084 - DNA, 11 bp, Homo sapiens
attaaattatg

SEQ ID NO: 3990085 - DNA, 18 bp, Homo sapiens
attaaattcacaaacttt

SEQ ID NO: 3990086 - DNA, 13 bp, Homo sapiens
attaaatttaatt

SEQ ID NO: 3990087 - DNA, 17 bp, Homo sapiens
attaaatttgcaacaat

SEQ ID NO: 3990088 - DNA, 12 bp, Homo sapiens
attaacaaatat

SEQ ID NO: 3990089 - DNA, 17 bp, Homo sapiens
attaacaaatatgctaa

SEQ ID NO: 3990090 - DNA, 20 bp, Homo sapiens
attaacaaatatgctaattt

SEQ ID NO: 3990091 - DNA, 14 bp, Homo sapiens
attaacagttttcc

SEQ ID NO: 3990092 - DNA, 16 bp, Homo sapiens
attaacagttttccat

SEQ ID NO: 3990093 - DNA, 23 bp, Homo sapiens
attaaccatttaataaagaaata

SEQ ID NO: 3990094 - DNA, 12 bp, Homo sapiens
attaacttattt

SEQ ID NO: 3990095 - DNA, 14 bp, Homo sapiens
attaacttatttag

SEQ ID NO: 3990096 - DNA, 16 bp, Homo sapiens
atcccgccacctatct

SEQ ID NO: 3990097 - DNA, 22 bp, Homo sapiens
atcccgcctcttcttcttcaga

SEQ ID NO: 3990098 - DNA, 13 bp, Homo sapiens
atcccgtgttctc

SEQ ID NO: 3990099 - DNA, 12 bp, Homo sapiens
atccctacatgt

SEQ ID NO: 3990100 - DNA, 14 bp, Homo sapiens
atccctacatgtat

SEQ ID NO: 3990101 - DNA, 17 bp, Homo sapiens
atccctatgggattcag

SEQ ID NO: 3990102 - DNA, 20 bp, Homo sapiens
atccctcgatatttttaaag

SEQ ID NO: 3990103 - DNA, 23 bp, Homo sapiens
atccctcgggaagcagccagctc

SEQ ID NO: 3990104 - DNA, 11 bp, Homo sapiens
atccctctctt

SEQ ID NO: 3990105 - DNA, 14 bp, Homo sapiens
atccctctcttccc

SEQ ID NO: 3990106 - DNA, 16 bp, Homo sapiens
atccctctcttcccct

SEQ ID NO: 3990107 - DNA, 21 bp, Homo sapiens
atccctctcttccccttccct

SEQ ID NO: 3990108 - DNA, 22 bp, Homo sapiens
atccctctcttccccttccctt

SEQ ID NO: 3990109 - DNA, 18 bp, Homo sapiens
atccctgcccttctcaag

SEQ ID NO: 3990110 - DNA, 17 bp, Homo sapiens
atccctggagcaggagc

SEQ ID NO: 3990111 - DNA, 18 bp, Homo sapiens
atccctggagcaggagcc

SEQ ID NO: 3990112 - DNA, 16 bp, Homo sapiens
atccctgggcccctcc

SEQ ID NO: 3990113 - DNA, 18 bp, Homo sapiens
atccctgttacccagaga

SEQ ID NO: 3990114 - DNA, 19 bp, Homo sapiens
atccctgttacccagagaa

SEQ ID NO: 3990115 - DNA, 22 bp, Homo sapiens
atccctgtttaatatttaaaca

SEQ ID NO: 3990116 - DNA, 23 bp, Homo sapiens
atccctgtttaatatttaaacag

SEQ ID NO: 3990117 - DNA, 13 bp, Homo sapiens
atcccttaaaatt

SEQ ID NO: 3990118 - DNA, 19 bp, Homo sapiens
atcccttccacctgctctg

SEQ ID NO: 3990119 - DNA, 21 bp, Homo sapiens
atcccttctcttccaggcagc

SEQ ID NO: 3990120 - DNA, 14 bp, Homo sapiens
atccctttattacc

SEQ ID NO: 3990121 - DNA, 15 bp, Homo sapiens
atccctttttcaatg

SEQ ID NO: 3990122 - DNA, 17 bp, Homo sapiens
atccggggccagctccg

SEQ ID NO: 3990123 - DNA, 22 bp, Homo sapiens
atccggtttagtcatccaacaa

SEQ ID NO: 3990124 - DNA, 14 bp, Homo sapiens
atcctaaaacaaat

SEQ ID NO: 3990125 - DNA, 22 bp, Homo sapiens
atcctaaataaaaaaagacaaa

SEQ ID NO: 3990126 - DNA, 21 bp, Homo sapiens
atcctaatgacttctaaaaat

SEQ ID NO: 3990127 - DNA, 19 bp, Homo sapiens
atcctaatttctcctccct

SEQ ID NO: 3990128 - DNA, 20 bp, Homo sapiens
atcctaatttctcctccctt

SEQ ID NO: 3990129 - DNA, 20 bp, Homo sapiens
atcctagtcattcttcccta

SEQ ID NO: 3990130 - DNA, 14 bp, Homo sapiens
atcatgctgttgca

SEQ ID NO: 3990131 - DNA, 12 bp, Homo sapiens
atcatggagtga

SEQ ID NO: 3990132 - DNA, 22 bp, Homo sapiens
atcatggtagagaatctctccc

SEQ ID NO: 3990133 - DNA, 23 bp, Homo sapiens
atcatggtggatatggtgcagag

SEQ ID NO: 3990134 - DNA, 16 bp, Homo sapiens
atcatggtgtaataag

SEQ ID NO: 3990135 - DNA, 23 bp, Homo sapiens
atcatggtgtaataagacataac

SEQ ID NO: 3990136 - DNA, 11 bp, Homo sapiens
atcatgtaaag

SEQ ID NO: 3990137 - DNA, 14 bp, Homo sapiens
atcatgtaaagaaa

SEQ ID NO: 3990138 - DNA, 17 bp, Homo sapiens
atcatgtaaagaaatgt

SEQ ID NO: 3990139 - DNA, 18 bp, Homo sapiens
atcatgtaaagaaatgtc

SEQ ID NO: 3990140 - DNA, 14 bp, Homo sapiens
atcatgtcagagca

SEQ ID NO: 3990141 - DNA, 21 bp, Homo sapiens
atcatgtgaacccgggacgca

SEQ ID NO: 3990142 - DNA, 17 bp, Homo sapiens
atcatgtggccccaccc

SEQ ID NO: 3990143 - DNA, 17 bp, Homo sapiens
atcattacccttccctg

SEQ ID NO: 3990144 - DNA, 20 bp, Homo sapiens
atcattacccttccctgcac

SEQ ID NO: 3990145 - DNA, 19 bp, Homo sapiens
atcattccagtgctagaaa

SEQ ID NO: 3990146 - DNA, 22 bp, Homo sapiens
atcattgcactctagcctgggc

SEQ ID NO: 3990147 - DNA, 14 bp, Homo sapiens
atcattgtccagag

SEQ ID NO: 3990148 - DNA, 16 bp, Homo sapiens
atcattgtccagagct

SEQ ID NO: 3990149 - DNA, 23 bp, Homo sapiens
atcattgtccagagctgcttccc

SEQ ID NO: 3990150 - DNA, 17 bp, Homo sapiens
atcatttattttaagca

SEQ ID NO: 3990151 - DNA, 21 bp, Homo sapiens
atcatttattttaagcactct

SEQ ID NO: 3990152 - DNA, 19 bp, Homo sapiens
atcatttattttttacatt

SEQ ID NO: 3990153 - DNA, 15 bp, Homo sapiens
atcattttaattatt

SEQ ID NO: 3990154 - DNA, 13 bp, Homo sapiens
atcattttacagt

SEQ ID NO: 3990155 - DNA, 15 bp, Homo sapiens
atcattttacagtga

SEQ ID NO: 3990156 - DNA, 15 bp, Homo sapiens
atcattttcccccca

SEQ ID NO: 3990157 - DNA, 17 bp, Homo sapiens
atcattttccccccact

SEQ ID NO: 3990158 - DNA, 13 bp, Homo sapiens
atcattttgcatt

SEQ ID NO: 3990159 - DNA, 15 bp, Homo sapiens
atccaaaagaaaaac

SEQ ID NO: 3990160 - DNA, 19 bp, Homo sapiens
atccaaaagaagcccccag

SEQ ID NO: 3990161 - DNA, 14 bp, Homo sapiens
atccaaaatgtgta

SEQ ID NO: 3990162 - DNA, 13 bp, Homo sapiens
atccaaacactga

SEQ ID NO: 3990163 - DNA, 21 bp, Homo sapiens
atgagctatttccattccaga

SEQ ID NO: 3990164 - DNA, 12 bp, Homo sapiens
atgagctcctgc

SEQ ID NO: 3990165 - DNA, 16 bp, Homo sapiens
atgagctcctgcggga

SEQ ID NO: 3990166 - DNA, 12 bp, Homo sapiens
atgagctgaggg

SEQ ID NO: 3990167 - DNA, 13 bp, Homo sapiens
atgagggactgga

SEQ ID NO: 3990168 - DNA, 14 bp, Homo sapiens
atgaggggagagga

SEQ ID NO: 3990169 - DNA, 14 bp, Homo sapiens
atgaggtctgaaat

SEQ ID NO: 3990170 - DNA, 15 bp, Homo sapiens
atgaggtgttgtgca

SEQ ID NO: 3990171 - DNA, 18 bp, Homo sapiens
atgaggtgttgtgcattt

SEQ ID NO: 3990172 - DNA, 16 bp, Homo sapiens
atgaggttctgagacc

SEQ ID NO: 3990173 - DNA, 18 bp, Homo sapiens
atgaggttctgagaccag

SEQ ID NO: 3990174 - DNA, 18 bp, Homo sapiens
atgaggttgcttactaag

SEQ ID NO: 3990175 - DNA, 16 bp, Homo sapiens
atgagtaacatttgct

SEQ ID NO: 3990176 - DNA, 17 bp, Homo sapiens
atgagtaacatttgctg

SEQ ID NO: 3990177 - DNA, 18 bp, Homo sapiens
atgagtaactattattat

SEQ ID NO: 3990178 - DNA, 17 bp, Homo sapiens
atgagtacaaatgcctt

SEQ ID NO: 3990179 - DNA, 23 bp, Homo sapiens
atgagtgattgacacacagcact

SEQ ID NO: 3990180 - DNA, 12 bp, Homo sapiens
atgagtgtgcat

SEQ ID NO: 3990181 - DNA, 13 bp, Homo sapiens
atgagtgtgcatg

SEQ ID NO: 3990182 - DNA, 13 bp, Homo sapiens
atgagtttttgat

SEQ ID NO: 3990183 - DNA, 20 bp, Homo sapiens
atgagtttttgatagcttta

SEQ ID NO: 3990184 - DNA, 17 bp, Homo sapiens
atgataaaataaataat

SEQ ID NO: 3990185 - DNA, 17 bp, Homo sapiens
atgataaagagacagtg

SEQ ID NO: 3990186 - DNA, 13 bp, Homo sapiens
atgatatgtaaac

SEQ ID NO: 3990187 - DNA, 21 bp, Homo sapiens
atgatattgacactgtccctc

SEQ ID NO: 3990188 - DNA, 19 bp, Homo sapiens
atgatattgtttaaaattc

SEQ ID NO: 3990189 - DNA, 21 bp, Homo sapiens
atgatattgtttaaaattcag

SEQ ID NO: 3990190 - DNA, 15 bp, Homo sapiens
atgatatttcttgct

SEQ ID NO: 3990191 - DNA, 18 bp, Homo sapiens
atgatatttcttgctttc

SEQ ID NO: 3990192 - DNA, 20 bp, Homo sapiens
atgatcagctgtttgtcata

SEQ ID NO: 3990193 - DNA, 20 bp, Homo sapiens
atgatcagtgttgttgctct

SEQ ID NO: 3990194 - DNA, 15 bp, Homo sapiens
atgatccagaacagt

SEQ ID NO: 3990195 - DNA, 18 bp, Homo sapiens
atgatccctgtgttgtct

SEQ ID NO: 3990196 - DNA, 20 bp, Homo sapiens
atgatccctgtgttgtctct

SEQ ID NO: 3990197 - DNA, 12 bp, Homo sapiens
atgatctcttct

SEQ ID NO: 3990198 - DNA, 14 bp, Homo sapiens
atgatctcttctgg

SEQ ID NO: 3990199 - DNA, 15 bp, Homo sapiens
atgatcttctttata

SEQ ID NO: 3990200 - DNA, 20 bp, Homo sapiens
atgatgatgtggaagaactt

SEQ ID NO: 3990201 - DNA, 22 bp, Homo sapiens
atgatgattaaacacctgacac

SEQ ID NO: 3990202 - DNA, 15 bp, Homo sapiens
atgatggatgccaat

SEQ ID NO: 3990203 - DNA, 19 bp, Homo sapiens
atgatggatgccaatatta

SEQ ID NO: 3990204 - DNA, 18 bp, Homo sapiens
atgatgggaaaatatttc

SEQ ID NO: 3990205 - DNA, 22 bp, Homo sapiens
atgatgggaatagggagacagg

SEQ ID NO: 3990206 - DNA, 13 bp, Homo sapiens
atgatgtatattt

SEQ ID NO: 3990207 - DNA, 14 bp, Homo sapiens
atgatgtccagaag

SEQ ID NO: 3990208 - DNA, 23 bp, Homo sapiens
atgatgtccagaagaatattcag

SEQ ID NO: 3990209 - DNA, 20 bp, Homo sapiens
atgatgtggtgcctgaggtc

SEQ ID NO: 3990210 - DNA, 13 bp, Homo sapiens
atgattaaacacc

SEQ ID NO: 3990211 - DNA, 20 bp, Homo sapiens
atgattaaacacctgacaca

SEQ ID NO: 3990212 - DNA, 21 bp, Homo sapiens
atgattaaacacctgacacat

SEQ ID NO: 3990213 - DNA, 12 bp, Homo sapiens
agtgagagcaga

SEQ ID NO: 3990214 - DNA, 16 bp, Homo sapiens
agtgagatatcataga

SEQ ID NO: 3990215 - DNA, 19 bp, Homo sapiens
agtgagcagtcgcctgcct

SEQ ID NO: 3990216 - DNA, 19 bp, Homo sapiens
agtgagccacagaccacct

SEQ ID NO: 3990217 - DNA, 21 bp, Homo sapiens
agtgagccacagaccacctgc

SEQ ID NO: 3990218 - DNA, 20 bp, Homo sapiens
agtgagcctcctgtgcctgg

SEQ ID NO: 3990219 - DNA, 19 bp, Homo sapiens
agtgagggagggctgtcat

SEQ ID NO: 3990220 - DNA, 22 bp, Homo sapiens
agtgaggtgtgtcacaatgaga

SEQ ID NO: 3990221 - DNA, 17 bp, Homo sapiens
agtgagtaattttggat

SEQ ID NO: 3990222 - DNA, 15 bp, Homo sapiens
agtgagtcacctgct

SEQ ID NO: 3990223 - DNA, 22 bp, Homo sapiens
agtgagtcacctgctccagaag

SEQ ID NO: 3990224 - DNA, 16 bp, Homo sapiens
agtgataggcccaagg

SEQ ID NO: 3990225 - DNA, 14 bp, Homo sapiens
agtgatatggcaga

SEQ ID NO: 3990226 - DNA, 14 bp, Homo sapiens
agtgatctccatat

SEQ ID NO: 3990227 - DNA, 14 bp, Homo sapiens
agtgattactgtca

SEQ ID NO: 3990228 - DNA, 15 bp, Homo sapiens
agtgatttctagaaa

SEQ ID NO: 3990229 - DNA, 23 bp, Homo sapiens
agtgcaaaaggcttgcagaactt

SEQ ID NO: 3990230 - DNA, 13 bp, Homo sapiens
agtgcagacaggc

SEQ ID NO: 3990231 - DNA, 18 bp, Homo sapiens
agtgcagagccttctcag

SEQ ID NO: 3990232 - DNA, 16 bp, Homo sapiens
agtgcagcagggcagt

SEQ ID NO: 3990233 - DNA, 12 bp, Homo sapiens
agtgcagccact

SEQ ID NO: 3990234 - DNA, 16 bp, Homo sapiens
agtgcagccttctcca

SEQ ID NO: 3990235 - DNA, 20 bp, Homo sapiens
agtgcagctgattttaacaa

SEQ ID NO: 3990236 - DNA, 23 bp, Homo sapiens
agtgcatagctactaaaatcagt

SEQ ID NO: 3990237 - DNA, 15 bp, Homo sapiens
agtgcatccaaaggt

SEQ ID NO: 3990238 - DNA, 21 bp, Homo sapiens
agtgcatccaaaggtgctcag

SEQ ID NO: 3990239 - DNA, 15 bp, Homo sapiens
agtgcatctcagccc

SEQ ID NO: 3990240 - DNA, 17 bp, Homo sapiens
agtgcatctcagcccac

SEQ ID NO: 3990241 - DNA, 12 bp, Homo sapiens
agtgcatttctg

SEQ ID NO: 3990242 - DNA, 20 bp, Homo sapiens
agtgccaaatgctggggcag

SEQ ID NO: 3990243 - DNA, 24 bp, Homo sapiens
agtgccaggactccccaggccagg

SEQ ID NO: 3990244 - DNA, 22 bp, Homo sapiens
agtgccattccactccactcag

SEQ ID NO: 3990245 - DNA, 20 bp, Homo sapiens
agtgccccagggagtccagg

SEQ ID NO: 3990246 - DNA, 22 bp, Homo sapiens
agtgccccagggagtccagggt

SEQ ID NO: 3990247 - DNA, 14 bp, Homo sapiens
agtgccccctcacc

SEQ ID NO: 3990248 - DNA, 23 bp, Homo sapiens
agtgccccgtctacagctccccc

SEQ ID NO: 3990249 - DNA, 17 bp, Homo sapiens
agtgccctgctttgcaa

SEQ ID NO: 3990250 - DNA, 19 bp, Homo sapiens
agtgccctgctttgcaaac

SEQ ID NO: 3990251 - DNA, 19 bp, Homo sapiens
agtgccggctgtggagcaa

SEQ ID NO: 3990252 - DNA, 21 bp, Homo sapiens
agtgcctcttgtctgagggac

SEQ ID NO: 3990253 - DNA, 22 bp, Homo sapiens
agtgcctggatcccctctgtct

SEQ ID NO: 3990254 - DNA, 15 bp, Homo sapiens
agtgccttccataat

SEQ ID NO: 3990255 - DNA, 19 bp, Homo sapiens
agtgccttctccttcccca

SEQ ID NO: 3990256 - DNA, 22 bp, Homo sapiens
agtgccttctccttccccagga

SEQ ID NO: 3990257 - DNA, 23 bp, Homo sapiens
agtgccttctccttccccaggat

SEQ ID NO: 3990258 - DNA, 16 bp, Homo sapiens
agtgcctttagagggt

SEQ ID NO: 3990259 - DNA, 22 bp, Homo sapiens
agtgccttttgcagaagagggt

SEQ ID NO: 3990260 - DNA, 21 bp, Homo sapiens
agtgccttttgctgcgcacca

SEQ ID NO: 3990261 - DNA, 21 bp, Homo sapiens
agtgcgggctgaggccagagt

SEQ ID NO: 3990262 - DNA, 15 bp, Homo sapiens
agtgcggttcctcat

SEQ ID NO: 3990263 - DNA, 22 bp, Homo sapiens
agtgcggttcctcatctgagag

SEQ ID NO: 3990264 - DNA, 17 bp, Homo sapiens
agtgcgtggcccaccag

SEQ ID NO: 3990265 - DNA, 13 bp, Homo sapiens
agtgcgtgtgtag

SEQ ID NO: 3990266 - DNA, 18 bp, Homo sapiens
agtgcgtgtgtagagtta

SEQ ID NO: 3990267 - DNA, 22 bp, Homo sapiens
agtgcgtgtgtagagttaagaa

SEQ ID NO: 3990268 - DNA, 22 bp, Homo sapiens
agtgctcaccagccctgcagcc

SEQ ID NO: 3990269 - DNA, 14 bp, Homo sapiens
agtgctcatctgtt

SEQ ID NO: 3990270 - DNA, 12 bp, Homo sapiens
agtgctctctcc

SEQ ID NO: 3990271 - DNA, 17 bp, Homo sapiens
agtgctcttggctgacc

SEQ ID NO: 3990272 - DNA, 18 bp, Homo sapiens
agtgctcttggctgaccc

SEQ ID NO: 3990273 - DNA, 19 bp, Homo sapiens
agtgctcttggctgacccc

SEQ ID NO: 3990274 - DNA, 23 bp, Homo sapiens
agtgctcttggctgacccctctg

SEQ ID NO: 3990275 - DNA, 16 bp, Homo sapiens
agtgctgaggccaggg

SEQ ID NO: 3990276 - DNA, 19 bp, Homo sapiens
agtgctgaggccagggctg

SEQ ID NO: 3990277 - DNA, 12 bp, Homo sapiens
agtgctggcact

SEQ ID NO: 3990278 - DNA, 14 bp, Homo sapiens
agtgctggctcaca

SEQ ID NO: 3990279 - DNA, 20 bp, Homo sapiens
agtgctggctcacagtacag

SEQ ID NO: 3990280 - DNA, 16 bp, Homo sapiens
agtgctgggaccagag

SEQ ID NO: 3990281 - DNA, 19 bp, Homo sapiens
agtgctgggaccagagcca

SEQ ID NO: 3990282 - DNA, 20 bp, Homo sapiens
agtgctgggaccagagccag

SEQ ID NO: 3990283 - DNA, 20 bp, Homo sapiens
agtgctgggattacaggcat

SEQ ID NO: 3990284 - DNA, 20 bp, Homo sapiens
agtgctgggattacaggcgt

SEQ ID NO: 3990285 - DNA, 20 bp, Homo sapiens
agtgctgtgctgtgtttaat

SEQ ID NO: 3990286 - DNA, 14 bp, Homo sapiens
agtgcttcttacta

SEQ ID NO: 3990287 - DNA, 21 bp, Homo sapiens
agtgcttcttactattaagca

SEQ ID NO: 3990288 - DNA, 14 bp, Homo sapiens
agtgcttgcttttt

SEQ ID NO: 3990289 - DNA, 13 bp, Homo sapiens
agtgctttaatgg

SEQ ID NO: 3990290 - DNA, 13 bp, Homo sapiens
agtgctttgtaat

SEQ ID NO: 3990291 - DNA, 19 bp, Homo sapiens
agtggaccttaggccttcc

SEQ ID NO: 3990292 - DNA, 20 bp, Homo sapiens
agtggaccttaggccttcct

SEQ ID NO: 3990293 - DNA, 23 bp, Homo sapiens
agtggaccttaggccttcctctc

SEQ ID NO: 3990294 - DNA, 18 bp, Homo sapiens
agtggaccttgagaccac

SEQ ID NO: 3990295 - DNA, 16 bp, Homo sapiens
agtggactcagggcag

SEQ ID NO: 3990296 - DNA, 20 bp, Homo sapiens
agtggactggaggagctggg

SEQ ID NO: 3990297 - DNA, 17 bp, Homo sapiens
agtggactggcccctgg

SEQ ID NO: 3990298 - DNA, 12 bp, Homo sapiens
agtggagaggga

SEQ ID NO: 3990299 - DNA, 23 bp, Homo sapiens
agtggaggaaggtgagatggcca

SEQ ID NO: 3990300 - DNA, 17 bp, Homo sapiens
agtggaggcactttagg

SEQ ID NO: 3990301 - DNA, 23 bp, Homo sapiens
agtggatctccaaggaccaggtt

SEQ ID NO: 3990302 - DNA, 14 bp, Homo sapiens
agtggatgactgtt

SEQ ID NO: 3990303 - DNA, 17 bp, Homo sapiens
agtggatgggaatttgt

SEQ ID NO: 3990304 - DNA, 18 bp, Homo sapiens
agtggatgggaatttgtc

SEQ ID NO: 3990305 - DNA, 14 bp, Homo sapiens
agtggattgtttat

SEQ ID NO: 3990306 - DNA, 22 bp, Homo sapiens
agtggcaaagctgttcttcctg

SEQ ID NO: 3990307 - DNA, 16 bp, Homo sapiens
agtggcacctgtctgc

SEQ ID NO: 3990308 - DNA, 22 bp, Homo sapiens
agtggcacctgtctgctccagc

SEQ ID NO: 3990309 - DNA, 16 bp, Homo sapiens
agtggcatgtgctgtg

SEQ ID NO: 3990310 - DNA, 14 bp, Homo sapiens
agtggccagccagt

SEQ ID NO: 3990311 - DNA, 13 bp, Homo sapiens
agtggcctggcca

SEQ ID NO: 3990312 - DNA, 14 bp, Homo sapiens
agtggcctggccag

SEQ ID NO: 3990313 - DNA, 19 bp, Homo sapiens
agtggcgggtgatggccag

SEQ ID NO: 3990314 - DNA, 15 bp, Homo sapiens
agtggcgttgttgca

SEQ ID NO: 3990315 - DNA, 21 bp, Homo sapiens
ataacttaaaaatgtaaatat

SEQ ID NO: 3990316 - DNA, 16 bp, Homo sapiens
ataacttcaagcaaac

SEQ ID NO: 3990317 - DNA, 14 bp, Homo sapiens
ataacttctgacct

SEQ ID NO: 3990318 - DNA, 17 bp, Homo sapiens
ataacttggggaggcaa

SEQ ID NO: 3990319 - DNA, 17 bp, Homo sapiens
ataactttgactttctt

SEQ ID NO: 3990320 - DNA, 13 bp, Homo sapiens
ataagaaatgaac

SEQ ID NO: 3990321 - DNA, 17 bp, Homo sapiens
ataagaaatgcatatgt

SEQ ID NO: 3990322 - DNA, 22 bp, Homo sapiens
ataagaatgctggttttcctaa

SEQ ID NO: 3990323 - DNA, 22 bp, Homo sapiens
ataagacatatctctaattcca

SEQ ID NO: 3990324 - DNA, 17 bp, Homo sapiens
ataagactgtttttaag

SEQ ID NO: 3990325 - DNA, 14 bp, Homo sapiens
ataagagaaagaaa

SEQ ID NO: 3990326 - DNA, 17 bp, Homo sapiens
ataagagaatgttccta

SEQ ID NO: 3990327 - DNA, 20 bp, Homo sapiens
ataagagaattatatatttc

SEQ ID NO: 3990328 - DNA, 14 bp, Homo sapiens
ataagcaagagaga

SEQ ID NO: 3990329 - DNA, 16 bp, Homo sapiens
ataagcaagagagatg

SEQ ID NO: 3990330 - DNA, 17 bp, Homo sapiens
ataagcaatcaaggtta

SEQ ID NO: 3990331 - DNA, 20 bp, Homo sapiens
ataagcactgaaaaacaaca

SEQ ID NO: 3990332 - DNA, 16 bp, Homo sapiens
ataagcaggtggatct

SEQ ID NO: 3990333 - DNA, 17 bp, Homo sapiens
ataagcaggtggatcta

SEQ ID NO: 3990334 - DNA, 22 bp, Homo sapiens
ataagcaggtggatctatttca

SEQ ID NO: 3990335 - DNA, 13 bp, Homo sapiens
ataagctaaagag

SEQ ID NO: 3990336 - DNA, 17 bp, Homo sapiens
ataagctaaagaggctg

SEQ ID NO: 3990337 - DNA, 22 bp, Homo sapiens
ataaggacgtgtgtaaatatgt

SEQ ID NO: 3990338 - DNA, 14 bp, Homo sapiens
ataaggatcagaac

SEQ ID NO: 3990339 - DNA, 20 bp, Homo sapiens
ataaggatcagaacagcaga

SEQ ID NO: 3990340 - DNA, 13 bp, Homo sapiens
ataaggcaggcat

SEQ ID NO: 3990341 - DNA, 19 bp, Homo sapiens
ataaggccataaaacaggt

SEQ ID NO: 3990342 - DNA, 18 bp, Homo sapiens
ataaggccttaatatgtt

SEQ ID NO: 3990343 - DNA, 21 bp, Homo sapiens
ataaggctgagggctgccagc

SEQ ID NO: 3990344 - DNA, 13 bp, Homo sapiens
ataagtaagtttg

SEQ ID NO: 3990345 - DNA, 14 bp, Homo sapiens
ataagtatttctga

SEQ ID NO: 3990346 - DNA, 22 bp, Homo sapiens
ataagtgaaatggatactacat

SEQ ID NO: 3990347 - DNA, 21 bp, Homo sapiens
ataagtgctattgcagagccg

SEQ ID NO: 3990348 - DNA, 22 bp, Homo sapiens
ataagttaacttccaatttaca

SEQ ID NO: 3990349 - DNA, 18 bp, Homo sapiens
ataagttatttttgtaca

SEQ ID NO: 3990350 - DNA, 22 bp, Homo sapiens
ataagttatttttgtacatgtt

SEQ ID NO: 3990351 - DNA, 13 bp, Homo sapiens
ataagttgcattt

SEQ ID NO: 3990352 - DNA, 21 bp, Homo sapiens
ataagttgcatttagaaatca

SEQ ID NO: 3990353 - DNA, 20 bp, Homo sapiens
ataagtttacacctttatct

SEQ ID NO: 3990354 - DNA, 17 bp, Homo sapiens
ataataaaaaaagaaag

SEQ ID NO: 3990355 - DNA, 20 bp, Homo sapiens
ataataaaaggaaaagcaaa

SEQ ID NO: 3990356 - DNA, 13 bp, Homo sapiens
ataataaacataa

SEQ ID NO: 3990357 - DNA, 21 bp, Homo sapiens
ataataaagaaaacctttcta

SEQ ID NO: 3990358 - DNA, 14 bp, Homo sapiens
ataataaatcacac

SEQ ID NO: 3990359 - DNA, 13 bp, Homo sapiens
ataataagctaaa

SEQ ID NO: 3990360 - DNA, 14 bp, Homo sapiens
ataataatttttat

SEQ ID NO: 3990361 - DNA, 21 bp, Homo sapiens
ataatagcaacttttgtgtaa

SEQ ID NO: 3990362 - DNA, 17 bp, Homo sapiens
ataataggtagtttgga

SEQ ID NO: 3990363 - DNA, 20 bp, Homo sapiens
ataataggtagtttggatat

SEQ ID NO: 3990364 - DNA, 12 bp, Homo sapiens
ataatagttatt

SEQ ID NO: 3990365 - DNA, 23 bp, Homo sapiens
ataatatattctatttttatact

SEQ ID NO: 3990366 - DNA, 13 bp, Homo sapiens
ataatatctgtga

SEQ ID NO: 3990367 - DNA, 21 bp, Homo sapiens
ataatatctgtgaggtgctga

SEQ ID NO: 3990368 - DNA, 12 bp, Homo sapiens
ataatcaatgaa

SEQ ID NO: 3990369 - DNA, 20 bp, Homo sapiens
ataatcagtgtgtctaaatt

SEQ ID NO: 3990370 - DNA, 23 bp, Homo sapiens
ataatcattagttttagaggcat

SEQ ID NO: 3990371 - DNA, 16 bp, Homo sapiens
ataatcccagcacttt

SEQ ID NO: 3990372 - DNA, 20 bp, Homo sapiens
ataatcctgtgaaaatatga

SEQ ID NO: 3990373 - DNA, 17 bp, Homo sapiens
ataatctgaagatatat

SEQ ID NO: 3990374 - DNA, 23 bp, Homo sapiens
ataatcttattagggagaaaatt

SEQ ID NO: 3990375 - DNA, 15 bp, Homo sapiens
ataatgaataaactg

SEQ ID NO: 3990376 - DNA, 17 bp, Homo sapiens
ataatgaggagtttatg

SEQ ID NO: 3990377 - DNA, 22 bp, Homo sapiens
ataatgataaaataaataattt

SEQ ID NO: 3990378 - DNA, 21 bp, Homo sapiens
ataatgatttgctctttgaca

SEQ ID NO: 3990379 - DNA, 18 bp, Homo sapiens
ataatgcttaatttctaa

SEQ ID NO: 3990380 - DNA, 14 bp, Homo sapiens
ataatggaaacatt

SEQ ID NO: 3990381 - DNA, 21 bp, Homo sapiens
ataatgggattttcttttctt

SEQ ID NO: 3990382 - DNA, 14 bp, Homo sapiens
ataatgtattgtaa

SEQ ID NO: 3990383 - DNA, 14 bp, Homo sapiens
ataatgtattgttg

SEQ ID NO: 3990384 - DNA, 12 bp, Homo sapiens
ataatgttaaat

SEQ ID NO: 3990385 - DNA, 23 bp, Homo sapiens
ataatgttaaatttgtaagtttc

SEQ ID NO: 3990386 - DNA, 12 bp, Homo sapiens
ataatgtttaaa

SEQ ID NO: 3990387 - DNA, 18 bp, Homo sapiens
ataatgtttaaatcatgt

SEQ ID NO: 3990388 - DNA, 20 bp, Homo sapiens
ataatgtttaaatcatgtat

SEQ ID NO: 3990389 - DNA, 22 bp, Homo sapiens
ataatgtttaaatcatgtatgt

SEQ ID NO: 3990390 - DNA, 14 bp, Homo sapiens
ataatgtttgctat

SEQ ID NO: 3990391 - DNA, 15 bp, Homo sapiens
ataattaaaatttat

SEQ ID NO: 3990392 - DNA, 19 bp, Homo sapiens
ataattaaaatttatctta

SEQ ID NO: 3990393 - DNA, 20 bp, Homo sapiens
ataattaaattttgagttct

SEQ ID NO: 3990394 - DNA, 17 bp, Homo sapiens
ataattatccagagttt

SEQ ID NO: 3990395 - DNA, 16 bp, Homo sapiens
ataattatcggaagca

SEQ ID NO: 3990396 - DNA, 19 bp, Homo sapiens
ataattatcggaagcagtg

SEQ ID NO: 3990397 - DNA, 18 bp, Homo sapiens
ataattatgacagttata

SEQ ID NO: 3990398 - DNA, 16 bp, Homo sapiens
ataattcactcaagca

SEQ ID NO: 3990399 - DNA, 12 bp, Homo sapiens
ataattccctat

SEQ ID NO: 3990400 - DNA, 16 bp, Homo sapiens
ataattctaaatccct

SEQ ID NO: 3990401 - DNA, 14 bp, Homo sapiens
ataattctactttg

SEQ ID NO: 3990402 - DNA, 15 bp, Homo sapiens
ataattctggagata

SEQ ID NO: 3990403 - DNA, 19 bp, Homo sapiens
ataattgctcataagcaat

SEQ ID NO: 3990404 - DNA, 19 bp, Homo sapiens
ataattgtaccaacctcat

SEQ ID NO: 3990405 - DNA, 19 bp, Homo sapiens
ataattgttgaaattttgc

SEQ ID NO: 3990406 - DNA, 14 bp, Homo sapiens
ataatttcatattc

SEQ ID NO: 3990407 - DNA, 21 bp, Homo sapiens
ataatttcccaattaggaagt

SEQ ID NO: 3990408 - DNA, 13 bp, Homo sapiens
ataatttcgagat

SEQ ID NO: 3990409 - DNA, 12 bp, Homo sapiens
ataatttgcata

SEQ ID NO: 3990410 - DNA, 21 bp, Homo sapiens
ataatttgcatattctattgt

SEQ ID NO: 3990411 - DNA, 23 bp, Homo sapiens
ataattttcttcatgcaatgaca

SEQ ID NO: 3990412 - DNA, 13 bp, Homo sapiens
ataattttgctgg

SEQ ID NO: 3990413 - DNA, 23 bp, Homo sapiens
ataatttttaatttggcttttct

SEQ ID NO: 3990414 - DNA, 23 bp, Homo sapiens
ataatttttatatttaattatta

SEQ ID NO: 3990415 - DNA, 13 bp, Homo sapiens
ataatttttctag

SEQ ID NO: 3990416 - DNA, 14 bp, Homo sapiens
atacaaaaagaaaa

SEQ ID NO: 3990417 - DNA, 17 bp, Homo sapiens
atacaaactggtattct

SEQ ID NO: 3990418 - DNA, 20 bp, Homo sapiens
atacaaatctgtataaatgt

SEQ ID NO: 3990419 - DNA, 21 bp, Homo sapiens
atacaaatctgtataaatgtc

SEQ ID NO: 3990420 - DNA, 22 bp, Homo sapiens
atacaaatctgtataaatgtct

SEQ ID NO: 3990421 - DNA, 24 bp, Homo sapiens
atacaaatctgtataaatgtctat

SEQ ID NO: 3990422 - DNA, 19 bp, Homo sapiens
atacaacaaaggcaagtta

SEQ ID NO: 3990423 - DNA, 22 bp, Homo sapiens
atacaacaaaggcaagttaaga

SEQ ID NO: 3990424 - DNA, 17 bp, Homo sapiens
atacaagattgaaaatc

SEQ ID NO: 3990425 - DNA, 22 bp, Homo sapiens
atacaagccattctaaggaaat

SEQ ID NO: 3990426 - DNA, 12 bp, Homo sapiens
atacaagtttca

SEQ ID NO: 3990427 - DNA, 12 bp, Homo sapiens
atacaataaact

SEQ ID NO: 3990428 - DNA, 16 bp, Homo sapiens
atacaatcctgtttat

SEQ ID NO: 3990429 - DNA, 17 bp, Homo sapiens
atacaatgaacacttat

SEQ ID NO: 3990430 - DNA, 18 bp, Homo sapiens
atacaatgaacacttata

SEQ ID NO: 3990431 - DNA, 11 bp, Homo sapiens
atacaattaaa

SEQ ID NO: 3990432 - DNA, 23 bp, Homo sapiens
atacaattaaaggtcctgccctc

SEQ ID NO: 3990433 - DNA, 15 bp, Homo sapiens
atacaattctacatt

SEQ ID NO: 3990434 - DNA, 14 bp, Homo sapiens
atacacaggatcct

SEQ ID NO: 3990435 - DNA, 20 bp, Homo sapiens
atacaccacctcactcctgt

SEQ ID NO: 3990436 - DNA, 21 bp, Homo sapiens
atacaccacctcactcctgtt

SEQ ID NO: 3990437 - DNA, 18 bp, Homo sapiens
atacaccgggcctggaga

SEQ ID NO: 3990438 - DNA, 20 bp, Homo sapiens
atacacttgtgattataaaa

SEQ ID NO: 3990439 - DNA, 15 bp, Homo sapiens
atacactttgttgca

SEQ ID NO: 3990440 - DNA, 21 bp, Homo sapiens
atacactttgttgcaagatgt

SEQ ID NO: 3990441 - DNA, 23 bp, Homo sapiens
atacactttgttgcaagatgtga

SEQ ID NO: 3990442 - DNA, 12 bp, Homo sapiens
atacagaaaaat

SEQ ID NO: 3990443 - DNA, 23 bp, Homo sapiens
atacagatagatatatgctctgc

SEQ ID NO: 3990444 - DNA, 22 bp, Homo sapiens
atacagatctcagggctcggga

SEQ ID NO: 3990445 - DNA, 14 bp, Homo sapiens
atacagatgaaaat

SEQ ID NO: 3990446 - DNA, 21 bp, Homo sapiens
atacagggcatgcattttgca

SEQ ID NO: 3990447 - DNA, 21 bp, Homo sapiens
atacagtgcagagccttctca

SEQ ID NO: 3990448 - DNA, 13 bp, Homo sapiens
atacagtgccttg

SEQ ID NO: 3990449 - DNA, 14 bp, Homo sapiens
atacagtgttattt

SEQ ID NO: 3990450 - DNA, 22 bp, Homo sapiens
atacagttaacacaatgtgaat

SEQ ID NO: 3990451 - DNA, 14 bp, Homo sapiens
atacagttattttg

SEQ ID NO: 3990452 - DNA, 16 bp, Homo sapiens
atacagttattttgga

SEQ ID NO: 3990453 - DNA, 20 bp, Homo sapiens
atacagttattttggatata

SEQ ID NO: 3990454 - DNA, 19 bp, Homo sapiens
atacagttcaataaactta

SEQ ID NO: 3990455 - DNA, 21 bp, Homo sapiens
atacagttctgctctggttgt

SEQ ID NO: 3990456 - DNA, 22 bp, Homo sapiens
atacagttttcagaaaaagaaa

SEQ ID NO: 3990457 - DNA, 19 bp, Homo sapiens
atacatatactgattctgt

SEQ ID NO: 3990458 - DNA, 14 bp, Homo sapiens
atacatatctttat

SEQ ID NO: 3990459 - DNA, 22 bp, Homo sapiens
atacatatgagtgtggaagccg

SEQ ID NO: 3990460 - DNA, 18 bp, Homo sapiens
atacatcactgcttgatg

SEQ ID NO: 3990461 - DNA, 14 bp, Homo sapiens
atacatggttgtga

SEQ ID NO: 3990462 - DNA, 21 bp, Homo sapiens
atacatgtgccgaatgtgcag

SEQ ID NO: 3990463 - DNA, 18 bp, Homo sapiens
atacattaaaactaggta

SEQ ID NO: 3990464 - DNA, 13 bp, Homo sapiens
atacattagtaaa

SEQ ID NO: 3990465 - DNA, 16 bp, Homo sapiens
atacattagtaaatgt

SEQ ID NO: 3990466 - DNA, 17 bp, Homo sapiens
atacattagtaaatgtc

SEQ ID NO: 3990467 - DNA, 21 bp, Homo sapiens
atacattagtaaatgtctttg

SEQ ID NO: 3990468 - DNA, 18 bp, Homo sapiens
atacattccctctaattt

SEQ ID NO: 3990469 - DNA, 14 bp, Homo sapiens
atacatttaaaact

SEQ ID NO: 3990470 - DNA, 15 bp, Homo sapiens
atacatttaaaactt

SEQ ID NO: 3990471 - DNA, 21 bp, Homo sapiens
atacatttataatgtttgcta

SEQ ID NO: 3990472 - DNA, 12 bp, Homo sapiens
ataccagtgtgg

SEQ ID NO: 3990473 - DNA, 17 bp, Homo sapiens
atacccccccatgcagt

SEQ ID NO: 3990474 - DNA, 15 bp, Homo sapiens
atacctcaccctgct

SEQ ID NO: 3990475 - DNA, 18 bp, Homo sapiens
atacctcttactttgctt

SEQ ID NO: 3990476 - DNA, 17 bp, Homo sapiens
atacctggcttttactt

SEQ ID NO: 3990477 - DNA, 20 bp, Homo sapiens
atacctggcttttactttat

SEQ ID NO: 3990478 - DNA, 23 bp, Homo sapiens
atacctggcttttactttattaa

SEQ ID NO: 3990479 - DNA, 12 bp, Homo sapiens
atacctgttgct

SEQ ID NO: 3990480 - DNA, 19 bp, Homo sapiens
atacgagagcagaggtctc

SEQ ID NO: 3990481 - DNA, 19 bp, Homo sapiens
atacgctactataaagaga

SEQ ID NO: 3990482 - DNA, 19 bp, Homo sapiens
atacgtagttgtgcttttg

SEQ ID NO: 3990483 - DNA, 21 bp, Homo sapiens
atacgtttcaaaaacaccccc

SEQ ID NO: 3990484 - DNA, 14 bp, Homo sapiens
atactaaaagcaaa

SEQ ID NO: 3990485 - DNA, 14 bp, Homo sapiens
atactaagaaaaga

SEQ ID NO: 3990486 - DNA, 12 bp, Homo sapiens
atactacatctt

SEQ ID NO: 3990487 - DNA, 16 bp, Homo sapiens
atactacccatagaaa

SEQ ID NO: 3990488 - DNA, 14 bp, Homo sapiens
atactactgaaaca

SEQ ID NO: 3990489 - DNA, 18 bp, Homo sapiens
atactactgaaacagatt

SEQ ID NO: 3990490 - DNA, 19 bp, Homo sapiens
atactactgaaacagattt

SEQ ID NO: 3990491 - DNA, 14 bp, Homo sapiens
atactatatttatg

SEQ ID NO: 3990492 - DNA, 13 bp, Homo sapiens
atactcagcctgc

SEQ ID NO: 3990493 - DNA, 15 bp, Homo sapiens
atactcagcctgctg

SEQ ID NO: 3990494 - DNA, 20 bp, Homo sapiens
atactcagcctgctgcccag

SEQ ID NO: 3990495 - DNA, 21 bp, Homo sapiens
atactccagtgtacatagtgt

SEQ ID NO: 3990496 - DNA, 13 bp, Homo sapiens
atactctgtcaga

SEQ ID NO: 3990497 - DNA, 16 bp, Homo sapiens
atactctgtcagatgg

SEQ ID NO: 3990498 - DNA, 16 bp, Homo sapiens
atactctttctgtata

SEQ ID NO: 3990499 - DNA, 22 bp, Homo sapiens
atactctttctgtatatacttt

SEQ ID NO: 3990500 - DNA, 15 bp, Homo sapiens
atactgaaggaaaaa

SEQ ID NO: 3990501 - DNA, 22 bp, Homo sapiens
atactgaaggaaaaacacaagc

SEQ ID NO: 3990502 - DNA, 14 bp, Homo sapiens
atactgaagtcttt

SEQ ID NO: 3990503 - DNA, 18 bp, Homo sapiens
atactgagccaagtataa

SEQ ID NO: 3990504 - DNA, 19 bp, Homo sapiens
atactgattctgtgtatct

SEQ ID NO: 3990505 - DNA, 14 bp, Homo sapiens
atactgatttaatt

SEQ ID NO: 3990506 - DNA, 15 bp, Homo sapiens
atactgcctccccca

SEQ ID NO: 3990507 - DNA, 15 bp, Homo sapiens
atactgctacagcaa

SEQ ID NO: 3990508 - DNA, 22 bp, Homo sapiens
atactgctacagcaatttctaa

SEQ ID NO: 3990509 - DNA, 23 bp, Homo sapiens
atactgcttgaccgtactctcac

SEQ ID NO: 3990510 - DNA, 17 bp, Homo sapiens
atactggaagttttgca

SEQ ID NO: 3990511 - DNA, 20 bp, Homo sapiens
atactggaagttttgcattt

SEQ ID NO: 3990512 - DNA, 14 bp, Homo sapiens
atactggaataatt

SEQ ID NO: 3990513 - DNA, 15 bp, Homo sapiens
atactggaataattt

SEQ ID NO: 3990514 - DNA, 20 bp, Homo sapiens
atactggaataatttgtaaa

SEQ ID NO: 3990515 - DNA, 22 bp, Homo sapiens
atactggaataatttgtaaatg

SEQ ID NO: 3990516 - DNA, 14 bp, Homo sapiens
atactggcctggac

SEQ ID NO: 3990517 - DNA, 14 bp, Homo sapiens
atataaaaacattt

SEQ ID NO: 3990518 - DNA, 17 bp, Homo sapiens
atataaaaacatttgta

SEQ ID NO: 3990519 - DNA, 18 bp, Homo sapiens
atataaaaacatttgtaa

SEQ ID NO: 3990520 - DNA, 22 bp, Homo sapiens
atataaaaagaaaagataaaga

SEQ ID NO: 3990521 - DNA, 23 bp, Homo sapiens
atataaaaagaaaagataaagat

SEQ ID NO: 3990522 - DNA, 12 bp, Homo sapiens
atataaacatct

SEQ ID NO: 3990523 - DNA, 11 bp, Homo sapiens
atataaaccgt

SEQ ID NO: 3990524 - DNA, 13 bp, Homo sapiens
atataaagcttaa

SEQ ID NO: 3990525 - DNA, 18 bp, Homo sapiens
atataaagcttaataaaa

SEQ ID NO: 3990526 - DNA, 16 bp, Homo sapiens
atataaatatatattc

SEQ ID NO: 3990527 - DNA, 12 bp, Homo sapiens
atataaattctg

SEQ ID NO: 3990528 - DNA, 22 bp, Homo sapiens
atataacacttaggactagaag

SEQ ID NO: 3990529 - DNA, 14 bp, Homo sapiens
atataagattttct

SEQ ID NO: 3990530 - DNA, 16 bp, Homo sapiens
atataagccttttata

SEQ ID NO: 3990531 - DNA, 23 bp, Homo sapiens
atataaggaaagcaataaatgaa

SEQ ID NO: 3990532 - DNA, 18 bp, Homo sapiens
atataagtgtacatatgt

SEQ ID NO: 3990533 - DNA, 21 bp, Homo sapiens
atataataaatgtacattaat

SEQ ID NO: 3990534 - DNA, 22 bp, Homo sapiens
atataataatagttattattta

SEQ ID NO: 3990535 - DNA, 22 bp, Homo sapiens
atataatgttgttatttaaaga

SEQ ID NO: 3990536 - DNA, 14 bp, Homo sapiens
atataattatcgga

SEQ ID NO: 3990537 - DNA, 17 bp, Homo sapiens
atataattctgtaaatg

SEQ ID NO: 3990538 - DNA, 22 bp, Homo sapiens
atataatttatttccactaaaa

SEQ ID NO: 3990539 - DNA, 11 bp, Homo sapiens
atataatttta

SEQ ID NO: 3990540 - DNA, 15 bp, Homo sapiens
atatacaaaaagaaa

SEQ ID NO: 3990541 - DNA, 15 bp, Homo sapiens
atatacagatgaaaa

SEQ ID NO: 3990542 - DNA, 17 bp, Homo sapiens
atatacagatgaaaatt

SEQ ID NO: 3990543 - DNA, 21 bp, Homo sapiens
atatgtatatatatatatgca

SEQ ID NO: 3990544 - DNA, 10 bp, Homo sapiens
atatgtatgc

SEQ ID NO: 3990545 - DNA, 13 bp, Homo sapiens
atatgtatgcttt

SEQ ID NO: 3990546 - DNA, 12 bp, Homo sapiens
atatgtatgggt

SEQ ID NO: 3990547 - DNA, 15 bp, Homo sapiens
atatgtattttccta

SEQ ID NO: 3990548 - DNA, 21 bp, Homo sapiens
atatgtattttcctaagtgtt

SEQ ID NO: 3990549 - DNA, 15 bp, Homo sapiens
atatgtcactagaat

SEQ ID NO: 3990550 - DNA, 20 bp, Homo sapiens
atatgttaacctcagtgtca

SEQ ID NO: 3990551 - DNA, 23 bp, Homo sapiens
atatgttaagcagctaaattttc

SEQ ID NO: 3990552 - DNA, 16 bp, Homo sapiens
atatgttgaatacttt

SEQ ID NO: 3990553 - DNA, 20 bp, Homo sapiens
atatgttgctataataaaga

SEQ ID NO: 3990554 - DNA, 13 bp, Homo sapiens
atatgtttccttg

SEQ ID NO: 3990555 - DNA, 18 bp, Homo sapiens
atatgtttccttgtttat

SEQ ID NO: 3990556 - DNA, 21 bp, Homo sapiens
atatgttttttagatcaaata

SEQ ID NO: 3990557 - DNA, 14 bp, Homo sapiens
atattaaaggagtt

SEQ ID NO: 3990558 - DNA, 12 bp, Homo sapiens
atattaaataca

SEQ ID NO: 3990559 - DNA, 13 bp, Homo sapiens
atattaaatctgc

SEQ ID NO: 3990560 - DNA, 15 bp, Homo sapiens
atattaagaaagact

SEQ ID NO: 3990561 - DNA, 16 bp, Homo sapiens
atattaagaaagacta

SEQ ID NO: 3990562 - DNA, 24 bp, Homo sapiens
atattaagaaagactatctaaatg

SEQ ID NO: 3990563 - DNA, 15 bp, Homo sapiens
atattaagcacttta

SEQ ID NO: 3990564 - DNA, 14 bp, Homo sapiens
atattaattttcca

SEQ ID NO: 3990565 - DNA, 22 bp, Homo sapiens
atattacaaaaacaaaataaaa

SEQ ID NO: 3990566 - DNA, 15 bp, Homo sapiens
atattacacatttgt

SEQ ID NO: 3990567 - DNA, 16 bp, Homo sapiens
atattacacatttgta

SEQ ID NO: 3990568 - DNA, 20 bp, Homo sapiens
atattactgttgcatttact

SEQ ID NO: 3990569 - DNA, 20 bp, Homo sapiens
atattactgtttatttctgt

SEQ ID NO: 3990570 - DNA, 21 bp, Homo sapiens
atattactgtttatttctgtt

SEQ ID NO: 3990571 - DNA, 15 bp, Homo sapiens
atattaggaaaatat

SEQ ID NO: 3990572 - DNA, 17 bp, Homo sapiens
atattataacttaaaaa

SEQ ID NO: 3990573 - DNA, 17 bp, Homo sapiens
atattatcataagaatt

SEQ ID NO: 3990574 - DNA, 17 bp, Homo sapiens
atattatgaaatttcac

SEQ ID NO: 3990575 - DNA, 18 bp, Homo sapiens
atattatgaaatttcact

SEQ ID NO: 3990576 - DNA, 18 bp, Homo sapiens
atattattgtaagttgta

SEQ ID NO: 3990577 - DNA, 19 bp, Homo sapiens
atattattgtaagttgtac

SEQ ID NO: 3990578 - DNA, 23 bp, Homo sapiens
atattatttgctaattaaaaagt

SEQ ID NO: 3990579 - DNA, 16 bp, Homo sapiens
atattcaggagttgga

SEQ ID NO: 3990580 - DNA, 21 bp, Homo sapiens
atattcaggctactcattcag

SEQ ID NO: 3990581 - DNA, 20 bp, Homo sapiens
atattcagtgaaaagatttt

SEQ ID NO: 3990582 - DNA, 21 bp, Homo sapiens
atattcatttaaaacattgca

SEQ ID NO: 3990583 - DNA, 15 bp, Homo sapiens
atattccatgaatgt

SEQ ID NO: 3990584 - DNA, 14 bp, Homo sapiens
atattcctccaaat

SEQ ID NO: 3990585 - DNA, 23 bp, Homo sapiens
atattcctgaatgaaatatcaga

SEQ ID NO: 3990586 - DNA, 16 bp, Homo sapiens
atattctaaaaccatt

SEQ ID NO: 3990587 - DNA, 13 bp, Homo sapiens
atattctaagcca

SEQ ID NO: 3990588 - DNA, 18 bp, Homo sapiens
atattctatatgaattta

SEQ ID NO: 3990589 - DNA, 20 bp, Homo sapiens
atattctatatgaatttaaa

SEQ ID NO: 3990590 - DNA, 22 bp, Homo sapiens
atattctattacattttcagtg

SEQ ID NO: 3990591 - DNA, 15 bp, Homo sapiens
atattctatttttat

SEQ ID NO: 3990592 - DNA, 16 bp, Homo sapiens
atattcttttgtttcc

SEQ ID NO: 3990593 - DNA, 18 bp, Homo sapiens
atattgaacttttgtact

SEQ ID NO: 3990594 - DNA, 14 bp, Homo sapiens
atattgaagacaat

SEQ ID NO: 3990595 - DNA, 12 bp, Homo sapiens
atattgacattt

SEQ ID NO: 3990596 - DNA, 14 bp, Homo sapiens
atattgacatttgt

SEQ ID NO: 3990597 - DNA, 20 bp, Homo sapiens
atattgacatttgtagttga

SEQ ID NO: 3990598 - DNA, 14 bp, Homo sapiens
atattgacttgtat

SEQ ID NO: 3990599 - DNA, 22 bp, Homo sapiens
atattgaggctttgtgttgtaa

SEQ ID NO: 3990600 - DNA, 22 bp, Homo sapiens
atattgctgagagaaatatgga

SEQ ID NO: 3990601 - DNA, 18 bp, Homo sapiens
atattgctttttctaatg

SEQ ID NO: 3990602 - DNA, 20 bp, Homo sapiens
atattggtgcgtttttacag

SEQ ID NO: 3990603 - DNA, 14 bp, Homo sapiens
atattgtacataaa

SEQ ID NO: 3990604 - DNA, 15 bp, Homo sapiens
atattgtcagatatt

SEQ ID NO: 3990605 - DNA, 19 bp, Homo sapiens
atattgtcctaagtgtcaa

SEQ ID NO: 3990606 - DNA, 13 bp, Homo sapiens
atattgtgtttgt

SEQ ID NO: 3990607 - DNA, 21 bp, Homo sapiens
atattgttcaaacaatatcat

SEQ ID NO: 3990608 - DNA, 16 bp, Homo sapiens
atattgttgcattgct

SEQ ID NO: 3990609 - DNA, 13 bp, Homo sapiens
atattgtttaaaa

SEQ ID NO: 3990610 - DNA, 18 bp, Homo sapiens
atattgtttaaaattcag

SEQ ID NO: 3990611 - DNA, 20 bp, Homo sapiens
atattgttttcagtgtacat

SEQ ID NO: 3990612 - DNA, 23 bp, Homo sapiens
atattgttttctgtaaataacct

SEQ ID NO: 3990613 - DNA, 18 bp, Homo sapiens
atattgtttttgtattta

SEQ ID NO: 3990614 - DNA, 14 bp, Homo sapiens
atatttaaacagca

SEQ ID NO: 3990615 - DNA, 23 bp, Homo sapiens
atatttaaacatggttacaatca

SEQ ID NO: 3990616 - DNA, 17 bp, Homo sapiens
atatttaagaaaagcac

SEQ ID NO: 3990617 - DNA, 19 bp, Homo sapiens
atatttaagaaaagcactt

SEQ ID NO: 3990618 - DNA, 20 bp, Homo sapiens
atatttaagaaaagcacttt

SEQ ID NO: 3990619 - DNA, 22 bp, Homo sapiens
atatttaagaaaagcacttttg

SEQ ID NO: 3990620 - DNA, 16 bp, Homo sapiens
atatttaagaaaatac

SEQ ID NO: 3990621 - DNA, 20 bp, Homo sapiens
atatttaagaaaatacaata

SEQ ID NO: 3990622 - DNA, 12 bp, Homo sapiens
atatttaagcct

SEQ ID NO: 3990623 - DNA, 9 bp, Homo sapiens
atatttaat

SEQ ID NO: 3990624 - DNA, 13 bp, Homo sapiens
atatttaatgata

SEQ ID NO: 3990625 - DNA, 14 bp, Homo sapiens
atatttaattatta

SEQ ID NO: 3990626 - DNA, 14 bp, Homo sapiens
atatttacaataaa

SEQ ID NO: 3990627 - DNA, 14 bp, Homo sapiens
atatttagctgtaa

SEQ ID NO: 3990628 - DNA, 15 bp, Homo sapiens
atatttatagtcaca

SEQ ID NO: 3990629 - DNA, 15 bp, Homo sapiens
atatttatatattta

SEQ ID NO: 3990630 - DNA, 14 bp, Homo sapiens
atatttatatttca

SEQ ID NO: 3990631 - DNA, 15 bp, Homo sapiens
atatttatatttcac

SEQ ID NO: 3990632 - DNA, 12 bp, Homo sapiens
atatttatccaa

SEQ ID NO: 3990633 - DNA, 15 bp, Homo sapiens
atatttatccaaaat

SEQ ID NO: 3990634 - DNA, 23 bp, Homo sapiens
atatttattaaataaaatcaatt

SEQ ID NO: 3990635 - DNA, 16 bp, Homo sapiens
atatttattacctctg

SEQ ID NO: 3990636 - DNA, 14 bp, Homo sapiens
atatttattgtgct

SEQ ID NO: 3990637 - DNA, 18 bp, Homo sapiens
atatttcacttttgttct

SEQ ID NO: 3990638 - DNA, 21 bp, Homo sapiens
atatttcacttttgttctgct

SEQ ID NO: 3990639 - DNA, 14 bp, Homo sapiens
atatttcagatatc

SEQ ID NO: 3990640 - DNA, 21 bp, Homo sapiens
atatttccatatggattttct

SEQ ID NO: 3990641 - DNA, 19 bp, Homo sapiens
atatttccctaaaatacat

SEQ ID NO: 3990642 - DNA, 13 bp, Homo sapiens
atatttcctgact

SEQ ID NO: 3990643 - DNA, 21 bp, Homo sapiens
atatttccttaaactgtgtgg

SEQ ID NO: 3990644 - DNA, 18 bp, Homo sapiens
atatttcctttatgtgaa

SEQ ID NO: 3990645 - DNA, 20 bp, Homo sapiens
atatttcctttatgtgaatt

SEQ ID NO: 3990646 - DNA, 15 bp, Homo sapiens
atatttctaactata

SEQ ID NO: 3990647 - DNA, 22 bp, Homo sapiens
aggtggaagaagggagaagaaa

SEQ ID NO: 3990648 - DNA, 16 bp, Homo sapiens
aggtggaaggcagaca

SEQ ID NO: 3990649 - DNA, 17 bp, Homo sapiens
aggtggaaggcagacag

SEQ ID NO: 3990650 - DNA, 18 bp, Homo sapiens
aggtggaaggcagacagc

SEQ ID NO: 3990651 - DNA, 14 bp, Homo sapiens
aggtggacacacaa

SEQ ID NO: 3990652 - DNA, 16 bp, Homo sapiens
aggtggaccttttaaa

SEQ ID NO: 3990653 - DNA, 16 bp, Homo sapiens
aggtggagtttctctg

SEQ ID NO: 3990654 - DNA, 16 bp, Homo sapiens
aggtggcaatgcttaa

SEQ ID NO: 3990655 - DNA, 17 bp, Homo sapiens
aggtggcaatgcttaaa

SEQ ID NO: 3990656 - DNA, 21 bp, Homo sapiens
aggtggcaatgcttaaactaa

SEQ ID NO: 3990657 - DNA, 22 bp, Homo sapiens
aggtggcaatgcttaaactaaa

SEQ ID NO: 3990658 - DNA, 20 bp, Homo sapiens
aggtggcagatgtcttccct

SEQ ID NO: 3990659 - DNA, 19 bp, Homo sapiens
aggtggcctttgtgctgcg

SEQ ID NO: 3990660 - DNA, 20 bp, Homo sapiens
aggtggcctttgtgctgcgc

SEQ ID NO: 3990661 - DNA, 14 bp, Homo sapiens
aggtggctctccag

SEQ ID NO: 3990662 - DNA, 22 bp, Homo sapiens
aggtgggatatcacttccatga

SEQ ID NO: 3990663 - DNA, 18 bp, Homo sapiens
aggtgggcatgccaccct

SEQ ID NO: 3990664 - DNA, 14 bp, Homo sapiens
aggtgggctgggcc

SEQ ID NO: 3990665 - DNA, 22 bp, Homo sapiens
aggtgggctgggccctctcttc

SEQ ID NO: 3990666 - DNA, 14 bp, Homo sapiens
aggtggggactggg

SEQ ID NO: 3990667 - DNA, 16 bp, Homo sapiens
aggtggggactgggca

SEQ ID NO: 3990668 - DNA, 21 bp, Homo sapiens
aggtggggagtccagggctcc

SEQ ID NO: 3990669 - DNA, 15 bp, Homo sapiens
aggtgggggttgctg

SEQ ID NO: 3990670 - DNA, 15 bp, Homo sapiens
aggtgggtgtctgcg

SEQ ID NO: 3990671 - DNA, 15 bp, Homo sapiens
aggtggtcagtaaat

SEQ ID NO: 3990672 - DNA, 19 bp, Homo sapiens
aggtggtctgaatgttctg

SEQ ID NO: 3990673 - DNA, 19 bp, Homo sapiens
aggtggttgtcttattgca

SEQ ID NO: 3990674 - DNA, 13 bp, Homo sapiens
aggtgtacactaa

SEQ ID NO: 3990675 - DNA, 14 bp, Homo sapiens
aggtgtacactaac

SEQ ID NO: 3990676 - DNA, 19 bp, Homo sapiens
aggtgtacactaacatttc

SEQ ID NO: 3990677 - DNA, 15 bp, Homo sapiens
aggtgtcatttccat

SEQ ID NO: 3990678 - DNA, 15 bp, Homo sapiens
aggtgtcctgagcac

SEQ ID NO: 3990679 - DNA, 19 bp, Homo sapiens
aggtgtcctgagcaccaca

SEQ ID NO: 3990680 - DNA, 21 bp, Homo sapiens
aggtgtctgcacccaggggtg

SEQ ID NO: 3990681 - DNA, 13 bp, Homo sapiens
aggtgtctggcct

SEQ ID NO: 3990682 - DNA, 15 bp, Homo sapiens
aggtgtctggcctga

SEQ ID NO: 3990683 - DNA, 16 bp, Homo sapiens
aggtgtctggcctgag

SEQ ID NO: 3990684 - DNA, 15 bp, Homo sapiens
aggtgtgagactggg

SEQ ID NO: 3990685 - DNA, 13 bp, Homo sapiens
aggtgtgaggagg

SEQ ID NO: 3990686 - DNA, 15 bp, Homo sapiens
aggtgtgaggcagga

SEQ ID NO: 3990687 - DNA, 15 bp, Homo sapiens
aggtgtgcctggcct

SEQ ID NO: 3990688 - DNA, 16 bp, Homo sapiens
aggtgtgcctggcctc

SEQ ID NO: 3990689 - DNA, 17 bp, Homo sapiens
aggtgtgcctggcctct

SEQ ID NO: 3990690 - DNA, 18 bp, Homo sapiens
aggtgtgcctggcctctg

SEQ ID NO: 3990691 - DNA, 15 bp, Homo sapiens
aggtgttactgtaat

SEQ ID NO: 3990692 - DNA, 17 bp, Homo sapiens
aggtgtttaaagagagg

SEQ ID NO: 3990693 - DNA, 18 bp, Homo sapiens
aggtgtttaaagagaggt

SEQ ID NO: 3990694 - DNA, 16 bp, Homo sapiens
aggtgtttggcaccca

SEQ ID NO: 3990695 - DNA, 18 bp, Homo sapiens
aggttaaacggtgcccat

SEQ ID NO: 3990696 - DNA, 15 bp, Homo sapiens
aggttaataaagtaa

SEQ ID NO: 3990697 - DNA, 16 bp, Homo sapiens
aggttaatatttaaga

SEQ ID NO: 3990698 - DNA, 23 bp, Homo sapiens
aggttaatttttccttcctctgt

SEQ ID NO: 3990699 - DNA, 18 bp, Homo sapiens
aggttaggatttaacagt

SEQ ID NO: 3990700 - DNA, 17 bp, Homo sapiens
aggttataggtcactcc

SEQ ID NO: 3990701 - DNA, 14 bp, Homo sapiens
aggttatcgaaata

SEQ ID NO: 3990702 - DNA, 18 bp, Homo sapiens
aggttatcgaaataacaa

SEQ ID NO: 3990703 - DNA, 19 bp, Homo sapiens
aggttatcgaaataacaat

SEQ ID NO: 3990704 - DNA, 24 bp, Homo sapiens
aggttcactgagctccccagatct

SEQ ID NO: 3990705 - DNA, 16 bp, Homo sapiens
aggttcctctgcctgc

SEQ ID NO: 3990706 - DNA, 19 bp, Homo sapiens
aggttcctctgcctgcccc

SEQ ID NO: 3990707 - DNA, 21 bp, Homo sapiens
aggttcgagacccaaaccccc

SEQ ID NO: 3990708 - DNA, 11 bp, Homo sapiens
aggttctaaaa

SEQ ID NO: 3990709 - DNA, 12 bp, Homo sapiens
aggttctctcta

SEQ ID NO: 3990710 - DNA, 18 bp, Homo sapiens
aggttctgggtgcaggag

SEQ ID NO: 3990711 - DNA, 22 bp, Homo sapiens
aggttctgtttatggccacatt

SEQ ID NO: 3990712 - DNA, 17 bp, Homo sapiens
aggttcttaaaaaggaa

SEQ ID NO: 3990713 - DNA, 19 bp, Homo sapiens
aggttcttaaaaaggaaca

SEQ ID NO: 3990714 - DNA, 15 bp, Homo sapiens
aggttgaactttgcc

SEQ ID NO: 3990715 - DNA, 20 bp, Homo sapiens
aggttggcaaacgggcttga

SEQ ID NO: 3990716 - DNA, 18 bp, Homo sapiens
aggttgggctagagaaat

SEQ ID NO: 3990717 - DNA, 17 bp, Homo sapiens
aggttgtctccaggcca

SEQ ID NO: 3990718 - DNA, 18 bp, Homo sapiens
aggtttggctcctgccca

SEQ ID NO: 3990719 - DNA, 12 bp, Homo sapiens
aggtttgtatat

SEQ ID NO: 3990720 - DNA, 20 bp, Homo sapiens
aggtttgtatattgtcagat

SEQ ID NO: 3990721 - DNA, 16 bp, Homo sapiens
aggtttgtcatcagat

SEQ ID NO: 3990722 - DNA, 23 bp, Homo sapiens
aggtttgtcgggcaccagccagc

SEQ ID NO: 3990723 - DNA, 10 bp, Homo sapiens
aggtttgtga

SEQ ID NO: 3990724 - DNA, 15 bp, Homo sapiens
aggtttgtgttttct

SEQ ID NO: 3990725 - DNA, 21 bp, Homo sapiens
aggttttgcactcttgtttct

SEQ ID NO: 3990726 - DNA, 12 bp, Homo sapiens
aggttttgtatt

SEQ ID NO: 3990727 - DNA, 20 bp, Homo sapiens
aggtttttccttatttgctt

SEQ ID NO: 3990728 - DNA, 22 bp, Homo sapiens
aggtttttgcttctccagtggt

SEQ ID NO: 3990729 - DNA, 16 bp, Homo sapiens
aggttttttttcagtt

SEQ ID NO: 3990730 - DNA, 16 bp, Homo sapiens
agtaaacagggtacct

SEQ ID NO: 3990731 - DNA, 14 bp, Homo sapiens
agtaaactttttgt

SEQ ID NO: 3990732 - DNA, 16 bp, Homo sapiens
agtaaatctcttctgt

SEQ ID NO: 3990733 - DNA, 15 bp, Homo sapiens
agtaaatcttttaca

SEQ ID NO: 3990734 - DNA, 23 bp, Homo sapiens
agtaaatgctaggttaattccaa

SEQ ID NO: 3990735 - DNA, 11 bp, Homo sapiens
agtaaatgtct

SEQ ID NO: 3990736 - DNA, 17 bp, Homo sapiens
agtaaatgtctttgtaa

SEQ ID NO: 3990737 - DNA, 20 bp, Homo sapiens
agtaacaatacaaatggatt

SEQ ID NO: 3990738 - DNA, 14 bp, Homo sapiens
agtaacacaggcca

SEQ ID NO: 3990739 - DNA, 17 bp, Homo sapiens
agtaacatttgctgttt

SEQ ID NO: 3990740 - DNA, 18 bp, Homo sapiens
agtaacgcgtcttcctga

SEQ ID NO: 3990741 - DNA, 17 bp, Homo sapiens
agtaactgttttttaag

SEQ ID NO: 3990742 - DNA, 14 bp, Homo sapiens
agtaagaagacatg

SEQ ID NO: 3990743 - DNA, 23 bp, Homo sapiens
agtaagtgtgtcttcctagaatt

SEQ ID NO: 3990744 - DNA, 14 bp, Homo sapiens
agtaagttaataat

SEQ ID NO: 3990745 - DNA, 15 bp, Homo sapiens
agtaagttaataatg

SEQ ID NO: 3990746 - DNA, 16 bp, Homo sapiens
agtaagttaataatgt

SEQ ID NO: 3990747 - DNA, 22 bp, Homo sapiens
agtaagtttcccctctggcttg

SEQ ID NO: 3990748 - DNA, 13 bp, Homo sapiens
agtaatagagcaa

SEQ ID NO: 3990749 - DNA, 20 bp, Homo sapiens
agtcctgcctggccaggcag

SEQ ID NO: 3990750 - DNA, 15 bp, Homo sapiens
agtcctgctacctcc

SEQ ID NO: 3990751 - DNA, 24 bp, Homo sapiens
agtcctgctacctcccttgccttt

SEQ ID NO: 3990752 - DNA, 13 bp, Homo sapiens
agtcctggctaca

SEQ ID NO: 3990753 - DNA, 22 bp, Homo sapiens
agtcctggctacatcccagcct

SEQ ID NO: 3990754 - DNA, 22 bp, Homo sapiens
agggctggacctatgtcctaag

SEQ ID NO: 3990755 - DNA, 19 bp, Homo sapiens
agggctggaggcccaggct

SEQ ID NO: 3990756 - DNA, 21 bp, Homo sapiens
agggctggaggcccaggctgg

SEQ ID NO: 3990757 - DNA, 18 bp, Homo sapiens
agggctggccccagggca

SEQ ID NO: 3990758 - DNA, 22 bp, Homo sapiens
agggctggccccagggcaccct

SEQ ID NO: 3990759 - DNA, 12 bp, Homo sapiens
agggctggctcc

SEQ ID NO: 3990760 - DNA, 13 bp, Homo sapiens
agggctggctccc

SEQ ID NO: 3990761 - DNA, 13 bp, Homo sapiens
agggctggctggc

SEQ ID NO: 3990762 - DNA, 17 bp, Homo sapiens
agggctggctggcctca

SEQ ID NO: 3990763 - DNA, 11 bp, Homo sapiens
agggctgggga

SEQ ID NO: 3990764 - DNA, 12 bp, Homo sapiens
agggctgggtgt

SEQ ID NO: 3990765 - DNA, 12 bp, Homo sapiens
agggctggtttg

SEQ ID NO: 3990766 - DNA, 15 bp, Homo sapiens
agggctggtttgttc

SEQ ID NO: 3990767 - DNA, 18 bp, Homo sapiens
agggctgtcatctgtgca

SEQ ID NO: 3990768 - DNA, 19 bp, Homo sapiens
agggctgtcatctgtgcac

SEQ ID NO: 3990769 - DNA, 13 bp, Homo sapiens
agggctgtcccag

SEQ ID NO: 3990770 - DNA, 21 bp, Homo sapiens
agggctgtgcttgaaggccct

SEQ ID NO: 3990771 - DNA, 23 bp, Homo sapiens
agggctgtgcttgaaggccctgc

SEQ ID NO: 3990772 - DNA, 16 bp, Homo sapiens
agggctgtgtgaaaca

SEQ ID NO: 3990773 - DNA, 20 bp, Homo sapiens
agggcttcctctagaagcca

SEQ ID NO: 3990774 - DNA, 21 bp, Homo sapiens
agggcttcctctagaagccaa

SEQ ID NO: 3990775 - DNA, 17 bp, Homo sapiens
agggctttgagggtgga

SEQ ID NO: 3990776 - DNA, 22 bp, Homo sapiens
agggctttgagggtggaaggat

SEQ ID NO: 3990777 - DNA, 18 bp, Homo sapiens
agggctttggttccttct

SEQ ID NO: 3990778 - DNA, 20 bp, Homo sapiens
agggctttggttccttctct

SEQ ID NO: 3990779 - DNA, 13 bp, Homo sapiens
aggggaacctgcc

SEQ ID NO: 3990780 - DNA, 15 bp, Homo sapiens
aggggaacctgccat

SEQ ID NO: 3990781 - DNA, 12 bp, Homo sapiens
aggggaaggccc

SEQ ID NO: 3990782 - DNA, 21 bp, Homo sapiens
aggggaaggccctgaggcgga

SEQ ID NO: 3990783 - DNA, 20 bp, Homo sapiens
aggggaatctggaggtagcc

SEQ ID NO: 3990784 - DNA, 14 bp, Homo sapiens
aggggactcagccc

SEQ ID NO: 3990785 - DNA, 22 bp, Homo sapiens
aggggactcagccctgaggtga

SEQ ID NO: 3990786 - DNA, 15 bp, Homo sapiens
aggggagacaggagc

SEQ ID NO: 3990787 - DNA, 18 bp, Homo sapiens
aggggagagacaggcagc

SEQ ID NO: 3990788 - DNA, 19 bp, Homo sapiens
aggggagagctttgtgctt

SEQ ID NO: 3990789 - DNA, 12 bp, Homo sapiens
aggggagccagg

SEQ ID NO: 3990790 - DNA, 12 bp, Homo sapiens
aggggagcccac

SEQ ID NO: 3990791 - DNA, 24 bp, Homo sapiens
aggggagcccactgtcctgggcct

SEQ ID NO: 3990792 - DNA, 13 bp, Homo sapiens
aggggagggcagg

SEQ ID NO: 3990793 - DNA, 17 bp, Homo sapiens
aggggagggggcaaagg

SEQ ID NO: 3990794 - DNA, 17 bp, Homo sapiens
aggggatataggagagg

SEQ ID NO: 3990795 - DNA, 18 bp, Homo sapiens
aggggatataggagagga

SEQ ID NO: 3990796 - DNA, 23 bp, Homo sapiens
aggggatatagtgatggggctca

SEQ ID NO: 3990797 - DNA, 19 bp, Homo sapiens
aggggatggaattcttcct

SEQ ID NO: 3990798 - DNA, 18 bp, Homo sapiens
aggggcaacgaagaaaaa

SEQ ID NO: 3990799 - DNA, 19 bp, Homo sapiens
aggggcacactacagagca

SEQ ID NO: 3990800 - DNA, 13 bp, Homo sapiens
aggggcagcctgc

SEQ ID NO: 3990801 - DNA, 14 bp, Homo sapiens
aggggcatctgccc

SEQ ID NO: 3990802 - DNA, 21 bp, Homo sapiens
aggggcatctgcccctccccc

SEQ ID NO: 3990803 - DNA, 22 bp, Homo sapiens
aggggcatctgcccctccccca

SEQ ID NO: 3990804 - DNA, 22 bp, Homo sapiens
aggggcccaaggcggcccctcc

SEQ ID NO: 3990805 - DNA, 21 bp, Homo sapiens
aggggcccttgggacagccag

SEQ ID NO: 3990806 - DNA, 23 bp, Homo sapiens
aggggcccttgggacagccagag

SEQ ID NO: 3990807 - DNA, 19 bp, Homo sapiens
aggggccttagggcactgg

SEQ ID NO: 3990808 - DNA, 21 bp, Homo sapiens
aggggccttagggcactgggc

SEQ ID NO: 3990809 - DNA, 18 bp, Homo sapiens
aggggcggcaggagggag

SEQ ID NO: 3990810 - DNA, 13 bp, Homo sapiens
aggggctttctct

SEQ ID NO: 3990811 - DNA, 21 bp, Homo sapiens
aggggctttctcttccccttc

SEQ ID NO: 3990812 - DNA, 15 bp, Homo sapiens
agggggaggggaagt

SEQ ID NO: 3990813 - DNA, 16 bp, Homo sapiens
agggggaggggaagtc

SEQ ID NO: 3990814 - DNA, 20 bp, Homo sapiens
agggggagggggttacaaac

SEQ ID NO: 3990815 - DNA, 16 bp, Homo sapiens
agggggattctgagca

SEQ ID NO: 3990816 - DNA, 20 bp, Homo sapiens
agggggcccatccctgccca

SEQ ID NO: 3990817 - DNA, 16 bp, Homo sapiens
agggggcttgaagcca

SEQ ID NO: 3990818 - DNA, 18 bp, Homo sapiens
agggggcttgaagccaaa

SEQ ID NO: 3990819 - DNA, 12 bp, Homo sapiens
aggggggagggg

SEQ ID NO: 3990820 - DNA, 21 bp, Homo sapiens
aggggggttgtgaggcctggc

SEQ ID NO: 3990821 - DNA, 17 bp, Homo sapiens
aggggtaggcagagcct

SEQ ID NO: 3990822 - DNA, 19 bp, Homo sapiens
aggggtaggcagagccttt

SEQ ID NO: 3990823 - DNA, 15 bp, Homo sapiens
aggggtcaggctcca

SEQ ID NO: 3990824 - DNA, 14 bp, Homo sapiens
aggggtctccctgg

SEQ ID NO: 3990825 - DNA, 15 bp, Homo sapiens
aggggtctccctggc

SEQ ID NO: 3990826 - DNA, 18 bp, Homo sapiens
aggggtctccctggctcc

SEQ ID NO: 3990827 - DNA, 21 bp, Homo sapiens
aggggtggggggtgcaggtgg

SEQ ID NO: 3990828 - DNA, 15 bp, Homo sapiens
aggggtgtggctcct

SEQ ID NO: 3990829 - DNA, 15 bp, Homo sapiens
aggggttcgagacca

SEQ ID NO: 3990830 - DNA, 20 bp, Homo sapiens
aggggttcgagaccagtctg

SEQ ID NO: 3990831 - DNA, 19 bp, Homo sapiens
aggggttggtgggagggtt

SEQ ID NO: 3990832 - DNA, 13 bp, Homo sapiens
agggtacagctgg

SEQ ID NO: 3990833 - DNA, 15 bp, Homo sapiens
agggtacagctgggc

SEQ ID NO: 3990834 - DNA, 13 bp, Homo sapiens
agggtacatttat

SEQ ID NO: 3990835 - DNA, 18 bp, Homo sapiens
agggtaccctttggggag

SEQ ID NO: 3990836 - DNA, 19 bp, Homo sapiens
agggtagaatgattaatca

SEQ ID NO: 3990837 - DNA, 21 bp, Homo sapiens
agggtaggaggtttggatggg

SEQ ID NO: 3990838 - DNA, 16 bp, Homo sapiens
agggtcatgtttgcag

SEQ ID NO: 3990839 - DNA, 20 bp, Homo sapiens
agggtcctggctcctgaggg

SEQ ID NO: 3990840 - DNA, 17 bp, Homo sapiens
agggtcggaacccaagc

SEQ ID NO: 3990841 - DNA, 12 bp, Homo sapiens
agggtctctccc

SEQ ID NO: 3990842 - DNA, 13 bp, Homo sapiens
agggtctgctctt

SEQ ID NO: 3990843 - DNA, 21 bp, Homo sapiens
agggtctgctctttctctgcc

SEQ ID NO: 3990844 - DNA, 22 bp, Homo sapiens
agggtctgctctttctctgcca

SEQ ID NO: 3990845 - DNA, 23 bp, Homo sapiens
agggtctgctctttctctgccag

SEQ ID NO: 3990846 - DNA, 15 bp, Homo sapiens
agggtctgtgtgaat

SEQ ID NO: 3990847 - DNA, 19 bp, Homo sapiens
agggtctgtttggactgca

SEQ ID NO: 3990848 - DNA, 21 bp, Homo sapiens
agggtcttgactctaaatgca

SEQ ID NO: 3990849 - DNA, 15 bp, Homo sapiens
agggtgaaaggcagg

SEQ ID NO: 3990850 - DNA, 14 bp, Homo sapiens
agggtgagagctgc

SEQ ID NO: 3990851 - DNA, 20 bp, Homo sapiens
agggtggatgacagggcaga

SEQ ID NO: 3990852 - DNA, 11 bp, Homo sapiens
agggtggccct

SEQ ID NO: 3990853 - DNA, 17 bp, Homo sapiens
agggtgggggagggagg

SEQ ID NO: 3990854 - DNA, 15 bp, Homo sapiens
agggtgtctgccccc

SEQ ID NO: 3990855 - DNA, 20 bp, Homo sapiens
aggctcagagactgcaagct

SEQ ID NO: 3990856 - DNA, 21 bp, Homo sapiens
aggctcagagatgtgcaccca

SEQ ID NO: 3990857 - DNA, 13 bp, Homo sapiens
aggctccaggcag

SEQ ID NO: 3990858 - DNA, 14 bp, Homo sapiens
aggctcctccttgc

SEQ ID NO: 3990859 - DNA, 19 bp, Homo sapiens
aggctcctccttgcccaga

SEQ ID NO: 3990860 - DNA, 15 bp, Homo sapiens
aggctctcaccccca

SEQ ID NO: 3990861 - DNA, 22 bp, Homo sapiens
aggctctctctttctagaggtg

SEQ ID NO: 3990862 - DNA, 23 bp, Homo sapiens
aggctctctctttctagaggtgc

SEQ ID NO: 3990863 - DNA, 15 bp, Homo sapiens
agggtgtggctttcc

SEQ ID NO: 3990864 - DNA, 23 bp, Homo sapiens
agggtgtggctttccaggcaccc

SEQ ID NO: 3990865 - DNA, 12 bp, Homo sapiens
agggtgtgtgct

SEQ ID NO: 3990866 - DNA, 20 bp, Homo sapiens
agggtgtgtttgaaatcatc

SEQ ID NO: 3990867 - DNA, 14 bp, Homo sapiens
agggttaaactgca

SEQ ID NO: 3990868 - DNA, 17 bp, Homo sapiens
agggttaagaaaagaga

SEQ ID NO: 3990869 - DNA, 18 bp, Homo sapiens
agggttcaaaatgtctgt

SEQ ID NO: 3990870 - DNA, 16 bp, Homo sapiens
agggttcatctgtcca

SEQ ID NO: 3990871 - DNA, 23 bp, Homo sapiens
agggttcctgtagacctagggag

SEQ ID NO: 3990872 - DNA, 18 bp, Homo sapiens
agggttgaaaatgtgttt

SEQ ID NO: 3990873 - DNA, 14 bp, Homo sapiens
agggttgatcacac

SEQ ID NO: 3990874 - DNA, 13 bp, Homo sapiens
agggttggcacct

SEQ ID NO: 3990875 - DNA, 14 bp, Homo sapiens
agggttgtgatttt

SEQ ID NO: 3990876 - DNA, 22 bp, Homo sapiens
agggtttgaattgttttcttta

SEQ ID NO: 3990877 - DNA, 18 bp, Homo sapiens
agggttttgcaataactt

SEQ ID NO: 3990878 - DNA, 19 bp, Homo sapiens
agggttttggggtcctggg

SEQ ID NO: 3990879 - DNA, 17 bp, Homo sapiens
aggtaaaagtgtgagca

SEQ ID NO: 3990880 - DNA, 14 bp, Homo sapiens
aggtaacagaacag

SEQ ID NO: 3990881 - DNA, 17 bp, Homo sapiens
aggtaacagaacagctt

SEQ ID NO: 3990882 - DNA, 23 bp, Homo sapiens
aggtaaccttatatttacaataa

SEQ ID NO: 3990883 - DNA, 19 bp, Homo sapiens
aggtaacttattagaaacc

SEQ ID NO: 3990884 - DNA, 13 bp, Homo sapiens
aggtaagctgtgc

SEQ ID NO: 3990885 - DNA, 16 bp, Homo sapiens
aggtaatgtgaataaa

SEQ ID NO: 3990886 - DNA, 19 bp, Homo sapiens
aggtaatgttttgtatata

SEQ ID NO: 3990887 - DNA, 22 bp, Homo sapiens
aggtaatgttttgtatatacag

SEQ ID NO: 3990888 - DNA, 11 bp, Homo sapiens
aggtacagggt

SEQ ID NO: 3990889 - DNA, 15 bp, Homo sapiens
aggtaccacccttca

SEQ ID NO: 3990890 - DNA, 16 bp, Homo sapiens
aggtaccagctgcgct

SEQ ID NO: 3990891 - DNA, 23 bp, Homo sapiens
aggtaccagctgcgcttgctttt

SEQ ID NO: 3990892 - DNA, 17 bp, Homo sapiens
aggtactagaatgctta

SEQ ID NO: 3990893 - DNA, 15 bp, Homo sapiens
aggtactatatttgc

SEQ ID NO: 3990894 - DNA, 14 bp, Homo sapiens
aggtactctcctgg

SEQ ID NO: 3990895 - DNA, 18 bp, Homo sapiens
aggtagaacgccagggac

SEQ ID NO: 3990896 - DNA, 12 bp, Homo sapiens
aggtagcccagc

SEQ ID NO: 3990897 - DNA, 20 bp, Homo sapiens
aggtagcccagcactgtgaa

SEQ ID NO: 3990898 - DNA, 21 bp, Homo sapiens
aggtagcccagcactgtgaag

SEQ ID NO: 3990899 - DNA, 23 bp, Homo sapiens
aggtagcccagcactgtgaagac

SEQ ID NO: 3990900 - DNA, 18 bp, Homo sapiens
aggtagccccctcttccc

SEQ ID NO: 3990901 - DNA, 15 bp, Homo sapiens
aggtagccgggctct

SEQ ID NO: 3990902 - DNA, 16 bp, Homo sapiens
aggtagccgggctctg

SEQ ID NO: 3990903 - DNA, 17 bp, Homo sapiens
aggtagccgggctctgc

SEQ ID NO: 3990904 - DNA, 18 bp, Homo sapiens
aggtagccgggctctgca

SEQ ID NO: 3990905 - DNA, 22 bp, Homo sapiens
aggtagtttggatatttttgta

SEQ ID NO: 3990906 - DNA, 14 bp, Homo sapiens
aggtatatactttg

SEQ ID NO: 3990907 - DNA, 15 bp, Homo sapiens
aggtatctccaggat

SEQ ID NO: 3990908 - DNA, 18 bp, Homo sapiens
aggtatgatctcttctgg

SEQ ID NO: 3990909 - DNA, 17 bp, Homo sapiens
aggtatgcaatcaaatc

SEQ ID NO: 3990910 - DNA, 23 bp, Homo sapiens
aggtatggctctgcacccctctg

SEQ ID NO: 3990911 - DNA, 22 bp, Homo sapiens
aggtattccttttgtgtacagt

SEQ ID NO: 3990912 - DNA, 14 bp, Homo sapiens
aggtatttctccag

SEQ ID NO: 3990913 - DNA, 20 bp, Homo sapiens
aggtattttgtttcttttaa

SEQ ID NO: 3990914 - DNA, 20 bp, Homo sapiens
aggtcaaactaattctcaca

SEQ ID NO: 3990915 - DNA, 21 bp, Homo sapiens
aggtcaaactaattctcacat

SEQ ID NO: 3990916 - DNA, 13 bp, Homo sapiens
aggtcaagggaaa

SEQ ID NO: 3990917 - DNA, 20 bp, Homo sapiens
aggtcaagggcttactattt

SEQ ID NO: 3990918 - DNA, 18 bp, Homo sapiens
aggtcaagtaagaagaca

SEQ ID NO: 3990919 - DNA, 19 bp, Homo sapiens
aggtcaagtaagaagacat

SEQ ID NO: 3990920 - DNA, 22 bp, Homo sapiens
aggtcaagtaagaagacatgaa

SEQ ID NO: 3990921 - DNA, 14 bp, Homo sapiens
aggtcaataaactt

SEQ ID NO: 3990922 - DNA, 14 bp, Homo sapiens
aggtcacagctgga

SEQ ID NO: 3990923 - DNA, 15 bp, Homo sapiens
aggtcaccctttgct

SEQ ID NO: 3990924 - DNA, 18 bp, Homo sapiens
aggtcactcctggggcct

SEQ ID NO: 3990925 - DNA, 19 bp, Homo sapiens
aggtcactcctggggcctc

SEQ ID NO: 3990926 - DNA, 16 bp, Homo sapiens
aggtcactggaaaggg

SEQ ID NO: 3990927 - DNA, 21 bp, Homo sapiens
aggtcactggaaaggggagag

SEQ ID NO: 3990928 - DNA, 15 bp, Homo sapiens
aggtcaggaagcagg

SEQ ID NO: 3990929 - DNA, 16 bp, Homo sapiens
aggtcaggacggctcc

SEQ ID NO: 3990930 - DNA, 15 bp, Homo sapiens
aggtcaggagttcct

SEQ ID NO: 3990931 - DNA, 20 bp, Homo sapiens
aggtcaggagttcctaacca

SEQ ID NO: 3990932 - DNA, 19 bp, Homo sapiens
aggtcagggacttggacag

SEQ ID NO: 3990933 - DNA, 20 bp, Homo sapiens
aggtcagggagtgctggctc

SEQ ID NO: 3990934 - DNA, 21 bp, Homo sapiens
aggtccaaatgtttatgtttt

SEQ ID NO: 3990935 - DNA, 17 bp, Homo sapiens
aggtccaacaagaatgc

SEQ ID NO: 3990936 - DNA, 17 bp, Homo sapiens
aggtccactccctgctc

SEQ ID NO: 3990937 - DNA, 21 bp, Homo sapiens
aggtcccctccacatcccagc

SEQ ID NO: 3990938 - DNA, 22 bp, Homo sapiens
aggtccctgtgtgtaggctggg

SEQ ID NO: 3990939 - DNA, 21 bp, Homo sapiens
aggtcctccgtagggtctttc

SEQ ID NO: 3990940 - DNA, 22 bp, Homo sapiens
aggtcctccgtagggtctttct

SEQ ID NO: 3990941 - DNA, 12 bp, Homo sapiens
aggtcctctcag

SEQ ID NO: 3990942 - DNA, 20 bp, Homo sapiens
aggtcctgcccatgtgtccc

SEQ ID NO: 3990943 - DNA, 21 bp, Homo sapiens
aggtcgttttaaaaacaaaaa

SEQ ID NO: 3990944 - DNA, 13 bp, Homo sapiens
aggtctcacgggc

SEQ ID NO: 3990945 - DNA, 21 bp, Homo sapiens
aggtctccagttggctttact

SEQ ID NO: 3990946 - DNA, 21 bp, Homo sapiens
aggtctcggactaagcctacc

SEQ ID NO: 3990947 - DNA, 15 bp, Homo sapiens
aggtctcttgaggga

SEQ ID NO: 3990948 - DNA, 20 bp, Homo sapiens
aggtcttcatcgaatctact

SEQ ID NO: 3990949 - DNA, 21 bp, Homo sapiens
aggtcttcatcgaatctacta

SEQ ID NO: 3990950 - DNA, 11 bp, Homo sapiens
aggtcttgcta

SEQ ID NO: 3990951 - DNA, 16 bp, Homo sapiens
aggtcttttgacatgt

SEQ ID NO: 3990952 - DNA, 18 bp, Homo sapiens
aggtcttttgacatgtgg

SEQ ID NO: 3990953 - DNA, 16 bp, Homo sapiens
aggtgaaagggagcta

SEQ ID NO: 3990954 - DNA, 21 bp, Homo sapiens
aggtgaaagggagctatcagg

SEQ ID NO: 3990955 - DNA, 15 bp, Homo sapiens
aggtgagaaaaaaac

SEQ ID NO: 3990956 - DNA, 14 bp, Homo sapiens
aggtgagagtggga

SEQ ID NO: 3990957 - DNA, 23 bp, Homo sapiens
aggtgcacttggggcacagggag

SEQ ID NO: 3990958 - DNA, 21 bp, Homo sapiens
aggtgcatctggggaactaga

SEQ ID NO: 3990959 - DNA, 23 bp, Homo sapiens
aggtgcatgcatgccctctctga

SEQ ID NO: 3990960 - DNA, 20 bp, Homo sapiens
aggtgcgcgccaccgtgcct

SEQ ID NO: 3990961 - DNA, 23 bp, Homo sapiens
aggtgcgcgccaccgtgcctggc

SEQ ID NO: 3990962 - DNA, 23 bp, Homo sapiens
aggtgctaaatggtcgcccagga

SEQ ID NO: 3990963 - DNA, 17 bp, Homo sapiens
aggtgctgacggccagg

SEQ ID NO: 3990964 - DNA, 15 bp, Homo sapiens
aggtggaagaaggga

SEQ ID NO: 3990965 - DNA, 19 bp, Homo sapiens
agattgaggcctgccctca

SEQ ID NO: 3990966 - DNA, 22 bp, Homo sapiens
agattgagtataaaaacttgaa

SEQ ID NO: 3990967 - DNA, 21 bp, Homo sapiens
agattgcagaaaattctgtgc

SEQ ID NO: 3990968 - DNA, 18 bp, Homo sapiens
agattgggttggaatgct

SEQ ID NO: 3990969 - DNA, 23 bp, Homo sapiens
agattgtcttgcaacttcagttt

SEQ ID NO: 3990970 - DNA, 19 bp, Homo sapiens
agattgtttcctcttccaa

SEQ ID NO: 3990971 - DNA, 11 bp, Homo sapiens
agatttaagca

SEQ ID NO: 3990972 - DNA, 19 bp, Homo sapiens
agatttaagcacaaacttt

SEQ ID NO: 3990973 - DNA, 17 bp, Homo sapiens
agatttatataaatgta

SEQ ID NO: 3990974 - DNA, 12 bp, Homo sapiens
agatttcaagat

SEQ ID NO: 3990975 - DNA, 12 bp, Homo sapiens
agatttcatagt

SEQ ID NO: 3990976 - DNA, 20 bp, Homo sapiens
agatttcatagttcagaatt

SEQ ID NO: 3990977 - DNA, 19 bp, Homo sapiens
agatttctggttgatttgt

SEQ ID NO: 3990978 - DNA, 22 bp, Homo sapiens
agatttgtaggaaggtctcatt

SEQ ID NO: 3990979 - DNA, 14 bp, Homo sapiens
agattttaaagaca

SEQ ID NO: 3990980 - DNA, 21 bp, Homo sapiens
agattttaattttgaataaat

SEQ ID NO: 3990981 - DNA, 17 bp, Homo sapiens
agattttacaaaagatg

SEQ ID NO: 3990982 - DNA, 19 bp, Homo sapiens
agattttacaaaagatgta

SEQ ID NO: 3990983 - DNA, 19 bp, Homo sapiens
agattttcctcagattaga

SEQ ID NO: 3990984 - DNA, 23 bp, Homo sapiens
agattttgttttgttggacattt

SEQ ID NO: 3990985 - DNA, 13 bp, Homo sapiens
agatttttaagaa

SEQ ID NO: 3990986 - DNA, 13 bp, Homo sapiens
agatttttctcaa

SEQ ID NO: 3990987 - DNA, 16 bp, Homo sapiens
agattttttattgcta

SEQ ID NO: 3990988 - DNA, 23 bp, Homo sapiens
agattttttattgctagtatttg

SEQ ID NO: 3990989 - DNA, 14 bp, Homo sapiens
agatttttttcctg

SEQ ID NO: 3990990 - DNA, 23 bp, Homo sapiens
agcaaaaaaaaaaaaaagcatct

SEQ ID NO: 3990991 - DNA, 13 bp, Homo sapiens
agcaaaaaatgaa

SEQ ID NO: 3990992 - DNA, 12 bp, Homo sapiens
agcaaaacaaaa

SEQ ID NO: 3990993 - DNA, 11 bp, Homo sapiens
agcaaaaggca

SEQ ID NO: 3990994 - DNA, 15 bp, Homo sapiens
agcaaaaggcagctc

SEQ ID NO: 3990995 - DNA, 17 bp, Homo sapiens
agcaaaaggcagctcac

SEQ ID NO: 3990996 - DNA, 22 bp, Homo sapiens
agcaaaaggcagctcacccctg

SEQ ID NO: 3990997 - DNA, 17 bp, Homo sapiens
agcaaaataaggaagag

SEQ ID NO: 3990998 - DNA, 13 bp, Homo sapiens
agcaaaattgatg

SEQ ID NO: 3990999 - DNA, 11 bp, Homo sapiens
agcaaaccaat

SEQ ID NO: 3991000 - DNA, 17 bp, Homo sapiens
agcaaaccatttttaaa

SEQ ID NO: 3991001 - DNA, 12 bp, Homo sapiens
agcaaagagtgg

SEQ ID NO: 3991002 - DNA, 22 bp, Homo sapiens
agcaaagagtgggctgcatctg

SEQ ID NO: 3991003 - DNA, 14 bp, Homo sapiens
agcaaagatcaaaa

SEQ ID NO: 3991004 - DNA, 17 bp, Homo sapiens
agcaaagatcaaaataa

SEQ ID NO: 3991005 - DNA, 21 bp, Homo sapiens
agcaaagctgatgacaacttc

SEQ ID NO: 3991006 - DNA, 16 bp, Homo sapiens
agcaaatgcattctat

SEQ ID NO: 3991007 - DNA, 22 bp, Homo sapiens
agcaaatgcattctatcgttat

SEQ ID NO: 3991008 - DNA, 17 bp, Homo sapiens
agcaacacaagctggaa

SEQ ID NO: 3991009 - DNA, 15 bp, Homo sapiens
agcaacacagaggaa

SEQ ID NO: 3991010 - DNA, 17 bp, Homo sapiens
agcaacagcaagaaata

SEQ ID NO: 3991011 - DNA, 22 bp, Homo sapiens
agcaacaggaatcaagagctgc

SEQ ID NO: 3991012 - DNA, 18 bp, Homo sapiens
agcaacaggttttataat

SEQ ID NO: 3991013 - DNA, 13 bp, Homo sapiens
agcaacatttgta

SEQ ID NO: 3991014 - DNA, 14 bp, Homo sapiens
agcaacatttgtat

SEQ ID NO: 3991015 - DNA, 19 bp, Homo sapiens
agcagaggcaggctgggac

SEQ ID NO: 3991016 - DNA, 18 bp, Homo sapiens
agcagagggactttgtat

SEQ ID NO: 3991017 - DNA, 14 bp, Homo sapiens
agcagagggggagt

SEQ ID NO: 3991018 - DNA, 13 bp, Homo sapiens
agcagaggtctcc

SEQ ID NO: 3991019 - DNA, 14 bp, Homo sapiens
agcagagtctgggc

SEQ ID NO: 3991020 - DNA, 19 bp, Homo sapiens
agcagatacctcaccctgc

SEQ ID NO: 3991021 - DNA, 13 bp, Homo sapiens
agcagatgcagag

SEQ ID NO: 3991022 - DNA, 16 bp, Homo sapiens
agcagatgcagagagc

SEQ ID NO: 3991023 - DNA, 17 bp, Homo sapiens
agcagatgcagagagcc

SEQ ID NO: 3991024 - DNA, 13 bp, Homo sapiens
agcagcaactgaa

SEQ ID NO: 3991025 - DNA, 14 bp, Homo sapiens
agcagcaaggtctt

SEQ ID NO: 3991026 - DNA, 18 bp, Homo sapiens
agcagcaccaaccacagc

SEQ ID NO: 3991027 - DNA, 18 bp, Homo sapiens
agcagcaccgttctgtgc

SEQ ID NO: 3991028 - DNA, 19 bp, Homo sapiens
agcagcaccgttctgtgca

SEQ ID NO: 3991029 - DNA, 13 bp, Homo sapiens
agcagcacctcct

SEQ ID NO: 3991030 - DNA, 23 bp, Homo sapiens
agcagcactccgcatcacctcac

SEQ ID NO: 3991031 - DNA, 13 bp, Homo sapiens
agcagcagcacca

SEQ ID NO: 3991032 - DNA, 19 bp, Homo sapiens
agcagcagcttggggagag

SEQ ID NO: 3991033 - DNA, 14 bp, Homo sapiens
agcagcagggtttt

SEQ ID NO: 3991034 - DNA, 10 bp, Homo sapiens
agcagccacg

SEQ ID NO: 3991035 - DNA, 13 bp, Homo sapiens
agcagccagctcc

SEQ ID NO: 3991036 - DNA, 18 bp, Homo sapiens
agcagccccgtctgccca

SEQ ID NO: 3991037 - DNA, 20 bp, Homo sapiens
agcagccctcaacaggccca

SEQ ID NO: 3991038 - DNA, 12 bp, Homo sapiens
agcagccgccag

SEQ ID NO: 3991039 - DNA, 19 bp, Homo sapiens
agcagccgccagctgggag

SEQ ID NO: 3991040 - DNA, 21 bp, Homo sapiens
agcagccgccttaagctgatc

SEQ ID NO: 3991041 - DNA, 14 bp, Homo sapiens
agcagcctcagagt

SEQ ID NO: 3991042 - DNA, 14 bp, Homo sapiens
agcagcctctggac

SEQ ID NO: 3991043 - DNA, 21 bp, Homo sapiens
agcagcctctggacagccagt

SEQ ID NO: 3991044 - DNA, 20 bp, Homo sapiens
agcagctaaaccaaggactg

SEQ ID NO: 3991045 - DNA, 11 bp, Homo sapiens
agcagctacca

SEQ ID NO: 3991046 - DNA, 20 bp, Homo sapiens
agcagctagaaaacattttt

SEQ ID NO: 3991047 - DNA, 22 bp, Homo sapiens
agcagctccctttctcaggagc

SEQ ID NO: 3991048 - DNA, 19 bp, Homo sapiens
agcagctgaagaaaaaatc

SEQ ID NO: 3991049 - DNA, 18 bp, Homo sapiens
agcagcttcaccagagca

SEQ ID NO: 3991050 - DNA, 17 bp, Homo sapiens
agcagctttaaacaaat

SEQ ID NO: 3991051 - DNA, 22 bp, Homo sapiens
agcagctttaaactcagggaca

SEQ ID NO: 3991052 - DNA, 21 bp, Homo sapiens
agcaggacctactaggagagg

SEQ ID NO: 3991053 - DNA, 12 bp, Homo sapiens
agcaggacctgg

SEQ ID NO: 3991054 - DNA, 19 bp, Homo sapiens
agcaggactccaggcccaa

SEQ ID NO: 3991055 - DNA, 21 bp, Homo sapiens
agcaggagagactgagcagcc

SEQ ID NO: 3991056 - DNA, 17 bp, Homo sapiens
agcaggagccccgccac

SEQ ID NO: 3991057 - DNA, 17 bp, Homo sapiens
agcaggaggccaataaa

SEQ ID NO: 3991058 - DNA, 18 bp, Homo sapiens
agcaggaggccaataaaa

SEQ ID NO: 3991059 - DNA, 20 bp, Homo sapiens
agcaggaggccaataaaaag

SEQ ID NO: 3991060 - DNA, 21 bp, Homo sapiens
agcaggaggccaataaaaagt

SEQ ID NO: 3991061 - DNA, 13 bp, Homo sapiens
agcaggagtggtg

SEQ ID NO: 3991062 - DNA, 18 bp, Homo sapiens
agcaggagtggtgcagac

SEQ ID NO: 3991063 - DNA, 21 bp, Homo sapiens
agcaggagtggtgcagacaga

SEQ ID NO: 3991064 - DNA, 17 bp, Homo sapiens
agcaggcaaaaaaggga

SEQ ID NO: 3991065 - DNA, 20 bp, Homo sapiens
agcaggcaaaaaagggacag

SEQ ID NO: 3991066 - DNA, 22 bp, Homo sapiens
agcaggcaaaaaagggacagca

SEQ ID NO: 3991067 - DNA, 14 bp, Homo sapiens
agcaggcagcgcca

SEQ ID NO: 3991068 - DNA, 15 bp, Homo sapiens
agcaggccggaacca

SEQ ID NO: 3991069 - DNA, 18 bp, Homo sapiens
agcaggccggaaccacag

SEQ ID NO: 3991070 - DNA, 22 bp, Homo sapiens
agcaggccggaaccacagggcc

SEQ ID NO: 3991071 - DNA, 20 bp, Homo sapiens
aggcactgccttctcctctc

SEQ ID NO: 3991072 - DNA, 16 bp, Homo sapiens
aggcacttctgcctga

SEQ ID NO: 3991073 - DNA, 22 bp, Homo sapiens
aggcactttagggctgtaaaat

SEQ ID NO: 3991074 - DNA, 23 bp, Homo sapiens
aggcagacagcaggcagcgccaa

SEQ ID NO: 3991075 - DNA, 18 bp, Homo sapiens
aggcagactacacaggat

SEQ ID NO: 3991076 - DNA, 13 bp, Homo sapiens
aggcagagaaaga

SEQ ID NO: 3991077 - DNA, 14 bp, Homo sapiens
aggcagagaatcat

SEQ ID NO: 3991078 - DNA, 22 bp, Homo sapiens
aggcagagaatcatacttagca

SEQ ID NO: 3991079 - DNA, 19 bp, Homo sapiens
aggcagagtttgccttcct

SEQ ID NO: 3991080 - DNA, 16 bp, Homo sapiens
aggcagatccaggact

SEQ ID NO: 3991081 - DNA, 16 bp, Homo sapiens
aggcagatctgtgccc

SEQ ID NO: 3991082 - DNA, 20 bp, Homo sapiens
aggcagatctgtgccccatg

SEQ ID NO: 3991083 - DNA, 21 bp, Homo sapiens
aggcagatctgtgccccatgc

SEQ ID NO: 3991084 - DNA, 23 bp, Homo sapiens
aggcagatctgtgccccatgcct

SEQ ID NO: 3991085 - DNA, 17 bp, Homo sapiens
aggcagattgaaaagga

SEQ ID NO: 3991086 - DNA, 13 bp, Homo sapiens
aggcagcagagag

SEQ ID NO: 3991087 - DNA, 13 bp, Homo sapiens
aggcagcctccag

SEQ ID NO: 3991088 - DNA, 21 bp, Homo sapiens
aggcagcctccagcctgccca

SEQ ID NO: 3991089 - DNA, 14 bp, Homo sapiens
aggcagcgggatct

SEQ ID NO: 3991090 - DNA, 13 bp, Homo sapiens
aggcagctcaccc

SEQ ID NO: 3991091 - DNA, 17 bp, Homo sapiens
aggcagctcacccctgg

SEQ ID NO: 3991092 - DNA, 22 bp, Homo sapiens
aggcagctcacccctgggcagg

SEQ ID NO: 3991093 - DNA, 21 bp, Homo sapiens
aggcagctgttgtctcttctc

SEQ ID NO: 3991094 - DNA, 20 bp, Homo sapiens
aggcagcttcaagtgccttt

SEQ ID NO: 3991095 - DNA, 16 bp, Homo sapiens
aggcaggaagggcagg

SEQ ID NO: 3991096 - DNA, 18 bp, Homo sapiens
aggcaggagaatggtgtg

SEQ ID NO: 3991097 - DNA, 15 bp, Homo sapiens
aggcaggagagacag

SEQ ID NO: 3991098 - DNA, 23 bp, Homo sapiens
aggcaggcattgaggaagagtct

SEQ ID NO: 3991099 - DNA, 21 bp, Homo sapiens
aggcaggccaaggccttctcc

SEQ ID NO: 3991100 - DNA, 17 bp, Homo sapiens
aggcaggctgggacgga

SEQ ID NO: 3991101 - DNA, 18 bp, Homo sapiens
aggcaggggccctgcagc

SEQ ID NO: 3991102 - DNA, 15 bp, Homo sapiens
aggcaggtgcctgga

SEQ ID NO: 3991103 - DNA, 17 bp, Homo sapiens
aggcagtagatgtgctt

SEQ ID NO: 3991104 - DNA, 22 bp, Homo sapiens
aggcatagaggcttctccgcca

SEQ ID NO: 3991105 - DNA, 19 bp, Homo sapiens
aggcataggcctgggtgct

SEQ ID NO: 3991106 - DNA, 17 bp, Homo sapiens
aggcatcccagcctggg

SEQ ID NO: 3991107 - DNA, 18 bp, Homo sapiens
aggcatcccagcctgggg

SEQ ID NO: 3991108 - DNA, 20 bp, Homo sapiens
aggcatcccagcctgggggc

SEQ ID NO: 3991109 - DNA, 23 bp, Homo sapiens
aggcatctacacagcctggactt

SEQ ID NO: 3991110 - DNA, 22 bp, Homo sapiens
aggcatctctgtactttgcttg

SEQ ID NO: 3991111 - DNA, 19 bp, Homo sapiens
aggcatgaaattcttccta

SEQ ID NO: 3991112 - DNA, 13 bp, Homo sapiens
aggcatgcacatc

SEQ ID NO: 3991113 - DNA, 12 bp, Homo sapiens
aggcatggccct

SEQ ID NO: 3991114 - DNA, 15 bp, Homo sapiens
aggcatggccctggg

SEQ ID NO: 3991115 - DNA, 16 bp, Homo sapiens
aggcatgggcttgctg

SEQ ID NO: 3991116 - DNA, 19 bp, Homo sapiens
aggcatgggtgcaaggaaa

SEQ ID NO: 3991117 - DNA, 20 bp, Homo sapiens
aggcatgggtgcaaggaaaa

SEQ ID NO: 3991118 - DNA, 21 bp, Homo sapiens
aggcatgggtgcaaggaaaat

SEQ ID NO: 3991119 - DNA, 13 bp, Homo sapiens
aggcattaatgtt

SEQ ID NO: 3991120 - DNA, 20 bp, Homo sapiens
aggcattgttagtttagtgt

SEQ ID NO: 3991121 - DNA, 20 bp, Homo sapiens
aggcatttctatcacatatt

SEQ ID NO: 3991122 - DNA, 21 bp, Homo sapiens
aggcatttgcagggtcctctt

SEQ ID NO: 3991123 - DNA, 16 bp, Homo sapiens
aggccaaactgtccct

SEQ ID NO: 3991124 - DNA, 20 bp, Homo sapiens
aggccaaactgtccctccct

SEQ ID NO: 3991125 - DNA, 13 bp, Homo sapiens
aggccaagaggtt

SEQ ID NO: 3991126 - DNA, 23 bp, Homo sapiens
aggccaagtccgcagaagccctg

SEQ ID NO: 3991127 - DNA, 12 bp, Homo sapiens
aggccaataaaa

SEQ ID NO: 3991128 - DNA, 22 bp, Homo sapiens
aggccacacgcactggtgccaa

SEQ ID NO: 3991129 - DNA, 18 bp, Homo sapiens
aggccacactcagcacaa

SEQ ID NO: 3991130 - DNA, 13 bp, Homo sapiens
aggccaccaggat

SEQ ID NO: 3991131 - DNA, 20 bp, Homo sapiens
aggccaccccctatcctctg

SEQ ID NO: 3991132 - DNA, 20 bp, Homo sapiens
aggccaccctgtgcagaagg

SEQ ID NO: 3991133 - DNA, 18 bp, Homo sapiens
aggccaccgggacagacc

SEQ ID NO: 3991134 - DNA, 19 bp, Homo sapiens
aggccaccgggacagacct

SEQ ID NO: 3991135 - DNA, 20 bp, Homo sapiens
aggccaccgggacagacctg

SEQ ID NO: 3991136 - DNA, 17 bp, Homo sapiens
aggccagagtggcctgg

SEQ ID NO: 3991137 - DNA, 20 bp, Homo sapiens
aggccagagtggcctggcca

SEQ ID NO: 3991138 - DNA, 21 bp, Homo sapiens
aggccagagtggcctggccag

SEQ ID NO: 3991139 - DNA, 19 bp, Homo sapiens
aggccagcaacattggcac

SEQ ID NO: 3991140 - DNA, 13 bp, Homo sapiens
aggccagcaacgc

SEQ ID NO: 3991141 - DNA, 14 bp, Homo sapiens
aggccagcaacgct

SEQ ID NO: 3991142 - DNA, 17 bp, Homo sapiens
aggccagcaacgcttgt

SEQ ID NO: 3991143 - DNA, 12 bp, Homo sapiens
aggccagcccag

SEQ ID NO: 3991144 - DNA, 15 bp, Homo sapiens
aggccagcccagcca

SEQ ID NO: 3991145 - DNA, 14 bp, Homo sapiens
aggccagcctccga

SEQ ID NO: 3991146 - DNA, 22 bp, Homo sapiens
aggccagcctccgagagggaga

SEQ ID NO: 3991147 - DNA, 23 bp, Homo sapiens
aggccagcctccgagagggagag

SEQ ID NO: 3991148 - DNA, 11 bp, Homo sapiens
aggccaggagt

SEQ ID NO: 3991149 - DNA, 18 bp, Homo sapiens
aggccaggccaccaggat

SEQ ID NO: 3991150 - DNA, 20 bp, Homo sapiens
aggccagtccccatttctgc

SEQ ID NO: 3991151 - DNA, 22 bp, Homo sapiens
aggccagtgggcgggccatgag

SEQ ID NO: 3991152 - DNA, 16 bp, Homo sapiens
aggccatctcaggaga

SEQ ID NO: 3991153 - DNA, 18 bp, Homo sapiens
aggccatctcaggagatg

SEQ ID NO: 3991154 - DNA, 21 bp, Homo sapiens
aggccatctgggctcctccag

SEQ ID NO: 3991155 - DNA, 22 bp, Homo sapiens
aggccatctgggctcctccagg

SEQ ID NO: 3991156 - DNA, 15 bp, Homo sapiens
agcctgagtctcctg

SEQ ID NO: 3991157 - DNA, 16 bp, Homo sapiens
agcctgccccagcgct

SEQ ID NO: 3991158 - DNA, 18 bp, Homo sapiens
agcctgcccgctgcaatg

SEQ ID NO: 3991159 - DNA, 13 bp, Homo sapiens
agcctgcctggag

SEQ ID NO: 3991160 - DNA, 15 bp, Homo sapiens
agcctgcctggagcg

SEQ ID NO: 3991161 - DNA, 17 bp, Homo sapiens
agcctgctgagagcccc

SEQ ID NO: 3991162 - DNA, 20 bp, Homo sapiens
agcctgctgcccaggctgtg

SEQ ID NO: 3991163 - DNA, 11 bp, Homo sapiens
agcctgctgga

SEQ ID NO: 3991164 - DNA, 19 bp, Homo sapiens
agcctgctggaagcccagc

SEQ ID NO: 3991165 - DNA, 18 bp, Homo sapiens
agcctggaaacctgtctg

SEQ ID NO: 3991166 - DNA, 14 bp, Homo sapiens
agcctggactctgc

SEQ ID NO: 3991167 - DNA, 16 bp, Homo sapiens
agcctggactctgccc

SEQ ID NO: 3991168 - DNA, 17 bp, Homo sapiens
agcctggactctgcccc

SEQ ID NO: 3991169 - DNA, 13 bp, Homo sapiens
agcctggactttg

SEQ ID NO: 3991170 - DNA, 14 bp, Homo sapiens
agcctggactttgg

SEQ ID NO: 3991171 - DNA, 20 bp, Homo sapiens
agcctggcacagggcagtgg

SEQ ID NO: 3991172 - DNA, 14 bp, Homo sapiens
agcctggccaccag

SEQ ID NO: 3991173 - DNA, 23 bp, Homo sapiens
agcctggccaccagccatcctcc

SEQ ID NO: 3991174 - DNA, 16 bp, Homo sapiens
agcctggccagacaca

SEQ ID NO: 3991175 - DNA, 18 bp, Homo sapiens
agcctggccccaggcccc

SEQ ID NO: 3991176 - DNA, 15 bp, Homo sapiens
agcctgggagcccag

SEQ ID NO: 3991177 - DNA, 18 bp, Homo sapiens
agcctgggagcccagagg

SEQ ID NO: 3991178 - DNA, 17 bp, Homo sapiens
agcctgggcaacagagc

SEQ ID NO: 3991179 - DNA, 20 bp, Homo sapiens
agcctgggcaacagagcaag

SEQ ID NO: 3991180 - DNA, 17 bp, Homo sapiens
agcctgggcagccaggc

SEQ ID NO: 3991181 - DNA, 22 bp, Homo sapiens
agcctggggagggggtcattgt

SEQ ID NO: 3991182 - DNA, 17 bp, Homo sapiens
agcctggggcaaaccta

SEQ ID NO: 3991183 - DNA, 13 bp, Homo sapiens
agcctgggggcca

SEQ ID NO: 3991184 - DNA, 15 bp, Homo sapiens
agcctggggtctgga

SEQ ID NO: 3991185 - DNA, 15 bp, Homo sapiens
agcctggtgctgctg

SEQ ID NO: 3991186 - DNA, 18 bp, Homo sapiens
agcctggtttttctcaat

SEQ ID NO: 3991187 - DNA, 17 bp, Homo sapiens
agcctgtaagcctgcaa

SEQ ID NO: 3991188 - DNA, 15 bp, Homo sapiens
agcctgtgcctccca

SEQ ID NO: 3991189 - DNA, 19 bp, Homo sapiens
agcctgtggttacagtgca

SEQ ID NO: 3991190 - DNA, 17 bp, Homo sapiens
agcctgttcccctcact

SEQ ID NO: 3991191 - DNA, 16 bp, Homo sapiens
agccttaagctgcagg

SEQ ID NO: 3991192 - DNA, 15 bp, Homo sapiens
agccttacatttgtg

SEQ ID NO: 3991193 - DNA, 15 bp, Homo sapiens
agccttagctgccag

SEQ ID NO: 3991194 - DNA, 14 bp, Homo sapiens
agccttagggaagc

SEQ ID NO: 3991195 - DNA, 18 bp, Homo sapiens
agccttataaaccaatct

SEQ ID NO: 3991196 - DNA, 19 bp, Homo sapiens
agccttcaaaaagagagat

SEQ ID NO: 3991197 - DNA, 20 bp, Homo sapiens
agccttcagagtacgtcctg

SEQ ID NO: 3991198 - DNA, 23 bp, Homo sapiens
agccttcagtcttgaatttctaa

SEQ ID NO: 3991199 - DNA, 18 bp, Homo sapiens
agccttccaactagctgg

SEQ ID NO: 3991200 - DNA, 12 bp, Homo sapiens
agccttcggaca

SEQ ID NO: 3991201 - DNA, 19 bp, Homo sapiens
agccttctgagctggcctc

SEQ ID NO: 3991202 - DNA, 15 bp, Homo sapiens
agccttctgatgtct

SEQ ID NO: 3991203 - DNA, 19 bp, Homo sapiens
agccttgagccctggctgt

SEQ ID NO: 3991204 - DNA, 19 bp, Homo sapiens
agccttgccagagatccaa

SEQ ID NO: 3991205 - DNA, 12 bp, Homo sapiens
agccttgctcat

SEQ ID NO: 3991206 - DNA, 19 bp, Homo sapiens
agccttggcctctttcctc

SEQ ID NO: 3991207 - DNA, 16 bp, Homo sapiens
agccttgtaattctaa

SEQ ID NO: 3991208 - DNA, 15 bp, Homo sapiens
agccttgtccccctc

SEQ ID NO: 3991209 - DNA, 14 bp, Homo sapiens
agcctttaatgcat

SEQ ID NO: 3991210 - DNA, 20 bp, Homo sapiens
agcctttagtatcagtgttt

SEQ ID NO: 3991211 - DNA, 22 bp, Homo sapiens
agcctttatggctgctgggctg

SEQ ID NO: 3991212 - DNA, 15 bp, Homo sapiens
agcctttctctcttt

SEQ ID NO: 3991213 - DNA, 23 bp, Homo sapiens
agcctttctctctttatacagct

SEQ ID NO: 3991214 - DNA, 15 bp, Homo sapiens
agcctttgcctcccc

SEQ ID NO: 3991215 - DNA, 20 bp, Homo sapiens
agcctttggatgaccagaac

SEQ ID NO: 3991216 - DNA, 19 bp, Homo sapiens
agcctttggttctggccag

SEQ ID NO: 3991217 - DNA, 17 bp, Homo sapiens
agccttttatctgcaga

SEQ ID NO: 3991218 - DNA, 14 bp, Homo sapiens
agcgaaacacagag

SEQ ID NO: 3991219 - DNA, 20 bp, Homo sapiens
agcttctgcttttctgccct

SEQ ID NO: 3991220 - DNA, 22 bp, Homo sapiens
agcttctgcttttctgccctgg

SEQ ID NO: 3991221 - DNA, 13 bp, Homo sapiens
agcttcttaatta

SEQ ID NO: 3991222 - DNA, 19 bp, Homo sapiens
agcttcttaattaatttga

SEQ ID NO: 3991223 - DNA, 15 bp, Homo sapiens
agcttcttcagagtg

SEQ ID NO: 3991224 - DNA, 16 bp, Homo sapiens
agcttcttctgaaaga

SEQ ID NO: 3991225 - DNA, 16 bp, Homo sapiens
agcttcttgtttcctt

SEQ ID NO: 3991226 - DNA, 17 bp, Homo sapiens
agcttcttgtttccttg

SEQ ID NO: 3991227 - DNA, 18 bp, Homo sapiens
agcttcttgtttccttgt

SEQ ID NO: 3991228 - DNA, 21 bp, Homo sapiens
agcttgagccgggcccctggg

SEQ ID NO: 3991229 - DNA, 23 bp, Homo sapiens
agcttgagccgggcccctgggct

SEQ ID NO: 3991230 - DNA, 17 bp, Homo sapiens
agcttggccctttcctt

SEQ ID NO: 3991231 - DNA, 18 bp, Homo sapiens
agcttggctctcctctgg

SEQ ID NO: 3991232 - DNA, 20 bp, Homo sapiens
agcttggctctcctctggct

SEQ ID NO: 3991233 - DNA, 21 bp, Homo sapiens
agcttgggcagtgccccaggg

SEQ ID NO: 3991234 - DNA, 18 bp, Homo sapiens
agcttggggaacccatga

SEQ ID NO: 3991235 - DNA, 14 bp, Homo sapiens
agcttggggagagg

SEQ ID NO: 3991236 - DNA, 19 bp, Homo sapiens
agcttgtgctcctcttgat

SEQ ID NO: 3991237 - DNA, 15 bp, Homo sapiens
agcttgtgtcctgtc

SEQ ID NO: 3991238 - DNA, 18 bp, Homo sapiens
agctttaaaaagaaaaaa

SEQ ID NO: 3991239 - DNA, 21 bp, Homo sapiens
agctttaaactcagggacaga

SEQ ID NO: 3991240 - DNA, 18 bp, Homo sapiens
agctttaccctcaggcat

SEQ ID NO: 3991241 - DNA, 20 bp, Homo sapiens
agctttaccctcaggcatag

SEQ ID NO: 3991242 - DNA, 18 bp, Homo sapiens
agctttatgttcatttgt

SEQ ID NO: 3991243 - DNA, 14 bp, Homo sapiens
agctttattcttca

SEQ ID NO: 3991244 - DNA, 19 bp, Homo sapiens
aggacagaaggctcctgcc

SEQ ID NO: 3991245 - DNA, 21 bp, Homo sapiens
aggacagaaggctcctgcccc

SEQ ID NO: 3991246 - DNA, 21 bp, Homo sapiens
aggacagagttcacaggaggc

SEQ ID NO: 3991247 - DNA, 19 bp, Homo sapiens
aggacaggaagctggcaga

SEQ ID NO: 3991248 - DNA, 21 bp, Homo sapiens
aggacaggaggaggagatggc

SEQ ID NO: 3991249 - DNA, 12 bp, Homo sapiens
aggacaggaggc

SEQ ID NO: 3991250 - DNA, 20 bp, Homo sapiens
aggacaggaggcggcccggc

SEQ ID NO: 3991251 - DNA, 17 bp, Homo sapiens
aggacatactgcatgta

SEQ ID NO: 3991252 - DNA, 15 bp, Homo sapiens
aggacatcagcaaac

SEQ ID NO: 3991253 - DNA, 22 bp, Homo sapiens
aggacatgcggtagccagcaca

SEQ ID NO: 3991254 - DNA, 13 bp, Homo sapiens
aggacattgcccc

SEQ ID NO: 3991255 - DNA, 17 bp, Homo sapiens
aggacattgccccaaga

SEQ ID NO: 3991256 - DNA, 19 bp, Homo sapiens
aggacattgccccaagata

SEQ ID NO: 3991257 - DNA, 15 bp, Homo sapiens
aggacatttcccagg

SEQ ID NO: 3991258 - DNA, 16 bp, Homo sapiens
aggaccactcctgtac

SEQ ID NO: 3991259 - DNA, 15 bp, Homo sapiens
aggaccagctcagga

SEQ ID NO: 3991260 - DNA, 12 bp, Homo sapiens
aggaccaggact

SEQ ID NO: 3991261 - DNA, 23 bp, Homo sapiens
aggaccaggactatagcccaggt

SEQ ID NO: 3991262 - DNA, 18 bp, Homo sapiens
aggaccaggactccctcc

SEQ ID NO: 3991263 - DNA, 19 bp, Homo sapiens
aggaccaggactccctcct

SEQ ID NO: 3991264 - DNA, 22 bp, Homo sapiens
aggacccccgaggggagggcag

SEQ ID NO: 3991265 - DNA, 23 bp, Homo sapiens
aggacccccgaggggagggcagg

SEQ ID NO: 3991266 - DNA, 17 bp, Homo sapiens
aggacccggaggggcct

SEQ ID NO: 3991267 - DNA, 18 bp, Homo sapiens
aggacccggaggggcctg

SEQ ID NO: 3991268 - DNA, 22 bp, Homo sapiens
aggacccggaggggcctggcag

SEQ ID NO: 3991269 - DNA, 22 bp, Homo sapiens
aggacctgaccctactcccttg

SEQ ID NO: 3991270 - DNA, 17 bp, Homo sapiens
aggacctggctgccata

SEQ ID NO: 3991271 - DNA, 14 bp, Homo sapiens
aggacgcctgcagg

SEQ ID NO: 3991272 - DNA, 22 bp, Homo sapiens
aggacgcctgcaggagagagca

SEQ ID NO: 3991273 - DNA, 21 bp, Homo sapiens
aggacgtcatcggaggctggg

SEQ ID NO: 3991274 - DNA, 13 bp, Homo sapiens
aggactagaagat

SEQ ID NO: 3991275 - DNA, 16 bp, Homo sapiens
aggactatagcccagg

SEQ ID NO: 3991276 - DNA, 18 bp, Homo sapiens
aggactatagcccaggtc

SEQ ID NO: 3991277 - DNA, 17 bp, Homo sapiens
aggactccctcctcacc

SEQ ID NO: 3991278 - DNA, 23 bp, Homo sapiens
aggactccctcctcacctctgga

SEQ ID NO: 3991279 - DNA, 21 bp, Homo sapiens
aggactcctcctttttccatg

SEQ ID NO: 3991280 - DNA, 21 bp, Homo sapiens
aggactgagtcccctccagga

SEQ ID NO: 3991281 - DNA, 12 bp, Homo sapiens
aggactgtataa

SEQ ID NO: 3991282 - DNA, 19 bp, Homo sapiens
aggacttatttaaactctg

SEQ ID NO: 3991283 - DNA, 22 bp, Homo sapiens
aggacttcctgtccagctccaa

SEQ ID NO: 3991284 - DNA, 14 bp, Homo sapiens
aggacttctgcagc

SEQ ID NO: 3991285 - DNA, 16 bp, Homo sapiens
aggacttggtctgatt

SEQ ID NO: 3991286 - DNA, 13 bp, Homo sapiens
aggagaaaaacaa

SEQ ID NO: 3991287 - DNA, 12 bp, Homo sapiens
aggagaaacaca

SEQ ID NO: 3991288 - DNA, 14 bp, Homo sapiens
aggagaaacacatc

SEQ ID NO: 3991289 - DNA, 20 bp, Homo sapiens
aggagaccaagtcctggcta

SEQ ID NO: 3991290 - DNA, 23 bp, Homo sapiens
aggagaccagctcagaggcccag

SEQ ID NO: 3991291 - DNA, 21 bp, Homo sapiens
aggagacctggcactggatgc

SEQ ID NO: 3991292 - DNA, 22 bp, Homo sapiens
aggagagactgagcagccgcca

SEQ ID NO: 3991293 - DNA, 24 bp, Homo sapiens
aggagagccaacctcggcttgtgg

SEQ ID NO: 3991294 - DNA, 14 bp, Homo sapiens
aggagagcctgctg

SEQ ID NO: 3991295 - DNA, 21 bp, Homo sapiens
aggagaggatgagagcccaga

SEQ ID NO: 3991296 - DNA, 23 bp, Homo sapiens
aggagaggatgagagcccagagg

SEQ ID NO: 3991297 - DNA, 22 bp, Homo sapiens
aggagaggggaagggccagtct

SEQ ID NO: 3991298 - DNA, 20 bp, Homo sapiens
aggagatcgagaccatcctg

SEQ ID NO: 3991299 - DNA, 22 bp, Homo sapiens
aggagatggccataggagagga

SEQ ID NO: 3991300 - DNA, 15 bp, Homo sapiens
aggagcaaacactga

SEQ ID NO: 3991301 - DNA, 16 bp, Homo sapiens
aggagcaatgggactg

SEQ ID NO: 3991302 - DNA, 17 bp, Homo sapiens
aggagcaatgggactgg

SEQ ID NO: 3991303 - DNA, 14 bp, Homo sapiens
aggagcagaaagat

SEQ ID NO: 3991304 - DNA, 13 bp, Homo sapiens
aggagcagcattg

SEQ ID NO: 3991305 - DNA, 22 bp, Homo sapiens
aggagcatttttttattcagca

SEQ ID NO: 3991306 - DNA, 20 bp, Homo sapiens
aggagcccatactcagcctg

SEQ ID NO: 3991307 - DNA, 14 bp, Homo sapiens
aggagccccagcta

SEQ ID NO: 3991308 - DNA, 18 bp, Homo sapiens
aggagcctagcggagccc

SEQ ID NO: 3991309 - DNA, 16 bp, Homo sapiens
aggagccttttgctct

SEQ ID NO: 3991310 - DNA, 20 bp, Homo sapiens
aggagctctaccctgctccc

SEQ ID NO: 3991311 - DNA, 12 bp, Homo sapiens
aggagctgatgg

SEQ ID NO: 3991312 - DNA, 18 bp, Homo sapiens
aggagctgccttggctca

SEQ ID NO: 3991313 - DNA, 22 bp, Homo sapiens
aggagctgccttggctcagaca

SEQ ID NO: 3991314 - DNA, 13 bp, Homo sapiens
aggagctgctggc

SEQ ID NO: 3991315 - DNA, 16 bp, Homo sapiens
aggagctgctggcttg

SEQ ID NO: 3991316 - DNA, 21 bp, Homo sapiens
aggagctggggatccctcccc

SEQ ID NO: 3991317 - DNA, 22 bp, Homo sapiens
aggagcttcttgtttccttgtt

SEQ ID NO: 3991318 - DNA, 22 bp, Homo sapiens
aggaggaatcatgtcaggcctg

SEQ ID NO: 3991319 - DNA, 17 bp, Homo sapiens
aggaggagatggccata

SEQ ID NO: 3991320 - DNA, 16 bp, Homo sapiens
aggaggaggagatggc

SEQ ID NO: 3991321 - DNA, 15 bp, Homo sapiens
aggaggatgtccctg

SEQ ID NO: 3991322 - DNA, 20 bp, Homo sapiens
aggaggatgtccctgggcca

SEQ ID NO: 3991323 - DNA, 16 bp, Homo sapiens
agccagctctgcatta

SEQ ID NO: 3991324 - DNA, 14 bp, Homo sapiens
agccagctgcccta

SEQ ID NO: 3991325 - DNA, 14 bp, Homo sapiens
agccagctgctttt

SEQ ID NO: 3991326 - DNA, 17 bp, Homo sapiens
agccaggaatttcccag

SEQ ID NO: 3991327 - DNA, 12 bp, Homo sapiens
agccaggagcag

SEQ ID NO: 3991328 - DNA, 12 bp, Homo sapiens
agccaggcctgg

SEQ ID NO: 3991329 - DNA, 15 bp, Homo sapiens
agccaggctgagtga

SEQ ID NO: 3991330 - DNA, 22 bp, Homo sapiens
agccaggctgagtgagccacag

SEQ ID NO: 3991331 - DNA, 16 bp, Homo sapiens
agccagggtctctccc

SEQ ID NO: 3991332 - DNA, 18 bp, Homo sapiens
agccaggtaatgagggac

SEQ ID NO: 3991333 - DNA, 17 bp, Homo sapiens
agccaggtatggctctg

SEQ ID NO: 3991334 - DNA, 23 bp, Homo sapiens
agccaggtgagctctgacccttg

SEQ ID NO: 3991335 - DNA, 19 bp, Homo sapiens
agccagtgaaatgtgaagg

SEQ ID NO: 3991336 - DNA, 17 bp, Homo sapiens
agccagttgtcctatgg

SEQ ID NO: 3991337 - DNA, 19 bp, Homo sapiens
agccatacttatctctctg

SEQ ID NO: 3991338 - DNA, 10 bp, Homo sapiens
agccatatca

SEQ ID NO: 3991339 - DNA, 20 bp, Homo sapiens
agccatatcatgctaaaatt

SEQ ID NO: 3991340 - DNA, 14 bp, Homo sapiens
agccatcaaaatgc

SEQ ID NO: 3991341 - DNA, 16 bp, Homo sapiens
agccatcaaaatgctt

SEQ ID NO: 3991342 - DNA, 18 bp, Homo sapiens
agccatcactagaagaaa

SEQ ID NO: 3991343 - DNA, 21 bp, Homo sapiens
agccatcactagaagaaaagc

SEQ ID NO: 3991344 - DNA, 15 bp, Homo sapiens
agccatcgactcctg

SEQ ID NO: 3991345 - DNA, 21 bp, Homo sapiens
agccatgagatgatacatcca

SEQ ID NO: 3991346 - DNA, 15 bp, Homo sapiens
agccatgctgggaag

SEQ ID NO: 3991347 - DNA, 21 bp, Homo sapiens
agccattggctatttaaaact

SEQ ID NO: 3991348 - DNA, 17 bp, Homo sapiens
agccatttgttggggca

SEQ ID NO: 3991349 - DNA, 18 bp, Homo sapiens
agccatttgttggggcag

SEQ ID NO: 3991350 - DNA, 14 bp, Homo sapiens
agccattttgtgaa

SEQ ID NO: 3991351 - DNA, 15 bp, Homo sapiens
agccattttgtgaat

SEQ ID NO: 3991352 - DNA, 16 bp, Homo sapiens
agccattttgtgaatg

SEQ ID NO: 3991353 - DNA, 19 bp, Homo sapiens
agcccaaagctgcaggtgc

SEQ ID NO: 3991354 - DNA, 22 bp, Homo sapiens
agcccaaagctgcaggtgccag

SEQ ID NO: 3991355 - DNA, 14 bp, Homo sapiens
agcccaagcttccc

SEQ ID NO: 3991356 - DNA, 20 bp, Homo sapiens
agcccaatattataattttt

SEQ ID NO: 3991357 - DNA, 14 bp, Homo sapiens
agcccaccaggtgt

SEQ ID NO: 3991358 - DNA, 19 bp, Homo sapiens
agcccaccaggtgtcagga

SEQ ID NO: 3991359 - DNA, 13 bp, Homo sapiens
agcccagactctg

SEQ ID NO: 3991360 - DNA, 10 bp, Homo sapiens
agcccagaga

SEQ ID NO: 3991361 - DNA, 11 bp, Homo sapiens
agcccagagaa

SEQ ID NO: 3991362 - DNA, 12 bp, Homo sapiens
agcccagagaca

SEQ ID NO: 3991363 - DNA, 14 bp, Homo sapiens
agcccagagcctgg

SEQ ID NO: 3991364 - DNA, 17 bp, Homo sapiens
agcccagaggtaacaga

SEQ ID NO: 3991365 - DNA, 20 bp, Homo sapiens
agcccagattcccctgtgtc

SEQ ID NO: 3991366 - DNA, 12 bp, Homo sapiens
agcccagcactg

SEQ ID NO: 3991367 - DNA, 14 bp, Homo sapiens
agcccagcactgtg

SEQ ID NO: 3991368 - DNA, 15 bp, Homo sapiens
agcccagcactgtga

SEQ ID NO: 3991369 - DNA, 17 bp, Homo sapiens
agcccagcactgtgaag

SEQ ID NO: 3991370 - DNA, 19 bp, Homo sapiens
agcccagcagtgtggagac

SEQ ID NO: 3991371 - DNA, 22 bp, Homo sapiens
agcccagcagtgtggagaccct

SEQ ID NO: 3991372 - DNA, 15 bp, Homo sapiens
agcccagccaggcca

SEQ ID NO: 3991373 - DNA, 15 bp, Homo sapiens
agcccagctgcctgg

SEQ ID NO: 3991374 - DNA, 13 bp, Homo sapiens
agcccagctgggt

SEQ ID NO: 3991375 - DNA, 20 bp, Homo sapiens
agcccagctgggtcaggcag

SEQ ID NO: 3991376 - DNA, 21 bp, Homo sapiens
agcccagcttggccctttcct

SEQ ID NO: 3991377 - DNA, 23 bp, Homo sapiens
agcccagcttggccctttccttc

SEQ ID NO: 3991378 - DNA, 22 bp, Homo sapiens
agcccaggagtcccactccaag

SEQ ID NO: 3991379 - DNA, 22 bp, Homo sapiens
agcccagggcatcttgctggct

SEQ ID NO: 3991380 - DNA, 23 bp, Homo sapiens
agcccagggcatcttgctggcta

SEQ ID NO: 3991381 - DNA, 17 bp, Homo sapiens
agcccaggtgccagcct

SEQ ID NO: 3991382 - DNA, 15 bp, Homo sapiens
agcccatactcagcc

SEQ ID NO: 3991383 - DNA, 20 bp, Homo sapiens
agatacgactttattttctg

SEQ ID NO: 3991384 - DNA, 19 bp, Homo sapiens
agatactgctactgtaatt

SEQ ID NO: 3991385 - DNA, 23 bp, Homo sapiens
agatactgctactgtaattttat

SEQ ID NO: 3991386 - DNA, 20 bp, Homo sapiens
agatactggaagttttgcat

SEQ ID NO: 3991387 - DNA, 15 bp, Homo sapiens
agatagaaataaata

SEQ ID NO: 3991388 - DNA, 18 bp, Homo sapiens
agatagaaataaatagct

SEQ ID NO: 3991389 - DNA, 16 bp, Homo sapiens
agataggcccctgggg

SEQ ID NO: 3991390 - DNA, 22 bp, Homo sapiens
agataggcccctggggctcccg

SEQ ID NO: 3991391 - DNA, 19 bp, Homo sapiens
agataggcttaacaaatgg

SEQ ID NO: 3991392 - DNA, 19 bp, Homo sapiens
agatagtatctagcaatca

SEQ ID NO: 3991393 - DNA, 16 bp, Homo sapiens
agatatatacaaggtg

SEQ ID NO: 3991394 - DNA, 15 bp, Homo sapiens
agatatatctgaaaa

SEQ ID NO: 3991395 - DNA, 20 bp, Homo sapiens
agatatatctgaaaactgga

SEQ ID NO: 3991396 - DNA, 19 bp, Homo sapiens
agatatatgctctgcatgt

SEQ ID NO: 3991397 - DNA, 17 bp, Homo sapiens
agatatatttaagcctt

SEQ ID NO: 3991398 - DNA, 19 bp, Homo sapiens
agatatatttaagccttat

SEQ ID NO: 3991399 - DNA, 16 bp, Homo sapiens
agatatatttcacttt

SEQ ID NO: 3991400 - DNA, 14 bp, Homo sapiens
agatatatttttca

SEQ ID NO: 3991401 - DNA, 13 bp, Homo sapiens
agatatcaaaatt

SEQ ID NO: 3991402 - DNA, 21 bp, Homo sapiens
agatatcaaaattctagctgt

SEQ ID NO: 3991403 - DNA, 12 bp, Homo sapiens
agatatcctctc

SEQ ID NO: 3991404 - DNA, 13 bp, Homo sapiens
agatatcctctcc

SEQ ID NO: 3991405 - DNA, 21 bp, Homo sapiens
agatatcctctccccctcctc

SEQ ID NO: 3991406 - DNA, 16 bp, Homo sapiens
agatatgatatgtaaa

SEQ ID NO: 3991407 - DNA, 14 bp, Homo sapiens
agatattattgctt

SEQ ID NO: 3991408 - DNA, 16 bp, Homo sapiens
agatattgtacataaa

SEQ ID NO: 3991409 - DNA, 17 bp, Homo sapiens
agatatttatatatatt

SEQ ID NO: 3991410 - DNA, 21 bp, Homo sapiens
agatatttccatttcttcctc

SEQ ID NO: 3991411 - DNA, 12 bp, Homo sapiens
agatcaaaataa

SEQ ID NO: 3991412 - DNA, 17 bp, Homo sapiens
agatcaaaataaaaagt

SEQ ID NO: 3991413 - DNA, 13 bp, Homo sapiens
agatcaaatactt

SEQ ID NO: 3991414 - DNA, 15 bp, Homo sapiens
agatcaagagatcaa

SEQ ID NO: 3991415 - DNA, 18 bp, Homo sapiens
agatcaattccctctctc

SEQ ID NO: 3991416 - DNA, 14 bp, Homo sapiens
agatcaatttgtaa

SEQ ID NO: 3991417 - DNA, 13 bp, Homo sapiens
agatcacagcctc

SEQ ID NO: 3991418 - DNA, 15 bp, Homo sapiens
agatcacagcctcca

SEQ ID NO: 3991419 - DNA, 17 bp, Homo sapiens
agatcacagcctccagg

SEQ ID NO: 3991420 - DNA, 21 bp, Homo sapiens
agatcagtgtaccatttgcct

SEQ ID NO: 3991421 - DNA, 18 bp, Homo sapiens
agatccaaaagaagcccc

SEQ ID NO: 3991422 - DNA, 13 bp, Homo sapiens
agatccagcctgg

SEQ ID NO: 3991423 - DNA, 21 bp, Homo sapiens
agatcccatccatcagctccc

SEQ ID NO: 3991424 - DNA, 15 bp, Homo sapiens
agatcccctcaggac

SEQ ID NO: 3991425 - DNA, 19 bp, Homo sapiens
agatcccgcctcttcttct

SEQ ID NO: 3991426 - DNA, 21 bp, Homo sapiens
agatcctttttccatcatttt

SEQ ID NO: 3991427 - DNA, 21 bp, Homo sapiens
agatcgagaccatcctggcta

SEQ ID NO: 3991428 - DNA, 14 bp, Homo sapiens
agatcgcagtttgc

SEQ ID NO: 3991429 - DNA, 19 bp, Homo sapiens
agatcgtgctactgcactc

SEQ ID NO: 3991430 - DNA, 14 bp, Homo sapiens
agatcgtgtattga

SEQ ID NO: 3991431 - DNA, 18 bp, Homo sapiens
actgtgtttcaagttcaa

SEQ ID NO: 3991432 - DNA, 16 bp, Homo sapiens
actgttaactatgaca

SEQ ID NO: 3991433 - DNA, 14 bp, Homo sapiens
actgttactccaca

SEQ ID NO: 3991434 - DNA, 20 bp, Homo sapiens
actgttagctttttaaaaca

SEQ ID NO: 3991435 - DNA, 20 bp, Homo sapiens
actgttaggaacagcagtgt

SEQ ID NO: 3991436 - DNA, 14 bp, Homo sapiens
actgttccaaagcc

SEQ ID NO: 3991437 - DNA, 23 bp, Homo sapiens
actgttcggaaggggttcctcaa

SEQ ID NO: 3991438 - DNA, 20 bp, Homo sapiens
actgttctggcctcagacca

SEQ ID NO: 3991439 - DNA, 15 bp, Homo sapiens
actgttctgtgtctt

SEQ ID NO: 3991440 - DNA, 20 bp, Homo sapiens
actgttgcatttacttttaa

SEQ ID NO: 3991441 - DNA, 12 bp, Homo sapiens
actgttgctcaa

SEQ ID NO: 3991442 - DNA, 18 bp, Homo sapiens
actgttgtgatcttgcat

SEQ ID NO: 3991443 - DNA, 16 bp, Homo sapiens
actgtttaagacactt

SEQ ID NO: 3991444 - DNA, 15 bp, Homo sapiens
actgtttcactgaaa

SEQ ID NO: 3991445 - DNA, 12 bp, Homo sapiens
actgtttctctg

SEQ ID NO: 3991446 - DNA, 15 bp, Homo sapiens
acttaaaaaaatgac

SEQ ID NO: 3991447 - DNA, 13 bp, Homo sapiens
acttaaaaaactt

SEQ ID NO: 3991448 - DNA, 16 bp, Homo sapiens
acttaaaaaatgtcca

SEQ ID NO: 3991449 - DNA, 14 bp, Homo sapiens
acttaaaaatgtaa

SEQ ID NO: 3991450 - DNA, 17 bp, Homo sapiens
acttaaaaatgtaaata

SEQ ID NO: 3991451 - DNA, 20 bp, Homo sapiens
acttaaaggacaggaggagg

SEQ ID NO: 3991452 - DNA, 13 bp, Homo sapiens
acttaaattttag

SEQ ID NO: 3991453 - DNA, 21 bp, Homo sapiens
acttaacagatgcaatgtgct

SEQ ID NO: 3991454 - DNA, 15 bp, Homo sapiens
acttaacggctccag

SEQ ID NO: 3991455 - DNA, 13 bp, Homo sapiens
acttaactacttt

SEQ ID NO: 3991456 - DNA, 23 bp, Homo sapiens
acttaactattcaggagagtaga

SEQ ID NO: 3991457 - DNA, 16 bp, Homo sapiens
acttaactttaactga

SEQ ID NO: 3991458 - DNA, 16 bp, Homo sapiens
acttaagcaaaagaaa

SEQ ID NO: 3991459 - DNA, 15 bp, Homo sapiens
acttaagcacaagca

SEQ ID NO: 3991460 - DNA, 17 bp, Homo sapiens
acttaataaattcagat

SEQ ID NO: 3991461 - DNA, 17 bp, Homo sapiens
acttaatactaccttga

SEQ ID NO: 3991462 - DNA, 15 bp, Homo sapiens
agaacagcattgtcc

SEQ ID NO: 3991463 - DNA, 13 bp, Homo sapiens
agaacagcttcag

SEQ ID NO: 3991464 - DNA, 11 bp, Homo sapiens
agaacagggtc

SEQ ID NO: 3991465 - DNA, 11 bp, Homo sapiens
agaacatagaa

SEQ ID NO: 3991466 - DNA, 16 bp, Homo sapiens
agaacatggacttgta

SEQ ID NO: 3991467 - DNA, 16 bp, Homo sapiens
agaacattttaattca

SEQ ID NO: 3991468 - DNA, 13 bp, Homo sapiens
agaaccactatga

SEQ ID NO: 3991469 - DNA, 22 bp, Homo sapiens
agaaccatccctattttgtatt

SEQ ID NO: 3991470 - DNA, 16 bp, Homo sapiens
agaaccctctgtccca

SEQ ID NO: 3991471 - DNA, 15 bp, Homo sapiens
agaaccgagcaaaga

SEQ ID NO: 3991472 - DNA, 18 bp, Homo sapiens
agaaccgagcaaagatca

SEQ ID NO: 3991473 - DNA, 23 bp, Homo sapiens
agaacctacagactccatctctt

SEQ ID NO: 3991474 - DNA, 21 bp, Homo sapiens
agaacctgagctattttcctc

SEQ ID NO: 3991475 - DNA, 22 bp, Homo sapiens
agaacctgagctattttcctct

SEQ ID NO: 3991476 - DNA, 21 bp, Homo sapiens
agaacctggaaaaattccaga

SEQ ID NO: 3991477 - DNA, 13 bp, Homo sapiens
agaacctggaact

SEQ ID NO: 3991478 - DNA, 15 bp, Homo sapiens
agaacgccagtctcc

SEQ ID NO: 3991479 - DNA, 13 bp, Homo sapiens
agaactaaatgtt

SEQ ID NO: 3991480 - DNA, 16 bp, Homo sapiens
agaactaaatgttcta

SEQ ID NO: 3991481 - DNA, 14 bp, Homo sapiens
agaactacttgaac

SEQ ID NO: 3991482 - DNA, 14 bp, Homo sapiens
agaactatctgcat

SEQ ID NO: 3991483 - DNA, 15 bp, Homo sapiens
agaactatctgcatt

SEQ ID NO: 3991484 - DNA, 19 bp, Homo sapiens
agaactatctgcattatct

SEQ ID NO: 3991485 - DNA, 19 bp, Homo sapiens
agaactcaaatggggccag

SEQ ID NO: 3991486 - DNA, 20 bp, Homo sapiens
agaactcattctatccccaa

SEQ ID NO: 3991487 - DNA, 16 bp, Homo sapiens
agaactccaggccctc

SEQ ID NO: 3991488 - DNA, 14 bp, Homo sapiens
agaactcctgactg

SEQ ID NO: 3991489 - DNA, 15 bp, Homo sapiens
agaactcctgactgt

SEQ ID NO: 3991490 - DNA, 20 bp, Homo sapiens
agaactctgggctgccatgt

SEQ ID NO: 3991491 - DNA, 17 bp, Homo sapiens
agaactgcatggaccta

SEQ ID NO: 3991492 - DNA, 20 bp, Homo sapiens
agaactgcatggacctaaca

SEQ ID NO: 3991493 - DNA, 21 bp, Homo sapiens
agaactgtgtttcaagttcaa

SEQ ID NO: 3991494 - DNA, 21 bp, Homo sapiens
agaacttactgattattttct

SEQ ID NO: 3991495 - DNA, 17 bp, Homo sapiens
agaacttcagaaagact

SEQ ID NO: 3991496 - DNA, 23 bp, Homo sapiens
agaacttccctgattgacctgct

SEQ ID NO: 3991497 - DNA, 18 bp, Homo sapiens
agaacttgaatgtgtcag

SEQ ID NO: 3991498 - DNA, 17 bp, Homo sapiens
agaacttgatttgcatg

SEQ ID NO: 3991499 - DNA, 11 bp, Homo sapiens
agaagaaaagc

SEQ ID NO: 3991500 - DNA, 20 bp, Homo sapiens
agaagaactgtgtttcaagt

SEQ ID NO: 3991501 - DNA, 16 bp, Homo sapiens
agaagaagagaagctg

SEQ ID NO: 3991502 - DNA, 19 bp, Homo sapiens
agaagaagtggctgccaca

SEQ ID NO: 3991503 - DNA, 14 bp, Homo sapiens
agaagaatattcag

SEQ ID NO: 3991504 - DNA, 15 bp, Homo sapiens
agaagaatattcagg

SEQ ID NO: 3991505 - DNA, 13 bp, Homo sapiens
agaagacaaaaag

SEQ ID NO: 3991506 - DNA, 14 bp, Homo sapiens
agaagacaccagag

SEQ ID NO: 3991507 - DNA, 17 bp, Homo sapiens
agaagacaccagagcag

SEQ ID NO: 3991508 - DNA, 19 bp, Homo sapiens
agaagacatactgcttgat

SEQ ID NO: 3991509 - DNA, 15 bp, Homo sapiens
agaagacatgaacca

SEQ ID NO: 3991510 - DNA, 19 bp, Homo sapiens
agaagacatggagactcct

SEQ ID NO: 3991511 - DNA, 15 bp, Homo sapiens
agaagagaagctgct

SEQ ID NO: 3991512 - DNA, 17 bp, Homo sapiens
agaagagaagctgctga

SEQ ID NO: 3991513 - DNA, 12 bp, Homo sapiens
agaagagacagg

SEQ ID NO: 3991514 - DNA, 22 bp, Homo sapiens
agaagaggctggtgctgtggcc

SEQ ID NO: 3991515 - DNA, 16 bp, Homo sapiens
agaagagggcccagcc

SEQ ID NO: 3991516 - DNA, 23 bp, Homo sapiens
agaagagtgccctgctttgcaaa

SEQ ID NO: 3991517 - DNA, 13 bp, Homo sapiens
agaagataattgt

SEQ ID NO: 3991518 - DNA, 13 bp, Homo sapiens
agaagatcccctc

SEQ ID NO: 3991519 - DNA, 15 bp, Homo sapiens
agaagatctttgggc

SEQ ID NO: 3991520 - DNA, 20 bp, Homo sapiens
agaagatgccagcttctctc

SEQ ID NO: 3991521 - DNA, 22 bp, Homo sapiens
agaagatgttgaagaatacagt

SEQ ID NO: 3991522 - DNA, 13 bp, Homo sapiens
agaagcaagccag

SEQ ID NO: 3991523 - DNA, 14 bp, Homo sapiens
agaagcaagccaga

SEQ ID NO: 3991524 - DNA, 15 bp, Homo sapiens
agaagcaagccagac

SEQ ID NO: 3991525 - DNA, 13 bp, Homo sapiens
agaagcacatgtg

SEQ ID NO: 3991526 - DNA, 13 bp, Homo sapiens
agaagcatgaaaa

SEQ ID NO: 3991527 - DNA, 13 bp, Homo sapiens
agaagcattcctt

SEQ ID NO: 3991528 - DNA, 20 bp, Homo sapiens
agaagcattccttctttgat

SEQ ID NO: 3991529 - DNA, 14 bp, Homo sapiens
actgcagcacctcc

SEQ ID NO: 3991530 - DNA, 16 bp, Homo sapiens
actgcagcacctccag

SEQ ID NO: 3991531 - DNA, 13 bp, Homo sapiens
actgcagcctcat

SEQ ID NO: 3991532 - DNA, 13 bp, Homo sapiens
actgcagtttcct

SEQ ID NO: 3991533 - DNA, 21 bp, Homo sapiens
actgcatggacctaacattcg

SEQ ID NO: 3991534 - DNA, 16 bp, Homo sapiens
actgcattagaaatta

SEQ ID NO: 3991535 - DNA, 21 bp, Homo sapiens
actgcattgactttcagtaaa

SEQ ID NO: 3991536 - DNA, 12 bp, Homo sapiens
actgccaagggt

SEQ ID NO: 3991537 - DNA, 18 bp, Homo sapiens
actgccaagggtgctggt

SEQ ID NO: 3991538 - DNA, 18 bp, Homo sapiens
actgccaggccagcctcc

SEQ ID NO: 3991539 - DNA, 16 bp, Homo sapiens
actgccaggctgcctc

SEQ ID NO: 3991540 - DNA, 21 bp, Homo sapiens
actgcccatggacaggctggc

SEQ ID NO: 3991541 - DNA, 18 bp, Homo sapiens
actgccccacggagacag

SEQ ID NO: 3991542 - DNA, 22 bp, Homo sapiens
actgcccccactgtccccctac

SEQ ID NO: 3991543 - DNA, 19 bp, Homo sapiens
actgccccccatgaggaag

SEQ ID NO: 3991544 - DNA, 18 bp, Homo sapiens
actgcctcccccagggtc

SEQ ID NO: 3991545 - DNA, 17 bp, Homo sapiens
actgcctcgaaacacag

SEQ ID NO: 3991546 - DNA, 20 bp, Homo sapiens
actgccttctcctctctggg

SEQ ID NO: 3991547 - DNA, 21 bp, Homo sapiens
actgcgaagaccctcttgccc

SEQ ID NO: 3991548 - DNA, 21 bp, Homo sapiens
actgcggggagacagaagcct

SEQ ID NO: 3991549 - DNA, 16 bp, Homo sapiens
actgctaaattctatg

SEQ ID NO: 3991550 - DNA, 21 bp, Homo sapiens
actgctaaattctatgttaaa

SEQ ID NO: 3991551 - DNA, 21 bp, Homo sapiens
actgctaggcgagtgccagga

SEQ ID NO: 3991552 - DNA, 23 bp, Homo sapiens
actgctaggcgagtgccaggact

SEQ ID NO: 3991553 - DNA, 18 bp, Homo sapiens
actgctcaagaagacatg

SEQ ID NO: 3991554 - DNA, 20 bp, Homo sapiens
actgctccatttataacccc

SEQ ID NO: 3991555 - DNA, 18 bp, Homo sapiens
actgctccccagccctgg

SEQ ID NO: 3991556 - DNA, 16 bp, Homo sapiens
actgctccctacccca

SEQ ID NO: 3991557 - DNA, 24 bp, Homo sapiens
actgctccctaccccagggccctg

SEQ ID NO: 3991558 - DNA, 17 bp, Homo sapiens
actgctcttaagaaact

SEQ ID NO: 3991559 - DNA, 15 bp, Homo sapiens
actgctgcagattag

SEQ ID NO: 3991560 - DNA, 15 bp, Homo sapiens
actgctggctgcctt

SEQ ID NO: 3991561 - DNA, 13 bp, Homo sapiens
actgcttaattca

SEQ ID NO: 3991562 - DNA, 23 bp, Homo sapiens
actgcttgatgaagcaaggaaga

SEQ ID NO: 3991563 - DNA, 15 bp, Homo sapiens
actgcttgattttaa

SEQ ID NO: 3991564 - DNA, 12 bp, Homo sapiens
actgctttcaag

SEQ ID NO: 3991565 - DNA, 16 bp, Homo sapiens
actgctttctgttcca

SEQ ID NO: 3991566 - DNA, 17 bp, Homo sapiens
actgctttctgttccaa

SEQ ID NO: 3991567 - DNA, 21 bp, Homo sapiens
actggaaaggggagagcctgc

SEQ ID NO: 3991568 - DNA, 15 bp, Homo sapiens
actggaaccagggag

SEQ ID NO: 3991569 - DNA, 13 bp, Homo sapiens
actggaagttttg

SEQ ID NO: 3991570 - DNA, 18 bp, Homo sapiens
actggaataatttgtaaa

SEQ ID NO: 3991571 - DNA, 19 bp, Homo sapiens
actggaataatttgtaaat

SEQ ID NO: 3991572 - DNA, 22 bp, Homo sapiens
actggaataatttgtaaatgat

SEQ ID NO: 3991573 - DNA, 22 bp, Homo sapiens
actggaggcccctggagccaga

SEQ ID NO: 3991574 - DNA, 21 bp, Homo sapiens
actggaggtcacattcaggaa

SEQ ID NO: 3991575 - DNA, 23 bp, Homo sapiens
actggaggtgggcatgccaccct

SEQ ID NO: 3991576 - DNA, 16 bp, Homo sapiens
actggaggttgaagcc

SEQ ID NO: 3991577 - DNA, 13 bp, Homo sapiens
actggagtcagat

SEQ ID NO: 3991578 - DNA, 16 bp, Homo sapiens
actggagtcagatgag

SEQ ID NO: 3991579 - DNA, 18 bp, Homo sapiens
actggagtcagatgagca

SEQ ID NO: 3991580 - DNA, 16 bp, Homo sapiens
actggagttacattaa

SEQ ID NO: 3991581 - DNA, 13 bp, Homo sapiens
actggatgaagat

SEQ ID NO: 3991582 - DNA, 18 bp, Homo sapiens
actggatgcagaaacagt

SEQ ID NO: 3991583 - DNA, 14 bp, Homo sapiens
actggattggccaa

SEQ ID NO: 3991584 - DNA, 21 bp, Homo sapiens
actggcacactgctcttaaga

SEQ ID NO: 3991585 - DNA, 16 bp, Homo sapiens
actggcactgaattaa

SEQ ID NO: 3991586 - DNA, 20 bp, Homo sapiens
actggcagagagatcttccc

SEQ ID NO: 3991587 - DNA, 22 bp, Homo sapiens
actggcaggggagacaggagcc

SEQ ID NO: 3991588 - DNA, 22 bp, Homo sapiens
actggccagggccacgctccag

SEQ ID NO: 3991589 - DNA, 21 bp, Homo sapiens
actggcccctactttgtggca

SEQ ID NO: 3991590 - DNA, 12 bp, Homo sapiens
actggcccctgg

SEQ ID NO: 3991591 - DNA, 14 bp, Homo sapiens
actggcccctgggt

SEQ ID NO: 3991592 - DNA, 17 bp, Homo sapiens
actggcccctgggtcag

SEQ ID NO: 3991593 - DNA, 13 bp, Homo sapiens
actggcctgactt

SEQ ID NO: 3991594 - DNA, 16 bp, Homo sapiens
actggctggctcctag

SEQ ID NO: 3991595 - DNA, 17 bp, Homo sapiens
actggctgtcagtatga

SEQ ID NO: 3991596 - DNA, 21 bp, Homo sapiens
actggctgtcagtatgacatt

SEQ ID NO: 3991597 - DNA, 23 bp, Homo sapiens
actggcttgaattggtgacattt

SEQ ID NO: 3991598 - DNA, 20 bp, Homo sapiens
actgggaaggcttgggattt

SEQ ID NO: 3991599 - DNA, 23 bp, Homo sapiens
actgggaccaaccctggggaagg

SEQ ID NO: 3991600 - DNA, 20 bp, Homo sapiens
actgggagccacttctcccc

SEQ ID NO: 3991601 - DNA, 22 bp, Homo sapiens
actgggagccacttctccccag

SEQ ID NO: 3991602 - DNA, 15 bp, Homo sapiens
actgggaggaggggg

SEQ ID NO: 3991603 - DNA, 18 bp, Homo sapiens
actgggaggagggggagg

SEQ ID NO: 3991604 - DNA, 20 bp, Homo sapiens
actgggaggagggggagggt

SEQ ID NO: 3991605 - DNA, 18 bp, Homo sapiens
actgggagtcagagccct

SEQ ID NO: 3991606 - DNA, 21 bp, Homo sapiens
actgggagtcagagccctggc

SEQ ID NO: 3991607 - DNA, 18 bp, Homo sapiens
actttgcactgatatatc

SEQ ID NO: 3991608 - DNA, 15 bp, Homo sapiens
actttgcctcaagac

SEQ ID NO: 3991609 - DNA, 20 bp, Homo sapiens
actttgcttcccctccagga

SEQ ID NO: 3991610 - DNA, 23 bp, Homo sapiens
actttggagtcccctcacctcct

SEQ ID NO: 3991611 - DNA, 20 bp, Homo sapiens
actttgggaggccaaggtgg

SEQ ID NO: 3991612 - DNA, 23 bp, Homo sapiens
actttgggcttagtatttctcag

SEQ ID NO: 3991613 - DNA, 23 bp, Homo sapiens
actttggtagtggaatagtgaat

SEQ ID NO: 3991614 - DNA, 12 bp, Homo sapiens
actttgtaattt

SEQ ID NO: 3991615 - DNA, 19 bp, Homo sapiens
actttgtaatttttgggga

SEQ ID NO: 3991616 - DNA, 14 bp, Homo sapiens
actttgtacttgtg

SEQ ID NO: 3991617 - DNA, 15 bp, Homo sapiens
actttgtcagaggca

SEQ ID NO: 3991618 - DNA, 14 bp, Homo sapiens
actttgtctctcct

SEQ ID NO: 3991619 - DNA, 19 bp, Homo sapiens
actttgtctctcctggctg

SEQ ID NO: 3991620 - DNA, 23 bp, Homo sapiens
actttgtggagagaatgtgtgtg

SEQ ID NO: 3991621 - DNA, 15 bp, Homo sapiens
actttgttgcaagat

SEQ ID NO: 3991622 - DNA, 13 bp, Homo sapiens
acttttaaagctc

SEQ ID NO: 3991623 - DNA, 23 bp, Homo sapiens
acttttaaagctcatgcatttca

SEQ ID NO: 3991624 - DNA, 19 bp, Homo sapiens
acttttaaatggcagtatt

SEQ ID NO: 3991625 - DNA, 21 bp, Homo sapiens
acttttactctgcctacagaa

SEQ ID NO: 3991626 - DNA, 11 bp, Homo sapiens
acttttataat

SEQ ID NO: 3991627 - DNA, 19 bp, Homo sapiens
acttttataataaaaggaa

SEQ ID NO: 3991628 - DNA, 14 bp, Homo sapiens
acttttattaatat

SEQ ID NO: 3991629 - DNA, 18 bp, Homo sapiens
acttttatttgcaacatt

SEQ ID NO: 3991630 - DNA, 18 bp, Homo sapiens
acttttcccctgttaaac

SEQ ID NO: 3991631 - DNA, 21 bp, Homo sapiens
acttttcccctgttaaacagt

SEQ ID NO: 3991632 - DNA, 22 bp, Homo sapiens
acttttcccctgttaaacagta

SEQ ID NO: 3991633 - DNA, 12 bp, Homo sapiens
acttttcgttaa

SEQ ID NO: 3991634 - DNA, 16 bp, Homo sapiens
acttttcgttaacatt

SEQ ID NO: 3991635 - DNA, 17 bp, Homo sapiens
acttttcgttaacattg

SEQ ID NO: 3991636 - DNA, 23 bp, Homo sapiens
acttttctaaactaggctccttc

SEQ ID NO: 3991637 - DNA, 20 bp, Homo sapiens
acttttgagtgtgtgtgtgc

SEQ ID NO: 3991638 - DNA, 18 bp, Homo sapiens
acttttgtactgaatttt

SEQ ID NO: 3991639 - DNA, 18 bp, Homo sapiens
acttttgtgtaatgaaaa

SEQ ID NO: 3991640 - DNA, 17 bp, Homo sapiens
acttttgttattccatc

SEQ ID NO: 3991641 - DNA, 22 bp, Homo sapiens
actctgagtttaccatttgtaa

SEQ ID NO: 3991642 - DNA, 21 bp, Homo sapiens
actctgcatcccagcacctgc

SEQ ID NO: 3991643 - DNA, 24 bp, Homo sapiens
actctgccccacgctgtggccctg

SEQ ID NO: 3991644 - DNA, 12 bp, Homo sapiens
actctgccccct

SEQ ID NO: 3991645 - DNA, 13 bp, Homo sapiens
actctgccccctg

SEQ ID NO: 3991646 - DNA, 15 bp, Homo sapiens
actctgccccctgct

SEQ ID NO: 3991647 - DNA, 20 bp, Homo sapiens
actctgcccctggacctggg

SEQ ID NO: 3991648 - DNA, 22 bp, Homo sapiens
actctgcccctggacctgggaa

SEQ ID NO: 3991649 - DNA, 16 bp, Homo sapiens
actctgcctgcccttt

SEQ ID NO: 3991650 - DNA, 14 bp, Homo sapiens
actctgctgtttga

SEQ ID NO: 3991651 - DNA, 14 bp, Homo sapiens
actctggcaaagct

SEQ ID NO: 3991652 - DNA, 12 bp, Homo sapiens
actctggccctg

SEQ ID NO: 3991653 - DNA, 15 bp, Homo sapiens
actctggcttccagg

SEQ ID NO: 3991654 - DNA, 13 bp, Homo sapiens
actctgggaaata

SEQ ID NO: 3991655 - DNA, 15 bp, Homo sapiens
actctggttctttgt

SEQ ID NO: 3991656 - DNA, 15 bp, Homo sapiens
actctgtcagccagc

SEQ ID NO: 3991657 - DNA, 16 bp, Homo sapiens
actctgtcagccagcc

SEQ ID NO: 3991658 - DNA, 17 bp, Homo sapiens
actctgtcagccagccg

SEQ ID NO: 3991659 - DNA, 18 bp, Homo sapiens
actctgtctcaataatat

SEQ ID NO: 3991660 - DNA, 15 bp, Homo sapiens
actctgttcccccac

SEQ ID NO: 3991661 - DNA, 19 bp, Homo sapiens
actctgttcccccaccctc

SEQ ID NO: 3991662 - DNA, 23 bp, Homo sapiens
actctgttcccccaccctccatg

SEQ ID NO: 3991663 - DNA, 12 bp, Homo sapiens
actcttaaagca

SEQ ID NO: 3991664 - DNA, 14 bp, Homo sapiens
actcttaatcaaat

SEQ ID NO: 3991665 - DNA, 17 bp, Homo sapiens
actcttaggaagagaaa

SEQ ID NO: 3991666 - DNA, 15 bp, Homo sapiens
actcttcagggtcta

SEQ ID NO: 3991667 - DNA, 16 bp, Homo sapiens
actcttcctgcaagga

SEQ ID NO: 3991668 - DNA, 23 bp, Homo sapiens
actcttctcatcttgacagagcc

SEQ ID NO: 3991669 - DNA, 20 bp, Homo sapiens
actcttctcggctcaggctc

SEQ ID NO: 3991670 - DNA, 17 bp, Homo sapiens
actcttctctctgctct

SEQ ID NO: 3991671 - DNA, 18 bp, Homo sapiens
actcttctctctgctctg

SEQ ID NO: 3991672 - DNA, 21 bp, Homo sapiens
actcttctttaagccatagac

SEQ ID NO: 3991673 - DNA, 13 bp, Homo sapiens
actcttgatctct

SEQ ID NO: 3991674 - DNA, 16 bp, Homo sapiens
actcttgatctctctt

SEQ ID NO: 3991675 - DNA, 16 bp, Homo sapiens
actcttgatgtgaaga

SEQ ID NO: 3991676 - DNA, 22 bp, Homo sapiens
actcttgcgtgtcaatttccct

SEQ ID NO: 3991677 - DNA, 23 bp, Homo sapiens
actcttggttcgatacctggagc

SEQ ID NO: 3991678 - DNA, 21 bp, Homo sapiens
actcttgttgagttctgtaga

SEQ ID NO: 3991679 - DNA, 21 bp, Homo sapiens
actctttctgtatatactttt

SEQ ID NO: 3991680 - DNA, 13 bp, Homo sapiens
actctttgtaaga

SEQ ID NO: 3991681 - DNA, 18 bp, Homo sapiens
actctttgttatttgaaa

SEQ ID NO: 3991682 - DNA, 14 bp, Homo sapiens
actcttttgcttta

SEQ ID NO: 3991683 - DNA, 14 bp, Homo sapiens
actctttttagggc

SEQ ID NO: 3991684 - DNA, 20 bp, Homo sapiens
actctttttagggccaggca

SEQ ID NO: 3991685 - DNA, 18 bp, Homo sapiens
actctttttgttttttgt

SEQ ID NO: 3991686 - DNA, 17 bp, Homo sapiens
actgaaaacttagccag

SEQ ID NO: 3991687 - DNA, 17 bp, Homo sapiens
actgaaacatggctgtg

SEQ ID NO: 3991688 - DNA, 20 bp, Homo sapiens
actgaaagccttagggaagc

SEQ ID NO: 3991689 - DNA, 15 bp, Homo sapiens
actgaaagttttgta

SEQ ID NO: 3991690 - DNA, 16 bp, Homo sapiens
actgaaagttttgtaa

SEQ ID NO: 3991691 - DNA, 21 bp, Homo sapiens
actgaacttcaggataataaa

SEQ ID NO: 3991692 - DNA, 12 bp, Homo sapiens
actgaagcctgc

SEQ ID NO: 3991693 - DNA, 16 bp, Homo sapiens
actgaaggtgattcac

SEQ ID NO: 3991694 - DNA, 17 bp, Homo sapiens
actgaagttaacagaga

SEQ ID NO: 3991695 - DNA, 14 bp, Homo sapiens
actgaatattttgg

SEQ ID NO: 3991696 - DNA, 17 bp, Homo sapiens
actgaatattttggaaa

SEQ ID NO: 3991697 - DNA, 21 bp, Homo sapiens
actgaatgcctcaatgtgacc

SEQ ID NO: 3991698 - DNA, 13 bp, Homo sapiens
actgaattaatca

SEQ ID NO: 3991699 - DNA, 12 bp, Homo sapiens
actgaccactgg

SEQ ID NO: 3991700 - DNA, 23 bp, Homo sapiens
actgaccatccactctaccctcc

SEQ ID NO: 3991701 - DNA, 15 bp, Homo sapiens
actgacccttgaacc

SEQ ID NO: 3991702 - DNA, 21 bp, Homo sapiens
actgacctgaccccattcctg

SEQ ID NO: 3991703 - DNA, 21 bp, Homo sapiens
actgactggattcattctcat

SEQ ID NO: 3991704 - DNA, 14 bp, Homo sapiens
actgactttaagta

SEQ ID NO: 3991705 - DNA, 23 bp, Homo sapiens
actgagagggcaatctttgcctt

SEQ ID NO: 3991706 - DNA, 21 bp, Homo sapiens
actgagcaccctctggattct

SEQ ID NO: 3991707 - DNA, 23 bp, Homo sapiens
actgaggagatgaccagggatgc

SEQ ID NO: 3991708 - DNA, 20 bp, Homo sapiens
actgaggaggaggctgcaca

SEQ ID NO: 3991709 - DNA, 16 bp, Homo sapiens
actgaggcagccttgg

SEQ ID NO: 3991710 - DNA, 13 bp, Homo sapiens
actgaggcttaga

SEQ ID NO: 3991711 - DNA, 17 bp, Homo sapiens
actgaggcttagagaga

SEQ ID NO: 3991712 - DNA, 23 bp, Homo sapiens
actgaggcttagagagaggaggc

SEQ ID NO: 3991713 - DNA, 20 bp, Homo sapiens
actgagggaccaactgggcc

SEQ ID NO: 3991714 - DNA, 22 bp, Homo sapiens
actgagggactctgaagcctct

SEQ ID NO: 3991715 - DNA, 20 bp, Homo sapiens
actgagtagctctcctgact

SEQ ID NO: 3991716 - DNA, 11 bp, Homo sapiens
actgagtcacg

SEQ ID NO: 3991717 - DNA, 18 bp, Homo sapiens
actgagtcccctccagga

SEQ ID NO: 3991718 - DNA, 21 bp, Homo sapiens
actgagtcccctccaggaaga

SEQ ID NO: 3991719 - DNA, 15 bp, Homo sapiens
actgataaagaaaga

SEQ ID NO: 3991720 - DNA, 16 bp, Homo sapiens
actgataagactgttt

SEQ ID NO: 3991721 - DNA, 14 bp, Homo sapiens
actgatatattttc

SEQ ID NO: 3991722 - DNA, 15 bp, Homo sapiens
actgatcatgcattg

SEQ ID NO: 3991723 - DNA, 16 bp, Homo sapiens
actgatcatgcattgt

SEQ ID NO: 3991724 - DNA, 17 bp, Homo sapiens
actgatcatgcattgtt

SEQ ID NO: 3991725 - DNA, 18 bp, Homo sapiens
actgatcatgcattgttg

SEQ ID NO: 3991726 - DNA, 22 bp, Homo sapiens
actgatctctactaccacaagg

SEQ ID NO: 3991727 - DNA, 16 bp, Homo sapiens
actgatgattttcctt

SEQ ID NO: 3991728 - DNA, 15 bp, Homo sapiens
actgatgctgagatt

SEQ ID NO: 3991729 - DNA, 15 bp, Homo sapiens
actgatgctgcccct

SEQ ID NO: 3991730 - DNA, 19 bp, Homo sapiens
actgatgctgcccctcatc

SEQ ID NO: 3991731 - DNA, 20 bp, Homo sapiens
actgatgctgttctcttctt

SEQ ID NO: 3991732 - DNA, 15 bp, Homo sapiens
actgatgcttagatg

SEQ ID NO: 3991733 - DNA, 21 bp, Homo sapiens
actgatgttacatcacagtgt

SEQ ID NO: 3991734 - DNA, 18 bp, Homo sapiens
actgattatgtcttttat

SEQ ID NO: 3991735 - DNA, 20 bp, Homo sapiens
actgattcataataaatatc

SEQ ID NO: 3991736 - DNA, 14 bp, Homo sapiens
actgatttcctttg

SEQ ID NO: 3991737 - DNA, 18 bp, Homo sapiens
actgattttgtaaagttg

SEQ ID NO: 3991738 - DNA, 18 bp, Homo sapiens
actgcaacctctgcctcc

SEQ ID NO: 3991739 - DNA, 21 bp, Homo sapiens
actgcaatagagactgtagat

SEQ ID NO: 3991740 - DNA, 20 bp, Homo sapiens
actgcacagcggcccctgca

SEQ ID NO: 3991741 - DNA, 21 bp, Homo sapiens
actgcactccagcctgggcga

SEQ ID NO: 3991742 - DNA, 13 bp, Homo sapiens
actgcagaagcaa

SEQ ID NO: 3991743 - DNA, 17 bp, Homo sapiens
actgcagagtaaattgc

SEQ ID NO: 3991744 - DNA, 21 bp, Homo sapiens
gccttttgttcatttcatcct

SEQ ID NO: 3991745 - DNA, 22 bp, Homo sapiens
gcctttttctgagatgctcact

SEQ ID NO: 3991746 - DNA, 13 bp, Homo sapiens
gcgacagagcagt

SEQ ID NO: 3991747 - DNA, 14 bp, Homo sapiens
gcgaccgccccctc

SEQ ID NO: 3991748 - DNA, 15 bp, Homo sapiens
gcgaccttcctcatc

SEQ ID NO: 3991749 - DNA, 22 bp, Homo sapiens
gcgaccttcctcatccacccca

SEQ ID NO: 3991750 - DNA, 23 bp, Homo sapiens
gcgactaatttcaaaatgctttt

SEQ ID NO: 3991751 - DNA, 21 bp, Homo sapiens
gcgactctatagactctagga

SEQ ID NO: 3991752 - DNA, 14 bp, Homo sapiens
gcgagactccgtct

SEQ ID NO: 3991753 - DNA, 14 bp, Homo sapiens
gcgagagaggagcc

SEQ ID NO: 3991754 - DNA, 16 bp, Homo sapiens
gcgagagaggagccag

SEQ ID NO: 3991755 - DNA, 21 bp, Homo sapiens
gcgagatcggggtagaaatgc

SEQ ID NO: 3991756 - DNA, 12 bp, Homo sapiens
gcgaggcaggcc

SEQ ID NO: 3991757 - DNA, 13 bp, Homo sapiens
gcgaggcaggccg

SEQ ID NO: 3991758 - DNA, 14 bp, Homo sapiens
gcgagtctggggac

SEQ ID NO: 3991759 - DNA, 22 bp, Homo sapiens
gcgagtgccaggactccccagg

SEQ ID NO: 3991760 - DNA, 14 bp, Homo sapiens
gcgatatacagatg

SEQ ID NO: 3991761 - DNA, 17 bp, Homo sapiens
gcgatccacctgtctca

SEQ ID NO: 3991762 - DNA, 15 bp, Homo sapiens
gcgatcccacacagg

SEQ ID NO: 3991763 - DNA, 20 bp, Homo sapiens
gcgatcccacacaggctggc

SEQ ID NO: 3991764 - DNA, 23 bp, Homo sapiens
gcgatgtttcaggaggctggagg

SEQ ID NO: 3991765 - DNA, 19 bp, Homo sapiens
gcgcaggtgggctggactt

SEQ ID NO: 3991766 - DNA, 18 bp, Homo sapiens
gcgccaccgtgcctggct

SEQ ID NO: 3991767 - DNA, 18 bp, Homo sapiens
gcgccaggaagccagagc

SEQ ID NO: 3991768 - DNA, 20 bp, Homo sapiens
gcgccaggaagccagagccc

SEQ ID NO: 3991769 - DNA, 22 bp, Homo sapiens
gcgccaggatggaacacggcca

SEQ ID NO: 3991770 - DNA, 13 bp, Homo sapiens
gcgcccccagtgt

SEQ ID NO: 3991771 - DNA, 14 bp, Homo sapiens
gcgcccctgctgtc

SEQ ID NO: 3991772 - DNA, 15 bp, Homo sapiens
gcgcccctgctgtct

SEQ ID NO: 3991773 - DNA, 12 bp, Homo sapiens
gcgcctcagccc

SEQ ID NO: 3991774 - DNA, 14 bp, Homo sapiens
gcgcctcagccctc

SEQ ID NO: 3991775 - DNA, 16 bp, Homo sapiens
gcgcctgcaggcagag

SEQ ID NO: 3991776 - DNA, 18 bp, Homo sapiens
gcgcctgctgcctgctga

SEQ ID NO: 3991777 - DNA, 19 bp, Homo sapiens
gcgcctgctgcctgctgag

SEQ ID NO: 3991778 - DNA, 20 bp, Homo sapiens
gcgcctgctgcctgctgaga

SEQ ID NO: 3991779 - DNA, 22 bp, Homo sapiens
gcgcctgctgcctgctgagatg

SEQ ID NO: 3991780 - DNA, 16 bp, Homo sapiens
gcgcctgtagtcccag

SEQ ID NO: 3991781 - DNA, 12 bp, Homo sapiens
gcgcctgtgacc

SEQ ID NO: 3991782 - DNA, 22 bp, Homo sapiens
gcgccttgtctcctactcctga

SEQ ID NO: 3991783 - DNA, 23 bp, Homo sapiens
gcgcctttccgcggagcccttgg

SEQ ID NO: 3991784 - DNA, 20 bp, Homo sapiens
gcgcgagggcctcaaaggcc

SEQ ID NO: 3991785 - DNA, 16 bp, Homo sapiens
gcgcggccagccccgg

SEQ ID NO: 3991786 - DNA, 21 bp, Homo sapiens
gcgcggccagccccggccctg

SEQ ID NO: 3991787 - DNA, 20 bp, Homo sapiens
gcgcggtggcgggcacctgt

SEQ ID NO: 3991788 - DNA, 18 bp, Homo sapiens
gcgctagcacagctccct

SEQ ID NO: 3991789 - DNA, 21 bp, Homo sapiens
gcgctagcacagctcccttct

SEQ ID NO: 3991790 - DNA, 21 bp, Homo sapiens
gcgctcagacggcggccaggc

SEQ ID NO: 3991791 - DNA, 20 bp, Homo sapiens
gcgctctcaagaccagagac

SEQ ID NO: 3991792 - DNA, 13 bp, Homo sapiens
gcgctggtggacc

SEQ ID NO: 3991793 - DNA, 22 bp, Homo sapiens
gcgctgtttttgttgtgtgtgc

SEQ ID NO: 3991794 - DNA, 20 bp, Homo sapiens
gcggaataaactagagaagg

SEQ ID NO: 3991795 - DNA, 14 bp, Homo sapiens
gcggacggctgtgg

SEQ ID NO: 3991796 - DNA, 14 bp, Homo sapiens
gcggacgggctgtc

SEQ ID NO: 3991797 - DNA, 15 bp, Homo sapiens
gcggagagtacagtg

SEQ ID NO: 3991798 - DNA, 20 bp, Homo sapiens
gcggagagtacagtgagcca

SEQ ID NO: 3991799 - DNA, 22 bp, Homo sapiens
gcggagagtacagtgagccaag

SEQ ID NO: 3991800 - DNA, 19 bp, Homo sapiens
gcggagcccagcctgggag

SEQ ID NO: 3991801 - DNA, 23 bp, Homo sapiens
gcggagcgggaggcggtggtaga

SEQ ID NO: 3991802 - DNA, 17 bp, Homo sapiens
gcggaggagaccagctc

SEQ ID NO: 3991803 - DNA, 18 bp, Homo sapiens
gcggaggagaccagctca

SEQ ID NO: 3991804 - DNA, 14 bp, Homo sapiens
gcggaggctgtgtg

SEQ ID NO: 3991805 - DNA, 20 bp, Homo sapiens
acctaatccaggcagatcca

SEQ ID NO: 3991806 - DNA, 22 bp, Homo sapiens
acctaatccaggcagatccagg

SEQ ID NO: 3991807 - DNA, 17 bp, Homo sapiens
acctacagactccatct

SEQ ID NO: 3991808 - DNA, 19 bp, Homo sapiens
acctacagactccatctct

SEQ ID NO: 3991809 - DNA, 21 bp, Homo sapiens
acctacagactccatctcttc

SEQ ID NO: 3991810 - DNA, 22 bp, Homo sapiens
acctacagactccatctcttct

SEQ ID NO: 3991811 - DNA, 23 bp, Homo sapiens
acctacattccctctcctgccca

SEQ ID NO: 3991812 - DNA, 14 bp, Homo sapiens
acctaccaaaaaat

SEQ ID NO: 3991813 - DNA, 15 bp, Homo sapiens
acctaccacagtgtc

SEQ ID NO: 3991814 - DNA, 19 bp, Homo sapiens
acctaccacagtgtctgta

SEQ ID NO: 3991815 - DNA, 13 bp, Homo sapiens
acctacctcccac

SEQ ID NO: 3991816 - DNA, 15 bp, Homo sapiens
acctactatgtgctg

SEQ ID NO: 3991817 - DNA, 12 bp, Homo sapiens
acctagaaaaca

SEQ ID NO: 3991818 - DNA, 22 bp, Homo sapiens
acctagcagcaccgttctgtgc

SEQ ID NO: 3991819 - DNA, 14 bp, Homo sapiens
acctagcaggctgt

SEQ ID NO: 3991820 - DNA, 19 bp, Homo sapiens
acctagctggtagcataaa

SEQ ID NO: 3991821 - DNA, 17 bp, Homo sapiens
acctagggaggacctta

SEQ ID NO: 3991822 - DNA, 24 bp, Homo sapiens
acctagggaggaccttatctgtgc

SEQ ID NO: 3991823 - DNA, 16 bp, Homo sapiens
acctataaagtaaagc

SEQ ID NO: 3991824 - DNA, 18 bp, Homo sapiens
acctatctcgtgggagag

SEQ ID NO: 3991825 - DNA, 23 bp, Homo sapiens
acctatggaagtggttctatgtc

SEQ ID NO: 3991826 - DNA, 22 bp, Homo sapiens
acctatgtcctaaggacacact

SEQ ID NO: 3991827 - DNA, 21 bp, Homo sapiens
acctatgttattttgtgtaca

SEQ ID NO: 3991828 - DNA, 12 bp, Homo sapiens
acctatttccat

SEQ ID NO: 3991829 - DNA, 13 bp, Homo sapiens
acctcaagccatc

SEQ ID NO: 3991830 - DNA, 20 bp, Homo sapiens
acctcaagggggactgtctt

SEQ ID NO: 3991831 - DNA, 21 bp, Homo sapiens
acctcaagggggactgtcttt

SEQ ID NO: 3991832 - DNA, 17 bp, Homo sapiens
acctcacccggcctctt

SEQ ID NO: 3991833 - DNA, 14 bp, Homo sapiens
acctcacctagaaa

SEQ ID NO: 3991834 - DNA, 14 bp, Homo sapiens
acctcaccttcctg

SEQ ID NO: 3991835 - DNA, 20 bp, Homo sapiens
acctcagaaagtcaccagga

SEQ ID NO: 3991836 - DNA, 23 bp, Homo sapiens
acctcagaaagtcaccaggactt

SEQ ID NO: 3991837 - DNA, 17 bp, Homo sapiens
cagagtggcctggccag

SEQ ID NO: 3991838 - DNA, 23 bp, Homo sapiens
cagagtggcctggccaggagctc

SEQ ID NO: 3991839 - DNA, 21 bp, Homo sapiens
cagagttaggttgtctccagg

SEQ ID NO: 3991840 - DNA, 12 bp, Homo sapiens
cagagttcacag

SEQ ID NO: 3991841 - DNA, 13 bp, Homo sapiens
cagagttcacagg

SEQ ID NO: 3991842 - DNA, 14 bp, Homo sapiens
cagagttcacagga

SEQ ID NO: 3991843 - DNA, 15 bp, Homo sapiens
cagagttcacaggag

SEQ ID NO: 3991844 - DNA, 17 bp, Homo sapiens
cagagttcacaggaggc

SEQ ID NO: 3991845 - DNA, 15 bp, Homo sapiens
cagagttctgtgaag

SEQ ID NO: 3991846 - DNA, 16 bp, Homo sapiens
cagagttctgtgaaga

SEQ ID NO: 3991847 - DNA, 22 bp, Homo sapiens
cagagttctgtgaagaggaaca

SEQ ID NO: 3991848 - DNA, 16 bp, Homo sapiens
cagagtttgccttcct

SEQ ID NO: 3991849 - DNA, 20 bp, Homo sapiens
cagagtttgccttcctttct

SEQ ID NO: 3991850 - DNA, 18 bp, Homo sapiens
cagataaatagaactatc

SEQ ID NO: 3991851 - DNA, 14 bp, Homo sapiens
cagatacacacaca

SEQ ID NO: 3991852 - DNA, 17 bp, Homo sapiens
cagatacatatgagtgt

SEQ ID NO: 3991853 - DNA, 12 bp, Homo sapiens
cagatacatcac

SEQ ID NO: 3991854 - DNA, 14 bp, Homo sapiens
cagatacatcactg

SEQ ID NO: 3991855 - DNA, 15 bp, Homo sapiens
cagatacctcaccct

SEQ ID NO: 3991856 - DNA, 17 bp, Homo sapiens
cagataccttgaaagga

SEQ ID NO: 3991857 - DNA, 21 bp, Homo sapiens
cagatactggaagttttgcat

SEQ ID NO: 3991858 - DNA, 19 bp, Homo sapiens
cagatagatatatgctctg

SEQ ID NO: 3991859 - DNA, 22 bp, Homo sapiens
cagatataaatggctggttttt

SEQ ID NO: 3991860 - DNA, 18 bp, Homo sapiens
cagatatatttaagcctt

SEQ ID NO: 3991861 - DNA, 13 bp, Homo sapiens
cagatatattttt

SEQ ID NO: 3991862 - DNA, 13 bp, Homo sapiens
cagatatcaaaat

SEQ ID NO: 3991863 - DNA, 23 bp, Homo sapiens
cagatatcaaaattctagctgta

SEQ ID NO: 3991864 - DNA, 15 bp, Homo sapiens
cagatatgatatgta

SEQ ID NO: 3991865 - DNA, 21 bp, Homo sapiens
cagatatttatatttttattt

SEQ ID NO: 3991866 - DNA, 12 bp, Homo sapiens
cagatatttcca

SEQ ID NO: 3991867 - DNA, 15 bp, Homo sapiens
cagatatttgtcatg

SEQ ID NO: 3991868 - DNA, 17 bp, Homo sapiens
cagatcaaagtatgtat

SEQ ID NO: 3991869 - DNA, 22 bp, Homo sapiens
cagatcaccagcccggcctgct

SEQ ID NO: 3991870 - DNA, 13 bp, Homo sapiens
cagatcagccaga

SEQ ID NO: 3991871 - DNA, 15 bp, Homo sapiens
cagatccagcctggg

SEQ ID NO: 3991872 - DNA, 17 bp, Homo sapiens
cagatccagcctggggt

SEQ ID NO: 3991873 - DNA, 18 bp, Homo sapiens
cagatccagcctggggtc

SEQ ID NO: 3991874 - DNA, 17 bp, Homo sapiens
gcttttctgtcctgggc

SEQ ID NO: 3991875 - DNA, 18 bp, Homo sapiens
gcttttgcttgatccaga

SEQ ID NO: 3991876 - DNA, 17 bp, Homo sapiens
gctttttaaaacattag

SEQ ID NO: 3991877 - DNA, 15 bp, Homo sapiens
gctttttaatattga

SEQ ID NO: 3991878 - DNA, 20 bp, Homo sapiens
gctttttaattgttgtttct

SEQ ID NO: 3991879 - DNA, 21 bp, Homo sapiens
gctttttatttctgcatatgt

SEQ ID NO: 3991880 - DNA, 19 bp, Homo sapiens
gctttttcctctgagccca

SEQ ID NO: 3991881 - DNA, 21 bp, Homo sapiens
ggaaaaaaacataaaaagcag

SEQ ID NO: 3991882 - DNA, 12 bp, Homo sapiens
ggaaaaaagcac

SEQ ID NO: 3991883 - DNA, 18 bp, Homo sapiens
ggaaaaaagcacatacat

SEQ ID NO: 3991884 - DNA, 13 bp, Homo sapiens
ggaaaaacacaag

SEQ ID NO: 3991885 - DNA, 23 bp, Homo sapiens
ggaaaaagcaagttcgtctgttg

SEQ ID NO: 3991886 - DNA, 22 bp, Homo sapiens
ggaaaaccagactacttgggag

SEQ ID NO: 3991887 - DNA, 14 bp, Homo sapiens
ggaaaagaatacag

SEQ ID NO: 3991888 - DNA, 22 bp, Homo sapiens
ggaaaagagcgcatcaggcctg

SEQ ID NO: 3991889 - DNA, 21 bp, Homo sapiens
ggaaaataaaaaaagaaaaaa

SEQ ID NO: 3991890 - DNA, 17 bp, Homo sapiens
ggaaaatatttcctgac

SEQ ID NO: 3991891 - DNA, 21 bp, Homo sapiens
ggaaaatgagtatttggtcca

SEQ ID NO: 3991892 - DNA, 22 bp, Homo sapiens
ggaaaatgagtatttggtccaa

SEQ ID NO: 3991893 - DNA, 13 bp, Homo sapiens
ggaaacaatgtgg

SEQ ID NO: 3991894 - DNA, 19 bp, Homo sapiens
ggaaaccaagtggtcagga

SEQ ID NO: 3991895 - DNA, 17 bp, Homo sapiens
ggaaactaccaggtgtg

SEQ ID NO: 3991896 - DNA, 18 bp, Homo sapiens
ggaaactccacatctgcc

SEQ ID NO: 3991897 - DNA, 21 bp, Homo sapiens
ggaaactccacatctgcctta

SEQ ID NO: 3991898 - DNA, 14 bp, Homo sapiens
ggaaactgaagcat

SEQ ID NO: 3991899 - DNA, 21 bp, Homo sapiens
ggaaagagcaccctcgagaag

SEQ ID NO: 3991900 - DNA, 23 bp, Homo sapiens
ggaaagatggtgtgggtgtcctg

SEQ ID NO: 3991901 - DNA, 12 bp, Homo sapiens
ggaaagcacaga

SEQ ID NO: 3991902 - DNA, 18 bp, Homo sapiens
ggaaagccacctctccct

SEQ ID NO: 3991903 - DNA, 20 bp, Homo sapiens
ggaaagccattgaccaccca

SEQ ID NO: 3991904 - DNA, 20 bp, Homo sapiens
ggaaaggtgtgagactggga

SEQ ID NO: 3991905 - DNA, 19 bp, Homo sapiens
ggaaaggttttgtattttt

SEQ ID NO: 3991906 - DNA, 21 bp, Homo sapiens
ggaaagtgtgagctcttccct

SEQ ID NO: 3991907 - DNA, 23 bp, Homo sapiens
ggaaagttggaaccgtgtccagc

SEQ ID NO: 3991908 - DNA, 18 bp, Homo sapiens
ggaaatacagttctgctc

SEQ ID NO: 3991909 - DNA, 13 bp, Homo sapiens
ggaaatagaaaga

SEQ ID NO: 3991910 - DNA, 18 bp, Homo sapiens
ggaaatagaaagaagcca

SEQ ID NO: 3991911 - DNA, 14 bp, Homo sapiens
ggaaatatatatgt

SEQ ID NO: 3991912 - DNA, 16 bp, Homo sapiens
ggaaatgtaatactgg

SEQ ID NO: 3991913 - DNA, 20 bp, Homo sapiens
ggaaatgtattttgacactg

SEQ ID NO: 3991914 - DNA, 19 bp, Homo sapiens
ggaaatgtcatctaaccat

SEQ ID NO: 3991915 - DNA, 18 bp, Homo sapiens
ggaacaaggagtcagaca

SEQ ID NO: 3991916 - DNA, 19 bp, Homo sapiens
ggaacaattgaagtaaact

SEQ ID NO: 3991917 - DNA, 23 bp, Homo sapiens
ggaacactggtgggcagctgagg

SEQ ID NO: 3991918 - DNA, 13 bp, Homo sapiens
ggaacagaaggat

SEQ ID NO: 3991919 - DNA, 14 bp, Homo sapiens
ggaacagcagtgtt

SEQ ID NO: 3991920 - DNA, 19 bp, Homo sapiens
ggaacagcgggagacctgt

SEQ ID NO: 3991921 - DNA, 20 bp, Homo sapiens
ggaacagcgggagacctgtg

SEQ ID NO: 3991922 - DNA, 14 bp, Homo sapiens
ggaacagtggctgg

SEQ ID NO: 3991923 - DNA, 18 bp, Homo sapiens
ggaacagtgtttcccata

SEQ ID NO: 3991924 - DNA, 13 bp, Homo sapiens
ggagccccctctg

SEQ ID NO: 3991925 - DNA, 19 bp, Homo sapiens
ggagccccttctgctcagc

SEQ ID NO: 3991926 - DNA, 12 bp, Homo sapiens
ggagccctgacc

SEQ ID NO: 3991927 - DNA, 16 bp, Homo sapiens
ggagcccttggcccct

SEQ ID NO: 3991928 - DNA, 22 bp, Homo sapiens
ggagcctagcggagcccagcct

SEQ ID NO: 3991929 - DNA, 16 bp, Homo sapiens
ggagcctagctcctgc

SEQ ID NO: 3991930 - DNA, 20 bp, Homo sapiens
ggagcctccactgcctctgg

SEQ ID NO: 3991931 - DNA, 14 bp, Homo sapiens
ggagcctccccctc

SEQ ID NO: 3991932 - DNA, 17 bp, Homo sapiens
ggagcctccccctcaga

SEQ ID NO: 3991933 - DNA, 22 bp, Homo sapiens
ggagcctgctggtcacagcctc

SEQ ID NO: 3991934 - DNA, 13 bp, Homo sapiens
ggagcctgtgcag

SEQ ID NO: 3991935 - DNA, 19 bp, Homo sapiens
ggagcggattgcaaagcaa

SEQ ID NO: 3991936 - DNA, 16 bp, Homo sapiens
ggagcgtctgggaact

SEQ ID NO: 3991937 - DNA, 14 bp, Homo sapiens
ggagctactgatga

SEQ ID NO: 3991938 - DNA, 15 bp, Homo sapiens
ggagctcaggtgggg

SEQ ID NO: 3991939 - DNA, 18 bp, Homo sapiens
ggagctcaggtggggagt

SEQ ID NO: 3991940 - DNA, 19 bp, Homo sapiens
ggagctcaggtggggagtc

SEQ ID NO: 3991941 - DNA, 21 bp, Homo sapiens
ggagctcctctcctggaggat

SEQ ID NO: 3991942 - DNA, 21 bp, Homo sapiens
ggagctgcctgcttggcccgg

SEQ ID NO: 3991943 - DNA, 20 bp, Homo sapiens
ggagcttcttgtttccttgt

SEQ ID NO: 3991944 - DNA, 22 bp, Homo sapiens
ggagcttgggcagtgccccagg

SEQ ID NO: 3991945 - DNA, 21 bp, Homo sapiens
ggaggaaaaccaagccgtggc

SEQ ID NO: 3991946 - DNA, 18 bp, Homo sapiens
ggaggaacactgcactct

SEQ ID NO: 3991947 - DNA, 11 bp, Homo sapiens
ggaggaagccc

SEQ ID NO: 3991948 - DNA, 14 bp, Homo sapiens
ggaggaagcttggg

SEQ ID NO: 3991949 - DNA, 11 bp, Homo sapiens
ggaggaaggat

SEQ ID NO: 3991950 - DNA, 14 bp, Homo sapiens
ggaggaaggcaaga

SEQ ID NO: 3991951 - DNA, 12 bp, Homo sapiens
ggaggaccaggg

SEQ ID NO: 3991952 - DNA, 14 bp, Homo sapiens
ggaggacctgcccg

SEQ ID NO: 3991953 - DNA, 12 bp, Homo sapiens
ggaggaccttat

SEQ ID NO: 3991954 - DNA, 14 bp, Homo sapiens
ggaggagaccagct

SEQ ID NO: 3991955 - DNA, 16 bp, Homo sapiens
ggaggagaccagctca

SEQ ID NO: 3991956 - DNA, 15 bp, Homo sapiens
ggaggaggagatggc

SEQ ID NO: 3991957 - DNA, 19 bp, Homo sapiens
ggaggaggcctgtcccaat

SEQ ID NO: 3991958 - DNA, 13 bp, Homo sapiens
ggaggagggagag

SEQ ID NO: 3991959 - DNA, 15 bp, Homo sapiens
ggaggagggttgtgc

SEQ ID NO: 3991960 - DNA, 20 bp, Homo sapiens
ggaggatgtccctgggccag

SEQ ID NO: 3991961 - DNA, 22 bp, Homo sapiens
ggaggattgcttgagcccagga

SEQ ID NO: 3991962 - DNA, 20 bp, Homo sapiens
ggaggcaagaaaaggacaaa

SEQ ID NO: 3991963 - DNA, 22 bp, Homo sapiens
ggaggcactttagggctgtaaa

SEQ ID NO: 3991964 - DNA, 21 bp, Homo sapiens
ggaggcagagtttgccttcct

SEQ ID NO: 3991965 - DNA, 23 bp, Homo sapiens
ggaggcagccccctccacaccag

SEQ ID NO: 3991966 - DNA, 11 bp, Homo sapiens
ggaggcagcct

SEQ ID NO: 3991967 - DNA, 16 bp, Homo sapiens
ggaggcagggctctcc

SEQ ID NO: 3991968 - DNA, 16 bp, Homo sapiens
ggaggcatggccctgg

SEQ ID NO: 3991969 - DNA, 17 bp, Homo sapiens
ggaggcatggccctggg

SEQ ID NO: 3991970 - DNA, 23 bp, Homo sapiens
ggaggccaaactgtccctccctt

SEQ ID NO: 3991971 - DNA, 17 bp, Homo sapiens
ggaggccaataaaaagt

SEQ ID NO: 3991972 - DNA, 22 bp, Homo sapiens
ggaggccacacgcactggtgcc

SEQ ID NO: 3991973 - DNA, 22 bp, Homo sapiens
ggaggccaccgggacagacctg

SEQ ID NO: 3991974 - DNA, 14 bp, Homo sapiens
ggaggcccaggctg

SEQ ID NO: 3991975 - DNA, 13 bp, Homo sapiens
ggaggcccagttc

SEQ ID NO: 3991976 - DNA, 19 bp, Homo sapiens
ggaggcccagttcaccctg

SEQ ID NO: 3991977 - DNA, 13 bp, Homo sapiens
ggaggcctcaggt

SEQ ID NO: 3991978 - DNA, 16 bp, Homo sapiens
ggaggcctcaggtgct

SEQ ID NO: 3991979 - DNA, 19 bp, Homo sapiens
ggaggcctcaggtgctgtc

SEQ ID NO: 3991980 - DNA, 20 bp, Homo sapiens
ggaggccttgggctctgctg

SEQ ID NO: 3991981 - DNA, 17 bp, Homo sapiens
ggaggcggcccggccag

SEQ ID NO: 3991982 - DNA, 18 bp, Homo sapiens
ggaggcgtctcgggagag

SEQ ID NO: 3991983 - DNA, 16 bp, Homo sapiens
ggaggctccaggcagc

SEQ ID NO: 3991984 - DNA, 14 bp, Homo sapiens
ggaggctgagacag

SEQ ID NO: 3991985 - DNA, 15 bp, Homo sapiens
ggaggctgagacagg

SEQ ID NO: 3991986 - DNA, 18 bp, Homo sapiens
ggaggctgagacaggaga

SEQ ID NO: 3991987 - DNA, 17 bp, Homo sapiens
ggaggctgaggcaggag

SEQ ID NO: 3991988 - DNA, 13 bp, Homo sapiens
ggaggctgccccc

SEQ ID NO: 3991989 - DNA, 22 bp, Homo sapiens
ggaggctgcctatgttgggggg

SEQ ID NO: 3991990 - DNA, 12 bp, Homo sapiens
ggaggctggagg

SEQ ID NO: 3991991 - DNA, 13 bp, Homo sapiens
ggaggctgggcac

SEQ ID NO: 3991992 - DNA, 23 bp, Homo sapiens
ggaggctgggcccctgggatggg

SEQ ID NO: 3991993 - DNA, 19 bp, Homo sapiens
ggagggaaaagggaagtag

SEQ ID NO: 3991994 - DNA, 13 bp, Homo sapiens
ggagggagaggga

SEQ ID NO: 3991995 - DNA, 16 bp, Homo sapiens
ggagggagcagacagg

SEQ ID NO: 3991996 - DNA, 15 bp, Homo sapiens
ggagggaggctcagg

SEQ ID NO: 3991997 - DNA, 16 bp, Homo sapiens
ggagggaggctcaggt

SEQ ID NO: 3991998 - DNA, 20 bp, Homo sapiens
ggagggatgaagggcgagtg

SEQ ID NO: 3991999 - DNA, 20 bp, Homo sapiens
ggagggatgctgctccgccc

SEQ ID NO: 3992000 - DNA, 12 bp, Homo sapiens
ggagggcacagc

SEQ ID NO: 3992001 - DNA, 14 bp, Homo sapiens
ggagggcacagccc

SEQ ID NO: 3992002 - DNA, 19 bp, Homo sapiens
ggagggcttggcccagcgc

SEQ ID NO: 3992003 - DNA, 20 bp, Homo sapiens
ggaggggaaatgtaatactg

SEQ ID NO: 3992004 - DNA, 14 bp, Homo sapiens
ggaggggagggtaa

SEQ ID NO: 3992005 - DNA, 15 bp, Homo sapiens
ggagggggagggtga

SEQ ID NO: 3992006 - DNA, 13 bp, Homo sapiens
ggagggggcaaag

SEQ ID NO: 3992007 - DNA, 21 bp, Homo sapiens
ggagggggcttgaagccaaag

SEQ ID NO: 3992008 - DNA, 16 bp, Homo sapiens
ggagggggttacaaac

SEQ ID NO: 3992009 - DNA, 15 bp, Homo sapiens
ggaggggtgtggctc

SEQ ID NO: 3992010 - DNA, 20 bp, Homo sapiens
ggagggtaaataaaccactg

SEQ ID NO: 3992011 - DNA, 16 bp, Homo sapiens
ggagggtacagctggg

SEQ ID NO: 3992012 - DNA, 18 bp, Homo sapiens
ggagggtacagctgggct

SEQ ID NO: 3992013 - DNA, 21 bp, Homo sapiens
ggaggtagagaggggactggg

SEQ ID NO: 3992014 - DNA, 18 bp, Homo sapiens
ggaggtcacagctggatc

SEQ ID NO: 3992015 - DNA, 13 bp, Homo sapiens
ggaggtcactgga

SEQ ID NO: 3992016 - DNA, 21 bp, Homo sapiens
ggaggtcactggaaaggggag

SEQ ID NO: 3992017 - DNA, 13 bp, Homo sapiens
ggaggtgcctgga

SEQ ID NO: 3992018 - DNA, 18 bp, Homo sapiens
ggaggtgggcatgccacc

SEQ ID NO: 3992019 - DNA, 12 bp, Homo sapiens
ggaggtgtgagg

SEQ ID NO: 3992020 - DNA, 15 bp, Homo sapiens
ggaggtgtgaggcag

SEQ ID NO: 3992021 - DNA, 15 bp, Homo sapiens
ggaggttgggtgggc

SEQ ID NO: 3992022 - DNA, 14 bp, Homo sapiens
ggaggtttgtcggg

SEQ ID NO: 3992023 - DNA, 13 bp, Homo sapiens
ggagtagccaagc

SEQ ID NO: 3992024 - DNA, 20 bp, Homo sapiens
ggagtagtgaagactccaga

SEQ ID NO: 3992025 - DNA, 15 bp, Homo sapiens
ggagtcagagccctg

SEQ ID NO: 3992026 - DNA, 21 bp, Homo sapiens
ggagtcagagccctggctggg

SEQ ID NO: 3992027 - DNA, 20 bp, Homo sapiens
ggcagctcacccctgggcag

SEQ ID NO: 3992028 - DNA, 18 bp, Homo sapiens
ggcagctgtttctcatga

SEQ ID NO: 3992029 - DNA, 16 bp, Homo sapiens
ggcagcttcaagtgcc

SEQ ID NO: 3992030 - DNA, 14 bp, Homo sapiens
ggcagctttctaga

SEQ ID NO: 3992031 - DNA, 16 bp, Homo sapiens
ggcaggaaggagagcc

SEQ ID NO: 3992032 - DNA, 18 bp, Homo sapiens
ggcaggcacacagcagcc

SEQ ID NO: 3992033 - DNA, 19 bp, Homo sapiens
ggcaggcacacagcagccc

SEQ ID NO: 3992034 - DNA, 11 bp, Homo sapiens
ggcaggcaggg

SEQ ID NO: 3992035 - DNA, 23 bp, Homo sapiens
ggcaggcggtccccatccccacc

SEQ ID NO: 3992036 - DNA, 16 bp, Homo sapiens
ggcaggctcactgcca

SEQ ID NO: 3992037 - DNA, 10 bp, Homo sapiens
ggcaggctgg

SEQ ID NO: 3992038 - DNA, 16 bp, Homo sapiens
ggcaggctggctggcc

SEQ ID NO: 3992039 - DNA, 15 bp, Homo sapiens
ggcaggctgggccat

SEQ ID NO: 3992040 - DNA, 16 bp, Homo sapiens
ggcaggctgggccatg

SEQ ID NO: 3992041 - DNA, 15 bp, Homo sapiens
ggcagggccttcctg

SEQ ID NO: 3992042 - DNA, 21 bp, Homo sapiens
ggcagggcgggcagagggctg

SEQ ID NO: 3992043 - DNA, 22 bp, Homo sapiens
ggcagggcgggcagagggctgg

SEQ ID NO: 3992044 - DNA, 23 bp, Homo sapiens
ggcagggcgggcagagggctgga

SEQ ID NO: 3992045 - DNA, 14 bp, Homo sapiens
ggcagggctctccc

SEQ ID NO: 3992046 - DNA, 15 bp, Homo sapiens
ggcagggctctcccg

SEQ ID NO: 3992047 - DNA, 13 bp, Homo sapiens
ggcagggctctga

SEQ ID NO: 3992048 - DNA, 11 bp, Homo sapiens
ggcagggctgt

SEQ ID NO: 3992049 - DNA, 18 bp, Homo sapiens
ggcaggggagacaggagc

SEQ ID NO: 3992050 - DNA, 22 bp, Homo sapiens
ggcaggggagacaggagcctag

SEQ ID NO: 3992051 - DNA, 19 bp, Homo sapiens
ggcaggggccctgcagctc

SEQ ID NO: 3992052 - DNA, 23 bp, Homo sapiens
ggcagggggccccgccagggctg

SEQ ID NO: 3992053 - DNA, 14 bp, Homo sapiens
ggcaggggtggggg

SEQ ID NO: 3992054 - DNA, 15 bp, Homo sapiens
ggcaggtcctgccca

SEQ ID NO: 3992055 - DNA, 19 bp, Homo sapiens
ggcaggtgtgtgtggaccc

SEQ ID NO: 3992056 - DNA, 21 bp, Homo sapiens
ggcagtagaactccaggccct

SEQ ID NO: 3992057 - DNA, 11 bp, Homo sapiens
ggcagtgactt

SEQ ID NO: 3992058 - DNA, 16 bp, Homo sapiens
ggcagtgagggagggc

SEQ ID NO: 3992059 - DNA, 13 bp, Homo sapiens
ggcagtgccccag

SEQ ID NO: 3992060 - DNA, 18 bp, Homo sapiens
ggcagtgccccagggagt

SEQ ID NO: 3992061 - DNA, 13 bp, Homo sapiens
ggcagtgttttgg

SEQ ID NO: 3992062 - DNA, 18 bp, Homo sapiens
ggcagttctcactcctag

SEQ ID NO: 3992063 - DNA, 16 bp, Homo sapiens
ggcatagaggcttctc

SEQ ID NO: 3992064 - DNA, 13 bp, Homo sapiens
ggcatcagcagca

SEQ ID NO: 3992065 - DNA, 16 bp, Homo sapiens
ggcatcccagcctggg

SEQ ID NO: 3992066 - DNA, 14 bp, Homo sapiens
ggcatcgcaggagt

SEQ ID NO: 3992067 - DNA, 20 bp, Homo sapiens
ggcatctcttccccagagag

SEQ ID NO: 3992068 - DNA, 14 bp, Homo sapiens
ggcatctgcccctc

SEQ ID NO: 3992069 - DNA, 19 bp, Homo sapiens
ggcatctgcccctccccca

SEQ ID NO: 3992070 - DNA, 16 bp, Homo sapiens
ggcatcttgctggcta

SEQ ID NO: 3992071 - DNA, 17 bp, Homo sapiens
ggcatcttgctggctac

SEQ ID NO: 3992072 - DNA, 23 bp, Homo sapiens
ggcatctttgccttgggctgctc

SEQ ID NO: 3992073 - DNA, 14 bp, Homo sapiens
ggcatgccaccctc

SEQ ID NO: 3992074 - DNA, 17 bp, Homo sapiens
ggcatgggtccagggcc

SEQ ID NO: 3992075 - DNA, 23 bp, Homo sapiens
ggcatgggtccagggcctgacac

SEQ ID NO: 3992076 - DNA, 24 bp, Homo sapiens
ggcatgggtccagggcctgacacc

SEQ ID NO: 3992077 - DNA, 21 bp, Homo sapiens
ggcatggtggctcatgcctgt

SEQ ID NO: 3992078 - DNA, 12 bp, Homo sapiens
ggcattctctct

SEQ ID NO: 3992079 - DNA, 13 bp, Homo sapiens
ggcattgctttcc

SEQ ID NO: 3992080 - DNA, 21 bp, Homo sapiens
ggcatttgcagggtcctcttc

SEQ ID NO: 3992081 - DNA, 13 bp, Homo sapiens
ggcattttcctcc

SEQ ID NO: 3992082 - DNA, 14 bp, Homo sapiens
ggcattttcctcct

SEQ ID NO: 3992083 - DNA, 15 bp, Homo sapiens
ggcattttcctcctc

SEQ ID NO: 3992084 - DNA, 17 bp, Homo sapiens
ggcattttcctcctctg

SEQ ID NO: 3992085 - DNA, 19 bp, Homo sapiens
ggcattttcctcctctgcc

SEQ ID NO: 3992086 - DNA, 20 bp, Homo sapiens
ggcattttcctcctctgcct

SEQ ID NO: 3992087 - DNA, 23 bp, Homo sapiens
ggccaaaagcttccctccctgct

SEQ ID NO: 3992088 - DNA, 15 bp, Homo sapiens
ggccaaacccttgct

SEQ ID NO: 3992089 - DNA, 20 bp, Homo sapiens
ggccaaacccttgctttcct

SEQ ID NO: 3992090 - DNA, 21 bp, Homo sapiens
ggccaaacccttgctttcctg

SEQ ID NO: 3992091 - DNA, 15 bp, Homo sapiens
ggccaaacctgggac

SEQ ID NO: 3992092 - DNA, 22 bp, Homo sapiens
ggccaaactgtccctcccttgc

SEQ ID NO: 3992093 - DNA, 13 bp, Homo sapiens
ggccaaagtgtta

SEQ ID NO: 3992094 - DNA, 23 bp, Homo sapiens
ggccaacttgagggcccagagca

SEQ ID NO: 3992095 - DNA, 18 bp, Homo sapiens
ggccaagaatacttgaag

SEQ ID NO: 3992096 - DNA, 14 bp, Homo sapiens
ggccaagagaaggg

SEQ ID NO: 3992097 - DNA, 16 bp, Homo sapiens
ggccaaggtcctgctc

SEQ ID NO: 3992098 - DNA, 15 bp, Homo sapiens
ggccaataaaaagtt

SEQ ID NO: 3992099 - DNA, 17 bp, Homo sapiens
ggccaataaaaagttca

SEQ ID NO: 3992100 - DNA, 21 bp, Homo sapiens
ggccacacgcactggtgccaa

SEQ ID NO: 3992101 - DNA, 23 bp, Homo sapiens
ggccacacgcactggtgccaaaa

SEQ ID NO: 3992102 - DNA, 21 bp, Homo sapiens
ggccacactattaccatgaga

SEQ ID NO: 3992103 - DNA, 21 bp, Homo sapiens
ggccacagcaagtacagcggc

SEQ ID NO: 3992104 - DNA, 20 bp, Homo sapiens
ggccacagggcgagactccg

SEQ ID NO: 3992105 - DNA, 23 bp, Homo sapiens
ggccacagggcgagactccgtct

SEQ ID NO: 3992106 - DNA, 19 bp, Homo sapiens
ggccacatcaaagaggctg

SEQ ID NO: 3992107 - DNA, 20 bp, Homo sapiens
ggccaccagccatcctccct

SEQ ID NO: 3992108 - DNA, 22 bp, Homo sapiens
ggccaccagccatcctccctcc

SEQ ID NO: 3992109 - DNA, 23 bp, Homo sapiens
ggccacccgttctgctggcctgg

SEQ ID NO: 3992110 - DNA, 21 bp, Homo sapiens
ggccaccgggacagacctgga

SEQ ID NO: 3992111 - DNA, 19 bp, Homo sapiens
ggccacctgtagccatctg

SEQ ID NO: 3992112 - DNA, 14 bp, Homo sapiens
ggccacgccccagc

SEQ ID NO: 3992113 - DNA, 15 bp, Homo sapiens
ggccacgccccagcc

SEQ ID NO: 3992114 - DNA, 16 bp, Homo sapiens
ggccacgccccagccc

SEQ ID NO: 3992115 - DNA, 14 bp, Homo sapiens
ggccacgctccagc

SEQ ID NO: 3992116 - DNA, 13 bp, Homo sapiens
ggccacggaggag

SEQ ID NO: 3992117 - DNA, 19 bp, Homo sapiens
ggccacggctgagccttca

SEQ ID NO: 3992118 - DNA, 20 bp, Homo sapiens
ggccacggctgagccttcag

SEQ ID NO: 3992119 - DNA, 14 bp, Homo sapiens
ggccactaaagctt

SEQ ID NO: 3992120 - DNA, 17 bp, Homo sapiens
ggccactccagacccct

SEQ ID NO: 3992121 - DNA, 14 bp, Homo sapiens
ggccactggaagga

SEQ ID NO: 3992122 - DNA, 15 bp, Homo sapiens
ggccacttttgacta

SEQ ID NO: 3992123 - DNA, 16 bp, Homo sapiens
ggccagacacaggccc

SEQ ID NO: 3992124 - DNA, 17 bp, Homo sapiens
ggccagacacaggccct

SEQ ID NO: 3992125 - DNA, 18 bp, Homo sapiens
ggccagacacaggccctc

SEQ ID NO: 3992126 - DNA, 16 bp, Homo sapiens
ggccagacgctgccgc

SEQ ID NO: 3992127 - DNA, 17 bp, Homo sapiens
ggccagacgctgccgct

SEQ ID NO: 3992128 - DNA, 21 bp, Homo sapiens
ggccagaggaactgtccagag

SEQ ID NO: 3992129 - DNA, 14 bp, Homo sapiens
ggccagaggctggg

SEQ ID NO: 3992130 - DNA, 20 bp, Homo sapiens
ggcctgcagcaggagtggtg

SEQ ID NO: 3992131 - DNA, 16 bp, Homo sapiens
ggcctgccctcaggga

SEQ ID NO: 3992132 - DNA, 14 bp, Homo sapiens
ggcctgccgggctg

SEQ ID NO: 3992133 - DNA, 15 bp, Homo sapiens
ggcctgcctcccact

SEQ ID NO: 3992134 - DNA, 12 bp, Homo sapiens
ggcctgcctggc

SEQ ID NO: 3992135 - DNA, 14 bp, Homo sapiens
ggcctgcctggccc

SEQ ID NO: 3992136 - DNA, 23 bp, Homo sapiens
ggcctgcctggcccctcgcctgt

SEQ ID NO: 3992137 - DNA, 15 bp, Homo sapiens
ggcctgctccagacc

SEQ ID NO: 3992138 - DNA, 17 bp, Homo sapiens
ggcctgctgccagtgca

SEQ ID NO: 3992139 - DNA, 21 bp, Homo sapiens
ggcctgctgccagtgcagcca

SEQ ID NO: 3992140 - DNA, 20 bp, Homo sapiens
ggcctgctggaggcctcagg

SEQ ID NO: 3992141 - DNA, 16 bp, Homo sapiens
ggcctggacctgcctc

SEQ ID NO: 3992142 - DNA, 21 bp, Homo sapiens
ggcctggacctgcctcctgcc

SEQ ID NO: 3992143 - DNA, 18 bp, Homo sapiens
ggcctggatgccagctgt

SEQ ID NO: 3992144 - DNA, 14 bp, Homo sapiens
ggcctggcagccgt

SEQ ID NO: 3992145 - DNA, 14 bp, Homo sapiens
ggcctggccacctc

SEQ ID NO: 3992146 - DNA, 16 bp, Homo sapiens
ggcctggccacctctc

SEQ ID NO: 3992147 - DNA, 14 bp, Homo sapiens
ggcctggccaggag

SEQ ID NO: 3992148 - DNA, 17 bp, Homo sapiens
ggcctggccaggagctc

SEQ ID NO: 3992149 - DNA, 23 bp, Homo sapiens
ggcctggccaggagctcttcagg

SEQ ID NO: 3992150 - DNA, 12 bp, Homo sapiens
ggcctggctgga

SEQ ID NO: 3992151 - DNA, 22 bp, Homo sapiens
ggcctggctggaggagcagcag

SEQ ID NO: 3992152 - DNA, 17 bp, Homo sapiens
ggcctgggacttccatg

SEQ ID NO: 3992153 - DNA, 17 bp, Homo sapiens
ggcctgggcctctgccc

SEQ ID NO: 3992154 - DNA, 21 bp, Homo sapiens
ggcctgggtgctggctgccca

SEQ ID NO: 3992155 - DNA, 20 bp, Homo sapiens
ggcctgtcccttgcctctgc

SEQ ID NO: 3992156 - DNA, 23 bp, Homo sapiens
ggcctgtctcatccccaggggtc

SEQ ID NO: 3992157 - DNA, 21 bp, Homo sapiens
ggccttagtgggccagggctg

SEQ ID NO: 3992158 - DNA, 21 bp, Homo sapiens
ggccttatcgggctccagcca

SEQ ID NO: 3992159 - DNA, 14 bp, Homo sapiens
ggccttccagctgc

SEQ ID NO: 3992160 - DNA, 15 bp, Homo sapiens
ggccttccagctgct

SEQ ID NO: 3992161 - DNA, 16 bp, Homo sapiens
ggccttccagctgctg

SEQ ID NO: 3992162 - DNA, 17 bp, Homo sapiens
ggccttccagctgctgt

SEQ ID NO: 3992163 - DNA, 23 bp, Homo sapiens
ggccttgacatcagttcctttgt

SEQ ID NO: 3992164 - DNA, 22 bp, Homo sapiens
ggccttggatcgctaagctggc

SEQ ID NO: 3992165 - DNA, 21 bp, Homo sapiens
ggccttgtcctacgtccaagg

SEQ ID NO: 3992166 - DNA, 20 bp, Homo sapiens
ggcctttccttccctctctg

SEQ ID NO: 3992167 - DNA, 23 bp, Homo sapiens
ggcctttgcttatgaatatttat

SEQ ID NO: 3992168 - DNA, 20 bp, Homo sapiens
ggcgacagagcgagactccg

SEQ ID NO: 3992169 - DNA, 15 bp, Homo sapiens
ggcgagagaggagcc

SEQ ID NO: 3992170 - DNA, 18 bp, Homo sapiens
ggcgagagaggagccaga

SEQ ID NO: 3992171 - DNA, 17 bp, Homo sapiens
ggcgaggggttggtggg

SEQ ID NO: 3992172 - DNA, 22 bp, Homo sapiens
ggcgatccacctgtctcagcct

SEQ ID NO: 3992173 - DNA, 15 bp, Homo sapiens
ggcgcccctgccacc

SEQ ID NO: 3992174 - DNA, 22 bp, Homo sapiens
ggcgcccctgccacctccctga

SEQ ID NO: 3992175 - DNA, 14 bp, Homo sapiens
ggcgcggccagccc

SEQ ID NO: 3992176 - DNA, 20 bp, Homo sapiens
ggcgctcagacggcggccag

SEQ ID NO: 3992177 - DNA, 20 bp, Homo sapiens
ggcgctgaggtgtctggcct

SEQ ID NO: 3992178 - DNA, 21 bp, Homo sapiens
ggcgctgaggtgtctggcctg

SEQ ID NO: 3992179 - DNA, 22 bp, Homo sapiens
ggcgctgaggtgtctggcctga

SEQ ID NO: 3992180 - DNA, 22 bp, Homo sapiens
ggcggaaagcctgtaagcctgc

SEQ ID NO: 3992181 - DNA, 18 bp, Homo sapiens
ggcggacggctgtggacc

SEQ ID NO: 3992182 - DNA, 13 bp, Homo sapiens
ggcggagccggcc

SEQ ID NO: 3992183 - DNA, 21 bp, Homo sapiens
ggcggagcttgcagtgagccg

SEQ ID NO: 3992184 - DNA, 21 bp, Homo sapiens
ggcggccacgcactgggccac

SEQ ID NO: 3992185 - DNA, 11 bp, Homo sapiens
ggcggccaggc

SEQ ID NO: 3992186 - DNA, 12 bp, Homo sapiens
ggcggccaggca

SEQ ID NO: 3992187 - DNA, 15 bp, Homo sapiens
ggcggccaggcacag

SEQ ID NO: 3992188 - DNA, 17 bp, Homo sapiens
ggcggccaggcacaggg

SEQ ID NO: 3992189 - DNA, 18 bp, Homo sapiens
ggcggccaggcacagggc

SEQ ID NO: 3992190 - DNA, 17 bp, Homo sapiens
ggcggcccggccagcgg

SEQ ID NO: 3992191 - DNA, 16 bp, Homo sapiens
ggcggctactctggaa

SEQ ID NO: 3992192 - DNA, 18 bp, Homo sapiens
ggcggctcggaggaagcc

SEQ ID NO: 3992193 - DNA, 17 bp, Homo sapiens
ggcggtgcccacaccgg

SEQ ID NO: 3992194 - DNA, 23 bp, Homo sapiens
ggcggtgcccacaccggggacag

SEQ ID NO: 3992195 - DNA, 13 bp, Homo sapiens
ggcggtggctgcc

SEQ ID NO: 3992196 - DNA, 18 bp, Homo sapiens
ggcgtgggagccagcctc

SEQ ID NO: 3992197 - DNA, 18 bp, Homo sapiens
ggcgtgggctgaccaggc

SEQ ID NO: 3992198 - DNA, 18 bp, Homo sapiens
ggcgttctgctgcccctg

SEQ ID NO: 3992199 - DNA, 15 bp, Homo sapiens
ggctaaggcccccaa

SEQ ID NO: 3992200 - DNA, 13 bp, Homo sapiens
ggctaatttttgt

SEQ ID NO: 3992201 - DNA, 17 bp, Homo sapiens
ggctacccgtgagccct

SEQ ID NO: 3992202 - DNA, 13 bp, Homo sapiens
ggctagagaaatc

SEQ ID NO: 3992203 - DNA, 16 bp, Homo sapiens
ggctagaggccagccc

SEQ ID NO: 3992204 - DNA, 20 bp, Homo sapiens
ggctagaggccagccccacc

SEQ ID NO: 3992205 - DNA, 20 bp, Homo sapiens
ggctagcctttcttgtagcc

SEQ ID NO: 3992206 - DNA, 14 bp, Homo sapiens
ggctagggggagcc

SEQ ID NO: 3992207 - DNA, 20 bp, Homo sapiens
ggctagtcttgaatttctga

SEQ ID NO: 3992208 - DNA, 19 bp, Homo sapiens
ggctatgtatggaatacag

SEQ ID NO: 3992209 - DNA, 22 bp, Homo sapiens
ggctatttttgaagcaaagaag

SEQ ID NO: 3992210 - DNA, 23 bp, Homo sapiens
ggctcaagcaatcctcctgcctc

SEQ ID NO: 3992211 - DNA, 17 bp, Homo sapiens
ggctcaagcccaggagg

SEQ ID NO: 3992212 - DNA, 23 bp, Homo sapiens
ggctcacagtacagcatgtgcct

SEQ ID NO: 3992213 - DNA, 17 bp, Homo sapiens
ggctcacgcctgtaatc

SEQ ID NO: 3992214 - DNA, 14 bp, Homo sapiens
ggctcactgccagg

SEQ ID NO: 3992215 - DNA, 15 bp, Homo sapiens
ggctcactgccaggc

SEQ ID NO: 3992216 - DNA, 18 bp, Homo sapiens
ggctcactgccaggccag

SEQ ID NO: 3992217 - DNA, 17 bp, Homo sapiens
ggctcactggctttgaa

SEQ ID NO: 3992218 - DNA, 13 bp, Homo sapiens
ggctcagagatgt

SEQ ID NO: 3992219 - DNA, 17 bp, Homo sapiens
ggctcagatgaaatgca

SEQ ID NO: 3992220 - DNA, 18 bp, Homo sapiens
ggctcagatggactggga

SEQ ID NO: 3992221 - DNA, 20 bp, Homo sapiens
ggctcagatggactgggagg

SEQ ID NO: 3992222 - DNA, 15 bp, Homo sapiens
ggctcagccagcact

SEQ ID NO: 3992223 - DNA, 14 bp, Homo sapiens
ggctccacacacac

SEQ ID NO: 3992224 - DNA, 22 bp, Homo sapiens
ggctccactcttgatctctctt

SEQ ID NO: 3992225 - DNA, 16 bp, Homo sapiens
ggctccagatgcaggg

SEQ ID NO: 3992226 - DNA, 18 bp, Homo sapiens
ggctccagatgcagggca

SEQ ID NO: 3992227 - DNA, 13 bp, Homo sapiens
ggctccaggcagc

SEQ ID NO: 3992228 - DNA, 13 bp, Homo sapiens
ggctccatgccag

SEQ ID NO: 3992229 - DNA, 22 bp, Homo sapiens
ggctcccaaaacacctgacagc

SEQ ID NO: 3992230 - DNA, 12 bp, Homo sapiens
ggctcccagggg

SEQ ID NO: 3992231 - DNA, 20 bp, Homo sapiens
ggctcccaggggtctccctg

SEQ ID NO: 3992232 - DNA, 14 bp, Homo sapiens
ggctgtcatctgtg

SEQ ID NO: 3992233 - DNA, 12 bp, Homo sapiens
ggctgtggaagg

SEQ ID NO: 3992234 - DNA, 18 bp, Homo sapiens
ggctgttctgtggttcct

SEQ ID NO: 3992235 - DNA, 17 bp, Homo sapiens
ggctgtttagcagaact

SEQ ID NO: 3992236 - DNA, 16 bp, Homo sapiens
ggcttaatgtttattc

SEQ ID NO: 3992237 - DNA, 20 bp, Homo sapiens
ggcttagtatttctcaggaa

SEQ ID NO: 3992238 - DNA, 22 bp, Homo sapiens
ggcttagtatttctcaggaaga

SEQ ID NO: 3992239 - DNA, 21 bp, Homo sapiens
ggcttataaacacattgaatg

SEQ ID NO: 3992240 - DNA, 15 bp, Homo sapiens
ggcttcactgtataa

SEQ ID NO: 3992241 - DNA, 22 bp, Homo sapiens
ggcttcactgtataaataggag

SEQ ID NO: 3992242 - DNA, 16 bp, Homo sapiens
ggcttcatgccagcta

SEQ ID NO: 3992243 - DNA, 15 bp, Homo sapiens
ggcttccagcttcag

SEQ ID NO: 3992244 - DNA, 21 bp, Homo sapiens
ggcttccagcttcaggcacca

SEQ ID NO: 3992245 - DNA, 15 bp, Homo sapiens
ggcttccccactccc

SEQ ID NO: 3992246 - DNA, 22 bp, Homo sapiens
ggcttcccgctcagccctccct

SEQ ID NO: 3992247 - DNA, 23 bp, Homo sapiens
ggcttctccgccagcctcctctg

SEQ ID NO: 3992248 - DNA, 13 bp, Homo sapiens
ggcttgaagccaa

SEQ ID NO: 3992249 - DNA, 14 bp, Homo sapiens
ggcttgacagcatg

SEQ ID NO: 3992250 - DNA, 21 bp, Homo sapiens
ggcttgagaaatatggacact

SEQ ID NO: 3992251 - DNA, 13 bp, Homo sapiens
ggcttgctgcaga

SEQ ID NO: 3992252 - DNA, 13 bp, Homo sapiens
ggcttggcccagc

SEQ ID NO: 3992253 - DNA, 15 bp, Homo sapiens
ggcttgggccctgca

SEQ ID NO: 3992254 - DNA, 17 bp, Homo sapiens
ggcttgggccctgcaca

SEQ ID NO: 3992255 - DNA, 13 bp, Homo sapiens
ggcttgtgggctg

SEQ ID NO: 3992256 - DNA, 15 bp, Homo sapiens
ggcttgtgggctggt

SEQ ID NO: 3992257 - DNA, 14 bp, Homo sapiens
ggctttcccaggag

SEQ ID NO: 3992258 - DNA, 20 bp, Homo sapiens
ggctttctcttccccttcct

SEQ ID NO: 3992259 - DNA, 21 bp, Homo sapiens
ggctttgaaacctcagggctg

SEQ ID NO: 3992260 - DNA, 19 bp, Homo sapiens
ggctttgcacttgacctca

SEQ ID NO: 3992261 - DNA, 21 bp, Homo sapiens
ggctttgcccacccctcactc

SEQ ID NO: 3992262 - DNA, 23 bp, Homo sapiens
ggctttgcccacccctcactccc

SEQ ID NO: 3992263 - DNA, 13 bp, Homo sapiens
ggctttgccttgc

SEQ ID NO: 3992264 - DNA, 18 bp, Homo sapiens
ggctttggttccttctct

SEQ ID NO: 3992265 - DNA, 13 bp, Homo sapiens
ggctttgtgttgt

SEQ ID NO: 3992266 - DNA, 19 bp, Homo sapiens
ggcttttcactgctggctg

SEQ ID NO: 3992267 - DNA, 19 bp, Homo sapiens
ggctttttcctctgagccc

SEQ ID NO: 3992268 - DNA, 17 bp, Homo sapiens
ggctttttgccatctgt

SEQ ID NO: 3992269 - DNA, 13 bp, Homo sapiens
gggaaaaaaaaaa

SEQ ID NO: 3992270 - DNA, 23 bp, Homo sapiens
gggaaaagcatttttcaatatat

SEQ ID NO: 3992271 - DNA, 20 bp, Homo sapiens
gggaaacctagagaagataa

SEQ ID NO: 3992272 - DNA, 21 bp, Homo sapiens
gggaaagccttaagctgcagg

SEQ ID NO: 3992273 - DNA, 15 bp, Homo sapiens
gggaaaggatatttt

SEQ ID NO: 3992274 - DNA, 12 bp, Homo sapiens
gggaacagtgtt

SEQ ID NO: 3992275 - DNA, 20 bp, Homo sapiens
gggaacagtgtttcccataa

SEQ ID NO: 3992276 - DNA, 19 bp, Homo sapiens
gggaaccatgaagacagga

SEQ ID NO: 3992277 - DNA, 12 bp, Homo sapiens
gggaaccctgct

SEQ ID NO: 3992278 - DNA, 17 bp, Homo sapiens
gggaagacgcctgagct

SEQ ID NO: 3992279 - DNA, 20 bp, Homo sapiens
gggaagagggggctggccat

SEQ ID NO: 3992280 - DNA, 22 bp, Homo sapiens
gggaagataggctctgcacaga

SEQ ID NO: 3992281 - DNA, 18 bp, Homo sapiens
gggaagatgaggttctga

SEQ ID NO: 3992282 - DNA, 23 bp, Homo sapiens
gggaagatgaggttctgagacca

SEQ ID NO: 3992283 - DNA, 17 bp, Homo sapiens
gggaagctgccagccca

SEQ ID NO: 3992284 - DNA, 18 bp, Homo sapiens
gggaaggcacagggagaa

SEQ ID NO: 3992285 - DNA, 15 bp, Homo sapiens
gggaaggccctgagg

SEQ ID NO: 3992286 - DNA, 13 bp, Homo sapiens
gggaaggcctgac

SEQ ID NO: 3992287 - DNA, 12 bp, Homo sapiens
gggaagggccag

SEQ ID NO: 3992288 - DNA, 18 bp, Homo sapiens
gggaaggggggtcagaag

SEQ ID NO: 3992289 - DNA, 15 bp, Homo sapiens
gggaagtagtccttg

SEQ ID NO: 3992290 - DNA, 22 bp, Homo sapiens
gggaagttgcattcctttgtct

SEQ ID NO: 3992291 - DNA, 14 bp, Homo sapiens
gggaatgagcccag

SEQ ID NO: 3992292 - DNA, 23 bp, Homo sapiens
gggaatgtttgggcagaagggag

SEQ ID NO: 3992293 - DNA, 18 bp, Homo sapiens
gggacaagtggactcagg

SEQ ID NO: 3992294 - DNA, 22 bp, Homo sapiens
gggacaagtggactcagggcag

SEQ ID NO: 3992295 - DNA, 14 bp, Homo sapiens
gggacacccagaaa

SEQ ID NO: 3992296 - DNA, 20 bp, Homo sapiens
gggacacccctacacacacc

SEQ ID NO: 3992297 - DNA, 14 bp, Homo sapiens
gggacacctgccct

SEQ ID NO: 3992298 - DNA, 16 bp, Homo sapiens
gggacacctgccctgc

SEQ ID NO: 3992299 - DNA, 15 bp, Homo sapiens
gggacagacctggac

SEQ ID NO: 3992300 - DNA, 21 bp, Homo sapiens
gggacagaggccccagcctcc

SEQ ID NO: 3992301 - DNA, 14 bp, Homo sapiens
gggacagaggcctg

SEQ ID NO: 3992302 - DNA, 17 bp, Homo sapiens
gggacagaggcctgccc

SEQ ID NO: 3992303 - DNA, 18 bp, Homo sapiens
gggacagaggcctgcccg

SEQ ID NO: 3992304 - DNA, 20 bp, Homo sapiens
gggacagccagagctgggtg

SEQ ID NO: 3992305 - DNA, 19 bp, Homo sapiens
gggacagcccagagcctgg

SEQ ID NO: 3992306 - DNA, 11 bp, Homo sapiens
gggacagctgt

SEQ ID NO: 3992307 - DNA, 19 bp, Homo sapiens
gggacagtgataggcccaa

SEQ ID NO: 3992308 - DNA, 21 bp, Homo sapiens
gggaccacatgccactgcctg

SEQ ID NO: 3992309 - DNA, 22 bp, Homo sapiens
gggaccacatgccactgcctgc

SEQ ID NO: 3992310 - DNA, 13 bp, Homo sapiens
gggaccatgtgtc

SEQ ID NO: 3992311 - DNA, 17 bp, Homo sapiens
gggaccatgtgtcactt

SEQ ID NO: 3992312 - DNA, 13 bp, Homo sapiens
gggaccctgcctc

SEQ ID NO: 3992313 - DNA, 23 bp, Homo sapiens
gggaccctgtgacatggtgcctg

SEQ ID NO: 3992314 - DNA, 20 bp, Homo sapiens
gggaccggtgctgcaggagt

SEQ ID NO: 3992315 - DNA, 18 bp, Homo sapiens
gggaccgtccaggggaga

SEQ ID NO: 3992316 - DNA, 17 bp, Homo sapiens
gggacctgccaggcagg

SEQ ID NO: 3992317 - DNA, 19 bp, Homo sapiens
gggacctgccaggcagggg

SEQ ID NO: 3992318 - DNA, 21 bp, Homo sapiens
gggacctggtaccctcctggc

SEQ ID NO: 3992319 - DNA, 14 bp, Homo sapiens
gggacctttaactt

SEQ ID NO: 3992320 - DNA, 16 bp, Homo sapiens
gggacgatcaggagga

SEQ ID NO: 3992321 - DNA, 17 bp, Homo sapiens
gggacggaccagcatct

SEQ ID NO: 3992322 - DNA, 22 bp, Homo sapiens
gggacgtggctcagccagcact

SEQ ID NO: 3992323 - DNA, 22 bp, Homo sapiens
gggacgttcgtggtcctgcgct

SEQ ID NO: 3992324 - DNA, 13 bp, Homo sapiens
gggactcagggac

SEQ ID NO: 3992325 - DNA, 20 bp, Homo sapiens
gggactctgaagcctctggg

SEQ ID NO: 3992326 - DNA, 12 bp, Homo sapiens
gggactgggggg

SEQ ID NO: 3992327 - DNA, 21 bp, Homo sapiens
gggactgtctttcagatacat

SEQ ID NO: 3992328 - DNA, 14 bp, Homo sapiens
gggactgttccaaa

SEQ ID NO: 3992329 - DNA, 19 bp, Homo sapiens
gggactgttccaaagccag

SEQ ID NO: 3992330 - DNA, 15 bp, Homo sapiens
gggagaaaaagaaac

SEQ ID NO: 3992331 - DNA, 11 bp, Homo sapiens
gggagaaaaga

SEQ ID NO: 3992332 - DNA, 22 bp, Homo sapiens
gggagaagaaaggtgagtttga

SEQ ID NO: 3992333 - DNA, 12 bp, Homo sapiens
gggagaagctcc

SEQ ID NO: 3992334 - DNA, 21 bp, Homo sapiens
gggagaaggcatgagaaagaa

SEQ ID NO: 3992335 - DNA, 21 bp, Homo sapiens
gggccttgctgctgctgcacc

SEQ ID NO: 3992336 - DNA, 15 bp, Homo sapiens
gggcctttgcaagat

SEQ ID NO: 3992337 - DNA, 22 bp, Homo sapiens
gggcgctcagacggcggccagg

SEQ ID NO: 3992338 - DNA, 15 bp, Homo sapiens
gggcggacggctgtg

SEQ ID NO: 3992339 - DNA, 15 bp, Homo sapiens
gggcggcaggaggga

SEQ ID NO: 3992340 - DNA, 15 bp, Homo sapiens
gggcggcggccacgc

SEQ ID NO: 3992341 - DNA, 19 bp, Homo sapiens
gggcgggccatgagggaca

SEQ ID NO: 3992342 - DNA, 14 bp, Homo sapiens
gggcgtgaggtccc

SEQ ID NO: 3992343 - DNA, 16 bp, Homo sapiens
gggcgtgaggtcccag

SEQ ID NO: 3992344 - DNA, 18 bp, Homo sapiens
gggcgttgggagcctagc

SEQ ID NO: 3992345 - DNA, 19 bp, Homo sapiens
gggctaacgggaggctggg

SEQ ID NO: 3992346 - DNA, 22 bp, Homo sapiens
gggctaacgggaggctgggcac

SEQ ID NO: 3992347 - DNA, 21 bp, Homo sapiens
gggctcaagcaatcctcctgc

SEQ ID NO: 3992348 - DNA, 20 bp, Homo sapiens
gggctcagatggactgggag

SEQ ID NO: 3992349 - DNA, 21 bp, Homo sapiens
gggctcagggagggagggcgg

SEQ ID NO: 3992350 - DNA, 23 bp, Homo sapiens
gggctcccaggggtctccctggc

SEQ ID NO: 3992351 - DNA, 22 bp, Homo sapiens
gggctcccggagagggagtcag

SEQ ID NO: 3992352 - DNA, 13 bp, Homo sapiens
gggctcctgcccc

SEQ ID NO: 3992353 - DNA, 21 bp, Homo sapiens
gggctcctttctccagccagc

SEQ ID NO: 3992354 - DNA, 16 bp, Homo sapiens
gggctgaccaggcttc

SEQ ID NO: 3992355 - DNA, 20 bp, Homo sapiens
gggctgactagaagggccag

SEQ ID NO: 3992356 - DNA, 14 bp, Homo sapiens
gggctgaggccaga

SEQ ID NO: 3992357 - DNA, 15 bp, Homo sapiens
gggctgaggccagag

SEQ ID NO: 3992358 - DNA, 18 bp, Homo sapiens
gggctgaggccagagtca

SEQ ID NO: 3992359 - DNA, 13 bp, Homo sapiens
gggctgagggcct

SEQ ID NO: 3992360 - DNA, 17 bp, Homo sapiens
gggctgagggcctgctg

SEQ ID NO: 3992361 - DNA, 18 bp, Homo sapiens
gggctgagggcctgctgg

SEQ ID NO: 3992362 - DNA, 11 bp, Homo sapiens
gggctgagggg

SEQ ID NO: 3992363 - DNA, 18 bp, Homo sapiens
gggctgaggggcaacgaa

SEQ ID NO: 3992364 - DNA, 18 bp, Homo sapiens
gggctgccaccagccccc

SEQ ID NO: 3992365 - DNA, 19 bp, Homo sapiens
gggctgccaccagcccccg

SEQ ID NO: 3992366 - DNA, 14 bp, Homo sapiens
gggctgccagcagc

SEQ ID NO: 3992367 - DNA, 18 bp, Homo sapiens
gggctgccagcagccccg

SEQ ID NO: 3992368 - DNA, 18 bp, Homo sapiens
gggctgccatgtgaagag

SEQ ID NO: 3992369 - DNA, 20 bp, Homo sapiens
gggctgcccctaatctctgt

SEQ ID NO: 3992370 - DNA, 13 bp, Homo sapiens
gggctgccctgag

SEQ ID NO: 3992371 - DNA, 12 bp, Homo sapiens
gggctgctcacc

SEQ ID NO: 3992372 - DNA, 19 bp, Homo sapiens
gggctggactggaggtggg

SEQ ID NO: 3992373 - DNA, 21 bp, Homo sapiens
gggctggactggaggtgggca

SEQ ID NO: 3992374 - DNA, 18 bp, Homo sapiens
gggctggacttctacctg

SEQ ID NO: 3992375 - DNA, 14 bp, Homo sapiens
gggctggccatggg

SEQ ID NO: 3992376 - DNA, 22 bp, Homo sapiens
gggctggccccagggcaccctg

SEQ ID NO: 3992377 - DNA, 17 bp, Homo sapiens
gggctggctctgcacta

SEQ ID NO: 3992378 - DNA, 18 bp, Homo sapiens
gggctgggccctctcttc

SEQ ID NO: 3992379 - DNA, 22 bp, Homo sapiens
gggctgggggactggggggcca

SEQ ID NO: 3992380 - DNA, 13 bp, Homo sapiens
gggctgggggagg

SEQ ID NO: 3992381 - DNA, 19 bp, Homo sapiens
gggctggtgccccacagct

SEQ ID NO: 3992382 - DNA, 16 bp, Homo sapiens
gggctgtcatctgtgc

SEQ ID NO: 3992383 - DNA, 15 bp, Homo sapiens
gggctgtcccagccc

SEQ ID NO: 3992384 - DNA, 16 bp, Homo sapiens
gggctgtcccagcccc

SEQ ID NO: 3992385 - DNA, 14 bp, Homo sapiens
gggctgtctgtcac

SEQ ID NO: 3992386 - DNA, 18 bp, Homo sapiens
gggcttacaaagccttac

SEQ ID NO: 3992387 - DNA, 17 bp, Homo sapiens
gggcttacaggcatgga

SEQ ID NO: 3992388 - DNA, 20 bp, Homo sapiens
gggcttataataaaggactg

SEQ ID NO: 3992389 - DNA, 22 bp, Homo sapiens
gggcttcctgcccttccctctg

SEQ ID NO: 3992390 - DNA, 13 bp, Homo sapiens
gggcttgaagcca

SEQ ID NO: 3992391 - DNA, 16 bp, Homo sapiens
gggcttgactttggct

SEQ ID NO: 3992392 - DNA, 17 bp, Homo sapiens
gggcttggcctgctgtg

SEQ ID NO: 3992393 - DNA, 17 bp, Homo sapiens
gggcttgtcatagccag

SEQ ID NO: 3992394 - DNA, 17 bp, Homo sapiens
gggctttctcttcccct

SEQ ID NO: 3992395 - DNA, 18 bp, Homo sapiens
gggctttgccttgcagcc

SEQ ID NO: 3992396 - DNA, 17 bp, Homo sapiens
gggctttggttccttct

SEQ ID NO: 3992397 - DNA, 18 bp, Homo sapiens
gggctttggttccttctc

SEQ ID NO: 3992398 - DNA, 19 bp, Homo sapiens
gggctttggttccttctct

SEQ ID NO: 3992399 - DNA, 14 bp, Homo sapiens
ggggaaatgtaata

SEQ ID NO: 3992400 - DNA, 13 bp, Homo sapiens
ggggaaatgtgga

SEQ ID NO: 3992401 - DNA, 14 bp, Homo sapiens
ggggaacagaccag

SEQ ID NO: 3992402 - DNA, 22 bp, Homo sapiens
ggggaacctgccatgccaggaa

SEQ ID NO: 3992403 - DNA, 18 bp, Homo sapiens
ggggaactcagatccagg

SEQ ID NO: 3992404 - DNA, 22 bp, Homo sapiens
ggggacagaggcctgcccgggc

SEQ ID NO: 3992405 - DNA, 21 bp, Homo sapiens
ggggacccaatgtaggagctg

SEQ ID NO: 3992406 - DNA, 18 bp, Homo sapiens
ggggaccccaacctcaga

SEQ ID NO: 3992407 - DNA, 11 bp, Homo sapiens
ggggaccctgt

SEQ ID NO: 3992408 - DNA, 23 bp, Homo sapiens
ggggactctgagcgggaggcaga

SEQ ID NO: 3992409 - DNA, 24 bp, Homo sapiens
ggggactgggagtcagagccctgg

SEQ ID NO: 3992410 - DNA, 20 bp, Homo sapiens
ggggagaagagccctggaca

SEQ ID NO: 3992411 - DNA, 17 bp, Homo sapiens
ggggagagacaggcagc

SEQ ID NO: 3992412 - DNA, 21 bp, Homo sapiens
ggggagcaggaggccaataaa

SEQ ID NO: 3992413 - DNA, 12 bp, Homo sapiens
ggggagcccagt

SEQ ID NO: 3992414 - DNA, 15 bp, Homo sapiens
ggggaggcgcacagt

SEQ ID NO: 3992415 - DNA, 11 bp, Homo sapiens
ggggaggcttt

SEQ ID NO: 3992416 - DNA, 15 bp, Homo sapiens
ggggagggcaggatg

SEQ ID NO: 3992417 - DNA, 22 bp, Homo sapiens
ggggagtggttaggcagcaagc

SEQ ID NO: 3992418 - DNA, 17 bp, Homo sapiens
ggggagttaagacctgg

SEQ ID NO: 3992419 - DNA, 21 bp, Homo sapiens
ggggagttaagacctggcagc

SEQ ID NO: 3992420 - DNA, 21 bp, Homo sapiens
ggggatccctcccccccatgc

SEQ ID NO: 3992421 - DNA, 13 bp, Homo sapiens
ggggatgggccag

SEQ ID NO: 3992422 - DNA, 18 bp, Homo sapiens
ggggatgtgggagggagc

SEQ ID NO: 3992423 - DNA, 18 bp, Homo sapiens
ggggattgcccctggctt

SEQ ID NO: 3992424 - DNA, 23 bp, Homo sapiens
ggggattgcccctggctttgcct

SEQ ID NO: 3992425 - DNA, 15 bp, Homo sapiens
ggggcaactgtatga

SEQ ID NO: 3992426 - DNA, 21 bp, Homo sapiens
ggggcacactacagagcagct

SEQ ID NO: 3992427 - DNA, 13 bp, Homo sapiens
ggggcaggactga

SEQ ID NO: 3992428 - DNA, 15 bp, Homo sapiens
ggggcaggctgggcc

SEQ ID NO: 3992429 - DNA, 21 bp, Homo sapiens
ggggcagggaaggggaggcag

SEQ ID NO: 3992430 - DNA, 14 bp, Homo sapiens
ggggcagggccttc

SEQ ID NO: 3992431 - DNA, 16 bp, Homo sapiens
ggggccagaggctggg

SEQ ID NO: 3992432 - DNA, 14 bp, Homo sapiens
ggggcccagcccct

SEQ ID NO: 3992433 - DNA, 14 bp, Homo sapiens
ggggccccgccagg

SEQ ID NO: 3992434 - DNA, 21 bp, Homo sapiens
ggggccccgccagggctgggg

SEQ ID NO: 3992435 - DNA, 11 bp, Homo sapiens
ggggccctggg

SEQ ID NO: 3992436 - DNA, 13 bp, Homo sapiens
ggggccctgggcc

SEQ ID NO: 3992437 - DNA, 14 bp, Homo sapiens
ggggccctgggcct

SEQ ID NO: 3992438 - DNA, 20 bp, Homo sapiens
ggtcattaaggccacatcca

SEQ ID NO: 3992439 - DNA, 17 bp, Homo sapiens
ggtccaaaaaaaggaaa

SEQ ID NO: 3992440 - DNA, 19 bp, Homo sapiens
ggtccaaaaaaaggaaaaa

SEQ ID NO: 3992441 - DNA, 17 bp, Homo sapiens
ggtccaattagtttcct

SEQ ID NO: 3992442 - DNA, 15 bp, Homo sapiens
ggtccactccctgct

SEQ ID NO: 3992443 - DNA, 11 bp, Homo sapiens
ggtccagggaa

SEQ ID NO: 3992444 - DNA, 21 bp, Homo sapiens
ggtccagggaagctggccgag

SEQ ID NO: 3992445 - DNA, 22 bp, Homo sapiens
ggtccagggcctgacaccccct

SEQ ID NO: 3992446 - DNA, 13 bp, Homo sapiens
ggtccatgcccac

SEQ ID NO: 3992447 - DNA, 16 bp, Homo sapiens
ggtccatgcccactgc

SEQ ID NO: 3992448 - DNA, 19 bp, Homo sapiens
ggtccatgcccactgctgg

SEQ ID NO: 3992449 - DNA, 20 bp, Homo sapiens
ggtccatgcccactgctggt

SEQ ID NO: 3992450 - DNA, 16 bp, Homo sapiens
ggtccatttgttcctg

SEQ ID NO: 3992451 - DNA, 14 bp, Homo sapiens
ggtcccagccaccc

SEQ ID NO: 3992452 - DNA, 23 bp, Homo sapiens
ggtcccagttttgttgccccaga

SEQ ID NO: 3992453 - DNA, 19 bp, Homo sapiens
ggtccccagcccttcctct

SEQ ID NO: 3992454 - DNA, 24 bp, Homo sapiens
ggtcccggttcagacccctgcctg

SEQ ID NO: 3992455 - DNA, 16 bp, Homo sapiens
ggtccctcactccaca

SEQ ID NO: 3992456 - DNA, 13 bp, Homo sapiens
ggtccctgcctta

SEQ ID NO: 3992457 - DNA, 23 bp, Homo sapiens
ggtccctgggaggaaatttgaat

SEQ ID NO: 3992458 - DNA, 22 bp, Homo sapiens
ggtccctgtgtgtaggctgggg

SEQ ID NO: 3992459 - DNA, 19 bp, Homo sapiens
ggtccgtccggtgtgtcag

SEQ ID NO: 3992460 - DNA, 14 bp, Homo sapiens
ggtcctagcccttc

SEQ ID NO: 3992461 - DNA, 16 bp, Homo sapiens
ggtcctagcccttccc

SEQ ID NO: 3992462 - DNA, 23 bp, Homo sapiens
ggtcctccgtagggtctttcttg

SEQ ID NO: 3992463 - DNA, 13 bp, Homo sapiens
ggtcctctgtcag

SEQ ID NO: 3992464 - DNA, 21 bp, Homo sapiens
ggtcctctgtcagtcacagcc

SEQ ID NO: 3992465 - DNA, 20 bp, Homo sapiens
ggtcctgcccatgtgtcccc

SEQ ID NO: 3992466 - DNA, 22 bp, Homo sapiens
ggtcctgcccatgtgtcccctc

SEQ ID NO: 3992467 - DNA, 17 bp, Homo sapiens
ggtcctggagcagacca

SEQ ID NO: 3992468 - DNA, 12 bp, Homo sapiens
ggtcctggctcc

SEQ ID NO: 3992469 - DNA, 22 bp, Homo sapiens
ggtcgaggagtaacaatacaaa

SEQ ID NO: 3992470 - DNA, 14 bp, Homo sapiens
ggtcgcccaggaga

SEQ ID NO: 3992471 - DNA, 13 bp, Homo sapiens
ggtcggccctgcc

SEQ ID NO: 3992472 - DNA, 18 bp, Homo sapiens
ggtcgggcagccagcaga

SEQ ID NO: 3992473 - DNA, 21 bp, Homo sapiens
ggtcgttttaaaaacaaaaat

SEQ ID NO: 3992474 - DNA, 23 bp, Homo sapiens
ggtctcaaactcctgacctcagg

SEQ ID NO: 3992475 - DNA, 21 bp, Homo sapiens
ggtctcaaactcctgggctca

SEQ ID NO: 3992476 - DNA, 23 bp, Homo sapiens
ggtctcaaactcctgggctcagg

SEQ ID NO: 3992477 - DNA, 22 bp, Homo sapiens
ggtctcaaacttgtggcctcaa

SEQ ID NO: 3992478 - DNA, 21 bp, Homo sapiens
ggtctcatgtaacacataaac

SEQ ID NO: 3992479 - DNA, 17 bp, Homo sapiens
ggtctcatgtcctgctg

SEQ ID NO: 3992480 - DNA, 16 bp, Homo sapiens
ggtctcccacgtggga

SEQ ID NO: 3992481 - DNA, 20 bp, Homo sapiens
ggtctccccaattctcccct

SEQ ID NO: 3992482 - DNA, 16 bp, Homo sapiens
ggtctccctggctccc

SEQ ID NO: 3992483 - DNA, 17 bp, Homo sapiens
ggtctccctggctccct

SEQ ID NO: 3992484 - DNA, 14 bp, Homo sapiens
ggtctcctcagggt

SEQ ID NO: 3992485 - DNA, 19 bp, Homo sapiens
ggtctcgctgtcactggct

SEQ ID NO: 3992486 - DNA, 19 bp, Homo sapiens
ggtctcgctttgttgccca

SEQ ID NO: 3992487 - DNA, 21 bp, Homo sapiens
ggtctcgctttgttgcccagg

SEQ ID NO: 3992488 - DNA, 20 bp, Homo sapiens
ggtctcggatgacaccctgg

SEQ ID NO: 3992489 - DNA, 21 bp, Homo sapiens
ggtctcgttttgttgccaaag

SEQ ID NO: 3992490 - DNA, 10 bp, Homo sapiens
ggtctctggt

SEQ ID NO: 3992491 - DNA, 21 bp, Homo sapiens
ggtctcttgagggagcttagc

SEQ ID NO: 3992492 - DNA, 20 bp, Homo sapiens
ggtctcttttgtaaattaaa

SEQ ID NO: 3992493 - DNA, 13 bp, Homo sapiens
ggtctgaaatgga

SEQ ID NO: 3992494 - DNA, 22 bp, Homo sapiens
ggtctgaatgttctgacattaa

SEQ ID NO: 3992495 - DNA, 13 bp, Homo sapiens
ggtctgagcatga

SEQ ID NO: 3992496 - DNA, 16 bp, Homo sapiens
ggtctgatattaatca

SEQ ID NO: 3992497 - DNA, 12 bp, Homo sapiens
ggtctgccacca

SEQ ID NO: 3992498 - DNA, 14 bp, Homo sapiens
ggtctgcgccttgg

SEQ ID NO: 3992499 - DNA, 16 bp, Homo sapiens
ggtctgctctttctct

SEQ ID NO: 3992500 - DNA, 22 bp, Homo sapiens
ggtctggcagcctcccatccag

SEQ ID NO: 3992501 - DNA, 19 bp, Homo sapiens
ggtctgggagtcacacagt

SEQ ID NO: 3992502 - DNA, 20 bp, Homo sapiens
ggtctgggagtcacacagtg

SEQ ID NO: 3992503 - DNA, 15 bp, Homo sapiens
ggtctgtctgctttg

SEQ ID NO: 3992504 - DNA, 16 bp, Homo sapiens
ggtctgtgcatttctg

SEQ ID NO: 3992505 - DNA, 13 bp, Homo sapiens
ggtctgtgtctct

SEQ ID NO: 3992506 - DNA, 16 bp, Homo sapiens
ggtcttacattgcctg

SEQ ID NO: 3992507 - DNA, 10 bp, Homo sapiens
ggtcttccta

SEQ ID NO: 3992508 - DNA, 17 bp, Homo sapiens
ggtcttcctactcttct

SEQ ID NO: 3992509 - DNA, 14 bp, Homo sapiens
ggtcttgctctgtc

SEQ ID NO: 3992510 - DNA, 23 bp, Homo sapiens
ggtcttgctctgtcccccaggct

SEQ ID NO: 3992511 - DNA, 22 bp, Homo sapiens
ggtcttttcctcgcttctttca

SEQ ID NO: 3992512 - DNA, 14 bp, Homo sapiens
ggtgaaagggagct

SEQ ID NO: 3992513 - DNA, 19 bp, Homo sapiens
ggtgaacaaagcagccacg

SEQ ID NO: 3992514 - DNA, 23 bp, Homo sapiens
ggtgaaggaggctccaggcagca

SEQ ID NO: 3992515 - DNA, 14 bp, Homo sapiens
ggtgaaggcctggc

SEQ ID NO: 3992516 - DNA, 16 bp, Homo sapiens
ggtgaaggctctcacc

SEQ ID NO: 3992517 - DNA, 15 bp, Homo sapiens
ggtgaatcacctggc

SEQ ID NO: 3992518 - DNA, 16 bp, Homo sapiens
ggtgaatcacctggct

SEQ ID NO: 3992519 - DNA, 17 bp, Homo sapiens
ggtgaatcacctggctg

SEQ ID NO: 3992520 - DNA, 18 bp, Homo sapiens
ggtgaatcacctggctga

SEQ ID NO: 3992521 - DNA, 16 bp, Homo sapiens
ggtgaatcttgtctaa

SEQ ID NO: 3992522 - DNA, 18 bp, Homo sapiens
ggtgaatggccttccttc

SEQ ID NO: 3992523 - DNA, 19 bp, Homo sapiens
ggtgacagtcatcatcagg

SEQ ID NO: 3992524 - DNA, 22 bp, Homo sapiens
ggtgacagtcatcatcagggcc

SEQ ID NO: 3992525 - DNA, 18 bp, Homo sapiens
ggtgacatgtgaaacctt

SEQ ID NO: 3992526 - DNA, 12 bp, Homo sapiens
ggtgacggccct

SEQ ID NO: 3992527 - DNA, 19 bp, Homo sapiens
ggtgacggccctcatctat

SEQ ID NO: 3992528 - DNA, 13 bp, Homo sapiens
ggtgactgtccca

SEQ ID NO: 3992529 - DNA, 12 bp, Homo sapiens
ggtgagagtggg

SEQ ID NO: 3992530 - DNA, 16 bp, Homo sapiens
ggtgagagtgggaggg

SEQ ID NO: 3992531 - DNA, 15 bp, Homo sapiens
ggtgaggaccactcc

SEQ ID NO: 3992532 - DNA, 15 bp, Homo sapiens
ggtgaggcaataaaa

SEQ ID NO: 3992533 - DNA, 17 bp, Homo sapiens
ggtgaggggctggcact

SEQ ID NO: 3992534 - DNA, 20 bp, Homo sapiens
ggtgagtttgagctgccttc

SEQ ID NO: 3992535 - DNA, 17 bp, Homo sapiens
ggtgatcctctattttg

SEQ ID NO: 3992536 - DNA, 18 bp, Homo sapiens
ggtgatcctctattttgt

SEQ ID NO: 3992537 - DNA, 23 bp, Homo sapiens
ggtgatcctctattttgtgatga

SEQ ID NO: 3992538 - DNA, 19 bp, Homo sapiens
ggtgatggccagcccctgg

SEQ ID NO: 3992539 - DNA, 14 bp, Homo sapiens
ggtgattcaccaaa

SEQ ID NO: 3992540 - DNA, 15 bp, Homo sapiens
gtaaatcctttttct

SEQ ID NO: 3992541 - DNA, 14 bp, Homo sapiens
gtaaatctgccaca

SEQ ID NO: 3992542 - DNA, 15 bp, Homo sapiens
gtaaatgctgtgttg

SEQ ID NO: 3992543 - DNA, 21 bp, Homo sapiens
gtaaatgtttgttaaaaataa

SEQ ID NO: 3992544 - DNA, 14 bp, Homo sapiens
gtaaattatttgct

SEQ ID NO: 3992545 - DNA, 16 bp, Homo sapiens
gtaaattgcctgattt

SEQ ID NO: 3992546 - DNA, 19 bp, Homo sapiens
gtaaatttttaggcaaaga

SEQ ID NO: 3992547 - DNA, 18 bp, Homo sapiens
gtaacaatacaaatggat

SEQ ID NO: 3992548 - DNA, 19 bp, Homo sapiens
gtaacaatacaaatggatt

SEQ ID NO: 3992549 - DNA, 14 bp, Homo sapiens
gtaacacagtcatt

SEQ ID NO: 3992550 - DNA, 19 bp, Homo sapiens
gtaacacataaacaattca

SEQ ID NO: 3992551 - DNA, 14 bp, Homo sapiens
gtaacagaacagct

SEQ ID NO: 3992552 - DNA, 16 bp, Homo sapiens
gtaacagctgaggtct

SEQ ID NO: 3992553 - DNA, 19 bp, Homo sapiens
gtaacaggaaaattttaaa

SEQ ID NO: 3992554 - DNA, 22 bp, Homo sapiens
gtaacagttcatgtttgcttca

SEQ ID NO: 3992555 - DNA, 13 bp, Homo sapiens
gtaaccagccaga

SEQ ID NO: 3992556 - DNA, 23 bp, Homo sapiens
gtaacccagattttgctgtatat

SEQ ID NO: 3992557 - DNA, 12 bp, Homo sapiens
gtaacctcagct

SEQ ID NO: 3992558 - DNA, 18 bp, Homo sapiens
gtaacctcagctctggga

SEQ ID NO: 3992559 - DNA, 19 bp, Homo sapiens
gtaaccttatatttacaat

SEQ ID NO: 3992560 - DNA, 17 bp, Homo sapiens
gtaactaggctcagaga

SEQ ID NO: 3992561 - DNA, 18 bp, Homo sapiens
gtaactccagatagagaa

SEQ ID NO: 3992562 - DNA, 19 bp, Homo sapiens
gtaactccagatagagaaa

SEQ ID NO: 3992563 - DNA, 15 bp, Homo sapiens
gtaactgctttctgt

SEQ ID NO: 3992564 - DNA, 19 bp, Homo sapiens
gtaactgctttctgttcca

SEQ ID NO: 3992565 - DNA, 21 bp, Homo sapiens
gtaactgtcctgtcctgctca

SEQ ID NO: 3992566 - DNA, 14 bp, Homo sapiens
gtaacttatattga

SEQ ID NO: 3992567 - DNA, 23 bp, Homo sapiens
gtaacttatattgaagacaattt

SEQ ID NO: 3992568 - DNA, 14 bp, Homo sapiens
gtaacttcctgctg

SEQ ID NO: 3992569 - DNA, 15 bp, Homo sapiens
gtaacttcctgctgc

SEQ ID NO: 3992570 - DNA, 17 bp, Homo sapiens
gtaacttcctgctgcac

SEQ ID NO: 3992571 - DNA, 21 bp, Homo sapiens
gtaacttgcttaaatttctta

SEQ ID NO: 3992572 - DNA, 17 bp, Homo sapiens
gtaactttactctgtgt

SEQ ID NO: 3992573 - DNA, 21 bp, Homo sapiens
gtaactttactctgtgtttaa

SEQ ID NO: 3992574 - DNA, 19 bp, Homo sapiens
gtaacttttgtaaatacac

SEQ ID NO: 3992575 - DNA, 13 bp, Homo sapiens
gtaagaagagact

SEQ ID NO: 3992576 - DNA, 11 bp, Homo sapiens
gtaagaagccg

SEQ ID NO: 3992577 - DNA, 13 bp, Homo sapiens
gtaagaaggcaat

SEQ ID NO: 3992578 - DNA, 20 bp, Homo sapiens
gtaagagcaccttcctcact

SEQ ID NO: 3992579 - DNA, 14 bp, Homo sapiens
gtaagagctggtgt

SEQ ID NO: 3992580 - DNA, 14 bp, Homo sapiens
gtaagagtgtagaa

SEQ ID NO: 3992581 - DNA, 17 bp, Homo sapiens
gtaagagtgtagaagca

SEQ ID NO: 3992582 - DNA, 13 bp, Homo sapiens
gtaagcggaataa

SEQ ID NO: 3992583 - DNA, 13 bp, Homo sapiens
gtaagctgtgcct

SEQ ID NO: 3992584 - DNA, 23 bp, Homo sapiens
gtaaggcagggtcccatttctca

SEQ ID NO: 3992585 - DNA, 16 bp, Homo sapiens
gtaaggtgcagttccc

SEQ ID NO: 3992586 - DNA, 13 bp, Homo sapiens
gtaagtaattatc

SEQ ID NO: 3992587 - DNA, 23 bp, Homo sapiens
gtaagtaattatcgggaacagtg

SEQ ID NO: 3992588 - DNA, 22 bp, Homo sapiens
gtaagtattcttatttaatgaa

SEQ ID NO: 3992589 - DNA, 21 bp, Homo sapiens
gtaagtggggttgcaaccact

SEQ ID NO: 3992590 - DNA, 22 bp, Homo sapiens
gtaagtgtgtcttcctagaatt

SEQ ID NO: 3992591 - DNA, 16 bp, Homo sapiens
gtaagttgtacaaatg

SEQ ID NO: 3992592 - DNA, 17 bp, Homo sapiens
gtaagttgtacaaatgt

SEQ ID NO: 3992593 - DNA, 14 bp, Homo sapiens
gtaagtttcaggtg

SEQ ID NO: 3992594 - DNA, 16 bp, Homo sapiens
gtaagtttcaggtgac

SEQ ID NO: 3992595 - DNA, 22 bp, Homo sapiens
gtaagtttcccctctggcttga

SEQ ID NO: 3992596 - DNA, 13 bp, Homo sapiens
gtaagttttttga

SEQ ID NO: 3992597 - DNA, 12 bp, Homo sapiens
gtaataaagtat

SEQ ID NO: 3992598 - DNA, 15 bp, Homo sapiens
gtaataaagtatata

SEQ ID NO: 3992599 - DNA, 13 bp, Homo sapiens
gtaataaatactg

SEQ ID NO: 3992600 - DNA, 21 bp, Homo sapiens
gtaataacaaacgtgtttttt

SEQ ID NO: 3992601 - DNA, 19 bp, Homo sapiens
gtaataagacataacgttt

SEQ ID NO: 3992602 - DNA, 23 bp, Homo sapiens
gtaataagacataacgtttttcc

SEQ ID NO: 3992603 - DNA, 14 bp, Homo sapiens
gtaataggaaaatg

SEQ ID NO: 3992604 - DNA, 22 bp, Homo sapiens
gtaatatattctgaagcaacat

SEQ ID NO: 3992605 - DNA, 18 bp, Homo sapiens
gtaatatttttatataca

SEQ ID NO: 3992606 - DNA, 16 bp, Homo sapiens
gtaatcaataaagaaa

SEQ ID NO: 3992607 - DNA, 12 bp, Homo sapiens
gtaatcaatgaa

SEQ ID NO: 3992608 - DNA, 21 bp, Homo sapiens
gtaatcaatgaatattgaagt

SEQ ID NO: 3992609 - DNA, 22 bp, Homo sapiens
gtaatcatccccatcctccaga

SEQ ID NO: 3992610 - DNA, 23 bp, Homo sapiens
gtaatcatccccatcctccagag

SEQ ID NO: 3992611 - DNA, 19 bp, Homo sapiens
gtaatccaggcacagctga

SEQ ID NO: 3992612 - DNA, 18 bp, Homo sapiens
gtaatcccagcactttgg

SEQ ID NO: 3992613 - DNA, 20 bp, Homo sapiens
gtaatcctattaaaacacag

SEQ ID NO: 3992614 - DNA, 22 bp, Homo sapiens
gtaatctctctgcagctgccgg

SEQ ID NO: 3992615 - DNA, 17 bp, Homo sapiens
gtaatctttacctgtat

SEQ ID NO: 3992616 - DNA, 19 bp, Homo sapiens
gtaatggtactgactttgc

SEQ ID NO: 3992617 - DNA, 15 bp, Homo sapiens
gtaatggtgtagaac

SEQ ID NO: 3992618 - DNA, 17 bp, Homo sapiens
gtaatggtgtagaacac

SEQ ID NO: 3992619 - DNA, 14 bp, Homo sapiens
gtaatgtgaataaa

SEQ ID NO: 3992620 - DNA, 20 bp, Homo sapiens
gtaatgtgtggtggcctcag

SEQ ID NO: 3992621 - DNA, 17 bp, Homo sapiens
gtaatgttactgatcat

SEQ ID NO: 3992622 - DNA, 15 bp, Homo sapiens
gtaatgttttgtata

SEQ ID NO: 3992623 - DNA, 22 bp, Homo sapiens
gtaatgttttgtatatacagtt

SEQ ID NO: 3992624 - DNA, 14 bp, Homo sapiens
gtaattaagtacta

SEQ ID NO: 3992625 - DNA, 21 bp, Homo sapiens
gtaattaagtactatgtatca

SEQ ID NO: 3992626 - DNA, 20 bp, Homo sapiens
gtaattatcgggaacagtgt

SEQ ID NO: 3992627 - DNA, 14 bp, Homo sapiens
gtaattctaaatga

SEQ ID NO: 3992628 - DNA, 17 bp, Homo sapiens
gtaattgtgtaaaaaat

SEQ ID NO: 3992629 - DNA, 22 bp, Homo sapiens
gtaatttaaacatttgttcctg

SEQ ID NO: 3992630 - DNA, 19 bp, Homo sapiens
gtaatttagggtactaaat

SEQ ID NO: 3992631 - DNA, 20 bp, Homo sapiens
gtaatttagggtactaaatt

SEQ ID NO: 3992632 - DNA, 11 bp, Homo sapiens
gtaatttatgc

SEQ ID NO: 3992633 - DNA, 18 bp, Homo sapiens
gtaatttggtttaaaaat

SEQ ID NO: 3992634 - DNA, 14 bp, Homo sapiens
gtaattttggattt

SEQ ID NO: 3992635 - DNA, 15 bp, Homo sapiens
gtaatttttttcacc

SEQ ID NO: 3992636 - DNA, 22 bp, Homo sapiens
gtacaaatgccttaaaatggaa

SEQ ID NO: 3992637 - DNA, 22 bp, Homo sapiens
gtacaaattataaaaagccact

SEQ ID NO: 3992638 - DNA, 18 bp, Homo sapiens
gtacacaataagcaaaaa

SEQ ID NO: 3992639 - DNA, 12 bp, Homo sapiens
gtacactaacat

SEQ ID NO: 3992640 - DNA, 16 bp, Homo sapiens
gtacactaacatttcc

SEQ ID NO: 3992641 - DNA, 18 bp, Homo sapiens
gtacactctgctgtttga

SEQ ID NO: 3992642 - DNA, 23 bp, Homo sapiens
gtacactgctgtacccagatgcc

SEQ ID NO: 3992643 - DNA, 13 bp, Homo sapiens
gtatttattaatt

SEQ ID NO: 3992644 - DNA, 12 bp, Homo sapiens
gtatttattttg

SEQ ID NO: 3992645 - DNA, 16 bp, Homo sapiens
gtatttattttgtaat

SEQ ID NO: 3992646 - DNA, 15 bp, Homo sapiens
gtatttcatgtggct

SEQ ID NO: 3992647 - DNA, 17 bp, Homo sapiens
gtatttcatgtggctgt

SEQ ID NO: 3992648 - DNA, 14 bp, Homo sapiens
gtatttcatttctt

SEQ ID NO: 3992649 - DNA, 16 bp, Homo sapiens
gtatttcgaaactgcc

SEQ ID NO: 3992650 - DNA, 17 bp, Homo sapiens
gtatttcgaaactgcca

SEQ ID NO: 3992651 - DNA, 19 bp, Homo sapiens
gtatttgaaaattttactt

SEQ ID NO: 3992652 - DNA, 14 bp, Homo sapiens
gtatttgatttcct

SEQ ID NO: 3992653 - DNA, 14 bp, Homo sapiens
gtattttaatcctg

SEQ ID NO: 3992654 - DNA, 15 bp, Homo sapiens
gtattttaatcctgt

SEQ ID NO: 3992655 - DNA, 16 bp, Homo sapiens
gtattttaatcctgta

SEQ ID NO: 3992656 - DNA, 13 bp, Homo sapiens
gtattttgaagaa

SEQ ID NO: 3992657 - DNA, 23 bp, Homo sapiens
gtattttgaagaatatttaagaa

SEQ ID NO: 3992658 - DNA, 20 bp, Homo sapiens
gtattttgaagtttacattt

SEQ ID NO: 3992659 - DNA, 14 bp, Homo sapiens
gtatttttataaat

SEQ ID NO: 3992660 - DNA, 15 bp, Homo sapiens
gtattttttaaaaca

SEQ ID NO: 3992661 - DNA, 21 bp, Homo sapiens
gtattttttcaagttgtaaat

SEQ ID NO: 3992662 - DNA, 16 bp, Homo sapiens
gtcaaacagtgccaaa

SEQ ID NO: 3992663 - DNA, 17 bp, Homo sapiens
gtcaaacagtgccaaat

SEQ ID NO: 3992664 - DNA, 23 bp, Homo sapiens
gtcaaacattcgtgagctgggga

SEQ ID NO: 3992665 - DNA, 16 bp, Homo sapiens
gtcaaactgtagaaat

SEQ ID NO: 3992666 - DNA, 20 bp, Homo sapiens
gtcaaactgtagaaatgatg

SEQ ID NO: 3992667 - DNA, 21 bp, Homo sapiens
gtcaaacttggatacttggat

SEQ ID NO: 3992668 - DNA, 14 bp, Homo sapiens
gtcaaagatgcccc

SEQ ID NO: 3992669 - DNA, 18 bp, Homo sapiens
gtcaaagctgcagtcagc

SEQ ID NO: 3992670 - DNA, 21 bp, Homo sapiens
gtcaactaaatgagattatat

SEQ ID NO: 3992671 - DNA, 18 bp, Homo sapiens
gtcaagaaacagccagca

SEQ ID NO: 3992672 - DNA, 22 bp, Homo sapiens
gtcaagctgctctgagccacag

SEQ ID NO: 3992673 - DNA, 18 bp, Homo sapiens
gtcaaggctgcttagaat

SEQ ID NO: 3992674 - DNA, 14 bp, Homo sapiens
gtcaagggaaaacc

SEQ ID NO: 3992675 - DNA, 14 bp, Homo sapiens
gtcaagtctctgct

SEQ ID NO: 3992676 - DNA, 21 bp, Homo sapiens
gtcaagtctctgctggcccag

SEQ ID NO: 3992677 - DNA, 14 bp, Homo sapiens
gtcaagtggcaaag

SEQ ID NO: 3992678 - DNA, 14 bp, Homo sapiens
gtcaagttgagatt

SEQ ID NO: 3992679 - DNA, 15 bp, Homo sapiens
gtcaagttgagattt

SEQ ID NO: 3992680 - DNA, 20 bp, Homo sapiens
gtcaataaacaacagctgaa

SEQ ID NO: 3992681 - DNA, 16 bp, Homo sapiens
gtcaatacaaatgtta

SEQ ID NO: 3992682 - DNA, 14 bp, Homo sapiens
gtcaatattaaata

SEQ ID NO: 3992683 - DNA, 16 bp, Homo sapiens
gtcaatattaaataca

SEQ ID NO: 3992684 - DNA, 14 bp, Homo sapiens
gtcaatgtgcagtg

SEQ ID NO: 3992685 - DNA, 15 bp, Homo sapiens
gtcacaacctctctg

SEQ ID NO: 3992686 - DNA, 20 bp, Homo sapiens
gtcacacagctagtgaagac

SEQ ID NO: 3992687 - DNA, 19 bp, Homo sapiens
gtcacacagtgttggaggt

SEQ ID NO: 3992688 - DNA, 20 bp, Homo sapiens
gtcacacagtgttggaggtt

SEQ ID NO: 3992689 - DNA, 13 bp, Homo sapiens
gtcacacctgtgc

SEQ ID NO: 3992690 - DNA, 15 bp, Homo sapiens
gtcacacggccaccc

SEQ ID NO: 3992691 - DNA, 22 bp, Homo sapiens
gtcacactgttactccacagcg

SEQ ID NO: 3992692 - DNA, 19 bp, Homo sapiens
gtcacagaaatcagaggag

SEQ ID NO: 3992693 - DNA, 12 bp, Homo sapiens
gtcacagccacc

SEQ ID NO: 3992694 - DNA, 12 bp, Homo sapiens
gtcacagccagg

SEQ ID NO: 3992695 - DNA, 13 bp, Homo sapiens
gtcacagccaggc

SEQ ID NO: 3992696 - DNA, 16 bp, Homo sapiens
gtcacagcctcctctg

SEQ ID NO: 3992697 - DNA, 13 bp, Homo sapiens
gtcacagggccaa

SEQ ID NO: 3992698 - DNA, 17 bp, Homo sapiens
gtcacatcagataagac

SEQ ID NO: 3992699 - DNA, 17 bp, Homo sapiens
gtcacattgcattctat

SEQ ID NO: 3992700 - DNA, 18 bp, Homo sapiens
gtcacattgcattctatt

SEQ ID NO: 3992701 - DNA, 21 bp, Homo sapiens
gtcacattgcattctattgcc

SEQ ID NO: 3992702 - DNA, 14 bp, Homo sapiens
gtcaccaaatttgt

SEQ ID NO: 3992703 - DNA, 21 bp, Homo sapiens
gtcaccaccacccgaaatgcc

SEQ ID NO: 3992704 - DNA, 23 bp, Homo sapiens
gtcaccaccacccgaaatgccac

SEQ ID NO: 3992705 - DNA, 17 bp, Homo sapiens
gtcaccacgactggcca

SEQ ID NO: 3992706 - DNA, 21 bp, Homo sapiens
gtcaccacgactggccagggc

SEQ ID NO: 3992707 - DNA, 18 bp, Homo sapiens
gtcaccagctatctgtca

SEQ ID NO: 3992708 - DNA, 23 bp, Homo sapiens
gtcaccagctatctgtcatctct

SEQ ID NO: 3992709 - DNA, 23 bp, Homo sapiens
gtcaccaggacttggggtcagga

SEQ ID NO: 3992710 - DNA, 12 bp, Homo sapiens
gtcacccccact

SEQ ID NO: 3992711 - DNA, 14 bp, Homo sapiens
gtcacccccactcc

SEQ ID NO: 3992712 - DNA, 19 bp, Homo sapiens
gtcacccctttctgtccca

SEQ ID NO: 3992713 - DNA, 20 bp, Homo sapiens
gtcacccctttctgtcccac

SEQ ID NO: 3992714 - DNA, 16 bp, Homo sapiens
gtcaccctccacctct

SEQ ID NO: 3992715 - DNA, 14 bp, Homo sapiens
gtcacctccccaca

SEQ ID NO: 3992716 - DNA, 15 bp, Homo sapiens
gtcacctccccacat

SEQ ID NO: 3992717 - DNA, 14 bp, Homo sapiens
gtcacctgctccag

SEQ ID NO: 3992718 - DNA, 14 bp, Homo sapiens
gtcacctgcttctc

SEQ ID NO: 3992719 - DNA, 17 bp, Homo sapiens
gtcacctgcttctctgc

SEQ ID NO: 3992720 - DNA, 22 bp, Homo sapiens
gtcacctgggcgtcatctggtc

SEQ ID NO: 3992721 - DNA, 17 bp, Homo sapiens
gtcaccttttctgtggc

SEQ ID NO: 3992722 - DNA, 19 bp, Homo sapiens
gtcactaaccaacaaggtt

SEQ ID NO: 3992723 - DNA, 22 bp, Homo sapiens
gtcactactcacagtctcttta

SEQ ID NO: 3992724 - DNA, 14 bp, Homo sapiens
gtcactcattgctg

SEQ ID NO: 3992725 - DNA, 21 bp, Homo sapiens
gtcactcattgctgagcctct

SEQ ID NO: 3992726 - DNA, 24 bp, Homo sapiens
gtcactcattgctgagcctctgct

SEQ ID NO: 3992727 - DNA, 21 bp, Homo sapiens
gtcactcctggggcctcttgg

SEQ ID NO: 3992728 - DNA, 20 bp, Homo sapiens
gtcactcttcctgcaaggac

SEQ ID NO: 3992729 - DNA, 23 bp, Homo sapiens
gtcactggaaaggggagagcctg

SEQ ID NO: 3992730 - DNA, 18 bp, Homo sapiens
gtcactggaggttgaagc

SEQ ID NO: 3992731 - DNA, 14 bp, Homo sapiens
gtcactggctggct

SEQ ID NO: 3992732 - DNA, 19 bp, Homo sapiens
gtcactggctggctcctag

SEQ ID NO: 3992733 - DNA, 16 bp, Homo sapiens
gtcactgtgcactgcc

SEQ ID NO: 3992734 - DNA, 18 bp, Homo sapiens
gtcactgtgcactgccct

SEQ ID NO: 3992735 - DNA, 14 bp, Homo sapiens
gtcactgtggtcct

SEQ ID NO: 3992736 - DNA, 17 bp, Homo sapiens
gtcacttcttctgtcca

SEQ ID NO: 3992737 - DNA, 19 bp, Homo sapiens
gtcacttcttctgtccaag

SEQ ID NO: 3992738 - DNA, 24 bp, Homo sapiens
gtcacttgtgctttgctcttgtcc

SEQ ID NO: 3992739 - DNA, 19 bp, Homo sapiens
gtcacttttgttcccaggt

SEQ ID NO: 3992740 - DNA, 20 bp, Homo sapiens
gtcagaagtcaataggccta

SEQ ID NO: 3992741 - DNA, 15 bp, Homo sapiens
gtcagactttaaaga

SEQ ID NO: 3992742 - DNA, 16 bp, Homo sapiens
gtcagactttaaagaa

SEQ ID NO: 3992743 - DNA, 18 bp, Homo sapiens
gtcagagccctggctggg

SEQ ID NO: 3992744 - DNA, 22 bp, Homo sapiens
gtcagagccctggctgggttca

SEQ ID NO: 3992745 - DNA, 23 bp, Homo sapiens
gtcagagccctggctgggttcag

SEQ ID NO: 3992746 - DNA, 21 bp, Homo sapiens
ttaagatggattctcagatat

SEQ ID NO: 3992747 - DNA, 23 bp, Homo sapiens
ttaagatggattctcagatattt

SEQ ID NO: 3992748 - DNA, 18 bp, Homo sapiens
ttaagattttacaaaaga

SEQ ID NO: 3992749 - DNA, 14 bp, Homo sapiens
ttaagatttttctc

SEQ ID NO: 3992750 - DNA, 17 bp, Homo sapiens
ttaagatttttctcaaa

SEQ ID NO: 3992751 - DNA, 16 bp, Homo sapiens
ttaagcaaaggggaca

SEQ ID NO: 3992752 - DNA, 14 bp, Homo sapiens
ttaagcaaatgcat

SEQ ID NO: 3992753 - DNA, 14 bp, Homo sapiens
ttaagcaacatctt

SEQ ID NO: 3992754 - DNA, 19 bp, Homo sapiens
ttaagcaacatctttttaa

SEQ ID NO: 3992755 - DNA, 14 bp, Homo sapiens
ttaagcactacata

SEQ ID NO: 3992756 - DNA, 20 bp, Homo sapiens
ttaagcactacataaactga

SEQ ID NO: 3992757 - DNA, 15 bp, Homo sapiens
ttaagcactcttaaa

SEQ ID NO: 3992758 - DNA, 15 bp, Homo sapiens
ttaagcagcatggaa

SEQ ID NO: 3992759 - DNA, 19 bp, Homo sapiens
ttaagcagcatggaaaaat

SEQ ID NO: 3992760 - DNA, 18 bp, Homo sapiens
ttaagcagtaaaaactgt

SEQ ID NO: 3992761 - DNA, 21 bp, Homo sapiens
ttaagcctcatatttaaagac

SEQ ID NO: 3992762 - DNA, 16 bp, Homo sapiens
ttaaggaaactcttat

SEQ ID NO: 3992763 - DNA, 11 bp, Homo sapiens
ttaaggcctga

SEQ ID NO: 3992764 - DNA, 16 bp, Homo sapiens
ttaagggcatgccttg

SEQ ID NO: 3992765 - DNA, 21 bp, Homo sapiens
ttaaggtatttcgaaactgcc

SEQ ID NO: 3992766 - DNA, 24 bp, Homo sapiens
ttaaggtatttcgaaactgccaag

SEQ ID NO: 3992767 - DNA, 20 bp, Homo sapiens
ttaagtagaaaagttgcaga

SEQ ID NO: 3992768 - DNA, 22 bp, Homo sapiens
ttaagtagaaaagttgcagatg

SEQ ID NO: 3992769 - DNA, 23 bp, Homo sapiens
ttaagtagtttctccaagtactt

SEQ ID NO: 3992770 - DNA, 14 bp, Homo sapiens
ttaagtatatcatg

SEQ ID NO: 3992771 - DNA, 17 bp, Homo sapiens
ttaagtatatcatgtaa

SEQ ID NO: 3992772 - DNA, 19 bp, Homo sapiens
ttaagtatcttttttcaaa

SEQ ID NO: 3992773 - DNA, 11 bp, Homo sapiens
ttaagtattta

SEQ ID NO: 3992774 - DNA, 16 bp, Homo sapiens
ttaagtatttatatat

SEQ ID NO: 3992775 - DNA, 17 bp, Homo sapiens
ttaagtatttatatatt

SEQ ID NO: 3992776 - DNA, 19 bp, Homo sapiens
ttaagtatttatatattta

SEQ ID NO: 3992777 - DNA, 18 bp, Homo sapiens
ttaagtgcgtgtgtagag

SEQ ID NO: 3992778 - DNA, 16 bp, Homo sapiens
ttaagtgctttgtaat

SEQ ID NO: 3992779 - DNA, 21 bp, Homo sapiens
ttaagtgttgtaaatatttat

SEQ ID NO: 3992780 - DNA, 12 bp, Homo sapiens
ttaagttcttat

SEQ ID NO: 3992781 - DNA, 22 bp, Homo sapiens
ttaagtttcaaacttactattt

SEQ ID NO: 3992782 - DNA, 21 bp, Homo sapiens
ttaataaaaagctttttcctc

SEQ ID NO: 3992783 - DNA, 14 bp, Homo sapiens
ttaataaactactc

SEQ ID NO: 3992784 - DNA, 13 bp, Homo sapiens
ttaataaagaaat

SEQ ID NO: 3992785 - DNA, 15 bp, Homo sapiens
ttaataaagaaatat

SEQ ID NO: 3992786 - DNA, 21 bp, Homo sapiens
ttaataacattaccttactgt

SEQ ID NO: 3992787 - DNA, 14 bp, Homo sapiens
ttaataatgtattg

SEQ ID NO: 3992788 - DNA, 21 bp, Homo sapiens
ttaataatgtattgtaatctt

SEQ ID NO: 3992789 - DNA, 22 bp, Homo sapiens
ttaataatgtattgtaatcttt

SEQ ID NO: 3992790 - DNA, 14 bp, Homo sapiens
ttaatacaggactt

SEQ ID NO: 3992791 - DNA, 19 bp, Homo sapiens
ttaatactataaataatat

SEQ ID NO: 3992792 - DNA, 22 bp, Homo sapiens
ttaatactcaaatgagtaacat

SEQ ID NO: 3992793 - DNA, 17 bp, Homo sapiens
ttaatagatcttagggt

SEQ ID NO: 3992794 - DNA, 13 bp, Homo sapiens
ttaatagccctcc

SEQ ID NO: 3992795 - DNA, 18 bp, Homo sapiens
ttaatagtagttagctta

SEQ ID NO: 3992796 - DNA, 15 bp, Homo sapiens
ttaatatatgtatta

SEQ ID NO: 3992797 - DNA, 19 bp, Homo sapiens
ttaatatatgtattattta

SEQ ID NO: 3992798 - DNA, 18 bp, Homo sapiens
ttaatatatttgaaaaaa

SEQ ID NO: 3992799 - DNA, 17 bp, Homo sapiens
ttaatatggatttgtta

SEQ ID NO: 3992800 - DNA, 23 bp, Homo sapiens
ttaatatgttaacctcagtgtca

SEQ ID NO: 3992801 - DNA, 15 bp, Homo sapiens
ttaatattctattaa

SEQ ID NO: 3992802 - DNA, 18 bp, Homo sapiens
ttaatattgatatgctta

SEQ ID NO: 3992803 - DNA, 22 bp, Homo sapiens
ttaatattgtattgctgctgtg

SEQ ID NO: 3992804 - DNA, 16 bp, Homo sapiens
ttaatatttaaacagc

SEQ ID NO: 3992805 - DNA, 18 bp, Homo sapiens
ttaatatttaaacagcag

SEQ ID NO: 3992806 - DNA, 22 bp, Homo sapiens
ttaatatttaaacagcagtgtt

SEQ ID NO: 3992807 - DNA, 12 bp, Homo sapiens
ttaatatttaac

SEQ ID NO: 3992808 - DNA, 17 bp, Homo sapiens
ttaatatttaacattat

SEQ ID NO: 3992809 - DNA, 21 bp, Homo sapiens
ttaatcaagatttttttcctg

SEQ ID NO: 3992810 - DNA, 19 bp, Homo sapiens
ttaatcacaaatttcactt

SEQ ID NO: 3992811 - DNA, 21 bp, Homo sapiens
ttaatcacaaatttcacttat

SEQ ID NO: 3992812 - DNA, 17 bp, Homo sapiens
ttaatcaccatgggaaa

SEQ ID NO: 3992813 - DNA, 17 bp, Homo sapiens
ttaatcactattgttcc

SEQ ID NO: 3992814 - DNA, 15 bp, Homo sapiens
ttaatcatctataaa

SEQ ID NO: 3992815 - DNA, 22 bp, Homo sapiens
ttaatcattttgcctcttttct

SEQ ID NO: 3992816 - DNA, 13 bp, Homo sapiens
ttaatcctgtacc

SEQ ID NO: 3992817 - DNA, 21 bp, Homo sapiens
ttaatcctgtaccaaatctga

SEQ ID NO: 3992818 - DNA, 23 bp, Homo sapiens
ttaatcctttgttttctgactaa

SEQ ID NO: 3992819 - DNA, 20 bp, Homo sapiens
ttaatctagacaatatacaa

SEQ ID NO: 3992820 - DNA, 17 bp, Homo sapiens
ttaatctgaaattctaa

SEQ ID NO: 3992821 - DNA, 23 bp, Homo sapiens
ttaatctgaaattctaaagagca

SEQ ID NO: 3992822 - DNA, 13 bp, Homo sapiens
ttaatcttcatgg

SEQ ID NO: 3992823 - DNA, 18 bp, Homo sapiens
ttaatctttgtgacagga

SEQ ID NO: 3992824 - DNA, 19 bp, Homo sapiens
ttaatgaaagactgtacaa

SEQ ID NO: 3992825 - DNA, 23 bp, Homo sapiens
ttaatgaaagactgtacaaagta

SEQ ID NO: 3992826 - DNA, 19 bp, Homo sapiens
ttaatgagcaatatctgct

SEQ ID NO: 3992827 - DNA, 17 bp, Homo sapiens
ttaatgataagtaaatg

SEQ ID NO: 3992828 - DNA, 21 bp, Homo sapiens
ttaatgataagtaaatgctag

SEQ ID NO: 3992829 - DNA, 22 bp, Homo sapiens
ttaatgcagttgcttactaaag

SEQ ID NO: 3992830 - DNA, 19 bp, Homo sapiens
ttaatgccattatccctga

SEQ ID NO: 3992831 - DNA, 23 bp, Homo sapiens
ttaatgcctctcccgcaccaggc

SEQ ID NO: 3992832 - DNA, 13 bp, Homo sapiens
ttaatgcttcatt

SEQ ID NO: 3992833 - DNA, 13 bp, Homo sapiens
ttaatgttcacat

SEQ ID NO: 3992834 - DNA, 18 bp, Homo sapiens
ttaatgttttttgccaca

SEQ ID NO: 3992835 - DNA, 16 bp, Homo sapiens
ttaattaatttgatta

SEQ ID NO: 3992836 - DNA, 21 bp, Homo sapiens
ttaattactcagcagaatggt

SEQ ID NO: 3992837 - DNA, 16 bp, Homo sapiens
ttaattattaactaca

SEQ ID NO: 3992838 - DNA, 17 bp, Homo sapiens
ttaattattaactacat

SEQ ID NO: 3992839 - DNA, 22 bp, Homo sapiens
ttaattcagcactgatttcaca

SEQ ID NO: 3992840 - DNA, 17 bp, Homo sapiens
ttaattctctttcaaag

SEQ ID NO: 3992841 - DNA, 16 bp, Homo sapiens
ttaattcttcacctgt

SEQ ID NO: 3992842 - DNA, 22 bp, Homo sapiens
ttaattcttcagcgtaaaatgg

SEQ ID NO: 3992843 - DNA, 19 bp, Homo sapiens
ttaattgcaacatgaagtt

SEQ ID NO: 3992844 - DNA, 16 bp, Homo sapiens
ttaattgttgtttctt

SEQ ID NO: 3992845 - DNA, 19 bp, Homo sapiens
ttaattgttgtttctttct

SEQ ID NO: 3992846 - DNA, 18 bp, Homo sapiens
ttaattgttttgcacttt

SEQ ID NO: 3992847 - DNA, 21 bp, Homo sapiens
ttaatttaaagcttactctgt

SEQ ID NO: 3992848 - DNA, 14 bp, Homo sapiens
ttagtcctgtactg

SEQ ID NO: 3992849 - DNA, 19 bp, Homo sapiens
ttagtcctgtactgtatgg

SEQ ID NO: 3992850 - DNA, 12 bp, Homo sapiens
ttagtctcagtt

SEQ ID NO: 3992851 - DNA, 23 bp, Homo sapiens
ttagtctcagtttgtgtgtctta

SEQ ID NO: 3992852 - DNA, 22 bp, Homo sapiens
ttagtctcttgtattaaactct

SEQ ID NO: 3992853 - DNA, 15 bp, Homo sapiens
ttagtctgaaactgg

SEQ ID NO: 3992854 - DNA, 15 bp, Homo sapiens
ttagtgacaaaatag

SEQ ID NO: 3992855 - DNA, 14 bp, Homo sapiens
ttagtgccagaatt

SEQ ID NO: 3992856 - DNA, 13 bp, Homo sapiens
ttagtgttagtta

SEQ ID NO: 3992857 - DNA, 13 bp, Homo sapiens
ttagttaatggat

SEQ ID NO: 3992858 - DNA, 15 bp, Homo sapiens
ttagttacatttcta

SEQ ID NO: 3992859 - DNA, 13 bp, Homo sapiens
ttagttccctgtc

SEQ ID NO: 3992860 - DNA, 21 bp, Homo sapiens
ttagttctcactgttccctct

SEQ ID NO: 3992861 - DNA, 16 bp, Homo sapiens
ttagttggacagttta

SEQ ID NO: 3992862 - DNA, 15 bp, Homo sapiens
ttagttggctttgcc

SEQ ID NO: 3992863 - DNA, 17 bp, Homo sapiens
ttagtttacaatcagcc

SEQ ID NO: 3992864 - DNA, 21 bp, Homo sapiens
ttagtttagtgtgtgtgcaga

SEQ ID NO: 3992865 - DNA, 13 bp, Homo sapiens
ttagttttgcttt

SEQ ID NO: 3992866 - DNA, 14 bp, Homo sapiens
ttagttttgctttt

SEQ ID NO: 3992867 - DNA, 22 bp, Homo sapiens
ttagttttgcttttagtttttc

SEQ ID NO: 3992868 - DNA, 17 bp, Homo sapiens
ttataaaaaatggttca

SEQ ID NO: 3992869 - DNA, 22 bp, Homo sapiens
ttataaaagggggtccgtggaa

SEQ ID NO: 3992870 - DNA, 16 bp, Homo sapiens
ttataaaattaagcaa

SEQ ID NO: 3992871 - DNA, 15 bp, Homo sapiens
ttataaacacattga

SEQ ID NO: 3992872 - DNA, 19 bp, Homo sapiens
ttataaacagacaatatgt

SEQ ID NO: 3992873 - DNA, 17 bp, Homo sapiens
ttataaaccaatcttaa

SEQ ID NO: 3992874 - DNA, 19 bp, Homo sapiens
ttataaataaactgttgct

SEQ ID NO: 3992875 - DNA, 21 bp, Homo sapiens
ttataaatataagccttttat

SEQ ID NO: 3992876 - DNA, 12 bp, Homo sapiens
ttataaatcata

SEQ ID NO: 3992877 - DNA, 21 bp, Homo sapiens
ttataaatgaaatttgcaaaa

SEQ ID NO: 3992878 - DNA, 16 bp, Homo sapiens
ttataactcatcataa

SEQ ID NO: 3992879 - DNA, 18 bp, Homo sapiens
ttataactcatcataaaa

SEQ ID NO: 3992880 - DNA, 17 bp, Homo sapiens
ttataacttaaaatatt

SEQ ID NO: 3992881 - DNA, 15 bp, Homo sapiens
ttataagcattgaaa

SEQ ID NO: 3992882 - DNA, 18 bp, Homo sapiens
ttataagcattgaaatta

SEQ ID NO: 3992883 - DNA, 18 bp, Homo sapiens
ttataagtcattgtatgt

SEQ ID NO: 3992884 - DNA, 15 bp, Homo sapiens
ttataagttcacaaa

SEQ ID NO: 3992885 - DNA, 21 bp, Homo sapiens
ttataataaaggactgtaatc

SEQ ID NO: 3992886 - DNA, 21 bp, Homo sapiens
ttataatataatatggaacct

SEQ ID NO: 3992887 - DNA, 14 bp, Homo sapiens
ttataatcaccagg

SEQ ID NO: 3992888 - DNA, 16 bp, Homo sapiens
ttataatctgaagata

SEQ ID NO: 3992889 - DNA, 13 bp, Homo sapiens
ttatacagctgta

SEQ ID NO: 3992890 - DNA, 15 bp, Homo sapiens
ttatacagctgtatt

SEQ ID NO: 3992891 - DNA, 15 bp, Homo sapiens
ttatacagtgccttg

SEQ ID NO: 3992892 - DNA, 22 bp, Homo sapiens
ttatacgctggcaacacagagg

SEQ ID NO: 3992893 - DNA, 19 bp, Homo sapiens
ttatactcttcctattttt

SEQ ID NO: 3992894 - DNA, 13 bp, Homo sapiens
ttatactgattat

SEQ ID NO: 3992895 - DNA, 12 bp, Homo sapiens
ttatactgtgaa

SEQ ID NO: 3992896 - DNA, 23 bp, Homo sapiens
ttatagagtgtacttaactattc

SEQ ID NO: 3992897 - DNA, 17 bp, Homo sapiens
ttatagcaaacttggaa

SEQ ID NO: 3992898 - DNA, 18 bp, Homo sapiens
ttatagcaacaacaattg

SEQ ID NO: 3992899 - DNA, 16 bp, Homo sapiens
ttatagctcagtttat

SEQ ID NO: 3992900 - DNA, 23 bp, Homo sapiens
ttataggcctgtcccttgcctct

SEQ ID NO: 3992901 - DNA, 22 bp, Homo sapiens
ttataggtaatcaatgaatatt

SEQ ID NO: 3992902 - DNA, 17 bp, Homo sapiens
ttataggtcactcctgg

SEQ ID NO: 3992903 - DNA, 14 bp, Homo sapiens
ttataggtgagaaa

SEQ ID NO: 3992904 - DNA, 13 bp, Homo sapiens
ttatagtacatga

SEQ ID NO: 3992905 - DNA, 17 bp, Homo sapiens
ttatagtacatgataaa

SEQ ID NO: 3992906 - DNA, 15 bp, Homo sapiens
ttatagtatatctgg

SEQ ID NO: 3992907 - DNA, 18 bp, Homo sapiens
ttatagtatatctggaca

SEQ ID NO: 3992908 - DNA, 15 bp, Homo sapiens
ttatagtgaatactg

SEQ ID NO: 3992909 - DNA, 21 bp, Homo sapiens
ttatagtgtttggacagctga

SEQ ID NO: 3992910 - DNA, 19 bp, Homo sapiens
ttatataaataaagttttt

SEQ ID NO: 3992911 - DNA, 23 bp, Homo sapiens
ttatataaatgtaaaaataataa

SEQ ID NO: 3992912 - DNA, 23 bp, Homo sapiens
ttatatacagtacacagatacct

SEQ ID NO: 3992913 - DNA, 14 bp, Homo sapiens
ttatatatatatct

SEQ ID NO: 3992914 - DNA, 15 bp, Homo sapiens
ttatatatgaaaact

SEQ ID NO: 3992915 - DNA, 14 bp, Homo sapiens
ttatatatgtattt

SEQ ID NO: 3992916 - DNA, 17 bp, Homo sapiens
ttatatatgtatttata

SEQ ID NO: 3992917 - DNA, 15 bp, Homo sapiens
ttatatatttataac

SEQ ID NO: 3992918 - DNA, 12 bp, Homo sapiens
ttatatatttct

SEQ ID NO: 3992919 - DNA, 15 bp, Homo sapiens
ttatatcatatgtat

SEQ ID NO: 3992920 - DNA, 21 bp, Homo sapiens
ttatatctgggttaagtgttt

SEQ ID NO: 3992921 - DNA, 12 bp, Homo sapiens
ttatatcttttg

SEQ ID NO: 3992922 - DNA, 14 bp, Homo sapiens
ttatatcttttggt

SEQ ID NO: 3992923 - DNA, 17 bp, Homo sapiens
ttatatcttttggttat

SEQ ID NO: 3992924 - DNA, 20 bp, Homo sapiens
ttatatggatgattcagaaa

SEQ ID NO: 3992925 - DNA, 17 bp, Homo sapiens
ttatatggcccagcctt

SEQ ID NO: 3992926 - DNA, 19 bp, Homo sapiens
ttatatgtacatgagaagg

SEQ ID NO: 3992927 - DNA, 15 bp, Homo sapiens
ttatatgtactttta

SEQ ID NO: 3992928 - DNA, 17 bp, Homo sapiens
ttatattagtgaagatg

SEQ ID NO: 3992929 - DNA, 16 bp, Homo sapiens
ttatattgaagacaat

SEQ ID NO: 3992930 - DNA, 23 bp, Homo sapiens
ttatattggtgcgtttttacagt

SEQ ID NO: 3992931 - DNA, 13 bp, Homo sapiens
ttatatttacaat

SEQ ID NO: 3992932 - DNA, 14 bp, Homo sapiens
ttatatttacaata

SEQ ID NO: 3992933 - DNA, 16 bp, Homo sapiens
ttatatttacaataaa

SEQ ID NO: 3992934 - DNA, 19 bp, Homo sapiens
ttatatttatatttcaggt

SEQ ID NO: 3992935 - DNA, 20 bp, Homo sapiens
ttatatttccctaaaataca

SEQ ID NO: 3992936 - DNA, 22 bp, Homo sapiens
ttatatttccctaaaatacatt

SEQ ID NO: 3992937 - DNA, 13 bp, Homo sapiens
ttatatttccttt

SEQ ID NO: 3992938 - DNA, 20 bp, Homo sapiens
ttatatttcctttatgtgaa

SEQ ID NO: 3992939 - DNA, 13 bp, Homo sapiens
ttatatttttaaa

SEQ ID NO: 3992940 - DNA, 19 bp, Homo sapiens
ttatcaaaccctagccttg

SEQ ID NO: 3992941 - DNA, 15 bp, Homo sapiens
ttatcaacaatagtg

SEQ ID NO: 3992942 - DNA, 24 bp, Homo sapiens
ttatcaaccacgtggagaaaatca

SEQ ID NO: 3992943 - DNA, 12 bp, Homo sapiens
ttatcaacttta

SEQ ID NO: 3992944 - DNA, 15 bp, Homo sapiens
ttatcaatatctaat

SEQ ID NO: 3992945 - DNA, 17 bp, Homo sapiens
ttatcaatatctaatat

SEQ ID NO: 3992946 - DNA, 19 bp, Homo sapiens
ttatcaatatctaatatat

SEQ ID NO: 3992947 - DNA, 18 bp, Homo sapiens
ttatcacattatttgcat

SEQ ID NO: 3992948 - DNA, 23 bp, Homo sapiens
ttatcagtcaatatttttagata

SEQ ID NO: 3992949 - DNA, 17 bp, Homo sapiens
ttatcagtgacagagtt

SEQ ID NO: 3992950 - DNA, 16 bp, Homo sapiens
ttatcataagaatttt

SEQ ID NO: 3992951 - DNA, 13 bp, Homo sapiens
ttcatcttcctgt

SEQ ID NO: 3992952 - DNA, 21 bp, Homo sapiens
ttcatgaaatgattggaatat

SEQ ID NO: 3992953 - DNA, 15 bp, Homo sapiens
ttcatgcaatgacat

SEQ ID NO: 3992954 - DNA, 22 bp, Homo sapiens
ttcatgccaccatggccagcca

SEQ ID NO: 3992955 - DNA, 19 bp, Homo sapiens
ttcatgcctttcatagttt

SEQ ID NO: 3992956 - DNA, 19 bp, Homo sapiens
ttcatggaatggacatcct

SEQ ID NO: 3992957 - DNA, 21 bp, Homo sapiens
ttcatgtagagaaaagcacac

SEQ ID NO: 3992958 - DNA, 17 bp, Homo sapiens
ttcatgtgcctctgcgg

SEQ ID NO: 3992959 - DNA, 17 bp, Homo sapiens
ttcatgttcccacttca

SEQ ID NO: 3992960 - DNA, 15 bp, Homo sapiens
ttcattattctctgc

SEQ ID NO: 3992961 - DNA, 18 bp, Homo sapiens
ttcattattttaaaaata

SEQ ID NO: 3992962 - DNA, 16 bp, Homo sapiens
ttcattattttgtggt

SEQ ID NO: 3992963 - DNA, 19 bp, Homo sapiens
ttcattcaatattgacatt

SEQ ID NO: 3992964 - DNA, 15 bp, Homo sapiens
ttcattccattgcct

SEQ ID NO: 3992965 - DNA, 22 bp, Homo sapiens
ttcattccttcagatttggctt

SEQ ID NO: 3992966 - DNA, 23 bp, Homo sapiens
ttcattctcataattcctacagc

SEQ ID NO: 3992967 - DNA, 21 bp, Homo sapiens
ttcattctcattgcagaataa

SEQ ID NO: 3992968 - DNA, 15 bp, Homo sapiens
ttcattctgcagggt

SEQ ID NO: 3992969 - DNA, 13 bp, Homo sapiens
ttcattcttgaaa

SEQ ID NO: 3992970 - DNA, 19 bp, Homo sapiens
ttcattgcactttgattag

SEQ ID NO: 3992971 - DNA, 18 bp, Homo sapiens
ttcattgtaatgttactg

SEQ ID NO: 3992972 - DNA, 15 bp, Homo sapiens
ttcattgtccctctt

SEQ ID NO: 3992973 - DNA, 12 bp, Homo sapiens
ttcattgtctct

SEQ ID NO: 3992974 - DNA, 14 bp, Homo sapiens
ttcatttaaaatga

SEQ ID NO: 3992975 - DNA, 15 bp, Homo sapiens
ttcatttaaaatgat

SEQ ID NO: 3992976 - DNA, 16 bp, Homo sapiens
ttcatttaaaatgatt

SEQ ID NO: 3992977 - DNA, 14 bp, Homo sapiens
ttcatttcatcctt

SEQ ID NO: 3992978 - DNA, 16 bp, Homo sapiens
ttcatttcatcctttc

SEQ ID NO: 3992979 - DNA, 13 bp, Homo sapiens
ttcatttccactc

SEQ ID NO: 3992980 - DNA, 17 bp, Homo sapiens
ttcatttcttcctcagc

SEQ ID NO: 3992981 - DNA, 21 bp, Homo sapiens
ttcatttcttcctcagctggt

SEQ ID NO: 3992982 - DNA, 21 bp, Homo sapiens
ttcatttcttgtcaattatgt

SEQ ID NO: 3992983 - DNA, 18 bp, Homo sapiens
ttcatttgagaagtaaac

SEQ ID NO: 3992984 - DNA, 18 bp, Homo sapiens
ttcattttcatcactggg

SEQ ID NO: 3992985 - DNA, 12 bp, Homo sapiens
ttcattttcctg

SEQ ID NO: 3992986 - DNA, 17 bp, Homo sapiens
ttcattttctgacatgc

SEQ ID NO: 3992987 - DNA, 17 bp, Homo sapiens
ttcattttgaaaaacac

SEQ ID NO: 3992988 - DNA, 16 bp, Homo sapiens
ttccaaaatctcccat

SEQ ID NO: 3992989 - DNA, 19 bp, Homo sapiens
ttccaaaatctcccatttt

SEQ ID NO: 3992990 - DNA, 14 bp, Homo sapiens
ttccaaaattctta

SEQ ID NO: 3992991 - DNA, 16 bp, Homo sapiens
ttccaaagaattctta

SEQ ID NO: 3992992 - DNA, 16 bp, Homo sapiens
ttccaaagccagtgaa

SEQ ID NO: 3992993 - DNA, 21 bp, Homo sapiens
ttccaaagccagtgaaatgtg

SEQ ID NO: 3992994 - DNA, 17 bp, Homo sapiens
ttccaacaccacagaca

SEQ ID NO: 3992995 - DNA, 22 bp, Homo sapiens
ttccaacaccacagacacacac

SEQ ID NO: 3992996 - DNA, 23 bp, Homo sapiens
ttccaacaccacagacacacaca

SEQ ID NO: 3992997 - DNA, 16 bp, Homo sapiens
ttccaaccaggcagta

SEQ ID NO: 3992998 - DNA, 13 bp, Homo sapiens
ttccaagacattg

SEQ ID NO: 3992999 - DNA, 16 bp, Homo sapiens
ttccaagacattgtca

SEQ ID NO: 3993000 - DNA, 14 bp, Homo sapiens
ttccaagaggctgt

SEQ ID NO: 3993001 - DNA, 13 bp, Homo sapiens
ttccaataaacca

SEQ ID NO: 3993002 - DNA, 21 bp, Homo sapiens
ttccaataaaccaggtttaga

SEQ ID NO: 3993003 - DNA, 22 bp, Homo sapiens
ttccaatttacatactctgctt

SEQ ID NO: 3993004 - DNA, 13 bp, Homo sapiens
ttccaatttggaa

SEQ ID NO: 3993005 - DNA, 18 bp, Homo sapiens
ttccacagttgccaccac

SEQ ID NO: 3993006 - DNA, 14 bp, Homo sapiens
ttccacctccacca

SEQ ID NO: 3993007 - DNA, 14 bp, Homo sapiens
ttccacctccctcc

SEQ ID NO: 3993008 - DNA, 13 bp, Homo sapiens
ttccacctgctct

SEQ ID NO: 3993009 - DNA, 15 bp, Homo sapiens
ttccacctgctctgc

SEQ ID NO: 3993010 - DNA, 16 bp, Homo sapiens
ttccacctgctctgct

SEQ ID NO: 3993011 - DNA, 14 bp, Homo sapiens
ttccacgatgaaaa

SEQ ID NO: 3993012 - DNA, 14 bp, Homo sapiens
ttccactaaaaata

SEQ ID NO: 3993013 - DNA, 16 bp, Homo sapiens
ttccactacacctggc

SEQ ID NO: 3993014 - DNA, 19 bp, Homo sapiens
ttccactacacctggctga

SEQ ID NO: 3993015 - DNA, 13 bp, Homo sapiens
ttccactgcaaaa

SEQ ID NO: 3993016 - DNA, 17 bp, Homo sapiens
ttccactgcgttgtcca

SEQ ID NO: 3993017 - DNA, 20 bp, Homo sapiens
ttccactgtcaagaaagagc

SEQ ID NO: 3993018 - DNA, 21 bp, Homo sapiens
ttccacttcttcctttctctt

SEQ ID NO: 3993019 - DNA, 22 bp, Homo sapiens
ttccagaaaggatatttaagaa

SEQ ID NO: 3993020 - DNA, 21 bp, Homo sapiens
ttccagaagaagagaagctgc

SEQ ID NO: 3993021 - DNA, 17 bp, Homo sapiens
ttccagaaggatccaag

SEQ ID NO: 3993022 - DNA, 21 bp, Homo sapiens
ttccagaatcttgactttctg

SEQ ID NO: 3993023 - DNA, 22 bp, Homo sapiens
ttccagaatcttgactttctga

SEQ ID NO: 3993024 - DNA, 15 bp, Homo sapiens
ttccagaatgctgta

SEQ ID NO: 3993025 - DNA, 18 bp, Homo sapiens
ttccagaatgctgtacat

SEQ ID NO: 3993026 - DNA, 10 bp, Homo sapiens
ttccagagca

SEQ ID NO: 3993027 - DNA, 13 bp, Homo sapiens
ttccagagcattc

SEQ ID NO: 3993028 - DNA, 11 bp, Homo sapiens
ttccagcaata

SEQ ID NO: 3993029 - DNA, 19 bp, Homo sapiens
ttccagctctaataaaaca

SEQ ID NO: 3993030 - DNA, 13 bp, Homo sapiens
ttccagctgctgt

SEQ ID NO: 3993031 - DNA, 20 bp, Homo sapiens
ttccagctgctgtcttctgg

SEQ ID NO: 3993032 - DNA, 12 bp, Homo sapiens
ttccagcttcag

SEQ ID NO: 3993033 - DNA, 24 bp, Homo sapiens
ttccaggaaactccacatctgcct

SEQ ID NO: 3993034 - DNA, 11 bp, Homo sapiens
ttccaggcagc

SEQ ID NO: 3993035 - DNA, 19 bp, Homo sapiens
ttccaggcttccctgactt

SEQ ID NO: 3993036 - DNA, 12 bp, Homo sapiens
ttccagggccct

SEQ ID NO: 3993037 - DNA, 14 bp, Homo sapiens
ttccaggggaacct

SEQ ID NO: 3993038 - DNA, 19 bp, Homo sapiens
ttccagtacctttgtcaca

SEQ ID NO: 3993039 - DNA, 18 bp, Homo sapiens
ttccagtgtccttagaac

SEQ ID NO: 3993040 - DNA, 22 bp, Homo sapiens
ttccagtgtctataaaagaaac

SEQ ID NO: 3993041 - DNA, 11 bp, Homo sapiens
ttccagttccc

SEQ ID NO: 3993042 - DNA, 19 bp, Homo sapiens
ttccataaggaatgtagct

SEQ ID NO: 3993043 - DNA, 14 bp, Homo sapiens
ttccataattatga

SEQ ID NO: 3993044 - DNA, 22 bp, Homo sapiens
ttccataattatgacagttata

SEQ ID NO: 3993045 - DNA, 15 bp, Homo sapiens
ttccatagcaacagg

SEQ ID NO: 3993046 - DNA, 23 bp, Homo sapiens
ttccataggacatactgcatgta

SEQ ID NO: 3993047 - DNA, 20 bp, Homo sapiens
ttccatatccttctggctgt

SEQ ID NO: 3993048 - DNA, 14 bp, Homo sapiens
ttccatatttggaa

SEQ ID NO: 3993049 - DNA, 17 bp, Homo sapiens
ttccatcattttacagt

SEQ ID NO: 3993050 - DNA, 22 bp, Homo sapiens
ttccatccatctttccatccat

SEQ ID NO: 3993051 - DNA, 14 bp, Homo sapiens
ttccatctctgact

SEQ ID NO: 3993052 - DNA, 12 bp, Homo sapiens
ttccatctgaaa

SEQ ID NO: 3993053 - DNA, 18 bp, Homo sapiens
ttccatctttacaaaact

SEQ ID NO: 3993054 - DNA, 23 bp, Homo sapiens
ttctatggttatgaaagaatata

SEQ ID NO: 3993055 - DNA, 17 bp, Homo sapiens
ttctatgtccattctca

SEQ ID NO: 3993056 - DNA, 15 bp, Homo sapiens
ttctatgtgacattt

SEQ ID NO: 3993057 - DNA, 12 bp, Homo sapiens
ttctatgttaaa

SEQ ID NO: 3993058 - DNA, 21 bp, Homo sapiens
ttctatgttaaatactgtgca

SEQ ID NO: 3993059 - DNA, 17 bp, Homo sapiens
ttctattaactttaatt

SEQ ID NO: 3993060 - DNA, 18 bp, Homo sapiens
ttctattatggaaaactg

SEQ ID NO: 3993061 - DNA, 17 bp, Homo sapiens
ttctattgccttctttg

SEQ ID NO: 3993062 - DNA, 20 bp, Homo sapiens
ttctattgccttctttgaag

SEQ ID NO: 3993063 - DNA, 18 bp, Homo sapiens
ttctatttatatgtacat

SEQ ID NO: 3993064 - DNA, 15 bp, Homo sapiens
ttctatttatttact

SEQ ID NO: 3993065 - DNA, 12 bp, Homo sapiens
ttctattttctt

SEQ ID NO: 3993066 - DNA, 17 bp, Homo sapiens
ttctatttttatcatga

SEQ ID NO: 3993067 - DNA, 18 bp, Homo sapiens
ttctcaaagatctgaatt

SEQ ID NO: 3993068 - DNA, 12 bp, Homo sapiens
ttctcaaagcag

SEQ ID NO: 3993069 - DNA, 15 bp, Homo sapiens
ttctcaaagcaggaa

SEQ ID NO: 3993070 - DNA, 14 bp, Homo sapiens
ttctcaaagttaat

SEQ ID NO: 3993071 - DNA, 18 bp, Homo sapiens
ttctcaaagttaattcac

SEQ ID NO: 3993072 - DNA, 15 bp, Homo sapiens
ttctcaaagttttga

SEQ ID NO: 3993073 - DNA, 18 bp, Homo sapiens
ttctcaaagttttgaaaa

SEQ ID NO: 3993074 - DNA, 21 bp, Homo sapiens
ttctcaagggacgtcctccaa

SEQ ID NO: 3993075 - DNA, 22 bp, Homo sapiens
ttctcacaccaacagtgtgaag

SEQ ID NO: 3993076 - DNA, 17 bp, Homo sapiens
ttctcacatccctctaa

SEQ ID NO: 3993077 - DNA, 21 bp, Homo sapiens
ttctcactagtgtcaggcccc

SEQ ID NO: 3993078 - DNA, 18 bp, Homo sapiens
ttctcactcctacctggt

SEQ ID NO: 3993079 - DNA, 18 bp, Homo sapiens
ttctcactgttccctctg

SEQ ID NO: 3993080 - DNA, 20 bp, Homo sapiens
ttctcacttcaattaatgct

SEQ ID NO: 3993081 - DNA, 22 bp, Homo sapiens
ttctcagaatctcaaataacta

SEQ ID NO: 3993082 - DNA, 20 bp, Homo sapiens
ttctcagatatttatatttt

SEQ ID NO: 3993083 - DNA, 23 bp, Homo sapiens
ttctcaggacagcatcccttccc

SEQ ID NO: 3993084 - DNA, 19 bp, Homo sapiens
ttctcaggtgttgccaaat

SEQ ID NO: 3993085 - DNA, 20 bp, Homo sapiens
ttctcataattcctacagca

SEQ ID NO: 3993086 - DNA, 21 bp, Homo sapiens
ttctcatagcattaactaatc

SEQ ID NO: 3993087 - DNA, 22 bp, Homo sapiens
ttctcataggaaaagtacattt

SEQ ID NO: 3993088 - DNA, 23 bp, Homo sapiens
ttctcatcttgacagagcctgcc

SEQ ID NO: 3993089 - DNA, 20 bp, Homo sapiens
ttctcatttggtctgccaga

SEQ ID NO: 3993090 - DNA, 16 bp, Homo sapiens
ttctcattttcttttc

SEQ ID NO: 3993091 - DNA, 15 bp, Homo sapiens
ttctccacagcaacc

SEQ ID NO: 3993092 - DNA, 14 bp, Homo sapiens
ttctccagaatgta

SEQ ID NO: 3993093 - DNA, 13 bp, Homo sapiens
ttctccagtggtg

SEQ ID NO: 3993094 - DNA, 23 bp, Homo sapiens
ttctccatgagacacatctcctc

SEQ ID NO: 3993095 - DNA, 13 bp, Homo sapiens
ttctccattacac

SEQ ID NO: 3993096 - DNA, 20 bp, Homo sapiens
ttctcccaggtaccagctgc

SEQ ID NO: 3993097 - DNA, 13 bp, Homo sapiens
ttctcccctccct

SEQ ID NO: 3993098 - DNA, 16 bp, Homo sapiens
ttctcccctccctcca

SEQ ID NO: 3993099 - DNA, 18 bp, Homo sapiens
ttctccccttccatttct

SEQ ID NO: 3993100 - DNA, 14 bp, Homo sapiens
ttctccgccagcct

SEQ ID NO: 3993101 - DNA, 19 bp, Homo sapiens
ttctcctcccttccttttc

SEQ ID NO: 3993102 - DNA, 21 bp, Homo sapiens
ttctcctcgtccatcagggat

SEQ ID NO: 3993103 - DNA, 17 bp, Homo sapiens
ttctcctctctgggcct

SEQ ID NO: 3993104 - DNA, 22 bp, Homo sapiens
ttctccttagttggctggaaac

SEQ ID NO: 3993105 - DNA, 15 bp, Homo sapiens
ttctccttccccagg

SEQ ID NO: 3993106 - DNA, 16 bp, Homo sapiens
ttctccttccccagga

SEQ ID NO: 3993107 - DNA, 22 bp, Homo sapiens
ttctcctttcacaaccttctgt

SEQ ID NO: 3993108 - DNA, 12 bp, Homo sapiens
ttctccttttcc

SEQ ID NO: 3993109 - DNA, 18 bp, Homo sapiens
ttctccttttcctctctc

SEQ ID NO: 3993110 - DNA, 17 bp, Homo sapiens
ttctcgtgcctccccac

SEQ ID NO: 3993111 - DNA, 18 bp, Homo sapiens
ttctctaatgcttgattt

SEQ ID NO: 3993112 - DNA, 17 bp, Homo sapiens
ttctctagctctctagg

SEQ ID NO: 3993113 - DNA, 22 bp, Homo sapiens
ttctctagctctctaggcctct

SEQ ID NO: 3993114 - DNA, 20 bp, Homo sapiens
ttctctcagccttacatttg

SEQ ID NO: 3993115 - DNA, 21 bp, Homo sapiens
ttctctcccttcctctctcct

SEQ ID NO: 3993116 - DNA, 12 bp, Homo sapiens
ttctctcctccc

SEQ ID NO: 3993117 - DNA, 17 bp, Homo sapiens
ttctctcggctccccat

SEQ ID NO: 3993118 - DNA, 17 bp, Homo sapiens
ttctctctacagtgcca

SEQ ID NO: 3993119 - DNA, 15 bp, Homo sapiens
ttctctctccagggt

SEQ ID NO: 3993120 - DNA, 20 bp, Homo sapiens
ttctctgaacacaggcagct

SEQ ID NO: 3993121 - DNA, 15 bp, Homo sapiens
ttctctgcccagctt

SEQ ID NO: 3993122 - DNA, 20 bp, Homo sapiens
ttctctgcctttgacattta

SEQ ID NO: 3993123 - DNA, 21 bp, Homo sapiens
ttctctgctatatataaaacg

SEQ ID NO: 3993124 - DNA, 12 bp, Homo sapiens
ttctctgtgaac

SEQ ID NO: 3993125 - DNA, 23 bp, Homo sapiens
ttctctgtgtatgagtgtgaatg

SEQ ID NO: 3993126 - DNA, 20 bp, Homo sapiens
ttctctgttgtcgtaaagat

SEQ ID NO: 3993127 - DNA, 23 bp, Homo sapiens
ttctctgttgtcgtaaagatttg

SEQ ID NO: 3993128 - DNA, 21 bp, Homo sapiens
ttctcttccagtttctgtaag

SEQ ID NO: 3993129 - DNA, 18 bp, Homo sapiens
ttctcttccccttcctgt

SEQ ID NO: 3993130 - DNA, 22 bp, Homo sapiens
ttctcttccccttcctgtttca

SEQ ID NO: 3993131 - DNA, 21 bp, Homo sapiens
ttctcttctccccttccattt

SEQ ID NO: 3993132 - DNA, 17 bp, Homo sapiens
ttctcttgggaactgaa

SEQ ID NO: 3993133 - DNA, 14 bp, Homo sapiens
ttctctttctctct

SEQ ID NO: 3993134 - DNA, 17 bp, Homo sapiens
ttctctttctctcttcc

SEQ ID NO: 3993135 - DNA, 20 bp, Homo sapiens
ttctcttttcccctttcctg

SEQ ID NO: 3993136 - DNA, 21 bp, Homo sapiens
ttctcttttcccctttcctgt

SEQ ID NO: 3993137 - DNA, 15 bp, Homo sapiens
ttctcttttcctttg

SEQ ID NO: 3993138 - DNA, 16 bp, Homo sapiens
ttctcttttctttctg

SEQ ID NO: 3993139 - DNA, 15 bp, Homo sapiens
ttctgaaaatataac

SEQ ID NO: 3993140 - DNA, 16 bp, Homo sapiens
ttctgaaaattccaga

SEQ ID NO: 3993141 - DNA, 15 bp, Homo sapiens
ttctgaaatgtgacc

SEQ ID NO: 3993142 - DNA, 16 bp, Homo sapiens
ttctgaacctgtcttt

SEQ ID NO: 3993143 - DNA, 14 bp, Homo sapiens
ttctgaactcaagc

SEQ ID NO: 3993144 - DNA, 19 bp, Homo sapiens
ttctgacaaaaagtttcca

SEQ ID NO: 3993145 - DNA, 23 bp, Homo sapiens
ttctgacattaacagttttccat

SEQ ID NO: 3993146 - DNA, 17 bp, Homo sapiens
ttctgaccacagcatca

SEQ ID NO: 3993147 - DNA, 20 bp, Homo sapiens
ttctgaccacagcatcattt

SEQ ID NO: 3993148 - DNA, 21 bp, Homo sapiens
ttctgaccctgcttcaaatat

SEQ ID NO: 3993149 - DNA, 18 bp, Homo sapiens
ttctgacctcaagtgatt

SEQ ID NO: 3993150 - DNA, 13 bp, Homo sapiens
ttctgactgctga

SEQ ID NO: 3993151 - DNA, 12 bp, Homo sapiens
ttctgagaccag

SEQ ID NO: 3993152 - DNA, 10 bp, Homo sapiens
ttctgagcag

SEQ ID NO: 3993153 - DNA, 15 bp, Homo sapiens
ttctgagcattcgct

SEQ ID NO: 3993154 - DNA, 14 bp, Homo sapiens
ttctgagctggcct

SEQ ID NO: 3993155 - DNA, 23 bp, Homo sapiens
ttctgaggaccgctgataagcat

SEQ ID NO: 3993156 - DNA, 17 bp, Homo sapiens
ttgagtgttttaagata

SEQ ID NO: 3993157 - DNA, 18 bp, Homo sapiens
ttgagttctgtagagcct

SEQ ID NO: 3993158 - DNA, 18 bp, Homo sapiens
ttgagttgatgggggcca

SEQ ID NO: 3993159 - DNA, 16 bp, Homo sapiens
ttgagttttatttatt

SEQ ID NO: 3993160 - DNA, 20 bp, Homo sapiens
ttgagttttatttattttat

SEQ ID NO: 3993161 - DNA, 16 bp, Homo sapiens
ttgagtttttcctccc

SEQ ID NO: 3993162 - DNA, 17 bp, Homo sapiens
ttgagtttttcctccca

SEQ ID NO: 3993163 - DNA, 21 bp, Homo sapiens
ttgagtttttcctcccagtga

SEQ ID NO: 3993164 - DNA, 22 bp, Homo sapiens
ttgataacaatgacactagaaa

SEQ ID NO: 3993165 - DNA, 17 bp, Homo sapiens
ttgataataaattgaaa

SEQ ID NO: 3993166 - DNA, 23 bp, Homo sapiens
ttgataatgctttcacaacattt

SEQ ID NO: 3993167 - DNA, 13 bp, Homo sapiens
ttgataatgttaa

SEQ ID NO: 3993168 - DNA, 20 bp, Homo sapiens
ttgataatgttaaatttgta

SEQ ID NO: 3993169 - DNA, 21 bp, Homo sapiens
ttgataatgttaaatttgtaa

SEQ ID NO: 3993170 - DNA, 13 bp, Homo sapiens
ttgatacccccct

SEQ ID NO: 3993171 - DNA, 19 bp, Homo sapiens
ttgatagggaactggggaa

SEQ ID NO: 3993172 - DNA, 20 bp, Homo sapiens
ttgatatacttttttcttat

SEQ ID NO: 3993173 - DNA, 21 bp, Homo sapiens
ttgatatacttttttcttatt

SEQ ID NO: 3993174 - DNA, 16 bp, Homo sapiens
ttgatatgcttataca

SEQ ID NO: 3993175 - DNA, 23 bp, Homo sapiens
ttgatatttgcattgaggaaata

SEQ ID NO: 3993176 - DNA, 22 bp, Homo sapiens
ttgatattttcaacgcagccct

SEQ ID NO: 3993177 - DNA, 14 bp, Homo sapiens
ttgatcagtataat

SEQ ID NO: 3993178 - DNA, 23 bp, Homo sapiens
ttgatcataaactgactatcata

SEQ ID NO: 3993179 - DNA, 19 bp, Homo sapiens
ttgatccagaagagcccat

SEQ ID NO: 3993180 - DNA, 23 bp, Homo sapiens
ttgatcctagtgtctttaaatac

SEQ ID NO: 3993181 - DNA, 18 bp, Homo sapiens
ttgatctctcttgtcctc

SEQ ID NO: 3993182 - DNA, 22 bp, Homo sapiens
ttgatctctcttgtcctcttct

SEQ ID NO: 3993183 - DNA, 16 bp, Homo sapiens
ttgatctggaacccag

SEQ ID NO: 3993184 - DNA, 17 bp, Homo sapiens
ttgatctggaacccaga

SEQ ID NO: 3993185 - DNA, 14 bp, Homo sapiens
ttgatctggacaga

SEQ ID NO: 3993186 - DNA, 18 bp, Homo sapiens
ttgatcttacaagatatt

SEQ ID NO: 3993187 - DNA, 21 bp, Homo sapiens
ttgatgaagcaaggaagatat

SEQ ID NO: 3993188 - DNA, 23 bp, Homo sapiens
ttgatgaagcaaggaagatatac

SEQ ID NO: 3993189 - DNA, 20 bp, Homo sapiens
ttgatgattttcatttcatg

SEQ ID NO: 3993190 - DNA, 17 bp, Homo sapiens
ttgatgctggagaggtt

SEQ ID NO: 3993191 - DNA, 18 bp, Homo sapiens
ttgatgctggagaggtta

SEQ ID NO: 3993192 - DNA, 13 bp, Homo sapiens
ttgatggaaaata

SEQ ID NO: 3993193 - DNA, 14 bp, Homo sapiens
ttgatggaaaataa

SEQ ID NO: 3993194 - DNA, 18 bp, Homo sapiens
ttgatgggggccaggaca

SEQ ID NO: 3993195 - DNA, 17 bp, Homo sapiens
ttgatggtggactaagc

SEQ ID NO: 3993196 - DNA, 20 bp, Homo sapiens
ttgatgtatatgtttatata

SEQ ID NO: 3993197 - DNA, 23 bp, Homo sapiens
ttgatgtgaagataatttgcata

SEQ ID NO: 3993198 - DNA, 14 bp, Homo sapiens
ttgatgtgacaata

SEQ ID NO: 3993199 - DNA, 11 bp, Homo sapiens
ttgatgtgttt

SEQ ID NO: 3993200 - DNA, 15 bp, Homo sapiens
ttgatgttacagatt

SEQ ID NO: 3993201 - DNA, 15 bp, Homo sapiens
ttgatgtttgtggcc

SEQ ID NO: 3993202 - DNA, 17 bp, Homo sapiens
ttgatgtttgtggcctc

SEQ ID NO: 3993203 - DNA, 15 bp, Homo sapiens
ttgattaagatttta

SEQ ID NO: 3993204 - DNA, 18 bp, Homo sapiens
ttgattaagattttacaa

SEQ ID NO: 3993205 - DNA, 16 bp, Homo sapiens
ttgattattagccagg

SEQ ID NO: 3993206 - DNA, 15 bp, Homo sapiens
ttgattcattttcct

SEQ ID NO: 3993207 - DNA, 12 bp, Homo sapiens
ttgattctgcag

SEQ ID NO: 3993208 - DNA, 19 bp, Homo sapiens
ttgattgactgcccattca

SEQ ID NO: 3993209 - DNA, 19 bp, Homo sapiens
ttgattgaggagctgcact

SEQ ID NO: 3993210 - DNA, 21 bp, Homo sapiens
ttgattggtgattaggtggtg

SEQ ID NO: 3993211 - DNA, 17 bp, Homo sapiens
ttgattgtcagctacta

SEQ ID NO: 3993212 - DNA, 17 bp, Homo sapiens
ttgatttaaacacacag

SEQ ID NO: 3993213 - DNA, 12 bp, Homo sapiens
ttgatttgcatg

SEQ ID NO: 3993214 - DNA, 13 bp, Homo sapiens
ttgatttgcatgg

SEQ ID NO: 3993215 - DNA, 19 bp, Homo sapiens
ttgatttgcattgaacaca

SEQ ID NO: 3993216 - DNA, 17 bp, Homo sapiens
ttgcaaaatcacttagc

SEQ ID NO: 3993217 - DNA, 15 bp, Homo sapiens
ttgcaaaatgagttg

SEQ ID NO: 3993218 - DNA, 22 bp, Homo sapiens
ttgcaaatgggagctgagcagc

SEQ ID NO: 3993219 - DNA, 12 bp, Homo sapiens
ttgcaaccactg

SEQ ID NO: 3993220 - DNA, 18 bp, Homo sapiens
ttgcaacctcaccttcct

SEQ ID NO: 3993221 - DNA, 19 bp, Homo sapiens
ttgcaacctcaccttcctg

SEQ ID NO: 3993222 - DNA, 18 bp, Homo sapiens
ttgcaacctctttgctca

SEQ ID NO: 3993223 - DNA, 14 bp, Homo sapiens
ttgcaacgtttaca

SEQ ID NO: 3993224 - DNA, 16 bp, Homo sapiens
ttgcaagatgtgaatt

SEQ ID NO: 3993225 - DNA, 19 bp, Homo sapiens
ttgcaagatgtgaattatt

SEQ ID NO: 3993226 - DNA, 22 bp, Homo sapiens
ttgcaagatgtgaattattgac

SEQ ID NO: 3993227 - DNA, 23 bp, Homo sapiens
ttgcaagatgtgaattattgaca

SEQ ID NO: 3993228 - DNA, 22 bp, Homo sapiens
ttgcaatgtcacaacctctctg

SEQ ID NO: 3993229 - DNA, 13 bp, Homo sapiens
ttgcacacttgtg

SEQ ID NO: 3993230 - DNA, 18 bp, Homo sapiens
ttgcacaggatgctggcc

SEQ ID NO: 3993231 - DNA, 15 bp, Homo sapiens
ttgcacatcttggct

SEQ ID NO: 3993232 - DNA, 20 bp, Homo sapiens
ttgcaccatactccttgctt

SEQ ID NO: 3993233 - DNA, 21 bp, Homo sapiens
ttgcaccccaaagctttcctg

SEQ ID NO: 3993234 - DNA, 22 bp, Homo sapiens
ttgcacccctcactctggcctc

SEQ ID NO: 3993235 - DNA, 17 bp, Homo sapiens
ttgcactctagcctggg

SEQ ID NO: 3993236 - DNA, 22 bp, Homo sapiens
ttgcagaaacattttgtggtca

SEQ ID NO: 3993237 - DNA, 16 bp, Homo sapiens
ttgcagaagagggtgt

SEQ ID NO: 3993238 - DNA, 19 bp, Homo sapiens
ttgcagactcagtttgtca

SEQ ID NO: 3993239 - DNA, 14 bp, Homo sapiens
ttgcagatgtattg

SEQ ID NO: 3993240 - DNA, 15 bp, Homo sapiens
ttgcagatgtattga

SEQ ID NO: 3993241 - DNA, 13 bp, Homo sapiens
ttgcagatttatt

SEQ ID NO: 3993242 - DNA, 13 bp, Homo sapiens
ttgcagcatgaga

SEQ ID NO: 3993243 - DNA, 16 bp, Homo sapiens
ttgcagcatgagactt

SEQ ID NO: 3993244 - DNA, 12 bp, Homo sapiens
ttgcagggcagc

SEQ ID NO: 3993245 - DNA, 21 bp, Homo sapiens
ttgcagggctaaggcccccaa

SEQ ID NO: 3993246 - DNA, 19 bp, Homo sapiens
ttgcaggtggaactcagtc

SEQ ID NO: 3993247 - DNA, 20 bp, Homo sapiens
ttgcagtagagtcatctcca

SEQ ID NO: 3993248 - DNA, 14 bp, Homo sapiens
ttgcataaagcata

SEQ ID NO: 3993249 - DNA, 23 bp, Homo sapiens
ttgcatagtaccaatcattttaa

SEQ ID NO: 3993250 - DNA, 16 bp, Homo sapiens
ttgcatatgagccgtg

SEQ ID NO: 3993251 - DNA, 20 bp, Homo sapiens
ttgcatattttgagaaactg

SEQ ID NO: 3993252 - DNA, 17 bp, Homo sapiens
ttgcatctcaaaattat

SEQ ID NO: 3993253 - DNA, 17 bp, Homo sapiens
ttgcatggattttggat

SEQ ID NO: 3993254 - DNA, 19 bp, Homo sapiens
ttgcatggctccagaaatg

SEQ ID NO: 3993255 - DNA, 13 bp, Homo sapiens
ttgcattccagaa

SEQ ID NO: 3993256 - DNA, 14 bp, Homo sapiens
ttgcattccagaat

SEQ ID NO: 3993257 - DNA, 22 bp, Homo sapiens
ttgcattgaacacaaactgtaa

SEQ ID NO: 3993258 - DNA, 21 bp, Homo sapiens
ttgtatattatggaagatttt

SEQ ID NO: 3993259 - DNA, 19 bp, Homo sapiens
ttgtatattgtgtttgtgt

SEQ ID NO: 3993260 - DNA, 14 bp, Homo sapiens
ttgtatatttgtac

SEQ ID NO: 3993261 - DNA, 21 bp, Homo sapiens
ttgtatctagtgcagctgatt

SEQ ID NO: 3993262 - DNA, 22 bp, Homo sapiens
ttgtatcttggggcaagactgc

SEQ ID NO: 3993263 - DNA, 20 bp, Homo sapiens
ttgtatggggaggcaagtgt

SEQ ID NO: 3993264 - DNA, 15 bp, Homo sapiens
ttgtatgttatgaac

SEQ ID NO: 3993265 - DNA, 16 bp, Homo sapiens
ttgtattaaactcttc

SEQ ID NO: 3993266 - DNA, 16 bp, Homo sapiens
ttgtattaaagacaga

SEQ ID NO: 3993267 - DNA, 14 bp, Homo sapiens
ttgtattatttgga

SEQ ID NO: 3993268 - DNA, 18 bp, Homo sapiens
ttgtattcttctgtattt

SEQ ID NO: 3993269 - DNA, 14 bp, Homo sapiens
ttgtattgttttct

SEQ ID NO: 3993270 - DNA, 18 bp, Homo sapiens
ttgtatttattaatttga

SEQ ID NO: 3993271 - DNA, 14 bp, Homo sapiens
ttgtattttaactc

SEQ ID NO: 3993272 - DNA, 22 bp, Homo sapiens
ttgtcaaactgtagaaatgatg

SEQ ID NO: 3993273 - DNA, 20 bp, Homo sapiens
ttgtcaagtctctgctggcc

SEQ ID NO: 3993274 - DNA, 17 bp, Homo sapiens
ttgtcacagaaatcaga

SEQ ID NO: 3993275 - DNA, 21 bp, Homo sapiens
ttgtcacctctgttaaggttg

SEQ ID NO: 3993276 - DNA, 14 bp, Homo sapiens
ttgtcactttttat

SEQ ID NO: 3993277 - DNA, 12 bp, Homo sapiens
ttgtcagacttt

SEQ ID NO: 3993278 - DNA, 12 bp, Homo sapiens
ttgtcagctact

SEQ ID NO: 3993279 - DNA, 21 bp, Homo sapiens
ttgtcatggggatcaattttc

SEQ ID NO: 3993280 - DNA, 17 bp, Homo sapiens
ttgtcattgactcttgc

SEQ ID NO: 3993281 - DNA, 13 bp, Homo sapiens
ttgtccagagctg

SEQ ID NO: 3993282 - DNA, 16 bp, Homo sapiens
ttgtccagagctgctt

SEQ ID NO: 3993283 - DNA, 15 bp, Homo sapiens
ttgtcccatttcctt

SEQ ID NO: 3993284 - DNA, 23 bp, Homo sapiens
ttgtcccatttccttggaggcca

SEQ ID NO: 3993285 - DNA, 19 bp, Homo sapiens
ttgtccctggcttccttac

SEQ ID NO: 3993286 - DNA, 13 bp, Homo sapiens
ttgtccctttccc

SEQ ID NO: 3993287 - DNA, 16 bp, Homo sapiens
ttgtccgctgggtggt

SEQ ID NO: 3993288 - DNA, 20 bp, Homo sapiens
ttgtcctgcctgcaatattt

SEQ ID NO: 3993289 - DNA, 17 bp, Homo sapiens
ttgtcctgggcctgccc

SEQ ID NO: 3993290 - DNA, 14 bp, Homo sapiens
ttgtcggctccagt

SEQ ID NO: 3993291 - DNA, 19 bp, Homo sapiens
ttgtctaactcagaattat

SEQ ID NO: 3993292 - DNA, 17 bp, Homo sapiens
ttgtctatttttgtctt

SEQ ID NO: 3993293 - DNA, 18 bp, Homo sapiens
ttgtctcaacgcctcccc

SEQ ID NO: 3993294 - DNA, 20 bp, Homo sapiens
ttgtctcaacgcctccccct

SEQ ID NO: 3993295 - DNA, 19 bp, Homo sapiens
ttgtctctatgccagctca

SEQ ID NO: 3993296 - DNA, 16 bp, Homo sapiens
ttgtctctcctggctg

SEQ ID NO: 3993297 - DNA, 13 bp, Homo sapiens
ttgtctcttagaa

SEQ ID NO: 3993298 - DNA, 15 bp, Homo sapiens
ttgtctcttctcctt

SEQ ID NO: 3993299 - DNA, 15 bp, Homo sapiens
ttgtctgaacttgca

SEQ ID NO: 3993300 - DNA, 17 bp, Homo sapiens
ttgtctgaagtcactgc

SEQ ID NO: 3993301 - DNA, 21 bp, Homo sapiens
ttgtctgaagtcactgcacag

SEQ ID NO: 3993302 - DNA, 20 bp, Homo sapiens
ttgtctgtttgtttcaagaa

SEQ ID NO: 3993303 - DNA, 15 bp, Homo sapiens
ttgtcttatctggcc

SEQ ID NO: 3993304 - DNA, 13 bp, Homo sapiens
ttgtcttattgca

SEQ ID NO: 3993305 - DNA, 12 bp, Homo sapiens
ttgtctttctgg

SEQ ID NO: 3993306 - DNA, 19 bp, Homo sapiens
ttgtcttttaatgcttcat

SEQ ID NO: 3993307 - DNA, 17 bp, Homo sapiens
ttgtgaaatgaaaacat

SEQ ID NO: 3993308 - DNA, 23 bp, Homo sapiens
ttgtgaaatgaaaacatgtaata

SEQ ID NO: 3993309 - DNA, 13 bp, Homo sapiens
ttgtgaatggatt

SEQ ID NO: 3993310 - DNA, 21 bp, Homo sapiens
ttgtgaatggattggattatt

SEQ ID NO: 3993311 - DNA, 17 bp, Homo sapiens
ttgtgacaggaaagccc

SEQ ID NO: 3993312 - DNA, 22 bp, Homo sapiens
ttgtgacaggaaagccctcccc

SEQ ID NO: 3993313 - DNA, 16 bp, Homo sapiens
ttgtgaccaagttata

SEQ ID NO: 3993314 - DNA, 12 bp, Homo sapiens
ttgtgagatggg

SEQ ID NO: 3993315 - DNA, 20 bp, Homo sapiens
ttgtgaggcccatggttgag

SEQ ID NO: 3993316 - DNA, 22 bp, Homo sapiens
ttgtgagtttaccttgtatact

SEQ ID NO: 3993317 - DNA, 16 bp, Homo sapiens
ttgtgatagcactttc

SEQ ID NO: 3993318 - DNA, 22 bp, Homo sapiens
ttgtgatgaatcaatgaaaaat

SEQ ID NO: 3993319 - DNA, 14 bp, Homo sapiens
ttgtgatttcttta

SEQ ID NO: 3993320 - DNA, 22 bp, Homo sapiens
ttgtgcaaaagcttcaaattaa

SEQ ID NO: 3993321 - DNA, 16 bp, Homo sapiens
ttgtgcacatttattt

SEQ ID NO: 3993322 - DNA, 14 bp, Homo sapiens
ttgtgcacatttct

SEQ ID NO: 3993323 - DNA, 11 bp, Homo sapiens
ttgtgcagaga

SEQ ID NO: 3993324 - DNA, 19 bp, Homo sapiens
ttgtgcatttgtaaatgct

SEQ ID NO: 3993325 - DNA, 22 bp, Homo sapiens
ttgtgccaactgccaggctgcc

SEQ ID NO: 3993326 - DNA, 11 bp, Homo sapiens
ttgtgctgcca

SEQ ID NO: 3993327 - DNA, 22 bp, Homo sapiens
ttgtgcttgtcattccagagtg

SEQ ID NO: 3993328 - DNA, 19 bp, Homo sapiens
ttgtgctttgctcttgtcc

SEQ ID NO: 3993329 - DNA, 15 bp, Homo sapiens
ttgtgcttttcctga

SEQ ID NO: 3993330 - DNA, 14 bp, Homo sapiens
ttgtggagagaatg

SEQ ID NO: 3993331 - DNA, 18 bp, Homo sapiens
ttgtggatataaaatgtg

SEQ ID NO: 3993332 - DNA, 19 bp, Homo sapiens
ttgtggccccttttacttt

SEQ ID NO: 3993333 - DNA, 11 bp, Homo sapiens
ttgtggcctca

SEQ ID NO: 3993334 - DNA, 23 bp, Homo sapiens
ttgtggcctcaagcaatccacct

SEQ ID NO: 3993335 - DNA, 20 bp, Homo sapiens
ttgtgggacttattacaatt

SEQ ID NO: 3993336 - DNA, 11 bp, Homo sapiens
ttgtgggcgct

SEQ ID NO: 3993337 - DNA, 17 bp, Homo sapiens
ttgtggtgtaaagctgg

SEQ ID NO: 3993338 - DNA, 22 bp, Homo sapiens
ttgtggtgtaaagctggccctg

SEQ ID NO: 3993339 - DNA, 13 bp, Homo sapiens
ttgtggttaatct

SEQ ID NO: 3993340 - DNA, 18 bp, Homo sapiens
ttgtgtaaaaaatggaaa

SEQ ID NO: 3993341 - DNA, 21 bp, Homo sapiens
ttgtgtaaaaaatggaaaaaa

SEQ ID NO: 3993342 - DNA, 15 bp, Homo sapiens
ttgtgtacagtgtgt

SEQ ID NO: 3993343 - DNA, 15 bp, Homo sapiens
ttgtgtagccttttt

SEQ ID NO: 3993344 - DNA, 16 bp, Homo sapiens
ttgtgtatatttgtat

SEQ ID NO: 3993345 - DNA, 21 bp, Homo sapiens
ttgtgtatcgtaaccagccag

SEQ ID NO: 3993346 - DNA, 19 bp, Homo sapiens
ttgtgtcctccaggagctt

SEQ ID NO: 3993347 - DNA, 19 bp, Homo sapiens
ttgtgtgtgggctgtgagt

SEQ ID NO: 3993348 - DNA, 17 bp, Homo sapiens
ttgtgttcctggctgat

SEQ ID NO: 3993349 - DNA, 13 bp, Homo sapiens
ttgtgttctaata

SEQ ID NO: 3993350 - DNA, 19 bp, Homo sapiens
ttgtgttcttcttcatatt

SEQ ID NO: 3993351 - DNA, 21 bp, Homo sapiens
ttgtgtttttaatttatttat

SEQ ID NO: 3993352 - DNA, 17 bp, Homo sapiens
ttgttaatgaaaatgtc

SEQ ID NO: 3993353 - DNA, 17 bp, Homo sapiens
ttgttaatggtgcaaat

SEQ ID NO: 3993354 - DNA, 22 bp, Homo sapiens
ttgttaatttttcctatattgc

SEQ ID NO: 3993355 - DNA, 17 bp, Homo sapiens
ttgttactctggttctt

SEQ ID NO: 3993356 - DNA, 12 bp, Homo sapiens
ttgttagtttac

SEQ ID NO: 3993357 - DNA, 22 bp, Homo sapiens
ttgttatcagtcaatattttta

SEQ ID NO: 3993358 - DNA, 15 bp, Homo sapiens
ttgttattccatcaa

SEQ ID NO: 3993359 - DNA, 14 bp, Homo sapiens
ttgttatttataac

SEQ ID NO: 3993360 - DNA, 16 bp, Homo sapiens
ttgttcaaacaatatc

SEQ ID NO: 3993361 - DNA, 22 bp, Homo sapiens
tttattttgtgctcatttaagt

SEQ ID NO: 3993362 - DNA, 13 bp, Homo sapiens
tttatttttgtaa

SEQ ID NO: 3993363 - DNA, 17 bp, Homo sapiens
tttattttttaagtatt

SEQ ID NO: 3993364 - DNA, 15 bp, Homo sapiens
tttattttttacatt

SEQ ID NO: 3993365 - DNA, 17 bp, Homo sapiens
tttattttttcttttgt

SEQ ID NO: 3993366 - DNA, 14 bp, Homo sapiens
tttatttttttcta

SEQ ID NO: 3993367 - DNA, 19 bp, Homo sapiens
tttcaaaaaagtcaacaaa

SEQ ID NO: 3993368 - DNA, 13 bp, Homo sapiens
tttcaaaagaaag

SEQ ID NO: 3993369 - DNA, 21 bp, Homo sapiens
tttcaaaagccttaccttgaa

SEQ ID NO: 3993370 - DNA, 13 bp, Homo sapiens
tttcaaatatcac

SEQ ID NO: 3993371 - DNA, 15 bp, Homo sapiens
tttcaacgcagccct

SEQ ID NO: 3993372 - DNA, 17 bp, Homo sapiens
tttcaaggaaggttcat

SEQ ID NO: 3993373 - DNA, 20 bp, Homo sapiens
tttcaataaagcatttataa

SEQ ID NO: 3993374 - DNA, 19 bp, Homo sapiens
tttcaataaatctttcaaa

SEQ ID NO: 3993375 - DNA, 22 bp, Homo sapiens
tttcaatatattgaacttttgt

SEQ ID NO: 3993376 - DNA, 14 bp, Homo sapiens
tttcaatgacattt

SEQ ID NO: 3993377 - DNA, 14 bp, Homo sapiens
tttcaattcagatt

SEQ ID NO: 3993378 - DNA, 22 bp, Homo sapiens
tttcacaaccttctgtggctca

SEQ ID NO: 3993379 - DNA, 17 bp, Homo sapiens
tttcacaggtcaataaa

SEQ ID NO: 3993380 - DNA, 16 bp, Homo sapiens
tttcacctagattttt

SEQ ID NO: 3993381 - DNA, 22 bp, Homo sapiens
tttcacctgtttttaagctgtt

SEQ ID NO: 3993382 - DNA, 14 bp, Homo sapiens
tttcactgctggct

SEQ ID NO: 3993383 - DNA, 23 bp, Homo sapiens
tttcacttagaacctttctgtgt

SEQ ID NO: 3993384 - DNA, 14 bp, Homo sapiens
tttcacttatacct

SEQ ID NO: 3993385 - DNA, 15 bp, Homo sapiens
tttcacttatacctg

SEQ ID NO: 3993386 - DNA, 22 bp, Homo sapiens
tttcacttcccgagcgctggtc

SEQ ID NO: 3993387 - DNA, 20 bp, Homo sapiens
tttcacttcgggctgtgtaa

SEQ ID NO: 3993388 - DNA, 16 bp, Homo sapiens
tttcagaaaaagaaat

SEQ ID NO: 3993389 - DNA, 20 bp, Homo sapiens
tttcagaaatatgtggtttc

SEQ ID NO: 3993390 - DNA, 15 bp, Homo sapiens
tttcagaagcaagcc

SEQ ID NO: 3993391 - DNA, 20 bp, Homo sapiens
tttcagacagggtctgaagg

SEQ ID NO: 3993392 - DNA, 21 bp, Homo sapiens
tttcagagtcatttatgagca

SEQ ID NO: 3993393 - DNA, 15 bp, Homo sapiens
tttcagatatcaaaa

SEQ ID NO: 3993394 - DNA, 16 bp, Homo sapiens
tttcagatatcaaaat

SEQ ID NO: 3993395 - DNA, 22 bp, Homo sapiens
tttcagatatcaaaattctagc

SEQ ID NO: 3993396 - DNA, 12 bp, Homo sapiens
tttcagatgctt

SEQ ID NO: 3993397 - DNA, 20 bp, Homo sapiens
tttcagatgcttctgggaga

SEQ ID NO: 3993398 - DNA, 17 bp, Homo sapiens
tttcagcacccccaccc

SEQ ID NO: 3993399 - DNA, 21 bp, Homo sapiens
tttcagcacccccacccacct

SEQ ID NO: 3993400 - DNA, 13 bp, Homo sapiens
tttcagcaggcag

SEQ ID NO: 3993401 - DNA, 20 bp, Homo sapiens
tttcagctaagggaagacat

SEQ ID NO: 3993402 - DNA, 21 bp, Homo sapiens
tttcagctatacctgcacgtt

SEQ ID NO: 3993403 - DNA, 14 bp, Homo sapiens
tttcagctgagccc

SEQ ID NO: 3993404 - DNA, 20 bp, Homo sapiens
tttcagctgagccctgggga

SEQ ID NO: 3993405 - DNA, 22 bp, Homo sapiens
tttcagctgagccctggggact

SEQ ID NO: 3993406 - DNA, 17 bp, Homo sapiens
tttcaggaatttaaaat

SEQ ID NO: 3993407 - DNA, 13 bp, Homo sapiens
tttcaggatactc

SEQ ID NO: 3993408 - DNA, 18 bp, Homo sapiens
tttcaggttatatccaat

SEQ ID NO: 3993409 - DNA, 17 bp, Homo sapiens
tttcagtatcatctcca

SEQ ID NO: 3993410 - DNA, 18 bp, Homo sapiens
tttcagtccagaagaatt

SEQ ID NO: 3993411 - DNA, 13 bp, Homo sapiens
tttcagtgtacat

SEQ ID NO: 3993412 - DNA, 17 bp, Homo sapiens
tttcagtgttacctgtg

SEQ ID NO: 3993413 - DNA, 21 bp, Homo sapiens
tttcagtttatttgaaccaat

SEQ ID NO: 3993414 - DNA, 14 bp, Homo sapiens
tttcatagtttatt

SEQ ID NO: 3993415 - DNA, 15 bp, Homo sapiens
tttcatagtttatta

SEQ ID NO: 3993416 - DNA, 23 bp, Homo sapiens
tttcatagtttattattattaaa

SEQ ID NO: 3993417 - DNA, 21 bp, Homo sapiens
tttcatatctggtcaagttga

SEQ ID NO: 3993418 - DNA, 22 bp, Homo sapiens
tttcatatgttgctcagtctcc

SEQ ID NO: 3993419 - DNA, 23 bp, Homo sapiens
tttcatccaaaatattttttgca

SEQ ID NO: 3993420 - DNA, 23 bp, Homo sapiens
tttcatccctatgggattcagtg

SEQ ID NO: 3993421 - DNA, 14 bp, Homo sapiens
tttcatccttccca

SEQ ID NO: 3993422 - DNA, 17 bp, Homo sapiens
tttcatctaccttttct

SEQ ID NO: 3993423 - DNA, 18 bp, Homo sapiens
tttcatctaccttttctg

SEQ ID NO: 3993424 - DNA, 16 bp, Homo sapiens
tttcatctcttgtata

SEQ ID NO: 3993425 - DNA, 18 bp, Homo sapiens
tttcatctggttttatta

SEQ ID NO: 3993426 - DNA, 24 bp, Homo sapiens
tttcatgaccagtaaaggctgctg

SEQ ID NO: 3993427 - DNA, 21 bp, Homo sapiens
tttcatgattagcaagttaca

SEQ ID NO: 3993428 - DNA, 19 bp, Homo sapiens
tttcatgttcactgtgagt

SEQ ID NO: 3993429 - DNA, 15 bp, Homo sapiens
tttcatgtttttgat

SEQ ID NO: 3993430 - DNA, 14 bp, Homo sapiens
tttcattaaacttg

SEQ ID NO: 3993431 - DNA, 16 bp, Homo sapiens
tttcattaaacttgaa

SEQ ID NO: 3993432 - DNA, 21 bp, Homo sapiens
tttcattaatacagggcattt

SEQ ID NO: 3993433 - DNA, 15 bp, Homo sapiens
tttcattcatcccat

SEQ ID NO: 3993434 - DNA, 18 bp, Homo sapiens
tttcattgctgtgacagt

SEQ ID NO: 3993435 - DNA, 21 bp, Homo sapiens
tttcatttactctaaaaactg

SEQ ID NO: 3993436 - DNA, 14 bp, Homo sapiens
tttcatttcaactg

SEQ ID NO: 3993437 - DNA, 20 bp, Homo sapiens
tttcatttcttcctcagctg

SEQ ID NO: 3993438 - DNA, 18 bp, Homo sapiens
tttccaacaccacagaca

SEQ ID NO: 3993439 - DNA, 15 bp, Homo sapiens
tttccaattctcctt

SEQ ID NO: 3993440 - DNA, 17 bp, Homo sapiens
tttccaattctccttta

SEQ ID NO: 3993441 - DNA, 17 bp, Homo sapiens
tttccacatttgtcaca

SEQ ID NO: 3993442 - DNA, 17 bp, Homo sapiens
tttccacgcagttcttt

SEQ ID NO: 3993443 - DNA, 16 bp, Homo sapiens
tttccactaaaaatat

SEQ ID NO: 3993444 - DNA, 16 bp, Homo sapiens
tttccacttcttcctt

SEQ ID NO: 3993445 - DNA, 23 bp, Homo sapiens
tttccactttgttctttaggaga

SEQ ID NO: 3993446 - DNA, 16 bp, Homo sapiens
tttccagcagaagaca

SEQ ID NO: 3993447 - DNA, 15 bp, Homo sapiens
tttccataaggaatg

SEQ ID NO: 3993448 - DNA, 16 bp, Homo sapiens
tttccatcattttaca

SEQ ID NO: 3993449 - DNA, 23 bp, Homo sapiens
tttcccacaccgtgtaaaccaaa

SEQ ID NO: 3993450 - DNA, 14 bp, Homo sapiens
tttcccacatcttt

SEQ ID NO: 3993451 - DNA, 19 bp, Homo sapiens
tttcccaccctcctgcccc

SEQ ID NO: 3993452 - DNA, 11 bp, Homo sapiens
tttcccaggac

SEQ ID NO: 3993453 - DNA, 14 bp, Homo sapiens
tttcccaggaccct

SEQ ID NO: 3993454 - DNA, 16 bp, Homo sapiens
tttcccaggttctgtt

SEQ ID NO: 3993455 - DNA, 22 bp, Homo sapiens
tttcccatctgcaccccttctc

SEQ ID NO: 3993456 - DNA, 15 bp, Homo sapiens
tttccccataactca

SEQ ID NO: 3993457 - DNA, 22 bp, Homo sapiens
tttcccccagcaacgcccctcc

SEQ ID NO: 3993458 - DNA, 17 bp, Homo sapiens
tttccccccactctccc

SEQ ID NO: 3993459 - DNA, 21 bp, Homo sapiens
tttcccccgagctcttggcct

SEQ ID NO: 3993460 - DNA, 14 bp, Homo sapiens
tttcccctttcctg

SEQ ID NO: 3993461 - DNA, 16 bp, Homo sapiens
tttcccttcagtaccc

SEQ ID NO: 3993462 - DNA, 19 bp, Homo sapiens
tttcccttcagtaccctct

SEQ ID NO: 3993463 - DNA, 13 bp, Homo sapiens
tttgtaattgtgt

SEQ ID NO: 3993464 - DNA, 13 bp, Homo sapiens
tttgtaatttttg

SEQ ID NO: 3993465 - DNA, 23 bp, Homo sapiens
tttgtacaaaaaaaaagttttat

SEQ ID NO: 3993466 - DNA, 15 bp, Homo sapiens
tttgtacactgctgt

SEQ ID NO: 3993467 - DNA, 16 bp, Homo sapiens
tttgtacactgctgta

SEQ ID NO: 3993468 - DNA, 13 bp, Homo sapiens
tttgtagctactt

SEQ ID NO: 3993469 - DNA, 21 bp, Homo sapiens
tttgtaggaaggtctcattct

SEQ ID NO: 3993470 - DNA, 18 bp, Homo sapiens
tttgtagtgaaataatag

SEQ ID NO: 3993471 - DNA, 14 bp, Homo sapiens
tttgtatagaccaa

SEQ ID NO: 3993472 - DNA, 18 bp, Homo sapiens
tttgtatatacagttatt

SEQ ID NO: 3993473 - DNA, 21 bp, Homo sapiens
tttgtatattacacatttgta

SEQ ID NO: 3993474 - DNA, 22 bp, Homo sapiens
tttgtatcttccatatttggaa

SEQ ID NO: 3993475 - DNA, 16 bp, Homo sapiens
tttgtatgcactttgt

SEQ ID NO: 3993476 - DNA, 22 bp, Homo sapiens
tttgtatgccaagtgagaagat

SEQ ID NO: 3993477 - DNA, 12 bp, Homo sapiens
tttgtatgtgtg

SEQ ID NO: 3993478 - DNA, 16 bp, Homo sapiens
tttgtatttattaatt

SEQ ID NO: 3993479 - DNA, 17 bp, Homo sapiens
tttgtcaatgacagttt

SEQ ID NO: 3993480 - DNA, 15 bp, Homo sapiens
tttgtcactgcttca

SEQ ID NO: 3993481 - DNA, 14 bp, Homo sapiens
tttgtcagacttta

SEQ ID NO: 3993482 - DNA, 20 bp, Homo sapiens
tttgtcatagttatgtgatt

SEQ ID NO: 3993483 - DNA, 17 bp, Homo sapiens
tttgtcattaaaattgt

SEQ ID NO: 3993484 - DNA, 10 bp, Homo sapiens
tttgtcccag

SEQ ID NO: 3993485 - DNA, 15 bp, Homo sapiens
tttgtcccatttcct

SEQ ID NO: 3993486 - DNA, 24 bp, Homo sapiens
tttgtcccatttccttggaggcca

SEQ ID NO: 3993487 - DNA, 22 bp, Homo sapiens
tttgtctcagaagtgaaaatct

SEQ ID NO: 3993488 - DNA, 21 bp, Homo sapiens
tttgtctctcctggctgggcc

SEQ ID NO: 3993489 - DNA, 12 bp, Homo sapiens
tttgtctcttct

SEQ ID NO: 3993490 - DNA, 13 bp, Homo sapiens
tttgtctgtcgtg

SEQ ID NO: 3993491 - DNA, 23 bp, Homo sapiens
tttgtgaatggattggattattt

SEQ ID NO: 3993492 - DNA, 12 bp, Homo sapiens
tttgtgagagcg

SEQ ID NO: 3993493 - DNA, 14 bp, Homo sapiens
tttgtgataattta

SEQ ID NO: 3993494 - DNA, 14 bp, Homo sapiens
tttgtgatgatgct

SEQ ID NO: 3993495 - DNA, 17 bp, Homo sapiens
tttgtgatgatgctgtg

SEQ ID NO: 3993496 - DNA, 20 bp, Homo sapiens
tttgtgcctggcttctttct

SEQ ID NO: 3993497 - DNA, 22 bp, Homo sapiens
tttgtgctgtgggcagcaccct

SEQ ID NO: 3993498 - DNA, 20 bp, Homo sapiens
tttgtgcttgtcattccaga

SEQ ID NO: 3993499 - DNA, 12 bp, Homo sapiens
tttgtggctggg

SEQ ID NO: 3993500 - DNA, 22 bp, Homo sapiens
tttgtggtacgacctttagatt

SEQ ID NO: 3993501 - DNA, 15 bp, Homo sapiens
tttgtggttctattt

SEQ ID NO: 3993502 - DNA, 16 bp, Homo sapiens
tttgtgtcctccagga

SEQ ID NO: 3993503 - DNA, 21 bp, Homo sapiens
tttgtgtgatgcgccttgctg

SEQ ID NO: 3993504 - DNA, 14 bp, Homo sapiens
tttgtgttcttctt

SEQ ID NO: 3993505 - DNA, 13 bp, Homo sapiens
tttgtgttgtaat

SEQ ID NO: 3993506 - DNA, 21 bp, Homo sapiens
tttgtgttgttggaaaaagtc

SEQ ID NO: 3993507 - DNA, 15 bp, Homo sapiens
tttgtgtttccattt

SEQ ID NO: 3993508 - DNA, 14 bp, Homo sapiens
tttgttaaaaataa

SEQ ID NO: 3993509 - DNA, 16 bp, Homo sapiens
tttgttacttccttat

SEQ ID NO: 3993510 - DNA, 21 bp, Homo sapiens
tttgttagatagctgcatgtg

SEQ ID NO: 3993511 - DNA, 16 bp, Homo sapiens
tttgttattccatcaa

SEQ ID NO: 3993512 - DNA, 20 bp, Homo sapiens
tttgttattccatcaataaa

SEQ ID NO: 3993513 - DNA, 21 bp, Homo sapiens
tttgttattccatcaataaat

SEQ ID NO: 3993514 - DNA, 17 bp, Homo sapiens
tttgttcaagttttggg

SEQ ID NO: 3993515 - DNA, 23 bp, Homo sapiens
tttgttcaagttttgggtatgtt

SEQ ID NO: 3993516 - DNA, 10 bp, Homo sapiens
tttgttcctg

SEQ ID NO: 3993517 - DNA, 15 bp, Homo sapiens
tttgttctgttctgg

SEQ ID NO: 3993518 - DNA, 15 bp, Homo sapiens
tttgttgaaattatg

SEQ ID NO: 3993519 - DNA, 19 bp, Homo sapiens
tttgttgacaaaattttct

SEQ ID NO: 3993520 - DNA, 19 bp, Homo sapiens
tttgttgcaagatgtgaat

SEQ ID NO: 3993521 - DNA, 14 bp, Homo sapiens
tttgttgccccaga

SEQ ID NO: 3993522 - DNA, 15 bp, Homo sapiens
tttgttgctttctta

SEQ ID NO: 3993523 - DNA, 12 bp, Homo sapiens
tttgttgtaaaa

SEQ ID NO: 3993524 - DNA, 15 bp, Homo sapiens
tttgttgtgtgtgca

SEQ ID NO: 3993525 - DNA, 14 bp, Homo sapiens
tttgttgttttctg

SEQ ID NO: 3993526 - DNA, 18 bp, Homo sapiens
tttgttgttttctggggg

SEQ ID NO: 3993527 - DNA, 17 bp, Homo sapiens
tttgtttaaagaataaa

SEQ ID NO: 3993528 - DNA, 21 bp, Homo sapiens
tttgtttaatttttatttctt

SEQ ID NO: 3993529 - DNA, 22 bp, Homo sapiens
tttgtttaatttttatttcttc

SEQ ID NO: 3993530 - DNA, 13 bp, Homo sapiens
tttgtttatgcat

SEQ ID NO: 3993531 - DNA, 17 bp, Homo sapiens
tttgtttcaatgaggtg

SEQ ID NO: 3993532 - DNA, 15 bp, Homo sapiens
tttgtttgtttgggt

SEQ ID NO: 3993533 - DNA, 15 bp, Homo sapiens
tttgttttgctgaga

SEQ ID NO: 3993534 - DNA, 23 bp, Homo sapiens
ttttaaaaaagcaacagaaacct

SEQ ID NO: 3993535 - DNA, 16 bp, Homo sapiens
ttttaaaaatacatat

SEQ ID NO: 3993536 - DNA, 23 bp, Homo sapiens
ttttaaaaatgtcctgcctttta

SEQ ID NO: 3993537 - DNA, 19 bp, Homo sapiens
ttttaaaacactaaaagca

SEQ ID NO: 3993538 - DNA, 15 bp, Homo sapiens
ttttaaagatctgta

SEQ ID NO: 3993539 - DNA, 20 bp, Homo sapiens
ttttaaagatctgtaagtaa

SEQ ID NO: 3993540 - DNA, 13 bp, Homo sapiens
ttttaaagtgttt

SEQ ID NO: 3993541 - DNA, 17 bp, Homo sapiens
ttttaaataaaagtgat

SEQ ID NO: 3993542 - DNA, 21 bp, Homo sapiens
ttttaaatctaaatctattta

SEQ ID NO: 3993543 - DNA, 14 bp, Homo sapiens
ttttaaatgacttg

SEQ ID NO: 3993544 - DNA, 21 bp, Homo sapiens
ttttaaattataacttaaaat

SEQ ID NO: 3993545 - DNA, 12 bp, Homo sapiens
ttttaaattgtt

SEQ ID NO: 3993546 - DNA, 15 bp, Homo sapiens
ttttaaattgtttca

SEQ ID NO: 3993547 - DNA, 22 bp, Homo sapiens
ttttaaattgtttcatatctgg

SEQ ID NO: 3993548 - DNA, 16 bp, Homo sapiens
ttttaacaaaagcaag

SEQ ID NO: 3993549 - DNA, 22 bp, Homo sapiens
ttttaacaataactactgtgtt

SEQ ID NO: 3993550 - DNA, 16 bp, Homo sapiens
ttttaactagaattta

SEQ ID NO: 3993551 - DNA, 16 bp, Homo sapiens
ttttaactttaagttt

SEQ ID NO: 3993552 - DNA, 16 bp, Homo sapiens
ttttaagaatatctgt

SEQ ID NO: 3993553 - DNA, 19 bp, Homo sapiens
ttttaagaattgagtaatg

SEQ ID NO: 3993554 - DNA, 22 bp, Homo sapiens
ttttaagataaattataagtta

SEQ ID NO: 3993555 - DNA, 18 bp, Homo sapiens
ttttaagatttttctcaa

SEQ ID NO: 3993556 - DNA, 21 bp, Homo sapiens
ttttaagcgtaattttgccaa

SEQ ID NO: 3993557 - DNA, 13 bp, Homo sapiens
ttttaagttctta

SEQ ID NO: 3993558 - DNA, 14 bp, Homo sapiens
ttttaagttgctga

SEQ ID NO: 3993559 - DNA, 12 bp, Homo sapiens
ttttaataaact

SEQ ID NO: 3993560 - DNA, 13 bp, Homo sapiens
ttttaataaacta

SEQ ID NO: 3993561 - DNA, 15 bp, Homo sapiens
ttttaataaactact

SEQ ID NO: 3993562 - DNA, 19 bp, Homo sapiens
ttttaataaactactcttt

SEQ ID NO: 3993563 - DNA, 18 bp, Homo sapiens
ttttaatagtgctttttt

SEQ ID NO: 3993564 - DNA, 22 bp, Homo sapiens
ttttaatatgcttaaaataagc

SEQ ID NO: 3993565 - DNA, 18 bp, Homo sapiens
ttttaatattcttttgtt

SEQ ID NO: 3993566 - DNA, 21 bp, Homo sapiens
ttttctgcatcatctgtagat

SEQ ID NO: 3993567 - DNA, 12 bp, Homo sapiens
ttttctgccctg

SEQ ID NO: 3993568 - DNA, 20 bp, Homo sapiens
ttttctggtagatagaaata

SEQ ID NO: 3993569 - DNA, 15 bp, Homo sapiens
ttttcttagttactt

SEQ ID NO: 3993570 - DNA, 15 bp, Homo sapiens
ttttctttaaagatg

SEQ ID NO: 3993571 - DNA, 22 bp, Homo sapiens
ttttctttacaaacaaaagcat

SEQ ID NO: 3993572 - DNA, 15 bp, Homo sapiens
ttttctttttacata

SEQ ID NO: 3993573 - DNA, 22 bp, Homo sapiens
ttttctttttttttaagttctt

SEQ ID NO: 3993574 - DNA, 16 bp, Homo sapiens
ttttgaaaagctatta

SEQ ID NO: 3993575 - DNA, 17 bp, Homo sapiens
ttttgaaaagcttctta

SEQ ID NO: 3993576 - DNA, 20 bp, Homo sapiens
ttttgaactaataaaagcat

SEQ ID NO: 3993577 - DNA, 19 bp, Homo sapiens
ttttgaagaatatttaaga

SEQ ID NO: 3993578 - DNA, 14 bp, Homo sapiens
ttttgaaggcaaaa

SEQ ID NO: 3993579 - DNA, 16 bp, Homo sapiens
ttttgaatttaaataa

SEQ ID NO: 3993580 - DNA, 18 bp, Homo sapiens
ttttgaatttaaataaag

SEQ ID NO: 3993581 - DNA, 20 bp, Homo sapiens
ttttgaatttaaataaagtt

SEQ ID NO: 3993582 - DNA, 13 bp, Homo sapiens
ttttgacactgaa

SEQ ID NO: 3993583 - DNA, 20 bp, Homo sapiens
ttttgacggatgattggatt

SEQ ID NO: 3993584 - DNA, 18 bp, Homo sapiens
ttttgacttaatgtgatt

SEQ ID NO: 3993585 - DNA, 15 bp, Homo sapiens
ttttgaggagcccca

SEQ ID NO: 3993586 - DNA, 14 bp, Homo sapiens
ttttgagttctaca

SEQ ID NO: 3993587 - DNA, 13 bp, Homo sapiens
ttttgataacaat

SEQ ID NO: 3993588 - DNA, 15 bp, Homo sapiens
ttttgatagctttat

SEQ ID NO: 3993589 - DNA, 20 bp, Homo sapiens
ttttgatgtttgtggcctca

SEQ ID NO: 3993590 - DNA, 13 bp, Homo sapiens
ttttgcaaatata

SEQ ID NO: 3993591 - DNA, 19 bp, Homo sapiens
ttttgcaaatataaacatc

SEQ ID NO: 3993592 - DNA, 23 bp, Homo sapiens
ttttgcacagttagttgtgaaag

SEQ ID NO: 3993593 - DNA, 13 bp, Homo sapiens
ttttgcagaagag

SEQ ID NO: 3993594 - DNA, 14 bp, Homo sapiens
ttttgcagcagtga

SEQ ID NO: 3993595 - DNA, 15 bp, Homo sapiens
ttttgcattcaaatt

SEQ ID NO: 3993596 - DNA, 14 bp, Homo sapiens
ttttgcattccaga

SEQ ID NO: 3993597 - DNA, 19 bp, Homo sapiens
ttttgcattccagaatctt

SEQ ID NO: 3993598 - DNA, 20 bp, Homo sapiens
ttttgcattccagaatcttg

SEQ ID NO: 3993599 - DNA, 15 bp, Homo sapiens
ttttgcctcttttct

SEQ ID NO: 3993600 - DNA, 17 bp, Homo sapiens
ttttgctattgtaaata

SEQ ID NO: 3993601 - DNA, 13 bp, Homo sapiens
ttttgctgtatat

SEQ ID NO: 3993602 - DNA, 13 bp, Homo sapiens
ttttggaaactgc

SEQ ID NO: 3993603 - DNA, 16 bp, Homo sapiens
ttttggattgtatatt

SEQ ID NO: 3993604 - DNA, 19 bp, Homo sapiens
ttttggcactgagatattt

SEQ ID NO: 3993605 - DNA, 15 bp, Homo sapiens
ttttggccaaagtgt

SEQ ID NO: 3993606 - DNA, 14 bp, Homo sapiens
ttttggctgacttc

SEQ ID NO: 3993607 - DNA, 17 bp, Homo sapiens
ttttggggaaaaaagca

SEQ ID NO: 3993608 - DNA, 16 bp, Homo sapiens
ttttggtaataacaaa

SEQ ID NO: 3993609 - DNA, 16 bp, Homo sapiens
ttttggtggtgaaatt

SEQ ID NO: 3993610 - DNA, 11 bp, Homo sapiens
ttttgtaagaa

SEQ ID NO: 3993611 - DNA, 16 bp, Homo sapiens
ttttgtaatgtgaaaa

SEQ ID NO: 3993612 - DNA, 18 bp, Homo sapiens
ttttgtaatgtgaaaagt

SEQ ID NO: 3993613 - DNA, 14 bp, Homo sapiens
ttttgtaattgtgt

SEQ ID NO: 3993614 - DNA, 16 bp, Homo sapiens
ttttgtaattgtgtaa

SEQ ID NO: 3993615 - DNA, 15 bp, Homo sapiens
ttttgtacactgctg

SEQ ID NO: 3993616 - DNA, 11 bp, Homo sapiens
ttttgtacatg

SEQ ID NO: 3993617 - DNA, 17 bp, Homo sapiens
ttttgtatatacagtta

SEQ ID NO: 3993618 - DNA, 17 bp, Homo sapiens
ttttgtctttaaataga

SEQ ID NO: 3993619 - DNA, 24 bp, Homo sapiens
ttttgtgaaatgaaaacatgtaat

SEQ ID NO: 3993620 - DNA, 14 bp, Homo sapiens
ttttgtgaactttt

SEQ ID NO: 3993621 - DNA, 21 bp, Homo sapiens
ttttgtgcaaaagcttcaaat

SEQ ID NO: 3993622 - DNA, 13 bp, Homo sapiens
ttttgtgcatttg

SEQ ID NO: 3993623 - DNA, 22 bp, Homo sapiens
ttttgtgcatttgtaaatgctg

SEQ ID NO: 3993624 - DNA, 21 bp, Homo sapiens
ttttgtggtcattaagcattg

SEQ ID NO: 3993625 - DNA, 15 bp, Homo sapiens
ttttgtgtttctaaa

SEQ ID NO: 3993626 - DNA, 16 bp, Homo sapiens
ttttgttacctttatg

SEQ ID NO: 3993627 - DNA, 24 bp, Homo sapiens
ttttgttcatttcatcctttcact

SEQ ID NO: 3993628 - DNA, 20 bp, Homo sapiens
ttttgttccaatgtcaatgt

SEQ ID NO: 3993629 - DNA, 21 bp, Homo sapiens
ttttgttccacaagttaaata

SEQ ID NO: 3993630 - DNA, 16 bp, Homo sapiens
ttttgttgccccagaa

SEQ ID NO: 3993631 - DNA, 18 bp, Homo sapiens
ttttgtttcaatgaggtg

SEQ ID NO: 3993632 - DNA, 14 bp, Homo sapiens
ttttgtttccatgg

SEQ ID NO: 3993633 - DNA, 18 bp, Homo sapiens
ttttgtttggcaaggaaa

SEQ ID NO: 3993634 - DNA, 19 bp, Homo sapiens
ttttgtttggcaaggaaag

SEQ ID NO: 3993635 - DNA, 16 bp, Homo sapiens
ttttgtttgtttcttt

SEQ ID NO: 3993636 - DNA, 22 bp, Homo sapiens
tttttaaaacactaaaagcagc

SEQ ID NO: 3993637 - DNA, 12 bp, Homo sapiens
tttttaaagatc

SEQ ID NO: 3993638 - DNA, 15 bp, Homo sapiens
tttttaaatgtgaat

SEQ ID NO: 3993639 - DNA, 13 bp, Homo sapiens
tttttaaattgtt

SEQ ID NO: 3993640 - DNA, 17 bp, Homo sapiens
tttttaacctctgttca

SEQ ID NO: 3993641 - DNA, 18 bp, Homo sapiens
tttttaactgaaaatgta

SEQ ID NO: 3993642 - DNA, 16 bp, Homo sapiens
tttttaagatagtgta

SEQ ID NO: 3993643 - DNA, 20 bp, Homo sapiens
tttttaagatagtgtaactt

SEQ ID NO: 3993644 - DNA, 16 bp, Homo sapiens
tttttaagatttttct

SEQ ID NO: 3993645 - DNA, 16 bp, Homo sapiens
tttttaagtatttata

SEQ ID NO: 3993646 - DNA, 16 bp, Homo sapiens
tttttaatctagacaa

SEQ ID NO: 3993647 - DNA, 22 bp, Homo sapiens
tttttaatctagacaatataca

SEQ ID NO: 3993648 - DNA, 17 bp, Homo sapiens
tttttaatttgatgaaa

SEQ ID NO: 3993649 - DNA, 20 bp, Homo sapiens
tttttaatttgatgaaagct

SEQ ID NO: 3993650 - DNA, 21 bp, Homo sapiens
tttttaattttcacaaaatgt

SEQ ID NO: 3993651 - DNA, 19 bp, Homo sapiens
tttttacaagttttaaata

SEQ ID NO: 3993652 - DNA, 22 bp, Homo sapiens
tttttacctaccacagtgtctg

SEQ ID NO: 3993653 - DNA, 21 bp, Homo sapiens
tttttagatcaaatactttaa

SEQ ID NO: 3993654 - DNA, 17 bp, Homo sapiens
tttttataccattcaga

SEQ ID NO: 3993655 - DNA, 14 bp, Homo sapiens
tttttatttctcct

SEQ ID NO: 3993656 - DNA, 17 bp, Homo sapiens
tttttcaagttgtaaat

SEQ ID NO: 3993657 - DNA, 16 bp, Homo sapiens
tttttcaatatattga

SEQ ID NO: 3993658 - DNA, 17 bp, Homo sapiens
tttttcaatatattgaa

SEQ ID NO: 3993659 - DNA, 16 bp, Homo sapiens
tttttcaatatttatt

SEQ ID NO: 3993660 - DNA, 22 bp, Homo sapiens
tttttcatttattgtttatgta

SEQ ID NO: 3993661 - DNA, 11 bp, Homo sapiens
tttttcatttc

SEQ ID NO: 3993662 - DNA, 20 bp, Homo sapiens
tttttccactttgttcttta

SEQ ID NO: 3993663 - DNA, 11 bp, Homo sapiens
tttttccttta

SEQ ID NO: 3993664 - DNA, 10 bp, Homo sapiens
tttttctcaa

SEQ ID NO: 3993665 - DNA, 18 bp, Homo sapiens
tttttctcaatacgcctt

SEQ ID NO: 3993666 - DNA, 14 bp, Homo sapiens
tttttctcatgtat

SEQ ID NO: 3993667 - DNA, 14 bp, Homo sapiens
tttttctttaagat

SEQ ID NO: 3993668 - DNA, 23 bp, Homo sapiens
tttttctttttaaccctaatctt

SEQ ID NO: 3993669 - DNA, 14 bp, Homo sapiens
ctagaatgtcagat

SEQ ID NO: 3993670 - DNA, 20 bp, Homo sapiens
ctagaatgtcagatttctgg

SEQ ID NO: 3993671 - DNA, 20 bp, Homo sapiens
ctagaatgtggatttgattc

SEQ ID NO: 3993672 - DNA, 20 bp, Homo sapiens
ctagaattataagtcacaaa

SEQ ID NO: 3993673 - DNA, 20 bp, Homo sapiens
ctagaattctgtattggata

SEQ ID NO: 3993674 - DNA, 12 bp, Homo sapiens
ctagaatttatt

SEQ ID NO: 3993675 - DNA, 23 bp, Homo sapiens
ctagaatttattcaattcctctg

SEQ ID NO: 3993676 - DNA, 19 bp, Homo sapiens
ctagaattttaagtgcttt

SEQ ID NO: 3993677 - DNA, 14 bp, Homo sapiens
ctagacaaacaagg

SEQ ID NO: 3993678 - DNA, 16 bp, Homo sapiens
ctagacaaacaaggga

SEQ ID NO: 3993679 - DNA, 20 bp, Homo sapiens
ctagacaaacaagggagaag

SEQ ID NO: 3993680 - DNA, 21 bp, Homo sapiens
ctagacaaacaagggagaaga

SEQ ID NO: 3993681 - DNA, 17 bp, Homo sapiens
ctagacacacaaagcag

SEQ ID NO: 3993682 - DNA, 20 bp, Homo sapiens
ctagactgcatcccgtacct

SEQ ID NO: 3993683 - DNA, 20 bp, Homo sapiens
ctagactttaaatttaaagt

SEQ ID NO: 3993684 - DNA, 16 bp, Homo sapiens
ctagagaacaggtggt

SEQ ID NO: 3993685 - DNA, 16 bp, Homo sapiens
ctagagaacgcagccc

SEQ ID NO: 3993686 - DNA, 18 bp, Homo sapiens
ctagagaacgcagcccta

SEQ ID NO: 3993687 - DNA, 12 bp, Homo sapiens
ctagagaagagg

SEQ ID NO: 3993688 - DNA, 14 bp, Homo sapiens
ctagagaagataat

SEQ ID NO: 3993689 - DNA, 21 bp, Homo sapiens
ctagagaagggagacattgtt

SEQ ID NO: 3993690 - DNA, 22 bp, Homo sapiens
ctagagaagtggactggaggag

SEQ ID NO: 3993691 - DNA, 14 bp, Homo sapiens
ctagagcagggatt

SEQ ID NO: 3993692 - DNA, 12 bp, Homo sapiens
ctagagcctgcc

SEQ ID NO: 3993693 - DNA, 13 bp, Homo sapiens
ctagagcctgcct

SEQ ID NO: 3993694 - DNA, 16 bp, Homo sapiens
ctagagcctgcctgga

SEQ ID NO: 3993695 - DNA, 22 bp, Homo sapiens
ctagaggcttgcataataagct

SEQ ID NO: 3993696 - DNA, 16 bp, Homo sapiens
ctagagggttcctgta

SEQ ID NO: 3993697 - DNA, 15 bp, Homo sapiens
ctagaggtcaggacg

SEQ ID NO: 3993698 - DNA, 19 bp, Homo sapiens
ctagagtcctcactcccag

SEQ ID NO: 3993699 - DNA, 16 bp, Homo sapiens
ctagagtctgaacagc

SEQ ID NO: 3993700 - DNA, 15 bp, Homo sapiens
ctagagttcggtctg

SEQ ID NO: 3993701 - DNA, 20 bp, Homo sapiens
ctagagttcggtctgacagt

SEQ ID NO: 3993702 - DNA, 16 bp, Homo sapiens
ctagagttttatcaac

SEQ ID NO: 3993703 - DNA, 13 bp, Homo sapiens
ctagatgtcttta

SEQ ID NO: 3993704 - DNA, 21 bp, Homo sapiens
ctagcaagctgccgaaccaaa

SEQ ID NO: 3993705 - DNA, 18 bp, Homo sapiens
ctagcaagtgagagagat

SEQ ID NO: 3993706 - DNA, 22 bp, Homo sapiens
ctagcaatcacaacactggctg

SEQ ID NO: 3993707 - DNA, 16 bp, Homo sapiens
ctagcagacagaaact

SEQ ID NO: 3993708 - DNA, 15 bp, Homo sapiens
ctagcagagtgctgg

SEQ ID NO: 3993709 - DNA, 17 bp, Homo sapiens
ctagcagagtgctggca

SEQ ID NO: 3993710 - DNA, 22 bp, Homo sapiens
ctagcaggcctaagacatgtga

SEQ ID NO: 3993711 - DNA, 17 bp, Homo sapiens
ctagcaggctgttccat

SEQ ID NO: 3993712 - DNA, 16 bp, Homo sapiens
ctagcagtaaaagatg

SEQ ID NO: 3993713 - DNA, 13 bp, Homo sapiens
ctagcatccctga

SEQ ID NO: 3993714 - DNA, 17 bp, Homo sapiens
ctagccaccagtgtcct

SEQ ID NO: 3993715 - DNA, 20 bp, Homo sapiens
ctagccaccagtgtcctcca

SEQ ID NO: 3993716 - DNA, 21 bp, Homo sapiens
ctagccaccagtgtcctccaa

SEQ ID NO: 3993717 - DNA, 22 bp, Homo sapiens
ctagccaggaagtacttccacc

SEQ ID NO: 3993718 - DNA, 16 bp, Homo sapiens
ctagcccagactctga

SEQ ID NO: 3993719 - DNA, 15 bp, Homo sapiens
ctagcccctggggtg

SEQ ID NO: 3993720 - DNA, 13 bp, Homo sapiens
ctagccctgcccg

SEQ ID NO: 3993721 - DNA, 22 bp, Homo sapiens
ctagcctgtgcctctgggactg

SEQ ID NO: 3993722 - DNA, 11 bp, Homo sapiens
ctagccttgct

SEQ ID NO: 3993723 - DNA, 13 bp, Homo sapiens
ctagccttgcttg

SEQ ID NO: 3993724 - DNA, 18 bp, Homo sapiens
ctagcgatctctcctggc

SEQ ID NO: 3993725 - DNA, 20 bp, Homo sapiens
ctagcggagcccagcctggg

SEQ ID NO: 3993726 - DNA, 22 bp, Homo sapiens
ctagcgtagtgcagcagggcag

SEQ ID NO: 3993727 - DNA, 14 bp, Homo sapiens
ctagctagaaatat

SEQ ID NO: 3993728 - DNA, 21 bp, Homo sapiens
ctagctgcctagcaagctggc

SEQ ID NO: 3993729 - DNA, 22 bp, Homo sapiens
ctagctgcctagcaagctggcc

SEQ ID NO: 3993730 - DNA, 17 bp, Homo sapiens
ctagctggtagcataaa

SEQ ID NO: 3993731 - DNA, 14 bp, Homo sapiens
ctagcttctgcttt

SEQ ID NO: 3993732 - DNA, 18 bp, Homo sapiens
ctagcttctgcttttctg

SEQ ID NO: 3993733 - DNA, 21 bp, Homo sapiens
ctagcttctgcttttctgccc

SEQ ID NO: 3993734 - DNA, 23 bp, Homo sapiens
ctagcttctgcttttctgccctg

SEQ ID NO: 3993735 - DNA, 20 bp, Homo sapiens
ctagcttgacacagtcagca

SEQ ID NO: 3993736 - DNA, 15 bp, Homo sapiens
ctagctttagaccct

SEQ ID NO: 3993737 - DNA, 19 bp, Homo sapiens
ctagctttagaccctgggt

SEQ ID NO: 3993738 - DNA, 19 bp, Homo sapiens
ctaggaagagcaggactcc

SEQ ID NO: 3993739 - DNA, 17 bp, Homo sapiens
ctaggaatcccagaggt

SEQ ID NO: 3993740 - DNA, 15 bp, Homo sapiens
ctaggagaggggggc

SEQ ID NO: 3993741 - DNA, 23 bp, Homo sapiens
ctaggagggagacactggcccct

SEQ ID NO: 3993742 - DNA, 15 bp, Homo sapiens
ctaggatgtcgtctt

SEQ ID NO: 3993743 - DNA, 15 bp, Homo sapiens
ctaggcacaaggttg

SEQ ID NO: 3993744 - DNA, 18 bp, Homo sapiens
ctaggcccaggcctgggt

SEQ ID NO: 3993745 - DNA, 19 bp, Homo sapiens
ctaggcccaggcctgggtt

SEQ ID NO: 3993746 - DNA, 15 bp, Homo sapiens
ctaggcccctcctag

SEQ ID NO: 3993747 - DNA, 17 bp, Homo sapiens
ctaggcccctcctagac

SEQ ID NO: 3993748 - DNA, 12 bp, Homo sapiens
ctaggccgggcg

SEQ ID NO: 3993749 - DNA, 19 bp, Homo sapiens
ctaggcgagtgccaggact

SEQ ID NO: 3993750 - DNA, 14 bp, Homo sapiens
ctagggaggacctt

SEQ ID NO: 3993751 - DNA, 21 bp, Homo sapiens
ctagggaggaccttatctgtg

SEQ ID NO: 3993752 - DNA, 16 bp, Homo sapiens
ctagggagtggtcttt

SEQ ID NO: 3993753 - DNA, 15 bp, Homo sapiens
ctagggattcaggct

SEQ ID NO: 3993754 - DNA, 18 bp, Homo sapiens
ctagggatttaaagggac

SEQ ID NO: 3993755 - DNA, 20 bp, Homo sapiens
ctaggggaacagaccagtga

SEQ ID NO: 3993756 - DNA, 22 bp, Homo sapiens
ctaggggaacagaccagtgacc

SEQ ID NO: 3993757 - DNA, 18 bp, Homo sapiens
ctaggggtcaggctccat

SEQ ID NO: 3993758 - DNA, 16 bp, Homo sapiens
ctagggtcttgggggt

SEQ ID NO: 3993759 - DNA, 13 bp, Homo sapiens
ctagggtggccct

SEQ ID NO: 3993760 - DNA, 20 bp, Homo sapiens
ctaggtaatgttttgtatat

SEQ ID NO: 3993761 - DNA, 20 bp, Homo sapiens
ctaggtagccccctcttccc

SEQ ID NO: 3993762 - DNA, 11 bp, Homo sapiens
ctaggtatcat

SEQ ID NO: 3993763 - DNA, 14 bp, Homo sapiens
ctaggtccaagccc

SEQ ID NO: 3993764 - DNA, 23 bp, Homo sapiens
ctaggtccgtccggtgtgtcaga

SEQ ID NO: 3993765 - DNA, 12 bp, Homo sapiens
ctaggtctccag

SEQ ID NO: 3993766 - DNA, 23 bp, Homo sapiens
ctaggtctcggactaagcctacc

SEQ ID NO: 3993767 - DNA, 13 bp, Homo sapiens
ctagtaagatgca

SEQ ID NO: 3993768 - DNA, 12 bp, Homo sapiens
ctagtacaaatt

SEQ ID NO: 3993769 - DNA, 15 bp, Homo sapiens
ctagtaggaatgtac

SEQ ID NO: 3993770 - DNA, 18 bp, Homo sapiens
ctagtaggaatgtacatg

SEQ ID NO: 3993771 - DNA, 13 bp, Homo sapiens
ctagtatttgaat

SEQ ID NO: 3993772 - DNA, 22 bp, Homo sapiens
ctcagagatgtgcacccatggg

SEQ ID NO: 3993773 - DNA, 13 bp, Homo sapiens
ctcagagcatctg

SEQ ID NO: 3993774 - DNA, 13 bp, Homo sapiens
ctcagagccaagt

SEQ ID NO: 3993775 - DNA, 16 bp, Homo sapiens
ctcagagccctgccct

SEQ ID NO: 3993776 - DNA, 17 bp, Homo sapiens
ctcagagcttgaagatt

SEQ ID NO: 3993777 - DNA, 19 bp, Homo sapiens
ctcagaggagctctaccct

SEQ ID NO: 3993778 - DNA, 13 bp, Homo sapiens
ctcagaggcccag

SEQ ID NO: 3993779 - DNA, 14 bp, Homo sapiens
ctcagaggcctgct

SEQ ID NO: 3993780 - DNA, 19 bp, Homo sapiens
ctcagaggcgcactgtgac

SEQ ID NO: 3993781 - DNA, 18 bp, Homo sapiens
ctcagaggctcagagact

SEQ ID NO: 3993782 - DNA, 17 bp, Homo sapiens
ctcagatcagtgtacca

SEQ ID NO: 3993783 - DNA, 21 bp, Homo sapiens
ctcagatcagtgtaccatttg

SEQ ID NO: 3993784 - DNA, 16 bp, Homo sapiens
ctcagatccagggaca

SEQ ID NO: 3993785 - DNA, 20 bp, Homo sapiens
ctcagatccagggacagagg

SEQ ID NO: 3993786 - DNA, 20 bp, Homo sapiens
ctcagatggactgggaggag

SEQ ID NO: 3993787 - DNA, 13 bp, Homo sapiens
ctcagcaagccct

SEQ ID NO: 3993788 - DNA, 22 bp, Homo sapiens
ctcagcagccgccttaagctga

SEQ ID NO: 3993789 - DNA, 18 bp, Homo sapiens
ctcagcatttccttccag

SEQ ID NO: 3993790 - DNA, 21 bp, Homo sapiens
ctcagcatttccttccagccc

SEQ ID NO: 3993791 - DNA, 15 bp, Homo sapiens
ctcagccccaactct

SEQ ID NO: 3993792 - DNA, 16 bp, Homo sapiens
ctcagccccaactctt

SEQ ID NO: 3993793 - DNA, 17 bp, Homo sapiens
ctcagccccaactcttt

SEQ ID NO: 3993794 - DNA, 20 bp, Homo sapiens
ctcagccccaactctttatc

SEQ ID NO: 3993795 - DNA, 16 bp, Homo sapiens
ctcagccccgagctgt

SEQ ID NO: 3993796 - DNA, 14 bp, Homo sapiens
ctcagccctccctg

SEQ ID NO: 3993797 - DNA, 19 bp, Homo sapiens
ctcagccctccctgcccct

SEQ ID NO: 3993798 - DNA, 18 bp, Homo sapiens
ctcagccctgactggtgc

SEQ ID NO: 3993799 - DNA, 15 bp, Homo sapiens
ctcagccctgaggtg

SEQ ID NO: 3993800 - DNA, 12 bp, Homo sapiens
ctcagcctcaga

SEQ ID NO: 3993801 - DNA, 20 bp, Homo sapiens
ctcagcctcccagagtgctg

SEQ ID NO: 3993802 - DNA, 13 bp, Homo sapiens
ctcagcctcctga

SEQ ID NO: 3993803 - DNA, 21 bp, Homo sapiens
ctcagcctcctgagcctgtgg

SEQ ID NO: 3993804 - DNA, 15 bp, Homo sapiens
ctcagcctgctgccc

SEQ ID NO: 3993805 - DNA, 17 bp, Homo sapiens
ctcagcctgctgcccag

SEQ ID NO: 3993806 - DNA, 15 bp, Homo sapiens
ctcagcctggccaga

SEQ ID NO: 3993807 - DNA, 16 bp, Homo sapiens
ctcagccttacatttg

SEQ ID NO: 3993808 - DNA, 18 bp, Homo sapiens
ctcagccttgccagagat

SEQ ID NO: 3993809 - DNA, 22 bp, Homo sapiens
ctcagccttgccagagatccaa

SEQ ID NO: 3993810 - DNA, 21 bp, Homo sapiens
ctcagctacccactatccttc

SEQ ID NO: 3993811 - DNA, 15 bp, Homo sapiens
ctcagctcagcgcca

SEQ ID NO: 3993812 - DNA, 17 bp, Homo sapiens
ctcagctcctacctctg

SEQ ID NO: 3993813 - DNA, 19 bp, Homo sapiens
ctcagctcctacctctgtg

SEQ ID NO: 3993814 - DNA, 14 bp, Homo sapiens
ctcagctctgggag

SEQ ID NO: 3993815 - DNA, 14 bp, Homo sapiens
ctcagctctgggcc

SEQ ID NO: 3993816 - DNA, 16 bp, Homo sapiens
ctcagctgacccggcc

SEQ ID NO: 3993817 - DNA, 14 bp, Homo sapiens
ctcagctgcctcct

SEQ ID NO: 3993818 - DNA, 17 bp, Homo sapiens
ctcagctgcctcctgcg

SEQ ID NO: 3993819 - DNA, 19 bp, Homo sapiens
ctcagctgcctcctgcgcc

SEQ ID NO: 3993820 - DNA, 20 bp, Homo sapiens
ctcagctggttactcagggt

SEQ ID NO: 3993821 - DNA, 22 bp, Homo sapiens
ctcagctggttactcagggttc

SEQ ID NO: 3993822 - DNA, 20 bp, Homo sapiens
ctcagcttatctcttttata

SEQ ID NO: 3993823 - DNA, 22 bp, Homo sapiens
ctcagcttcctacccacacctc

SEQ ID NO: 3993824 - DNA, 16 bp, Homo sapiens
ctcaggaagagctatg

SEQ ID NO: 3993825 - DNA, 22 bp, Homo sapiens
ctcaggacagcatcccttccca

SEQ ID NO: 3993826 - DNA, 20 bp, Homo sapiens
ctcaggacctctgtaggcag

SEQ ID NO: 3993827 - DNA, 15 bp, Homo sapiens
ctcaggactcctctc

SEQ ID NO: 3993828 - DNA, 20 bp, Homo sapiens
ctcaggagatggagggcttg

SEQ ID NO: 3993829 - DNA, 12 bp, Homo sapiens
ctcaggagcaca

SEQ ID NO: 3993830 - DNA, 14 bp, Homo sapiens
ctcaggagcttggg

SEQ ID NO: 3993831 - DNA, 20 bp, Homo sapiens
ctcaggatatccttatcaga

SEQ ID NO: 3993832 - DNA, 17 bp, Homo sapiens
ctcaggcataggcctgg

SEQ ID NO: 3993833 - DNA, 20 bp, Homo sapiens
ctcaggcataggcctgggtg

SEQ ID NO: 3993834 - DNA, 22 bp, Homo sapiens
ctcaggcataggcctgggtgct

SEQ ID NO: 3993835 - DNA, 20 bp, Homo sapiens
ctcaggccaagaaacgtctt

SEQ ID NO: 3993836 - DNA, 23 bp, Homo sapiens
ctcaggcctataaccccagctcc

SEQ ID NO: 3993837 - DNA, 14 bp, Homo sapiens
ctcaggcctgtgcc

SEQ ID NO: 3993838 - DNA, 15 bp, Homo sapiens
ctcaggcctgtgccc

SEQ ID NO: 3993839 - DNA, 20 bp, Homo sapiens
ctcaggcgatccacctgtct

SEQ ID NO: 3993840 - DNA, 21 bp, Homo sapiens
ctcaggcgatccacctgtctc

SEQ ID NO: 3993841 - DNA, 13 bp, Homo sapiens
ctcaggctctgct

SEQ ID NO: 3993842 - DNA, 14 bp, Homo sapiens
ctcaggctctgtgg

SEQ ID NO: 3993843 - DNA, 21 bp, Homo sapiens
ctcagggagcagggaaggcct

SEQ ID NO: 3993844 - DNA, 10 bp, Homo sapiens
ctcagggcac

SEQ ID NO: 3993845 - DNA, 14 bp, Homo sapiens
ctcagggccaggcc

SEQ ID NO: 3993846 - DNA, 16 bp, Homo sapiens
ctcagggccaggccca

SEQ ID NO: 3993847 - DNA, 17 bp, Homo sapiens
ctcagggccaggcccag

SEQ ID NO: 3993848 - DNA, 23 bp, Homo sapiens
ctcagggccaggcccaggcctca

SEQ ID NO: 3993849 - DNA, 13 bp, Homo sapiens
ctcagggcctggc

SEQ ID NO: 3993850 - DNA, 20 bp, Homo sapiens
ctcagggcctggcaggccag

SEQ ID NO: 3993851 - DNA, 15 bp, Homo sapiens
ctcagggcgctcaga

SEQ ID NO: 3993852 - DNA, 19 bp, Homo sapiens
ctcagggcgctcagacggc

SEQ ID NO: 3993853 - DNA, 15 bp, Homo sapiens
ctcagggctcccagg

SEQ ID NO: 3993854 - DNA, 18 bp, Homo sapiens
ctcagggctcgggagcca

SEQ ID NO: 3993855 - DNA, 15 bp, Homo sapiens
ctcagggctgtccca

SEQ ID NO: 3993856 - DNA, 14 bp, Homo sapiens
ctcagggtgggggg

SEQ ID NO: 3993857 - DNA, 15 bp, Homo sapiens
ctcagggttcatctg

SEQ ID NO: 3993858 - DNA, 16 bp, Homo sapiens
ctcagggttcatctgt

SEQ ID NO: 3993859 - DNA, 18 bp, Homo sapiens
ctcagggttcatctgtcc

SEQ ID NO: 3993860 - DNA, 17 bp, Homo sapiens
ctcaggtagaaggttga

SEQ ID NO: 3993861 - DNA, 17 bp, Homo sapiens
ctcaggtcaactgacct

SEQ ID NO: 3993862 - DNA, 24 bp, Homo sapiens
ctcaggtggggagtccagggctcc

SEQ ID NO: 3993863 - DNA, 14 bp, Homo sapiens
ctcaggtgttgcca

SEQ ID NO: 3993864 - DNA, 22 bp, Homo sapiens
ctcaggtgttttttatgaagtg

SEQ ID NO: 3993865 - DNA, 16 bp, Homo sapiens
ctcagtcatgcataaa

SEQ ID NO: 3993866 - DNA, 18 bp, Homo sapiens
ctcagtcatgcataaata

SEQ ID NO: 3993867 - DNA, 23 bp, Homo sapiens
ctcagtccatttatatatgaaaa

SEQ ID NO: 3993868 - DNA, 14 bp, Homo sapiens
ctcagtctcccttt

SEQ ID NO: 3993869 - DNA, 24 bp, Homo sapiens
ctcagtctggtgctccagttccag

SEQ ID NO: 3993870 - DNA, 13 bp, Homo sapiens
ctcagtgagcctc

SEQ ID NO: 3993871 - DNA, 16 bp, Homo sapiens
ctcagtgagctggaga

SEQ ID NO: 3993872 - DNA, 18 bp, Homo sapiens
ctcagtgtcatttatgaa

SEQ ID NO: 3993873 - DNA, 12 bp, Homo sapiens
ctcagtgttttg

SEQ ID NO: 3993874 - DNA, 22 bp, Homo sapiens
ctcagtgttttggactccatct

SEQ ID NO: 3993875 - DNA, 22 bp, Homo sapiens
ctccctgggacacagacccagg

SEQ ID NO: 3993876 - DNA, 22 bp, Homo sapiens
ctccctgtctccagctgcctgg

SEQ ID NO: 3993877 - DNA, 21 bp, Homo sapiens
ctccctgtgtccacctgtggg

SEQ ID NO: 3993878 - DNA, 19 bp, Homo sapiens
ctcccttcaaccattcccc

SEQ ID NO: 3993879 - DNA, 16 bp, Homo sapiens
ctcccttccccataga

SEQ ID NO: 3993880 - DNA, 22 bp, Homo sapiens
ctcccttcctatgctgttcact

SEQ ID NO: 3993881 - DNA, 17 bp, Homo sapiens
ctcccttgacctgctga

SEQ ID NO: 3993882 - DNA, 16 bp, Homo sapiens
ctcccttgctgaacac

SEQ ID NO: 3993883 - DNA, 19 bp, Homo sapiens
ctcccttgctgaacacaca

SEQ ID NO: 3993884 - DNA, 20 bp, Homo sapiens
ctcccttgctgaacacacac

SEQ ID NO: 3993885 - DNA, 16 bp, Homo sapiens
ctcccttgggctggaa

SEQ ID NO: 3993886 - DNA, 18 bp, Homo sapiens
ctcccttgggttctgata

SEQ ID NO: 3993887 - DNA, 21 bp, Homo sapiens
ctcccttggtggcaagagccc

SEQ ID NO: 3993888 - DNA, 14 bp, Homo sapiens
ctccctttttatat

SEQ ID NO: 3993889 - DNA, 21 bp, Homo sapiens
ctccctttttatatcccattt

SEQ ID NO: 3993890 - DNA, 16 bp, Homo sapiens
ctccgactgctaggga

SEQ ID NO: 3993891 - DNA, 22 bp, Homo sapiens
ctccgacttgtgcacaggcaga

SEQ ID NO: 3993892 - DNA, 15 bp, Homo sapiens
ctccgcagttcctgt

SEQ ID NO: 3993893 - DNA, 21 bp, Homo sapiens
ctccgcatcacctcaccaagg

SEQ ID NO: 3993894 - DNA, 20 bp, Homo sapiens
ctccgccagcctcctctgga

SEQ ID NO: 3993895 - DNA, 22 bp, Homo sapiens
ctccgcccgctcctgccgcaga

SEQ ID NO: 3993896 - DNA, 15 bp, Homo sapiens
ctccgccctcctcgg

SEQ ID NO: 3993897 - DNA, 17 bp, Homo sapiens
ctccgccctcctcgggc

SEQ ID NO: 3993898 - DNA, 12 bp, Homo sapiens
ctccgctgctcc

SEQ ID NO: 3993899 - DNA, 16 bp, Homo sapiens
ctccgctgctccttgg

SEQ ID NO: 3993900 - DNA, 18 bp, Homo sapiens
ctccgctgctccttggct

SEQ ID NO: 3993901 - DNA, 16 bp, Homo sapiens
ctccggactggtgccc

SEQ ID NO: 3993902 - DNA, 15 bp, Homo sapiens
ctccgggtgtggcct

SEQ ID NO: 3993903 - DNA, 18 bp, Homo sapiens
ctccgggtgtggcctcag

SEQ ID NO: 3993904 - DNA, 13 bp, Homo sapiens
ctccgtccatatc

SEQ ID NO: 3993905 - DNA, 15 bp, Homo sapiens
ctccgttccatctgg

SEQ ID NO: 3993906 - DNA, 13 bp, Homo sapiens
ctcctaaaactgg

SEQ ID NO: 3993907 - DNA, 15 bp, Homo sapiens
ctcctaattttaaat

SEQ ID NO: 3993908 - DNA, 21 bp, Homo sapiens
ctcctaattttaaataatttc

SEQ ID NO: 3993909 - DNA, 15 bp, Homo sapiens
ctcctacctctgtgc

SEQ ID NO: 3993910 - DNA, 18 bp, Homo sapiens
ctcctacctctgtgccag

SEQ ID NO: 3993911 - DNA, 18 bp, Homo sapiens
ctcctacctgccctggaa

SEQ ID NO: 3993912 - DNA, 20 bp, Homo sapiens
ctcctacctgccctggaaca

SEQ ID NO: 3993913 - DNA, 15 bp, Homo sapiens
ctcctagagaacgca

SEQ ID NO: 3993914 - DNA, 23 bp, Homo sapiens
ctcctagcagacagaaactggat

SEQ ID NO: 3993915 - DNA, 16 bp, Homo sapiens
ctcctaggagagccaa

SEQ ID NO: 3993916 - DNA, 20 bp, Homo sapiens
ctcctaggagagccaacctc

SEQ ID NO: 3993917 - DNA, 23 bp, Homo sapiens
ctcctaggtagccccctcttccc

SEQ ID NO: 3993918 - DNA, 17 bp, Homo sapiens
ctcctcacacaccctga

SEQ ID NO: 3993919 - DNA, 12 bp, Homo sapiens
ctcctcacctca

SEQ ID NO: 3993920 - DNA, 16 bp, Homo sapiens
ctcctcacctctggac

SEQ ID NO: 3993921 - DNA, 21 bp, Homo sapiens
ctcctcagagcgccaggaagc

SEQ ID NO: 3993922 - DNA, 17 bp, Homo sapiens
ctcctcaggcacacagc

SEQ ID NO: 3993923 - DNA, 13 bp, Homo sapiens
ctcctcatctcca

SEQ ID NO: 3993924 - DNA, 17 bp, Homo sapiens
ctcctccagcccctgtc

SEQ ID NO: 3993925 - DNA, 14 bp, Homo sapiens
ctcctccaggcctg

SEQ ID NO: 3993926 - DNA, 17 bp, Homo sapiens
ctcctccaggcctgcct

SEQ ID NO: 3993927 - DNA, 19 bp, Homo sapiens
ctcctccaggcctgcctcc

SEQ ID NO: 3993928 - DNA, 14 bp, Homo sapiens
ctcctccagggaag

SEQ ID NO: 3993929 - DNA, 24 bp, Homo sapiens
ctcctccagggaaggtggccacag

SEQ ID NO: 3993930 - DNA, 18 bp, Homo sapiens
ctcctccatctttctaca

SEQ ID NO: 3993931 - DNA, 20 bp, Homo sapiens
ctcctcccgcccttccatgt

SEQ ID NO: 3993932 - DNA, 21 bp, Homo sapiens
ctcctcccgcccttccatgtg

SEQ ID NO: 3993933 - DNA, 14 bp, Homo sapiens
ctcctcccggtgcc

SEQ ID NO: 3993934 - DNA, 22 bp, Homo sapiens
ctcctccctcagctctctggga

SEQ ID NO: 3993935 - DNA, 13 bp, Homo sapiens
ctcctcccttcct

SEQ ID NO: 3993936 - DNA, 21 bp, Homo sapiens
ctcctcccttccttttccctg

SEQ ID NO: 3993937 - DNA, 13 bp, Homo sapiens
ctcctcctcttca

SEQ ID NO: 3993938 - DNA, 18 bp, Homo sapiens
ctcctccttgcccagact

SEQ ID NO: 3993939 - DNA, 17 bp, Homo sapiens
ctcctcggagagcagca

SEQ ID NO: 3993940 - DNA, 20 bp, Homo sapiens
ctcctcggagagcagcagca

SEQ ID NO: 3993941 - DNA, 17 bp, Homo sapiens
ctcctcgggccgaggcc

SEQ ID NO: 3993942 - DNA, 19 bp, Homo sapiens
ctcctcgttcctttctcct

SEQ ID NO: 3993943 - DNA, 14 bp, Homo sapiens
ctcctctcagtgtt

SEQ ID NO: 3993944 - DNA, 14 bp, Homo sapiens
ctcctctccccagc

SEQ ID NO: 3993945 - DNA, 15 bp, Homo sapiens
ctcctctccccagcc

SEQ ID NO: 3993946 - DNA, 17 bp, Homo sapiens
ctcctctccccagccca

SEQ ID NO: 3993947 - DNA, 21 bp, Homo sapiens
ctcctctccccagcccagaga

SEQ ID NO: 3993948 - DNA, 23 bp, Homo sapiens
ctcctctccccagcccagagaca

SEQ ID NO: 3993949 - DNA, 14 bp, Homo sapiens
ctcctctcctggag

SEQ ID NO: 3993950 - DNA, 16 bp, Homo sapiens
ctcctctcctggagga

SEQ ID NO: 3993951 - DNA, 12 bp, Homo sapiens
ctcctctgccta

SEQ ID NO: 3993952 - DNA, 14 bp, Homo sapiens
ctcctctggctaga

SEQ ID NO: 3993953 - DNA, 13 bp, Homo sapiens
ctcctcttcacca

SEQ ID NO: 3993954 - DNA, 18 bp, Homo sapiens
ctcctcttcaccaggtgc

SEQ ID NO: 3993955 - DNA, 23 bp, Homo sapiens
ctcctcttcttttttttcattat

SEQ ID NO: 3993956 - DNA, 18 bp, Homo sapiens
ctcctcttgattcctggt

SEQ ID NO: 3993957 - DNA, 20 bp, Homo sapiens
ctcctgacgtctgaagcttg

SEQ ID NO: 3993958 - DNA, 16 bp, Homo sapiens
ctcctgagaaatgtta

SEQ ID NO: 3993959 - DNA, 19 bp, Homo sapiens
ctcctgagcctgtgggtcc

SEQ ID NO: 3993960 - DNA, 17 bp, Homo sapiens
ctcctgaggctttggat

SEQ ID NO: 3993961 - DNA, 16 bp, Homo sapiens
ctcctgaggggcatct

SEQ ID NO: 3993962 - DNA, 19 bp, Homo sapiens
ctcctgaggggcatctgcc

SEQ ID NO: 3993963 - DNA, 20 bp, Homo sapiens
ctcctgaggggcatctgccc

SEQ ID NO: 3993964 - DNA, 19 bp, Homo sapiens
ctcctgcagcatggtccct

SEQ ID NO: 3993965 - DNA, 18 bp, Homo sapiens
ctcctgccacatggagcc

SEQ ID NO: 3993966 - DNA, 14 bp, Homo sapiens
ctcctgccaggcac

SEQ ID NO: 3993967 - DNA, 21 bp, Homo sapiens
ctcctgccaggcacacacagc

SEQ ID NO: 3993968 - DNA, 23 bp, Homo sapiens
ctcctgcccagatgccctttgga

SEQ ID NO: 3993969 - DNA, 16 bp, Homo sapiens
ctcctgccccacactc

SEQ ID NO: 3993970 - DNA, 14 bp, Homo sapiens
ctcctgcccctttc

SEQ ID NO: 3993971 - DNA, 20 bp, Homo sapiens
ctcctgcccctttcaggcct

SEQ ID NO: 3993972 - DNA, 23 bp, Homo sapiens
ctcctgcccctttcaggcctaca

SEQ ID NO: 3993973 - DNA, 16 bp, Homo sapiens
ctcctgccctgtccct

SEQ ID NO: 3993974 - DNA, 18 bp, Homo sapiens
ctcctgccctgtccctgt

SEQ ID NO: 3993975 - DNA, 14 bp, Homo sapiens
ctcctgccctgtga

SEQ ID NO: 3993976 - DNA, 15 bp, Homo sapiens
ctcctgccctgtgat

SEQ ID NO: 3993977 - DNA, 12 bp, Homo sapiens
ctctggctctca

SEQ ID NO: 3993978 - DNA, 13 bp, Homo sapiens
ctctggcttccag

SEQ ID NO: 3993979 - DNA, 18 bp, Homo sapiens
ctctggcttccaggtatc

SEQ ID NO: 3993980 - DNA, 20 bp, Homo sapiens
ctctggcttgacagcatgag

SEQ ID NO: 3993981 - DNA, 14 bp, Homo sapiens
ctctggctttccca

SEQ ID NO: 3993982 - DNA, 16 bp, Homo sapiens
ctctggctttcccagg

SEQ ID NO: 3993983 - DNA, 20 bp, Homo sapiens
ctctgggaaatgagaaggca

SEQ ID NO: 3993984 - DNA, 23 bp, Homo sapiens
ctctgggaaatgagaaggcagcc

SEQ ID NO: 3993985 - DNA, 17 bp, Homo sapiens
ctctgggagaggatttt

SEQ ID NO: 3993986 - DNA, 20 bp, Homo sapiens
ctctgggccattctccacag

SEQ ID NO: 3993987 - DNA, 23 bp, Homo sapiens
ctctggggacagcttcctcacac

SEQ ID NO: 3993988 - DNA, 14 bp, Homo sapiens
ctctggggcagccc

SEQ ID NO: 3993989 - DNA, 21 bp, Homo sapiens
ctctggggccctgggcctcag

SEQ ID NO: 3993990 - DNA, 22 bp, Homo sapiens
ctctggggccctgggcctcagt

SEQ ID NO: 3993991 - DNA, 16 bp, Homo sapiens
ctctggtgtgtggtga

SEQ ID NO: 3993992 - DNA, 16 bp, Homo sapiens
ctctggtttaattaca

SEQ ID NO: 3993993 - DNA, 23 bp, Homo sapiens
ctctgtaaaaacactgaaaaatt

SEQ ID NO: 3993994 - DNA, 19 bp, Homo sapiens
ctctgtaagatatcccagc

SEQ ID NO: 3993995 - DNA, 20 bp, Homo sapiens
ctctgtaggcagcagagaga

SEQ ID NO: 3993996 - DNA, 18 bp, Homo sapiens
ctctgtatagaaatctaa

SEQ ID NO: 3993997 - DNA, 23 bp, Homo sapiens
ctctgtcagatgggaagacatga

SEQ ID NO: 3993998 - DNA, 21 bp, Homo sapiens
ctctgtcagccagccgccctg

SEQ ID NO: 3993999 - DNA, 23 bp, Homo sapiens
ctctgtcagccagccgccctggg

SEQ ID NO: 3994000 - DNA, 17 bp, Homo sapiens
ctctgtcagtcacagcc

SEQ ID NO: 3994001 - DNA, 20 bp, Homo sapiens
ctctgtcagtcacagccacc

SEQ ID NO: 3994002 - DNA, 17 bp, Homo sapiens
ctctgtccatttatcca

SEQ ID NO: 3994003 - DNA, 15 bp, Homo sapiens
ctctgtcccacccct

SEQ ID NO: 3994004 - DNA, 18 bp, Homo sapiens
ctctgtcccacccctagc

SEQ ID NO: 3994005 - DNA, 20 bp, Homo sapiens
ctctgtcccacccctagcca

SEQ ID NO: 3994006 - DNA, 22 bp, Homo sapiens
ctctgtcccacccctagccacc

SEQ ID NO: 3994007 - DNA, 19 bp, Homo sapiens
ctctgtctcatcctcctgg

SEQ ID NO: 3994008 - DNA, 16 bp, Homo sapiens
ctctgtcttgtgtttc

SEQ ID NO: 3994009 - DNA, 18 bp, Homo sapiens
ctctgtgaacgatttaga

SEQ ID NO: 3994010 - DNA, 23 bp, Homo sapiens
ctctgtgaacgatttagaaagaa

SEQ ID NO: 3994011 - DNA, 18 bp, Homo sapiens
ctctgtgaatacaattaa

SEQ ID NO: 3994012 - DNA, 20 bp, Homo sapiens
ctctgtgaatacaattaaag

SEQ ID NO: 3994013 - DNA, 13 bp, Homo sapiens
ctctgtgccaggg

SEQ ID NO: 3994014 - DNA, 16 bp, Homo sapiens
ctctgtgccagggcag

SEQ ID NO: 3994015 - DNA, 19 bp, Homo sapiens
ctctgtgccagggcagcat

SEQ ID NO: 3994016 - DNA, 15 bp, Homo sapiens
ctctgtgccttcttt

SEQ ID NO: 3994017 - DNA, 16 bp, Homo sapiens
ctctgtgtccttccct

SEQ ID NO: 3994018 - DNA, 22 bp, Homo sapiens
ctctgtgttcccagaggcaggc

SEQ ID NO: 3994019 - DNA, 18 bp, Homo sapiens
ctctgttaaggttgaact

SEQ ID NO: 3994020 - DNA, 22 bp, Homo sapiens
ctctgttaaggttgaactttgc

SEQ ID NO: 3994021 - DNA, 13 bp, Homo sapiens
ctctgttccccca

SEQ ID NO: 3994022 - DNA, 20 bp, Homo sapiens
ctctgttgcaagtgcaataa

SEQ ID NO: 3994023 - DNA, 14 bp, Homo sapiens
ctctgttgtaagaa

SEQ ID NO: 3994024 - DNA, 18 bp, Homo sapiens
ctcttaaagttggaattt

SEQ ID NO: 3994025 - DNA, 12 bp, Homo sapiens
ctcttaagaaac

SEQ ID NO: 3994026 - DNA, 16 bp, Homo sapiens
ctcttactaatgtaaa

SEQ ID NO: 3994027 - DNA, 15 bp, Homo sapiens
ctcttactctttcct

SEQ ID NO: 3994028 - DNA, 14 bp, Homo sapiens
ctcttacttgccaa

SEQ ID NO: 3994029 - DNA, 15 bp, Homo sapiens
ctcttagaaatactt

SEQ ID NO: 3994030 - DNA, 18 bp, Homo sapiens
ctcttagcaaaaacatgt

SEQ ID NO: 3994031 - DNA, 17 bp, Homo sapiens
ctcttagcagcttccag

SEQ ID NO: 3994032 - DNA, 16 bp, Homo sapiens
ctcttatagaatattt

SEQ ID NO: 3994033 - DNA, 18 bp, Homo sapiens
ctcttatagaatatttat

SEQ ID NO: 3994034 - DNA, 20 bp, Homo sapiens
ctcttatagaatatttatta

SEQ ID NO: 3994035 - DNA, 15 bp, Homo sapiens
ctcttatctcagtca

SEQ ID NO: 3994036 - DNA, 21 bp, Homo sapiens
ctcttatctcagtcatgcata

SEQ ID NO: 3994037 - DNA, 23 bp, Homo sapiens
ctcttatctcagtcatgcataaa

SEQ ID NO: 3994038 - DNA, 14 bp, Homo sapiens
ctcttcaatctctt

SEQ ID NO: 3994039 - DNA, 16 bp, Homo sapiens
ctcttcacaccattca

SEQ ID NO: 3994040 - DNA, 15 bp, Homo sapiens
ctcttcaccaggtgc

SEQ ID NO: 3994041 - DNA, 15 bp, Homo sapiens
ctcttcaggcctccc

SEQ ID NO: 3994042 - DNA, 16 bp, Homo sapiens
ctcttcaggcctccct

SEQ ID NO: 3994043 - DNA, 18 bp, Homo sapiens
ctcttcaggcctccctct

SEQ ID NO: 3994044 - DNA, 22 bp, Homo sapiens
ctcttcaggttcttagtgtcac

SEQ ID NO: 3994045 - DNA, 14 bp, Homo sapiens
ctcttccaggcagc

SEQ ID NO: 3994046 - DNA, 13 bp, Homo sapiens
ctcttcccatgac

SEQ ID NO: 3994047 - DNA, 21 bp, Homo sapiens
ctcttccccagaaaggagact

SEQ ID NO: 3994048 - DNA, 22 bp, Homo sapiens
ctcttccccttagaaacactgc

SEQ ID NO: 3994049 - DNA, 15 bp, Homo sapiens
ctcttccccttccct

SEQ ID NO: 3994050 - DNA, 16 bp, Homo sapiens
ctcttccccttccctt

SEQ ID NO: 3994051 - DNA, 22 bp, Homo sapiens
ctcttccccttcctgtttcaga

SEQ ID NO: 3994052 - DNA, 19 bp, Homo sapiens
ctcttccggagatgtagca

SEQ ID NO: 3994053 - DNA, 23 bp, Homo sapiens
ctcttccggagatgtagcaaaac

SEQ ID NO: 3994054 - DNA, 19 bp, Homo sapiens
ctcttcctacccaaccact

SEQ ID NO: 3994055 - DNA, 20 bp, Homo sapiens
ctcttcctacccaaccactc

SEQ ID NO: 3994056 - DNA, 14 bp, Homo sapiens
ctcttcgcctttcc

SEQ ID NO: 3994057 - DNA, 16 bp, Homo sapiens
ctcttcgcctttccca

SEQ ID NO: 3994058 - DNA, 12 bp, Homo sapiens
ctcttctccact

SEQ ID NO: 3994059 - DNA, 14 bp, Homo sapiens
ctcttctccactgg

SEQ ID NO: 3994060 - DNA, 14 bp, Homo sapiens
ctcttctccccttc

SEQ ID NO: 3994061 - DNA, 21 bp, Homo sapiens
ctcttctccccttccatttct

SEQ ID NO: 3994062 - DNA, 13 bp, Homo sapiens
ctcttctcctttc

SEQ ID NO: 3994063 - DNA, 16 bp, Homo sapiens
ctcttctcggctcagg

SEQ ID NO: 3994064 - DNA, 14 bp, Homo sapiens
ctcttctctctgct

SEQ ID NO: 3994065 - DNA, 12 bp, Homo sapiens
ctcttctgctcc

SEQ ID NO: 3994066 - DNA, 16 bp, Homo sapiens
ctcttctgctccaccc

SEQ ID NO: 3994067 - DNA, 21 bp, Homo sapiens
ctcttctgctccacccttggc

SEQ ID NO: 3994068 - DNA, 12 bp, Homo sapiens
ctcttctgctct

SEQ ID NO: 3994069 - DNA, 19 bp, Homo sapiens
ctcttctggggcaggctgg

SEQ ID NO: 3994070 - DNA, 15 bp, Homo sapiens
ctcttcttcttcaga

SEQ ID NO: 3994071 - DNA, 18 bp, Homo sapiens
ctcttcttcttcagaaga

SEQ ID NO: 3994072 - DNA, 19 bp, Homo sapiens
ctcttctttaagccataga

SEQ ID NO: 3994073 - DNA, 13 bp, Homo sapiens
ctcttgaagtact

SEQ ID NO: 3994074 - DNA, 15 bp, Homo sapiens
ctcttgagcagtggc

SEQ ID NO: 3994075 - DNA, 16 bp, Homo sapiens
ctcttgaggccaggag

SEQ ID NO: 3994076 - DNA, 15 bp, Homo sapiens
ctcttgagggagctt

SEQ ID NO: 3994077 - DNA, 21 bp, Homo sapiens
ctcttgatacccccctctgtc

SEQ ID NO: 3994078 - DNA, 23 bp, Homo sapiens
ctcttgatctctcttgtcctctt

SEQ ID NO: 3994079 - DNA, 20 bp, Homo sapiens
ctgaggcggaggctgtgctc

SEQ ID NO: 3994080 - DNA, 11 bp, Homo sapiens
ctgaggctggc

SEQ ID NO: 3994081 - DNA, 17 bp, Homo sapiens
ctgaggctggcacagga

SEQ ID NO: 3994082 - DNA, 18 bp, Homo sapiens
ctgaggctggcacaggac

SEQ ID NO: 3994083 - DNA, 20 bp, Homo sapiens
ctgaggctggcacaggacat

SEQ ID NO: 3994084 - DNA, 15 bp, Homo sapiens
ctgaggcttagagag

SEQ ID NO: 3994085 - DNA, 18 bp, Homo sapiens
ctgaggcttagagagagg

SEQ ID NO: 3994086 - DNA, 23 bp, Homo sapiens
ctgaggcttagagagaggaggca

SEQ ID NO: 3994087 - DNA, 18 bp, Homo sapiens
ctgaggctttggatttga

SEQ ID NO: 3994088 - DNA, 21 bp, Homo sapiens
ctgagggacatatcagtgacc

SEQ ID NO: 3994089 - DNA, 16 bp, Homo sapiens
ctgagggaccaactgg

SEQ ID NO: 3994090 - DNA, 19 bp, Homo sapiens
ctgagggaccaactgggcc

SEQ ID NO: 3994091 - DNA, 22 bp, Homo sapiens
ctgagggactctgaagcctctg

SEQ ID NO: 3994092 - DNA, 22 bp, Homo sapiens
ctgagggattgaggggccctgg

SEQ ID NO: 3994093 - DNA, 23 bp, Homo sapiens
ctgagggattgaggggccctggc

SEQ ID NO: 3994094 - DNA, 23 bp, Homo sapiens
ctgagggcagaaaggttctgccc

SEQ ID NO: 3994095 - DNA, 15 bp, Homo sapiens
ctgagggccacacta

SEQ ID NO: 3994096 - DNA, 16 bp, Homo sapiens
ctgagggccacactat

SEQ ID NO: 3994097 - DNA, 15 bp, Homo sapiens
ctgagggcctgctgg

SEQ ID NO: 3994098 - DNA, 16 bp, Homo sapiens
ctgagggcctgctgga

SEQ ID NO: 3994099 - DNA, 18 bp, Homo sapiens
ctgagggctgccagcagc

SEQ ID NO: 3994100 - DNA, 21 bp, Homo sapiens
ctgagggctgccagcagcccc

SEQ ID NO: 3994101 - DNA, 19 bp, Homo sapiens
ctgaggggcaacgaagaaa

SEQ ID NO: 3994102 - DNA, 21 bp, Homo sapiens
ctgaggggcaacgaagaaaaa

SEQ ID NO: 3994103 - DNA, 18 bp, Homo sapiens
ctgaggggcatctgcccc

SEQ ID NO: 3994104 - DNA, 13 bp, Homo sapiens
ctgagggggagcc

SEQ ID NO: 3994105 - DNA, 20 bp, Homo sapiens
ctgaggggggccgtgcccag

SEQ ID NO: 3994106 - DNA, 22 bp, Homo sapiens
ctgaggggggccgtgcccaggg

SEQ ID NO: 3994107 - DNA, 15 bp, Homo sapiens
ctgagggtccccacc

SEQ ID NO: 3994108 - DNA, 18 bp, Homo sapiens
ctgagggtccccacctgg

SEQ ID NO: 3994109 - DNA, 18 bp, Homo sapiens
ctgagggtctgggcggcg

SEQ ID NO: 3994110 - DNA, 19 bp, Homo sapiens
ctgagggtggagactaagc

SEQ ID NO: 3994111 - DNA, 20 bp, Homo sapiens
ctgagggtggagactaagcc

SEQ ID NO: 3994112 - DNA, 20 bp, Homo sapiens
ctgaggtccttatgtcctgt

SEQ ID NO: 3994113 - DNA, 21 bp, Homo sapiens
ctgaggtccttatgtcctgtc

SEQ ID NO: 3994114 - DNA, 19 bp, Homo sapiens
ctgaggtctcttgagggag

SEQ ID NO: 3994115 - DNA, 17 bp, Homo sapiens
ctgaggtgcctgtccca

SEQ ID NO: 3994116 - DNA, 15 bp, Homo sapiens
ctgaggtgtctggcc

SEQ ID NO: 3994117 - DNA, 17 bp, Homo sapiens
ctgaggtgtctggcctg

SEQ ID NO: 3994118 - DNA, 18 bp, Homo sapiens
ctgaggtgtctggcctga

SEQ ID NO: 3994119 - DNA, 16 bp, Homo sapiens
ctgaggttcctctgcc

SEQ ID NO: 3994120 - DNA, 21 bp, Homo sapiens
ctgaggttgggagaggtgcac

SEQ ID NO: 3994121 - DNA, 21 bp, Homo sapiens
ctgagtaccaggggctgggct

SEQ ID NO: 3994122 - DNA, 20 bp, Homo sapiens
ctgagtagctgggattacag

SEQ ID NO: 3994123 - DNA, 15 bp, Homo sapiens
ctgagtcacgctggg

SEQ ID NO: 3994124 - DNA, 17 bp, Homo sapiens
ctgagtcatctgttagg

SEQ ID NO: 3994125 - DNA, 21 bp, Homo sapiens
ctgagtcatctgttagggcct

SEQ ID NO: 3994126 - DNA, 15 bp, Homo sapiens
ctgagtccagagctt

SEQ ID NO: 3994127 - DNA, 16 bp, Homo sapiens
ctgagtccagagcttg

SEQ ID NO: 3994128 - DNA, 19 bp, Homo sapiens
ctgagtcccctccaggaag

SEQ ID NO: 3994129 - DNA, 13 bp, Homo sapiens
ctgagtgaacctg

SEQ ID NO: 3994130 - DNA, 18 bp, Homo sapiens
ctgagtgaacctgtataa

SEQ ID NO: 3994131 - DNA, 15 bp, Homo sapiens
ctgagtgagccacag

SEQ ID NO: 3994132 - DNA, 22 bp, Homo sapiens
ctgagtgcgggctgaggccaga

SEQ ID NO: 3994133 - DNA, 17 bp, Homo sapiens
ctgagtggccagccagt

SEQ ID NO: 3994134 - DNA, 15 bp, Homo sapiens
ctgagttatgatgta

SEQ ID NO: 3994135 - DNA, 13 bp, Homo sapiens
ctgagttggcctg

SEQ ID NO: 3994136 - DNA, 14 bp, Homo sapiens
ctgagttggcctgg

SEQ ID NO: 3994137 - DNA, 23 bp, Homo sapiens
ctgagttggcctggccatttcca

SEQ ID NO: 3994138 - DNA, 17 bp, Homo sapiens
ctgagtttaccatttgt

SEQ ID NO: 3994139 - DNA, 23 bp, Homo sapiens
ctgagtttaccatttgtaataaa

SEQ ID NO: 3994140 - DNA, 11 bp, Homo sapiens
ctgagtttcct

SEQ ID NO: 3994141 - DNA, 19 bp, Homo sapiens
ctgagtttcctatgggaac

SEQ ID NO: 3994142 - DNA, 15 bp, Homo sapiens
ctgagttttgttttg

SEQ ID NO: 3994143 - DNA, 14 bp, Homo sapiens
ctgataaagaaaga

SEQ ID NO: 3994144 - DNA, 20 bp, Homo sapiens
ctgataacttggggaggcaa

SEQ ID NO: 3994145 - DNA, 12 bp, Homo sapiens
ctgatacctcaa

SEQ ID NO: 3994146 - DNA, 16 bp, Homo sapiens
ctgatataaattctgt

SEQ ID NO: 3994147 - DNA, 13 bp, Homo sapiens
ctgatattaatca

SEQ ID NO: 3994148 - DNA, 16 bp, Homo sapiens
ctgatattaatcaaaa

SEQ ID NO: 3994149 - DNA, 18 bp, Homo sapiens
ctgatattccatgaatgt

SEQ ID NO: 3994150 - DNA, 19 bp, Homo sapiens
ctgatattgccgcactagg

SEQ ID NO: 3994151 - DNA, 21 bp, Homo sapiens
ctgatcacccaatgcatcacg

SEQ ID NO: 3994152 - DNA, 19 bp, Homo sapiens
ctgatcagaggtgtacact

SEQ ID NO: 3994153 - DNA, 20 bp, Homo sapiens
ctgatcagaggtgtacacta

SEQ ID NO: 3994154 - DNA, 12 bp, Homo sapiens
ctgatcatgcat

SEQ ID NO: 3994155 - DNA, 14 bp, Homo sapiens
ctgatcatgcattg

SEQ ID NO: 3994156 - DNA, 18 bp, Homo sapiens
ctgatccccatgcctagc

SEQ ID NO: 3994157 - DNA, 12 bp, Homo sapiens
ctgatcctggag

SEQ ID NO: 3994158 - DNA, 15 bp, Homo sapiens
ctgatcctggaggcc

SEQ ID NO: 3994159 - DNA, 17 bp, Homo sapiens
ctgatcctggaggccca

SEQ ID NO: 3994160 - DNA, 18 bp, Homo sapiens
ctgatcctggaggcccag

SEQ ID NO: 3994161 - DNA, 19 bp, Homo sapiens
ctgatcctggaggcccagt

SEQ ID NO: 3994162 - DNA, 20 bp, Homo sapiens
ctgatcgccaacctttcccc

SEQ ID NO: 3994163 - DNA, 19 bp, Homo sapiens
ctgatcgtgctaaattttc

SEQ ID NO: 3994164 - DNA, 21 bp, Homo sapiens
ctgatctctactaccacaagg

SEQ ID NO: 3994165 - DNA, 14 bp, Homo sapiens
ctgatcttgcctgt

SEQ ID NO: 3994166 - DNA, 16 bp, Homo sapiens
ctgatcttgcctgtct

SEQ ID NO: 3994167 - DNA, 16 bp, Homo sapiens
ctgatgaaatctgcta

SEQ ID NO: 3994168 - DNA, 21 bp, Homo sapiens
ctgatgacacccaccctgtgc

SEQ ID NO: 3994169 - DNA, 23 bp, Homo sapiens
ctgatgacacccaccctgtgcca

SEQ ID NO: 3994170 - DNA, 15 bp, Homo sapiens
ctgatgacagagcga

SEQ ID NO: 3994171 - DNA, 17 bp, Homo sapiens
ctgatgacagagcgaga

SEQ ID NO: 3994172 - DNA, 21 bp, Homo sapiens
ctgatgacccccccagcttca

SEQ ID NO: 3994173 - DNA, 14 bp, Homo sapiens
ctgatgatccagaa

SEQ ID NO: 3994174 - DNA, 19 bp, Homo sapiens
ctgatgattttcctttttc

SEQ ID NO: 3994175 - DNA, 17 bp, Homo sapiens
ctgatgctccctcccct

SEQ ID NO: 3994176 - DNA, 18 bp, Homo sapiens
ctgatgctccctcccctg

SEQ ID NO: 3994177 - DNA, 19 bp, Homo sapiens
ctgatgctccctcccctgc

SEQ ID NO: 3994178 - DNA, 23 bp, Homo sapiens
ctgatgctgagattcttcaggct

SEQ ID NO: 3994179 - DNA, 16 bp, Homo sapiens
ctgatgctgttctctt

SEQ ID NO: 3994180 - DNA, 17 bp, Homo sapiens
ctgatgctttgcttcaa

SEQ ID NO: 3994181 - DNA, 15 bp, Homo sapiens
ctgcctcgaaacaca

SEQ ID NO: 3994182 - DNA, 17 bp, Homo sapiens
ctgcctcgctcaccgct

SEQ ID NO: 3994183 - DNA, 23 bp, Homo sapiens
ctgcctcgctcaccgctggccct

SEQ ID NO: 3994184 - DNA, 19 bp, Homo sapiens
ctgcctctaatctgagctg

SEQ ID NO: 3994185 - DNA, 22 bp, Homo sapiens
ctgcctctcccatcacttccct

SEQ ID NO: 3994186 - DNA, 12 bp, Homo sapiens
ctgcctctctgg

SEQ ID NO: 3994187 - DNA, 14 bp, Homo sapiens
ctgcctctttccct

SEQ ID NO: 3994188 - DNA, 18 bp, Homo sapiens
ctgcctctttccctagga

SEQ ID NO: 3994189 - DNA, 19 bp, Homo sapiens
ctgcctgaaacagccatgt

SEQ ID NO: 3994190 - DNA, 16 bp, Homo sapiens
ctgcctgacactgagc

SEQ ID NO: 3994191 - DNA, 14 bp, Homo sapiens
ctgcctgagggcag

SEQ ID NO: 3994192 - DNA, 23 bp, Homo sapiens
ctgcctgaggggcagcctgcctt

SEQ ID NO: 3994193 - DNA, 15 bp, Homo sapiens
ctgcctgcagcaggc

SEQ ID NO: 3994194 - DNA, 16 bp, Homo sapiens
ctgcctgccagctgca

SEQ ID NO: 3994195 - DNA, 17 bp, Homo sapiens
ctgcctgccccacacgg

SEQ ID NO: 3994196 - DNA, 14 bp, Homo sapiens
ctgcctgccccgcc

SEQ ID NO: 3994197 - DNA, 17 bp, Homo sapiens
ctgcctgccctttgtcc

SEQ ID NO: 3994198 - DNA, 23 bp, Homo sapiens
ctgcctgccctttgtcctcctgc

SEQ ID NO: 3994199 - DNA, 12 bp, Homo sapiens
ctgcctgctttg

SEQ ID NO: 3994200 - DNA, 13 bp, Homo sapiens
ctgcctggagagg

SEQ ID NO: 3994201 - DNA, 14 bp, Homo sapiens
ctgcctggagaggg

SEQ ID NO: 3994202 - DNA, 23 bp, Homo sapiens
ctgcctggagagggtctcgctgt

SEQ ID NO: 3994203 - DNA, 12 bp, Homo sapiens
ctgcctggcccc

SEQ ID NO: 3994204 - DNA, 15 bp, Homo sapiens
ctgcctggcccccaa

SEQ ID NO: 3994205 - DNA, 22 bp, Homo sapiens
ctgcctggcccccaacctcagg

SEQ ID NO: 3994206 - DNA, 23 bp, Homo sapiens
ctgcctggcccccaacctcaggg

SEQ ID NO: 3994207 - DNA, 12 bp, Homo sapiens
ctgcctggtggt

SEQ ID NO: 3994208 - DNA, 20 bp, Homo sapiens
ctgcctggtggtcagatgca

SEQ ID NO: 3994209 - DNA, 22 bp, Homo sapiens
ctgcctggtggtcagatgcagg

SEQ ID NO: 3994210 - DNA, 19 bp, Homo sapiens
ctgcctgtaacttgagagt

SEQ ID NO: 3994211 - DNA, 16 bp, Homo sapiens
ctgcctgtagcagtga

SEQ ID NO: 3994212 - DNA, 11 bp, Homo sapiens
ctgcctgtctg

SEQ ID NO: 3994213 - DNA, 14 bp, Homo sapiens
ctgcctgtctgccc

SEQ ID NO: 3994214 - DNA, 15 bp, Homo sapiens
ctgcctgtctgcccc

SEQ ID NO: 3994215 - DNA, 18 bp, Homo sapiens
ctgcctgtctgccccagc

SEQ ID NO: 3994216 - DNA, 22 bp, Homo sapiens
ctgccttaaaaccaaagagggc

SEQ ID NO: 3994217 - DNA, 17 bp, Homo sapiens
ctgccttaggcctacct

SEQ ID NO: 3994218 - DNA, 11 bp, Homo sapiens
ctgccttccct

SEQ ID NO: 3994219 - DNA, 15 bp, Homo sapiens
ctgccttccctagct

SEQ ID NO: 3994220 - DNA, 13 bp, Homo sapiens
ctgccttcgttaa

SEQ ID NO: 3994221 - DNA, 20 bp, Homo sapiens
ctgccttcgttaactgtgta

SEQ ID NO: 3994222 - DNA, 17 bp, Homo sapiens
ctgccttctttccatca

SEQ ID NO: 3994223 - DNA, 21 bp, Homo sapiens
ctgccttgagctaaccccaag

SEQ ID NO: 3994224 - DNA, 20 bp, Homo sapiens
ctgccttgcccactcctgct

SEQ ID NO: 3994225 - DNA, 12 bp, Homo sapiens
ctgccttgctcc

SEQ ID NO: 3994226 - DNA, 14 bp, Homo sapiens
ctgccttggcctcc

SEQ ID NO: 3994227 - DNA, 19 bp, Homo sapiens
ctgccttggcctcccaaag

SEQ ID NO: 3994228 - DNA, 14 bp, Homo sapiens
ctgccttggctcag

SEQ ID NO: 3994229 - DNA, 22 bp, Homo sapiens
ctgccttgggccttgctgctgc

SEQ ID NO: 3994230 - DNA, 24 bp, Homo sapiens
ctgccttgggccttgctgctgctg

SEQ ID NO: 3994231 - DNA, 14 bp, Homo sapiens
ctgccttgtgtaca

SEQ ID NO: 3994232 - DNA, 17 bp, Homo sapiens
ctgcctttgacatttaa

SEQ ID NO: 3994233 - DNA, 18 bp, Homo sapiens
ctgcctttgatgttacag

SEQ ID NO: 3994234 - DNA, 21 bp, Homo sapiens
ctgcgaagaccctcttgccca

SEQ ID NO: 3994235 - DNA, 22 bp, Homo sapiens
ctgcgaagaccctcttgcccat

SEQ ID NO: 3994236 - DNA, 22 bp, Homo sapiens
ctgcgaccttgcaacctcacct

SEQ ID NO: 3994237 - DNA, 22 bp, Homo sapiens
ctgcgagacgcacacagctgag

SEQ ID NO: 3994238 - DNA, 15 bp, Homo sapiens
ctgcgcaccaatgcc

SEQ ID NO: 3994239 - DNA, 18 bp, Homo sapiens
ctgcgcccttaccttccc

SEQ ID NO: 3994240 - DNA, 15 bp, Homo sapiens
ctgcgcctccagagg

SEQ ID NO: 3994241 - DNA, 17 bp, Homo sapiens
ctgcgcctgcaggcaga

SEQ ID NO: 3994242 - DNA, 18 bp, Homo sapiens
ctgcgcctgcaggcagag

SEQ ID NO: 3994243 - DNA, 23 bp, Homo sapiens
ctgcgcctgcaggcagagctgga

SEQ ID NO: 3994244 - DNA, 15 bp, Homo sapiens
ctgcgcctgctgcct

SEQ ID NO: 3994245 - DNA, 12 bp, Homo sapiens
ctgcgccttggg

SEQ ID NO: 3994246 - DNA, 20 bp, Homo sapiens
ctgcgctggacgatagcttg

SEQ ID NO: 3994247 - DNA, 13 bp, Homo sapiens
ctgcgcttgcttt

SEQ ID NO: 3994248 - DNA, 19 bp, Homo sapiens
ctgcggcagacgggagggg

SEQ ID NO: 3994249 - DNA, 16 bp, Homo sapiens
ctgcggggcagggcct

SEQ ID NO: 3994250 - DNA, 22 bp, Homo sapiens
ctgcgggtgaacaaagcagcca

SEQ ID NO: 3994251 - DNA, 14 bp, Homo sapiens
ctgcggtcaggctg

SEQ ID NO: 3994252 - DNA, 17 bp, Homo sapiens
ctgcgtcctcctcacct

SEQ ID NO: 3994253 - DNA, 18 bp, Homo sapiens
ctgcgtcctcctcacctc

SEQ ID NO: 3994254 - DNA, 19 bp, Homo sapiens
ctgcgttggtccagagcgg

SEQ ID NO: 3994255 - DNA, 21 bp, Homo sapiens
ctgcgttttcctagctgtgtt

SEQ ID NO: 3994256 - DNA, 16 bp, Homo sapiens
ctgctaaggctcctcc

SEQ ID NO: 3994257 - DNA, 17 bp, Homo sapiens
ctgctaaggctcctcct

SEQ ID NO: 3994258 - DNA, 19 bp, Homo sapiens
ctgctaaggctcctccttg

SEQ ID NO: 3994259 - DNA, 14 bp, Homo sapiens
ctgctaagtagggg

SEQ ID NO: 3994260 - DNA, 16 bp, Homo sapiens
ctgctacacatacagg

SEQ ID NO: 3994261 - DNA, 12 bp, Homo sapiens
ctgctacaggag

SEQ ID NO: 3994262 - DNA, 13 bp, Homo sapiens
ctgctacaggagg

SEQ ID NO: 3994263 - DNA, 21 bp, Homo sapiens
ctgctaccgccctgggctgga

SEQ ID NO: 3994264 - DNA, 18 bp, Homo sapiens
ctgctacctcccttgcct

SEQ ID NO: 3994265 - DNA, 21 bp, Homo sapiens
ctgctacgttcctattgtcat

SEQ ID NO: 3994266 - DNA, 13 bp, Homo sapiens
ctgctagaaagtt

SEQ ID NO: 3994267 - DNA, 16 bp, Homo sapiens
ctgctagcaaatggca

SEQ ID NO: 3994268 - DNA, 18 bp, Homo sapiens
ctgctaggcgagtgccag

SEQ ID NO: 3994269 - DNA, 16 bp, Homo sapiens
ctgctaggcgctgggg

SEQ ID NO: 3994270 - DNA, 20 bp, Homo sapiens
ctgctatccccatctccctg

SEQ ID NO: 3994271 - DNA, 21 bp, Homo sapiens
ctgctcaccacctgcctctaa

SEQ ID NO: 3994272 - DNA, 15 bp, Homo sapiens
ctgctcaccgcccat

SEQ ID NO: 3994273 - DNA, 23 bp, Homo sapiens
ctgctcaccgcccatcagggttc

SEQ ID NO: 3994274 - DNA, 23 bp, Homo sapiens
ctgctccaacccccgccacctca

SEQ ID NO: 3994275 - DNA, 13 bp, Homo sapiens
ctgctccaccagc

SEQ ID NO: 3994276 - DNA, 17 bp, Homo sapiens
ctgctccaccagcagca

SEQ ID NO: 3994277 - DNA, 11 bp, Homo sapiens
ctgctccaccc

SEQ ID NO: 3994278 - DNA, 15 bp, Homo sapiens
ctgctccacccttgg

SEQ ID NO: 3994279 - DNA, 19 bp, Homo sapiens
ctgctccacccttggcctg

SEQ ID NO: 3994280 - DNA, 20 bp, Homo sapiens
ctgctccacccttggcctgt

SEQ ID NO: 3994281 - DNA, 16 bp, Homo sapiens
ctgctccacgaagcct

SEQ ID NO: 3994282 - DNA, 18 bp, Homo sapiens
ctgctccacgaagcctta

SEQ ID NO: 3994283 - DNA, 20 bp, Homo sapiens
ctgctccagaagatgccagc

SEQ ID NO: 3994284 - DNA, 20 bp, Homo sapiens
ctggaggaggcctgtcccaa

SEQ ID NO: 3994285 - DNA, 14 bp, Homo sapiens
ctggaggcccaggc

SEQ ID NO: 3994286 - DNA, 17 bp, Homo sapiens
ctggaggcccaggctgg

SEQ ID NO: 3994287 - DNA, 19 bp, Homo sapiens
ctggaggcccaggctggga

SEQ ID NO: 3994288 - DNA, 21 bp, Homo sapiens
ctggaggcccagttcaccctg

SEQ ID NO: 3994289 - DNA, 14 bp, Homo sapiens
ctggaggcccctgg

SEQ ID NO: 3994290 - DNA, 15 bp, Homo sapiens
ctggaggcctcaggt

SEQ ID NO: 3994291 - DNA, 16 bp, Homo sapiens
ctggaggccttccagc

SEQ ID NO: 3994292 - DNA, 19 bp, Homo sapiens
ctggaggccttccagctgc

SEQ ID NO: 3994293 - DNA, 13 bp, Homo sapiens
ctggagggacttt

SEQ ID NO: 3994294 - DNA, 20 bp, Homo sapiens
ctggaggggtgtggctcctt

SEQ ID NO: 3994295 - DNA, 21 bp, Homo sapiens
ctggaggtcacattcaggaag

SEQ ID NO: 3994296 - DNA, 21 bp, Homo sapiens
ctggaggtgggcatgccaccc

SEQ ID NO: 3994297 - DNA, 22 bp, Homo sapiens
ctggaggtgggcatgccaccct

SEQ ID NO: 3994298 - DNA, 16 bp, Homo sapiens
ctggaggtggggcgag

SEQ ID NO: 3994299 - DNA, 20 bp, Homo sapiens
ctggaggtggggcgaggcag

SEQ ID NO: 3994300 - DNA, 17 bp, Homo sapiens
ctggaggttgaagccaa

SEQ ID NO: 3994301 - DNA, 16 bp, Homo sapiens
ctggagtcagatgagc

SEQ ID NO: 3994302 - DNA, 16 bp, Homo sapiens
ctggagtgagcactca

SEQ ID NO: 3994303 - DNA, 16 bp, Homo sapiens
ctggagtgcagggagg

SEQ ID NO: 3994304 - DNA, 19 bp, Homo sapiens
ctggagtgcccaccctggg

SEQ ID NO: 3994305 - DNA, 20 bp, Homo sapiens
ctggagttccttatccctct

SEQ ID NO: 3994306 - DNA, 24 bp, Homo sapiens
ctggagttccttatccctctcttc

SEQ ID NO: 3994307 - DNA, 15 bp, Homo sapiens
ctggagttgatctgg

SEQ ID NO: 3994308 - DNA, 18 bp, Homo sapiens
ctggagtttcatgtacaa

SEQ ID NO: 3994309 - DNA, 15 bp, Homo sapiens
ctggataggagcctg

SEQ ID NO: 3994310 - DNA, 16 bp, Homo sapiens
ctggatcacagctgct

SEQ ID NO: 3994311 - DNA, 21 bp, Homo sapiens
ctggatcacgacgctgcagag

SEQ ID NO: 3994312 - DNA, 13 bp, Homo sapiens
ctggatcagtcct

SEQ ID NO: 3994313 - DNA, 23 bp, Homo sapiens
ctggatccctgcccttctcaaga

SEQ ID NO: 3994314 - DNA, 16 bp, Homo sapiens
ctggatgatggattcc

SEQ ID NO: 3994315 - DNA, 21 bp, Homo sapiens
ctggatggaaagacaaactgc

SEQ ID NO: 3994316 - DNA, 19 bp, Homo sapiens
ctggattctgggaggcaag

SEQ ID NO: 3994317 - DNA, 22 bp, Homo sapiens
ctggattgatcggagcctcctc

SEQ ID NO: 3994318 - DNA, 23 bp, Homo sapiens
ctggattggttggcaaactaaag

SEQ ID NO: 3994319 - DNA, 22 bp, Homo sapiens
ctggcaaacatgaaaaatcggc

SEQ ID NO: 3994320 - DNA, 22 bp, Homo sapiens
ctggcaaaggacccttgagtaa

SEQ ID NO: 3994321 - DNA, 18 bp, Homo sapiens
ctggcaaaggtggctctc

SEQ ID NO: 3994322 - DNA, 21 bp, Homo sapiens
ctggcaaaggtggctctccag

SEQ ID NO: 3994323 - DNA, 15 bp, Homo sapiens
ctggcaacacagagg

SEQ ID NO: 3994324 - DNA, 16 bp, Homo sapiens
ctggcaacacagaggc

SEQ ID NO: 3994325 - DNA, 22 bp, Homo sapiens
ctggcaatgaaaaattctcagt

SEQ ID NO: 3994326 - DNA, 18 bp, Homo sapiens
ctggcaattgtctattta

SEQ ID NO: 3994327 - DNA, 16 bp, Homo sapiens
ctggcacagggcagtg

SEQ ID NO: 3994328 - DNA, 16 bp, Homo sapiens
ctggcactataatgta

SEQ ID NO: 3994329 - DNA, 19 bp, Homo sapiens
ctggcactgaattaatcat

SEQ ID NO: 3994330 - DNA, 21 bp, Homo sapiens
ctggcactggatgcagaaaca

SEQ ID NO: 3994331 - DNA, 19 bp, Homo sapiens
ctggcagccgtgccttcag

SEQ ID NO: 3994332 - DNA, 20 bp, Homo sapiens
ctggcagccgtgccttcagc

SEQ ID NO: 3994333 - DNA, 15 bp, Homo sapiens
ctggcagcctcccat

SEQ ID NO: 3994334 - DNA, 12 bp, Homo sapiens
ctggcaggaggg

SEQ ID NO: 3994335 - DNA, 14 bp, Homo sapiens
ctggcaggagggtg

SEQ ID NO: 3994336 - DNA, 11 bp, Homo sapiens
ctggcaggcag

SEQ ID NO: 3994337 - DNA, 16 bp, Homo sapiens
ctggcaggccagtgtc

SEQ ID NO: 3994338 - DNA, 17 bp, Homo sapiens
ctggcaggccagtgtct

SEQ ID NO: 3994339 - DNA, 23 bp, Homo sapiens
ctggcagggctggccccagggca

SEQ ID NO: 3994340 - DNA, 21 bp, Homo sapiens
ctggcaggggagacaggagcc

SEQ ID NO: 3994341 - DNA, 23 bp, Homo sapiens
ctggcatcaagaggtgggagggc

SEQ ID NO: 3994342 - DNA, 18 bp, Homo sapiens
ctggcatcttagacctcc

SEQ ID NO: 3994343 - DNA, 19 bp, Homo sapiens
ctggcattagaattattta

SEQ ID NO: 3994344 - DNA, 16 bp, Homo sapiens
ctggccaaatagcaaa

SEQ ID NO: 3994345 - DNA, 23 bp, Homo sapiens
ctggccaacatcgtgaaaccctg

SEQ ID NO: 3994346 - DNA, 14 bp, Homo sapiens
ctggccaccagcca

SEQ ID NO: 3994347 - DNA, 16 bp, Homo sapiens
ctggccacctctctcc

SEQ ID NO: 3994348 - DNA, 19 bp, Homo sapiens
ctggccactaaagcttcag

SEQ ID NO: 3994349 - DNA, 21 bp, Homo sapiens
ctggccactaaagcttcagac

SEQ ID NO: 3994350 - DNA, 22 bp, Homo sapiens
ctggccactaaagcttcagact

SEQ ID NO: 3994351 - DNA, 13 bp, Homo sapiens
ctggccagacaca

SEQ ID NO: 3994352 - DNA, 21 bp, Homo sapiens
ctggccagacacaggccctcc

SEQ ID NO: 3994353 - DNA, 13 bp, Homo sapiens
ctggccagacgct

SEQ ID NO: 3994354 - DNA, 14 bp, Homo sapiens
ctggccagacgctg

SEQ ID NO: 3994355 - DNA, 16 bp, Homo sapiens
ctggccagacgctgcc

SEQ ID NO: 3994356 - DNA, 15 bp, Homo sapiens
ctggccagcaaggca

SEQ ID NO: 3994357 - DNA, 19 bp, Homo sapiens
ctggccagcaaggcaggtt

SEQ ID NO: 3994358 - DNA, 13 bp, Homo sapiens
ctggccagcaccc

SEQ ID NO: 3994359 - DNA, 14 bp, Homo sapiens
ctggccagcaccct

SEQ ID NO: 3994360 - DNA, 22 bp, Homo sapiens
ctggccagcaccctctcctggg

SEQ ID NO: 3994361 - DNA, 23 bp, Homo sapiens
ctggccagcaccctctcctgggg

SEQ ID NO: 3994362 - DNA, 12 bp, Homo sapiens
ctggccaggagc

SEQ ID NO: 3994363 - DNA, 15 bp, Homo sapiens
ctggccaggagctct

SEQ ID NO: 3994364 - DNA, 23 bp, Homo sapiens
ctggccaggatggaggggtggtc

SEQ ID NO: 3994365 - DNA, 11 bp, Homo sapiens
ctggccaggca

SEQ ID NO: 3994366 - DNA, 21 bp, Homo sapiens
ctggccaggcagatctgtgcc

SEQ ID NO: 3994367 - DNA, 14 bp, Homo sapiens
ctggccagggccac

SEQ ID NO: 3994368 - DNA, 18 bp, Homo sapiens
ctggccagggccacgctc

SEQ ID NO: 3994369 - DNA, 17 bp, Homo sapiens
ctggccatggggccctc

SEQ ID NO: 3994370 - DNA, 19 bp, Homo sapiens
ctggccatggggccctccc

SEQ ID NO: 3994371 - DNA, 21 bp, Homo sapiens
ctggccatggggccctcccag

SEQ ID NO: 3994372 - DNA, 21 bp, Homo sapiens
ctggcccatctcagcctcctg

SEQ ID NO: 3994373 - DNA, 13 bp, Homo sapiens
ctggccccagcct

SEQ ID NO: 3994374 - DNA, 14 bp, Homo sapiens
ctggccccagcctg

SEQ ID NO: 3994375 - DNA, 13 bp, Homo sapiens
ctggccccaggac

SEQ ID NO: 3994376 - DNA, 20 bp, Homo sapiens
ctggccccaggacctggctg

SEQ ID NO: 3994377 - DNA, 21 bp, Homo sapiens
ctggccccaggacctggctgc

SEQ ID NO: 3994378 - DNA, 21 bp, Homo sapiens
ctggccccaggccccagacag

SEQ ID NO: 3994379 - DNA, 18 bp, Homo sapiens
ctggccccagggcaccct

SEQ ID NO: 3994380 - DNA, 12 bp, Homo sapiens
ctggcccctggg

SEQ ID NO: 3994381 - DNA, 13 bp, Homo sapiens
ctggccctgcctc

SEQ ID NO: 3994382 - DNA, 17 bp, Homo sapiens
ctggccctgcctcctgg

SEQ ID NO: 3994383 - DNA, 18 bp, Homo sapiens
ctggccctgcctcctggg

SEQ ID NO: 3994384 - DNA, 22 bp, Homo sapiens
ctggccctgcctcctgggaaga

SEQ ID NO: 3994385 - DNA, 16 bp, Homo sapiens
ctggcccttacacact

SEQ ID NO: 3994386 - DNA, 16 bp, Homo sapiens
ctggttactcagggtt

SEQ ID NO: 3994387 - DNA, 21 bp, Homo sapiens
ctggttcccgtttctccacct

SEQ ID NO: 3994388 - DNA, 13 bp, Homo sapiens
ctggttgtcattt

SEQ ID NO: 3994389 - DNA, 14 bp, Homo sapiens
ctggttgtcatttt

SEQ ID NO: 3994390 - DNA, 15 bp, Homo sapiens
ctggttgtcattttt

SEQ ID NO: 3994391 - DNA, 16 bp, Homo sapiens
ctggttgttatgtgat

SEQ ID NO: 3994392 - DNA, 16 bp, Homo sapiens
ctggttgtttctgttc

SEQ ID NO: 3994393 - DNA, 21 bp, Homo sapiens
ctggttgtttctgttccaaat

SEQ ID NO: 3994394 - DNA, 16 bp, Homo sapiens
ctggtttacaggccct

SEQ ID NO: 3994395 - DNA, 22 bp, Homo sapiens
ctggtttatttgttgttttctg

SEQ ID NO: 3994396 - DNA, 23 bp, Homo sapiens
ctggtttcatttctactgtgact

SEQ ID NO: 3994397 - DNA, 13 bp, Homo sapiens
ctggtttcctgcc

SEQ ID NO: 3994398 - DNA, 14 bp, Homo sapiens
ctggtttgactcag

SEQ ID NO: 3994399 - DNA, 13 bp, Homo sapiens
ctggtttgttctg

SEQ ID NO: 3994400 - DNA, 19 bp, Homo sapiens
ctggttttgtacactgctg

SEQ ID NO: 3994401 - DNA, 20 bp, Homo sapiens
ctggttttgtacactgctgt

SEQ ID NO: 3994402 - DNA, 14 bp, Homo sapiens
ctggtttttctcaa

SEQ ID NO: 3994403 - DNA, 16 bp, Homo sapiens
ctgtaaaatgaaatta

SEQ ID NO: 3994404 - DNA, 13 bp, Homo sapiens
ctgtaaactgaat

SEQ ID NO: 3994405 - DNA, 14 bp, Homo sapiens
ctgtaacagttctt

SEQ ID NO: 3994406 - DNA, 15 bp, Homo sapiens
ctgtaacgtgtgctg

SEQ ID NO: 3994407 - DNA, 22 bp, Homo sapiens
ctgtaagaagagactgggaaga

SEQ ID NO: 3994408 - DNA, 16 bp, Homo sapiens
ctgtaagcctgcaagc

SEQ ID NO: 3994409 - DNA, 17 bp, Homo sapiens
ctgtaagcctgcaagcc

SEQ ID NO: 3994410 - DNA, 18 bp, Homo sapiens
ctgtaagcctgcaagcct

SEQ ID NO: 3994411 - DNA, 21 bp, Homo sapiens
ctgtaatacgtagctctctta

SEQ ID NO: 3994412 - DNA, 13 bp, Homo sapiens
ctgtaatcccagc

SEQ ID NO: 3994413 - DNA, 17 bp, Homo sapiens
ctgtaatcccagcactt

SEQ ID NO: 3994414 - DNA, 15 bp, Homo sapiens
ctgtacaaagtagaa

SEQ ID NO: 3994415 - DNA, 20 bp, Homo sapiens
ctgtacagaatttccactgt

SEQ ID NO: 3994416 - DNA, 16 bp, Homo sapiens
ctgtacatatgtaaac

SEQ ID NO: 3994417 - DNA, 16 bp, Homo sapiens
ctgtaccaaatctgac

SEQ ID NO: 3994418 - DNA, 17 bp, Homo sapiens
ctgtaccaaatctgaca

SEQ ID NO: 3994419 - DNA, 18 bp, Homo sapiens
ctgtacccagatgcctac

SEQ ID NO: 3994420 - DNA, 19 bp, Homo sapiens
ctgtacccagatgcctaca

SEQ ID NO: 3994421 - DNA, 13 bp, Homo sapiens
ctgtacctcatcc

SEQ ID NO: 3994422 - DNA, 15 bp, Homo sapiens
ctgtacctcatccca

SEQ ID NO: 3994423 - DNA, 22 bp, Homo sapiens
ctgtactaaagtaacgcaataa

SEQ ID NO: 3994424 - DNA, 16 bp, Homo sapiens
ctgtactcctcccagg

SEQ ID NO: 3994425 - DNA, 16 bp, Homo sapiens
ctgtacttaataaatt

SEQ ID NO: 3994426 - DNA, 22 bp, Homo sapiens
ctgtacttgaagtctaaaagca

SEQ ID NO: 3994427 - DNA, 19 bp, Homo sapiens
ctgtagaaaggggagaatg

SEQ ID NO: 3994428 - DNA, 22 bp, Homo sapiens
ctgtagaaaggggagaatgtca

SEQ ID NO: 3994429 - DNA, 15 bp, Homo sapiens
ctgtagactagtgcc

SEQ ID NO: 3994430 - DNA, 13 bp, Homo sapiens
ctgtagagttgct

SEQ ID NO: 3994431 - DNA, 14 bp, Homo sapiens
ctgtagatgcagaa

SEQ ID NO: 3994432 - DNA, 15 bp, Homo sapiens
ctgtagatgcagaaa

SEQ ID NO: 3994433 - DNA, 16 bp, Homo sapiens
ctgtagatgcagaaaa

SEQ ID NO: 3994434 - DNA, 19 bp, Homo sapiens
ctgtagatgcagaaaaaga

SEQ ID NO: 3994435 - DNA, 19 bp, Homo sapiens
ctgtagattgcttctgtag

SEQ ID NO: 3994436 - DNA, 18 bp, Homo sapiens
ctgtagccacagctgctg

SEQ ID NO: 3994437 - DNA, 18 bp, Homo sapiens
ctgtagggctggacctat

SEQ ID NO: 3994438 - DNA, 20 bp, Homo sapiens
ctgtaggtatgatctcttct

SEQ ID NO: 3994439 - DNA, 23 bp, Homo sapiens
ctgtagtcatttactaaacatat

SEQ ID NO: 3994440 - DNA, 20 bp, Homo sapiens
ctgtagtcctagccactcag

SEQ ID NO: 3994441 - DNA, 18 bp, Homo sapiens
ctgtagtgtagtcaggtg

SEQ ID NO: 3994442 - DNA, 20 bp, Homo sapiens
ctgtagtgtagtcaggtgct

SEQ ID NO: 3994443 - DNA, 22 bp, Homo sapiens
ctgtagtgtagtcaggtgctca

SEQ ID NO: 3994444 - DNA, 21 bp, Homo sapiens
ctgtagtttatggcagaaggg

SEQ ID NO: 3994445 - DNA, 14 bp, Homo sapiens
ctgtataaagcatg

SEQ ID NO: 3994446 - DNA, 16 bp, Homo sapiens
ctgtataaataggaga

SEQ ID NO: 3994447 - DNA, 20 bp, Homo sapiens
ctgtataaataggagaggat

SEQ ID NO: 3994448 - DNA, 21 bp, Homo sapiens
ctgtataaataggagaggatg

SEQ ID NO: 3994449 - DNA, 19 bp, Homo sapiens
ctgtataaatgtctattat

SEQ ID NO: 3994450 - DNA, 21 bp, Homo sapiens
ctgtataaatgtctattatta

SEQ ID NO: 3994451 - DNA, 19 bp, Homo sapiens
ctgtataagcactgaaaaa

SEQ ID NO: 3994452 - DNA, 21 bp, Homo sapiens
ctgtataagtggaggcacttt

SEQ ID NO: 3994453 - DNA, 23 bp, Homo sapiens
ctgtataagttatttttgtacat

SEQ ID NO: 3994454 - DNA, 13 bp, Homo sapiens
ctgtatacagtgc

SEQ ID NO: 3994455 - DNA, 16 bp, Homo sapiens
ctgtatacgtttcaaa

SEQ ID NO: 3994456 - DNA, 22 bp, Homo sapiens
ctgtatatttgtgatagcactt

SEQ ID NO: 3994457 - DNA, 18 bp, Homo sapiens
ctgtatcggagacagtga

SEQ ID NO: 3994458 - DNA, 21 bp, Homo sapiens
ctgtatgaaaaattggggagg

SEQ ID NO: 3994459 - DNA, 12 bp, Homo sapiens
ctgtatgattta

SEQ ID NO: 3994460 - DNA, 23 bp, Homo sapiens
ctgtatgatttgttttgaatttt

SEQ ID NO: 3994461 - DNA, 18 bp, Homo sapiens
ctgtatgggagcttaact

SEQ ID NO: 3994462 - DNA, 17 bp, Homo sapiens
ctgtattgtctgaactt

SEQ ID NO: 3994463 - DNA, 17 bp, Homo sapiens
ctgtatttatgtgtgag

SEQ ID NO: 3994464 - DNA, 18 bp, Homo sapiens
ctgtatttatgtgtgagg

SEQ ID NO: 3994465 - DNA, 21 bp, Homo sapiens
ctgtattttatttagacaaga

SEQ ID NO: 3994466 - DNA, 21 bp, Homo sapiens
ctgtcaagttaacaaggaatg

SEQ ID NO: 3994467 - DNA, 19 bp, Homo sapiens
ctgtcaagttcctttgggt

SEQ ID NO: 3994468 - DNA, 19 bp, Homo sapiens
ctgtcaatttccctgactc

SEQ ID NO: 3994469 - DNA, 13 bp, Homo sapiens
ctgtcacaccagc

SEQ ID NO: 3994470 - DNA, 19 bp, Homo sapiens
ctgtcacattgcattctat

SEQ ID NO: 3994471 - DNA, 14 bp, Homo sapiens
ctgtcaccctccac

SEQ ID NO: 3994472 - DNA, 18 bp, Homo sapiens
ctgtcaccctccacctct

SEQ ID NO: 3994473 - DNA, 16 bp, Homo sapiens
ctgtcactggctggct

SEQ ID NO: 3994474 - DNA, 14 bp, Homo sapiens
ctgtcactgtttct

SEQ ID NO: 3994475 - DNA, 14 bp, Homo sapiens
ctgtcactttgctc

SEQ ID NO: 3994476 - DNA, 21 bp, Homo sapiens
ctgtcagatgggaagacatga

SEQ ID NO: 3994477 - DNA, 22 bp, Homo sapiens
ctgtcagatgggaagacatgaa

SEQ ID NO: 3994478 - DNA, 18 bp, Homo sapiens
ctgtcagcatctggctgt

SEQ ID NO: 3994479 - DNA, 12 bp, Homo sapiens
ctgtcagccagc

SEQ ID NO: 3994480 - DNA, 17 bp, Homo sapiens
ctgtcagccagccgccc

SEQ ID NO: 3994481 - DNA, 21 bp, Homo sapiens
ctgtcagccagccgccctggg

SEQ ID NO: 3994482 - DNA, 12 bp, Homo sapiens
ctgtcaggaggc

SEQ ID NO: 3994483 - DNA, 15 bp, Homo sapiens
ctgtcaggaggcaga

SEQ ID NO: 3994484 - DNA, 18 bp, Homo sapiens
ctgtcagtgttaaagatt

SEQ ID NO: 3994485 - DNA, 19 bp, Homo sapiens
ctgtcataagaatgaataa

SEQ ID NO: 3994486 - DNA, 13 bp, Homo sapiens
ctgtcatctctct

SEQ ID NO: 3994487 - DNA, 14 bp, Homo sapiens
ctgtcatctctctg

SEQ ID NO: 3994488 - DNA, 18 bp, Homo sapiens
cttaaaatggaattgaaa

SEQ ID NO: 3994489 - DNA, 18 bp, Homo sapiens
cttaaaattcaagaaaat

SEQ ID NO: 3994490 - DNA, 21 bp, Homo sapiens
cttaaaattcaagaaaataaa

SEQ ID NO: 3994491 - DNA, 11 bp, Homo sapiens
cttaaacaaag

SEQ ID NO: 3994492 - DNA, 13 bp, Homo sapiens
cttaaacaaagtg

SEQ ID NO: 3994493 - DNA, 16 bp, Homo sapiens
cttaaacaaagtgact

SEQ ID NO: 3994494 - DNA, 16 bp, Homo sapiens
cttaaacacaggctgt

SEQ ID NO: 3994495 - DNA, 20 bp, Homo sapiens
cttaaacataataaatcaca

SEQ ID NO: 3994496 - DNA, 14 bp, Homo sapiens
cttaaactaaataa

SEQ ID NO: 3994497 - DNA, 14 bp, Homo sapiens
cttaaactgtgtgg

SEQ ID NO: 3994498 - DNA, 15 bp, Homo sapiens
cttaaagtttaaagt

SEQ ID NO: 3994499 - DNA, 19 bp, Homo sapiens
cttaaagtttaaagttgca

SEQ ID NO: 3994500 - DNA, 17 bp, Homo sapiens
cttaaagtttcatgtga

SEQ ID NO: 3994501 - DNA, 19 bp, Homo sapiens
cttaaataatgcttcagat

SEQ ID NO: 3994502 - DNA, 20 bp, Homo sapiens
cttaaataatgcttcagata

SEQ ID NO: 3994503 - DNA, 21 bp, Homo sapiens
cttaaatcagaataaattaat

SEQ ID NO: 3994504 - DNA, 21 bp, Homo sapiens
cttaaatgaaagcatgtggca

SEQ ID NO: 3994505 - DNA, 18 bp, Homo sapiens
cttaaatgctcattttct

SEQ ID NO: 3994506 - DNA, 20 bp, Homo sapiens
cttaaatgctcattttctgg

SEQ ID NO: 3994507 - DNA, 16 bp, Homo sapiens
cttaaattatgtttta

SEQ ID NO: 3994508 - DNA, 14 bp, Homo sapiens
cttaaatttcttat

SEQ ID NO: 3994509 - DNA, 15 bp, Homo sapiens
cttaacaaaccaaca

SEQ ID NO: 3994510 - DNA, 20 bp, Homo sapiens
cttaacatacacgttaactg

SEQ ID NO: 3994511 - DNA, 13 bp, Homo sapiens
cttaactaatttg

SEQ ID NO: 3994512 - DNA, 12 bp, Homo sapiens
cttaactacttt

SEQ ID NO: 3994513 - DNA, 12 bp, Homo sapiens
cttaactatgag

SEQ ID NO: 3994514 - DNA, 11 bp, Homo sapiens
cttaactattc

SEQ ID NO: 3994515 - DNA, 11 bp, Homo sapiens
cttaagaaaaa

SEQ ID NO: 3994516 - DNA, 17 bp, Homo sapiens
cttaagcaaaagaaaaa

SEQ ID NO: 3994517 - DNA, 18 bp, Homo sapiens
cttaagcaaaagaaaaag

SEQ ID NO: 3994518 - DNA, 14 bp, Homo sapiens
cttaagcagcatgg

SEQ ID NO: 3994519 - DNA, 12 bp, Homo sapiens
cttaagctgcag

SEQ ID NO: 3994520 - DNA, 15 bp, Homo sapiens
cttaagctgcaggat

SEQ ID NO: 3994521 - DNA, 20 bp, Homo sapiens
cttaagttagcctccaccac

SEQ ID NO: 3994522 - DNA, 15 bp, Homo sapiens
cttaagttctatgaa

SEQ ID NO: 3994523 - DNA, 18 bp, Homo sapiens
cttaataaattcagatat

SEQ ID NO: 3994524 - DNA, 19 bp, Homo sapiens
cttaataactgtgtactgt

SEQ ID NO: 3994525 - DNA, 20 bp, Homo sapiens
cttaataactgtgtactgtt

SEQ ID NO: 3994526 - DNA, 23 bp, Homo sapiens
cttaatagtagttagcttaagta

SEQ ID NO: 3994527 - DNA, 16 bp, Homo sapiens
cttaatagtatttatg

SEQ ID NO: 3994528 - DNA, 22 bp, Homo sapiens
cttaatcaagatttttttcctg

SEQ ID NO: 3994529 - DNA, 18 bp, Homo sapiens
cttaatccagctgatgag

SEQ ID NO: 3994530 - DNA, 23 bp, Homo sapiens
cttaatgacattcccctcccacc

SEQ ID NO: 3994531 - DNA, 20 bp, Homo sapiens
cttaatgtgattactgctct

SEQ ID NO: 3994532 - DNA, 13 bp, Homo sapiens
cttaatgttctta

SEQ ID NO: 3994533 - DNA, 14 bp, Homo sapiens
cttaatgttcttat

SEQ ID NO: 3994534 - DNA, 12 bp, Homo sapiens
cttaatgtttat

SEQ ID NO: 3994535 - DNA, 16 bp, Homo sapiens
cttaatgtttattcct

SEQ ID NO: 3994536 - DNA, 11 bp, Homo sapiens
cttaattatta

SEQ ID NO: 3994537 - DNA, 19 bp, Homo sapiens
cttaattattatttgtgtt

SEQ ID NO: 3994538 - DNA, 13 bp, Homo sapiens
cttaattcaaata

SEQ ID NO: 3994539 - DNA, 13 bp, Homo sapiens
cttaatttccttt

SEQ ID NO: 3994540 - DNA, 20 bp, Homo sapiens
cttaatttcctttttgacac

SEQ ID NO: 3994541 - DNA, 18 bp, Homo sapiens
cttaattttcagtataat

SEQ ID NO: 3994542 - DNA, 21 bp, Homo sapiens
cttacaaagccttacacaggg

SEQ ID NO: 3994543 - DNA, 17 bp, Homo sapiens
cttacaagatattgatg

SEQ ID NO: 3994544 - DNA, 18 bp, Homo sapiens
cttacaagcctaagaatc

SEQ ID NO: 3994545 - DNA, 17 bp, Homo sapiens
cttacaatcgcaaatca

SEQ ID NO: 3994546 - DNA, 16 bp, Homo sapiens
cttacacactcaggcc

SEQ ID NO: 3994547 - DNA, 17 bp, Homo sapiens
cttacacactcaggcct

SEQ ID NO: 3994548 - DNA, 19 bp, Homo sapiens
cttacacatctcagaccct

SEQ ID NO: 3994549 - DNA, 21 bp, Homo sapiens
cttacaggcatggacatgcag

SEQ ID NO: 3994550 - DNA, 22 bp, Homo sapiens
cttacattagcagtttgctttg

SEQ ID NO: 3994551 - DNA, 23 bp, Homo sapiens
cttacattgcctgactaaaatgt

SEQ ID NO: 3994552 - DNA, 13 bp, Homo sapiens
cttacatttgtga

SEQ ID NO: 3994553 - DNA, 14 bp, Homo sapiens
cttacatttttaca

SEQ ID NO: 3994554 - DNA, 17 bp, Homo sapiens
cttacatttttacaata

SEQ ID NO: 3994555 - DNA, 22 bp, Homo sapiens
cttacatttttacaataaataa

SEQ ID NO: 3994556 - DNA, 17 bp, Homo sapiens
cttaccagagacgccca

SEQ ID NO: 3994557 - DNA, 13 bp, Homo sapiens
cttaccaggaagc

SEQ ID NO: 3994558 - DNA, 13 bp, Homo sapiens
cttaccattaaag

SEQ ID NO: 3994559 - DNA, 16 bp, Homo sapiens
cttacccaatttccca

SEQ ID NO: 3994560 - DNA, 14 bp, Homo sapiens
cttaccgacaagca

SEQ ID NO: 3994561 - DNA, 21 bp, Homo sapiens
cttacctaaacagatataaat

SEQ ID NO: 3994562 - DNA, 19 bp, Homo sapiens
cttacctaagtgacatttg

SEQ ID NO: 3994563 - DNA, 21 bp, Homo sapiens
cttacctaagtgacatttgta

SEQ ID NO: 3994564 - DNA, 19 bp, Homo sapiens
cttacctgggcattcttgt

SEQ ID NO: 3994565 - DNA, 19 bp, Homo sapiens
cttactattaagcagtaaa

SEQ ID NO: 3994566 - DNA, 12 bp, Homo sapiens
cttactctttcc

SEQ ID NO: 3994567 - DNA, 16 bp, Homo sapiens
cttactctttcctatt

SEQ ID NO: 3994568 - DNA, 23 bp, Homo sapiens
cttactctttcctatttcagtgt

SEQ ID NO: 3994569 - DNA, 22 bp, Homo sapiens
cttactggtccttaccagagac

SEQ ID NO: 3994570 - DNA, 21 bp, Homo sapiens
cttactttaattactggaatt

SEQ ID NO: 3994571 - DNA, 21 bp, Homo sapiens
cttactttgcttgagaatcct

SEQ ID NO: 3994572 - DNA, 14 bp, Homo sapiens
cttagaaacactgc

SEQ ID NO: 3994573 - DNA, 16 bp, Homo sapiens
cttagaaattgcattt

SEQ ID NO: 3994574 - DNA, 12 bp, Homo sapiens
cttagaacattt

SEQ ID NO: 3994575 - DNA, 16 bp, Homo sapiens
cttagaatacagtttt

SEQ ID NO: 3994576 - DNA, 12 bp, Homo sapiens
cttagaatccaa

SEQ ID NO: 3994577 - DNA, 16 bp, Homo sapiens
cttagaatccaaactt

SEQ ID NO: 3994578 - DNA, 18 bp, Homo sapiens
cttagaattatttgcact

SEQ ID NO: 3994579 - DNA, 14 bp, Homo sapiens
cttagagcctcgtc

SEQ ID NO: 3994580 - DNA, 21 bp, Homo sapiens
cttagaggcatgggcttgctg

SEQ ID NO: 3994581 - DNA, 14 bp, Homo sapiens
cttagagtttctgt

SEQ ID NO: 3994582 - DNA, 17 bp, Homo sapiens
cttagagtttctgtttg

SEQ ID NO: 3994583 - DNA, 13 bp, Homo sapiens
cttagatgtatat

SEQ ID NO: 3994584 - DNA, 20 bp, Homo sapiens
cttagatgttccagtaatct

SEQ ID NO: 3994585 - DNA, 16 bp, Homo sapiens
cttagcaccttcaggg

SEQ ID NO: 3994586 - DNA, 20 bp, Homo sapiens
cttagcagcaactgaagaca

SEQ ID NO: 3994587 - DNA, 18 bp, Homo sapiens
cttagcagcttccagatt

SEQ ID NO: 3994588 - DNA, 22 bp, Homo sapiens
cttagcatagcttattattgaa

SEQ ID NO: 3994589 - DNA, 18 bp, Homo sapiens
cttagcatcctaagaaat

SEQ ID NO: 3994590 - DNA, 22 bp, Homo sapiens
cttagcatcctaagaaatatgt

SEQ ID NO: 3994591 - DNA, 14 bp, Homo sapiens
cttcgcctttccca

SEQ ID NO: 3994592 - DNA, 21 bp, Homo sapiens
cttcgctggactattgtgcca

SEQ ID NO: 3994593 - DNA, 18 bp, Homo sapiens
cttcggagggcccctgcg

SEQ ID NO: 3994594 - DNA, 19 bp, Homo sapiens
cttctaaacccaatccaaa

SEQ ID NO: 3994595 - DNA, 19 bp, Homo sapiens
cttctaaacttccccatct

SEQ ID NO: 3994596 - DNA, 13 bp, Homo sapiens
cttctaaattaaa

SEQ ID NO: 3994597 - DNA, 17 bp, Homo sapiens
cttctaacccaactgac

SEQ ID NO: 3994598 - DNA, 23 bp, Homo sapiens
cttctaacccaactgacttgtat

SEQ ID NO: 3994599 - DNA, 15 bp, Homo sapiens
cttctaagatgccag

SEQ ID NO: 3994600 - DNA, 14 bp, Homo sapiens
cttctaatttatat

SEQ ID NO: 3994601 - DNA, 18 bp, Homo sapiens
cttctaatttatattatc

SEQ ID NO: 3994602 - DNA, 15 bp, Homo sapiens
cttctacaaccagag

SEQ ID NO: 3994603 - DNA, 16 bp, Homo sapiens
cttctacaaccagagc

SEQ ID NO: 3994604 - DNA, 12 bp, Homo sapiens
cttctacctgcc

SEQ ID NO: 3994605 - DNA, 16 bp, Homo sapiens
cttctacctgccctca

SEQ ID NO: 3994606 - DNA, 18 bp, Homo sapiens
cttctacctgccctcaag

SEQ ID NO: 3994607 - DNA, 19 bp, Homo sapiens
cttctacctgccctcaagg

SEQ ID NO: 3994608 - DNA, 15 bp, Homo sapiens
cttctactcctgcct

SEQ ID NO: 3994609 - DNA, 23 bp, Homo sapiens
cttctagaattataagtcacaaa

SEQ ID NO: 3994610 - DNA, 16 bp, Homo sapiens
cttctaggttctaaaa

SEQ ID NO: 3994611 - DNA, 19 bp, Homo sapiens
cttctattatagccacatc

SEQ ID NO: 3994612 - DNA, 12 bp, Homo sapiens
cttctcaagact

SEQ ID NO: 3994613 - DNA, 14 bp, Homo sapiens
cttctcagaagcac

SEQ ID NO: 3994614 - DNA, 17 bp, Homo sapiens
cttctcagaagcacaga

SEQ ID NO: 3994615 - DNA, 23 bp, Homo sapiens
cttctcagccacaaaccctgcct

SEQ ID NO: 3994616 - DNA, 13 bp, Homo sapiens
cttctcatagcat

SEQ ID NO: 3994617 - DNA, 13 bp, Homo sapiens
cttctcattaccc

SEQ ID NO: 3994618 - DNA, 14 bp, Homo sapiens
cttctccactggat

SEQ ID NO: 3994619 - DNA, 12 bp, Homo sapiens
cttctccaggct

SEQ ID NO: 3994620 - DNA, 13 bp, Homo sapiens
cttctccagtggt

SEQ ID NO: 3994621 - DNA, 17 bp, Homo sapiens
cttctcccccatcctac

SEQ ID NO: 3994622 - DNA, 20 bp, Homo sapiens
cttctccccttccatttctg

SEQ ID NO: 3994623 - DNA, 18 bp, Homo sapiens
cttctccctattccctct

SEQ ID NO: 3994624 - DNA, 18 bp, Homo sapiens
cttctccgccagcctcct

SEQ ID NO: 3994625 - DNA, 23 bp, Homo sapiens
cttctccgccagcctcctctgga

SEQ ID NO: 3994626 - DNA, 16 bp, Homo sapiens
cttctcctctctgggc

SEQ ID NO: 3994627 - DNA, 14 bp, Homo sapiens
cttctccttcccca

SEQ ID NO: 3994628 - DNA, 18 bp, Homo sapiens
cttctccttccccaggat

SEQ ID NO: 3994629 - DNA, 14 bp, Homo sapiens
cttctcggctcagg

SEQ ID NO: 3994630 - DNA, 16 bp, Homo sapiens
cttctcggctcaggct

SEQ ID NO: 3994631 - DNA, 22 bp, Homo sapiens
cttctcggctcaggctctgctg

SEQ ID NO: 3994632 - DNA, 11 bp, Homo sapiens
cttctctacag

SEQ ID NO: 3994633 - DNA, 13 bp, Homo sapiens
cttctctacagac

SEQ ID NO: 3994634 - DNA, 13 bp, Homo sapiens
cttctctccctgc

SEQ ID NO: 3994635 - DNA, 13 bp, Homo sapiens
cttctctcctccc

SEQ ID NO: 3994636 - DNA, 12 bp, Homo sapiens
cttctctctcca

SEQ ID NO: 3994637 - DNA, 13 bp, Homo sapiens
cttctctctgctc

SEQ ID NO: 3994638 - DNA, 22 bp, Homo sapiens
cttctctgaacacaggcagctt

SEQ ID NO: 3994639 - DNA, 12 bp, Homo sapiens
cttctctgccca

SEQ ID NO: 3994640 - DNA, 19 bp, Homo sapiens
cttctctgcccagcttttc

SEQ ID NO: 3994641 - DNA, 16 bp, Homo sapiens
cttctctgctccacca

SEQ ID NO: 3994642 - DNA, 22 bp, Homo sapiens
cttctctgctccaccacatcct

SEQ ID NO: 3994643 - DNA, 12 bp, Homo sapiens
cttctcttaatt

SEQ ID NO: 3994644 - DNA, 16 bp, Homo sapiens
cttctcttaatttaat

SEQ ID NO: 3994645 - DNA, 13 bp, Homo sapiens
cttctcttagatt

SEQ ID NO: 3994646 - DNA, 17 bp, Homo sapiens
cttctcttgctttctat

SEQ ID NO: 3994647 - DNA, 17 bp, Homo sapiens
cttctgaactcaagctg

SEQ ID NO: 3994648 - DNA, 12 bp, Homo sapiens
cttctgaagatt

SEQ ID NO: 3994649 - DNA, 18 bp, Homo sapiens
cttctgaatattttatct

SEQ ID NO: 3994650 - DNA, 15 bp, Homo sapiens
cttctgaatgctgct

SEQ ID NO: 3994651 - DNA, 16 bp, Homo sapiens
cttctgaatgctgcta

SEQ ID NO: 3994652 - DNA, 19 bp, Homo sapiens
cttctgaatgctgctactt

SEQ ID NO: 3994653 - DNA, 18 bp, Homo sapiens
cttctgaccacagcatca

SEQ ID NO: 3994654 - DNA, 16 bp, Homo sapiens
cttctgccctttccta

SEQ ID NO: 3994655 - DNA, 22 bp, Homo sapiens
cttctgccctttcctaggccca

SEQ ID NO: 3994656 - DNA, 23 bp, Homo sapiens
cttctgccctttcctaggcccag

SEQ ID NO: 3994657 - DNA, 13 bp, Homo sapiens
cttctgccttttc

SEQ ID NO: 3994658 - DNA, 14 bp, Homo sapiens
cttctgctcagctc

SEQ ID NO: 3994659 - DNA, 10 bp, Homo sapiens
cttctgctcc

SEQ ID NO: 3994660 - DNA, 12 bp, Homo sapiens
cttctgctccac

SEQ ID NO: 3994661 - DNA, 14 bp, Homo sapiens
cttctgctcttttc

SEQ ID NO: 3994662 - DNA, 17 bp, Homo sapiens
cttctgctggataaaat

SEQ ID NO: 3994663 - DNA, 19 bp, Homo sapiens
cttctgctggataaaatga

SEQ ID NO: 3994664 - DNA, 16 bp, Homo sapiens
cttctgcttaggagag

SEQ ID NO: 3994665 - DNA, 17 bp, Homo sapiens
cttctgcttttctgccc

SEQ ID NO: 3994666 - DNA, 23 bp, Homo sapiens
cttctgcttttctgccctggctg

SEQ ID NO: 3994667 - DNA, 17 bp, Homo sapiens
cttctggaaactaccag

SEQ ID NO: 3994668 - DNA, 18 bp, Homo sapiens
cttctggaatttgttcaa

SEQ ID NO: 3994669 - DNA, 19 bp, Homo sapiens
cttctggacactgagaggg

SEQ ID NO: 3994670 - DNA, 15 bp, Homo sapiens
cttctggacaggctc

SEQ ID NO: 3994671 - DNA, 15 bp, Homo sapiens
cttctggctgtagat

SEQ ID NO: 3994672 - DNA, 14 bp, Homo sapiens
cttctggggcaggc

SEQ ID NO: 3994673 - DNA, 21 bp, Homo sapiens
cttctgtagtactccttaaga

SEQ ID NO: 3994674 - DNA, 14 bp, Homo sapiens
cttctgtatttcct

SEQ ID NO: 3994675 - DNA, 15 bp, Homo sapiens
cttctgtatttctag

SEQ ID NO: 3994676 - DNA, 21 bp, Homo sapiens
cttctgtatttctaggcacaa

SEQ ID NO: 3994677 - DNA, 22 bp, Homo sapiens
cttctgtatttttttttctaag

SEQ ID NO: 3994678 - DNA, 15 bp, Homo sapiens
cttctgtccccagcc

SEQ ID NO: 3994679 - DNA, 14 bp, Homo sapiens
cttctgtgaaagta

SEQ ID NO: 3994680 - DNA, 19 bp, Homo sapiens
cttctgtgaaatataattg

SEQ ID NO: 3994681 - DNA, 19 bp, Homo sapiens
cttctgtgagacccccaca

SEQ ID NO: 3994682 - DNA, 15 bp, Homo sapiens
cttctgtggctcaca

SEQ ID NO: 3994683 - DNA, 17 bp, Homo sapiens
cttctgtgggcccctca

SEQ ID NO: 3994684 - DNA, 24 bp, Homo sapiens
cttctgtgggcccctcaacagcca

SEQ ID NO: 3994685 - DNA, 17 bp, Homo sapiens
cttctgtgtttgaactg

SEQ ID NO: 3994686 - DNA, 12 bp, Homo sapiens
cttcttcaaata

SEQ ID NO: 3994687 - DNA, 14 bp, Homo sapiens
cttcttcacccagc

SEQ ID NO: 3994688 - DNA, 16 bp, Homo sapiens
cttcttcacccagcta

SEQ ID NO: 3994689 - DNA, 23 bp, Homo sapiens
cttcttcacccagctaatctgta

SEQ ID NO: 3994690 - DNA, 14 bp, Homo sapiens
cttcttcagagtga

SEQ ID NO: 3994691 - DNA, 22 bp, Homo sapiens
cttcttcagagtgaagaatctt

SEQ ID NO: 3994692 - DNA, 12 bp, Homo sapiens
cttcttcccagt

SEQ ID NO: 3994693 - DNA, 14 bp, Homo sapiens
cttcttcctaggtc

SEQ ID NO: 3994694 - DNA, 17 bp, Homo sapiens
cttcttcctaggtccaa

SEQ ID NO: 3994695 - DNA, 12 bp, Homo sapiens
ctttaaggaaaa

SEQ ID NO: 3994696 - DNA, 17 bp, Homo sapiens
ctttaagggcatgcctt

SEQ ID NO: 3994697 - DNA, 19 bp, Homo sapiens
ctttaagggcatgccttgt

SEQ ID NO: 3994698 - DNA, 20 bp, Homo sapiens
ctttaagggcatgccttgtg

SEQ ID NO: 3994699 - DNA, 22 bp, Homo sapiens
ctttaagggcatgccttgtgct

SEQ ID NO: 3994700 - DNA, 20 bp, Homo sapiens
ctttaaggggaggaaccaga

SEQ ID NO: 3994701 - DNA, 21 bp, Homo sapiens
ctttaatcttcagttttatct

SEQ ID NO: 3994702 - DNA, 12 bp, Homo sapiens
ctttaatgcatc

SEQ ID NO: 3994703 - DNA, 13 bp, Homo sapiens
ctttaatgttttt

SEQ ID NO: 3994704 - DNA, 23 bp, Homo sapiens
ctttaatgttttttgccacagct

SEQ ID NO: 3994705 - DNA, 14 bp, Homo sapiens
ctttaccctctttg

SEQ ID NO: 3994706 - DNA, 15 bp, Homo sapiens
ctttacctatggaag

SEQ ID NO: 3994707 - DNA, 22 bp, Homo sapiens
ctttacctatggaagtggttct

SEQ ID NO: 3994708 - DNA, 21 bp, Homo sapiens
ctttacgtgtttaaaaaaaag

SEQ ID NO: 3994709 - DNA, 18 bp, Homo sapiens
ctttactctgtgtttaaa

SEQ ID NO: 3994710 - DNA, 19 bp, Homo sapiens
ctttactctgtgtttaaaa

SEQ ID NO: 3994711 - DNA, 15 bp, Homo sapiens
ctttagaaaaggcat

SEQ ID NO: 3994712 - DNA, 16 bp, Homo sapiens
ctttagaaataaatgt

SEQ ID NO: 3994713 - DNA, 14 bp, Homo sapiens
ctttagagaagatg

SEQ ID NO: 3994714 - DNA, 15 bp, Homo sapiens
ctttagagcagcttt

SEQ ID NO: 3994715 - DNA, 13 bp, Homo sapiens
ctttagagtagca

SEQ ID NO: 3994716 - DNA, 16 bp, Homo sapiens
ctttagcttcatttta

SEQ ID NO: 3994717 - DNA, 14 bp, Homo sapiens
ctttatacattagt

SEQ ID NO: 3994718 - DNA, 19 bp, Homo sapiens
ctttatacattagtaaatg

SEQ ID NO: 3994719 - DNA, 20 bp, Homo sapiens
ctttatacattagtaaatgt

SEQ ID NO: 3994720 - DNA, 15 bp, Homo sapiens
ctttatctcctgctc

SEQ ID NO: 3994721 - DNA, 16 bp, Homo sapiens
ctttatctctgaggct

SEQ ID NO: 3994722 - DNA, 14 bp, Homo sapiens
ctttatcttgacat

SEQ ID NO: 3994723 - DNA, 23 bp, Homo sapiens
ctttatctttccatgggagccag

SEQ ID NO: 3994724 - DNA, 13 bp, Homo sapiens
ctttatggtttct

SEQ ID NO: 3994725 - DNA, 13 bp, Homo sapiens
ctttatgtatctc

SEQ ID NO: 3994726 - DNA, 13 bp, Homo sapiens
ctttatgtgaatt

SEQ ID NO: 3994727 - DNA, 17 bp, Homo sapiens
ctttatgtgaattttta

SEQ ID NO: 3994728 - DNA, 20 bp, Homo sapiens
ctttatgtgatataaggatt

SEQ ID NO: 3994729 - DNA, 17 bp, Homo sapiens
ctttatgtttttggtta

SEQ ID NO: 3994730 - DNA, 21 bp, Homo sapiens
ctttattaaatacaaaacttc

SEQ ID NO: 3994731 - DNA, 20 bp, Homo sapiens
ctttattaatcactattgtt

SEQ ID NO: 3994732 - DNA, 13 bp, Homo sapiens
ctttattttctgg

SEQ ID NO: 3994733 - DNA, 23 bp, Homo sapiens
ctttattttttaagtatttatat

SEQ ID NO: 3994734 - DNA, 14 bp, Homo sapiens
ctttcacaaccttc

SEQ ID NO: 3994735 - DNA, 15 bp, Homo sapiens
ctttcacagctcctc

SEQ ID NO: 3994736 - DNA, 13 bp, Homo sapiens
ctttcacttcttt

SEQ ID NO: 3994737 - DNA, 14 bp, Homo sapiens
ctttcacttctttc

SEQ ID NO: 3994738 - DNA, 19 bp, Homo sapiens
ctttcagatacatggttgt

SEQ ID NO: 3994739 - DNA, 14 bp, Homo sapiens
ctttcaggcctaca

SEQ ID NO: 3994740 - DNA, 17 bp, Homo sapiens
ctttcagggccatggtt

SEQ ID NO: 3994741 - DNA, 21 bp, Homo sapiens
ctttcatcctgactctgcccc

SEQ ID NO: 3994742 - DNA, 18 bp, Homo sapiens
ctttccacatttgtcaca

SEQ ID NO: 3994743 - DNA, 19 bp, Homo sapiens
ctttccacatttgtcacag

SEQ ID NO: 3994744 - DNA, 23 bp, Homo sapiens
ctttccagagcaaccagaaggag

SEQ ID NO: 3994745 - DNA, 11 bp, Homo sapiens
ctttccaggca

SEQ ID NO: 3994746 - DNA, 12 bp, Homo sapiens
ctttccaggcac

SEQ ID NO: 3994747 - DNA, 18 bp, Homo sapiens
ctttccaggcaccctcag

SEQ ID NO: 3994748 - DNA, 20 bp, Homo sapiens
ctttccaggcaccctcaggg

SEQ ID NO: 3994749 - DNA, 23 bp, Homo sapiens
ctttccatccattacctccatcc

SEQ ID NO: 3994750 - DNA, 22 bp, Homo sapiens
ctttccatgggagccagctgct

SEQ ID NO: 3994751 - DNA, 23 bp, Homo sapiens
ctttccatgggagccagctgctt

SEQ ID NO: 3994752 - DNA, 18 bp, Homo sapiens
ctttcccacccagcctgg

SEQ ID NO: 3994753 - DNA, 19 bp, Homo sapiens
ctttcccacccagcctggg

SEQ ID NO: 3994754 - DNA, 13 bp, Homo sapiens
ctttcccttccag

SEQ ID NO: 3994755 - DNA, 14 bp, Homo sapiens
ctttcccttcctcc

SEQ ID NO: 3994756 - DNA, 19 bp, Homo sapiens
ctttccgctgtcgccccag

SEQ ID NO: 3994757 - DNA, 18 bp, Homo sapiens
ctttcctatcatggagtg

SEQ ID NO: 3994758 - DNA, 20 bp, Homo sapiens
ctttcctcaagtatcttcta

SEQ ID NO: 3994759 - DNA, 13 bp, Homo sapiens
ctttcctccaccc

SEQ ID NO: 3994760 - DNA, 14 bp, Homo sapiens
ctttcctccaccca

SEQ ID NO: 3994761 - DNA, 17 bp, Homo sapiens
ctttcctccccctgcaa

SEQ ID NO: 3994762 - DNA, 19 bp, Homo sapiens
ctttcctccccctgcaact

SEQ ID NO: 3994763 - DNA, 21 bp, Homo sapiens
ctttcctgcaactcaaggact

SEQ ID NO: 3994764 - DNA, 10 bp, Homo sapiens
ctttcctgcc

SEQ ID NO: 3994765 - DNA, 14 bp, Homo sapiens
ctttcctgccctgt

SEQ ID NO: 3994766 - DNA, 17 bp, Homo sapiens
ctttcctgccctgtcca

SEQ ID NO: 3994767 - DNA, 18 bp, Homo sapiens
ctttcctgccctgtccaa

SEQ ID NO: 3994768 - DNA, 13 bp, Homo sapiens
ctttcctgtccca

SEQ ID NO: 3994769 - DNA, 21 bp, Homo sapiens
ctttcctgtgtgtactctgtc

SEQ ID NO: 3994770 - DNA, 15 bp, Homo sapiens
ctttccttccatccc

SEQ ID NO: 3994771 - DNA, 14 bp, Homo sapiens
ctttccttccctct

SEQ ID NO: 3994772 - DNA, 17 bp, Homo sapiens
ctttccttccctctctg

SEQ ID NO: 3994773 - DNA, 13 bp, Homo sapiens
ctttcgaggcctg

SEQ ID NO: 3994774 - DNA, 23 bp, Homo sapiens
ctttcggcagaggaacccccacc

SEQ ID NO: 3994775 - DNA, 14 bp, Homo sapiens
ctttctaatgctga

SEQ ID NO: 3994776 - DNA, 15 bp, Homo sapiens
ctttctacaatgtga

SEQ ID NO: 3994777 - DNA, 22 bp, Homo sapiens
ctttctacatgactgggcctcc

SEQ ID NO: 3994778 - DNA, 19 bp, Homo sapiens
ctttctagtggtctttgta

SEQ ID NO: 3994779 - DNA, 13 bp, Homo sapiens
ctttctcagtgtg

SEQ ID NO: 3994780 - DNA, 23 bp, Homo sapiens
ctttctccaaagttatccagagg

SEQ ID NO: 3994781 - DNA, 15 bp, Homo sapiens
ctttctccagccagc

SEQ ID NO: 3994782 - DNA, 21 bp, Homo sapiens
ctttctccttagtcttctcat

SEQ ID NO: 3994783 - DNA, 21 bp, Homo sapiens
ctttctctcagccttacattt

SEQ ID NO: 3994784 - DNA, 22 bp, Homo sapiens
ctttctctcagccttacatttg

SEQ ID NO: 3994785 - DNA, 22 bp, Homo sapiens
ctttctctctttatacagctgt

SEQ ID NO: 3994786 - DNA, 22 bp, Homo sapiens
ctttctcttccccttcctgttt

SEQ ID NO: 3994787 - DNA, 17 bp, Homo sapiens
ctttctctttctctctt

SEQ ID NO: 3994788 - DNA, 22 bp, Homo sapiens
ctttctcttttcccctttcctg

SEQ ID NO: 3994789 - DNA, 15 bp, Homo sapiens
ctttctgaaattcac

SEQ ID NO: 3994790 - DNA, 18 bp, Homo sapiens
ctttctgccgacccctag

SEQ ID NO: 3994791 - DNA, 15 bp, Homo sapiens
ctttctggcctgcct

SEQ ID NO: 3994792 - DNA, 14 bp, Homo sapiens
ctttctgggagcag

SEQ ID NO: 3994793 - DNA, 17 bp, Homo sapiens
ctttctgggagcagaaa

SEQ ID NO: 3994794 - DNA, 17 bp, Homo sapiens
ctttctggggtttttct

SEQ ID NO: 3994795 - DNA, 13 bp, Homo sapiens
ctttctgtatata

SEQ ID NO: 3994796 - DNA, 19 bp, Homo sapiens
ctttctgtccttttggcac

SEQ ID NO: 3994797 - DNA, 13 bp, Homo sapiens
ctttctgtcttgt

SEQ ID NO: 3994798 - DNA, 20 bp, Homo sapiens
gaccagcaacttgtcttttt

SEQ ID NO: 3994799 - DNA, 17 bp, Homo sapiens
gaccagcctgggcagca

SEQ ID NO: 3994800 - DNA, 14 bp, Homo sapiens
gaccagctcaggac

SEQ ID NO: 3994801 - DNA, 17 bp, Homo sapiens
gaccaggactccctcct

SEQ ID NO: 3994802 - DNA, 23 bp, Homo sapiens
gaccaggactccctcctcacctc

SEQ ID NO: 3994803 - DNA, 12 bp, Homo sapiens
gaccaggatccc

SEQ ID NO: 3994804 - DNA, 23 bp, Homo sapiens
gaccaggcatcctccacaatagc

SEQ ID NO: 3994805 - DNA, 13 bp, Homo sapiens
gaccaggctgtag

SEQ ID NO: 3994806 - DNA, 16 bp, Homo sapiens
gaccaggcttggcctt

SEQ ID NO: 3994807 - DNA, 13 bp, Homo sapiens
gaccagggatgct

SEQ ID NO: 3994808 - DNA, 16 bp, Homo sapiens
gaccagggatgctggg

SEQ ID NO: 3994809 - DNA, 13 bp, Homo sapiens
gaccagggccgag

SEQ ID NO: 3994810 - DNA, 22 bp, Homo sapiens
gaccaggggtgatttcagagag

SEQ ID NO: 3994811 - DNA, 21 bp, Homo sapiens
gaccaggttattttaaaaaga

SEQ ID NO: 3994812 - DNA, 17 bp, Homo sapiens
gaccagtgaccccagaa

SEQ ID NO: 3994813 - DNA, 22 bp, Homo sapiens
gaccagtggtttccagtcatga

SEQ ID NO: 3994814 - DNA, 23 bp, Homo sapiens
gaccagtgtatcaggtcagggac

SEQ ID NO: 3994815 - DNA, 14 bp, Homo sapiens
gaccagttgggagc

SEQ ID NO: 3994816 - DNA, 15 bp, Homo sapiens
gaccagttgggagca

SEQ ID NO: 3994817 - DNA, 16 bp, Homo sapiens
gaccataacagccaac

SEQ ID NO: 3994818 - DNA, 19 bp, Homo sapiens
gaccataacagccaacagg

SEQ ID NO: 3994819 - DNA, 20 bp, Homo sapiens
gaccataatgttacattatt

SEQ ID NO: 3994820 - DNA, 17 bp, Homo sapiens
gaccatattacctggat

SEQ ID NO: 3994821 - DNA, 23 bp, Homo sapiens
gaccatccactctaccctcccac

SEQ ID NO: 3994822 - DNA, 21 bp, Homo sapiens
gaccatgccagattctgcctc

SEQ ID NO: 3994823 - DNA, 22 bp, Homo sapiens
gaccatgccagattctgcctct

SEQ ID NO: 3994824 - DNA, 13 bp, Homo sapiens
gaccatgtgtcac

SEQ ID NO: 3994825 - DNA, 14 bp, Homo sapiens
gacccaaaacacag

SEQ ID NO: 3994826 - DNA, 19 bp, Homo sapiens
gacccagaatggagcctgc

SEQ ID NO: 3994827 - DNA, 16 bp, Homo sapiens
gacccagatcctcaca

SEQ ID NO: 3994828 - DNA, 22 bp, Homo sapiens
gacccagccccttgagaaacct

SEQ ID NO: 3994829 - DNA, 13 bp, Homo sapiens
gacccagggggag

SEQ ID NO: 3994830 - DNA, 23 bp, Homo sapiens
gaccccaaagagcctggagaagc

SEQ ID NO: 3994831 - DNA, 15 bp, Homo sapiens
gaccccaacctcaga

SEQ ID NO: 3994832 - DNA, 12 bp, Homo sapiens
gaccccagggca

SEQ ID NO: 3994833 - DNA, 13 bp, Homo sapiens
gaccccagggcag

SEQ ID NO: 3994834 - DNA, 22 bp, Homo sapiens
gaccccattcctgatcccatgg

SEQ ID NO: 3994835 - DNA, 15 bp, Homo sapiens
gacccccacacctca

SEQ ID NO: 3994836 - DNA, 17 bp, Homo sapiens
gacccccagctccggcc

SEQ ID NO: 3994837 - DNA, 14 bp, Homo sapiens
gacccctagttccc

SEQ ID NO: 3994838 - DNA, 17 bp, Homo sapiens
gacccctagttccctct

SEQ ID NO: 3994839 - DNA, 18 bp, Homo sapiens
gacccctagttccctctg

SEQ ID NO: 3994840 - DNA, 22 bp, Homo sapiens
gacccctagttccctctgctca

SEQ ID NO: 3994841 - DNA, 17 bp, Homo sapiens
gacccctcgtccacccc

SEQ ID NO: 3994842 - DNA, 18 bp, Homo sapiens
gacccctctggccaggat

SEQ ID NO: 3994843 - DNA, 19 bp, Homo sapiens
gacccctgctcccagcctg

SEQ ID NO: 3994844 - DNA, 12 bp, Homo sapiens
gacccctttgag

SEQ ID NO: 3994845 - DNA, 17 bp, Homo sapiens
gacccggcctctctgcc

SEQ ID NO: 3994846 - DNA, 18 bp, Homo sapiens
gaccctcatggcccccag

SEQ ID NO: 3994847 - DNA, 21 bp, Homo sapiens
gaccctcatggcccccagggg

SEQ ID NO: 3994848 - DNA, 20 bp, Homo sapiens
gaccctctgaccctagctct

SEQ ID NO: 3994849 - DNA, 19 bp, Homo sapiens
gaccctctggaaatatgta

SEQ ID NO: 3994850 - DNA, 11 bp, Homo sapiens
gaccctgaggc

SEQ ID NO: 3994851 - DNA, 13 bp, Homo sapiens
gaccctgaggccc

SEQ ID NO: 3994852 - DNA, 18 bp, Homo sapiens
gaccctgaggccctgggc

SEQ ID NO: 3994853 - DNA, 19 bp, Homo sapiens
gaccctgaggccctgggct

SEQ ID NO: 3994854 - DNA, 23 bp, Homo sapiens
gaccctgaggccctgggctgggt

SEQ ID NO: 3994855 - DNA, 18 bp, Homo sapiens
gaccctgcaaacagaaca

SEQ ID NO: 3994856 - DNA, 20 bp, Homo sapiens
gaccctgcaaacagaacagg

SEQ ID NO: 3994857 - DNA, 13 bp, Homo sapiens
gaccctgccacag

SEQ ID NO: 3994858 - DNA, 21 bp, Homo sapiens
gaccctgccacagccagagga

SEQ ID NO: 3994859 - DNA, 23 bp, Homo sapiens
gaccctgccacagccagaggagg

SEQ ID NO: 3994860 - DNA, 16 bp, Homo sapiens
gaccctgcctcagctg

SEQ ID NO: 3994861 - DNA, 17 bp, Homo sapiens
gaccctgcctcagctga

SEQ ID NO: 3994862 - DNA, 23 bp, Homo sapiens
gaccctgcctcagctgacccggc

SEQ ID NO: 3994863 - DNA, 21 bp, Homo sapiens
gaccctgggtgggctctgtgc

SEQ ID NO: 3994864 - DNA, 17 bp, Homo sapiens
gaccctggtgcctggct

SEQ ID NO: 3994865 - DNA, 17 bp, Homo sapiens
gaccctgtcttctgggc

SEQ ID NO: 3994866 - DNA, 20 bp, Homo sapiens
gaccctgtgacatggtgcct

SEQ ID NO: 3994867 - DNA, 21 bp, Homo sapiens
gacccttcttgcctgctgggc

SEQ ID NO: 3994868 - DNA, 14 bp, Homo sapiens
gacccttttctcag

SEQ ID NO: 3994869 - DNA, 16 bp, Homo sapiens
gacccttttctcagga

SEQ ID NO: 3994870 - DNA, 16 bp, Homo sapiens
gaccgccccctcctct

SEQ ID NO: 3994871 - DNA, 15 bp, Homo sapiens
gaccggcggctcgga

SEQ ID NO: 3994872 - DNA, 16 bp, Homo sapiens
gaccggtgctgcagga

SEQ ID NO: 3994873 - DNA, 14 bp, Homo sapiens
gaccgtactctcac

SEQ ID NO: 3994874 - DNA, 13 bp, Homo sapiens
gaccgtggacagg

SEQ ID NO: 3994875 - DNA, 15 bp, Homo sapiens
gaccgtggacaggcc

SEQ ID NO: 3994876 - DNA, 18 bp, Homo sapiens
gaccgtggacaggcccag

SEQ ID NO: 3994877 - DNA, 19 bp, Homo sapiens
gaccgtggacaggcccagc

SEQ ID NO: 3994878 - DNA, 20 bp, Homo sapiens
gacctccacacccgtgagaa

SEQ ID NO: 3994879 - DNA, 15 bp, Homo sapiens
gacctccgcccctgc

SEQ ID NO: 3994880 - DNA, 14 bp, Homo sapiens
gacctctaggagga

SEQ ID NO: 3994881 - DNA, 17 bp, Homo sapiens
gacctctgtaggcagca

SEQ ID NO: 3994882 - DNA, 13 bp, Homo sapiens
gacctcttgctgt

SEQ ID NO: 3994883 - DNA, 15 bp, Homo sapiens
gacctcttgctgtct

SEQ ID NO: 3994884 - DNA, 16 bp, Homo sapiens
gacctcttgctgtctc

SEQ ID NO: 3994885 - DNA, 18 bp, Homo sapiens
gacctcttgctgtctctg

SEQ ID NO: 3994886 - DNA, 20 bp, Homo sapiens
gacctcttgctgtctctgct

SEQ ID NO: 3994887 - DNA, 22 bp, Homo sapiens
gacctcttgctgtctctgctcg

SEQ ID NO: 3994888 - DNA, 14 bp, Homo sapiens
gacctgatcactag

SEQ ID NO: 3994889 - DNA, 15 bp, Homo sapiens
gacctgatcctggag

SEQ ID NO: 3994890 - DNA, 21 bp, Homo sapiens
gacctgatcctggaggcccag

SEQ ID NO: 3994891 - DNA, 20 bp, Homo sapiens
gacctgcactggggagcccg

SEQ ID NO: 3994892 - DNA, 17 bp, Homo sapiens
gacctgccaggcagggg

SEQ ID NO: 3994893 - DNA, 13 bp, Homo sapiens
gacctgcctcctg

SEQ ID NO: 3994894 - DNA, 14 bp, Homo sapiens
gacctgcctcctgc

SEQ ID NO: 3994895 - DNA, 16 bp, Homo sapiens
gacctgcctcctgcct

SEQ ID NO: 3994896 - DNA, 15 bp, Homo sapiens
gacctgctccgctgc

SEQ ID NO: 3994897 - DNA, 18 bp, Homo sapiens
gacctgctccgctgctcc

SEQ ID NO: 3994898 - DNA, 23 bp, Homo sapiens
gacctgctccgctgctccttggc

SEQ ID NO: 3994899 - DNA, 20 bp, Homo sapiens
gacctgcttagctgccttga

SEQ ID NO: 3994900 - DNA, 23 bp, Homo sapiens
gactttttttggtataatgttta

SEQ ID NO: 3994901 - DNA, 10 bp, Homo sapiens
gagaaaaaaa

SEQ ID NO: 3994902 - DNA, 19 bp, Homo sapiens
gagaaaaagctcctgtcct

SEQ ID NO: 3994903 - DNA, 17 bp, Homo sapiens
gagaaaaccccttccca

SEQ ID NO: 3994904 - DNA, 13 bp, Homo sapiens
gagaaaattgaaa

SEQ ID NO: 3994905 - DNA, 18 bp, Homo sapiens
gagaaaattgcactaaat

SEQ ID NO: 3994906 - DNA, 15 bp, Homo sapiens
gagaaaatttatatc

SEQ ID NO: 3994907 - DNA, 14 bp, Homo sapiens
gagaaacccaggga

SEQ ID NO: 3994908 - DNA, 23 bp, Homo sapiens
gagaaaccttattgtacctctct

SEQ ID NO: 3994909 - DNA, 15 bp, Homo sapiens
gagaaactttataca

SEQ ID NO: 3994910 - DNA, 17 bp, Homo sapiens
gagaaactttatacatt

SEQ ID NO: 3994911 - DNA, 19 bp, Homo sapiens
gagaaactttatacattag

SEQ ID NO: 3994912 - DNA, 17 bp, Homo sapiens
gagaaaggggagcccac

SEQ ID NO: 3994913 - DNA, 20 bp, Homo sapiens
gagaaagtgatttctagaaa

SEQ ID NO: 3994914 - DNA, 13 bp, Homo sapiens
gagaaatgggact

SEQ ID NO: 3994915 - DNA, 17 bp, Homo sapiens
gagaaattcgtgtgttt

SEQ ID NO: 3994916 - DNA, 19 bp, Homo sapiens
gagaaattcgtgtgttttt

SEQ ID NO: 3994917 - DNA, 12 bp, Homo sapiens
gagaaattctgt

SEQ ID NO: 3994918 - DNA, 14 bp, Homo sapiens
gagaaattctgtta

SEQ ID NO: 3994919 - DNA, 16 bp, Homo sapiens
gagaaattctgttaaa

SEQ ID NO: 3994920 - DNA, 17 bp, Homo sapiens
gagaaattctgttaaaa

SEQ ID NO: 3994921 - DNA, 22 bp, Homo sapiens
gagaaattctgttaaaatctat

SEQ ID NO: 3994922 - DNA, 20 bp, Homo sapiens
gagaaccgagcaaagatcaa

SEQ ID NO: 3994923 - DNA, 13 bp, Homo sapiens
gagaacgcagccc

SEQ ID NO: 3994924 - DNA, 18 bp, Homo sapiens
gagaacgccagtctccca

SEQ ID NO: 3994925 - DNA, 13 bp, Homo sapiens
gagaactgggatt

SEQ ID NO: 3994926 - DNA, 20 bp, Homo sapiens
gagaactgggatttgaaccc

SEQ ID NO: 3994927 - DNA, 22 bp, Homo sapiens
gagaagaatgaaaatgcagtcc

SEQ ID NO: 3994928 - DNA, 21 bp, Homo sapiens
gagaagaggctggtgctgtgg

SEQ ID NO: 3994929 - DNA, 16 bp, Homo sapiens
gagaagagggcctgtg

SEQ ID NO: 3994930 - DNA, 20 bp, Homo sapiens
gagaagagtgccctgctttg

SEQ ID NO: 3994931 - DNA, 22 bp, Homo sapiens
gagaagataattgttgaaattt

SEQ ID NO: 3994932 - DNA, 16 bp, Homo sapiens
gagaagcggatttcca

SEQ ID NO: 3994933 - DNA, 12 bp, Homo sapiens
gagaagctcttc

SEQ ID NO: 3994934 - DNA, 18 bp, Homo sapiens
gagaagctgctgaccaat

SEQ ID NO: 3994935 - DNA, 17 bp, Homo sapiens
gagaagctggacttctg

SEQ ID NO: 3994936 - DNA, 23 bp, Homo sapiens
gagaaggacccggaggggcctgg

SEQ ID NO: 3994937 - DNA, 11 bp, Homo sapiens
gagaaggcagc

SEQ ID NO: 3994938 - DNA, 12 bp, Homo sapiens
gagaaggcagcc

SEQ ID NO: 3994939 - DNA, 18 bp, Homo sapiens
gagaaggggacttctctt

SEQ ID NO: 3994940 - DNA, 16 bp, Homo sapiens
gagaagtatacataag

SEQ ID NO: 3994941 - DNA, 19 bp, Homo sapiens
gagaagtgccttctccttc

SEQ ID NO: 3994942 - DNA, 12 bp, Homo sapiens
gagaagttctca

SEQ ID NO: 3994943 - DNA, 18 bp, Homo sapiens
gagaagttctcaaagtta

SEQ ID NO: 3994944 - DNA, 19 bp, Homo sapiens
gagaagttctcaaagttaa

SEQ ID NO: 3994945 - DNA, 21 bp, Homo sapiens
gagaagtttctggccctggct

SEQ ID NO: 3994946 - DNA, 19 bp, Homo sapiens
gagaatactttgcttcata

SEQ ID NO: 3994947 - DNA, 12 bp, Homo sapiens
gagaatatatac

SEQ ID NO: 3994948 - DNA, 22 bp, Homo sapiens
gagaatcactaggtaacttatt

SEQ ID NO: 3994949 - DNA, 21 bp, Homo sapiens
gagaatcatacttagcaaagt

SEQ ID NO: 3994950 - DNA, 17 bp, Homo sapiens
gagaatcccttaaaatt

SEQ ID NO: 3994951 - DNA, 18 bp, Homo sapiens
gagaatcccttaaaatta

SEQ ID NO: 3994952 - DNA, 21 bp, Homo sapiens
gagaatctacccccagatcca

SEQ ID NO: 3994953 - DNA, 17 bp, Homo sapiens
gagaatgagggccaaga

SEQ ID NO: 3994954 - DNA, 20 bp, Homo sapiens
gagaatggcgtgaacccggg

SEQ ID NO: 3994955 - DNA, 21 bp, Homo sapiens
gagaatggtgtgaacccggga

SEQ ID NO: 3994956 - DNA, 13 bp, Homo sapiens
gagaattggctca

SEQ ID NO: 3994957 - DNA, 17 bp, Homo sapiens
gagaattgggattacat

SEQ ID NO: 3994958 - DNA, 15 bp, Homo sapiens
gagaattgtatcatt

SEQ ID NO: 3994959 - DNA, 12 bp, Homo sapiens
gagaatttctaa

SEQ ID NO: 3994960 - DNA, 16 bp, Homo sapiens
gagaattttaaattat

SEQ ID NO: 3994961 - DNA, 16 bp, Homo sapiens
gagacaaaattttagt

SEQ ID NO: 3994962 - DNA, 16 bp, Homo sapiens
gagacaatgttttctt

SEQ ID NO: 3994963 - DNA, 16 bp, Homo sapiens
gagacacggagcccag

SEQ ID NO: 3994964 - DNA, 17 bp, Homo sapiens
gagacactggcccctca

SEQ ID NO: 3994965 - DNA, 22 bp, Homo sapiens
gagacagaccacttgccacgct

SEQ ID NO: 3994966 - DNA, 20 bp, Homo sapiens
gagacagagcgacagagcag

SEQ ID NO: 3994967 - DNA, 19 bp, Homo sapiens
gagacagggtaggaaaggg

SEQ ID NO: 3994968 - DNA, 13 bp, Homo sapiens
gagacagtccagt

SEQ ID NO: 3994969 - DNA, 17 bp, Homo sapiens
gagacagtccagtgtca

SEQ ID NO: 3994970 - DNA, 17 bp, Homo sapiens
gagacagtgatctccat

SEQ ID NO: 3994971 - DNA, 22 bp, Homo sapiens
gagacagtttcttagcttttta

SEQ ID NO: 3994972 - DNA, 18 bp, Homo sapiens
gagacatacttgaagggc

SEQ ID NO: 3994973 - DNA, 21 bp, Homo sapiens
gagacatacttgaagggccag

SEQ ID NO: 3994974 - DNA, 17 bp, Homo sapiens
gagaccaagtcctggct

SEQ ID NO: 3994975 - DNA, 18 bp, Homo sapiens
gagaccaagtcctggcta

SEQ ID NO: 3994976 - DNA, 19 bp, Homo sapiens
gagaccaagtcctggctac

SEQ ID NO: 3994977 - DNA, 19 bp, Homo sapiens
gagaccagcctgggcagca

SEQ ID NO: 3994978 - DNA, 12 bp, Homo sapiens
gagaccagctca

SEQ ID NO: 3994979 - DNA, 14 bp, Homo sapiens
gagaccagctcaga

SEQ ID NO: 3994980 - DNA, 19 bp, Homo sapiens
gagaccagctcagaggccc

SEQ ID NO: 3994981 - DNA, 16 bp, Homo sapiens
gagaccagggagcctt

SEQ ID NO: 3994982 - DNA, 13 bp, Homo sapiens
gagaccagtgtat

SEQ ID NO: 3994983 - DNA, 20 bp, Homo sapiens
gagaccagtgtatcaggtca

SEQ ID NO: 3994984 - DNA, 21 bp, Homo sapiens
gagaccagtgtatcaggtcag

SEQ ID NO: 3994985 - DNA, 20 bp, Homo sapiens
gagaccagttgggagcactg

SEQ ID NO: 3994986 - DNA, 22 bp, Homo sapiens
gagaccagttgggagcactgga

SEQ ID NO: 3994987 - DNA, 15 bp, Homo sapiens
gagaccatcctggct

SEQ ID NO: 3994988 - DNA, 22 bp, Homo sapiens
gagacccaaagcggtccctgtc

SEQ ID NO: 3994989 - DNA, 12 bp, Homo sapiens
gagacccccaca

SEQ ID NO: 3994990 - DNA, 19 bp, Homo sapiens
gagaccctgccacagccag

SEQ ID NO: 3994991 - DNA, 20 bp, Homo sapiens
gagaccctgccacagccaga

SEQ ID NO: 3994992 - DNA, 21 bp, Homo sapiens
gagaccctgccacagccagag

SEQ ID NO: 3994993 - DNA, 14 bp, Homo sapiens
gagaccgagtgaac

SEQ ID NO: 3994994 - DNA, 20 bp, Homo sapiens
gagaccggggtatcctgggg

SEQ ID NO: 3994995 - DNA, 10 bp, Homo sapiens
gagacctggt

SEQ ID NO: 3994996 - DNA, 12 bp, Homo sapiens
gagacctgtgct

SEQ ID NO: 3994997 - DNA, 15 bp, Homo sapiens
gagacgacaggcgag

SEQ ID NO: 3994998 - DNA, 13 bp, Homo sapiens
gagacgcccagcc

SEQ ID NO: 3994999 - DNA, 14 bp, Homo sapiens
gagacgcccagccc

SEQ ID NO: 3995000 - DNA, 21 bp, Homo sapiens
gagacgcccagccccatccct

SEQ ID NO: 3995001 - DNA, 20 bp, Homo sapiens
gagacgtggaacctctgtct

SEQ ID NO: 3995002 - DNA, 22 bp, Homo sapiens
gagacgtttttggaagagtagt

SEQ ID NO: 3995003 - DNA, 16 bp, Homo sapiens
gagccctggggactgt

SEQ ID NO: 3995004 - DNA, 18 bp, Homo sapiens
gagccctgttcctccctc

SEQ ID NO: 3995005 - DNA, 24 bp, Homo sapiens
gagcccttcggaggaccagggctg

SEQ ID NO: 3995006 - DNA, 20 bp, Homo sapiens
gagccgctgtgagcccctgg

SEQ ID NO: 3995007 - DNA, 14 bp, Homo sapiens
gagccgggcctggg

SEQ ID NO: 3995008 - DNA, 20 bp, Homo sapiens
gagccgggcctggggctcct

SEQ ID NO: 3995009 - DNA, 19 bp, Homo sapiens
gagccgtggtccctgagga

SEQ ID NO: 3995010 - DNA, 18 bp, Homo sapiens
gagcctagcggagcccag

SEQ ID NO: 3995011 - DNA, 19 bp, Homo sapiens
gagcctagcggagcccagc

SEQ ID NO: 3995012 - DNA, 12 bp, Homo sapiens
gagcctccccct

SEQ ID NO: 3995013 - DNA, 14 bp, Homo sapiens
gagcctccccctca

SEQ ID NO: 3995014 - DNA, 16 bp, Homo sapiens
gagcctccccctcaga

SEQ ID NO: 3995015 - DNA, 22 bp, Homo sapiens
gagcctcctctctcaaactggg

SEQ ID NO: 3995016 - DNA, 17 bp, Homo sapiens
gagcctcctgtgcctgg

SEQ ID NO: 3995017 - DNA, 21 bp, Homo sapiens
gagcctcctgtgcctggcccc

SEQ ID NO: 3995018 - DNA, 23 bp, Homo sapiens
gagcctcctgtgcctggccccag

SEQ ID NO: 3995019 - DNA, 16 bp, Homo sapiens
gagcctcgtccctccc

SEQ ID NO: 3995020 - DNA, 13 bp, Homo sapiens
gagcctgcctgga

SEQ ID NO: 3995021 - DNA, 18 bp, Homo sapiens
gagcctgctctccgcgcc

SEQ ID NO: 3995022 - DNA, 10 bp, Homo sapiens
gagcctgctg

SEQ ID NO: 3995023 - DNA, 15 bp, Homo sapiens
gagcctgctggaagc

SEQ ID NO: 3995024 - DNA, 14 bp, Homo sapiens
gagcctggccccag

SEQ ID NO: 3995025 - DNA, 23 bp, Homo sapiens
gagcctggccccaggccccagac

SEQ ID NO: 3995026 - DNA, 17 bp, Homo sapiens
gagcctggtgctgctgc

SEQ ID NO: 3995027 - DNA, 18 bp, Homo sapiens
gagcctgtgggtccccac

SEQ ID NO: 3995028 - DNA, 13 bp, Homo sapiens
gagccttctcaga

SEQ ID NO: 3995029 - DNA, 17 bp, Homo sapiens
gagcctttggatgacca

SEQ ID NO: 3995030 - DNA, 14 bp, Homo sapiens
gagccttttgctct

SEQ ID NO: 3995031 - DNA, 17 bp, Homo sapiens
gagccttttgctctctg

SEQ ID NO: 3995032 - DNA, 14 bp, Homo sapiens
gagcgacagagcag

SEQ ID NO: 3995033 - DNA, 15 bp, Homo sapiens
gagcgacagagcagt

SEQ ID NO: 3995034 - DNA, 15 bp, Homo sapiens
gagcgcatggcaagt

SEQ ID NO: 3995035 - DNA, 14 bp, Homo sapiens
gagcgccttggtat

SEQ ID NO: 3995036 - DNA, 15 bp, Homo sapiens
gagcgctacccactt

SEQ ID NO: 3995037 - DNA, 13 bp, Homo sapiens
gagcggaggttgc

SEQ ID NO: 3995038 - DNA, 18 bp, Homo sapiens
gagcggattgcaaagcaa

SEQ ID NO: 3995039 - DNA, 14 bp, Homo sapiens
gagcgggaggcaga

SEQ ID NO: 3995040 - DNA, 14 bp, Homo sapiens
gagcgttcccagca

SEQ ID NO: 3995041 - DNA, 18 bp, Homo sapiens
gagctaaactccttcctg

SEQ ID NO: 3995042 - DNA, 22 bp, Homo sapiens
gagctaaactccttcctggcct

SEQ ID NO: 3995043 - DNA, 14 bp, Homo sapiens
gagctaataaatct

SEQ ID NO: 3995044 - DNA, 13 bp, Homo sapiens
gagctactgatga

SEQ ID NO: 3995045 - DNA, 22 bp, Homo sapiens
gagctccagagcaacgaccagg

SEQ ID NO: 3995046 - DNA, 15 bp, Homo sapiens
gagctctatccccat

SEQ ID NO: 3995047 - DNA, 21 bp, Homo sapiens
gagctctgacccttgggcctg

SEQ ID NO: 3995048 - DNA, 23 bp, Homo sapiens
gagctctgacccttgggcctggg

SEQ ID NO: 3995049 - DNA, 15 bp, Homo sapiens
gagctctggggacag

SEQ ID NO: 3995050 - DNA, 16 bp, Homo sapiens
gagctcttcaggcctc

SEQ ID NO: 3995051 - DNA, 15 bp, Homo sapiens
gagctcttggccttt

SEQ ID NO: 3995052 - DNA, 16 bp, Homo sapiens
gagctcttggcctttg

SEQ ID NO: 3995053 - DNA, 20 bp, Homo sapiens
gagctcttggcctttgcatt

SEQ ID NO: 3995054 - DNA, 17 bp, Homo sapiens
gagctgagcagcctctg

SEQ ID NO: 3995055 - DNA, 20 bp, Homo sapiens
gagctgagcagcctctggac

SEQ ID NO: 3995056 - DNA, 16 bp, Homo sapiens
gagctgatggcagctg

SEQ ID NO: 3995057 - DNA, 11 bp, Homo sapiens
gagctgccagt

SEQ ID NO: 3995058 - DNA, 21 bp, Homo sapiens
gagctgccctccttgtccacc

SEQ ID NO: 3995059 - DNA, 18 bp, Homo sapiens
gagctgccttggctcaga

SEQ ID NO: 3995060 - DNA, 21 bp, Homo sapiens
gagctgccttggctcagacat

SEQ ID NO: 3995061 - DNA, 13 bp, Homo sapiens
gagctggagcccc

SEQ ID NO: 3995062 - DNA, 19 bp, Homo sapiens
gagctggagcccccagcag

SEQ ID NO: 3995063 - DNA, 22 bp, Homo sapiens
gagctggagcggagaggaagcc

SEQ ID NO: 3995064 - DNA, 16 bp, Homo sapiens
gagctggccaggccct

SEQ ID NO: 3995065 - DNA, 17 bp, Homo sapiens
gagctgggaggcatggc

SEQ ID NO: 3995066 - DNA, 17 bp, Homo sapiens
gagctggggactcaggg

SEQ ID NO: 3995067 - DNA, 19 bp, Homo sapiens
gagctggggactcagggac

SEQ ID NO: 3995068 - DNA, 12 bp, Homo sapiens
gagctgggtggc

SEQ ID NO: 3995069 - DNA, 21 bp, Homo sapiens
gagctggtagttagtagcatg

SEQ ID NO: 3995070 - DNA, 11 bp, Homo sapiens
gagctggtgca

SEQ ID NO: 3995071 - DNA, 14 bp, Homo sapiens
gagctggtgcatta

SEQ ID NO: 3995072 - DNA, 16 bp, Homo sapiens
gagctggtgcccggag

SEQ ID NO: 3995073 - DNA, 21 bp, Homo sapiens
gagctggtgcccggagattgg

SEQ ID NO: 3995074 - DNA, 11 bp, Homo sapiens
gagctggtttc

SEQ ID NO: 3995075 - DNA, 16 bp, Homo sapiens
gagctggtttcctgcc

SEQ ID NO: 3995076 - DNA, 16 bp, Homo sapiens
gagctgtcaccaagga

SEQ ID NO: 3995077 - DNA, 19 bp, Homo sapiens
gagctgtcaccaaggaaac

SEQ ID NO: 3995078 - DNA, 14 bp, Homo sapiens
gagctgtcatcact

SEQ ID NO: 3995079 - DNA, 19 bp, Homo sapiens
gagctgtggaggattgcta

SEQ ID NO: 3995080 - DNA, 17 bp, Homo sapiens
gagctgtttatggcctc

SEQ ID NO: 3995081 - DNA, 18 bp, Homo sapiens
gagctgtttatggcctca

SEQ ID NO: 3995082 - DNA, 22 bp, Homo sapiens
gagctgtttatggcctcagctg

SEQ ID NO: 3995083 - DNA, 18 bp, Homo sapiens
gagcttcttgtttccttg

SEQ ID NO: 3995084 - DNA, 20 bp, Homo sapiens
gagcttgctcattaattttg

SEQ ID NO: 3995085 - DNA, 13 bp, Homo sapiens
gagcttgctttga

SEQ ID NO: 3995086 - DNA, 17 bp, Homo sapiens
gagcttgggcagtgccc

SEQ ID NO: 3995087 - DNA, 18 bp, Homo sapiens
gagcttgtaataaatact

SEQ ID NO: 3995088 - DNA, 16 bp, Homo sapiens
gagcttgtgtcctgtc

SEQ ID NO: 3995089 - DNA, 22 bp, Homo sapiens
gagcttgtgtcctgtcctttct

SEQ ID NO: 3995090 - DNA, 23 bp, Homo sapiens
gagctttctgtccttttggcact

SEQ ID NO: 3995091 - DNA, 21 bp, Homo sapiens
gaggaaaaccaagccgtggct

SEQ ID NO: 3995092 - DNA, 23 bp, Homo sapiens
gaggaaaaccaagccgtggcttc

SEQ ID NO: 3995093 - DNA, 19 bp, Homo sapiens
gaggaaagcacagaggcct

SEQ ID NO: 3995094 - DNA, 21 bp, Homo sapiens
gaggaaagggaggagtggagg

SEQ ID NO: 3995095 - DNA, 14 bp, Homo sapiens
gaggaaagggctgg

SEQ ID NO: 3995096 - DNA, 17 bp, Homo sapiens
gaggaaagggctggctc

SEQ ID NO: 3995097 - DNA, 22 bp, Homo sapiens
gaggaacccccaccagacatca

SEQ ID NO: 3995098 - DNA, 17 bp, Homo sapiens
gaggaactgtccagaga

SEQ ID NO: 3995099 - DNA, 19 bp, Homo sapiens
gaggaactgtccagagagc

SEQ ID NO: 3995100 - DNA, 15 bp, Homo sapiens
gaggaaggattgtaa

SEQ ID NO: 3995101 - DNA, 16 bp, Homo sapiens
gaggaaggattgtaaa

SEQ ID NO: 3995102 - DNA, 20 bp, Homo sapiens
gaggaatcatgtcaggcctg

SEQ ID NO: 3995103 - DNA, 15 bp, Homo sapiens
gaggaatgctctgtg

SEQ ID NO: 3995104 - DNA, 17 bp, Homo sapiens
gaggaattcagctcagc

SEQ ID NO: 3995105 - DNA, 22 bp, Homo sapiens
gaggaatttatacctcaaacta

SEQ ID NO: 3995106 - DNA, 22 bp, Homo sapiens
gagttgatgggggccaggacac

SEQ ID NO: 3995107 - DNA, 16 bp, Homo sapiens
gagttgattgtctagt

SEQ ID NO: 3995108 - DNA, 23 bp, Homo sapiens
gagttgattgtctagtgaggaag

SEQ ID NO: 3995109 - DNA, 22 bp, Homo sapiens
gagttggagtactatatttaca

SEQ ID NO: 3995110 - DNA, 23 bp, Homo sapiens
gagtttaccatttgtaataaagt

SEQ ID NO: 3995111 - DNA, 18 bp, Homo sapiens
gagtttcattctcctgcc

SEQ ID NO: 3995112 - DNA, 19 bp, Homo sapiens
gagtttcattctcctgcct

SEQ ID NO: 3995113 - DNA, 17 bp, Homo sapiens
gagtttgagctgccttc

SEQ ID NO: 3995114 - DNA, 14 bp, Homo sapiens
gagtttgccttcct

SEQ ID NO: 3995115 - DNA, 13 bp, Homo sapiens
gagtttgtgtctg

SEQ ID NO: 3995116 - DNA, 15 bp, Homo sapiens
gagtttgtgtctgtt

SEQ ID NO: 3995117 - DNA, 21 bp, Homo sapiens
gagtttgttctgttctggggg

SEQ ID NO: 3995118 - DNA, 19 bp, Homo sapiens
gagttttaaattatgtata

SEQ ID NO: 3995119 - DNA, 22 bp, Homo sapiens
gagttttcctctatacatctct

SEQ ID NO: 3995120 - DNA, 14 bp, Homo sapiens
gagtttttcctccc

SEQ ID NO: 3995121 - DNA, 15 bp, Homo sapiens
gagtttttcctccca

SEQ ID NO: 3995122 - DNA, 22 bp, Homo sapiens
gataaaaggtggagtttctctg

SEQ ID NO: 3995123 - DNA, 21 bp, Homo sapiens
gataaaataatgctgcaaact

SEQ ID NO: 3995124 - DNA, 16 bp, Homo sapiens
gataaaatgactactt

SEQ ID NO: 3995125 - DNA, 18 bp, Homo sapiens
gataaaatgactacttag

SEQ ID NO: 3995126 - DNA, 18 bp, Homo sapiens
gataaaatgaggttcaac

SEQ ID NO: 3995127 - DNA, 16 bp, Homo sapiens
gataaacaacaaggtg

SEQ ID NO: 3995128 - DNA, 14 bp, Homo sapiens
gataaactgagcct

SEQ ID NO: 3995129 - DNA, 13 bp, Homo sapiens
gataaagatgatc

SEQ ID NO: 3995130 - DNA, 14 bp, Homo sapiens
gataaagcacagct

SEQ ID NO: 3995131 - DNA, 16 bp, Homo sapiens
gataaatatttgactt

SEQ ID NO: 3995132 - DNA, 23 bp, Homo sapiens
gataaatcatttcagtatcatct

SEQ ID NO: 3995133 - DNA, 15 bp, Homo sapiens
gataaatgatagaca

SEQ ID NO: 3995134 - DNA, 12 bp, Homo sapiens
gataaattataa

SEQ ID NO: 3995135 - DNA, 20 bp, Homo sapiens
gataacaatgcagcaaggcc

SEQ ID NO: 3995136 - DNA, 15 bp, Homo sapiens
gataacacttaaaat

SEQ ID NO: 3995137 - DNA, 13 bp, Homo sapiens
gataacagaattg

SEQ ID NO: 3995138 - DNA, 17 bp, Homo sapiens
gataaccatagcatagg

SEQ ID NO: 3995139 - DNA, 21 bp, Homo sapiens
gataacttaggtggcaagctg

SEQ ID NO: 3995140 - DNA, 16 bp, Homo sapiens
gataacttggggaggc

SEQ ID NO: 3995141 - DNA, 22 bp, Homo sapiens
gataagaatgctggttttccta

SEQ ID NO: 3995142 - DNA, 22 bp, Homo sapiens
gataagtttctattctgtcagt

SEQ ID NO: 3995143 - DNA, 14 bp, Homo sapiens
gataataagattag

SEQ ID NO: 3995144 - DNA, 18 bp, Homo sapiens
gataataattttatagaa

SEQ ID NO: 3995145 - DNA, 14 bp, Homo sapiens
gataatatctgtga

SEQ ID NO: 3995146 - DNA, 16 bp, Homo sapiens
gataatatctgtgagg

SEQ ID NO: 3995147 - DNA, 23 bp, Homo sapiens
gataatattactgtttatttctg

SEQ ID NO: 3995148 - DNA, 13 bp, Homo sapiens
gataatgcatgaa

SEQ ID NO: 3995149 - DNA, 16 bp, Homo sapiens
gataatgcatgaagca

SEQ ID NO: 3995150 - DNA, 19 bp, Homo sapiens
gataatgttaaatttgtaa

SEQ ID NO: 3995151 - DNA, 11 bp, Homo sapiens
gataattgcta

SEQ ID NO: 3995152 - DNA, 14 bp, Homo sapiens
gataattgctattt

SEQ ID NO: 3995153 - DNA, 22 bp, Homo sapiens
gataattgctatttatttttac

SEQ ID NO: 3995154 - DNA, 12 bp, Homo sapiens
gataatttaaga

SEQ ID NO: 3995155 - DNA, 13 bp, Homo sapiens
gataatttgcata

SEQ ID NO: 3995156 - DNA, 13 bp, Homo sapiens
gatacaaagtgtt

SEQ ID NO: 3995157 - DNA, 22 bp, Homo sapiens
gatacaagtttcagacagggtc

SEQ ID NO: 3995158 - DNA, 16 bp, Homo sapiens
gatacagatctcaggg

SEQ ID NO: 3995159 - DNA, 19 bp, Homo sapiens
gatacaggcccctgggttt

SEQ ID NO: 3995160 - DNA, 18 bp, Homo sapiens
gatacagtgtaggcattt

SEQ ID NO: 3995161 - DNA, 14 bp, Homo sapiens
gatacataataaaa

SEQ ID NO: 3995162 - DNA, 20 bp, Homo sapiens
gataccaggttgaaagacct

SEQ ID NO: 3995163 - DNA, 16 bp, Homo sapiens
gatactactgaccaga

SEQ ID NO: 3995164 - DNA, 20 bp, Homo sapiens
gatactctttctaatgctga

SEQ ID NO: 3995165 - DNA, 13 bp, Homo sapiens
gatactgcctccc

SEQ ID NO: 3995166 - DNA, 22 bp, Homo sapiens
gatacttggtcacagccaggcg

SEQ ID NO: 3995167 - DNA, 13 bp, Homo sapiens
gatactttacatg

SEQ ID NO: 3995168 - DNA, 18 bp, Homo sapiens
gatactttgatattttca

SEQ ID NO: 3995169 - DNA, 11 bp, Homo sapiens
gatagagaaat

SEQ ID NO: 3995170 - DNA, 20 bp, Homo sapiens
gatagaggggctgcagggcc

SEQ ID NO: 3995171 - DNA, 16 bp, Homo sapiens
gatagatattgtccta

SEQ ID NO: 3995172 - DNA, 20 bp, Homo sapiens
gatagcactttctacaatgt

SEQ ID NO: 3995173 - DNA, 17 bp, Homo sapiens
gataggagcctgctggt

SEQ ID NO: 3995174 - DNA, 15 bp, Homo sapiens
gataggcccaaggtc

SEQ ID NO: 3995175 - DNA, 13 bp, Homo sapiens
gataggtaaattt

SEQ ID NO: 3995176 - DNA, 18 bp, Homo sapiens
gatagtagcatacattta

SEQ ID NO: 3995177 - DNA, 22 bp, Homo sapiens
gatagtctttcagttaaggaga

SEQ ID NO: 3995178 - DNA, 16 bp, Homo sapiens
gatagtgttctgctcc

SEQ ID NO: 3995179 - DNA, 20 bp, Homo sapiens
gatagtgttctgctcctgct

SEQ ID NO: 3995180 - DNA, 22 bp, Homo sapiens
gatagtgttctgctcctgcttt

SEQ ID NO: 3995181 - DNA, 15 bp, Homo sapiens
gatagttcaccccct

SEQ ID NO: 3995182 - DNA, 15 bp, Homo sapiens
gatataaaatgtgca

SEQ ID NO: 3995183 - DNA, 16 bp, Homo sapiens
gatataaatggctggt

SEQ ID NO: 3995184 - DNA, 14 bp, Homo sapiens
gatataaattctgt

SEQ ID NO: 3995185 - DNA, 18 bp, Homo sapiens
gatatacaaagtgtacca

SEQ ID NO: 3995186 - DNA, 21 bp, Homo sapiens
gatatactatgggatgtatat

SEQ ID NO: 3995187 - DNA, 15 bp, Homo sapiens
gatatataagtgtac

SEQ ID NO: 3995188 - DNA, 15 bp, Homo sapiens
gatatatacaaggtg

SEQ ID NO: 3995189 - DNA, 20 bp, Homo sapiens
gatatatcatgagtgaataa

SEQ ID NO: 3995190 - DNA, 12 bp, Homo sapiens
gatatatctgaa

SEQ ID NO: 3995191 - DNA, 16 bp, Homo sapiens
gatatatctgaaaact

SEQ ID NO: 3995192 - DNA, 18 bp, Homo sapiens
gatatatgctctgcatgt

SEQ ID NO: 3995193 - DNA, 23 bp, Homo sapiens
gatatatttaaaaacaaaaggca

SEQ ID NO: 3995194 - DNA, 15 bp, Homo sapiens
gatatatttaaaaat

SEQ ID NO: 3995195 - DNA, 15 bp, Homo sapiens
gatatatttaagcct

SEQ ID NO: 3995196 - DNA, 18 bp, Homo sapiens
gatatatttcacttttgt

SEQ ID NO: 3995197 - DNA, 22 bp, Homo sapiens
gatatatttcacttttgttctg

SEQ ID NO: 3995198 - DNA, 15 bp, Homo sapiens
gatatccatcttttt

SEQ ID NO: 3995199 - DNA, 11 bp, Homo sapiens
gatatcctctc

SEQ ID NO: 3995200 - DNA, 14 bp, Homo sapiens
gatatcctctcccc

SEQ ID NO: 3995201 - DNA, 16 bp, Homo sapiens
gatatggctgcccagg

SEQ ID NO: 3995202 - DNA, 13 bp, Homo sapiens
gatatgtggtgta

SEQ ID NO: 3995203 - DNA, 14 bp, Homo sapiens
gatattaatcaaaa

SEQ ID NO: 3995204 - DNA, 18 bp, Homo sapiens
gatattccatgaatgtat

SEQ ID NO: 3995205 - DNA, 18 bp, Homo sapiens
gatattgacactgtccct

SEQ ID NO: 3995206 - DNA, 15 bp, Homo sapiens
gatattggaacttgc

SEQ ID NO: 3995207 - DNA, 13 bp, Homo sapiens
gatattgtacata

SEQ ID NO: 3995208 - DNA, 18 bp, Homo sapiens
gatattgtttaaaattca

SEQ ID NO: 3995209 - DNA, 21 bp, Homo sapiens
gcaagactgcaaactttttta

SEQ ID NO: 3995210 - DNA, 19 bp, Homo sapiens
gcaagagaattgcttgaac

SEQ ID NO: 3995211 - DNA, 14 bp, Homo sapiens
gcaagagagatgtt

SEQ ID NO: 3995212 - DNA, 17 bp, Homo sapiens
gcaagagagatgttttg

SEQ ID NO: 3995213 - DNA, 20 bp, Homo sapiens
gcaagagggggtggaggggt

SEQ ID NO: 3995214 - DNA, 19 bp, Homo sapiens
gcaagagtgtggaggctga

SEQ ID NO: 3995215 - DNA, 13 bp, Homo sapiens
gcaagatatttat

SEQ ID NO: 3995216 - DNA, 17 bp, Homo sapiens
gcaagatcttgtctcca

SEQ ID NO: 3995217 - DNA, 17 bp, Homo sapiens
gcaagatgtgaattatt

SEQ ID NO: 3995218 - DNA, 17 bp, Homo sapiens
gcaagcaggacctggca

SEQ ID NO: 3995219 - DNA, 20 bp, Homo sapiens
gcaagcatttatgtttattt

SEQ ID NO: 3995220 - DNA, 17 bp, Homo sapiens
gcaagccacaggaagga

SEQ ID NO: 3995221 - DNA, 12 bp, Homo sapiens
gcaagctggcct

SEQ ID NO: 3995222 - DNA, 15 bp, Homo sapiens
gcaagcttcttgctg

SEQ ID NO: 3995223 - DNA, 14 bp, Homo sapiens
gcaaggaaggaaag

SEQ ID NO: 3995224 - DNA, 21 bp, Homo sapiens
gcaaggacattgccccaagat

SEQ ID NO: 3995225 - DNA, 14 bp, Homo sapiens
gcaaggaccaggac

SEQ ID NO: 3995226 - DNA, 21 bp, Homo sapiens
gcaaggaccaggactccctcc

SEQ ID NO: 3995227 - DNA, 19 bp, Homo sapiens
gcaaggcaggttggatggg

SEQ ID NO: 3995228 - DNA, 15 bp, Homo sapiens
gcaaggctatgtgat

SEQ ID NO: 3995229 - DNA, 12 bp, Homo sapiens
gcaaggctgggt

SEQ ID NO: 3995230 - DNA, 20 bp, Homo sapiens
gcaagggagaaaagagaaac

SEQ ID NO: 3995231 - DNA, 18 bp, Homo sapiens
gcaaggtatttctccagt

SEQ ID NO: 3995232 - DNA, 21 bp, Homo sapiens
gcaaggtatttctccagttgg

SEQ ID NO: 3995233 - DNA, 18 bp, Homo sapiens
gcaaggtcttgctctcct

SEQ ID NO: 3995234 - DNA, 18 bp, Homo sapiens
gcaagtagataaatattt

SEQ ID NO: 3995235 - DNA, 16 bp, Homo sapiens
gcaagtggatgggaat

SEQ ID NO: 3995236 - DNA, 21 bp, Homo sapiens
gcaagtggatgggaatttgtc

SEQ ID NO: 3995237 - DNA, 23 bp, Homo sapiens
gcaagtggatgggaatttgtcag

SEQ ID NO: 3995238 - DNA, 17 bp, Homo sapiens
gcaagttctagagaaga

SEQ ID NO: 3995239 - DNA, 21 bp, Homo sapiens
gcaagttctagagaagaggct

SEQ ID NO: 3995240 - DNA, 22 bp, Homo sapiens
gcaagtttctagctagaaatat

SEQ ID NO: 3995241 - DNA, 19 bp, Homo sapiens
gcaataaacgcattatcag

SEQ ID NO: 3995242 - DNA, 12 bp, Homo sapiens
gcaataacttct

SEQ ID NO: 3995243 - DNA, 13 bp, Homo sapiens
gcaataacttcta

SEQ ID NO: 3995244 - DNA, 15 bp, Homo sapiens
gcaataacttctgac

SEQ ID NO: 3995245 - DNA, 14 bp, Homo sapiens
gcaataagaaatga

SEQ ID NO: 3995246 - DNA, 21 bp, Homo sapiens
gcaataagaatttagggagaa

SEQ ID NO: 3995247 - DNA, 15 bp, Homo sapiens
gcaatagagactgta

SEQ ID NO: 3995248 - DNA, 22 bp, Homo sapiens
gcaatccatgttagtttttact

SEQ ID NO: 3995249 - DNA, 20 bp, Homo sapiens
gcaatcctcctgcctcagcc

SEQ ID NO: 3995250 - DNA, 21 bp, Homo sapiens
gcaatcctcctgcctcagcct

SEQ ID NO: 3995251 - DNA, 15 bp, Homo sapiens
gcaatgaaaaattct

SEQ ID NO: 3995252 - DNA, 16 bp, Homo sapiens
gcaatgaaaaattctc

SEQ ID NO: 3995253 - DNA, 21 bp, Homo sapiens
gcaatgacatctcaggggcca

SEQ ID NO: 3995254 - DNA, 16 bp, Homo sapiens
gcaatgacatcttcaa

SEQ ID NO: 3995255 - DNA, 17 bp, Homo sapiens
gcaatgatgtccagaag

SEQ ID NO: 3995256 - DNA, 22 bp, Homo sapiens
gcaatgcttaaactaaataatg

SEQ ID NO: 3995257 - DNA, 13 bp, Homo sapiens
gcaatggcgcctg

SEQ ID NO: 3995258 - DNA, 22 bp, Homo sapiens
gcaatggtgtcagtatccaggc

SEQ ID NO: 3995259 - DNA, 23 bp, Homo sapiens
gcaatggtgttgccctgagtgga

SEQ ID NO: 3995260 - DNA, 14 bp, Homo sapiens
gcaatgtgctactg

SEQ ID NO: 3995261 - DNA, 15 bp, Homo sapiens
gcaatgttttgcttt

SEQ ID NO: 3995262 - DNA, 17 bp, Homo sapiens
gcaatgttttgcttttg

SEQ ID NO: 3995263 - DNA, 19 bp, Homo sapiens
gcaattaggattttgatgt

SEQ ID NO: 3995264 - DNA, 21 bp, Homo sapiens
gcaattagtctgaaactggct

SEQ ID NO: 3995265 - DNA, 22 bp, Homo sapiens
gcaattagtctgaaactggctt

SEQ ID NO: 3995266 - DNA, 14 bp, Homo sapiens
gcaattcataaaaa

SEQ ID NO: 3995267 - DNA, 18 bp, Homo sapiens
gcaattcccctctgctgc

SEQ ID NO: 3995268 - DNA, 13 bp, Homo sapiens
gcaatttaaatgt

SEQ ID NO: 3995269 - DNA, 19 bp, Homo sapiens
gcaatttaactagacacag

SEQ ID NO: 3995270 - DNA, 16 bp, Homo sapiens
gcaatttatacaatat

SEQ ID NO: 3995271 - DNA, 19 bp, Homo sapiens
gcaatttatacaatatcat

SEQ ID NO: 3995272 - DNA, 22 bp, Homo sapiens
gcaatttctaatttttaagaat

SEQ ID NO: 3995273 - DNA, 13 bp, Homo sapiens
gcacaaaacccag

SEQ ID NO: 3995274 - DNA, 22 bp, Homo sapiens
gcacaactgcaataacttctga

SEQ ID NO: 3995275 - DNA, 22 bp, Homo sapiens
gcacaagccacaagtcttccag

SEQ ID NO: 3995276 - DNA, 12 bp, Homo sapiens
gcacaattataa

SEQ ID NO: 3995277 - DNA, 15 bp, Homo sapiens
gcacacacagcccct

SEQ ID NO: 3995278 - DNA, 16 bp, Homo sapiens
gcacacacctccgaga

SEQ ID NO: 3995279 - DNA, 13 bp, Homo sapiens
gcacacagctact

SEQ ID NO: 3995280 - DNA, 18 bp, Homo sapiens
gcacacagctactctccc

SEQ ID NO: 3995281 - DNA, 15 bp, Homo sapiens
gcacacagctgagca

SEQ ID NO: 3995282 - DNA, 18 bp, Homo sapiens
gcacacagctgagcactt

SEQ ID NO: 3995283 - DNA, 22 bp, Homo sapiens
gcacacagctgagcacttagca

SEQ ID NO: 3995284 - DNA, 23 bp, Homo sapiens
gcacacagctgagcacttagcag

SEQ ID NO: 3995285 - DNA, 20 bp, Homo sapiens
gcacaccacaattctcccta

SEQ ID NO: 3995286 - DNA, 15 bp, Homo sapiens
gcacacccaggtttg

SEQ ID NO: 3995287 - DNA, 18 bp, Homo sapiens
gcacactccatctcctgc

SEQ ID NO: 3995288 - DNA, 21 bp, Homo sapiens
gcacactgctcttaagaaact

SEQ ID NO: 3995289 - DNA, 14 bp, Homo sapiens
gcacactggggccc

SEQ ID NO: 3995290 - DNA, 20 bp, Homo sapiens
gcacagaaacacaatatttt

SEQ ID NO: 3995291 - DNA, 11 bp, Homo sapiens
gcacagagcct

SEQ ID NO: 3995292 - DNA, 20 bp, Homo sapiens
gcacagagcctggccccagg

SEQ ID NO: 3995293 - DNA, 22 bp, Homo sapiens
gcacagagcctggccccaggcc

SEQ ID NO: 3995294 - DNA, 22 bp, Homo sapiens
gcacagagcgtccttccccctg

SEQ ID NO: 3995295 - DNA, 12 bp, Homo sapiens
gcacagaggcct

SEQ ID NO: 3995296 - DNA, 21 bp, Homo sapiens
gcacagaggtcaggaagcagg

SEQ ID NO: 3995297 - DNA, 22 bp, Homo sapiens
gcacagatggatttgcctgtgc

SEQ ID NO: 3995298 - DNA, 24 bp, Homo sapiens
gcacagatggatttgcctgtgcca

SEQ ID NO: 3995299 - DNA, 20 bp, Homo sapiens
gcacagccctccgaccctca

SEQ ID NO: 3995300 - DNA, 23 bp, Homo sapiens
gcacagccctccgaccctcatgg

SEQ ID NO: 3995301 - DNA, 16 bp, Homo sapiens
gcacagctcttcacac

SEQ ID NO: 3995302 - DNA, 16 bp, Homo sapiens
gcacagctgtagtggg

SEQ ID NO: 3995303 - DNA, 14 bp, Homo sapiens
gcacaggacatgcg

SEQ ID NO: 3995304 - DNA, 21 bp, Homo sapiens
gcacaggacatgcggtagcca

SEQ ID NO: 3995305 - DNA, 11 bp, Homo sapiens
gcacaggcaga

SEQ ID NO: 3995306 - DNA, 12 bp, Homo sapiens
gcacagggagaa

SEQ ID NO: 3995307 - DNA, 15 bp, Homo sapiens
gcacagggcaccaga

SEQ ID NO: 3995308 - DNA, 17 bp, Homo sapiens
gcacagggcaccagagg

SEQ ID NO: 3995309 - DNA, 16 bp, Homo sapiens
gcacagggcagtggga

SEQ ID NO: 3995310 - DNA, 18 bp, Homo sapiens
gcacagggtctgctcttt

SEQ ID NO: 3995311 - DNA, 22 bp, Homo sapiens
gcatattaatgcgatttcttcc

SEQ ID NO: 3995312 - DNA, 20 bp, Homo sapiens
gcatattttgagaaactgct

SEQ ID NO: 3995313 - DNA, 21 bp, Homo sapiens
gcatattttgagaaactgctg

SEQ ID NO: 3995314 - DNA, 23 bp, Homo sapiens
gcatcaagaggtgggagggccct

SEQ ID NO: 3995315 - DNA, 19 bp, Homo sapiens
gcatcacgtaccccactgg

SEQ ID NO: 3995316 - DNA, 20 bp, Homo sapiens
gcatcactccccaaggaaga

SEQ ID NO: 3995317 - DNA, 21 bp, Homo sapiens
gcatcactccccaaggaagag

SEQ ID NO: 3995318 - DNA, 22 bp, Homo sapiens
gcatcactgggtgttgatctta

SEQ ID NO: 3995319 - DNA, 14 bp, Homo sapiens
gcatcatctgtaga

SEQ ID NO: 3995320 - DNA, 17 bp, Homo sapiens
gcatcattccaggcccg

SEQ ID NO: 3995321 - DNA, 15 bp, Homo sapiens
gcatccaaaggtgct

SEQ ID NO: 3995322 - DNA, 15 bp, Homo sapiens
gcatccaccttggct

SEQ ID NO: 3995323 - DNA, 20 bp, Homo sapiens
gcatccaccttggctctgcc

SEQ ID NO: 3995324 - DNA, 19 bp, Homo sapiens
gcatccccttggctgtgag

SEQ ID NO: 3995325 - DNA, 20 bp, Homo sapiens
gcatccccttggctgtgagg

SEQ ID NO: 3995326 - DNA, 18 bp, Homo sapiens
gcatccctgaggagccag

SEQ ID NO: 3995327 - DNA, 20 bp, Homo sapiens
gcatccctggagcaggagcc

SEQ ID NO: 3995328 - DNA, 14 bp, Homo sapiens
gcatcccttcccac

SEQ ID NO: 3995329 - DNA, 22 bp, Homo sapiens
gcatcccttcccacatgcctgc

SEQ ID NO: 3995330 - DNA, 14 bp, Homo sapiens
gcatccgaccaggt

SEQ ID NO: 3995331 - DNA, 13 bp, Homo sapiens
gcatcctaagaaa

SEQ ID NO: 3995332 - DNA, 15 bp, Homo sapiens
gcatcctaagaaata

SEQ ID NO: 3995333 - DNA, 22 bp, Homo sapiens
gcatcggacaagacccccagca

SEQ ID NO: 3995334 - DNA, 18 bp, Homo sapiens
gcatcgggagcacccaga

SEQ ID NO: 3995335 - DNA, 17 bp, Homo sapiens
gcatctacacagcctgg

SEQ ID NO: 3995336 - DNA, 21 bp, Homo sapiens
gcatctacacagcctggactt

SEQ ID NO: 3995337 - DNA, 12 bp, Homo sapiens
gcatctcagccc

SEQ ID NO: 3995338 - DNA, 15 bp, Homo sapiens
gcatctcagcccaca

SEQ ID NO: 3995339 - DNA, 15 bp, Homo sapiens
gcatctcctgtgcat

SEQ ID NO: 3995340 - DNA, 14 bp, Homo sapiens
gcatctctgtactt

SEQ ID NO: 3995341 - DNA, 17 bp, Homo sapiens
gcatctctgtactttgc

SEQ ID NO: 3995342 - DNA, 16 bp, Homo sapiens
gcatctcttccccaga

SEQ ID NO: 3995343 - DNA, 14 bp, Homo sapiens
gcatctcttgaggc

SEQ ID NO: 3995344 - DNA, 21 bp, Homo sapiens
gcatctcttgaggccaggagt

SEQ ID NO: 3995345 - DNA, 15 bp, Homo sapiens
gcatctgcccctccc

SEQ ID NO: 3995346 - DNA, 18 bp, Homo sapiens
gcatctgctaataaaacc

SEQ ID NO: 3995347 - DNA, 18 bp, Homo sapiens
gcatctggctgtctagaa

SEQ ID NO: 3995348 - DNA, 22 bp, Homo sapiens
gcatctggctgtctagaatgtg

SEQ ID NO: 3995349 - DNA, 22 bp, Homo sapiens
gcatctggctgtttagcagaac

SEQ ID NO: 3995350 - DNA, 20 bp, Homo sapiens
gcatctggggcccatactgg

SEQ ID NO: 3995351 - DNA, 18 bp, Homo sapiens
gcatctttgccttgggct

SEQ ID NO: 3995352 - DNA, 23 bp, Homo sapiens
gcatctttgccttgggctgctcc

SEQ ID NO: 3995353 - DNA, 15 bp, Homo sapiens
gcatgaacagtgcac

SEQ ID NO: 3995354 - DNA, 14 bp, Homo sapiens
gcatgaagagaagc

SEQ ID NO: 3995355 - DNA, 22 bp, Homo sapiens
gcatgaagagaagcaattttgg

SEQ ID NO: 3995356 - DNA, 22 bp, Homo sapiens
gcatgacttgtgtgtgatgaga

SEQ ID NO: 3995357 - DNA, 20 bp, Homo sapiens
gcatgagacattgacaccag

SEQ ID NO: 3995358 - DNA, 15 bp, Homo sapiens
gcatgatgggaaaat

SEQ ID NO: 3995359 - DNA, 18 bp, Homo sapiens
gcatgatgggaaaatatt

SEQ ID NO: 3995360 - DNA, 21 bp, Homo sapiens
gcatgatgggaaaatatttcc

SEQ ID NO: 3995361 - DNA, 14 bp, Homo sapiens
gcatgattctttaa

SEQ ID NO: 3995362 - DNA, 15 bp, Homo sapiens
gcatgattttgtaac

SEQ ID NO: 3995363 - DNA, 19 bp, Homo sapiens
gcatgcatgccctctctga

SEQ ID NO: 3995364 - DNA, 15 bp, Homo sapiens
gcatgcattttgcag

SEQ ID NO: 3995365 - DNA, 12 bp, Homo sapiens
gcatgccaccct

SEQ ID NO: 3995366 - DNA, 18 bp, Homo sapiens
gcatgccccttggctgga

SEQ ID NO: 3995367 - DNA, 12 bp, Homo sapiens
gcatgccctctc

SEQ ID NO: 3995368 - DNA, 12 bp, Homo sapiens
gcatgccttgtg

SEQ ID NO: 3995369 - DNA, 14 bp, Homo sapiens
gcatgcttcccaga

SEQ ID NO: 3995370 - DNA, 15 bp, Homo sapiens
gcatgcttcccagag

SEQ ID NO: 3995371 - DNA, 16 bp, Homo sapiens
gcatgcttcccagagg

SEQ ID NO: 3995372 - DNA, 18 bp, Homo sapiens
gcatgcttcccagaggga

SEQ ID NO: 3995373 - DNA, 20 bp, Homo sapiens
gcatgcttcccagagggagc

SEQ ID NO: 3995374 - DNA, 22 bp, Homo sapiens
gcatgcttcccagagggagcag

SEQ ID NO: 3995375 - DNA, 13 bp, Homo sapiens
gcatggaaaaatg

SEQ ID NO: 3995376 - DNA, 23 bp, Homo sapiens
gcatggaaaaatggttgatggaa

SEQ ID NO: 3995377 - DNA, 19 bp, Homo sapiens
gcatggagtgtgtattgtt

SEQ ID NO: 3995378 - DNA, 20 bp, Homo sapiens
gcatggagtgtgtattgttc

SEQ ID NO: 3995379 - DNA, 22 bp, Homo sapiens
gcatggagtgtgtattgttccc

SEQ ID NO: 3995380 - DNA, 14 bp, Homo sapiens
gcatggccaggtgg

SEQ ID NO: 3995381 - DNA, 22 bp, Homo sapiens
gcatggccctggggtcccacga

SEQ ID NO: 3995382 - DNA, 23 bp, Homo sapiens
gcatggctcagagcttgaagatt

SEQ ID NO: 3995383 - DNA, 17 bp, Homo sapiens
gcatggctccagaaatg

SEQ ID NO: 3995384 - DNA, 19 bp, Homo sapiens
gcatggctccagaaatgtc

SEQ ID NO: 3995385 - DNA, 15 bp, Homo sapiens
gcatggggtttttat

SEQ ID NO: 3995386 - DNA, 15 bp, Homo sapiens
gcatgggtccagggc

SEQ ID NO: 3995387 - DNA, 18 bp, Homo sapiens
gcatgggtccagggcctg

SEQ ID NO: 3995388 - DNA, 15 bp, Homo sapiens
gcatggtcacacact

SEQ ID NO: 3995389 - DNA, 18 bp, Homo sapiens
gcatggtccctgccttag

SEQ ID NO: 3995390 - DNA, 17 bp, Homo sapiens
gcatggtgccccaggac

SEQ ID NO: 3995391 - DNA, 18 bp, Homo sapiens
gcatggtgccccaggacc

SEQ ID NO: 3995392 - DNA, 21 bp, Homo sapiens
gcatggtggctcatgcctgta

SEQ ID NO: 3995393 - DNA, 20 bp, Homo sapiens
gcatgtaccatttgcatggc

SEQ ID NO: 3995394 - DNA, 21 bp, Homo sapiens
gcatgtcagacagaacttgaa

SEQ ID NO: 3995395 - DNA, 14 bp, Homo sapiens
gcatgtctgcctgg

SEQ ID NO: 3995396 - DNA, 15 bp, Homo sapiens
gcatgtctgcctgga

SEQ ID NO: 3995397 - DNA, 16 bp, Homo sapiens
gcatgtctgcctggag

SEQ ID NO: 3995398 - DNA, 15 bp, Homo sapiens
gcatgtctgttcttc

SEQ ID NO: 3995399 - DNA, 20 bp, Homo sapiens
gcatgtgatcacgcctggct

SEQ ID NO: 3995400 - DNA, 14 bp, Homo sapiens
gcatgtgtcagagt

SEQ ID NO: 3995401 - DNA, 18 bp, Homo sapiens
gcatgttgagccaggcct

SEQ ID NO: 3995402 - DNA, 13 bp, Homo sapiens
gcattaacacaaa

SEQ ID NO: 3995403 - DNA, 13 bp, Homo sapiens
gcattaatgtttc

SEQ ID NO: 3995404 - DNA, 13 bp, Homo sapiens
gcattacaggcaa

SEQ ID NO: 3995405 - DNA, 15 bp, Homo sapiens
gcattacgtgagcca

SEQ ID NO: 3995406 - DNA, 13 bp, Homo sapiens
gcattagaaatta

SEQ ID NO: 3995407 - DNA, 15 bp, Homo sapiens
gcattagaattattt

SEQ ID NO: 3995408 - DNA, 17 bp, Homo sapiens
gcattagaattatttaa

SEQ ID NO: 3995409 - DNA, 17 bp, Homo sapiens
gcattagtaactttgaa

SEQ ID NO: 3995410 - DNA, 21 bp, Homo sapiens
gcattagtaactttgaaaggt

SEQ ID NO: 3995411 - DNA, 20 bp, Homo sapiens
gcattataatcaccagggcc

SEQ ID NO: 3995412 - DNA, 19 bp, Homo sapiens
gcattatataccatttatc

SEQ ID NO: 3995413 - DNA, 23 bp, Homo sapiens
gccatatatgaccagaagccttg

SEQ ID NO: 3995414 - DNA, 15 bp, Homo sapiens
gccatcaaaatgctt

SEQ ID NO: 3995415 - DNA, 18 bp, Homo sapiens
gccatcaaaatgcttttt

SEQ ID NO: 3995416 - DNA, 14 bp, Homo sapiens
gccatccctgggcc

SEQ ID NO: 3995417 - DNA, 21 bp, Homo sapiens
gccatccctgggcccctccac

SEQ ID NO: 3995418 - DNA, 23 bp, Homo sapiens
gccatctagccagcccctcttcc

SEQ ID NO: 3995419 - DNA, 19 bp, Homo sapiens
gccatctcatgaggggaga

SEQ ID NO: 3995420 - DNA, 20 bp, Homo sapiens
gccatctcatgaggggagag

SEQ ID NO: 3995421 - DNA, 13 bp, Homo sapiens
gccatctgatccc

SEQ ID NO: 3995422 - DNA, 21 bp, Homo sapiens
gccatctgcgtgacaataaaa

SEQ ID NO: 3995423 - DNA, 20 bp, Homo sapiens
gccatctgtacatattactg

SEQ ID NO: 3995424 - DNA, 14 bp, Homo sapiens
gccatgacagaggc

SEQ ID NO: 3995425 - DNA, 15 bp, Homo sapiens
gccatgacagaggct

SEQ ID NO: 3995426 - DNA, 14 bp, Homo sapiens
gccatgagggacag

SEQ ID NO: 3995427 - DNA, 22 bp, Homo sapiens
gccatgatggaaatatttattt

SEQ ID NO: 3995428 - DNA, 17 bp, Homo sapiens
gccatgatggcaacaga

SEQ ID NO: 3995429 - DNA, 23 bp, Homo sapiens
gccatgatggcaacagatctgga

SEQ ID NO: 3995430 - DNA, 15 bp, Homo sapiens
gccatgccaggaacc

SEQ ID NO: 3995431 - DNA, 16 bp, Homo sapiens
gccatgccaggaacct

SEQ ID NO: 3995432 - DNA, 18 bp, Homo sapiens
gccatgccaggaacctgt

SEQ ID NO: 3995433 - DNA, 13 bp, Homo sapiens
gccatgctgggcc

SEQ ID NO: 3995434 - DNA, 15 bp, Homo sapiens
gccatgctgggccac

SEQ ID NO: 3995435 - DNA, 17 bp, Homo sapiens
gccatgctgggccactg

SEQ ID NO: 3995436 - DNA, 19 bp, Homo sapiens
gccatgtataaatgtgata

SEQ ID NO: 3995437 - DNA, 22 bp, Homo sapiens
gccatgtctgcagtgtgccccc

SEQ ID NO: 3995438 - DNA, 20 bp, Homo sapiens
gccatgtgagccaccgctgc

SEQ ID NO: 3995439 - DNA, 22 bp, Homo sapiens
gccattcacactttttatttaa

SEQ ID NO: 3995440 - DNA, 14 bp, Homo sapiens
gccattgaccaccc

SEQ ID NO: 3995441 - DNA, 16 bp, Homo sapiens
gccattgcggccccag

SEQ ID NO: 3995442 - DNA, 21 bp, Homo sapiens
gccattgcggccccaggaggg

SEQ ID NO: 3995443 - DNA, 19 bp, Homo sapiens
gccattttgtgaatggatt

SEQ ID NO: 3995444 - DNA, 16 bp, Homo sapiens
gcccaaaacccagggc

SEQ ID NO: 3995445 - DNA, 21 bp, Homo sapiens
gcccaacaggggctccatgcc

SEQ ID NO: 3995446 - DNA, 22 bp, Homo sapiens
gcccaacaggggctccatgcca

SEQ ID NO: 3995447 - DNA, 13 bp, Homo sapiens
gcccaaccacact

SEQ ID NO: 3995448 - DNA, 14 bp, Homo sapiens
gcccaacctcctga

SEQ ID NO: 3995449 - DNA, 22 bp, Homo sapiens
gcccaagaatagatgctgactg

SEQ ID NO: 3995450 - DNA, 23 bp, Homo sapiens
gcccaagacagatgccccagagc

SEQ ID NO: 3995451 - DNA, 13 bp, Homo sapiens
gcccaagagcaga

SEQ ID NO: 3995452 - DNA, 21 bp, Homo sapiens
gcccaagagcagagtctgggc

SEQ ID NO: 3995453 - DNA, 15 bp, Homo sapiens
gcccaagcccaggcc

SEQ ID NO: 3995454 - DNA, 14 bp, Homo sapiens
gcccaagcttccct

SEQ ID NO: 3995455 - DNA, 17 bp, Homo sapiens
gcccaaggcggcccctc

SEQ ID NO: 3995456 - DNA, 20 bp, Homo sapiens
gcccaagggcctcccaccag

SEQ ID NO: 3995457 - DNA, 22 bp, Homo sapiens
gcccaagggcctcccaccagag

SEQ ID NO: 3995458 - DNA, 20 bp, Homo sapiens
gcccaaggtcccctccacat

SEQ ID NO: 3995459 - DNA, 17 bp, Homo sapiens
gcccaagtcacacagct

SEQ ID NO: 3995460 - DNA, 18 bp, Homo sapiens
gcccaagtcacacagcta

SEQ ID NO: 3995461 - DNA, 12 bp, Homo sapiens
gcccaatattat

SEQ ID NO: 3995462 - DNA, 20 bp, Homo sapiens
gcccaatgagactctagggt

SEQ ID NO: 3995463 - DNA, 23 bp, Homo sapiens
gcccacatccggggccagctccg

SEQ ID NO: 3995464 - DNA, 19 bp, Homo sapiens
gcccaccaccccctcaagc

SEQ ID NO: 3995465 - DNA, 12 bp, Homo sapiens
gcccaccaggtg

SEQ ID NO: 3995466 - DNA, 13 bp, Homo sapiens
gcccaccaggtgt

SEQ ID NO: 3995467 - DNA, 14 bp, Homo sapiens
gcccaccaggtgtc

SEQ ID NO: 3995468 - DNA, 13 bp, Homo sapiens
gcccaccccagcc

SEQ ID NO: 3995469 - DNA, 14 bp, Homo sapiens
gcccaccccagcct

SEQ ID NO: 3995470 - DNA, 14 bp, Homo sapiens
gcccaccccctgcc

SEQ ID NO: 3995471 - DNA, 19 bp, Homo sapiens
gcccaccccctgccctgca

SEQ ID NO: 3995472 - DNA, 20 bp, Homo sapiens
gcccaccccctgccctgcac

SEQ ID NO: 3995473 - DNA, 19 bp, Homo sapiens
gcccacccctcactcccca

SEQ ID NO: 3995474 - DNA, 22 bp, Homo sapiens
gcccacccctcactccccaggg

SEQ ID NO: 3995475 - DNA, 19 bp, Homo sapiens
gcccaccctgctcctcctg

SEQ ID NO: 3995476 - DNA, 13 bp, Homo sapiens
gcccacctgccca

SEQ ID NO: 3995477 - DNA, 13 bp, Homo sapiens
gcccactcctgct

SEQ ID NO: 3995478 - DNA, 17 bp, Homo sapiens
gcccactcctgctctgc

SEQ ID NO: 3995479 - DNA, 19 bp, Homo sapiens
gcccactcctgctctgctc

SEQ ID NO: 3995480 - DNA, 22 bp, Homo sapiens
gcccactgctggtgccagggtg

SEQ ID NO: 3995481 - DNA, 24 bp, Homo sapiens
gcccactgtcctgggcctgcagaa

SEQ ID NO: 3995482 - DNA, 15 bp, Homo sapiens
gcccagaactgcccc

SEQ ID NO: 3995483 - DNA, 19 bp, Homo sapiens
gcccagaactgcccccact

SEQ ID NO: 3995484 - DNA, 14 bp, Homo sapiens
gcccagactacagg

SEQ ID NO: 3995485 - DNA, 23 bp, Homo sapiens
gcccagactctgagctgctcacc

SEQ ID NO: 3995486 - DNA, 20 bp, Homo sapiens
gcccagagacatacttgaag

SEQ ID NO: 3995487 - DNA, 14 bp, Homo sapiens
gcccagagcaggaa

SEQ ID NO: 3995488 - DNA, 16 bp, Homo sapiens
gcccagagcccagctc

SEQ ID NO: 3995489 - DNA, 18 bp, Homo sapiens
gcccagagcccagctcca

SEQ ID NO: 3995490 - DNA, 13 bp, Homo sapiens
gcccagagcctgg

SEQ ID NO: 3995491 - DNA, 16 bp, Homo sapiens
gcccagaggactccca

SEQ ID NO: 3995492 - DNA, 18 bp, Homo sapiens
gcccagagggtggcaaga

SEQ ID NO: 3995493 - DNA, 12 bp, Homo sapiens
gcccagaggtaa

SEQ ID NO: 3995494 - DNA, 16 bp, Homo sapiens
gcccagaggtaacaga

SEQ ID NO: 3995495 - DNA, 22 bp, Homo sapiens
gcccagaggtaacagaacagct

SEQ ID NO: 3995496 - DNA, 21 bp, Homo sapiens
gcccagatgtgtcccccccag

SEQ ID NO: 3995497 - DNA, 14 bp, Homo sapiens
gcccagcaggagag

SEQ ID NO: 3995498 - DNA, 17 bp, Homo sapiens
gcccagccaaaccctgt

SEQ ID NO: 3995499 - DNA, 21 bp, Homo sapiens
gcccagccaaaccctgtctga

SEQ ID NO: 3995500 - DNA, 13 bp, Homo sapiens
gcccagccaggag

SEQ ID NO: 3995501 - DNA, 15 bp, Homo sapiens
gcccagccaggagca

SEQ ID NO: 3995502 - DNA, 20 bp, Homo sapiens
gcccagccccatccctgtcc

SEQ ID NO: 3995503 - DNA, 22 bp, Homo sapiens
gcccagccccatccctgtcctc

SEQ ID NO: 3995504 - DNA, 17 bp, Homo sapiens
gcccagcccctactgct

SEQ ID NO: 3995505 - DNA, 21 bp, Homo sapiens
gcccagcccctactgctgtga

SEQ ID NO: 3995506 - DNA, 16 bp, Homo sapiens
gcccagcccctgttta

SEQ ID NO: 3995507 - DNA, 19 bp, Homo sapiens
gcccagcccctgtttactg

SEQ ID NO: 3995508 - DNA, 12 bp, Homo sapiens
gcccagccctcc

SEQ ID NO: 3995509 - DNA, 15 bp, Homo sapiens
gcccagcctctttcc

SEQ ID NO: 3995510 - DNA, 17 bp, Homo sapiens
gcccagcgcggccagcg

SEQ ID NO: 3995511 - DNA, 15 bp, Homo sapiens
gcccagcgggcagat

SEQ ID NO: 3995512 - DNA, 18 bp, Homo sapiens
gcccagcgggcagatggg

SEQ ID NO: 3995513 - DNA, 23 bp, Homo sapiens
gcccagctgcctggagagggtct

SEQ ID NO: 3995514 - DNA, 13 bp, Homo sapiens
gcccagctgggtc

SEQ ID NO: 3995515 - DNA, 23 bp, Homo sapiens
gccggggacagaggcctgcccgg

SEQ ID NO: 3995516 - DNA, 22 bp, Homo sapiens
gccggggtgtaacttcctgctg

SEQ ID NO: 3995517 - DNA, 13 bp, Homo sapiens
gccgggtgcggtg

SEQ ID NO: 3995518 - DNA, 16 bp, Homo sapiens
gccgggtgcggtggct

SEQ ID NO: 3995519 - DNA, 18 bp, Homo sapiens
gccgggttctagtctcct

SEQ ID NO: 3995520 - DNA, 17 bp, Homo sapiens
gccggtaactgtcctgt

SEQ ID NO: 3995521 - DNA, 14 bp, Homo sapiens
gccggtcgggcagc

SEQ ID NO: 3995522 - DNA, 21 bp, Homo sapiens
gccgtagggagtacctgctgc

SEQ ID NO: 3995523 - DNA, 17 bp, Homo sapiens
gccgtgatgctcaggct

SEQ ID NO: 3995524 - DNA, 15 bp, Homo sapiens
gccgtgccttcagct

SEQ ID NO: 3995525 - DNA, 18 bp, Homo sapiens
gccgtggatggccgtgga

SEQ ID NO: 3995526 - DNA, 22 bp, Homo sapiens
gccgtggattgcacgtggcctc

SEQ ID NO: 3995527 - DNA, 23 bp, Homo sapiens
gccgtggattgcacgtggcctct

SEQ ID NO: 3995528 - DNA, 12 bp, Homo sapiens
gccgtggcttcc

SEQ ID NO: 3995529 - DNA, 19 bp, Homo sapiens
gccgtggcttcccgctcag

SEQ ID NO: 3995530 - DNA, 22 bp, Homo sapiens
gccgtggcttcccgctcagccc

SEQ ID NO: 3995531 - DNA, 19 bp, Homo sapiens
gccgtggtccagctcttgg

SEQ ID NO: 3995532 - DNA, 13 bp, Homo sapiens
gccgtgtattttt

SEQ ID NO: 3995533 - DNA, 15 bp, Homo sapiens
gccgtgtctctgagg

SEQ ID NO: 3995534 - DNA, 14 bp, Homo sapiens
gccgtgtgagtgtg

SEQ ID NO: 3995535 - DNA, 22 bp, Homo sapiens
gccgtgtgagtgtgacagggcc

SEQ ID NO: 3995536 - DNA, 21 bp, Homo sapiens
gccgtgtgtctgtcagcccaa

SEQ ID NO: 3995537 - DNA, 18 bp, Homo sapiens
gccgttgaagaggaaggg

SEQ ID NO: 3995538 - DNA, 18 bp, Homo sapiens
gcctaaaactggcctgac

SEQ ID NO: 3995539 - DNA, 16 bp, Homo sapiens
gcctaaaagtaaacat

SEQ ID NO: 3995540 - DNA, 21 bp, Homo sapiens
gcctaaagtacagcctggacc

SEQ ID NO: 3995541 - DNA, 18 bp, Homo sapiens
gcctaactaactggcagg

SEQ ID NO: 3995542 - DNA, 15 bp, Homo sapiens
gcctaagacatgtga

SEQ ID NO: 3995543 - DNA, 16 bp, Homo sapiens
gcctaatccctgggca

SEQ ID NO: 3995544 - DNA, 22 bp, Homo sapiens
gcctaatccctgggcattgctt

SEQ ID NO: 3995545 - DNA, 23 bp, Homo sapiens
gcctaatccctgggcattgcttt

SEQ ID NO: 3995546 - DNA, 16 bp, Homo sapiens
gcctacaaccatccct

SEQ ID NO: 3995547 - DNA, 19 bp, Homo sapiens
gcctacaaccatccctgcc

SEQ ID NO: 3995548 - DNA, 21 bp, Homo sapiens
gcctacaaccatccctgccac

SEQ ID NO: 3995549 - DNA, 14 bp, Homo sapiens
gcctacagatgaac

SEQ ID NO: 3995550 - DNA, 13 bp, Homo sapiens
gcctacagccaca

SEQ ID NO: 3995551 - DNA, 15 bp, Homo sapiens
gcctacagccacatc

SEQ ID NO: 3995552 - DNA, 22 bp, Homo sapiens
gcctacagctttgatccctgac

SEQ ID NO: 3995553 - DNA, 13 bp, Homo sapiens
gcctacctgctct

SEQ ID NO: 3995554 - DNA, 14 bp, Homo sapiens
gcctacctgtatgt

SEQ ID NO: 3995555 - DNA, 20 bp, Homo sapiens
gcctagattaggtagacttt

SEQ ID NO: 3995556 - DNA, 19 bp, Homo sapiens
gcctagcagagtgctggca

SEQ ID NO: 3995557 - DNA, 21 bp, Homo sapiens
gcctagcagagtgctggcact

SEQ ID NO: 3995558 - DNA, 22 bp, Homo sapiens
gcctagcagagtgctggcactt

SEQ ID NO: 3995559 - DNA, 19 bp, Homo sapiens
gcctagcggagcccagcct

SEQ ID NO: 3995560 - DNA, 19 bp, Homo sapiens
gcctagctgcctagcaagc

SEQ ID NO: 3995561 - DNA, 15 bp, Homo sapiens
gcctaggaggactgg

SEQ ID NO: 3995562 - DNA, 16 bp, Homo sapiens
gcctagtttactgttt

SEQ ID NO: 3995563 - DNA, 13 bp, Homo sapiens
gcctcaaggactt

SEQ ID NO: 3995564 - DNA, 20 bp, Homo sapiens
gcctcacccacccctgcaca

SEQ ID NO: 3995565 - DNA, 12 bp, Homo sapiens
gcctcactgaaa

SEQ ID NO: 3995566 - DNA, 20 bp, Homo sapiens
gcctcactgaaacatggctg

SEQ ID NO: 3995567 - DNA, 16 bp, Homo sapiens
gcctcacttgaatgtg

SEQ ID NO: 3995568 - DNA, 12 bp, Homo sapiens
gcctcagaccaa

SEQ ID NO: 3995569 - DNA, 20 bp, Homo sapiens
gcctcagaccaactctctcc

SEQ ID NO: 3995570 - DNA, 20 bp, Homo sapiens
gcctcagacgttgcctgaga

SEQ ID NO: 3995571 - DNA, 15 bp, Homo sapiens
gcctcagactccgcc

SEQ ID NO: 3995572 - DNA, 18 bp, Homo sapiens
gcctcagactccgccctc

SEQ ID NO: 3995573 - DNA, 12 bp, Homo sapiens
gcctcagccctc

SEQ ID NO: 3995574 - DNA, 13 bp, Homo sapiens
gcctcagccctca

SEQ ID NO: 3995575 - DNA, 14 bp, Homo sapiens
gcctcagccctcag

SEQ ID NO: 3995576 - DNA, 16 bp, Homo sapiens
gcctcagcctcccaag

SEQ ID NO: 3995577 - DNA, 22 bp, Homo sapiens
gcctcagccttccaactagctg

SEQ ID NO: 3995578 - DNA, 13 bp, Homo sapiens
gcctcagggccag

SEQ ID NO: 3995579 - DNA, 16 bp, Homo sapiens
gcctcagggccaggcc

SEQ ID NO: 3995580 - DNA, 23 bp, Homo sapiens
gcctcagggccaggcccaggcct

SEQ ID NO: 3995581 - DNA, 17 bp, Homo sapiens
gcctcagggcgctcaga

SEQ ID NO: 3995582 - DNA, 18 bp, Homo sapiens
gcctcagggcgctcagac

SEQ ID NO: 3995583 - DNA, 16 bp, Homo sapiens
gcctcatactcctggg

SEQ ID NO: 3995584 - DNA, 17 bp, Homo sapiens
gcctcatactcctgggc

SEQ ID NO: 3995585 - DNA, 13 bp, Homo sapiens
gcctccaagcctg

SEQ ID NO: 3995586 - DNA, 13 bp, Homo sapiens
gcctccaccctcc

SEQ ID NO: 3995587 - DNA, 12 bp, Homo sapiens
gcctccagaact

SEQ ID NO: 3995588 - DNA, 17 bp, Homo sapiens
gcctccagaactcactg

SEQ ID NO: 3995589 - DNA, 11 bp, Homo sapiens
gcctccagagg

SEQ ID NO: 3995590 - DNA, 16 bp, Homo sapiens
gcctccagaggtcctc

SEQ ID NO: 3995591 - DNA, 19 bp, Homo sapiens
gcctccagaggtcctccgt

SEQ ID NO: 3995592 - DNA, 18 bp, Homo sapiens
gcctccagggcccaggtt

SEQ ID NO: 3995593 - DNA, 15 bp, Homo sapiens
gcctcccaaatgagc

SEQ ID NO: 3995594 - DNA, 22 bp, Homo sapiens
gcctcccacacttgctggggct

SEQ ID NO: 3995595 - DNA, 23 bp, Homo sapiens
gcctcccacacttgctggggctc

SEQ ID NO: 3995596 - DNA, 12 bp, Homo sapiens
gcctcccacccc

SEQ ID NO: 3995597 - DNA, 12 bp, Homo sapiens
gcctcccagctt

SEQ ID NO: 3995598 - DNA, 22 bp, Homo sapiens
gcctcccatccagggcccccat

SEQ ID NO: 3995599 - DNA, 23 bp, Homo sapiens
gcctccccatttcccatctgcac

SEQ ID NO: 3995600 - DNA, 14 bp, Homo sapiens
gcctccccctcaga

SEQ ID NO: 3995601 - DNA, 21 bp, Homo sapiens
gcctccccctcccccattccc

SEQ ID NO: 3995602 - DNA, 18 bp, Homo sapiens
gcctccctcaggctctgt

SEQ ID NO: 3995603 - DNA, 21 bp, Homo sapiens
gcctccctctctcttctgctc

SEQ ID NO: 3995604 - DNA, 23 bp, Homo sapiens
gcctccctctctcttctgctcca

SEQ ID NO: 3995605 - DNA, 11 bp, Homo sapiens
gcctccctgaa

SEQ ID NO: 3995606 - DNA, 11 bp, Homo sapiens
gcctccctgct

SEQ ID NO: 3995607 - DNA, 16 bp, Homo sapiens
gcctccctggtccctt

SEQ ID NO: 3995608 - DNA, 15 bp, Homo sapiens
gcctccctgtctcca

SEQ ID NO: 3995609 - DNA, 16 bp, Homo sapiens
gcctccctgtctccag

SEQ ID NO: 3995610 - DNA, 15 bp, Homo sapiens
gcctcccttgggctg

SEQ ID NO: 3995611 - DNA, 15 bp, Homo sapiens
gcctccgagagggag

SEQ ID NO: 3995612 - DNA, 18 bp, Homo sapiens
gcctccgagagggagaga

SEQ ID NO: 3995613 - DNA, 17 bp, Homo sapiens
gcctcctcatcccgtgt

SEQ ID NO: 3995614 - DNA, 21 bp, Homo sapiens
gcctcctcggagagcagcagc

SEQ ID NO: 3995615 - DNA, 23 bp, Homo sapiens
gcctcctcggagagcagcagcac

SEQ ID NO: 3995616 - DNA, 19 bp, Homo sapiens
gcctcctctgtctgccctt

SEQ ID NO: 3995617 - DNA, 17 bp, Homo sapiens
gcctcctgagcctgtgg

SEQ ID NO: 3995618 - DNA, 13 bp, Homo sapiens
gtcccttgcagct

SEQ ID NO: 3995619 - DNA, 14 bp, Homo sapiens
gtcccttgcctcaa

SEQ ID NO: 3995620 - DNA, 18 bp, Homo sapiens
gtcccttgcctctgccct

SEQ ID NO: 3995621 - DNA, 16 bp, Homo sapiens
gtccctttccctacct

SEQ ID NO: 3995622 - DNA, 17 bp, Homo sapiens
gtccctttccctacctt

SEQ ID NO: 3995623 - DNA, 13 bp, Homo sapiens
gtcccttttgcta

SEQ ID NO: 3995624 - DNA, 13 bp, Homo sapiens
gtccgtggaaaat

SEQ ID NO: 3995625 - DNA, 20 bp, Homo sapiens
gtcctacgtccaaggtggca

SEQ ID NO: 3995626 - DNA, 18 bp, Homo sapiens
gtcctagccactcaggag

SEQ ID NO: 3995627 - DNA, 19 bp, Homo sapiens
gtcctagcccttccctgag

SEQ ID NO: 3995628 - DNA, 18 bp, Homo sapiens
gtcctatctatcttccaa

SEQ ID NO: 3995629 - DNA, 17 bp, Homo sapiens
gtcctatggacaactta

SEQ ID NO: 3995630 - DNA, 21 bp, Homo sapiens
gtcctccaacaccaagcacag

SEQ ID NO: 3995631 - DNA, 14 bp, Homo sapiens
gtcctccaagtgcc

SEQ ID NO: 3995632 - DNA, 22 bp, Homo sapiens
gtcctccagaagcctctggcta

SEQ ID NO: 3995633 - DNA, 17 bp, Homo sapiens
gtcctccagaccaccag

SEQ ID NO: 3995634 - DNA, 15 bp, Homo sapiens
gtcctccaggagctt

SEQ ID NO: 3995635 - DNA, 18 bp, Homo sapiens
gtcctcccatcccctgga

SEQ ID NO: 3995636 - DNA, 20 bp, Homo sapiens
gtcctcccatcccctggact

SEQ ID NO: 3995637 - DNA, 21 bp, Homo sapiens
gtcctcccatcccctggactg

SEQ ID NO: 3995638 - DNA, 16 bp, Homo sapiens
gtcctccgtagggtct

SEQ ID NO: 3995639 - DNA, 13 bp, Homo sapiens
gtcctcctcacct

SEQ ID NO: 3995640 - DNA, 15 bp, Homo sapiens
gtcctcctgctgcca

SEQ ID NO: 3995641 - DNA, 20 bp, Homo sapiens
gtcctctcagttctctccct

SEQ ID NO: 3995642 - DNA, 18 bp, Homo sapiens
gtcctctcccctccagcc

SEQ ID NO: 3995643 - DNA, 19 bp, Homo sapiens
gtcctctgtcagtcacagc

SEQ ID NO: 3995644 - DNA, 19 bp, Homo sapiens
gtcctcttccctctctgca

SEQ ID NO: 3995645 - DNA, 16 bp, Homo sapiens
gtcctgacggcgcccc

SEQ ID NO: 3995646 - DNA, 14 bp, Homo sapiens
gtcctgcccatgtg

SEQ ID NO: 3995647 - DNA, 23 bp, Homo sapiens
gtcctgcccatgtgtcccctcac

SEQ ID NO: 3995648 - DNA, 14 bp, Homo sapiens
gtcctgcctggcca

SEQ ID NO: 3995649 - DNA, 19 bp, Homo sapiens
gtcctgcctggccaggcag

SEQ ID NO: 3995650 - DNA, 20 bp, Homo sapiens
gtcctgcctggccaggcaga

SEQ ID NO: 3995651 - DNA, 15 bp, Homo sapiens
gtgacaagtgaagaa

SEQ ID NO: 3995652 - DNA, 12 bp, Homo sapiens
gtgacaataaaa

SEQ ID NO: 3995653 - DNA, 12 bp, Homo sapiens
gtgacacagcag

SEQ ID NO: 3995654 - DNA, 20 bp, Homo sapiens
gtgacacttcagagagctgg

SEQ ID NO: 3995655 - DNA, 21 bp, Homo sapiens
gtgacagctgcaagccaggga

SEQ ID NO: 3995656 - DNA, 14 bp, Homo sapiens
gtgacagcttcctt

SEQ ID NO: 3995657 - DNA, 15 bp, Homo sapiens
gtgacaggaaagccc

SEQ ID NO: 3995658 - DNA, 17 bp, Homo sapiens
gtgacaggaaagccctc

SEQ ID NO: 3995659 - DNA, 19 bp, Homo sapiens
gtgacaggaaagccctccc

SEQ ID NO: 3995660 - DNA, 13 bp, Homo sapiens
gtgacagggccag

SEQ ID NO: 3995661 - DNA, 14 bp, Homo sapiens
gtgacagggccagt

SEQ ID NO: 3995662 - DNA, 23 bp, Homo sapiens
gtgacagggccagtggggcctgt

SEQ ID NO: 3995663 - DNA, 19 bp, Homo sapiens
gtgacagtattttggttct

SEQ ID NO: 3995664 - DNA, 23 bp, Homo sapiens
gtgacagtcatcatcagggcctg

SEQ ID NO: 3995665 - DNA, 17 bp, Homo sapiens
gtgacagtgccttctct

SEQ ID NO: 3995666 - DNA, 16 bp, Homo sapiens
gtgacatggtgcctga

SEQ ID NO: 3995667 - DNA, 19 bp, Homo sapiens
gtgacatggtgcctgagag

SEQ ID NO: 3995668 - DNA, 24 bp, Homo sapiens
gtgacatggtgcctgagaggcagg

SEQ ID NO: 3995669 - DNA, 16 bp, Homo sapiens
gtgacatgtgaaacct

SEQ ID NO: 3995670 - DNA, 17 bp, Homo sapiens
gtgacatgtgaaacctt

SEQ ID NO: 3995671 - DNA, 18 bp, Homo sapiens
gtgacatgtgaaaccttt

SEQ ID NO: 3995672 - DNA, 20 bp, Homo sapiens
gtgacatgtgaaaccttttt

SEQ ID NO: 3995673 - DNA, 17 bp, Homo sapiens
gtgacattttacattaa

SEQ ID NO: 3995674 - DNA, 21 bp, Homo sapiens
gtgacattttacattaaattt

SEQ ID NO: 3995675 - DNA, 17 bp, Homo sapiens
gtgaccactctgtcttg

SEQ ID NO: 3995676 - DNA, 14 bp, Homo sapiens
gtgaccaggggtga

SEQ ID NO: 3995677 - DNA, 13 bp, Homo sapiens
gtgaccccactgc

SEQ ID NO: 3995678 - DNA, 19 bp, Homo sapiens
gtgacctctagccctgccc

SEQ ID NO: 3995679 - DNA, 20 bp, Homo sapiens
gtgacctctagccctgcccg

SEQ ID NO: 3995680 - DNA, 23 bp, Homo sapiens
gtgacctgaggatttaagggatg

SEQ ID NO: 3995681 - DNA, 13 bp, Homo sapiens
gtgacctgagggc

SEQ ID NO: 3995682 - DNA, 13 bp, Homo sapiens
gtgacggtcccac

SEQ ID NO: 3995683 - DNA, 15 bp, Homo sapiens
gtgacggtcccacac

SEQ ID NO: 3995684 - DNA, 19 bp, Homo sapiens
gtgactagtacaaattata

SEQ ID NO: 3995685 - DNA, 16 bp, Homo sapiens
gtgactctttttaggg

SEQ ID NO: 3995686 - DNA, 12 bp, Homo sapiens
gtgactgtccca

SEQ ID NO: 3995687 - DNA, 22 bp, Homo sapiens
gtgactgtcccaccgggagcct

SEQ ID NO: 3995688 - DNA, 14 bp, Homo sapiens
gtgactgtttggct

SEQ ID NO: 3995689 - DNA, 15 bp, Homo sapiens
gtgacttctccaggt

SEQ ID NO: 3995690 - DNA, 16 bp, Homo sapiens
gtgactttaaaagaaa

SEQ ID NO: 3995691 - DNA, 12 bp, Homo sapiens
gtgagaaagaaa

SEQ ID NO: 3995692 - DNA, 20 bp, Homo sapiens
gtgagaatagtggaggaagg

SEQ ID NO: 3995693 - DNA, 23 bp, Homo sapiens
gtgagaatgatcaaggatctgga

SEQ ID NO: 3995694 - DNA, 14 bp, Homo sapiens
gtgagacccccaca

SEQ ID NO: 3995695 - DNA, 15 bp, Homo sapiens
gtgagacccccacac

SEQ ID NO: 3995696 - DNA, 14 bp, Homo sapiens
gtgagactgcccca

SEQ ID NO: 3995697 - DNA, 17 bp, Homo sapiens
gtgagagagatgggagc

SEQ ID NO: 3995698 - DNA, 14 bp, Homo sapiens
gtgagagattctgt

SEQ ID NO: 3995699 - DNA, 12 bp, Homo sapiens
gtgagatttttt

SEQ ID NO: 3995700 - DNA, 13 bp, Homo sapiens
gtgagatttttta

SEQ ID NO: 3995701 - DNA, 18 bp, Homo sapiens
gtgagcagtcgcctgcct

SEQ ID NO: 3995702 - DNA, 15 bp, Homo sapiens
gtgagccacagacca

SEQ ID NO: 3995703 - DNA, 18 bp, Homo sapiens
gtgagccaccgctgccag

SEQ ID NO: 3995704 - DNA, 24 bp, Homo sapiens
gtgagccaccgctgccagcacaga

SEQ ID NO: 3995705 - DNA, 18 bp, Homo sapiens
gtgagccaccgtgcctgg

SEQ ID NO: 3995706 - DNA, 15 bp, Homo sapiens
gtgagcccagctggg

SEQ ID NO: 3995707 - DNA, 13 bp, Homo sapiens
gtgagcctcctgt

SEQ ID NO: 3995708 - DNA, 21 bp, Homo sapiens
gtgagcctcctgtgcctggcc

SEQ ID NO: 3995709 - DNA, 19 bp, Homo sapiens
gtgagctctgacccttggg

SEQ ID NO: 3995710 - DNA, 12 bp, Homo sapiens
gtgagctgggga

SEQ ID NO: 3995711 - DNA, 20 bp, Homo sapiens
gtgaggaatgctctgtgcca

SEQ ID NO: 3995712 - DNA, 14 bp, Homo sapiens
gtgaggagctgctg

SEQ ID NO: 3995713 - DNA, 17 bp, Homo sapiens
gtgaggagctgctggct

SEQ ID NO: 3995714 - DNA, 14 bp, Homo sapiens
gtgaggaggaaaag

SEQ ID NO: 3995715 - DNA, 15 bp, Homo sapiens
gtgaggaggaaaagg

SEQ ID NO: 3995716 - DNA, 13 bp, Homo sapiens
gtgaggcccctgg

SEQ ID NO: 3995717 - DNA, 13 bp, Homo sapiens
gtgaggcctggcc

SEQ ID NO: 3995718 - DNA, 13 bp, Homo sapiens
gtgagggagggga

SEQ ID NO: 3995719 - DNA, 14 bp, Homo sapiens
gtgaggggggctgg

SEQ ID NO: 3995720 - DNA, 15 bp, Homo sapiens
gtgagggtcccatgt

SEQ ID NO: 3995721 - DNA, 16 bp, Homo sapiens
gtgagggtcccatgtg

SEQ ID NO: 3995722 - DNA, 16 bp, Homo sapiens
gtgaggtgtgcctggc

SEQ ID NO: 3995723 - DNA, 17 bp, Homo sapiens
gtgaggtgtgcctggcc

SEQ ID NO: 3995724 - DNA, 18 bp, Homo sapiens
gtgaggtgtgcctggcct

SEQ ID NO: 3995725 - DNA, 14 bp, Homo sapiens
gtgagtcacctgct

SEQ ID NO: 3995726 - DNA, 19 bp, Homo sapiens
gtgagtcacctgctccaga

SEQ ID NO: 3995727 - DNA, 21 bp, Homo sapiens
gtgagtcacctgctccagaag

SEQ ID NO: 3995728 - DNA, 15 bp, Homo sapiens
gtgagtccattctcc

SEQ ID NO: 3995729 - DNA, 13 bp, Homo sapiens
gtgagtgtgacag

SEQ ID NO: 3995730 - DNA, 17 bp, Homo sapiens
gtgagttgagtctcctc

SEQ ID NO: 3995731 - DNA, 15 bp, Homo sapiens
gtgagtttgagctgc

SEQ ID NO: 3995732 - DNA, 21 bp, Homo sapiens
gtgagtttgagctgccttccc

SEQ ID NO: 3995733 - DNA, 20 bp, Homo sapiens
gtgataatgccccaaggaca

SEQ ID NO: 3995734 - DNA, 17 bp, Homo sapiens
gtgatagaaaagtgtgg

SEQ ID NO: 3995735 - DNA, 14 bp, Homo sapiens
gtgatagcactttc

SEQ ID NO: 3995736 - DNA, 20 bp, Homo sapiens
gtgataggcccaaggtcccc

SEQ ID NO: 3995737 - DNA, 17 bp, Homo sapiens
gtgatagttcaccccct

SEQ ID NO: 3995738 - DNA, 16 bp, Homo sapiens
gtgatatggcagaaga

SEQ ID NO: 3995739 - DNA, 19 bp, Homo sapiens
gtgatatggcagaagacac

SEQ ID NO: 3995740 - DNA, 17 bp, Homo sapiens
gtgatcaatatttttat

SEQ ID NO: 3995741 - DNA, 21 bp, Homo sapiens
gtgatcctctattttgtgatg

SEQ ID NO: 3995742 - DNA, 14 bp, Homo sapiens
gtgatctcagatca

SEQ ID NO: 3995743 - DNA, 16 bp, Homo sapiens
gtgatctcagggcaga

SEQ ID NO: 3995744 - DNA, 22 bp, Homo sapiens
gtgatctgggcattttcctcct

SEQ ID NO: 3995745 - DNA, 23 bp, Homo sapiens
gtgatgaatcaatgaaaaatgta

SEQ ID NO: 3995746 - DNA, 15 bp, Homo sapiens
gtgatgatgctgtga

SEQ ID NO: 3995747 - DNA, 22 bp, Homo sapiens
gtgatgcattaattaatggctt

SEQ ID NO: 3995748 - DNA, 15 bp, Homo sapiens
gtgatgccacacaga

SEQ ID NO: 3995749 - DNA, 17 bp, Homo sapiens
gtgatgccacacagagt

SEQ ID NO: 3995750 - DNA, 19 bp, Homo sapiens
gtgatgcgccttgctgatg

SEQ ID NO: 3995751 - DNA, 20 bp, Homo sapiens
gtgatgggactcattgtaga

SEQ ID NO: 3995752 - DNA, 14 bp, Homo sapiens
gtgatggggcaagg

SEQ ID NO: 3995753 - DNA, 18 bp, Homo sapiens
gtgatggggctcagatgg

SEQ ID NO: 3995754 - DNA, 13 bp, Homo sapiens
gtggcctgccagt

SEQ ID NO: 3995755 - DNA, 20 bp, Homo sapiens
gtggcctgtttctgcagccc

SEQ ID NO: 3995756 - DNA, 23 bp, Homo sapiens
gtggcctttttctgagatgctca

SEQ ID NO: 3995757 - DNA, 15 bp, Homo sapiens
gtggcgtctccctcg

SEQ ID NO: 3995758 - DNA, 22 bp, Homo sapiens
gtggcgttctgctgcccctgca

SEQ ID NO: 3995759 - DNA, 22 bp, Homo sapiens
gtggctcacgcctgtaatccca

SEQ ID NO: 3995760 - DNA, 14 bp, Homo sapiens
gtggctcatgcctg

SEQ ID NO: 3995761 - DNA, 13 bp, Homo sapiens
gtggctgccccgg

SEQ ID NO: 3995762 - DNA, 15 bp, Homo sapiens
gtggctggctctacc

SEQ ID NO: 3995763 - DNA, 16 bp, Homo sapiens
gtggctggctctacct

SEQ ID NO: 3995764 - DNA, 11 bp, Homo sapiens
gtggctgggca

SEQ ID NO: 3995765 - DNA, 15 bp, Homo sapiens
gtggctggtccaggg

SEQ ID NO: 3995766 - DNA, 13 bp, Homo sapiens
gtggcttcccagc

SEQ ID NO: 3995767 - DNA, 18 bp, Homo sapiens
gtggcttcccatgtcttt

SEQ ID NO: 3995768 - DNA, 19 bp, Homo sapiens
gtggctttggcagtgtttt

SEQ ID NO: 3995769 - DNA, 22 bp, Homo sapiens
gtgggaagagggggctggccat

SEQ ID NO: 3995770 - DNA, 13 bp, Homo sapiens
gtgggacagccca

SEQ ID NO: 3995771 - DNA, 21 bp, Homo sapiens
gtgggagccctgaccttggct

SEQ ID NO: 3995772 - DNA, 13 bp, Homo sapiens
gtgggagggagca

SEQ ID NO: 3995773 - DNA, 21 bp, Homo sapiens
gtgggagtagttggagcattg

SEQ ID NO: 3995774 - DNA, 13 bp, Homo sapiens
gtgggatcctccc

SEQ ID NO: 3995775 - DNA, 23 bp, Homo sapiens
gtgggatgttcagcactgtccct

SEQ ID NO: 3995776 - DNA, 17 bp, Homo sapiens
gtgggcaaacaggcagt

SEQ ID NO: 3995777 - DNA, 15 bp, Homo sapiens
gtgggcagcaccctc

SEQ ID NO: 3995778 - DNA, 16 bp, Homo sapiens
gtgggcagcaccctcc

SEQ ID NO: 3995779 - DNA, 15 bp, Homo sapiens
gtgggcagctgagga

SEQ ID NO: 3995780 - DNA, 20 bp, Homo sapiens
gtgggcatttcttgcgagcc

SEQ ID NO: 3995781 - DNA, 13 bp, Homo sapiens
gtgggcgggccat

SEQ ID NO: 3995782 - DNA, 14 bp, Homo sapiens
gtgggctaattaaa

SEQ ID NO: 3995783 - DNA, 20 bp, Homo sapiens
gtgggctggtgccccacagc

SEQ ID NO: 3995784 - DNA, 13 bp, Homo sapiens
gtgggctgtgagt

SEQ ID NO: 3995785 - DNA, 14 bp, Homo sapiens
gtgggcttcctgcc

SEQ ID NO: 3995786 - DNA, 14 bp, Homo sapiens
gtggggaactgagg

SEQ ID NO: 3995787 - DNA, 13 bp, Homo sapiens
gtggggacacagc

SEQ ID NO: 3995788 - DNA, 19 bp, Homo sapiens
gtggggacacagcagtgag

SEQ ID NO: 3995789 - DNA, 12 bp, Homo sapiens
gtggggactggg

SEQ ID NO: 3995790 - DNA, 14 bp, Homo sapiens
gtggggccaggtca

SEQ ID NO: 3995791 - DNA, 13 bp, Homo sapiens
gtggggcctgtgg

SEQ ID NO: 3995792 - DNA, 23 bp, Homo sapiens
gtgggggccaaacctgggacccc

SEQ ID NO: 3995793 - DNA, 13 bp, Homo sapiens
gtggggggtcctt

SEQ ID NO: 3995794 - DNA, 20 bp, Homo sapiens
gtgggggtggaggcttcctg

SEQ ID NO: 3995795 - DNA, 21 bp, Homo sapiens
gtgggggtggccatccctggg

SEQ ID NO: 3995796 - DNA, 20 bp, Homo sapiens
gtgggtagatcacgagatca

SEQ ID NO: 3995797 - DNA, 14 bp, Homo sapiens
gtgggtctggagga

SEQ ID NO: 3995798 - DNA, 13 bp, Homo sapiens
gtgggtgctcaga

SEQ ID NO: 3995799 - DNA, 13 bp, Homo sapiens
gtgggtgctgcca

SEQ ID NO: 3995800 - DNA, 12 bp, Homo sapiens
gtgggtggtgga

SEQ ID NO: 3995801 - DNA, 16 bp, Homo sapiens
gtgggtggtggatctg

SEQ ID NO: 3995802 - DNA, 18 bp, Homo sapiens
gtgggtgtcctgcctgtc

SEQ ID NO: 3995803 - DNA, 17 bp, Homo sapiens
gtgggtgttctttcctg

SEQ ID NO: 3995804 - DNA, 16 bp, Homo sapiens
gtggtatcctgtgaca

SEQ ID NO: 3995805 - DNA, 15 bp, Homo sapiens
gtggtatgtctgcca

SEQ ID NO: 3995806 - DNA, 13 bp, Homo sapiens
gtggtccagctct

SEQ ID NO: 3995807 - DNA, 14 bp, Homo sapiens
gtggtccagctctt

SEQ ID NO: 3995808 - DNA, 13 bp, Homo sapiens
gtggtccatgccc

SEQ ID NO: 3995809 - DNA, 20 bp, Homo sapiens
gtggtccatgcccactgctg

SEQ ID NO: 3995810 - DNA, 17 bp, Homo sapiens
gtggtctgaatgttctg

SEQ ID NO: 3995811 - DNA, 19 bp, Homo sapiens
gtggtcttcaaattgtctt

SEQ ID NO: 3995812 - DNA, 17 bp, Homo sapiens
gtggtctttctggagag

SEQ ID NO: 3995813 - DNA, 15 bp, Homo sapiens
gtggtgaagaaaact

SEQ ID NO: 3995814 - DNA, 13 bp, Homo sapiens
gtggtgagatcat

SEQ ID NO: 3995815 - DNA, 20 bp, Homo sapiens
gtggtggatctgtccaagga

SEQ ID NO: 3995816 - DNA, 16 bp, Homo sapiens
gtggtggcacaggccc

SEQ ID NO: 3995817 - DNA, 17 bp, Homo sapiens
gtggtggcagtggaggt

SEQ ID NO: 3995818 - DNA, 16 bp, Homo sapiens
gtggtgtaaagctggc

SEQ ID NO: 3995819 - DNA, 17 bp, Homo sapiens
gtggtgtaaagctggcc

SEQ ID NO: 3995820 - DNA, 13 bp, Homo sapiens
gtggtgtgactct

SEQ ID NO: 3995821 - DNA, 14 bp, Homo sapiens
gtggtgtgatctta

SEQ ID NO: 3995822 - DNA, 16 bp, Homo sapiens
gtggttcctctgctca

SEQ ID NO: 3995823 - DNA, 16 bp, Homo sapiens
gtggttctattttact

SEQ ID NO: 3995824 - DNA, 18 bp, Homo sapiens
gtggtttaggctatttgt

SEQ ID NO: 3995825 - DNA, 17 bp, Homo sapiens
gtgtaaaaaatggaaaa

SEQ ID NO: 3995826 - DNA, 18 bp, Homo sapiens
gtgtaaaaaatggaaaaa

SEQ ID NO: 3995827 - DNA, 21 bp, Homo sapiens
gtgtaaaaaatggaaaaaaac

SEQ ID NO: 3995828 - DNA, 12 bp, Homo sapiens
gtgtaaagctgg

SEQ ID NO: 3995829 - DNA, 17 bp, Homo sapiens
gtgtaaagctggccctg

SEQ ID NO: 3995830 - DNA, 19 bp, Homo sapiens
gtgtaacaattgtgtagcc

SEQ ID NO: 3995831 - DNA, 23 bp, Homo sapiens
gtgtaacaattgtgtagcctttt

SEQ ID NO: 3995832 - DNA, 12 bp, Homo sapiens
gtgtaacagctg

SEQ ID NO: 3995833 - DNA, 21 bp, Homo sapiens
gtgtaacagctgaggtctctt

SEQ ID NO: 3995834 - DNA, 15 bp, Homo sapiens
gtgtaacttcctgct

SEQ ID NO: 3995835 - DNA, 16 bp, Homo sapiens
gtgtaacttcctgctg

SEQ ID NO: 3995836 - DNA, 15 bp, Homo sapiens
gtgtaataagacata

SEQ ID NO: 3995837 - DNA, 22 bp, Homo sapiens
gtgtaatgtagcgtgtttacat

SEQ ID NO: 3995838 - DNA, 12 bp, Homo sapiens
gtgtacaggtac

SEQ ID NO: 3995839 - DNA, 18 bp, Homo sapiens
gtgtacatagtgtaatgt

SEQ ID NO: 3995840 - DNA, 15 bp, Homo sapiens
gtgtacatatgtgct

SEQ ID NO: 3995841 - DNA, 17 bp, Homo sapiens
gtgtacatggaataaca

SEQ ID NO: 3995842 - DNA, 13 bp, Homo sapiens
gtgtagaagcatt

SEQ ID NO: 3995843 - DNA, 18 bp, Homo sapiens
gtgtagagttaagaagct

SEQ ID NO: 3995844 - DNA, 13 bp, Homo sapiens
gtgtagtcaggtg

SEQ ID NO: 3995845 - DNA, 15 bp, Homo sapiens
gtgtagtcaggtgct

SEQ ID NO: 3995846 - DNA, 23 bp, Homo sapiens
gtgtatatccttccaaaaaatta

SEQ ID NO: 3995847 - DNA, 18 bp, Homo sapiens
gtgtatcgtaaccagcca

SEQ ID NO: 3995848 - DNA, 19 bp, Homo sapiens
gtgtatgagtgtgaatgat

SEQ ID NO: 3995849 - DNA, 20 bp, Homo sapiens
gtgtatgtgtctgctaatgt

SEQ ID NO: 3995850 - DNA, 18 bp, Homo sapiens
gtgtatgtttgcacactt

SEQ ID NO: 3995851 - DNA, 19 bp, Homo sapiens
gtgtattctagttttgtca

SEQ ID NO: 3995852 - DNA, 12 bp, Homo sapiens
gtgtatttattt

SEQ ID NO: 3995853 - DNA, 22 bp, Homo sapiens
gtgtcaagtcctgactgggctg

SEQ ID NO: 3995854 - DNA, 17 bp, Homo sapiens
gtgtcacctctctcaga

SEQ ID NO: 3995855 - DNA, 19 bp, Homo sapiens
gtgtcacctctctcagagc

SEQ ID NO: 3995856 - DNA, 22 bp, Homo sapiens
gtgtcacctctctcagagcatc

SEQ ID NO: 3995857 - DNA, 23 bp, Homo sapiens
gtgtcactactcacagtctcttt

SEQ ID NO: 3995858 - DNA, 14 bp, Homo sapiens
gttattgttttgtt

SEQ ID NO: 3995859 - DNA, 14 bp, Homo sapiens
gttatttactttta

SEQ ID NO: 3995860 - DNA, 14 bp, Homo sapiens
gttatttcttgttt

SEQ ID NO: 3995861 - DNA, 17 bp, Homo sapiens
gttattttctacagtgg

SEQ ID NO: 3995862 - DNA, 20 bp, Homo sapiens
gttattttctacagtggttt

SEQ ID NO: 3995863 - DNA, 21 bp, Homo sapiens
gttattttctttatcattgct

SEQ ID NO: 3995864 - DNA, 17 bp, Homo sapiens
gttattttggatatatt

SEQ ID NO: 3995865 - DNA, 14 bp, Homo sapiens
gttatttttgtaca

SEQ ID NO: 3995866 - DNA, 22 bp, Homo sapiens
gttatttttgtttcttccaaag

SEQ ID NO: 3995867 - DNA, 14 bp, Homo sapiens
gttcaaaatgtctg

SEQ ID NO: 3995868 - DNA, 23 bp, Homo sapiens
gttcaaagccacattatttctag

SEQ ID NO: 3995869 - DNA, 15 bp, Homo sapiens
gttcaacccacagct

SEQ ID NO: 3995870 - DNA, 20 bp, Homo sapiens
gttcaataaacttaacttta

SEQ ID NO: 3995871 - DNA, 18 bp, Homo sapiens
gttcaataataaatattt

SEQ ID NO: 3995872 - DNA, 15 bp, Homo sapiens
gttcacacctgcaga

SEQ ID NO: 3995873 - DNA, 13 bp, Homo sapiens
gttcacagaaaaa

SEQ ID NO: 3995874 - DNA, 15 bp, Homo sapiens
gttcacaggaggcca

SEQ ID NO: 3995875 - DNA, 20 bp, Homo sapiens
gttcaccctgcattacatgt

SEQ ID NO: 3995876 - DNA, 22 bp, Homo sapiens
gttcaccttgaagaacctctca

SEQ ID NO: 3995877 - DNA, 15 bp, Homo sapiens
gttcacgcaacttga

SEQ ID NO: 3995878 - DNA, 24 bp, Homo sapiens
gttcactgagctccccagatctcc

SEQ ID NO: 3995879 - DNA, 12 bp, Homo sapiens
gttcagaaaaaa

SEQ ID NO: 3995880 - DNA, 14 bp, Homo sapiens
gttcagacacctgt

SEQ ID NO: 3995881 - DNA, 18 bp, Homo sapiens
gttcagagccaagcctta

SEQ ID NO: 3995882 - DNA, 14 bp, Homo sapiens
gttcagcactgtcc

SEQ ID NO: 3995883 - DNA, 22 bp, Homo sapiens
gttcagcactgtcccttgcctc

SEQ ID NO: 3995884 - DNA, 16 bp, Homo sapiens
gttcagcctggcctgc

SEQ ID NO: 3995885 - DNA, 19 bp, Homo sapiens
gttcagctcccccaggctg

SEQ ID NO: 3995886 - DNA, 17 bp, Homo sapiens
gttcagggaccgtccag

SEQ ID NO: 3995887 - DNA, 18 bp, Homo sapiens
gttcaggggactcagccc

SEQ ID NO: 3995888 - DNA, 23 bp, Homo sapiens
gttcagtctgaatgctgccacaa

SEQ ID NO: 3995889 - DNA, 13 bp, Homo sapiens
gttcataaatgaa

SEQ ID NO: 3995890 - DNA, 22 bp, Homo sapiens
gttcatacactaaccaaatctc

SEQ ID NO: 3995891 - DNA, 18 bp, Homo sapiens
gttcatagggtctcttca

SEQ ID NO: 3995892 - DNA, 22 bp, Homo sapiens
gttcatagggtctcttcaggtt

SEQ ID NO: 3995893 - DNA, 19 bp, Homo sapiens
gttcatattccatatttat

SEQ ID NO: 3995894 - DNA, 21 bp, Homo sapiens
gttcatccaatcctcactggg

SEQ ID NO: 3995895 - DNA, 22 bp, Homo sapiens
gttcatccaatcctcactgggt

SEQ ID NO: 3995896 - DNA, 18 bp, Homo sapiens
gttcatcccttctcttcc

SEQ ID NO: 3995897 - DNA, 20 bp, Homo sapiens
gttcatcccttctcttccag

SEQ ID NO: 3995898 - DNA, 16 bp, Homo sapiens
gttcatcgattttcta

SEQ ID NO: 3995899 - DNA, 17 bp, Homo sapiens
gttcatcgtataacaca

SEQ ID NO: 3995900 - DNA, 15 bp, Homo sapiens
gttcatctgtccatg

SEQ ID NO: 3995901 - DNA, 22 bp, Homo sapiens
gttcatctgtccatggcctttc

SEQ ID NO: 3995902 - DNA, 23 bp, Homo sapiens
gttcatctgtccatggcctttct

SEQ ID NO: 3995903 - DNA, 15 bp, Homo sapiens
gttcatgtagagaaa

SEQ ID NO: 3995904 - DNA, 14 bp, Homo sapiens
gttcatgtgcctct

SEQ ID NO: 3995905 - DNA, 20 bp, Homo sapiens
gttcattaaagcatgaatgg

SEQ ID NO: 3995906 - DNA, 15 bp, Homo sapiens
gttcattattggaat

SEQ ID NO: 3995907 - DNA, 22 bp, Homo sapiens
gttcattattggaattaacctg

SEQ ID NO: 3995908 - DNA, 14 bp, Homo sapiens
gttcattattttgt

SEQ ID NO: 3995909 - DNA, 14 bp, Homo sapiens
gttcattgtaatgt

SEQ ID NO: 3995910 - DNA, 19 bp, Homo sapiens
gttcattgtaatgttactg

SEQ ID NO: 3995911 - DNA, 21 bp, Homo sapiens
gttcattgtaatgttactgat

SEQ ID NO: 3995912 - DNA, 22 bp, Homo sapiens
gttcattgtaatgttactgatc

SEQ ID NO: 3995913 - DNA, 23 bp, Homo sapiens
gttcattgtaatgttactgatca

SEQ ID NO: 3995914 - DNA, 15 bp, Homo sapiens
gttcatttgtttgtt

SEQ ID NO: 3995915 - DNA, 15 bp, Homo sapiens
gttccaaattcagtt

SEQ ID NO: 3995916 - DNA, 19 bp, Homo sapiens
gttccaagtccaataagac

SEQ ID NO: 3995917 - DNA, 14 bp, Homo sapiens
gttccacagttgcc

SEQ ID NO: 3995918 - DNA, 16 bp, Homo sapiens
gttccacagttgccac

SEQ ID NO: 3995919 - DNA, 14 bp, Homo sapiens
gttccagctctttg

SEQ ID NO: 3995920 - DNA, 22 bp, Homo sapiens
gttccaggcctgatcttgcctg

SEQ ID NO: 3995921 - DNA, 17 bp, Homo sapiens
gttccatgcctgagggt

SEQ ID NO: 3995922 - DNA, 20 bp, Homo sapiens
gttccatgcctgagggtgga

SEQ ID NO: 3995923 - DNA, 22 bp, Homo sapiens
gttccattgaagccgactctgg

SEQ ID NO: 3995924 - DNA, 19 bp, Homo sapiens
gttcccaagctcagaggcg

SEQ ID NO: 3995925 - DNA, 16 bp, Homo sapiens
gttcccaataaaagtg

SEQ ID NO: 3995926 - DNA, 18 bp, Homo sapiens
gttcccaataaaagtgac

SEQ ID NO: 3995927 - DNA, 15 bp, Homo sapiens
gttcccagtagttat

SEQ ID NO: 3995928 - DNA, 21 bp, Homo sapiens
gttcccagtgacacttcagag

SEQ ID NO: 3995929 - DNA, 17 bp, Homo sapiens
gttcccatgtagccccc

SEQ ID NO: 3995930 - DNA, 13 bp, Homo sapiens
gttccccagagaa

SEQ ID NO: 3995931 - DNA, 14 bp, Homo sapiens
gttccccagagaaa

SEQ ID NO: 3995932 - DNA, 18 bp, Homo sapiens
gttccccatctgggtcct

SEQ ID NO: 3995933 - DNA, 19 bp, Homo sapiens
gttcccccagtacctccaa

SEQ ID NO: 3995934 - DNA, 15 bp, Homo sapiens
gttcccctgttcact

SEQ ID NO: 3995935 - DNA, 18 bp, Homo sapiens
gttcccctgttcactcta

SEQ ID NO: 3995936 - DNA, 16 bp, Homo sapiens
gttcccgtttctccac

SEQ ID NO: 3995937 - DNA, 18 bp, Homo sapiens
gttcccgtttctccacct

SEQ ID NO: 3995938 - DNA, 18 bp, Homo sapiens
gttccctcctagctctcc

SEQ ID NO: 3995939 - DNA, 15 bp, Homo sapiens
gttccctctccctgt

SEQ ID NO: 3995940 - DNA, 17 bp, Homo sapiens
gttccctctccctgttg

SEQ ID NO: 3995941 - DNA, 12 bp, Homo sapiens
gttccctctgag

SEQ ID NO: 3995942 - DNA, 14 bp, Homo sapiens
gttccctctgctca

SEQ ID NO: 3995943 - DNA, 16 bp, Homo sapiens
gttccctctgctcctg

SEQ ID NO: 3995944 - DNA, 14 bp, Homo sapiens
gttcccttggcctc

SEQ ID NO: 3995945 - DNA, 15 bp, Homo sapiens
gttcctattgtcatt

SEQ ID NO: 3995946 - DNA, 23 bp, Homo sapiens
gttcctcctacttacaacccagg

SEQ ID NO: 3995947 - DNA, 12 bp, Homo sapiens
gttcctctgcct

SEQ ID NO: 3995948 - DNA, 13 bp, Homo sapiens
gttcctctgcctg

SEQ ID NO: 3995949 - DNA, 16 bp, Homo sapiens
gttcctctgcctgccc

SEQ ID NO: 3995950 - DNA, 17 bp, Homo sapiens
gttcctgacatcacagc

SEQ ID NO: 3995951 - DNA, 20 bp, Homo sapiens
gttcctgacatcacagcagc

SEQ ID NO: 3995952 - DNA, 21 bp, Homo sapiens
gttcctgacatcacagcagcc

SEQ ID NO: 3995953 - DNA, 23 bp, Homo sapiens
gttcctgacatcacagcagcctc

SEQ ID NO: 3995954 - DNA, 13 bp, Homo sapiens
gttcctggagttt

SEQ ID NO: 3995955 - DNA, 17 bp, Homo sapiens
gttccttatccctctct

SEQ ID NO: 3995956 - DNA, 19 bp, Homo sapiens
gttccttatccctctcttc

SEQ ID NO: 3995957 - DNA, 15 bp, Homo sapiens
gttccttctctgggt

SEQ ID NO: 3995958 - DNA, 17 bp, Homo sapiens
gttcctttttaaatgtg

SEQ ID NO: 3995959 - DNA, 20 bp, Homo sapiens
gttcctttttaaatgtgaat

SEQ ID NO: 3995960 - DNA, 16 bp, Homo sapiens
gtttttaaaatattta

SEQ ID NO: 3995961 - DNA, 18 bp, Homo sapiens
gtttttaaatgaggatta

SEQ ID NO: 3995962 - DNA, 17 bp, Homo sapiens
gtttttaaattgtttca

SEQ ID NO: 3995963 - DNA, 13 bp, Homo sapiens
gtttttaagctgt

SEQ ID NO: 3995964 - DNA, 14 bp, Homo sapiens
gtttttaagctgtt

SEQ ID NO: 3995965 - DNA, 19 bp, Homo sapiens
gtttttaagctgtttccat

SEQ ID NO: 3995966 - DNA, 18 bp, Homo sapiens
gtttttaagtaacttaag

SEQ ID NO: 3995967 - DNA, 20 bp, Homo sapiens
gtttttaatctttgtgacag

SEQ ID NO: 3995968 - DNA, 11 bp, Homo sapiens
gtttttacagc

SEQ ID NO: 3995969 - DNA, 13 bp, Homo sapiens
gtttttacagtta

SEQ ID NO: 3995970 - DNA, 20 bp, Homo sapiens
gtttttacctgtcacattgc

SEQ ID NO: 3995971 - DNA, 21 bp, Homo sapiens
gtttttacctgtcacattgca

SEQ ID NO: 3995972 - DNA, 23 bp, Homo sapiens
gtttttacctgtcacattgcatt

SEQ ID NO: 3995973 - DNA, 17 bp, Homo sapiens
gtttttattaatttata

SEQ ID NO: 3995974 - DNA, 22 bp, Homo sapiens
gtttttcagcacccccacccac

SEQ ID NO: 3995975 - DNA, 12 bp, Homo sapiens
gtttttcattca

SEQ ID NO: 3995976 - DNA, 19 bp, Homo sapiens
gtttttccctccccagaat

SEQ ID NO: 3995977 - DNA, 12 bp, Homo sapiens
gtttttcctccc

SEQ ID NO: 3995978 - DNA, 17 bp, Homo sapiens
gtttttctcatgtatct

SEQ ID NO: 3995979 - DNA, 18 bp, Homo sapiens
gtttttctttttccacaa

SEQ ID NO: 3995980 - DNA, 12 bp, Homo sapiens
gtttttgcaact

SEQ ID NO: 3995981 - DNA, 11 bp, Homo sapiens
gtttttgcttt

SEQ ID NO: 3995982 - DNA, 17 bp, Homo sapiens
gtttttgctttctgaaa

SEQ ID NO: 3995983 - DNA, 23 bp, Homo sapiens
gtttttgctttctgaaattcaca

SEQ ID NO: 3995984 - DNA, 15 bp, Homo sapiens
gtttttggtgtttct

SEQ ID NO: 3995985 - DNA, 12 bp, Homo sapiens
gtttttgtgctg

SEQ ID NO: 3995986 - DNA, 16 bp, Homo sapiens
gttttttagatcaaat

SEQ ID NO: 3995987 - DNA, 16 bp, Homo sapiens
gttttttatgaagtgc

SEQ ID NO: 3995988 - DNA, 14 bp, Homo sapiens
gttttttgccacag

SEQ ID NO: 3995989 - DNA, 22 bp, Homo sapiens
gttttttgttggagtgtttcta

SEQ ID NO: 3995990 - DNA, 10 bp, Homo sapiens
gtttttttgc

SEQ ID NO: 3995991 - DNA, 11 bp, Homo sapiens
gtttttttgcc

SEQ ID NO: 3995992 - DNA, 20 bp, Homo sapiens
gttttttttaaataaaagca

SEQ ID NO: 3995993 - DNA, 15 bp, Homo sapiens
gttttttttcagttg

SEQ ID NO: 3995994 - DNA, 17 bp, Homo sapiens
gttttttttttgtttgt

SEQ ID NO: 3995995 - DNA, 20 bp, Homo sapiens
gttttttttttttttatgtg

SEQ ID NO: 3995996 - DNA, 23 bp, Homo sapiens
gttttttttttttttatgtgatc

SEQ ID NO: 3995997 - DNA, 16 bp, Homo sapiens
taaaaaaaaaggcata

SEQ ID NO: 3995998 - DNA, 15 bp, Homo sapiens
taaaaaaaaatgcct

SEQ ID NO: 3995999 - DNA, 18 bp, Homo sapiens
taaaaaaaaatgcctttg

SEQ ID NO: 3996000 - DNA, 13 bp, Homo sapiens
taaaaaaatgaca

SEQ ID NO: 3996001 - DNA, 15 bp, Homo sapiens
taaaaaacagaaaaa

SEQ ID NO: 3996002 - DNA, 12 bp, Homo sapiens
taaaaaacattt

SEQ ID NO: 3996003 - DNA, 18 bp, Homo sapiens
taaaaaacatttttaatt

SEQ ID NO: 3996004 - DNA, 22 bp, Homo sapiens
taaaaaagcctggtttttctca

SEQ ID NO: 3996005 - DNA, 14 bp, Homo sapiens
taaaaaagccttcc

SEQ ID NO: 3996006 - DNA, 15 bp, Homo sapiens
taaaaaagccttcct

SEQ ID NO: 3996007 - DNA, 13 bp, Homo sapiens
taaaaaatggaaa

SEQ ID NO: 3996008 - DNA, 15 bp, Homo sapiens
taaaaaatggaaaaa

SEQ ID NO: 3996009 - DNA, 15 bp, Homo sapiens
taaaaaatggaaaga

SEQ ID NO: 3996010 - DNA, 18 bp, Homo sapiens
taaaaaattatgacaatg

SEQ ID NO: 3996011 - DNA, 18 bp, Homo sapiens
taaaaaattgaaaagatt

SEQ ID NO: 3996012 - DNA, 16 bp, Homo sapiens
taaaaacagcattgct

SEQ ID NO: 3996013 - DNA, 17 bp, Homo sapiens
taaaaacagcattgctt

SEQ ID NO: 3996014 - DNA, 18 bp, Homo sapiens
taaaaacagcattgcttt

SEQ ID NO: 3996015 - DNA, 15 bp, Homo sapiens
taaaaacattttgaa

SEQ ID NO: 3996016 - DNA, 23 bp, Homo sapiens
taaaaaccatgctggtatatggc

SEQ ID NO: 3996017 - DNA, 23 bp, Homo sapiens
taaaaagaaaagataaagatgat

SEQ ID NO: 3996018 - DNA, 14 bp, Homo sapiens
taaaaagcaaaaat

SEQ ID NO: 3996019 - DNA, 20 bp, Homo sapiens
taaaaagccactagactctt

SEQ ID NO: 3996020 - DNA, 23 bp, Homo sapiens
taaaaagccactagactcttcac

SEQ ID NO: 3996021 - DNA, 20 bp, Homo sapiens
taaaaagcttccatgattct

SEQ ID NO: 3996022 - DNA, 17 bp, Homo sapiens
taaaaaggctaaatgga

SEQ ID NO: 3996023 - DNA, 16 bp, Homo sapiens
taaaaagtatatgtta

SEQ ID NO: 3996024 - DNA, 18 bp, Homo sapiens
taaaaagtattttttcaa

SEQ ID NO: 3996025 - DNA, 14 bp, Homo sapiens
taaaaagtcttcac

SEQ ID NO: 3996026 - DNA, 19 bp, Homo sapiens
taaaaagtgagaaagaaag

SEQ ID NO: 3996027 - DNA, 17 bp, Homo sapiens
taaaaagttcagagttc

SEQ ID NO: 3996028 - DNA, 17 bp, Homo sapiens
taaaaatattcctccaa

SEQ ID NO: 3996029 - DNA, 21 bp, Homo sapiens
taaaaatattgtgttgtgaat

SEQ ID NO: 3996030 - DNA, 17 bp, Homo sapiens
taaaaatatttcagata

SEQ ID NO: 3996031 - DNA, 21 bp, Homo sapiens
taaaaatatttcagatatcaa

SEQ ID NO: 3996032 - DNA, 16 bp, Homo sapiens
taaaaatcacactgta

SEQ ID NO: 3996033 - DNA, 16 bp, Homo sapiens
taaaaatgaaagtgac

SEQ ID NO: 3996034 - DNA, 22 bp, Homo sapiens
taaaaatgaaagtgactttaaa

SEQ ID NO: 3996035 - DNA, 15 bp, Homo sapiens
taaaaatgaggtact

SEQ ID NO: 3996036 - DNA, 22 bp, Homo sapiens
taaaaatggaaactatattgac

SEQ ID NO: 3996037 - DNA, 20 bp, Homo sapiens
taaaaatggcaaatgcactg

SEQ ID NO: 3996038 - DNA, 20 bp, Homo sapiens
taaaaatgtaaatattctat

SEQ ID NO: 3996039 - DNA, 21 bp, Homo sapiens
taaaaatgtaaatattctata

SEQ ID NO: 3996040 - DNA, 18 bp, Homo sapiens
taaaaatgttagtatttt

SEQ ID NO: 3996041 - DNA, 14 bp, Homo sapiens
taaaaattctgaat

SEQ ID NO: 3996042 - DNA, 23 bp, Homo sapiens
taaaacaaaatctgaactctcaa

SEQ ID NO: 3996043 - DNA, 14 bp, Homo sapiens
taaaacacagcttt

SEQ ID NO: 3996044 - DNA, 23 bp, Homo sapiens
taaaacacattatgtatcttagt

SEQ ID NO: 3996045 - DNA, 23 bp, Homo sapiens
taaaacagctgtctctaacttat

SEQ ID NO: 3996046 - DNA, 12 bp, Homo sapiens
taaaacattaat

SEQ ID NO: 3996047 - DNA, 14 bp, Homo sapiens
taaaacgataaaaa

SEQ ID NO: 3996048 - DNA, 21 bp, Homo sapiens
taaaactaagctctttgagaa

SEQ ID NO: 3996049 - DNA, 22 bp, Homo sapiens
taaaactaggtaatgttttgta

SEQ ID NO: 3996050 - DNA, 22 bp, Homo sapiens
taaaactatattcatttccact

SEQ ID NO: 3996051 - DNA, 21 bp, Homo sapiens
taaaactatggttcccaataa

SEQ ID NO: 3996052 - DNA, 22 bp, Homo sapiens
taaaactatggttcccaataaa

SEQ ID NO: 3996053 - DNA, 23 bp, Homo sapiens
taaaactatggttcccaataaaa

SEQ ID NO: 3996054 - DNA, 17 bp, Homo sapiens
taaaactcactgtgatc

SEQ ID NO: 3996055 - DNA, 16 bp, Homo sapiens
taaaactggcctgact

SEQ ID NO: 3996056 - DNA, 20 bp, Homo sapiens
taaaacttacctaagtgaca

SEQ ID NO: 3996057 - DNA, 20 bp, Homo sapiens
taaaacttctcaagatactg

SEQ ID NO: 3996058 - DNA, 13 bp, Homo sapiens
taaaacttcttaa

SEQ ID NO: 3996059 - DNA, 15 bp, Homo sapiens
taaaactttgctgcc

SEQ ID NO: 3996060 - DNA, 19 bp, Homo sapiens
taaaagaacttactgatta

SEQ ID NO: 3996061 - DNA, 19 bp, Homo sapiens
taaaagaatttttttgtct

SEQ ID NO: 3996062 - DNA, 19 bp, Homo sapiens
taaatatatgtctgataat

SEQ ID NO: 3996063 - DNA, 22 bp, Homo sapiens
taaatatctgtacttcttcgat

SEQ ID NO: 3996064 - DNA, 15 bp, Homo sapiens
taaatatcttttatg

SEQ ID NO: 3996065 - DNA, 17 bp, Homo sapiens
taaatatcttttatgtt

SEQ ID NO: 3996066 - DNA, 20 bp, Homo sapiens
taaatatcttttatgtttga

SEQ ID NO: 3996067 - DNA, 22 bp, Homo sapiens
taaatatgaatctgctcacttt

SEQ ID NO: 3996068 - DNA, 18 bp, Homo sapiens
taaatattgaggctttgt

SEQ ID NO: 3996069 - DNA, 13 bp, Homo sapiens
taaatcacacatt

SEQ ID NO: 3996070 - DNA, 14 bp, Homo sapiens
taaatcacacattc

SEQ ID NO: 3996071 - DNA, 16 bp, Homo sapiens
taaatcagaataaatt

SEQ ID NO: 3996072 - DNA, 20 bp, Homo sapiens
taaatcatattagtattaat

SEQ ID NO: 3996073 - DNA, 20 bp, Homo sapiens
taaatcatattgatgaaaag

SEQ ID NO: 3996074 - DNA, 23 bp, Homo sapiens
taaatcatttcagtatcatctcc

SEQ ID NO: 3996075 - DNA, 14 bp, Homo sapiens
taaatccaataaaa

SEQ ID NO: 3996076 - DNA, 19 bp, Homo sapiens
taaatcctttttctttata

SEQ ID NO: 3996077 - DNA, 18 bp, Homo sapiens
taaatctatttattaata

SEQ ID NO: 3996078 - DNA, 19 bp, Homo sapiens
taaatctatttattaatat

SEQ ID NO: 3996079 - DNA, 20 bp, Homo sapiens
taaatctatttattaatatt

SEQ ID NO: 3996080 - DNA, 17 bp, Homo sapiens
taaatctcaaatttatt

SEQ ID NO: 3996081 - DNA, 14 bp, Homo sapiens
taaatctcttctgt

SEQ ID NO: 3996082 - DNA, 16 bp, Homo sapiens
taaatctgacccagtg

SEQ ID NO: 3996083 - DNA, 12 bp, Homo sapiens
taaatctgccac

SEQ ID NO: 3996084 - DNA, 19 bp, Homo sapiens
taaatcttccttgtgagga

SEQ ID NO: 3996085 - DNA, 18 bp, Homo sapiens
taaatgaaatttgcaaaa

SEQ ID NO: 3996086 - DNA, 14 bp, Homo sapiens
taaatgaagattac

SEQ ID NO: 3996087 - DNA, 22 bp, Homo sapiens
taaatgaagcagctttaaacaa

SEQ ID NO: 3996088 - DNA, 12 bp, Homo sapiens
taaatgaatgtt

SEQ ID NO: 3996089 - DNA, 16 bp, Homo sapiens
taaatgagctcctgcg

SEQ ID NO: 3996090 - DNA, 16 bp, Homo sapiens
taaatgattttatgtt

SEQ ID NO: 3996091 - DNA, 16 bp, Homo sapiens
taaatgcagttttaag

SEQ ID NO: 3996092 - DNA, 10 bp, Homo sapiens
taaatgcata

SEQ ID NO: 3996093 - DNA, 13 bp, Homo sapiens
taaatgctatttt

SEQ ID NO: 3996094 - DNA, 17 bp, Homo sapiens
taaatgctcattttctg

SEQ ID NO: 3996095 - DNA, 15 bp, Homo sapiens
taaatggcagtattt

SEQ ID NO: 3996096 - DNA, 15 bp, Homo sapiens
taaatggtgtacata

SEQ ID NO: 3996097 - DNA, 16 bp, Homo sapiens
taaatggtgtacataa

SEQ ID NO: 3996098 - DNA, 17 bp, Homo sapiens
taaatggtgtacataat

SEQ ID NO: 3996099 - DNA, 21 bp, Homo sapiens
taaatggtttctgaaaatgtt

SEQ ID NO: 3996100 - DNA, 17 bp, Homo sapiens
taaatgtatactatagt

SEQ ID NO: 3996101 - DNA, 14 bp, Homo sapiens
taaatgtctttgta

SEQ ID NO: 3996102 - DNA, 10 bp, Homo sapiens
taaatgtgaa

SEQ ID NO: 3996103 - DNA, 11 bp, Homo sapiens
taaatgtgaat

SEQ ID NO: 3996104 - DNA, 23 bp, Homo sapiens
taaatgtgatatgattggcaata

SEQ ID NO: 3996105 - DNA, 14 bp, Homo sapiens
taaatgtgtacaat

SEQ ID NO: 3996106 - DNA, 22 bp, Homo sapiens
taaatgttctatggttatgaaa

SEQ ID NO: 3996107 - DNA, 20 bp, Homo sapiens
taaatgttgaaagatcaaaa

SEQ ID NO: 3996108 - DNA, 14 bp, Homo sapiens
taaatgttttataa

SEQ ID NO: 3996109 - DNA, 14 bp, Homo sapiens
taaattaggaataa

SEQ ID NO: 3996110 - DNA, 21 bp, Homo sapiens
taaattaggaataaataaaaa

SEQ ID NO: 3996111 - DNA, 22 bp, Homo sapiens
taaattaggaataaataaaaat

SEQ ID NO: 3996112 - DNA, 13 bp, Homo sapiens
taaattaggcagt

SEQ ID NO: 3996113 - DNA, 18 bp, Homo sapiens
taaattagtatttattta

SEQ ID NO: 3996114 - DNA, 21 bp, Homo sapiens
taaattatttgctaagcatat

SEQ ID NO: 3996115 - DNA, 20 bp, Homo sapiens
taaattcaaccactgtaaaa

SEQ ID NO: 3996116 - DNA, 16 bp, Homo sapiens
taaattcacaaacttt

SEQ ID NO: 3996117 - DNA, 22 bp, Homo sapiens
taaattctgagacatgtgtcaa

SEQ ID NO: 3996118 - DNA, 19 bp, Homo sapiens
taaattgaatcagtataaa

SEQ ID NO: 3996119 - DNA, 22 bp, Homo sapiens
taaattgaatcagtataaacaa

SEQ ID NO: 3996120 - DNA, 16 bp, Homo sapiens
taaattgcaacatatt

SEQ ID NO: 3996121 - DNA, 17 bp, Homo sapiens
taaattgcaacatatta

SEQ ID NO: 3996122 - DNA, 13 bp, Homo sapiens
taaattgctctgt

SEQ ID NO: 3996123 - DNA, 20 bp, Homo sapiens
taaattgtaccatcatttta

SEQ ID NO: 3996124 - DNA, 22 bp, Homo sapiens
taaattgtagggctttagcttt

SEQ ID NO: 3996125 - DNA, 17 bp, Homo sapiens
taaatttatttcaaaaa

SEQ ID NO: 3996126 - DNA, 18 bp, Homo sapiens
taaatttccatatccttc

SEQ ID NO: 3996127 - DNA, 18 bp, Homo sapiens
taaatttcttatgtgaca

SEQ ID NO: 3996128 - DNA, 15 bp, Homo sapiens
taaatttgtaagttt

SEQ ID NO: 3996129 - DNA, 23 bp, Homo sapiens
taaatttgtaagtttcaggtgac

SEQ ID NO: 3996130 - DNA, 20 bp, Homo sapiens
taaattttgtctttaactca

SEQ ID NO: 3996131 - DNA, 19 bp, Homo sapiens
taaatttttaggcaaagat

SEQ ID NO: 3996132 - DNA, 14 bp, Homo sapiens
taacaaaagatgaa

SEQ ID NO: 3996133 - DNA, 20 bp, Homo sapiens
taacaaaagatgaaagcagg

SEQ ID NO: 3996134 - DNA, 13 bp, Homo sapiens
taacaaaatggac

SEQ ID NO: 3996135 - DNA, 16 bp, Homo sapiens
taacaaactaaaaata

SEQ ID NO: 3996136 - DNA, 17 bp, Homo sapiens
taacaagatctttcagg

SEQ ID NO: 3996137 - DNA, 18 bp, Homo sapiens
taacaagatctttcagga

SEQ ID NO: 3996138 - DNA, 12 bp, Homo sapiens
taacaaggaatg

SEQ ID NO: 3996139 - DNA, 22 bp, Homo sapiens
taacaaggaatgcctgtgccaa

SEQ ID NO: 3996140 - DNA, 18 bp, Homo sapiens
taacaataactactgtgt

SEQ ID NO: 3996141 - DNA, 21 bp, Homo sapiens
taacaataactactgtgttcc

SEQ ID NO: 3996142 - DNA, 19 bp, Homo sapiens
taacaatacaaatggattt

SEQ ID NO: 3996143 - DNA, 20 bp, Homo sapiens
taacaatgcagcaaggccct

SEQ ID NO: 3996144 - DNA, 12 bp, Homo sapiens
taacaatgttaa

SEQ ID NO: 3996145 - DNA, 15 bp, Homo sapiens
taacaatgttaagga

SEQ ID NO: 3996146 - DNA, 21 bp, Homo sapiens
taacaatgttaaggaaactct

SEQ ID NO: 3996147 - DNA, 22 bp, Homo sapiens
taacaatgttaaggaaactctt

SEQ ID NO: 3996148 - DNA, 18 bp, Homo sapiens
taacaattgtgtagcctt

SEQ ID NO: 3996149 - DNA, 13 bp, Homo sapiens
taacacaaaggaa

SEQ ID NO: 3996150 - DNA, 15 bp, Homo sapiens
taacacacacagaaa

SEQ ID NO: 3996151 - DNA, 12 bp, Homo sapiens
taacacagagag

SEQ ID NO: 3996152 - DNA, 13 bp, Homo sapiens
taacacataaaca

SEQ ID NO: 3996153 - DNA, 15 bp, Homo sapiens
taacacataaacaat

SEQ ID NO: 3996154 - DNA, 18 bp, Homo sapiens
taacaccaatcccagggc

SEQ ID NO: 3996155 - DNA, 18 bp, Homo sapiens
taacactaaaattttagg

SEQ ID NO: 3996156 - DNA, 19 bp, Homo sapiens
taacactatgtttatttac

SEQ ID NO: 3996157 - DNA, 17 bp, Homo sapiens
taacagaacagcttcag

SEQ ID NO: 3996158 - DNA, 20 bp, Homo sapiens
taacagaacagcttcaggtt

SEQ ID NO: 3996159 - DNA, 22 bp, Homo sapiens
taacagaacagcttcaggttat

SEQ ID NO: 3996160 - DNA, 21 bp, Homo sapiens
taacagcaacagcaagaaata

SEQ ID NO: 3996161 - DNA, 22 bp, Homo sapiens
taacagcattcttgtcacaata

SEQ ID NO: 3996162 - DNA, 12 bp, Homo sapiens
taacagctgagg

SEQ ID NO: 3996163 - DNA, 14 bp, Homo sapiens
taacaggatgaaag

SEQ ID NO: 3996164 - DNA, 15 bp, Homo sapiens
taacaggcatttgtt

SEQ ID NO: 3996165 - DNA, 18 bp, Homo sapiens
taatcctttgttttctga

SEQ ID NO: 3996166 - DNA, 15 bp, Homo sapiens
taatccttttcctta

SEQ ID NO: 3996167 - DNA, 17 bp, Homo sapiens
taatccttttccttatt

SEQ ID NO: 3996168 - DNA, 20 bp, Homo sapiens
taatccttttccttatttgc

SEQ ID NO: 3996169 - DNA, 18 bp, Homo sapiens
taatctaggtgtggctgt

SEQ ID NO: 3996170 - DNA, 20 bp, Homo sapiens
taatctctctgcagctgccg

SEQ ID NO: 3996171 - DNA, 21 bp, Homo sapiens
taatctgaataaagtgtaaca

SEQ ID NO: 3996172 - DNA, 21 bp, Homo sapiens
taatctgagctgcagcctggc

SEQ ID NO: 3996173 - DNA, 23 bp, Homo sapiens
taatctgagctgcagcctggctg

SEQ ID NO: 3996174 - DNA, 17 bp, Homo sapiens
taatctgtagggctgga

SEQ ID NO: 3996175 - DNA, 16 bp, Homo sapiens
taatcttaaatcagaa

SEQ ID NO: 3996176 - DNA, 19 bp, Homo sapiens
taatcttaggggagagctt

SEQ ID NO: 3996177 - DNA, 21 bp, Homo sapiens
taatctttcacttgaaagatt

SEQ ID NO: 3996178 - DNA, 15 bp, Homo sapiens
taatgaaaatgtcag

SEQ ID NO: 3996179 - DNA, 18 bp, Homo sapiens
taatgaaagactgtacaa

SEQ ID NO: 3996180 - DNA, 19 bp, Homo sapiens
taatgaaataatcagtgac

SEQ ID NO: 3996181 - DNA, 22 bp, Homo sapiens
taatgaagggaaaggatatttt

SEQ ID NO: 3996182 - DNA, 18 bp, Homo sapiens
taatgagcaatatctgct

SEQ ID NO: 3996183 - DNA, 21 bp, Homo sapiens
taatgataaaataaataattt

SEQ ID NO: 3996184 - DNA, 16 bp, Homo sapiens
taatgatttgctcttt

SEQ ID NO: 3996185 - DNA, 20 bp, Homo sapiens
taatgatttgctctttgaca

SEQ ID NO: 3996186 - DNA, 22 bp, Homo sapiens
taatgcatctagattatggagc

SEQ ID NO: 3996187 - DNA, 18 bp, Homo sapiens
taatgcattcttctctgt

SEQ ID NO: 3996188 - DNA, 22 bp, Homo sapiens
taatgccccaaggacaaggggc

SEQ ID NO: 3996189 - DNA, 16 bp, Homo sapiens
taatgcctctcccgca

SEQ ID NO: 3996190 - DNA, 17 bp, Homo sapiens
taatgcctctcccgcac

SEQ ID NO: 3996191 - DNA, 19 bp, Homo sapiens
taatgctaatttaaagaga

SEQ ID NO: 3996192 - DNA, 20 bp, Homo sapiens
taatgcttccaatcttgctt

SEQ ID NO: 3996193 - DNA, 22 bp, Homo sapiens
taatgcttccaatcttgctttg

SEQ ID NO: 3996194 - DNA, 17 bp, Homo sapiens
taatgctttcacaacat

SEQ ID NO: 3996195 - DNA, 20 bp, Homo sapiens
taatggaagtgtatttattt

SEQ ID NO: 3996196 - DNA, 17 bp, Homo sapiens
taatggcagctagtgcc

SEQ ID NO: 3996197 - DNA, 15 bp, Homo sapiens
taatgggattttctt

SEQ ID NO: 3996198 - DNA, 23 bp, Homo sapiens
taatggtactgactttgcttgct

SEQ ID NO: 3996199 - DNA, 14 bp, Homo sapiens
taatggtttttatt

SEQ ID NO: 3996200 - DNA, 13 bp, Homo sapiens
taatgtaaaatga

SEQ ID NO: 3996201 - DNA, 23 bp, Homo sapiens
taatgtaaactttgtcatggttt

SEQ ID NO: 3996202 - DNA, 16 bp, Homo sapiens
taatgtaagctctact

SEQ ID NO: 3996203 - DNA, 17 bp, Homo sapiens
taatgtaagctctactg

SEQ ID NO: 3996204 - DNA, 15 bp, Homo sapiens
taatgtacatctggc

SEQ ID NO: 3996205 - DNA, 23 bp, Homo sapiens
taatgtagcgtgtttacatgtgt

SEQ ID NO: 3996206 - DNA, 15 bp, Homo sapiens
taatgtcttcataaa

SEQ ID NO: 3996207 - DNA, 16 bp, Homo sapiens
taatgtgaaaagtatc

SEQ ID NO: 3996208 - DNA, 16 bp, Homo sapiens
taatgtgaagacattt

SEQ ID NO: 3996209 - DNA, 13 bp, Homo sapiens
taatgttaaattt

SEQ ID NO: 3996210 - DNA, 17 bp, Homo sapiens
taatgttaaatttgtaa

SEQ ID NO: 3996211 - DNA, 20 bp, Homo sapiens
taatgttaaatttgtaagtt

SEQ ID NO: 3996212 - DNA, 11 bp, Homo sapiens
taatgttactg

SEQ ID NO: 3996213 - DNA, 13 bp, Homo sapiens
taatgttactgat

SEQ ID NO: 3996214 - DNA, 18 bp, Homo sapiens
taatgttgttatttaaag

SEQ ID NO: 3996215 - DNA, 11 bp, Homo sapiens
taatgtttaaa

SEQ ID NO: 3996216 - DNA, 12 bp, Homo sapiens
taatgtttaaat

SEQ ID NO: 3996217 - DNA, 14 bp, Homo sapiens
taatgtttaaatca

SEQ ID NO: 3996218 - DNA, 15 bp, Homo sapiens
taatgtttaaatcat

SEQ ID NO: 3996219 - DNA, 22 bp, Homo sapiens
taatgtttatgagccagacaaa

SEQ ID NO: 3996220 - DNA, 17 bp, Homo sapiens
taatgtttctatctgat

SEQ ID NO: 3996221 - DNA, 13 bp, Homo sapiens
taatgttttgtat

SEQ ID NO: 3996222 - DNA, 21 bp, Homo sapiens
taatgttttttgccacagctt

SEQ ID NO: 3996223 - DNA, 22 bp, Homo sapiens
taattaaataaatcattaatac

SEQ ID NO: 3996224 - DNA, 14 bp, Homo sapiens
taattaaatgtatt

SEQ ID NO: 3996225 - DNA, 14 bp, Homo sapiens
taattaagtactat

SEQ ID NO: 3996226 - DNA, 13 bp, Homo sapiens
taattaatttgat

SEQ ID NO: 3996227 - DNA, 16 bp, Homo sapiens
taattaatttgattaa

SEQ ID NO: 3996228 - DNA, 19 bp, Homo sapiens
taattaatttgattaacaa

SEQ ID NO: 3996229 - DNA, 21 bp, Homo sapiens
taattaatttgattaacaaat

SEQ ID NO: 3996230 - DNA, 22 bp, Homo sapiens
taattaatttgattaacaaata

SEQ ID NO: 3996231 - DNA, 23 bp, Homo sapiens
taattaatttgattaacaaatat

SEQ ID NO: 3996232 - DNA, 22 bp, Homo sapiens
taattaggcaaggctatgtgat

SEQ ID NO: 3996233 - DNA, 17 bp, Homo sapiens
taattaggggttgctaa

SEQ ID NO: 3996234 - DNA, 21 bp, Homo sapiens
taattagggtacatttataat

SEQ ID NO: 3996235 - DNA, 19 bp, Homo sapiens
taattatcgggaacagtgt

SEQ ID NO: 3996236 - DNA, 19 bp, Homo sapiens
taattattaactacattta

SEQ ID NO: 3996237 - DNA, 20 bp, Homo sapiens
taattattaactacatttat

SEQ ID NO: 3996238 - DNA, 12 bp, Homo sapiens
taattattattc

SEQ ID NO: 3996239 - DNA, 14 bp, Homo sapiens
taattattattctt

SEQ ID NO: 3996240 - DNA, 12 bp, Homo sapiens
taattattattt

SEQ ID NO: 3996241 - DNA, 17 bp, Homo sapiens
taattattatttatata

SEQ ID NO: 3996242 - DNA, 14 bp, Homo sapiens
taattatttaaata

SEQ ID NO: 3996243 - DNA, 18 bp, Homo sapiens
taattatttcactttaga

SEQ ID NO: 3996244 - DNA, 13 bp, Homo sapiens
taattattttaaa

SEQ ID NO: 3996245 - DNA, 20 bp, Homo sapiens
taattattttaaaatattta

SEQ ID NO: 3996246 - DNA, 20 bp, Homo sapiens
taattattttggtactttta

SEQ ID NO: 3996247 - DNA, 21 bp, Homo sapiens
taattattttggtacttttat

SEQ ID NO: 3996248 - DNA, 19 bp, Homo sapiens
taattcatcccaactgtct

SEQ ID NO: 3996249 - DNA, 17 bp, Homo sapiens
taattccacacctttta

SEQ ID NO: 3996250 - DNA, 18 bp, Homo sapiens
taattcccattttgcaaa

SEQ ID NO: 3996251 - DNA, 19 bp, Homo sapiens
taattcccattttgcaaaa

SEQ ID NO: 3996252 - DNA, 21 bp, Homo sapiens
taattcccattttgcaaaatt

SEQ ID NO: 3996253 - DNA, 15 bp, Homo sapiens
taattcctcttttta

SEQ ID NO: 3996254 - DNA, 14 bp, Homo sapiens
taattctcatttgt

SEQ ID NO: 3996255 - DNA, 17 bp, Homo sapiens
taattctggagatactg

SEQ ID NO: 3996256 - DNA, 13 bp, Homo sapiens
taattctgtaaat

SEQ ID NO: 3996257 - DNA, 17 bp, Homo sapiens
taattcttcacctgtta

SEQ ID NO: 3996258 - DNA, 22 bp, Homo sapiens
taattcttcagcgtaaaatggt

SEQ ID NO: 3996259 - DNA, 15 bp, Homo sapiens
taattcttctgtcct

SEQ ID NO: 3996260 - DNA, 22 bp, Homo sapiens
taattgacaggattattggaaa

SEQ ID NO: 3996261 - DNA, 19 bp, Homo sapiens
taattgatcaaattcattt

SEQ ID NO: 3996262 - DNA, 23 bp, Homo sapiens
taattgcagataactttgacttt

SEQ ID NO: 3996263 - DNA, 18 bp, Homo sapiens
taattgcatctcaaaatt

SEQ ID NO: 3996264 - DNA, 17 bp, Homo sapiens
taattgcatttgctttt

SEQ ID NO: 3996265 - DNA, 23 bp, Homo sapiens
taattgcttacatttttacaata

SEQ ID NO: 3996266 - DNA, 21 bp, Homo sapiens
taattgtgaaaaagttaaaca

SEQ ID NO: 3996267 - DNA, 22 bp, Homo sapiens
tacatatgagtgtggaagccgg

SEQ ID NO: 3996268 - DNA, 12 bp, Homo sapiens
tacatatgtaaa

SEQ ID NO: 3996269 - DNA, 14 bp, Homo sapiens
tacatattactgtt

SEQ ID NO: 3996270 - DNA, 18 bp, Homo sapiens
tacatattactgttgcat

SEQ ID NO: 3996271 - DNA, 23 bp, Homo sapiens
tacatattactgttgcatttact

SEQ ID NO: 3996272 - DNA, 17 bp, Homo sapiens
tacatatttattttctt

SEQ ID NO: 3996273 - DNA, 17 bp, Homo sapiens
tacatatttgagactag

SEQ ID NO: 3996274 - DNA, 12 bp, Homo sapiens
tacatcactgct

SEQ ID NO: 3996275 - DNA, 23 bp, Homo sapiens
tacatcactgcttgatgaagcaa

SEQ ID NO: 3996276 - DNA, 20 bp, Homo sapiens
tacatccaaagcagacagct

SEQ ID NO: 3996277 - DNA, 14 bp, Homo sapiens
tacatcccagcctg

SEQ ID NO: 3996278 - DNA, 20 bp, Homo sapiens
tacatctattttggattgta

SEQ ID NO: 3996279 - DNA, 23 bp, Homo sapiens
tacatctattttggattgtatat

SEQ ID NO: 3996280 - DNA, 17 bp, Homo sapiens
tacatcttctgtgaaat

SEQ ID NO: 3996281 - DNA, 22 bp, Homo sapiens
tacatcttctgtgaaatataat

SEQ ID NO: 3996282 - DNA, 15 bp, Homo sapiens
tacatcttcttccca

SEQ ID NO: 3996283 - DNA, 14 bp, Homo sapiens
tacatgaatacaaa

SEQ ID NO: 3996284 - DNA, 16 bp, Homo sapiens
tacatgactgggcctc

SEQ ID NO: 3996285 - DNA, 16 bp, Homo sapiens
tacatgcaaaaagaaa

SEQ ID NO: 3996286 - DNA, 22 bp, Homo sapiens
tacatgcagcccatgcccacct

SEQ ID NO: 3996287 - DNA, 14 bp, Homo sapiens
tacatggaataaca

SEQ ID NO: 3996288 - DNA, 18 bp, Homo sapiens
tacatggaataacatgta

SEQ ID NO: 3996289 - DNA, 19 bp, Homo sapiens
tacatgtattgcacattgt

SEQ ID NO: 3996290 - DNA, 20 bp, Homo sapiens
tacatgtgtttattcatcca

SEQ ID NO: 3996291 - DNA, 13 bp, Homo sapiens
tacattaaaacta

SEQ ID NO: 3996292 - DNA, 20 bp, Homo sapiens
tacattaatgttaattcagc

SEQ ID NO: 3996293 - DNA, 20 bp, Homo sapiens
tacattagcagtttgctttg

SEQ ID NO: 3996294 - DNA, 14 bp, Homo sapiens
tacattagtaaatg

SEQ ID NO: 3996295 - DNA, 18 bp, Homo sapiens
tacattagtaaatgtctt

SEQ ID NO: 3996296 - DNA, 15 bp, Homo sapiens
tacattcaatgttta

SEQ ID NO: 3996297 - DNA, 17 bp, Homo sapiens
tacattccctctcctgc

SEQ ID NO: 3996298 - DNA, 14 bp, Homo sapiens
tacattgttcaatt

SEQ ID NO: 3996299 - DNA, 23 bp, Homo sapiens
tacattgttgagctattgctgtt

SEQ ID NO: 3996300 - DNA, 16 bp, Homo sapiens
tacatttaaagcattg

SEQ ID NO: 3996301 - DNA, 20 bp, Homo sapiens
tacatttaaagcattgctgt

SEQ ID NO: 3996302 - DNA, 22 bp, Homo sapiens
tacatttaaagcattgctgtta

SEQ ID NO: 3996303 - DNA, 12 bp, Homo sapiens
tacatttataat

SEQ ID NO: 3996304 - DNA, 14 bp, Homo sapiens
tacatttataattg

SEQ ID NO: 3996305 - DNA, 12 bp, Homo sapiens
tacatttatgat

SEQ ID NO: 3996306 - DNA, 14 bp, Homo sapiens
tacatttatgattt

SEQ ID NO: 3996307 - DNA, 19 bp, Homo sapiens
tacatttatgatttaataa

SEQ ID NO: 3996308 - DNA, 20 bp, Homo sapiens
tacatttatgatttaataaa

SEQ ID NO: 3996309 - DNA, 23 bp, Homo sapiens
tacatttatgatttaataaaata

SEQ ID NO: 3996310 - DNA, 15 bp, Homo sapiens
tacatttatttatta

SEQ ID NO: 3996311 - DNA, 19 bp, Homo sapiens
tacatttatttattactgt

SEQ ID NO: 3996312 - DNA, 16 bp, Homo sapiens
tacatttttacaataa

SEQ ID NO: 3996313 - DNA, 17 bp, Homo sapiens
tacatttttacaataaa

SEQ ID NO: 3996314 - DNA, 20 bp, Homo sapiens
tacatttttagcctgtgtca

SEQ ID NO: 3996315 - DNA, 20 bp, Homo sapiens
tacattttttgggcagcaat

SEQ ID NO: 3996316 - DNA, 17 bp, Homo sapiens
taccaaatctgacatat

SEQ ID NO: 3996317 - DNA, 18 bp, Homo sapiens
taccaaatctgacatatt

SEQ ID NO: 3996318 - DNA, 17 bp, Homo sapiens
taccaagagtaacttta

SEQ ID NO: 3996319 - DNA, 23 bp, Homo sapiens
taccaagagtaactttactctgt

SEQ ID NO: 3996320 - DNA, 18 bp, Homo sapiens
taccaaggtcttcttaat

SEQ ID NO: 3996321 - DNA, 14 bp, Homo sapiens
taccaagtcaaact

SEQ ID NO: 3996322 - DNA, 23 bp, Homo sapiens
taccacagacacaatatgtatgc

SEQ ID NO: 3996323 - DNA, 18 bp, Homo sapiens
taccacggcctcctttcc

SEQ ID NO: 3996324 - DNA, 15 bp, Homo sapiens
taccactttcttatt

SEQ ID NO: 3996325 - DNA, 21 bp, Homo sapiens
taccactttcttattctgtat

SEQ ID NO: 3996326 - DNA, 18 bp, Homo sapiens
taccagagacgcccagcc

SEQ ID NO: 3996327 - DNA, 19 bp, Homo sapiens
taccagagacgcccagccc

SEQ ID NO: 3996328 - DNA, 16 bp, Homo sapiens
taccagcaaagcaaat

SEQ ID NO: 3996329 - DNA, 14 bp, Homo sapiens
taccagctgcgctt

SEQ ID NO: 3996330 - DNA, 21 bp, Homo sapiens
taccagctgcgcttgcttttc

SEQ ID NO: 3996331 - DNA, 17 bp, Homo sapiens
taccaggcaaattcact

SEQ ID NO: 3996332 - DNA, 19 bp, Homo sapiens
taccaggtattattatctt

SEQ ID NO: 3996333 - DNA, 15 bp, Homo sapiens
taccagttaattact

SEQ ID NO: 3996334 - DNA, 16 bp, Homo sapiens
taccagttggcagaca

SEQ ID NO: 3996335 - DNA, 14 bp, Homo sapiens
taccagtttgctga

SEQ ID NO: 3996336 - DNA, 21 bp, Homo sapiens
taccatcatccggtttagtca

SEQ ID NO: 3996337 - DNA, 15 bp, Homo sapiens
taccatgaaacaaag

SEQ ID NO: 3996338 - DNA, 22 bp, Homo sapiens
taccatgagaagagggcctgtg

SEQ ID NO: 3996339 - DNA, 13 bp, Homo sapiens
taccattcagatc

SEQ ID NO: 3996340 - DNA, 23 bp, Homo sapiens
taccattcagtgattactgtcaa

SEQ ID NO: 3996341 - DNA, 13 bp, Homo sapiens
taccatttgtaat

SEQ ID NO: 3996342 - DNA, 18 bp, Homo sapiens
taccatttgtaataaagt

SEQ ID NO: 3996343 - DNA, 22 bp, Homo sapiens
taccatttgtaataaagtatat

SEQ ID NO: 3996344 - DNA, 17 bp, Homo sapiens
taccatttttctggatt

SEQ ID NO: 3996345 - DNA, 13 bp, Homo sapiens
tacccaaccactc

SEQ ID NO: 3996346 - DNA, 21 bp, Homo sapiens
tacccaaccactcaaattaat

SEQ ID NO: 3996347 - DNA, 13 bp, Homo sapiens
tacccaatttccc

SEQ ID NO: 3996348 - DNA, 20 bp, Homo sapiens
tacccacccgacctggctgc

SEQ ID NO: 3996349 - DNA, 18 bp, Homo sapiens
tacccaccgatggagccc

SEQ ID NO: 3996350 - DNA, 23 bp, Homo sapiens
tacccaccgatggagcccccaga

SEQ ID NO: 3996351 - DNA, 17 bp, Homo sapiens
tacccactcggtcccag

SEQ ID NO: 3996352 - DNA, 16 bp, Homo sapiens
tacccaggaccaagcc

SEQ ID NO: 3996353 - DNA, 18 bp, Homo sapiens
tacccaggctggagtgca

SEQ ID NO: 3996354 - DNA, 18 bp, Homo sapiens
tacccatgactttatatg

SEQ ID NO: 3996355 - DNA, 15 bp, Homo sapiens
tacccatgagcctgc

SEQ ID NO: 3996356 - DNA, 17 bp, Homo sapiens
tacccatgagcctgccc

SEQ ID NO: 3996357 - DNA, 16 bp, Homo sapiens
tacccattctgttttc

SEQ ID NO: 3996358 - DNA, 18 bp, Homo sapiens
taccccaatttcggattt

SEQ ID NO: 3996359 - DNA, 22 bp, Homo sapiens
tacccccaggaaactagctttt

SEQ ID NO: 3996360 - DNA, 15 bp, Homo sapiens
tacccccctctgtct

SEQ ID NO: 3996361 - DNA, 13 bp, Homo sapiens
taccccctccttc

SEQ ID NO: 3996362 - DNA, 18 bp, Homo sapiens
taccccctccttcagaca

SEQ ID NO: 3996363 - DNA, 19 bp, Homo sapiens
tacccccttttcagctgag

SEQ ID NO: 3996364 - DNA, 20 bp, Homo sapiens
taccccttctttgcagggct

SEQ ID NO: 3996365 - DNA, 13 bp, Homo sapiens
taccctaatgtct

SEQ ID NO: 3996366 - DNA, 17 bp, Homo sapiens
taccctaatgtcttcat

SEQ ID NO: 3996367 - DNA, 14 bp, Homo sapiens
taccctcaaatgct

SEQ ID NO: 3996368 - DNA, 23 bp, Homo sapiens
taccctcaggcataggcctgggt

SEQ ID NO: 3996369 - DNA, 21 bp, Homo sapiens
tactttaaaggaaaaaatgtt

SEQ ID NO: 3996370 - DNA, 22 bp, Homo sapiens
tactttaattactggaattctt

SEQ ID NO: 3996371 - DNA, 18 bp, Homo sapiens
tactttattaatatgagt

SEQ ID NO: 3996372 - DNA, 14 bp, Homo sapiens
tactttatttctga

SEQ ID NO: 3996373 - DNA, 23 bp, Homo sapiens
tactttccacaaatctataaaga

SEQ ID NO: 3996374 - DNA, 19 bp, Homo sapiens
tactttgaaaccagaaaat

SEQ ID NO: 3996375 - DNA, 19 bp, Homo sapiens
tactttggtttctgtctgt

SEQ ID NO: 3996376 - DNA, 20 bp, Homo sapiens
tactttgtaatttttgggga

SEQ ID NO: 3996377 - DNA, 16 bp, Homo sapiens
tactttgtacttgtgt

SEQ ID NO: 3996378 - DNA, 16 bp, Homo sapiens
tacttttataataaaa

SEQ ID NO: 3996379 - DNA, 16 bp, Homo sapiens
tacttttcccctgtta

SEQ ID NO: 3996380 - DNA, 17 bp, Homo sapiens
tacttttcccctgttaa

SEQ ID NO: 3996381 - DNA, 13 bp, Homo sapiens
tacttttgagtgt

SEQ ID NO: 3996382 - DNA, 14 bp, Homo sapiens
tacttttgagtgtg

SEQ ID NO: 3996383 - DNA, 17 bp, Homo sapiens
tacttttgagtgtgtgt

SEQ ID NO: 3996384 - DNA, 14 bp, Homo sapiens
tacttttttcttat

SEQ ID NO: 3996385 - DNA, 15 bp, Homo sapiens
tagaaaaaaaattat

SEQ ID NO: 3996386 - DNA, 15 bp, Homo sapiens
tagaaaaaaattact

SEQ ID NO: 3996387 - DNA, 20 bp, Homo sapiens
tagaaaacaatgcaaaacct

SEQ ID NO: 3996388 - DNA, 12 bp, Homo sapiens
tagaaaaggaac

SEQ ID NO: 3996389 - DNA, 17 bp, Homo sapiens
tagaaaagttgcagatg

SEQ ID NO: 3996390 - DNA, 21 bp, Homo sapiens
tagaaaagttgcagatgtatt

SEQ ID NO: 3996391 - DNA, 20 bp, Homo sapiens
tagaaaatgacttatttctg

SEQ ID NO: 3996392 - DNA, 24 bp, Homo sapiens
tagaaaatgtgtcctatctatctt

SEQ ID NO: 3996393 - DNA, 17 bp, Homo sapiens
tagaaacccaaattggg

SEQ ID NO: 3996394 - DNA, 13 bp, Homo sapiens
tagaaagaagcca

SEQ ID NO: 3996395 - DNA, 21 bp, Homo sapiens
tagaaagaagcccaatattat

SEQ ID NO: 3996396 - DNA, 17 bp, Homo sapiens
tagaaagagatacagag

SEQ ID NO: 3996397 - DNA, 16 bp, Homo sapiens
tagaaaggggagaatg

SEQ ID NO: 3996398 - DNA, 21 bp, Homo sapiens
tagaaagttagggggttctta

SEQ ID NO: 3996399 - DNA, 19 bp, Homo sapiens
tagaaataaaggatgtgat

SEQ ID NO: 3996400 - DNA, 16 bp, Homo sapiens
tagaaataaatagcta

SEQ ID NO: 3996401 - DNA, 15 bp, Homo sapiens
tagaaataatatgca

SEQ ID NO: 3996402 - DNA, 16 bp, Homo sapiens
tagaaataatatgcat

SEQ ID NO: 3996403 - DNA, 11 bp, Homo sapiens
tagaaatactt

SEQ ID NO: 3996404 - DNA, 17 bp, Homo sapiens
tagaaatagctaattta

SEQ ID NO: 3996405 - DNA, 15 bp, Homo sapiens
tagaaatataattga

SEQ ID NO: 3996406 - DNA, 14 bp, Homo sapiens
tagaaatatgattt

SEQ ID NO: 3996407 - DNA, 19 bp, Homo sapiens
tagaaatgatgatgtggaa

SEQ ID NO: 3996408 - DNA, 14 bp, Homo sapiens
tagaaatgcaaggg

SEQ ID NO: 3996409 - DNA, 14 bp, Homo sapiens
tagaaattttacaa

SEQ ID NO: 3996410 - DNA, 22 bp, Homo sapiens
tagaaattttacaataggtgct

SEQ ID NO: 3996411 - DNA, 17 bp, Homo sapiens
tagaaattttgtaagaa

SEQ ID NO: 3996412 - DNA, 19 bp, Homo sapiens
tagaaatttttcagatgct

SEQ ID NO: 3996413 - DNA, 19 bp, Homo sapiens
tagaactcagttttaacta

SEQ ID NO: 3996414 - DNA, 16 bp, Homo sapiens
tagaactgtctgtgaa

SEQ ID NO: 3996415 - DNA, 21 bp, Homo sapiens
tagaactttctgctttgcaca

SEQ ID NO: 3996416 - DNA, 19 bp, Homo sapiens
tagaagagggttttaggta

SEQ ID NO: 3996417 - DNA, 21 bp, Homo sapiens
tagaagcactacaccttgcct

SEQ ID NO: 3996418 - DNA, 22 bp, Homo sapiens
tagaagcattccttctttgata

SEQ ID NO: 3996419 - DNA, 15 bp, Homo sapiens
tagaagccaagggaa

SEQ ID NO: 3996420 - DNA, 19 bp, Homo sapiens
tagaagggccagtcctgcc

SEQ ID NO: 3996421 - DNA, 22 bp, Homo sapiens
tagaagggccagtcctgcctgg

SEQ ID NO: 3996422 - DNA, 19 bp, Homo sapiens
tagaagtcttagatgtata

SEQ ID NO: 3996423 - DNA, 13 bp, Homo sapiens
tagaataaaagct

SEQ ID NO: 3996424 - DNA, 23 bp, Homo sapiens
tagaatacagttttgagtagagt

SEQ ID NO: 3996425 - DNA, 15 bp, Homo sapiens
tagaatatttattac

SEQ ID NO: 3996426 - DNA, 14 bp, Homo sapiens
tagaatccaaactt

SEQ ID NO: 3996427 - DNA, 15 bp, Homo sapiens
tagaatgattaatca

SEQ ID NO: 3996428 - DNA, 22 bp, Homo sapiens
tagaatgtggccacttatttca

SEQ ID NO: 3996429 - DNA, 18 bp, Homo sapiens
tagaatgtgttttctgaa

SEQ ID NO: 3996430 - DNA, 12 bp, Homo sapiens
tagaatgttgaa

SEQ ID NO: 3996431 - DNA, 12 bp, Homo sapiens
tagaattattta

SEQ ID NO: 3996432 - DNA, 15 bp, Homo sapiens
tagaattatttaaac

SEQ ID NO: 3996433 - DNA, 20 bp, Homo sapiens
tagaatttattcaattcctc

SEQ ID NO: 3996434 - DNA, 23 bp, Homo sapiens
tagaatttattcaattcctctgg

SEQ ID NO: 3996435 - DNA, 16 bp, Homo sapiens
tagaattttaagtgct

SEQ ID NO: 3996436 - DNA, 17 bp, Homo sapiens
tagacaaatagaaaatg

SEQ ID NO: 3996437 - DNA, 19 bp, Homo sapiens
tagacaaatagaaaatggt

SEQ ID NO: 3996438 - DNA, 20 bp, Homo sapiens
tagacaacctgaaatttatt

SEQ ID NO: 3996439 - DNA, 19 bp, Homo sapiens
tagacaagatattgtacat

SEQ ID NO: 3996440 - DNA, 14 bp, Homo sapiens
tagacaatatacaa

SEQ ID NO: 3996441 - DNA, 12 bp, Homo sapiens
tagacacacaaa

SEQ ID NO: 3996442 - DNA, 12 bp, Homo sapiens
tagaccaaagca

SEQ ID NO: 3996443 - DNA, 23 bp, Homo sapiens
tagaccatttatctgggattatg

SEQ ID NO: 3996444 - DNA, 13 bp, Homo sapiens
tagacccaggtgg

SEQ ID NO: 3996445 - DNA, 20 bp, Homo sapiens
tagacccaggtggagggcac

SEQ ID NO: 3996446 - DNA, 22 bp, Homo sapiens
tagacccaggtggagggcacag

SEQ ID NO: 3996447 - DNA, 12 bp, Homo sapiens
tagaccctgggt

SEQ ID NO: 3996448 - DNA, 19 bp, Homo sapiens
tagacctagggaggacctt

SEQ ID NO: 3996449 - DNA, 22 bp, Homo sapiens
tagacctagggaggaccttatc

SEQ ID NO: 3996450 - DNA, 21 bp, Homo sapiens
tagactaagaataagaagcat

SEQ ID NO: 3996451 - DNA, 21 bp, Homo sapiens
tagactcttttccttcccttt

SEQ ID NO: 3996452 - DNA, 22 bp, Homo sapiens
tagactgacttgtttgtcttcc

SEQ ID NO: 3996453 - DNA, 17 bp, Homo sapiens
tagactgtgattcagaa

SEQ ID NO: 3996454 - DNA, 19 bp, Homo sapiens
tagacttcccaacagcctt

SEQ ID NO: 3996455 - DNA, 19 bp, Homo sapiens
tagactttagaaataaatg

SEQ ID NO: 3996456 - DNA, 19 bp, Homo sapiens
tagagaacgcagccctaga

SEQ ID NO: 3996457 - DNA, 19 bp, Homo sapiens
tagagaagtatacataagt

SEQ ID NO: 3996458 - DNA, 19 bp, Homo sapiens
tagagactgtagattgctt

SEQ ID NO: 3996459 - DNA, 14 bp, Homo sapiens
tagagagaacaggt

SEQ ID NO: 3996460 - DNA, 17 bp, Homo sapiens
tagagaggggactgggg

SEQ ID NO: 3996461 - DNA, 20 bp, Homo sapiens
tagagatatatatacttgtg

SEQ ID NO: 3996462 - DNA, 23 bp, Homo sapiens
tagagatgctgtaacttaaaata

SEQ ID NO: 3996463 - DNA, 15 bp, Homo sapiens
tagagatttgtctaa

SEQ ID NO: 3996464 - DNA, 20 bp, Homo sapiens
tagagatttgtctaattgca

SEQ ID NO: 3996465 - DNA, 14 bp, Homo sapiens
tagagcaaaattga

SEQ ID NO: 3996466 - DNA, 23 bp, Homo sapiens
tagagcctcgtccctccctcact

SEQ ID NO: 3996467 - DNA, 18 bp, Homo sapiens
tagagcctgcctggagcg

SEQ ID NO: 3996468 - DNA, 16 bp, Homo sapiens
tagagctgggtggcct

SEQ ID NO: 3996469 - DNA, 18 bp, Homo sapiens
tagagctgggtggcctgt

SEQ ID NO: 3996470 - DNA, 18 bp, Homo sapiens
tagaggaaaaaaatgact

SEQ ID NO: 3996471 - DNA, 21 bp, Homo sapiens
taggttccctgttcttcctcc

SEQ ID NO: 3996472 - DNA, 22 bp, Homo sapiens
taggttccctgttcttcctcca

SEQ ID NO: 3996473 - DNA, 12 bp, Homo sapiens
taggttctaaaa

SEQ ID NO: 3996474 - DNA, 12 bp, Homo sapiens
taggtttctctc

SEQ ID NO: 3996475 - DNA, 15 bp, Homo sapiens
taggtttttattagt

SEQ ID NO: 3996476 - DNA, 21 bp, Homo sapiens
taggtttttccttatttgctt

SEQ ID NO: 3996477 - DNA, 13 bp, Homo sapiens
tagtaaatgtctt

SEQ ID NO: 3996478 - DNA, 14 bp, Homo sapiens
tagtaaatgtcttt

SEQ ID NO: 3996479 - DNA, 17 bp, Homo sapiens
tagtaaatgtctttgta

SEQ ID NO: 3996480 - DNA, 18 bp, Homo sapiens
tagtaaatgtctttgtaa

SEQ ID NO: 3996481 - DNA, 19 bp, Homo sapiens
tagtaaatgtctttgtaag

SEQ ID NO: 3996482 - DNA, 22 bp, Homo sapiens
tagtaaatgtctttgtaagtca

SEQ ID NO: 3996483 - DNA, 16 bp, Homo sapiens
tagtaagatgcactga

SEQ ID NO: 3996484 - DNA, 15 bp, Homo sapiens
tagtaatgttttata

SEQ ID NO: 3996485 - DNA, 16 bp, Homo sapiens
tagtaccaatcatttt

SEQ ID NO: 3996486 - DNA, 18 bp, Homo sapiens
tagtaccatttatacaaa

SEQ ID NO: 3996487 - DNA, 19 bp, Homo sapiens
tagtaccatttatacaaat

SEQ ID NO: 3996488 - DNA, 21 bp, Homo sapiens
tagtactcctgcaaaatttta

SEQ ID NO: 3996489 - DNA, 20 bp, Homo sapiens
tagtagaaattttacaatag

SEQ ID NO: 3996490 - DNA, 14 bp, Homo sapiens
tagtagcatgttga

SEQ ID NO: 3996491 - DNA, 17 bp, Homo sapiens
tagtaggaatgtacatg

SEQ ID NO: 3996492 - DNA, 14 bp, Homo sapiens
tagtaggtcctcaa

SEQ ID NO: 3996493 - DNA, 20 bp, Homo sapiens
tagtaggtcctcaataaata

SEQ ID NO: 3996494 - DNA, 19 bp, Homo sapiens
tagtagttagcttaagtag

SEQ ID NO: 3996495 - DNA, 14 bp, Homo sapiens
tagtatctaacatg

SEQ ID NO: 3996496 - DNA, 19 bp, Homo sapiens
tagtatctagcaatcacaa

SEQ ID NO: 3996497 - DNA, 17 bp, Homo sapiens
tagtatttctcaggaag

SEQ ID NO: 3996498 - DNA, 12 bp, Homo sapiens
tagtatttgaat

SEQ ID NO: 3996499 - DNA, 17 bp, Homo sapiens
tagtattttaatcctgt

SEQ ID NO: 3996500 - DNA, 16 bp, Homo sapiens
tagtcaatttctactt

SEQ ID NO: 3996501 - DNA, 16 bp, Homo sapiens
tagtcatccaacaaga

SEQ ID NO: 3996502 - DNA, 13 bp, Homo sapiens
tagtcatttacta

SEQ ID NO: 3996503 - DNA, 14 bp, Homo sapiens
tagtcatttactaa

SEQ ID NO: 3996504 - DNA, 13 bp, Homo sapiens
tagtccaaaatta

SEQ ID NO: 3996505 - DNA, 21 bp, Homo sapiens
tagtccccctgttttctgttt

SEQ ID NO: 3996506 - DNA, 16 bp, Homo sapiens
tagtcccttcccctcc

SEQ ID NO: 3996507 - DNA, 22 bp, Homo sapiens
tagtcccttcccctccctggct

SEQ ID NO: 3996508 - DNA, 23 bp, Homo sapiens
tagtcccttcccctccctggctc

SEQ ID NO: 3996509 - DNA, 10 bp, Homo sapiens
tagtccttgg

SEQ ID NO: 3996510 - DNA, 21 bp, Homo sapiens
tagtctcttgtattaaactct

SEQ ID NO: 3996511 - DNA, 18 bp, Homo sapiens
tagtctgaaactggcttc

SEQ ID NO: 3996512 - DNA, 18 bp, Homo sapiens
tagtctgtgtgaaggtga

SEQ ID NO: 3996513 - DNA, 12 bp, Homo sapiens
tagtcttctcat

SEQ ID NO: 3996514 - DNA, 15 bp, Homo sapiens
tagtcttgaatttct

SEQ ID NO: 3996515 - DNA, 18 bp, Homo sapiens
tagtgaagactccagaaa

SEQ ID NO: 3996516 - DNA, 22 bp, Homo sapiens
tagtgaccatcttcataatttg

SEQ ID NO: 3996517 - DNA, 19 bp, Homo sapiens
tagtgaggaagacaagcat

SEQ ID NO: 3996518 - DNA, 13 bp, Homo sapiens
tagtgcagctgat

SEQ ID NO: 3996519 - DNA, 18 bp, Homo sapiens
tagtgcagctgattttaa

SEQ ID NO: 3996520 - DNA, 22 bp, Homo sapiens
tagtgcagctgattttaacaat

SEQ ID NO: 3996521 - DNA, 23 bp, Homo sapiens
tagtgccgtagggagtacctgct

SEQ ID NO: 3996522 - DNA, 14 bp, Homo sapiens
tagtgcggacaagt

SEQ ID NO: 3996523 - DNA, 21 bp, Homo sapiens
tagtgcttaaaaatcattgat

SEQ ID NO: 3996524 - DNA, 17 bp, Homo sapiens
tagtggaaacatttata

SEQ ID NO: 3996525 - DNA, 13 bp, Homo sapiens
tagtggtctttgt

SEQ ID NO: 3996526 - DNA, 14 bp, Homo sapiens
tagtggtctttgta

SEQ ID NO: 3996527 - DNA, 18 bp, Homo sapiens
tagtgtctttaaatactt

SEQ ID NO: 3996528 - DNA, 15 bp, Homo sapiens
tagtgtgttctgatt

SEQ ID NO: 3996529 - DNA, 18 bp, Homo sapiens
tagtgttctgctcctgct

SEQ ID NO: 3996530 - DNA, 24 bp, Homo sapiens
tagtgttctgctcctgcttttctg

SEQ ID NO: 3996531 - DNA, 17 bp, Homo sapiens
tagtgtttctagctaaa

SEQ ID NO: 3996532 - DNA, 22 bp, Homo sapiens
tagtgtttctagctaaataaat

SEQ ID NO: 3996533 - DNA, 18 bp, Homo sapiens
tagtgtttggacagctga

SEQ ID NO: 3996534 - DNA, 21 bp, Homo sapiens
tagtgtttggacagctgataa

SEQ ID NO: 3996535 - DNA, 14 bp, Homo sapiens
tagttaagacatga

SEQ ID NO: 3996536 - DNA, 21 bp, Homo sapiens
tagttaagacatgatttcctt

SEQ ID NO: 3996537 - DNA, 13 bp, Homo sapiens
tagttaatggatt

SEQ ID NO: 3996538 - DNA, 16 bp, Homo sapiens
tagttaatttatctaa

SEQ ID NO: 3996539 - DNA, 18 bp, Homo sapiens
tagttaatttatctaaat

SEQ ID NO: 3996540 - DNA, 20 bp, Homo sapiens
tagttagccatctaatgctt

SEQ ID NO: 3996541 - DNA, 16 bp, Homo sapiens
tagttagcttaagtag

SEQ ID NO: 3996542 - DNA, 16 bp, Homo sapiens
tagttagtagcatgtt

SEQ ID NO: 3996543 - DNA, 16 bp, Homo sapiens
tagttatttttctctt

SEQ ID NO: 3996544 - DNA, 22 bp, Homo sapiens
tagttcagcatccgcaggtgct

SEQ ID NO: 3996545 - DNA, 18 bp, Homo sapiens
tagttcatccaatcctca

SEQ ID NO: 3996546 - DNA, 20 bp, Homo sapiens
tagttctcactgttccctct

SEQ ID NO: 3996547 - DNA, 16 bp, Homo sapiens
tagttctgccaggcaa

SEQ ID NO: 3996548 - DNA, 17 bp, Homo sapiens
tagttcttactgcttaa

SEQ ID NO: 3996549 - DNA, 22 bp, Homo sapiens
tagttctttcctccccctgcaa

SEQ ID NO: 3996550 - DNA, 19 bp, Homo sapiens
tagttgaaaggcctcaaga

SEQ ID NO: 3996551 - DNA, 18 bp, Homo sapiens
tagttgaggaaagcacag

SEQ ID NO: 3996552 - DNA, 14 bp, Homo sapiens
tagttgcaattgaa

SEQ ID NO: 3996553 - DNA, 16 bp, Homo sapiens
tagttgcaattgaatt

SEQ ID NO: 3996554 - DNA, 18 bp, Homo sapiens
tagttgcagactcagttt

SEQ ID NO: 3996555 - DNA, 21 bp, Homo sapiens
tagttgccaaatctggctcct

SEQ ID NO: 3996556 - DNA, 14 bp, Homo sapiens
tagttgtattcttc

SEQ ID NO: 3996557 - DNA, 19 bp, Homo sapiens
tagttgtattcttctgtat

SEQ ID NO: 3996558 - DNA, 12 bp, Homo sapiens
tagtttacaata

SEQ ID NO: 3996559 - DNA, 11 bp, Homo sapiens
tagtttactgt

SEQ ID NO: 3996560 - DNA, 13 bp, Homo sapiens
tagtttactgttt

SEQ ID NO: 3996561 - DNA, 14 bp, Homo sapiens
tagtttaggagaaa

SEQ ID NO: 3996562 - DNA, 14 bp, Homo sapiens
tagtttctttggga

SEQ ID NO: 3996563 - DNA, 13 bp, Homo sapiens
tagtttggttcac

SEQ ID NO: 3996564 - DNA, 18 bp, Homo sapiens
tagtttgtctattttaaa

SEQ ID NO: 3996565 - DNA, 13 bp, Homo sapiens
tagttttgctttt

SEQ ID NO: 3996566 - DNA, 14 bp, Homo sapiens
tataaaaaatggtt

SEQ ID NO: 3996567 - DNA, 17 bp, Homo sapiens
tataaaaaatggttcag

SEQ ID NO: 3996568 - DNA, 19 bp, Homo sapiens
tataaaaagaaaagataaa

SEQ ID NO: 3996569 - DNA, 21 bp, Homo sapiens
tataaaaagaaaagataaaga

SEQ ID NO: 3996570 - DNA, 12 bp, Homo sapiens
tataaaacttct

SEQ ID NO: 3996571 - DNA, 23 bp, Homo sapiens
tataaaatatgaagacataaacc

SEQ ID NO: 3996572 - DNA, 21 bp, Homo sapiens
tataaaatgtgcagatgcaat

SEQ ID NO: 3996573 - DNA, 22 bp, Homo sapiens
tataaactttagagtagcatga

SEQ ID NO: 3996574 - DNA, 16 bp, Homo sapiens
tatgttgtgttctaat

SEQ ID NO: 3996575 - DNA, 22 bp, Homo sapiens
tatgtttaaagtaattgttcca

SEQ ID NO: 3996576 - DNA, 19 bp, Homo sapiens
tatgtttaatctgttatgt

SEQ ID NO: 3996577 - DNA, 14 bp, Homo sapiens
tatgtttgcacact

SEQ ID NO: 3996578 - DNA, 15 bp, Homo sapiens
tatgttttgtttctg

SEQ ID NO: 3996579 - DNA, 18 bp, Homo sapiens
tatgttttgtttctgaaa

SEQ ID NO: 3996580 - DNA, 20 bp, Homo sapiens
tattaaaacacattatgtat

SEQ ID NO: 3996581 - DNA, 21 bp, Homo sapiens
tattaaaacacattatgtatc

SEQ ID NO: 3996582 - DNA, 20 bp, Homo sapiens
tattaaacagatttttacaa

SEQ ID NO: 3996583 - DNA, 18 bp, Homo sapiens
tattaaatacaaaacttc

SEQ ID NO: 3996584 - DNA, 19 bp, Homo sapiens
tattaaatacaaaacttcc

SEQ ID NO: 3996585 - DNA, 13 bp, Homo sapiens
tattaaatacaga

SEQ ID NO: 3996586 - DNA, 12 bp, Homo sapiens
tattaaattatg

SEQ ID NO: 3996587 - DNA, 15 bp, Homo sapiens
tattaactacattta

SEQ ID NO: 3996588 - DNA, 16 bp, Homo sapiens
tattaactacatttat

SEQ ID NO: 3996589 - DNA, 17 bp, Homo sapiens
tattaactttaatgttt

SEQ ID NO: 3996590 - DNA, 16 bp, Homo sapiens
tattaagaaagactat

SEQ ID NO: 3996591 - DNA, 19 bp, Homo sapiens
tattaagatggattctcag

SEQ ID NO: 3996592 - DNA, 13 bp, Homo sapiens
tattaagcacttt

SEQ ID NO: 3996593 - DNA, 20 bp, Homo sapiens
tattaagcagtaaaaactgt

SEQ ID NO: 3996594 - DNA, 22 bp, Homo sapiens
tattaatactacccatagaaaa

SEQ ID NO: 3996595 - DNA, 14 bp, Homo sapiens
tattaatatatgta

SEQ ID NO: 3996596 - DNA, 22 bp, Homo sapiens
tattaatttgaaaccaggacat

SEQ ID NO: 3996597 - DNA, 16 bp, Homo sapiens
tattacaaaaacaaaa

SEQ ID NO: 3996598 - DNA, 20 bp, Homo sapiens
tattacaataccgttaagat

SEQ ID NO: 3996599 - DNA, 15 bp, Homo sapiens
tattacattttcagt

SEQ ID NO: 3996600 - DNA, 22 bp, Homo sapiens
tattaccagtggcgttgttgca

SEQ ID NO: 3996601 - DNA, 21 bp, Homo sapiens
tattaccccctccttcagaca

SEQ ID NO: 3996602 - DNA, 11 bp, Homo sapiens
tattacctctg

SEQ ID NO: 3996603 - DNA, 16 bp, Homo sapiens
tattagactttagaaa

SEQ ID NO: 3996604 - DNA, 18 bp, Homo sapiens
tattagccaggatcatgg

SEQ ID NO: 3996605 - DNA, 21 bp, Homo sapiens
tattagggagaaaattcaatt

SEQ ID NO: 3996606 - DNA, 17 bp, Homo sapiens
tattagtattgtgaata

SEQ ID NO: 3996607 - DNA, 14 bp, Homo sapiens
tattagtgaagatg

SEQ ID NO: 3996608 - DNA, 21 bp, Homo sapiens
tattagtgaagatggtttcaa

SEQ ID NO: 3996609 - DNA, 19 bp, Homo sapiens
tattagttaatggattaaa

SEQ ID NO: 3996610 - DNA, 12 bp, Homo sapiens
tattataaatgt

SEQ ID NO: 3996611 - DNA, 14 bp, Homo sapiens
tattataaatgtta

SEQ ID NO: 3996612 - DNA, 15 bp, Homo sapiens
tattataacttaaaa

SEQ ID NO: 3996613 - DNA, 22 bp, Homo sapiens
tattataagggagagctgagcc

SEQ ID NO: 3996614 - DNA, 19 bp, Homo sapiens
tattatacaggaaagcaat

SEQ ID NO: 3996615 - DNA, 19 bp, Homo sapiens
tattatactaagaaaagat

SEQ ID NO: 3996616 - DNA, 20 bp, Homo sapiens
tattatcaggggagaaaaat

SEQ ID NO: 3996617 - DNA, 16 bp, Homo sapiens
tattatggaaaactgt

SEQ ID NO: 3996618 - DNA, 21 bp, Homo sapiens
tattatggaagattttaaatt

SEQ ID NO: 3996619 - DNA, 14 bp, Homo sapiens
tattatgttgttca

SEQ ID NO: 3996620 - DNA, 14 bp, Homo sapiens
tattattaaagtct

SEQ ID NO: 3996621 - DNA, 21 bp, Homo sapiens
tattattaaagtctaaacaaa

SEQ ID NO: 3996622 - DNA, 15 bp, Homo sapiens
tattattattttggg

SEQ ID NO: 3996623 - DNA, 13 bp, Homo sapiens
tattattgtaagt

SEQ ID NO: 3996624 - DNA, 19 bp, Homo sapiens
tattattgtaagttgtaca

SEQ ID NO: 3996625 - DNA, 21 bp, Homo sapiens
tattatttctaatccttttcc

SEQ ID NO: 3996626 - DNA, 12 bp, Homo sapiens
tattatttctat

SEQ ID NO: 3996627 - DNA, 14 bp, Homo sapiens
tattatttggagtt

SEQ ID NO: 3996628 - DNA, 15 bp, Homo sapiens
tattatttggagtta

SEQ ID NO: 3996629 - DNA, 17 bp, Homo sapiens
tattatttggagttagg

SEQ ID NO: 3996630 - DNA, 13 bp, Homo sapiens
tattattttgggg

SEQ ID NO: 3996631 - DNA, 16 bp, Homo sapiens
tattatttttacctaa

SEQ ID NO: 3996632 - DNA, 15 bp, Homo sapiens
tattcaattcctctg

SEQ ID NO: 3996633 - DNA, 21 bp, Homo sapiens
tattcacatcgcttctgtgta

SEQ ID NO: 3996634 - DNA, 15 bp, Homo sapiens
tattcaccttcagtt

SEQ ID NO: 3996635 - DNA, 17 bp, Homo sapiens
tattcaccttcagtttt

SEQ ID NO: 3996636 - DNA, 14 bp, Homo sapiens
tattcactggcccc

SEQ ID NO: 3996637 - DNA, 22 bp, Homo sapiens
tattcagacaagcaacaggttt

SEQ ID NO: 3996638 - DNA, 16 bp, Homo sapiens
tattcaggagagtaga

SEQ ID NO: 3996639 - DNA, 19 bp, Homo sapiens
tattcagtaaacaacttgt

SEQ ID NO: 3996640 - DNA, 14 bp, Homo sapiens
tattcatccagcag

SEQ ID NO: 3996641 - DNA, 15 bp, Homo sapiens
tattcatccagcagt

SEQ ID NO: 3996642 - DNA, 16 bp, Homo sapiens
tattcatccagcagtg

SEQ ID NO: 3996643 - DNA, 15 bp, Homo sapiens
tattcatttaaaatg

SEQ ID NO: 3996644 - DNA, 12 bp, Homo sapiens
tattcatttagt

SEQ ID NO: 3996645 - DNA, 14 bp, Homo sapiens
tattccaaatgtct

SEQ ID NO: 3996646 - DNA, 16 bp, Homo sapiens
tattccagaatgctgt

SEQ ID NO: 3996647 - DNA, 17 bp, Homo sapiens
tattccagaatgctgta

SEQ ID NO: 3996648 - DNA, 20 bp, Homo sapiens
tattccagaatgctgtacat

SEQ ID NO: 3996649 - DNA, 21 bp, Homo sapiens
tattccagaatgctgtacatc

SEQ ID NO: 3996650 - DNA, 17 bp, Homo sapiens
tattccagagctgccag

SEQ ID NO: 3996651 - DNA, 19 bp, Homo sapiens
tattccatcaataaatgct

SEQ ID NO: 3996652 - DNA, 16 bp, Homo sapiens
tattccatgaatgtat

SEQ ID NO: 3996653 - DNA, 20 bp, Homo sapiens
tattcccctatctctagaat

SEQ ID NO: 3996654 - DNA, 19 bp, Homo sapiens
tattccgatacaaagtgtt

SEQ ID NO: 3996655 - DNA, 21 bp, Homo sapiens
tattcctagtggatgactgtt

SEQ ID NO: 3996656 - DNA, 17 bp, Homo sapiens
tattcctccaaatctct

SEQ ID NO: 3996657 - DNA, 18 bp, Homo sapiens
tattcctccaaatctctt

SEQ ID NO: 3996658 - DNA, 21 bp, Homo sapiens
tattcctctaggcaagcagga

SEQ ID NO: 3996659 - DNA, 20 bp, Homo sapiens
tattcctgaatgaaatatca

SEQ ID NO: 3996660 - DNA, 16 bp, Homo sapiens
tattccttgatcattt

SEQ ID NO: 3996661 - DNA, 14 bp, Homo sapiens
tattcgccatctga

SEQ ID NO: 3996662 - DNA, 22 bp, Homo sapiens
tattctaagccagttttcattt

SEQ ID NO: 3996663 - DNA, 15 bp, Homo sapiens
tattctatatgaatt

SEQ ID NO: 3996664 - DNA, 19 bp, Homo sapiens
tattctatatgaatttaaa

SEQ ID NO: 3996665 - DNA, 14 bp, Homo sapiens
tattctcaccagga

SEQ ID NO: 3996666 - DNA, 18 bp, Homo sapiens
tattctcagagcatgtgt

SEQ ID NO: 3996667 - DNA, 14 bp, Homo sapiens
tattctcttttatc

SEQ ID NO: 3996668 - DNA, 22 bp, Homo sapiens
tattctgggctcctggaaccaa

SEQ ID NO: 3996669 - DNA, 18 bp, Homo sapiens
tattctgtcagtgttaaa

SEQ ID NO: 3996670 - DNA, 11 bp, Homo sapiens
tattctgtttt

SEQ ID NO: 3996671 - DNA, 12 bp, Homo sapiens
tattcttccaga

SEQ ID NO: 3996672 - DNA, 18 bp, Homo sapiens
tattcttggaccatgcca

SEQ ID NO: 3996673 - DNA, 20 bp, Homo sapiens
tattcttggaccatgccaga

SEQ ID NO: 3996674 - DNA, 21 bp, Homo sapiens
tattgaaggaagccaaattta

SEQ ID NO: 3996675 - DNA, 22 bp, Homo sapiens
tattgaaggaagccaaatttat

SEQ ID NO: 3996676 - DNA, 13 bp, Homo sapiens
tattgacacagaa

SEQ ID NO: 3996677 - DNA, 19 bp, Homo sapiens
tcaacctcttctggctcaa

SEQ ID NO: 3996678 - DNA, 19 bp, Homo sapiens
tcaacctggtggcaccaga

SEQ ID NO: 3996679 - DNA, 14 bp, Homo sapiens
tcaacgcagccctg

SEQ ID NO: 3996680 - DNA, 18 bp, Homo sapiens
tcaacgcagccctgcttt

SEQ ID NO: 3996681 - DNA, 18 bp, Homo sapiens
tcaactccctcctttagt

SEQ ID NO: 3996682 - DNA, 14 bp, Homo sapiens
tcaactctttgtta

SEQ ID NO: 3996683 - DNA, 23 bp, Homo sapiens
tcaactgaaaagactcagtgttc

SEQ ID NO: 3996684 - DNA, 12 bp, Homo sapiens
tcaactgctttg

SEQ ID NO: 3996685 - DNA, 21 bp, Homo sapiens
tcaactttagtatttttacta

SEQ ID NO: 3996686 - DNA, 16 bp, Homo sapiens
tcaagaaacagccagc

SEQ ID NO: 3996687 - DNA, 20 bp, Homo sapiens
tcaagaacaaacactgcagt

SEQ ID NO: 3996688 - DNA, 14 bp, Homo sapiens
tcaagaagaaaaag

SEQ ID NO: 3996689 - DNA, 22 bp, Homo sapiens
tcaagacccccatttgtcccag

SEQ ID NO: 3996690 - DNA, 21 bp, Homo sapiens
tcaagactttagcttttcctt

SEQ ID NO: 3996691 - DNA, 16 bp, Homo sapiens
tcaagagctgccctcc

SEQ ID NO: 3996692 - DNA, 16 bp, Homo sapiens
tcaagaggcagagttc

SEQ ID NO: 3996693 - DNA, 20 bp, Homo sapiens
tcaagagggcactggtggcc

SEQ ID NO: 3996694 - DNA, 22 bp, Homo sapiens
tcaagatactgctactgtaatt

SEQ ID NO: 3996695 - DNA, 22 bp, Homo sapiens
tcaagattttagggcttttatt

SEQ ID NO: 3996696 - DNA, 20 bp, Homo sapiens
tcaagcaatccacctgcctt

SEQ ID NO: 3996697 - DNA, 13 bp, Homo sapiens
tcaagcactgata

SEQ ID NO: 3996698 - DNA, 22 bp, Homo sapiens
tcaagcagcgaccgccccctcc

SEQ ID NO: 3996699 - DNA, 17 bp, Homo sapiens
tcaagcaggaattatgt

SEQ ID NO: 3996700 - DNA, 20 bp, Homo sapiens
tcaagccatgtataaatgtg

SEQ ID NO: 3996701 - DNA, 22 bp, Homo sapiens
tcaagccatgtataaatgtgat

SEQ ID NO: 3996702 - DNA, 14 bp, Homo sapiens
tcaagccccagcag

SEQ ID NO: 3996703 - DNA, 24 bp, Homo sapiens
tcaagccccagcagccctcaacag

SEQ ID NO: 3996704 - DNA, 18 bp, Homo sapiens
tcaagccccatttcctca

SEQ ID NO: 3996705 - DNA, 15 bp, Homo sapiens
tcaagcgattctcct

SEQ ID NO: 3996706 - DNA, 16 bp, Homo sapiens
tcaagctagtgtttct

SEQ ID NO: 3996707 - DNA, 18 bp, Homo sapiens
tcaagctgaccttgctga

SEQ ID NO: 3996708 - DNA, 23 bp, Homo sapiens
tcaagctgttatttcttccctgc

SEQ ID NO: 3996709 - DNA, 21 bp, Homo sapiens
tcaagcttttgcttgatccag

SEQ ID NO: 3996710 - DNA, 18 bp, Homo sapiens
tcaaggaaggttcatgta

SEQ ID NO: 3996711 - DNA, 18 bp, Homo sapiens
tcaaggacttgaaagcat

SEQ ID NO: 3996712 - DNA, 21 bp, Homo sapiens
tcaagggctttcctgtgccag

SEQ ID NO: 3996713 - DNA, 21 bp, Homo sapiens
tcaagtcatggcaggtacagt

SEQ ID NO: 3996714 - DNA, 21 bp, Homo sapiens
tcaagtcctgactgggctggg

SEQ ID NO: 3996715 - DNA, 23 bp, Homo sapiens
tcaagtcctgactgggctgggtt

SEQ ID NO: 3996716 - DNA, 18 bp, Homo sapiens
tcaagtccttacctcttc

SEQ ID NO: 3996717 - DNA, 15 bp, Homo sapiens
tcaagtcctttgtga

SEQ ID NO: 3996718 - DNA, 14 bp, Homo sapiens
tcaagtctctgctg

SEQ ID NO: 3996719 - DNA, 21 bp, Homo sapiens
tcaagtgccttttgctgcgca

SEQ ID NO: 3996720 - DNA, 18 bp, Homo sapiens
tcaagtgggatctgtcac

SEQ ID NO: 3996721 - DNA, 19 bp, Homo sapiens
tcaagttaacaaggaatgc

SEQ ID NO: 3996722 - DNA, 13 bp, Homo sapiens
tcaagttcacacc

SEQ ID NO: 3996723 - DNA, 16 bp, Homo sapiens
tcaagttcacacctgc

SEQ ID NO: 3996724 - DNA, 22 bp, Homo sapiens
tcaagttctggacctgggcatg

SEQ ID NO: 3996725 - DNA, 17 bp, Homo sapiens
tcaagttgagattttta

SEQ ID NO: 3996726 - DNA, 22 bp, Homo sapiens
tcaagttgagatttttaagaac

SEQ ID NO: 3996727 - DNA, 19 bp, Homo sapiens
tcaagttttgggtatgttt

SEQ ID NO: 3996728 - DNA, 13 bp, Homo sapiens
tcaataaaatgtg

SEQ ID NO: 3996729 - DNA, 12 bp, Homo sapiens
tcaataaacagc

SEQ ID NO: 3996730 - DNA, 21 bp, Homo sapiens
tcaataaacagcttcatgcct

SEQ ID NO: 3996731 - DNA, 12 bp, Homo sapiens
tcaataaactta

SEQ ID NO: 3996732 - DNA, 20 bp, Homo sapiens
tcaataaacttagaggaaaa

SEQ ID NO: 3996733 - DNA, 18 bp, Homo sapiens
tcaataaagcactgagca

SEQ ID NO: 3996734 - DNA, 20 bp, Homo sapiens
tcaataacagccgctccaga

SEQ ID NO: 3996735 - DNA, 21 bp, Homo sapiens
tcaataacagccgctccagag

SEQ ID NO: 3996736 - DNA, 24 bp, Homo sapiens
tcaataacagccgctccagagtca

SEQ ID NO: 3996737 - DNA, 21 bp, Homo sapiens
tcaatacgcctttaaaggttt

SEQ ID NO: 3996738 - DNA, 19 bp, Homo sapiens
tcaatatccctcttgtaag

SEQ ID NO: 3996739 - DNA, 13 bp, Homo sapiens
tcaatatctaata

SEQ ID NO: 3996740 - DNA, 19 bp, Homo sapiens
tcaatatctaatatatatg

SEQ ID NO: 3996741 - DNA, 17 bp, Homo sapiens
tcaatattgacatttgt

SEQ ID NO: 3996742 - DNA, 12 bp, Homo sapiens
tcaatatttatt

SEQ ID NO: 3996743 - DNA, 17 bp, Homo sapiens
tcaatcaagccatgtat

SEQ ID NO: 3996744 - DNA, 12 bp, Homo sapiens
tcaatcatttct

SEQ ID NO: 3996745 - DNA, 15 bp, Homo sapiens
tcaatcatttctcac

SEQ ID NO: 3996746 - DNA, 14 bp, Homo sapiens
tcaatccaccttca

SEQ ID NO: 3996747 - DNA, 16 bp, Homo sapiens
tcaatccaccttcagg

SEQ ID NO: 3996748 - DNA, 12 bp, Homo sapiens
tcaatgaaaaat

SEQ ID NO: 3996749 - DNA, 15 bp, Homo sapiens
tcaatgaagccagct

SEQ ID NO: 3996750 - DNA, 16 bp, Homo sapiens
tcaatgaagccagctc

SEQ ID NO: 3996751 - DNA, 20 bp, Homo sapiens
tcaatgcaagagtgattgca

SEQ ID NO: 3996752 - DNA, 16 bp, Homo sapiens
tcaatgctagaaaatc

SEQ ID NO: 3996753 - DNA, 11 bp, Homo sapiens
tcaatgttcat

SEQ ID NO: 3996754 - DNA, 14 bp, Homo sapiens
tcaatgttcattgt

SEQ ID NO: 3996755 - DNA, 24 bp, Homo sapiens
tcaatgttcattgtaatgttactg

SEQ ID NO: 3996756 - DNA, 21 bp, Homo sapiens
tcaatgtttatgcaaggaagg

SEQ ID NO: 3996757 - DNA, 23 bp, Homo sapiens
tcaattaaaatagtctctttaaa

SEQ ID NO: 3996758 - DNA, 13 bp, Homo sapiens
tcaattaaagtct

SEQ ID NO: 3996759 - DNA, 19 bp, Homo sapiens
tcaattaaagtctattcaa

SEQ ID NO: 3996760 - DNA, 18 bp, Homo sapiens
tcaattcagattgtcttg

SEQ ID NO: 3996761 - DNA, 17 bp, Homo sapiens
tcaattccctctctcag

SEQ ID NO: 3996762 - DNA, 15 bp, Homo sapiens
tcaattcctctggga

SEQ ID NO: 3996763 - DNA, 16 bp, Homo sapiens
tcaattcctctgggaa

SEQ ID NO: 3996764 - DNA, 18 bp, Homo sapiens
tcaattggcagtgacttt

SEQ ID NO: 3996765 - DNA, 23 bp, Homo sapiens
tcaattggcagtgactttgtata

SEQ ID NO: 3996766 - DNA, 14 bp, Homo sapiens
tcaattgtcacttt

SEQ ID NO: 3996767 - DNA, 15 bp, Homo sapiens
tcaatttcattatca

SEQ ID NO: 3996768 - DNA, 16 bp, Homo sapiens
tcaattttatccctca

SEQ ID NO: 3996769 - DNA, 22 bp, Homo sapiens
tcaattttatccctcacctgta

SEQ ID NO: 3996770 - DNA, 21 bp, Homo sapiens
tcaattttcattaaacttgaa

SEQ ID NO: 3996771 - DNA, 18 bp, Homo sapiens
tcaattttgacttaatgt

SEQ ID NO: 3996772 - DNA, 17 bp, Homo sapiens
tcacaaaacctggcaca

SEQ ID NO: 3996773 - DNA, 18 bp, Homo sapiens
tcacaaagagttctggaa

SEQ ID NO: 3996774 - DNA, 20 bp, Homo sapiens
tcacaaatcctaaaagaagc

SEQ ID NO: 3996775 - DNA, 16 bp, Homo sapiens
tcacaacttgggttct

SEQ ID NO: 3996776 - DNA, 20 bp, Homo sapiens
tcacaagtggtgtttattgc

SEQ ID NO: 3996777 - DNA, 21 bp, Homo sapiens
tcacaagtggtgtttattgca

SEQ ID NO: 3996778 - DNA, 13 bp, Homo sapiens
tcacaatacagat

SEQ ID NO: 3996779 - DNA, 22 bp, Homo sapiens
tcagccttccaactagctggga

SEQ ID NO: 3996780 - DNA, 16 bp, Homo sapiens
tcagccttgccagaga

SEQ ID NO: 3996781 - DNA, 17 bp, Homo sapiens
tcagccttgccagagat

SEQ ID NO: 3996782 - DNA, 22 bp, Homo sapiens
tcagctaagggaagacatttct

SEQ ID NO: 3996783 - DNA, 23 bp, Homo sapiens
tcagctaagggaagacatttctt

SEQ ID NO: 3996784 - DNA, 19 bp, Homo sapiens
tcagctacccactatcctt

SEQ ID NO: 3996785 - DNA, 15 bp, Homo sapiens
tcagctatacctgca

SEQ ID NO: 3996786 - DNA, 19 bp, Homo sapiens
tcagctatacctgcacgtt

SEQ ID NO: 3996787 - DNA, 21 bp, Homo sapiens
tcagctcccccaggctgttct

SEQ ID NO: 3996788 - DNA, 20 bp, Homo sapiens
tcagctcctacctctgtgcc

SEQ ID NO: 3996789 - DNA, 19 bp, Homo sapiens
tcagctctctgccctgtgt

SEQ ID NO: 3996790 - DNA, 21 bp, Homo sapiens
tcagctctctgccctgtgtac

SEQ ID NO: 3996791 - DNA, 19 bp, Homo sapiens
tcagctctgggccattctc

SEQ ID NO: 3996792 - DNA, 15 bp, Homo sapiens
tcagctgagccctgg

SEQ ID NO: 3996793 - DNA, 18 bp, Homo sapiens
tcagctgagccctgggga

SEQ ID NO: 3996794 - DNA, 18 bp, Homo sapiens
tcagctgagccttctgag

SEQ ID NO: 3996795 - DNA, 14 bp, Homo sapiens
tcagctgcctcact

SEQ ID NO: 3996796 - DNA, 15 bp, Homo sapiens
tcagctgcctcactt

SEQ ID NO: 3996797 - DNA, 24 bp, Homo sapiens
tcagctgcctcacttcctacaaga

SEQ ID NO: 3996798 - DNA, 21 bp, Homo sapiens
tcagctgcctcctgcgccctg

SEQ ID NO: 3996799 - DNA, 17 bp, Homo sapiens
tcagctgcctgaaacag

SEQ ID NO: 3996800 - DNA, 18 bp, Homo sapiens
tcagctgtcctgcagcaa

SEQ ID NO: 3996801 - DNA, 22 bp, Homo sapiens
tcagcttacatccctgagcagg

SEQ ID NO: 3996802 - DNA, 18 bp, Homo sapiens
tcagcttatgtaggtaaa

SEQ ID NO: 3996803 - DNA, 15 bp, Homo sapiens
tcagcttcctaccca

SEQ ID NO: 3996804 - DNA, 18 bp, Homo sapiens
tcagcttcttcctaggtc

SEQ ID NO: 3996805 - DNA, 13 bp, Homo sapiens
tcaggaacagaag

SEQ ID NO: 3996806 - DNA, 20 bp, Homo sapiens
tcaggaatttaaaattaagt

SEQ ID NO: 3996807 - DNA, 14 bp, Homo sapiens
tcaggacagatgcc

SEQ ID NO: 3996808 - DNA, 14 bp, Homo sapiens
tcaggacggctcct

SEQ ID NO: 3996809 - DNA, 16 bp, Homo sapiens
tcaggacggctcctca

SEQ ID NO: 3996810 - DNA, 15 bp, Homo sapiens
tcaggacttggtctg

SEQ ID NO: 3996811 - DNA, 18 bp, Homo sapiens
tcaggagatggagggctt

SEQ ID NO: 3996812 - DNA, 23 bp, Homo sapiens
tcaggagatggagggcttggccc

SEQ ID NO: 3996813 - DNA, 18 bp, Homo sapiens
tcaggagcacaggcagct

SEQ ID NO: 3996814 - DNA, 23 bp, Homo sapiens
tcaggagcttgggcagtgcccca

SEQ ID NO: 3996815 - DNA, 12 bp, Homo sapiens
tcaggaggctga

SEQ ID NO: 3996816 - DNA, 20 bp, Homo sapiens
tcaggagtcccaaggaaagc

SEQ ID NO: 3996817 - DNA, 12 bp, Homo sapiens
tcaggagttcct

SEQ ID NO: 3996818 - DNA, 16 bp, Homo sapiens
tcaggagttggaatgt

SEQ ID NO: 3996819 - DNA, 23 bp, Homo sapiens
tcaggatatccttatcagagcta

SEQ ID NO: 3996820 - DNA, 16 bp, Homo sapiens
tcaggatgaacccagg

SEQ ID NO: 3996821 - DNA, 13 bp, Homo sapiens
tcaggcacacagc

SEQ ID NO: 3996822 - DNA, 17 bp, Homo sapiens
tcaggcaccagcatcca

SEQ ID NO: 3996823 - DNA, 21 bp, Homo sapiens
tcaggcaggaagggcaggaag

SEQ ID NO: 3996824 - DNA, 12 bp, Homo sapiens
tcaggccagccc

SEQ ID NO: 3996825 - DNA, 14 bp, Homo sapiens
tcaggccagcccag

SEQ ID NO: 3996826 - DNA, 16 bp, Homo sapiens
tcaggccagcccagcc

SEQ ID NO: 3996827 - DNA, 17 bp, Homo sapiens
tcaggccagcccagcca

SEQ ID NO: 3996828 - DNA, 18 bp, Homo sapiens
tcaggccagcccagccag

SEQ ID NO: 3996829 - DNA, 21 bp, Homo sapiens
tcaggcccccagtgggaccac

SEQ ID NO: 3996830 - DNA, 22 bp, Homo sapiens
tcaggccccgccccatgggccc

SEQ ID NO: 3996831 - DNA, 20 bp, Homo sapiens
tcaggccgggcagagcacag

SEQ ID NO: 3996832 - DNA, 17 bp, Homo sapiens
tcaggcctccctctctc

SEQ ID NO: 3996833 - DNA, 14 bp, Homo sapiens
tcaggcctgtgccc

SEQ ID NO: 3996834 - DNA, 20 bp, Homo sapiens
tcaggcgatccacctgtctc

SEQ ID NO: 3996835 - DNA, 21 bp, Homo sapiens
tcaggctactcattcagtccc

SEQ ID NO: 3996836 - DNA, 13 bp, Homo sapiens
tcaggctctgctg

SEQ ID NO: 3996837 - DNA, 15 bp, Homo sapiens
tcaggctcttctcct

SEQ ID NO: 3996838 - DNA, 16 bp, Homo sapiens
tcaggctcttctcctt

SEQ ID NO: 3996839 - DNA, 15 bp, Homo sapiens
tcaggctgcttggga

SEQ ID NO: 3996840 - DNA, 15 bp, Homo sapiens
tcagggacaggatga

SEQ ID NO: 3996841 - DNA, 16 bp, Homo sapiens
tcagggaccggtgctg

SEQ ID NO: 3996842 - DNA, 22 bp, Homo sapiens
tcagggaccggtgctgcaggag

SEQ ID NO: 3996843 - DNA, 17 bp, Homo sapiens
tcagggaccgtccaggg

SEQ ID NO: 3996844 - DNA, 12 bp, Homo sapiens
tcagggacttgg

SEQ ID NO: 3996845 - DNA, 16 bp, Homo sapiens
tcagggacttggacag

SEQ ID NO: 3996846 - DNA, 21 bp, Homo sapiens
tcagggagcagggaaggcctg

SEQ ID NO: 3996847 - DNA, 20 bp, Homo sapiens
tcagggagggagggcggtgg

SEQ ID NO: 3996848 - DNA, 15 bp, Homo sapiens
tcagggaggtcattt

SEQ ID NO: 3996849 - DNA, 19 bp, Homo sapiens
tcagggagtgctggctcac

SEQ ID NO: 3996850 - DNA, 19 bp, Homo sapiens
tcagggcagcgccaggctg

SEQ ID NO: 3996851 - DNA, 14 bp, Homo sapiens
tcagggccaggccc

SEQ ID NO: 3996852 - DNA, 17 bp, Homo sapiens
tcagggccaggcccagg

SEQ ID NO: 3996853 - DNA, 14 bp, Homo sapiens
tcagggccatgcct

SEQ ID NO: 3996854 - DNA, 17 bp, Homo sapiens
tcagggccatgcctgcc

SEQ ID NO: 3996855 - DNA, 23 bp, Homo sapiens
tcagggcgctcagacggcggcca

SEQ ID NO: 3996856 - DNA, 13 bp, Homo sapiens
tcagggctgtccc

SEQ ID NO: 3996857 - DNA, 14 bp, Homo sapiens
tcagggctgtccca

SEQ ID NO: 3996858 - DNA, 16 bp, Homo sapiens
tcagggctgtcccagc

SEQ ID NO: 3996859 - DNA, 18 bp, Homo sapiens
tcagggctgtcccagccc

SEQ ID NO: 3996860 - DNA, 18 bp, Homo sapiens
tcaggggactcagccctg

SEQ ID NO: 3996861 - DNA, 16 bp, Homo sapiens
tcaggggccagaggaa

SEQ ID NO: 3996862 - DNA, 19 bp, Homo sapiens
tcaggtagttgcaattgaa

SEQ ID NO: 3996863 - DNA, 23 bp, Homo sapiens
tcaggtcccacgtctggccaggc

SEQ ID NO: 3996864 - DNA, 14 bp, Homo sapiens
tcaggtcctgctca

SEQ ID NO: 3996865 - DNA, 16 bp, Homo sapiens
tcaggtcctgctcagc

SEQ ID NO: 3996866 - DNA, 18 bp, Homo sapiens
tcaggtcctgctcagcag

SEQ ID NO: 3996867 - DNA, 19 bp, Homo sapiens
tcaggtgatttgtatgctc

SEQ ID NO: 3996868 - DNA, 17 bp, Homo sapiens
tcaggttctattttctt

SEQ ID NO: 3996869 - DNA, 19 bp, Homo sapiens
tcaggttctattttcttaa

SEQ ID NO: 3996870 - DNA, 17 bp, Homo sapiens
tcaggttgacaggaggt

SEQ ID NO: 3996871 - DNA, 14 bp, Homo sapiens
tcagtaaacaactt

SEQ ID NO: 3996872 - DNA, 16 bp, Homo sapiens
tcagtaccctctcagc

SEQ ID NO: 3996873 - DNA, 17 bp, Homo sapiens
tcagtaccctctcagct

SEQ ID NO: 3996874 - DNA, 22 bp, Homo sapiens
tcagtacttgtgaaacacagct

SEQ ID NO: 3996875 - DNA, 24 bp, Homo sapiens
tcagtacttgtgaaacacagctgt

SEQ ID NO: 3996876 - DNA, 16 bp, Homo sapiens
tcagtacttttattaa

SEQ ID NO: 3996877 - DNA, 19 bp, Homo sapiens
tcagtacttttattaatat

SEQ ID NO: 3996878 - DNA, 15 bp, Homo sapiens
tcagtatgtattctt

SEQ ID NO: 3996879 - DNA, 14 bp, Homo sapiens
tcagtatttcagtg

SEQ ID NO: 3996880 - DNA, 16 bp, Homo sapiens
tcagtcaatattttta

SEQ ID NO: 3996881 - DNA, 17 bp, Homo sapiens
tccaatttacatactct

SEQ ID NO: 3996882 - DNA, 14 bp, Homo sapiens
tccacaaatgatgt

SEQ ID NO: 3996883 - DNA, 17 bp, Homo sapiens
tccacaaggaataaatg

SEQ ID NO: 3996884 - DNA, 20 bp, Homo sapiens
tccacaattattggcaaagt

SEQ ID NO: 3996885 - DNA, 17 bp, Homo sapiens
tccacaccagtggcctc

SEQ ID NO: 3996886 - DNA, 16 bp, Homo sapiens
tccacagagtgagcca

SEQ ID NO: 3996887 - DNA, 20 bp, Homo sapiens
tccacagagtgagccagtga

SEQ ID NO: 3996888 - DNA, 20 bp, Homo sapiens
tccacagcaaccccaggctg

SEQ ID NO: 3996889 - DNA, 19 bp, Homo sapiens
tccacagcggaggagacca

SEQ ID NO: 3996890 - DNA, 22 bp, Homo sapiens
tccacagcggaggagaccagct

SEQ ID NO: 3996891 - DNA, 16 bp, Homo sapiens
tccacagttgccacca

SEQ ID NO: 3996892 - DNA, 19 bp, Homo sapiens
tccacagttgccaccacct

SEQ ID NO: 3996893 - DNA, 17 bp, Homo sapiens
tccacatcccagcagcc

SEQ ID NO: 3996894 - DNA, 13 bp, Homo sapiens
tccacatctgcct

SEQ ID NO: 3996895 - DNA, 16 bp, Homo sapiens
tccacatttgtcacag

SEQ ID NO: 3996896 - DNA, 18 bp, Homo sapiens
tccacatttgtcacagaa

SEQ ID NO: 3996897 - DNA, 21 bp, Homo sapiens
tccaccacatctgccagacct

SEQ ID NO: 3996898 - DNA, 13 bp, Homo sapiens
tccaccagcagca

SEQ ID NO: 3996899 - DNA, 14 bp, Homo sapiens
tccaccagcagcat

SEQ ID NO: 3996900 - DNA, 15 bp, Homo sapiens
tccaccagcagcatg

SEQ ID NO: 3996901 - DNA, 17 bp, Homo sapiens
tccacccaccttggcct

SEQ ID NO: 3996902 - DNA, 12 bp, Homo sapiens
tccacccagcaa

SEQ ID NO: 3996903 - DNA, 11 bp, Homo sapiens
tccacccagcc

SEQ ID NO: 3996904 - DNA, 20 bp, Homo sapiens
tccacccataataagagaat

SEQ ID NO: 3996905 - DNA, 22 bp, Homo sapiens
tccacccataatcctttctgcc

SEQ ID NO: 3996906 - DNA, 14 bp, Homo sapiens
tccaccccccacac

SEQ ID NO: 3996907 - DNA, 19 bp, Homo sapiens
tccaccccccacacacact

SEQ ID NO: 3996908 - DNA, 13 bp, Homo sapiens
tccaccctccacc

SEQ ID NO: 3996909 - DNA, 14 bp, Homo sapiens
tccaccctccacct

SEQ ID NO: 3996910 - DNA, 18 bp, Homo sapiens
tccaccctccaccttcca

SEQ ID NO: 3996911 - DNA, 22 bp, Homo sapiens
tccaccctggccgagtccaagc

SEQ ID NO: 3996912 - DNA, 13 bp, Homo sapiens
tccacccttggcc

SEQ ID NO: 3996913 - DNA, 14 bp, Homo sapiens
tccacccttggcct

SEQ ID NO: 3996914 - DNA, 20 bp, Homo sapiens
tccacccttggcctgtctca

SEQ ID NO: 3996915 - DNA, 21 bp, Homo sapiens
tccacctgccttggcctccca

SEQ ID NO: 3996916 - DNA, 17 bp, Homo sapiens
tccacctgctctgctga

SEQ ID NO: 3996917 - DNA, 13 bp, Homo sapiens
tccacctgtctca

SEQ ID NO: 3996918 - DNA, 17 bp, Homo sapiens
tccacctgtctcagcct

SEQ ID NO: 3996919 - DNA, 19 bp, Homo sapiens
tccaccttggctctgccag

SEQ ID NO: 3996920 - DNA, 17 bp, Homo sapiens
tccacgcagttctttcc

SEQ ID NO: 3996921 - DNA, 14 bp, Homo sapiens
tccacgcctcctgg

SEQ ID NO: 3996922 - DNA, 17 bp, Homo sapiens
tccacgcctcctggcca

SEQ ID NO: 3996923 - DNA, 20 bp, Homo sapiens
tccactaaatgagctcctgc

SEQ ID NO: 3996924 - DNA, 20 bp, Homo sapiens
tccactaccccacaccagcc

SEQ ID NO: 3996925 - DNA, 17 bp, Homo sapiens
tccactcccacctcacc

SEQ ID NO: 3996926 - DNA, 17 bp, Homo sapiens
tccactcgacccagaat

SEQ ID NO: 3996927 - DNA, 23 bp, Homo sapiens
tccactctaccctcccaccccct

SEQ ID NO: 3996928 - DNA, 15 bp, Homo sapiens
tccactgccttcgat

SEQ ID NO: 3996929 - DNA, 16 bp, Homo sapiens
tccactgggcacaact

SEQ ID NO: 3996930 - DNA, 22 bp, Homo sapiens
tccactggggaggaatcctgga

SEQ ID NO: 3996931 - DNA, 17 bp, Homo sapiens
tccactggggtggcctg

SEQ ID NO: 3996932 - DNA, 18 bp, Homo sapiens
tccactggggtggcctga

SEQ ID NO: 3996933 - DNA, 22 bp, Homo sapiens
tccactgtaattaaaactattt

SEQ ID NO: 3996934 - DNA, 12 bp, Homo sapiens
tccactgtcacc

SEQ ID NO: 3996935 - DNA, 14 bp, Homo sapiens
tccacttcaatgca

SEQ ID NO: 3996936 - DNA, 14 bp, Homo sapiens
tccacttcttcctt

SEQ ID NO: 3996937 - DNA, 18 bp, Homo sapiens
tccacttcttcctttctc

SEQ ID NO: 3996938 - DNA, 16 bp, Homo sapiens
tccagaaactcctgtt

SEQ ID NO: 3996939 - DNA, 20 bp, Homo sapiens
tccagaaactcctgtttctc

SEQ ID NO: 3996940 - DNA, 14 bp, Homo sapiens
tccagaaaggatat

SEQ ID NO: 3996941 - DNA, 18 bp, Homo sapiens
tccagaaaggatatttaa

SEQ ID NO: 3996942 - DNA, 23 bp, Homo sapiens
tccagaaaggatatttaagaaaa

SEQ ID NO: 3996943 - DNA, 22 bp, Homo sapiens
tccagaaatgtccctttcttct

SEQ ID NO: 3996944 - DNA, 23 bp, Homo sapiens
tccagaaatgtctaaatgctgaa

SEQ ID NO: 3996945 - DNA, 15 bp, Homo sapiens
tccagaagaagagaa

SEQ ID NO: 3996946 - DNA, 20 bp, Homo sapiens
tccagaagaagagaagctgc

SEQ ID NO: 3996947 - DNA, 22 bp, Homo sapiens
tccagaagaagagaagctgctg

SEQ ID NO: 3996948 - DNA, 17 bp, Homo sapiens
tccagaagaatattcag

SEQ ID NO: 3996949 - DNA, 19 bp, Homo sapiens
tccagaagaatattcagga

SEQ ID NO: 3996950 - DNA, 22 bp, Homo sapiens
tccagaagaatattcaggactt

SEQ ID NO: 3996951 - DNA, 15 bp, Homo sapiens
tccagaagagcccat

SEQ ID NO: 3996952 - DNA, 19 bp, Homo sapiens
tccagaaggatccaagaca

SEQ ID NO: 3996953 - DNA, 12 bp, Homo sapiens
tccagaatatct

SEQ ID NO: 3996954 - DNA, 23 bp, Homo sapiens
tccagaatatctgggattctact

SEQ ID NO: 3996955 - DNA, 17 bp, Homo sapiens
tccagaatgctgtacat

SEQ ID NO: 3996956 - DNA, 21 bp, Homo sapiens
tccagaatgctgtacatctat

SEQ ID NO: 3996957 - DNA, 18 bp, Homo sapiens
tccagaatgtaagaaaac

SEQ ID NO: 3996958 - DNA, 13 bp, Homo sapiens
tccagacccctgg

SEQ ID NO: 3996959 - DNA, 11 bp, Homo sapiens
tccagacctga

SEQ ID NO: 3996960 - DNA, 13 bp, Homo sapiens
tccagacctggct

SEQ ID NO: 3996961 - DNA, 14 bp, Homo sapiens
tccagacttccttg

SEQ ID NO: 3996962 - DNA, 20 bp, Homo sapiens
tccagacttccttgagacac

SEQ ID NO: 3996963 - DNA, 14 bp, Homo sapiens
tccagagagcagct

SEQ ID NO: 3996964 - DNA, 20 bp, Homo sapiens
tccagagagcttaaattgtc

SEQ ID NO: 3996965 - DNA, 20 bp, Homo sapiens
tccagagcaaccagaaggag

SEQ ID NO: 3996966 - DNA, 20 bp, Homo sapiens
tccagagcattccagtcagg

SEQ ID NO: 3996967 - DNA, 20 bp, Homo sapiens
tccagagcggaggctgtgtg

SEQ ID NO: 3996968 - DNA, 16 bp, Homo sapiens
tccagagctgcttccc

SEQ ID NO: 3996969 - DNA, 15 bp, Homo sapiens
tccagaggtattcct

SEQ ID NO: 3996970 - DNA, 17 bp, Homo sapiens
tccagaggtcctccgta

SEQ ID NO: 3996971 - DNA, 18 bp, Homo sapiens
tccagattattggctgct

SEQ ID NO: 3996972 - DNA, 17 bp, Homo sapiens
tccagattgacgacaag

SEQ ID NO: 3996973 - DNA, 15 bp, Homo sapiens
tccagcaataagaaa

SEQ ID NO: 3996974 - DNA, 18 bp, Homo sapiens
tccagcaattctcctgcc

SEQ ID NO: 3996975 - DNA, 12 bp, Homo sapiens
tccagcactggt

SEQ ID NO: 3996976 - DNA, 15 bp, Homo sapiens
tccagcagtgttgct

SEQ ID NO: 3996977 - DNA, 15 bp, Homo sapiens
tccagccatctcatg

SEQ ID NO: 3996978 - DNA, 12 bp, Homo sapiens
tccagcccctgt

SEQ ID NO: 3996979 - DNA, 13 bp, Homo sapiens
tccagcccctgtc

SEQ ID NO: 3996980 - DNA, 23 bp, Homo sapiens
tccagcccctgtcccaccccctt

SEQ ID NO: 3996981 - DNA, 19 bp, Homo sapiens
tccagccctattctgccac

SEQ ID NO: 3996982 - DNA, 16 bp, Homo sapiens
tccagcctccctgtct

SEQ ID NO: 3996983 - DNA, 22 bp, Homo sapiens
tccagcctccctgtctccagct

SEQ ID NO: 3996984 - DNA, 14 bp, Homo sapiens
tcccatctcttcct

SEQ ID NO: 3996985 - DNA, 13 bp, Homo sapiens
tcccatctgcacc

SEQ ID NO: 3996986 - DNA, 21 bp, Homo sapiens
tcccatctttttaacctctgt

SEQ ID NO: 3996987 - DNA, 23 bp, Homo sapiens
tcccatctttttaacctctgttc

SEQ ID NO: 3996988 - DNA, 19 bp, Homo sapiens
tcccatgactgcacccagc

SEQ ID NO: 3996989 - DNA, 23 bp, Homo sapiens
tcccatgactgcacccagctcca

SEQ ID NO: 3996990 - DNA, 22 bp, Homo sapiens
tcccatgagaccctggtgcctg

SEQ ID NO: 3996991 - DNA, 15 bp, Homo sapiens
tcccatgcaggccct

SEQ ID NO: 3996992 - DNA, 16 bp, Homo sapiens
tcccatgcaggccctt

SEQ ID NO: 3996993 - DNA, 22 bp, Homo sapiens
tcccatgtatttatctctattt

SEQ ID NO: 3996994 - DNA, 20 bp, Homo sapiens
tcccattaatcatttcccca

SEQ ID NO: 3996995 - DNA, 14 bp, Homo sapiens
tcccattcctgaag

SEQ ID NO: 3996996 - DNA, 16 bp, Homo sapiens
tcccatttcaggaatt

SEQ ID NO: 3996997 - DNA, 12 bp, Homo sapiens
tcccatttcctt

SEQ ID NO: 3996998 - DNA, 15 bp, Homo sapiens
tcccatttctcactg

SEQ ID NO: 3996999 - DNA, 18 bp, Homo sapiens
tcccatttctcactgaga

SEQ ID NO: 3997000 - DNA, 15 bp, Homo sapiens
tcccatttcttccca

SEQ ID NO: 3997001 - DNA, 16 bp, Homo sapiens
tccccaaccacagaga

SEQ ID NO: 3997002 - DNA, 17 bp, Homo sapiens
tccccaaccacagagaa

SEQ ID NO: 3997003 - DNA, 16 bp, Homo sapiens
tccccaagcccaccag

SEQ ID NO: 3997004 - DNA, 19 bp, Homo sapiens
tccccaaggccccctgcct

SEQ ID NO: 3997005 - DNA, 23 bp, Homo sapiens
tccccaaggccccctgcctgccc

SEQ ID NO: 3997006 - DNA, 19 bp, Homo sapiens
tccccacaccttccagggc

SEQ ID NO: 3997007 - DNA, 13 bp, Homo sapiens
tccccaccagctc

SEQ ID NO: 3997008 - DNA, 15 bp, Homo sapiens
tccccacccctgccc

SEQ ID NO: 3997009 - DNA, 13 bp, Homo sapiens
tccccaccctcca

SEQ ID NO: 3997010 - DNA, 16 bp, Homo sapiens
tccccacgagggctgg

SEQ ID NO: 3997011 - DNA, 17 bp, Homo sapiens
tccccacgagggctggc

SEQ ID NO: 3997012 - DNA, 23 bp, Homo sapiens
tccccactcccccgtttctcctt

SEQ ID NO: 3997013 - DNA, 22 bp, Homo sapiens
tccccactccctggctctcaga

SEQ ID NO: 3997014 - DNA, 16 bp, Homo sapiens
tccccactgacagcct

SEQ ID NO: 3997015 - DNA, 19 bp, Homo sapiens
tccccactgacagcctccc

SEQ ID NO: 3997016 - DNA, 11 bp, Homo sapiens
tccccagagaa

SEQ ID NO: 3997017 - DNA, 15 bp, Homo sapiens
tccccagatctccca

SEQ ID NO: 3997018 - DNA, 17 bp, Homo sapiens
tccccagatctcccact

SEQ ID NO: 3997019 - DNA, 12 bp, Homo sapiens
tccccagcccag

SEQ ID NO: 3997020 - DNA, 16 bp, Homo sapiens
tccccagcccagagac

SEQ ID NO: 3997021 - DNA, 17 bp, Homo sapiens
tccccagcccagagaca

SEQ ID NO: 3997022 - DNA, 18 bp, Homo sapiens
tccccagcccttcctctg

SEQ ID NO: 3997023 - DNA, 19 bp, Homo sapiens
tccccaggatggactcttc

SEQ ID NO: 3997024 - DNA, 23 bp, Homo sapiens
tccccaggccaggccaccaggat

SEQ ID NO: 3997025 - DNA, 13 bp, Homo sapiens
tccccaggctgga

SEQ ID NO: 3997026 - DNA, 18 bp, Homo sapiens
tccccagggagctctggg

SEQ ID NO: 3997027 - DNA, 20 bp, Homo sapiens
tccccaggggtcccagccac

SEQ ID NO: 3997028 - DNA, 20 bp, Homo sapiens
tccccatagataggcccctg

SEQ ID NO: 3997029 - DNA, 14 bp, Homo sapiens
tccccatccccacc

SEQ ID NO: 3997030 - DNA, 16 bp, Homo sapiens
tccccatcctccagag

SEQ ID NO: 3997031 - DNA, 22 bp, Homo sapiens
tccccatctccctgcctggccc

SEQ ID NO: 3997032 - DNA, 14 bp, Homo sapiens
tccccatctgggtc

SEQ ID NO: 3997033 - DNA, 15 bp, Homo sapiens
tccccatctgtccag

SEQ ID NO: 3997034 - DNA, 19 bp, Homo sapiens
tccccatcttctaaaccca

SEQ ID NO: 3997035 - DNA, 21 bp, Homo sapiens
tccccatgccacgttccacag

SEQ ID NO: 3997036 - DNA, 12 bp, Homo sapiens
tccccatgccta

SEQ ID NO: 3997037 - DNA, 15 bp, Homo sapiens
tccccatttcccatc

SEQ ID NO: 3997038 - DNA, 19 bp, Homo sapiens
tccccatttctgcctcgct

SEQ ID NO: 3997039 - DNA, 18 bp, Homo sapiens
tcccccaaaggcatccca

SEQ ID NO: 3997040 - DNA, 19 bp, Homo sapiens
tcccccaacccccacccca

SEQ ID NO: 3997041 - DNA, 20 bp, Homo sapiens
tcccccaacccccaccccac

SEQ ID NO: 3997042 - DNA, 13 bp, Homo sapiens
tcccccaccctcc

SEQ ID NO: 3997043 - DNA, 13 bp, Homo sapiens
tcccccactccca

SEQ ID NO: 3997044 - DNA, 14 bp, Homo sapiens
tcccccaggctgga

SEQ ID NO: 3997045 - DNA, 14 bp, Homo sapiens
tcccccaggctgtt

SEQ ID NO: 3997046 - DNA, 12 bp, Homo sapiens
tccccccactct

SEQ ID NO: 3997047 - DNA, 21 bp, Homo sapiens
tccccccactctccccacact

SEQ ID NO: 3997048 - DNA, 13 bp, Homo sapiens
tccccccagtggg

SEQ ID NO: 3997049 - DNA, 20 bp, Homo sapiens
tcccccctttttttcctttt

SEQ ID NO: 3997050 - DNA, 13 bp, Homo sapiens
tcccccgagctct

SEQ ID NO: 3997051 - DNA, 14 bp, Homo sapiens
tcccccgagctctt

SEQ ID NO: 3997052 - DNA, 16 bp, Homo sapiens
tcccccgagctcttgg

SEQ ID NO: 3997053 - DNA, 14 bp, Homo sapiens
tcccccgccactcc

SEQ ID NO: 3997054 - DNA, 13 bp, Homo sapiens
tccccctacccac

SEQ ID NO: 3997055 - DNA, 21 bp, Homo sapiens
tccccctccccaggctggaga

SEQ ID NO: 3997056 - DNA, 17 bp, Homo sapiens
tccccctcccccattcc

SEQ ID NO: 3997057 - DNA, 20 bp, Homo sapiens
tccccctcctccagggaagg

SEQ ID NO: 3997058 - DNA, 17 bp, Homo sapiens
tccccctgttttctgtt

SEQ ID NO: 3997059 - DNA, 12 bp, Homo sapiens
tcccccttccca

SEQ ID NO: 3997060 - DNA, 17 bp, Homo sapiens
tcccccttgccacccca

SEQ ID NO: 3997061 - DNA, 15 bp, Homo sapiens
tccccctttcttcct

SEQ ID NO: 3997062 - DNA, 19 bp, Homo sapiens
tccccgccttagagcctcg

SEQ ID NO: 3997063 - DNA, 24 bp, Homo sapiens
tccccgccttagagcctcgtccct

SEQ ID NO: 3997064 - DNA, 20 bp, Homo sapiens
tccccggacatactctctgc

SEQ ID NO: 3997065 - DNA, 15 bp, Homo sapiens
tccccgtctcattcc

SEQ ID NO: 3997066 - DNA, 20 bp, Homo sapiens
tccccgttcctgacatcaca

SEQ ID NO: 3997067 - DNA, 14 bp, Homo sapiens
tcccctcactctgt

SEQ ID NO: 3997068 - DNA, 17 bp, Homo sapiens
tcccctcactctgtcag

SEQ ID NO: 3997069 - DNA, 22 bp, Homo sapiens
tcccctcactctgtcagccagc

SEQ ID NO: 3997070 - DNA, 15 bp, Homo sapiens
tcccctccactgtca

SEQ ID NO: 3997071 - DNA, 13 bp, Homo sapiens
tcccctccaggaa

SEQ ID NO: 3997072 - DNA, 19 bp, Homo sapiens
tcccctcccacctctcctt

SEQ ID NO: 3997073 - DNA, 13 bp, Homo sapiens
tcccctccctgtc

SEQ ID NO: 3997074 - DNA, 20 bp, Homo sapiens
tcccctccggactggtgccc

SEQ ID NO: 3997075 - DNA, 14 bp, Homo sapiens
tcccctccttccct

SEQ ID NO: 3997076 - DNA, 20 bp, Homo sapiens
tcccctccttccctcacccc

SEQ ID NO: 3997077 - DNA, 22 bp, Homo sapiens
tcccctccttccctcaccccca

SEQ ID NO: 3997078 - DNA, 18 bp, Homo sapiens
tcccctccttctcccttt

SEQ ID NO: 3997079 - DNA, 14 bp, Homo sapiens
tcccctctgctgct

SEQ ID NO: 3997080 - DNA, 15 bp, Homo sapiens
tcccctctgctgctg

SEQ ID NO: 3997081 - DNA, 13 bp, Homo sapiens
tcccctctgcttc

SEQ ID NO: 3997082 - DNA, 13 bp, Homo sapiens
tcccctctggctt

SEQ ID NO: 3997083 - DNA, 24 bp, Homo sapiens
tcccctgccctggtccagggaagc

SEQ ID NO: 3997084 - DNA, 19 bp, Homo sapiens
tcccctgcggtcaggctgg

SEQ ID NO: 3997085 - DNA, 20 bp, Homo sapiens
tcccctgggggtttcacctg

SEQ ID NO: 3997086 - DNA, 12 bp, Homo sapiens
tcccctgtgtca

SEQ ID NO: 3997087 - DNA, 19 bp, Homo sapiens
tcctctccccagcccagag

SEQ ID NO: 3997088 - DNA, 22 bp, Homo sapiens
tcctctccccctcctccaggga

SEQ ID NO: 3997089 - DNA, 18 bp, Homo sapiens
tcctctcccctccagcct

SEQ ID NO: 3997090 - DNA, 16 bp, Homo sapiens
tcctctcgagcccaga

SEQ ID NO: 3997091 - DNA, 17 bp, Homo sapiens
tcctctcgagcccagat

SEQ ID NO: 3997092 - DNA, 22 bp, Homo sapiens
tcctctcgagcccagatggaaa

SEQ ID NO: 3997093 - DNA, 14 bp, Homo sapiens
tcctctctgagact

SEQ ID NO: 3997094 - DNA, 12 bp, Homo sapiens
tcctctctgggc

SEQ ID NO: 3997095 - DNA, 13 bp, Homo sapiens
tcctctctgggcc

SEQ ID NO: 3997096 - DNA, 14 bp, Homo sapiens
tcctctgagcccag

SEQ ID NO: 3997097 - DNA, 13 bp, Homo sapiens
tcctctgcaagct

SEQ ID NO: 3997098 - DNA, 22 bp, Homo sapiens
tcctctgcaagcttcttgctga

SEQ ID NO: 3997099 - DNA, 16 bp, Homo sapiens
tcctctgcctacagcc

SEQ ID NO: 3997100 - DNA, 18 bp, Homo sapiens
tcctctgcctacagccag

SEQ ID NO: 3997101 - DNA, 20 bp, Homo sapiens
tcctctgcctacagccaggt

SEQ ID NO: 3997102 - DNA, 12 bp, Homo sapiens
tcctctgcctgc

SEQ ID NO: 3997103 - DNA, 12 bp, Homo sapiens
tcctctgctccc

SEQ ID NO: 3997104 - DNA, 15 bp, Homo sapiens
tcctctggacggcag

SEQ ID NO: 3997105 - DNA, 18 bp, Homo sapiens
tcctctggacggcaggct

SEQ ID NO: 3997106 - DNA, 24 bp, Homo sapiens
tcctctggacggcaggctcactgc

SEQ ID NO: 3997107 - DNA, 16 bp, Homo sapiens
tcctctggccgcagag

SEQ ID NO: 3997108 - DNA, 19 bp, Homo sapiens
tcctctggccgcagaggtg

SEQ ID NO: 3997109 - DNA, 15 bp, Homo sapiens
tcctctggctttccc

SEQ ID NO: 3997110 - DNA, 19 bp, Homo sapiens
tcctctgtcagtcacagcc

SEQ ID NO: 3997111 - DNA, 12 bp, Homo sapiens
tcctctgtctgc

SEQ ID NO: 3997112 - DNA, 13 bp, Homo sapiens
tcctcttcaccag

SEQ ID NO: 3997113 - DNA, 14 bp, Homo sapiens
tcctcttcaccagg

SEQ ID NO: 3997114 - DNA, 18 bp, Homo sapiens
tcctcttccctctctgca

SEQ ID NO: 3997115 - DNA, 12 bp, Homo sapiens
tcctcttctgct

SEQ ID NO: 3997116 - DNA, 21 bp, Homo sapiens
tcctcttctgctcttttcctg

SEQ ID NO: 3997117 - DNA, 23 bp, Homo sapiens
tcctcttctgcttaggagagacc

SEQ ID NO: 3997118 - DNA, 17 bp, Homo sapiens
tcctcttgattcctggt

SEQ ID NO: 3997119 - DNA, 13 bp, Homo sapiens
tcctcttgtccta

SEQ ID NO: 3997120 - DNA, 20 bp, Homo sapiens
tcctcttgtgatttctttaa

SEQ ID NO: 3997121 - DNA, 21 bp, Homo sapiens
tcctcttttatcttggactga

SEQ ID NO: 3997122 - DNA, 21 bp, Homo sapiens
tcctgaaacgctcctttgtgt

SEQ ID NO: 3997123 - DNA, 22 bp, Homo sapiens
tcctgaaagtgtttttaaataa

SEQ ID NO: 3997124 - DNA, 14 bp, Homo sapiens
tcctgaagaaccag

SEQ ID NO: 3997125 - DNA, 16 bp, Homo sapiens
tcctgaagaaccagtc

SEQ ID NO: 3997126 - DNA, 13 bp, Homo sapiens
tcctgaagaatta

SEQ ID NO: 3997127 - DNA, 14 bp, Homo sapiens
tcctgaagaattaa

SEQ ID NO: 3997128 - DNA, 19 bp, Homo sapiens
tcctgaatgaaatatcaga

SEQ ID NO: 3997129 - DNA, 20 bp, Homo sapiens
tcctgacatcacagcagcct

SEQ ID NO: 3997130 - DNA, 16 bp, Homo sapiens
tcctgacctcaggtga

SEQ ID NO: 3997131 - DNA, 18 bp, Homo sapiens
tcctgactgggctgggtt

SEQ ID NO: 3997132 - DNA, 13 bp, Homo sapiens
tcctgacttctaa

SEQ ID NO: 3997133 - DNA, 13 bp, Homo sapiens
tcctgagaagcat

SEQ ID NO: 3997134 - DNA, 15 bp, Homo sapiens
tcctgagcctgtggg

SEQ ID NO: 3997135 - DNA, 16 bp, Homo sapiens
tcctgagcctgtgggt

SEQ ID NO: 3997136 - DNA, 22 bp, Homo sapiens
tcctgagggtccccacctggga

SEQ ID NO: 3997137 - DNA, 17 bp, Homo sapiens
tcctgagtgtggacttg

SEQ ID NO: 3997138 - DNA, 18 bp, Homo sapiens
tcctgataaagcacagct

SEQ ID NO: 3997139 - DNA, 18 bp, Homo sapiens
tcctgataataattgatc

SEQ ID NO: 3997140 - DNA, 20 bp, Homo sapiens
tcctgattggtttctcttct

SEQ ID NO: 3997141 - DNA, 23 bp, Homo sapiens
tcctgattggtttctcttctccc

SEQ ID NO: 3997142 - DNA, 17 bp, Homo sapiens
tcctgcaaaattttata

SEQ ID NO: 3997143 - DNA, 19 bp, Homo sapiens
tcctgcaaaattttatagc

SEQ ID NO: 3997144 - DNA, 17 bp, Homo sapiens
tcctgcaactcaaggac

SEQ ID NO: 3997145 - DNA, 14 bp, Homo sapiens
tcctgcaatgaaag

SEQ ID NO: 3997146 - DNA, 15 bp, Homo sapiens
tcctgcaattttcta

SEQ ID NO: 3997147 - DNA, 13 bp, Homo sapiens
tcctgcagcaaac

SEQ ID NO: 3997148 - DNA, 20 bp, Homo sapiens
tcctgcagcaaacactccac

SEQ ID NO: 3997149 - DNA, 14 bp, Homo sapiens
tcctgccagcccca

SEQ ID NO: 3997150 - DNA, 22 bp, Homo sapiens
tcctgccaggcacacacagccc

SEQ ID NO: 3997151 - DNA, 15 bp, Homo sapiens
tcctgcccactgata

SEQ ID NO: 3997152 - DNA, 16 bp, Homo sapiens
tcctgcccatgtgtcc

SEQ ID NO: 3997153 - DNA, 16 bp, Homo sapiens
tcctgccccacactcc

SEQ ID NO: 3997154 - DNA, 21 bp, Homo sapiens
tcctgccccagatggctttgt

SEQ ID NO: 3997155 - DNA, 22 bp, Homo sapiens
tcctgccccagatggctttgtg

SEQ ID NO: 3997156 - DNA, 14 bp, Homo sapiens
tcctgccctgtcca

SEQ ID NO: 3997157 - DNA, 21 bp, Homo sapiens
tcctgccctgtccctgtcccc

SEQ ID NO: 3997158 - DNA, 18 bp, Homo sapiens
tcctgccctgttgtgtat

SEQ ID NO: 3997159 - DNA, 19 bp, Homo sapiens
tcctgccgcagacgggcac

SEQ ID NO: 3997160 - DNA, 20 bp, Homo sapiens
tcctgcctgcccctctcccg

SEQ ID NO: 3997161 - DNA, 24 bp, Homo sapiens
tcctgcctggcacttactggtcct

SEQ ID NO: 3997162 - DNA, 19 bp, Homo sapiens
tcctgcgggagtagttgga

SEQ ID NO: 3997163 - DNA, 15 bp, Homo sapiens
tcctgcgtcctcctc

SEQ ID NO: 3997164 - DNA, 20 bp, Homo sapiens
tcctgctacaacttcagcag

SEQ ID NO: 3997165 - DNA, 13 bp, Homo sapiens
tcctgctacagga

SEQ ID NO: 3997166 - DNA, 14 bp, Homo sapiens
tcctgctacaggag

SEQ ID NO: 3997167 - DNA, 23 bp, Homo sapiens
tcctgctacctcccttgcctttc

SEQ ID NO: 3997168 - DNA, 16 bp, Homo sapiens
tcctgctcaccacctg

SEQ ID NO: 3997169 - DNA, 17 bp, Homo sapiens
tcctgctcaccacctgc

SEQ ID NO: 3997170 - DNA, 21 bp, Homo sapiens
tcctgctcaccacctgcctct

SEQ ID NO: 3997171 - DNA, 22 bp, Homo sapiens
tcctgctcattatgccacttcc

SEQ ID NO: 3997172 - DNA, 11 bp, Homo sapiens
tcctgctctgc

SEQ ID NO: 3997173 - DNA, 13 bp, Homo sapiens
tcctgctctgctc

SEQ ID NO: 3997174 - DNA, 14 bp, Homo sapiens
tcctgctgcaccct

SEQ ID NO: 3997175 - DNA, 15 bp, Homo sapiens
tcctgctgcaccctg

SEQ ID NO: 3997176 - DNA, 21 bp, Homo sapiens
tcctgctgccagtaccagccc

SEQ ID NO: 3997177 - DNA, 15 bp, Homo sapiens
tcctgctttggcagt

SEQ ID NO: 3997178 - DNA, 18 bp, Homo sapiens
tcctgctttgggaagccg

SEQ ID NO: 3997179 - DNA, 17 bp, Homo sapiens
tcctgcttttctgtcct

SEQ ID NO: 3997180 - DNA, 19 bp, Homo sapiens
tcctgcttttctgtcctgg

SEQ ID NO: 3997181 - DNA, 20 bp, Homo sapiens
tcctggaaaagaagaaactt

SEQ ID NO: 3997182 - DNA, 15 bp, Homo sapiens
tcctggaaccaatcc

SEQ ID NO: 3997183 - DNA, 22 bp, Homo sapiens
tcctggaaccttgctgtcctga

SEQ ID NO: 3997184 - DNA, 22 bp, Homo sapiens
tcctggaagcgcgagggcctca

SEQ ID NO: 3997185 - DNA, 20 bp, Homo sapiens
tcctggaatttggacaagtg

SEQ ID NO: 3997186 - DNA, 14 bp, Homo sapiens
tcctggaggcccag

SEQ ID NO: 3997187 - DNA, 15 bp, Homo sapiens
tcctggaggcccagt

SEQ ID NO: 3997188 - DNA, 14 bp, Homo sapiens
tcctggaggctgcc

SEQ ID NO: 3997189 - DNA, 21 bp, Homo sapiens
tcctggcaatagtgtgttctg

SEQ ID NO: 3997190 - DNA, 20 bp, Homo sapiens
tctacagctaatcagcattc

SEQ ID NO: 3997191 - DNA, 18 bp, Homo sapiens
tctacagtcgtaaaagag

SEQ ID NO: 3997192 - DNA, 23 bp, Homo sapiens
tctacagtcgtaaaagagataat

SEQ ID NO: 3997193 - DNA, 13 bp, Homo sapiens
tctacagtggttt

SEQ ID NO: 3997194 - DNA, 20 bp, Homo sapiens
tctacataagtaattcaaga

SEQ ID NO: 3997195 - DNA, 16 bp, Homo sapiens
tctacatttgagggcc

SEQ ID NO: 3997196 - DNA, 18 bp, Homo sapiens
tctacatttgagggccca

SEQ ID NO: 3997197 - DNA, 16 bp, Homo sapiens
tctaccaggcaaattc

SEQ ID NO: 3997198 - DNA, 18 bp, Homo sapiens
tctacccatgagcctgcc

SEQ ID NO: 3997199 - DNA, 23 bp, Homo sapiens
tctacccatgagcctgcccgctg

SEQ ID NO: 3997200 - DNA, 22 bp, Homo sapiens
tctacccctcccggccctgcct

SEQ ID NO: 3997201 - DNA, 23 bp, Homo sapiens
tctacccctcccggccctgcctg

SEQ ID NO: 3997202 - DNA, 14 bp, Homo sapiens
tctaccctggcact

SEQ ID NO: 3997203 - DNA, 21 bp, Homo sapiens
tctaccctggcactataatgt

SEQ ID NO: 3997204 - DNA, 20 bp, Homo sapiens
tctacctaatgtctcactgt

SEQ ID NO: 3997205 - DNA, 18 bp, Homo sapiens
tctacctgccctcaaggg

SEQ ID NO: 3997206 - DNA, 17 bp, Homo sapiens
tctaccttcctgtccct

SEQ ID NO: 3997207 - DNA, 18 bp, Homo sapiens
tctaccttcctgtccctg

SEQ ID NO: 3997208 - DNA, 16 bp, Homo sapiens
tctaccttgaggtctt

SEQ ID NO: 3997209 - DNA, 14 bp, Homo sapiens
tctaccttttctgg

SEQ ID NO: 3997210 - DNA, 22 bp, Homo sapiens
tctacgccactccacaaatgat

SEQ ID NO: 3997211 - DNA, 18 bp, Homo sapiens
tctactgaggtgctatgt

SEQ ID NO: 3997212 - DNA, 18 bp, Homo sapiens
tctactggagtggaaggt

SEQ ID NO: 3997213 - DNA, 13 bp, Homo sapiens
tctacttaataaa

SEQ ID NO: 3997214 - DNA, 18 bp, Homo sapiens
tctactttttttttaatt

SEQ ID NO: 3997215 - DNA, 21 bp, Homo sapiens
tctagaagactgtcagcttcc

SEQ ID NO: 3997216 - DNA, 11 bp, Homo sapiens
tctagaatgtg

SEQ ID NO: 3997217 - DNA, 20 bp, Homo sapiens
tctagaatgtgttttctgaa

SEQ ID NO: 3997218 - DNA, 17 bp, Homo sapiens
tctagaattataagtca

SEQ ID NO: 3997219 - DNA, 19 bp, Homo sapiens
tctagaattttaagtgctt

SEQ ID NO: 3997220 - DNA, 20 bp, Homo sapiens
tctagacaagatattgtaca

SEQ ID NO: 3997221 - DNA, 23 bp, Homo sapiens
tctagacaagatattgtacataa

SEQ ID NO: 3997222 - DNA, 16 bp, Homo sapiens
tctagacactttttct

SEQ ID NO: 3997223 - DNA, 23 bp, Homo sapiens
tctagacactttttctttacaaa

SEQ ID NO: 3997224 - DNA, 16 bp, Homo sapiens
tctagagatatatata

SEQ ID NO: 3997225 - DNA, 18 bp, Homo sapiens
tctagagatatatatact

SEQ ID NO: 3997226 - DNA, 15 bp, Homo sapiens
tctagagtctcagaa

SEQ ID NO: 3997227 - DNA, 22 bp, Homo sapiens
tctagcaaccgcctcaaaatgt

SEQ ID NO: 3997228 - DNA, 17 bp, Homo sapiens
tctagcactcattttct

SEQ ID NO: 3997229 - DNA, 18 bp, Homo sapiens
tctagcactcattttcta

SEQ ID NO: 3997230 - DNA, 20 bp, Homo sapiens
tctagcctatttacctgcag

SEQ ID NO: 3997231 - DNA, 12 bp, Homo sapiens
tctagcctgggc

SEQ ID NO: 3997232 - DNA, 14 bp, Homo sapiens
tctagctaaataaa

SEQ ID NO: 3997233 - DNA, 17 bp, Homo sapiens
tctagctaaataaatgg

SEQ ID NO: 3997234 - DNA, 16 bp, Homo sapiens
tctagctagaaatatg

SEQ ID NO: 3997235 - DNA, 21 bp, Homo sapiens
tctagctagaaatatgatttt

SEQ ID NO: 3997236 - DNA, 18 bp, Homo sapiens
tctagctctatttacttc

SEQ ID NO: 3997237 - DNA, 13 bp, Homo sapiens
tctagctgtatga

SEQ ID NO: 3997238 - DNA, 17 bp, Homo sapiens
tctagctgtatgatttg

SEQ ID NO: 3997239 - DNA, 18 bp, Homo sapiens
tctagctgtatgatttgt

SEQ ID NO: 3997240 - DNA, 19 bp, Homo sapiens
tctagctgtatgatttgtt

SEQ ID NO: 3997241 - DNA, 18 bp, Homo sapiens
tctagctgttgagctgtt

SEQ ID NO: 3997242 - DNA, 15 bp, Homo sapiens
tctagctttgtcata

SEQ ID NO: 3997243 - DNA, 15 bp, Homo sapiens
tctaggacctgtgtc

SEQ ID NO: 3997244 - DNA, 16 bp, Homo sapiens
tctaggatgtggagct

SEQ ID NO: 3997245 - DNA, 17 bp, Homo sapiens
tctaggcaagcaggacc

SEQ ID NO: 3997246 - DNA, 18 bp, Homo sapiens
tctaggcaagcaggacct

SEQ ID NO: 3997247 - DNA, 19 bp, Homo sapiens
tctaggcaagcaggacctg

SEQ ID NO: 3997248 - DNA, 23 bp, Homo sapiens
tctaggcaagcaggacctggcat

SEQ ID NO: 3997249 - DNA, 15 bp, Homo sapiens
tctaggcacaaggtt

SEQ ID NO: 3997250 - DNA, 13 bp, Homo sapiens
tctaggtaatttt

SEQ ID NO: 3997251 - DNA, 15 bp, Homo sapiens
tctaggtgtggctgt

SEQ ID NO: 3997252 - DNA, 19 bp, Homo sapiens
tctaggtgtggctgtgaag

SEQ ID NO: 3997253 - DNA, 14 bp, Homo sapiens
tctaggttctaaaa

SEQ ID NO: 3997254 - DNA, 23 bp, Homo sapiens
tctaggttctaaaaattgtgatc

SEQ ID NO: 3997255 - DNA, 22 bp, Homo sapiens
tctagtacttgggagacctgta

SEQ ID NO: 3997256 - DNA, 22 bp, Homo sapiens
tctagtctcctttgcactgagg

SEQ ID NO: 3997257 - DNA, 22 bp, Homo sapiens
tctagtgaggaagacaagcatt

SEQ ID NO: 3997258 - DNA, 19 bp, Homo sapiens
tctagtgcagctgatttta

SEQ ID NO: 3997259 - DNA, 15 bp, Homo sapiens
tctagtgggacagcc

SEQ ID NO: 3997260 - DNA, 19 bp, Homo sapiens
tctagtgggacagcccaga

SEQ ID NO: 3997261 - DNA, 19 bp, Homo sapiens
tctagtggtctttgtaaga

SEQ ID NO: 3997262 - DNA, 21 bp, Homo sapiens
tctagtggtctttgtaagagt

SEQ ID NO: 3997263 - DNA, 21 bp, Homo sapiens
tctagttctttcctccccctg

SEQ ID NO: 3997264 - DNA, 22 bp, Homo sapiens
tctagttttttacttttgttta

SEQ ID NO: 3997265 - DNA, 20 bp, Homo sapiens
tctataaagcgatatacaga

SEQ ID NO: 3997266 - DNA, 15 bp, Homo sapiens
tctataagagaatta

SEQ ID NO: 3997267 - DNA, 13 bp, Homo sapiens
tctataaggccat

SEQ ID NO: 3997268 - DNA, 16 bp, Homo sapiens
tctataaggccataaa

SEQ ID NO: 3997269 - DNA, 20 bp, Homo sapiens
tctataatcccagcactttg

SEQ ID NO: 3997270 - DNA, 18 bp, Homo sapiens
tctataggaacatatgaa

SEQ ID NO: 3997271 - DNA, 12 bp, Homo sapiens
tctatatgaatt

SEQ ID NO: 3997272 - DNA, 18 bp, Homo sapiens
tctatattttaatagaaa

SEQ ID NO: 3997273 - DNA, 14 bp, Homo sapiens
tctatcaagcccag

SEQ ID NO: 3997274 - DNA, 14 bp, Homo sapiens
tctatcagtacttt

SEQ ID NO: 3997275 - DNA, 17 bp, Homo sapiens
tctatcagtacttttat

SEQ ID NO: 3997276 - DNA, 21 bp, Homo sapiens
tctatcatggaatatttatag

SEQ ID NO: 3997277 - DNA, 22 bp, Homo sapiens
tctatccaaagaacttgatttg

SEQ ID NO: 3997278 - DNA, 15 bp, Homo sapiens
tctatccccatccag

SEQ ID NO: 3997279 - DNA, 15 bp, Homo sapiens
tctatcgttattata

SEQ ID NO: 3997280 - DNA, 17 bp, Homo sapiens
tctatcttccaaatgca

SEQ ID NO: 3997281 - DNA, 23 bp, Homo sapiens
tctatcttccaaatgcaatttga

SEQ ID NO: 3997282 - DNA, 11 bp, Homo sapiens
tctatgatata

SEQ ID NO: 3997283 - DNA, 13 bp, Homo sapiens
tctatgcagcatg

SEQ ID NO: 3997284 - DNA, 21 bp, Homo sapiens
tctatgctgtttgtagtgaaa

SEQ ID NO: 3997285 - DNA, 13 bp, Homo sapiens
tctatgggaagat

SEQ ID NO: 3997286 - DNA, 23 bp, Homo sapiens
tctatgggaagatacttattttt

SEQ ID NO: 3997287 - DNA, 14 bp, Homo sapiens
tctatggttatgaa

SEQ ID NO: 3997288 - DNA, 20 bp, Homo sapiens
tctatggttatgaaagaata

SEQ ID NO: 3997289 - DNA, 16 bp, Homo sapiens
tctatgttaaatactg

SEQ ID NO: 3997290 - DNA, 23 bp, Homo sapiens
tctatgttaaatactgtgcagaa

SEQ ID NO: 3997291 - DNA, 16 bp, Homo sapiens
tctattaaagtgactt

SEQ ID NO: 3997292 - DNA, 18 bp, Homo sapiens
tctgaaacacactgaaag

SEQ ID NO: 3997293 - DNA, 20 bp, Homo sapiens
tctgaaacacactgaaagct

SEQ ID NO: 3997294 - DNA, 11 bp, Homo sapiens
tctgaaactgg

SEQ ID NO: 3997295 - DNA, 22 bp, Homo sapiens
tctgaaagaattatttgccttc

SEQ ID NO: 3997296 - DNA, 20 bp, Homo sapiens
tctgaaattcacagaagcct

SEQ ID NO: 3997297 - DNA, 15 bp, Homo sapiens
tctgaacacaggcag

SEQ ID NO: 3997298 - DNA, 17 bp, Homo sapiens
tctgaacacaggcagct

SEQ ID NO: 3997299 - DNA, 15 bp, Homo sapiens
tctgaactcaagctg

SEQ ID NO: 3997300 - DNA, 18 bp, Homo sapiens
tctgaacttgcattgtga

SEQ ID NO: 3997301 - DNA, 19 bp, Homo sapiens
tctgaacttgcattgtgat

SEQ ID NO: 3997302 - DNA, 17 bp, Homo sapiens
tctgaacttgccttaaa

SEQ ID NO: 3997303 - DNA, 12 bp, Homo sapiens
tctgaactttgg

SEQ ID NO: 3997304 - DNA, 19 bp, Homo sapiens
tctgaagagtatccttcct

SEQ ID NO: 3997305 - DNA, 15 bp, Homo sapiens
tctgaagatatattt

SEQ ID NO: 3997306 - DNA, 18 bp, Homo sapiens
tctgaagatatatttcac

SEQ ID NO: 3997307 - DNA, 22 bp, Homo sapiens
tctgaagatatatttcactttt

SEQ ID NO: 3997308 - DNA, 13 bp, Homo sapiens
tctgaaggactgg

SEQ ID NO: 3997309 - DNA, 15 bp, Homo sapiens
tctgaagtcactgca

SEQ ID NO: 3997310 - DNA, 16 bp, Homo sapiens
tctgaagtcactgcac

SEQ ID NO: 3997311 - DNA, 18 bp, Homo sapiens
tctgaagtcactgcacag

SEQ ID NO: 3997312 - DNA, 22 bp, Homo sapiens
tctgaatcgagtgagacaaaat

SEQ ID NO: 3997313 - DNA, 19 bp, Homo sapiens
tctgaatctcaagatgggg

SEQ ID NO: 3997314 - DNA, 16 bp, Homo sapiens
tctgaatgctgctact

SEQ ID NO: 3997315 - DNA, 12 bp, Homo sapiens
tctgaatgttct

SEQ ID NO: 3997316 - DNA, 19 bp, Homo sapiens
tctgaatgttctgacatta

SEQ ID NO: 3997317 - DNA, 22 bp, Homo sapiens
tctgaatgttctgacattaaca

SEQ ID NO: 3997318 - DNA, 19 bp, Homo sapiens
tctgacataatccagtaaa

SEQ ID NO: 3997319 - DNA, 23 bp, Homo sapiens
tctgacataatccagtaaaataa

SEQ ID NO: 3997320 - DNA, 13 bp, Homo sapiens
tctgacatgcatt

SEQ ID NO: 3997321 - DNA, 16 bp, Homo sapiens
tctgacatgcattgtt

SEQ ID NO: 3997322 - DNA, 15 bp, Homo sapiens
tctgacattaacagt

SEQ ID NO: 3997323 - DNA, 11 bp, Homo sapiens
tctgacccagt

SEQ ID NO: 3997324 - DNA, 14 bp, Homo sapiens
tctgacccagtgcc

SEQ ID NO: 3997325 - DNA, 15 bp, Homo sapiens
tctgacccagtgccc

SEQ ID NO: 3997326 - DNA, 17 bp, Homo sapiens
tctgacgtagaaagatc

SEQ ID NO: 3997327 - DNA, 15 bp, Homo sapiens
tctgactaattaggc

SEQ ID NO: 3997328 - DNA, 12 bp, Homo sapiens
tctgactataac

SEQ ID NO: 3997329 - DNA, 22 bp, Homo sapiens
tctgactcatccccacagctgg

SEQ ID NO: 3997330 - DNA, 13 bp, Homo sapiens
tctgactctgagt

SEQ ID NO: 3997331 - DNA, 19 bp, Homo sapiens
tctgacttaagcaaaagaa

SEQ ID NO: 3997332 - DNA, 18 bp, Homo sapiens
tctgactttttgtttctt

SEQ ID NO: 3997333 - DNA, 12 bp, Homo sapiens
tctgagaccagt

SEQ ID NO: 3997334 - DNA, 18 bp, Homo sapiens
tctgagacccttttctca

SEQ ID NO: 3997335 - DNA, 14 bp, Homo sapiens
tctgagactcacag

SEQ ID NO: 3997336 - DNA, 14 bp, Homo sapiens
tctgagaggctctc

SEQ ID NO: 3997337 - DNA, 20 bp, Homo sapiens
tctgagaggctctccgtgca

SEQ ID NO: 3997338 - DNA, 16 bp, Homo sapiens
tctgagatgctcactt

SEQ ID NO: 3997339 - DNA, 23 bp, Homo sapiens
tctgagatttttttgtgtatgtt

SEQ ID NO: 3997340 - DNA, 15 bp, Homo sapiens
tctgagcaagagctg

SEQ ID NO: 3997341 - DNA, 17 bp, Homo sapiens
tctgagcaagagctggc

SEQ ID NO: 3997342 - DNA, 16 bp, Homo sapiens
tctgagcccagctgcc

SEQ ID NO: 3997343 - DNA, 16 bp, Homo sapiens
tctgagcgggaggcag

SEQ ID NO: 3997344 - DNA, 22 bp, Homo sapiens
tctgagcgggaggcagagtttg

SEQ ID NO: 3997345 - DNA, 16 bp, Homo sapiens
tctgagctgcagcctg

SEQ ID NO: 3997346 - DNA, 17 bp, Homo sapiens
tctgagctgcagcctgg

SEQ ID NO: 3997347 - DNA, 14 bp, Homo sapiens
tctgagctgctcac

SEQ ID NO: 3997348 - DNA, 22 bp, Homo sapiens
tctgagctggcctctcactgcc

SEQ ID NO: 3997349 - DNA, 15 bp, Homo sapiens
tctgaggaccgctga

SEQ ID NO: 3997350 - DNA, 16 bp, Homo sapiens
tctgagggaaagtgca

SEQ ID NO: 3997351 - DNA, 16 bp, Homo sapiens
tctgaggtccctgtgt

SEQ ID NO: 3997352 - DNA, 23 bp, Homo sapiens
tctgagtagagcttgtaataaat

SEQ ID NO: 3997353 - DNA, 17 bp, Homo sapiens
tctgagtctggactttg

SEQ ID NO: 3997354 - DNA, 18 bp, Homo sapiens
tctgagtgaacctgtata

SEQ ID NO: 3997355 - DNA, 21 bp, Homo sapiens
tctgagtttaccatttgtaat

SEQ ID NO: 3997356 - DNA, 22 bp, Homo sapiens
tctgagtttaccatttgtaata

SEQ ID NO: 3997357 - DNA, 16 bp, Homo sapiens
tctgatacccagagca

SEQ ID NO: 3997358 - DNA, 19 bp, Homo sapiens
tctgatattaatcaaaatt

SEQ ID NO: 3997359 - DNA, 19 bp, Homo sapiens
tctgatattccatgaatgt

SEQ ID NO: 3997360 - DNA, 20 bp, Homo sapiens
tctgatattccatgaatgta

SEQ ID NO: 3997361 - DNA, 13 bp, Homo sapiens
tctgatcagaggt

SEQ ID NO: 3997362 - DNA, 21 bp, Homo sapiens
tctgatcagaggtgtacacta

SEQ ID NO: 3997363 - DNA, 19 bp, Homo sapiens
tctgatcttgtgctcagca

SEQ ID NO: 3997364 - DNA, 13 bp, Homo sapiens
tctgatgaatctc

SEQ ID NO: 3997365 - DNA, 19 bp, Homo sapiens
tctgatggaccttctagaa

SEQ ID NO: 3997366 - DNA, 15 bp, Homo sapiens
tctgatggccttaat

SEQ ID NO: 3997367 - DNA, 14 bp, Homo sapiens
tctgatgtcccagt

SEQ ID NO: 3997368 - DNA, 16 bp, Homo sapiens
tctgattaaaacaact

SEQ ID NO: 3997369 - DNA, 18 bp, Homo sapiens
tctgattagctttgtgtt

SEQ ID NO: 3997370 - DNA, 21 bp, Homo sapiens
tctgattagctttgtgtttgg

SEQ ID NO: 3997371 - DNA, 19 bp, Homo sapiens
tctgattcagcatcactaa

SEQ ID NO: 3997372 - DNA, 13 bp, Homo sapiens
tctgatttcagga

SEQ ID NO: 3997373 - DNA, 20 bp, Homo sapiens
tctgatttgtccctatgcat

SEQ ID NO: 3997374 - DNA, 13 bp, Homo sapiens
tctgattttctca

SEQ ID NO: 3997375 - DNA, 14 bp, Homo sapiens
tctgcaaaaatatt

SEQ ID NO: 3997376 - DNA, 18 bp, Homo sapiens
tctgcaacatttgacaaa

SEQ ID NO: 3997377 - DNA, 17 bp, Homo sapiens
tctgcaagcctcatgcc

SEQ ID NO: 3997378 - DNA, 19 bp, Homo sapiens
tctgcaatgggcactggga

SEQ ID NO: 3997379 - DNA, 20 bp, Homo sapiens
tctgcaatttgtttaaagaa

SEQ ID NO: 3997380 - DNA, 18 bp, Homo sapiens
tctgcacacacctccgag

SEQ ID NO: 3997381 - DNA, 13 bp, Homo sapiens
tctgcacccaggg

SEQ ID NO: 3997382 - DNA, 13 bp, Homo sapiens
tctgcacccctct

SEQ ID NO: 3997383 - DNA, 18 bp, Homo sapiens
tctgcaccccttctctcc

SEQ ID NO: 3997384 - DNA, 19 bp, Homo sapiens
tctgcaccccttctctcct

SEQ ID NO: 3997385 - DNA, 20 bp, Homo sapiens
tctgcaccccttctctcctc

SEQ ID NO: 3997386 - DNA, 22 bp, Homo sapiens
tctgcacctatgtagctctgca

SEQ ID NO: 3997387 - DNA, 15 bp, Homo sapiens
tctgcactctaaact

SEQ ID NO: 3997388 - DNA, 19 bp, Homo sapiens
tctgcagacttcccagcta

SEQ ID NO: 3997389 - DNA, 16 bp, Homo sapiens
tctgcagcatgacctg

SEQ ID NO: 3997390 - DNA, 11 bp, Homo sapiens
tctgcagccct

SEQ ID NO: 3997391 - DNA, 14 bp, Homo sapiens
tctgcagtctcatt

SEQ ID NO: 3997392 - DNA, 18 bp, Homo sapiens
tctgcagtctcatttctc

SEQ ID NO: 3997393 - DNA, 20 bp, Homo sapiens
tctgcatagcgaaataaaaa

SEQ ID NO: 3997394 - DNA, 18 bp, Homo sapiens
tctgcatatgttgaatac

SEQ ID NO: 3997395 - DNA, 19 bp, Homo sapiens
tctgtgggcccctcaacag

SEQ ID NO: 3997396 - DNA, 22 bp, Homo sapiens
tctgtgggtccgataatatctt

SEQ ID NO: 3997397 - DNA, 21 bp, Homo sapiens
tctgtgtgaaactttcattcc

SEQ ID NO: 3997398 - DNA, 15 bp, Homo sapiens
tctgtgtgtatattg

SEQ ID NO: 3997399 - DNA, 20 bp, Homo sapiens
tctgtgttcccagaggcagg

SEQ ID NO: 3997400 - DNA, 21 bp, Homo sapiens
tctgtgttcccagaggcaggc

SEQ ID NO: 3997401 - DNA, 21 bp, Homo sapiens
tctgtgttgcattattcattt

SEQ ID NO: 3997402 - DNA, 22 bp, Homo sapiens
tctgtgttgcattattcattta

SEQ ID NO: 3997403 - DNA, 15 bp, Homo sapiens
tctgtgtttttgaaa

SEQ ID NO: 3997404 - DNA, 20 bp, Homo sapiens
tctgttaaaatctattctgt

SEQ ID NO: 3997405 - DNA, 17 bp, Homo sapiens
tctgttaaggttgaact

SEQ ID NO: 3997406 - DNA, 19 bp, Homo sapiens
tctgttaaggttgaacttt

SEQ ID NO: 3997407 - DNA, 23 bp, Homo sapiens
tctgttaaggttgaactttgcca

SEQ ID NO: 3997408 - DNA, 22 bp, Homo sapiens
tctgttcaggaagtccttatct

SEQ ID NO: 3997409 - DNA, 13 bp, Homo sapiens
tctgttccaaatg

SEQ ID NO: 3997410 - DNA, 13 bp, Homo sapiens
tctgttccaaatt

SEQ ID NO: 3997411 - DNA, 19 bp, Homo sapiens
tctgttccaaattcagttt

SEQ ID NO: 3997412 - DNA, 23 bp, Homo sapiens
tctgttccaaattcagtttcata

SEQ ID NO: 3997413 - DNA, 17 bp, Homo sapiens
tctgttcccagtagtta

SEQ ID NO: 3997414 - DNA, 23 bp, Homo sapiens
tctgttgggtggcatcattccag

SEQ ID NO: 3997415 - DNA, 14 bp, Homo sapiens
tctgttgtcattgc

SEQ ID NO: 3997416 - DNA, 22 bp, Homo sapiens
tctgtttaaagcatatagagat

SEQ ID NO: 3997417 - DNA, 14 bp, Homo sapiens
tctgtttaagaaaa

SEQ ID NO: 3997418 - DNA, 22 bp, Homo sapiens
tctgtttattcttccagaatgc

SEQ ID NO: 3997419 - DNA, 14 bp, Homo sapiens
tctgtttgtaaatt

SEQ ID NO: 3997420 - DNA, 15 bp, Homo sapiens
tctgtttgtaaatta

SEQ ID NO: 3997421 - DNA, 21 bp, Homo sapiens
tctgtttgtaaattatttgct

SEQ ID NO: 3997422 - DNA, 13 bp, Homo sapiens
tctgtttgttatt

SEQ ID NO: 3997423 - DNA, 14 bp, Homo sapiens
tctgttttccccca

SEQ ID NO: 3997424 - DNA, 21 bp, Homo sapiens
tctgttttctgtttgtaaatt

SEQ ID NO: 3997425 - DNA, 21 bp, Homo sapiens
tcttaaaattcaagaaaataa

SEQ ID NO: 3997426 - DNA, 22 bp, Homo sapiens
tcttaaaccaacctttaaaatt

SEQ ID NO: 3997427 - DNA, 19 bp, Homo sapiens
tcttaaataatgcttcaga

SEQ ID NO: 3997428 - DNA, 22 bp, Homo sapiens
tcttaaataatgcttcagatat

SEQ ID NO: 3997429 - DNA, 13 bp, Homo sapiens
tcttaaatatctt

SEQ ID NO: 3997430 - DNA, 17 bp, Homo sapiens
tcttaaatatcttttat

SEQ ID NO: 3997431 - DNA, 14 bp, Homo sapiens
tcttaaatcagaat

SEQ ID NO: 3997432 - DNA, 15 bp, Homo sapiens
tcttaaatcagaata

SEQ ID NO: 3997433 - DNA, 17 bp, Homo sapiens
tcttaaatcagaataaa

SEQ ID NO: 3997434 - DNA, 16 bp, Homo sapiens
tcttaaatgagaagta

SEQ ID NO: 3997435 - DNA, 23 bp, Homo sapiens
tcttaaatgctcattttctggtt

SEQ ID NO: 3997436 - DNA, 15 bp, Homo sapiens
tcttaatatatttga

SEQ ID NO: 3997437 - DNA, 12 bp, Homo sapiens
tcttaatctgtg

SEQ ID NO: 3997438 - DNA, 15 bp, Homo sapiens
tcttaatctgtgtgt

SEQ ID NO: 3997439 - DNA, 14 bp, Homo sapiens
tcttaattaatttg

SEQ ID NO: 3997440 - DNA, 10 bp, Homo sapiens
tcttaatttt

SEQ ID NO: 3997441 - DNA, 15 bp, Homo sapiens
tcttacccaatttcc

SEQ ID NO: 3997442 - DNA, 16 bp, Homo sapiens
tcttacccaatttccc

SEQ ID NO: 3997443 - DNA, 22 bp, Homo sapiens
tcttaccgacaagcacagtcag

SEQ ID NO: 3997444 - DNA, 14 bp, Homo sapiens
tcttactaatgtaa

SEQ ID NO: 3997445 - DNA, 13 bp, Homo sapiens
tcttactctttcc

SEQ ID NO: 3997446 - DNA, 14 bp, Homo sapiens
tcttactgataatt

SEQ ID NO: 3997447 - DNA, 22 bp, Homo sapiens
tcttactttgcttgagaatcct

SEQ ID NO: 3997448 - DNA, 21 bp, Homo sapiens
tcttagagccttttatctgca

SEQ ID NO: 3997449 - DNA, 13 bp, Homo sapiens
tcttagattctta

SEQ ID NO: 3997450 - DNA, 15 bp, Homo sapiens
tcttagctactgtat

SEQ ID NO: 3997451 - DNA, 18 bp, Homo sapiens
tcttagctttttaattgt

SEQ ID NO: 3997452 - DNA, 21 bp, Homo sapiens
tcttagctttttaattgttgt

SEQ ID NO: 3997453 - DNA, 15 bp, Homo sapiens
tcttaggaagagaaa

SEQ ID NO: 3997454 - DNA, 21 bp, Homo sapiens
tcttagttgacaacctagaat

SEQ ID NO: 3997455 - DNA, 14 bp, Homo sapiens
tcttatacatttga

SEQ ID NO: 3997456 - DNA, 15 bp, Homo sapiens
tcttatacatttgat

SEQ ID NO: 3997457 - DNA, 19 bp, Homo sapiens
tcttatacgcttttctttg

SEQ ID NO: 3997458 - DNA, 13 bp, Homo sapiens
tcttatagaataa

SEQ ID NO: 3997459 - DNA, 15 bp, Homo sapiens
tcttatagaataaaa

SEQ ID NO: 3997460 - DNA, 18 bp, Homo sapiens
tcttatagaataaaagct

SEQ ID NO: 3997461 - DNA, 20 bp, Homo sapiens
tcttatagaatatttattac

SEQ ID NO: 3997462 - DNA, 20 bp, Homo sapiens
tcttatatatatttctttgt

SEQ ID NO: 3997463 - DNA, 22 bp, Homo sapiens
tcttatccaacatcaacatctt

SEQ ID NO: 3997464 - DNA, 12 bp, Homo sapiens
tcttatctcagt

SEQ ID NO: 3997465 - DNA, 14 bp, Homo sapiens
tcttatctcagtca

SEQ ID NO: 3997466 - DNA, 20 bp, Homo sapiens
tcttatctcagtcatgcata

SEQ ID NO: 3997467 - DNA, 18 bp, Homo sapiens
tcttatgaataagcactt

SEQ ID NO: 3997468 - DNA, 13 bp, Homo sapiens
tcttatgcttcca

SEQ ID NO: 3997469 - DNA, 14 bp, Homo sapiens
tcttatggaattga

SEQ ID NO: 3997470 - DNA, 18 bp, Homo sapiens
tcttatggaattgatttg

SEQ ID NO: 3997471 - DNA, 22 bp, Homo sapiens
tcttatggaattgatttgcatt

SEQ ID NO: 3997472 - DNA, 19 bp, Homo sapiens
tcttatgtgacattaacaa

SEQ ID NO: 3997473 - DNA, 13 bp, Homo sapiens
tcttattctgtat

SEQ ID NO: 3997474 - DNA, 16 bp, Homo sapiens
tcttattgcgctgcta

SEQ ID NO: 3997475 - DNA, 14 bp, Homo sapiens
tcttatttaactta

SEQ ID NO: 3997476 - DNA, 20 bp, Homo sapiens
tcttattttgcattccagaa

SEQ ID NO: 3997477 - DNA, 21 bp, Homo sapiens
tcttattttgcattccagaat

SEQ ID NO: 3997478 - DNA, 14 bp, Homo sapiens
tcttcaaactgtga

SEQ ID NO: 3997479 - DNA, 15 bp, Homo sapiens
tcttcaaactttcac

SEQ ID NO: 3997480 - DNA, 17 bp, Homo sapiens
tcttcaaactttcactt

SEQ ID NO: 3997481 - DNA, 18 bp, Homo sapiens
tcttcaaactttcacttt

SEQ ID NO: 3997482 - DNA, 12 bp, Homo sapiens
tcttcaaataca

SEQ ID NO: 3997483 - DNA, 21 bp, Homo sapiens
tcttcaaatacaaagtaaata

SEQ ID NO: 3997484 - DNA, 19 bp, Homo sapiens
tcttcaaatccttccaaaa

SEQ ID NO: 3997485 - DNA, 17 bp, Homo sapiens
tcttcaacatcctgcca

SEQ ID NO: 3997486 - DNA, 15 bp, Homo sapiens
tcttcacaggcactc

SEQ ID NO: 3997487 - DNA, 13 bp, Homo sapiens
tcttcaccaggtg

SEQ ID NO: 3997488 - DNA, 15 bp, Homo sapiens
tcttcaccaggtgca

SEQ ID NO: 3997489 - DNA, 17 bp, Homo sapiens
tcttcacctctatccaa

SEQ ID NO: 3997490 - DNA, 20 bp, Homo sapiens
tcttcactgcaattttgtgt

SEQ ID NO: 3997491 - DNA, 17 bp, Homo sapiens
tcttcacttcaagctgt

SEQ ID NO: 3997492 - DNA, 16 bp, Homo sapiens
tcttcagagtgaagaa

SEQ ID NO: 3997493 - DNA, 20 bp, Homo sapiens
tcttcagagtgaagaatctt

SEQ ID NO: 3997494 - DNA, 19 bp, Homo sapiens
tcttcagatacaaactgca

SEQ ID NO: 3997495 - DNA, 18 bp, Homo sapiens
tcttcagcgtaaaatggt

SEQ ID NO: 3997496 - DNA, 20 bp, Homo sapiens
tcttcaggaaaataaatatc

SEQ ID NO: 3997497 - DNA, 14 bp, Homo sapiens
tcttcagggtctaa

SEQ ID NO: 3997498 - DNA, 20 bp, Homo sapiens
tcttttccttcattcatagg

SEQ ID NO: 3997499 - DNA, 19 bp, Homo sapiens
tcttttctggaatgtaatc

SEQ ID NO: 3997500 - DNA, 13 bp, Homo sapiens
tcttttctttctg

SEQ ID NO: 3997501 - DNA, 14 bp, Homo sapiens
tcttttctttttac

SEQ ID NO: 3997502 - DNA, 17 bp, Homo sapiens
tcttttctttttacata

SEQ ID NO: 3997503 - DNA, 20 bp, Homo sapiens
tcttttgacatgtggaaagt

SEQ ID NO: 3997504 - DNA, 21 bp, Homo sapiens
tcttttgcccttcacagtgtt

SEQ ID NO: 3997505 - DNA, 19 bp, Homo sapiens
tcttttgctactaagttca

SEQ ID NO: 3997506 - DNA, 12 bp, Homo sapiens
tcttttgtaatt

SEQ ID NO: 3997507 - DNA, 21 bp, Homo sapiens
tcttttgtaattgtgtaaaaa

SEQ ID NO: 3997508 - DNA, 22 bp, Homo sapiens
tcttttgttaaataatatggct

SEQ ID NO: 3997509 - DNA, 20 bp, Homo sapiens
tcttttgttcgcatggtcac

SEQ ID NO: 3997510 - DNA, 13 bp, Homo sapiens
tcttttgtttcca

SEQ ID NO: 3997511 - DNA, 15 bp, Homo sapiens
tcttttgtttccatg

SEQ ID NO: 3997512 - DNA, 13 bp, Homo sapiens
tctttttaattat

SEQ ID NO: 3997513 - DNA, 14 bp, Homo sapiens
tctttttatgcatt

SEQ ID NO: 3997514 - DNA, 13 bp, Homo sapiens
tctttttcctcct

SEQ ID NO: 3997515 - DNA, 15 bp, Homo sapiens
tctttttctttttaa

SEQ ID NO: 3997516 - DNA, 16 bp, Homo sapiens
tcttttttagcataaa

SEQ ID NO: 3997517 - DNA, 16 bp, Homo sapiens
tcttttttcaaaagaa

SEQ ID NO: 3997518 - DNA, 21 bp, Homo sapiens
tcttttttcatttcttcctca

SEQ ID NO: 3997519 - DNA, 16 bp, Homo sapiens
tcttttttgctttctt

SEQ ID NO: 3997520 - DNA, 12 bp, Homo sapiens
tctttttttatg

SEQ ID NO: 3997521 - DNA, 16 bp, Homo sapiens
tctttttttttaagtt

SEQ ID NO: 3997522 - DNA, 12 bp, Homo sapiens
tgaaaaacttcc

SEQ ID NO: 3997523 - DNA, 22 bp, Homo sapiens
tgaaaaagacctttggagcaaa

SEQ ID NO: 3997524 - DNA, 21 bp, Homo sapiens
tgaaaaagcagctaccaggtg

SEQ ID NO: 3997525 - DNA, 20 bp, Homo sapiens
tgaaaaaggaataaattgtt

SEQ ID NO: 3997526 - DNA, 21 bp, Homo sapiens
tgaaaaatgtaatttagaaac

SEQ ID NO: 3997527 - DNA, 13 bp, Homo sapiens
tgaaaaattctca

SEQ ID NO: 3997528 - DNA, 20 bp, Homo sapiens
tgaaaaatttaagcattgtt

SEQ ID NO: 3997529 - DNA, 20 bp, Homo sapiens
tgaaaacggagctgaacaat

SEQ ID NO: 3997530 - DNA, 18 bp, Homo sapiens
tgaaaacgttttattgtg

SEQ ID NO: 3997531 - DNA, 14 bp, Homo sapiens
tgaaaactatacaa

SEQ ID NO: 3997532 - DNA, 18 bp, Homo sapiens
tgaaaactctttgctgct

SEQ ID NO: 3997533 - DNA, 21 bp, Homo sapiens
tgaaaactggaataagaagca

SEQ ID NO: 3997534 - DNA, 15 bp, Homo sapiens
tgaaaagaaagtgtt

SEQ ID NO: 3997535 - DNA, 12 bp, Homo sapiens
tgaaaagatgta

SEQ ID NO: 3997536 - DNA, 22 bp, Homo sapiens
tgaaaagatgtacctggtggat

SEQ ID NO: 3997537 - DNA, 13 bp, Homo sapiens
tgaaaagctatta

SEQ ID NO: 3997538 - DNA, 20 bp, Homo sapiens
tgaaaagctattagccagga

SEQ ID NO: 3997539 - DNA, 15 bp, Homo sapiens
tgaaaagcttcttaa

SEQ ID NO: 3997540 - DNA, 20 bp, Homo sapiens
tgaaaagttactacctgtca

SEQ ID NO: 3997541 - DNA, 22 bp, Homo sapiens
tgaaaagttactacctgtcaag

SEQ ID NO: 3997542 - DNA, 23 bp, Homo sapiens
tgaaaatacaacttaaataataa

SEQ ID NO: 3997543 - DNA, 14 bp, Homo sapiens
tgaaaatcttggag

SEQ ID NO: 3997544 - DNA, 19 bp, Homo sapiens
tgaaaatgaatatctatta

SEQ ID NO: 3997545 - DNA, 17 bp, Homo sapiens
tgaaaatgtatgtgtaa

SEQ ID NO: 3997546 - DNA, 14 bp, Homo sapiens
tgaaaatgtcagaa

SEQ ID NO: 3997547 - DNA, 16 bp, Homo sapiens
tgaaaatgtgtttgct

SEQ ID NO: 3997548 - DNA, 20 bp, Homo sapiens
tgaaaattccagaaaggata

SEQ ID NO: 3997549 - DNA, 19 bp, Homo sapiens
tgaaaattttaaaaataca

SEQ ID NO: 3997550 - DNA, 13 bp, Homo sapiens
tgaaaattttact

SEQ ID NO: 3997551 - DNA, 19 bp, Homo sapiens
tgaaacacaccaggctgtg

SEQ ID NO: 3997552 - DNA, 13 bp, Homo sapiens
tgaaacacagctg

SEQ ID NO: 3997553 - DNA, 15 bp, Homo sapiens
tgaaacatggttgta

SEQ ID NO: 3997554 - DNA, 20 bp, Homo sapiens
tgaaaccaccgtgaaccaga

SEQ ID NO: 3997555 - DNA, 15 bp, Homo sapiens
tgaaaccatgactgt

SEQ ID NO: 3997556 - DNA, 23 bp, Homo sapiens
tgaaaccctgtctctactaaaaa

SEQ ID NO: 3997557 - DNA, 21 bp, Homo sapiens
tgaaacctcagggctgtccca

SEQ ID NO: 3997558 - DNA, 22 bp, Homo sapiens
tgaaacctcagggctgtcccag

SEQ ID NO: 3997559 - DNA, 18 bp, Homo sapiens
tgaaaccttttttaagat

SEQ ID NO: 3997560 - DNA, 17 bp, Homo sapiens
tgaaactagttatttta

SEQ ID NO: 3997561 - DNA, 19 bp, Homo sapiens
tgaaagaaagctgagaaga

SEQ ID NO: 3997562 - DNA, 20 bp, Homo sapiens
tgaaagaacatggacttgta

SEQ ID NO: 3997563 - DNA, 18 bp, Homo sapiens
tgaaagaatatatttatt

SEQ ID NO: 3997564 - DNA, 18 bp, Homo sapiens
tgaaagaattatttttgt

SEQ ID NO: 3997565 - DNA, 22 bp, Homo sapiens
tgaaagactgtacaaagtagaa

SEQ ID NO: 3997566 - DNA, 18 bp, Homo sapiens
tgaaagagaaccagtttc

SEQ ID NO: 3997567 - DNA, 19 bp, Homo sapiens
tgaaagaggctgaggcctg

SEQ ID NO: 3997568 - DNA, 21 bp, Homo sapiens
tgaaagaggctgaggcctgga

SEQ ID NO: 3997569 - DNA, 13 bp, Homo sapiens
tgaaagattaaac

SEQ ID NO: 3997570 - DNA, 14 bp, Homo sapiens
tgaaagattttatt

SEQ ID NO: 3997571 - DNA, 15 bp, Homo sapiens
tgaaagcatccatgt

SEQ ID NO: 3997572 - DNA, 17 bp, Homo sapiens
tgaaagcatccatgtgt

SEQ ID NO: 3997573 - DNA, 17 bp, Homo sapiens
tgaaagctctgttgcaa

SEQ ID NO: 3997574 - DNA, 21 bp, Homo sapiens
tgaaagctgagaactcctgac

SEQ ID NO: 3997575 - DNA, 22 bp, Homo sapiens
tgaaagctgattactgtcaata

SEQ ID NO: 3997576 - DNA, 18 bp, Homo sapiens
tgaaaggaagctccactg

SEQ ID NO: 3997577 - DNA, 17 bp, Homo sapiens
tgaaaggaattttgcta

SEQ ID NO: 3997578 - DNA, 19 bp, Homo sapiens
tgaaaggtactatatttgc

SEQ ID NO: 3997579 - DNA, 15 bp, Homo sapiens
tgaaagtagggggct

SEQ ID NO: 3997580 - DNA, 16 bp, Homo sapiens
tgaaagtgactttaaa

SEQ ID NO: 3997581 - DNA, 18 bp, Homo sapiens
tgaaagtgactttaaaag

SEQ ID NO: 3997582 - DNA, 13 bp, Homo sapiens
tgaaataaatgtt

SEQ ID NO: 3997583 - DNA, 18 bp, Homo sapiens
tgaaataacaaaatggac

SEQ ID NO: 3997584 - DNA, 20 bp, Homo sapiens
tgaaataacaaaatggacat

SEQ ID NO: 3997585 - DNA, 14 bp, Homo sapiens
tgaaataactcctt

SEQ ID NO: 3997586 - DNA, 15 bp, Homo sapiens
tgaaataatcagtga

SEQ ID NO: 3997587 - DNA, 16 bp, Homo sapiens
tgaaataccagtgtgg

SEQ ID NO: 3997588 - DNA, 18 bp, Homo sapiens
tgaaatagtctgtgtgaa

SEQ ID NO: 3997589 - DNA, 15 bp, Homo sapiens
tgaaatataattgta

SEQ ID NO: 3997590 - DNA, 11 bp, Homo sapiens
tgaaatatttt

SEQ ID NO: 3997591 - DNA, 19 bp, Homo sapiens
tgaaatcaatgcaagagtg

SEQ ID NO: 3997592 - DNA, 17 bp, Homo sapiens
tgaaatccttgactgga

SEQ ID NO: 3997593 - DNA, 16 bp, Homo sapiens
tgaaatctcagaattc

SEQ ID NO: 3997594 - DNA, 18 bp, Homo sapiens
tgaaatctgctagaaagt

SEQ ID NO: 3997595 - DNA, 18 bp, Homo sapiens
tgaaatgaggtctgttta

SEQ ID NO: 3997596 - DNA, 16 bp, Homo sapiens
tgaaatggaggtcctt

SEQ ID NO: 3997597 - DNA, 17 bp, Homo sapiens
tgaaatggatactacat

SEQ ID NO: 3997598 - DNA, 20 bp, Homo sapiens
tgaaatgtttggattctctt

SEQ ID NO: 3997599 - DNA, 13 bp, Homo sapiens
tgaaattaacaca

SEQ ID NO: 3997600 - DNA, 19 bp, Homo sapiens
tgaaattaagaaggcaaaa

SEQ ID NO: 3997601 - DNA, 22 bp, Homo sapiens
tgacaataatattgttgtataa

SEQ ID NO: 3997602 - DNA, 18 bp, Homo sapiens
tgacaatcaactctaata

SEQ ID NO: 3997603 - DNA, 22 bp, Homo sapiens
tgacaattttgtacaaatttgt

SEQ ID NO: 3997604 - DNA, 12 bp, Homo sapiens
tgacacacagca

SEQ ID NO: 3997605 - DNA, 20 bp, Homo sapiens
tgacacactaaccaagctga

SEQ ID NO: 3997606 - DNA, 19 bp, Homo sapiens
tgacacagaaaatgttgag

SEQ ID NO: 3997607 - DNA, 23 bp, Homo sapiens
tgacacagaaaatgttgagaatc

SEQ ID NO: 3997608 - DNA, 16 bp, Homo sapiens
tgacacagtcagcatg

SEQ ID NO: 3997609 - DNA, 17 bp, Homo sapiens
tgacacagtcagcatgc

SEQ ID NO: 3997610 - DNA, 20 bp, Homo sapiens
tgacaccaaagccacctctg

SEQ ID NO: 3997611 - DNA, 16 bp, Homo sapiens
tgacaccccctccccg

SEQ ID NO: 3997612 - DNA, 14 bp, Homo sapiens
tgacaccctggcct

SEQ ID NO: 3997613 - DNA, 15 bp, Homo sapiens
tgacaccctggcctg

SEQ ID NO: 3997614 - DNA, 17 bp, Homo sapiens
tgacacctcttttttcg

SEQ ID NO: 3997615 - DNA, 15 bp, Homo sapiens
tgacacctgctgaga

SEQ ID NO: 3997616 - DNA, 20 bp, Homo sapiens
tgacactatagtttaaaaca

SEQ ID NO: 3997617 - DNA, 18 bp, Homo sapiens
tgacactgaaagttttgt

SEQ ID NO: 3997618 - DNA, 22 bp, Homo sapiens
tgacactgaaagttttgtaaaa

SEQ ID NO: 3997619 - DNA, 22 bp, Homo sapiens
tgacactgaacttaataactgt

SEQ ID NO: 3997620 - DNA, 17 bp, Homo sapiens
tgacactgagccccacc

SEQ ID NO: 3997621 - DNA, 18 bp, Homo sapiens
tgacactgagccccacct

SEQ ID NO: 3997622 - DNA, 17 bp, Homo sapiens
tgacagaccacatcttt

SEQ ID NO: 3997623 - DNA, 22 bp, Homo sapiens
tgacagaccacatctttatctg

SEQ ID NO: 3997624 - DNA, 21 bp, Homo sapiens
tgacagagcaagactctgtct

SEQ ID NO: 3997625 - DNA, 13 bp, Homo sapiens
tgacagaggctgc

SEQ ID NO: 3997626 - DNA, 15 bp, Homo sapiens
tgacagagttcacta

SEQ ID NO: 3997627 - DNA, 22 bp, Homo sapiens
tgacagcatgaggtgttgtgca

SEQ ID NO: 3997628 - DNA, 22 bp, Homo sapiens
tgacagcctcccacccccatct

SEQ ID NO: 3997629 - DNA, 14 bp, Homo sapiens
tgacagcctgcagc

SEQ ID NO: 3997630 - DNA, 15 bp, Homo sapiens
tgacagcctgcagca

SEQ ID NO: 3997631 - DNA, 16 bp, Homo sapiens
tgacagggcagagcag

SEQ ID NO: 3997632 - DNA, 18 bp, Homo sapiens
tgacagggccagtggggc

SEQ ID NO: 3997633 - DNA, 13 bp, Homo sapiens
tgacagtcatcat

SEQ ID NO: 3997634 - DNA, 20 bp, Homo sapiens
tgacagtcatcatcagggcc

SEQ ID NO: 3997635 - DNA, 21 bp, Homo sapiens
tgacagtcatcatcagggcct

SEQ ID NO: 3997636 - DNA, 14 bp, Homo sapiens
tgacagtgcctggg

SEQ ID NO: 3997637 - DNA, 16 bp, Homo sapiens
tgacagtgccttctct

SEQ ID NO: 3997638 - DNA, 13 bp, Homo sapiens
tgacagttatttt

SEQ ID NO: 3997639 - DNA, 12 bp, Homo sapiens
tgacatattatg

SEQ ID NO: 3997640 - DNA, 15 bp, Homo sapiens
tgacatctcaggggc

SEQ ID NO: 3997641 - DNA, 21 bp, Homo sapiens
tgacatctcaggggccagagg

SEQ ID NO: 3997642 - DNA, 22 bp, Homo sapiens
tgacatctcaggggccagagga

SEQ ID NO: 3997643 - DNA, 22 bp, Homo sapiens
tgacatctctattccccaccct

SEQ ID NO: 3997644 - DNA, 16 bp, Homo sapiens
tgacatcttcaaagct

SEQ ID NO: 3997645 - DNA, 18 bp, Homo sapiens
tgacatggtgcctgagag

SEQ ID NO: 3997646 - DNA, 21 bp, Homo sapiens
tgacatggtgcctgagaggca

SEQ ID NO: 3997647 - DNA, 13 bp, Homo sapiens
tgacatgtgaaac

SEQ ID NO: 3997648 - DNA, 17 bp, Homo sapiens
tgacatgtgaaaccttt

SEQ ID NO: 3997649 - DNA, 14 bp, Homo sapiens
tgacatgtggaaag

SEQ ID NO: 3997650 - DNA, 20 bp, Homo sapiens
tgacatgtggggccaggtca

SEQ ID NO: 3997651 - DNA, 21 bp, Homo sapiens
tgacattaaatgcaataattt

SEQ ID NO: 3997652 - DNA, 17 bp, Homo sapiens
tgacattaacagttttc

SEQ ID NO: 3997653 - DNA, 19 bp, Homo sapiens
tgacattaacagttttcca

SEQ ID NO: 3997654 - DNA, 15 bp, Homo sapiens
tgacattcaaggcat

SEQ ID NO: 3997655 - DNA, 13 bp, Homo sapiens
tgacattccctgc

SEQ ID NO: 3997656 - DNA, 16 bp, Homo sapiens
tgacatttaatttagt

SEQ ID NO: 3997657 - DNA, 18 bp, Homo sapiens
tgacatttaatttagtga

SEQ ID NO: 3997658 - DNA, 20 bp, Homo sapiens
tgacatttatatattgaatt

SEQ ID NO: 3997659 - DNA, 14 bp, Homo sapiens
tgacatttgtagtt

SEQ ID NO: 3997660 - DNA, 16 bp, Homo sapiens
tgaccaaagtcctttt

SEQ ID NO: 3997661 - DNA, 15 bp, Homo sapiens
tgaccaagaactgca

SEQ ID NO: 3997662 - DNA, 23 bp, Homo sapiens
tgaccaatattatactaagaaaa

SEQ ID NO: 3997663 - DNA, 17 bp, Homo sapiens
tgaccaattgtgctgcc

SEQ ID NO: 3997664 - DNA, 14 bp, Homo sapiens
tgaccacagcacag

SEQ ID NO: 3997665 - DNA, 23 bp, Homo sapiens
tgaccaccaccccaacaaaccat

SEQ ID NO: 3997666 - DNA, 13 bp, Homo sapiens
tgaccagaagcct

SEQ ID NO: 3997667 - DNA, 16 bp, Homo sapiens
tgaccagaagccttgg

SEQ ID NO: 3997668 - DNA, 17 bp, Homo sapiens
tgaccagataaatagaa

SEQ ID NO: 3997669 - DNA, 19 bp, Homo sapiens
tgaccagcaacttgtcttt

SEQ ID NO: 3997670 - DNA, 16 bp, Homo sapiens
tgaccaggcatcctcc

SEQ ID NO: 3997671 - DNA, 16 bp, Homo sapiens
tgaccaggcttcttcc

SEQ ID NO: 3997672 - DNA, 16 bp, Homo sapiens
tgaccagggatgctgg

SEQ ID NO: 3997673 - DNA, 18 bp, Homo sapiens
tgaccagggatgctgggc

SEQ ID NO: 3997674 - DNA, 23 bp, Homo sapiens
tgaccagggatgctgggctgggc

SEQ ID NO: 3997675 - DNA, 22 bp, Homo sapiens
tgaccatccactctaccctccc

SEQ ID NO: 3997676 - DNA, 15 bp, Homo sapiens
tgaccatctgctttt

SEQ ID NO: 3997677 - DNA, 23 bp, Homo sapiens
tgacccagtgcccccactgacca

SEQ ID NO: 3997678 - DNA, 18 bp, Homo sapiens
tgaccccactgccaagtg

SEQ ID NO: 3997679 - DNA, 16 bp, Homo sapiens
tgaccccattcctgat

SEQ ID NO: 3997680 - DNA, 15 bp, Homo sapiens
tgacccccccagctt

SEQ ID NO: 3997681 - DNA, 17 bp, Homo sapiens
tgacccccttcctgtcc

SEQ ID NO: 3997682 - DNA, 18 bp, Homo sapiens
tgacccctcgtccacccc

SEQ ID NO: 3997683 - DNA, 13 bp, Homo sapiens
tgacccctctggt

SEQ ID NO: 3997684 - DNA, 13 bp, Homo sapiens
tgacccggcctct

SEQ ID NO: 3997685 - DNA, 21 bp, Homo sapiens
tgacccggctgggtcggccct

SEQ ID NO: 3997686 - DNA, 18 bp, Homo sapiens
tgaccctagctctttcct

SEQ ID NO: 3997687 - DNA, 23 bp, Homo sapiens
tgaccctctgaatggtccagggt

SEQ ID NO: 3997688 - DNA, 15 bp, Homo sapiens
tgaccctgaagtgag

SEQ ID NO: 3997689 - DNA, 22 bp, Homo sapiens
tgacccttgggcctgggcctct

SEQ ID NO: 3997690 - DNA, 20 bp, Homo sapiens
tgaccgacagctttccagta

SEQ ID NO: 3997691 - DNA, 19 bp, Homo sapiens
tgaccgcgactaatttcaa

SEQ ID NO: 3997692 - DNA, 20 bp, Homo sapiens
tgacctcaggtgatccgcct

SEQ ID NO: 3997693 - DNA, 13 bp, Homo sapiens
tgacctccctcta

SEQ ID NO: 3997694 - DNA, 14 bp, Homo sapiens
tgacctccctctaa

SEQ ID NO: 3997695 - DNA, 23 bp, Homo sapiens
tgacctccgcccctgcccccgct

SEQ ID NO: 3997696 - DNA, 17 bp, Homo sapiens
tgacctcgtgatccgcc

SEQ ID NO: 3997697 - DNA, 16 bp, Homo sapiens
tgacctctcagggcct

SEQ ID NO: 3997698 - DNA, 20 bp, Homo sapiens
tgacctctcagggcctggca

SEQ ID NO: 3997699 - DNA, 22 bp, Homo sapiens
tgacctctcagggcctggcagg

SEQ ID NO: 3997700 - DNA, 21 bp, Homo sapiens
tgacctctcataaatttactt

SEQ ID NO: 3997701 - DNA, 12 bp, Homo sapiens
tgacctcttgct

SEQ ID NO: 3997702 - DNA, 13 bp, Homo sapiens
tgacctcttgctg

SEQ ID NO: 3997703 - DNA, 16 bp, Homo sapiens
tgagacccccacacct

SEQ ID NO: 3997704 - DNA, 22 bp, Homo sapiens
tgagacccccacacctcagttc

SEQ ID NO: 3997705 - DNA, 15 bp, Homo sapiens
tgagacccttttctc

SEQ ID NO: 3997706 - DNA, 18 bp, Homo sapiens
tgagacccttttctcagg

SEQ ID NO: 3997707 - DNA, 18 bp, Homo sapiens
tgagactcacaggaagga

SEQ ID NO: 3997708 - DNA, 14 bp, Homo sapiens
tgagactgccccac

SEQ ID NO: 3997709 - DNA, 18 bp, Homo sapiens
tgagactgggtctcgctt

SEQ ID NO: 3997710 - DNA, 16 bp, Homo sapiens
tgagagaagccacgct

SEQ ID NO: 3997711 - DNA, 20 bp, Homo sapiens
tgagagacgccactccctgg

SEQ ID NO: 3997712 - DNA, 21 bp, Homo sapiens
tgagagacgccactccctggg

SEQ ID NO: 3997713 - DNA, 17 bp, Homo sapiens
tgagagagatgggagct

SEQ ID NO: 3997714 - DNA, 12 bp, Homo sapiens
tgagagccagtg

SEQ ID NO: 3997715 - DNA, 14 bp, Homo sapiens
tgagagccagtggc

SEQ ID NO: 3997716 - DNA, 12 bp, Homo sapiens
tgagagccccca

SEQ ID NO: 3997717 - DNA, 16 bp, Homo sapiens
tgagagctgctctgga

SEQ ID NO: 3997718 - DNA, 19 bp, Homo sapiens
tgagagctgctctggaaaa

SEQ ID NO: 3997719 - DNA, 20 bp, Homo sapiens
tgagaggcaatgattgttaa

SEQ ID NO: 3997720 - DNA, 13 bp, Homo sapiens
tgagaggcaggca

SEQ ID NO: 3997721 - DNA, 16 bp, Homo sapiens
tgagaggcaggcatag

SEQ ID NO: 3997722 - DNA, 18 bp, Homo sapiens
tgagagggcaaggaagtg

SEQ ID NO: 3997723 - DNA, 13 bp, Homo sapiens
tgagaggggagag

SEQ ID NO: 3997724 - DNA, 20 bp, Homo sapiens
tgagaggtagccgggctctg

SEQ ID NO: 3997725 - DNA, 19 bp, Homo sapiens
tgagagtatcaggtctccc

SEQ ID NO: 3997726 - DNA, 16 bp, Homo sapiens
tgagagtcagctctct

SEQ ID NO: 3997727 - DNA, 19 bp, Homo sapiens
tgagagtcagctctctgcc

SEQ ID NO: 3997728 - DNA, 21 bp, Homo sapiens
tgagagtgtctctgataaaag

SEQ ID NO: 3997729 - DNA, 16 bp, Homo sapiens
tgagataatatctgtg

SEQ ID NO: 3997730 - DNA, 19 bp, Homo sapiens
tgagataatatctgtgagg

SEQ ID NO: 3997731 - DNA, 20 bp, Homo sapiens
tgagatcacagcctccaggg

SEQ ID NO: 3997732 - DNA, 23 bp, Homo sapiens
tgagatcgtgctactgcactcca

SEQ ID NO: 3997733 - DNA, 22 bp, Homo sapiens
tgagatctaagcctttccataa

SEQ ID NO: 3997734 - DNA, 13 bp, Homo sapiens
tgagatgctggtt

SEQ ID NO: 3997735 - DNA, 21 bp, Homo sapiens
tgagatggaaaagtgtccttc

SEQ ID NO: 3997736 - DNA, 17 bp, Homo sapiens
tgagattagagggaggt

SEQ ID NO: 3997737 - DNA, 13 bp, Homo sapiens
tgagatttttaag

SEQ ID NO: 3997738 - DNA, 16 bp, Homo sapiens
tgagatttttaagaac

SEQ ID NO: 3997739 - DNA, 19 bp, Homo sapiens
tgagcaaaatatgcccctt

SEQ ID NO: 3997740 - DNA, 14 bp, Homo sapiens
tgagcaaggacatt

SEQ ID NO: 3997741 - DNA, 15 bp, Homo sapiens
tgagcaaggacattg

SEQ ID NO: 3997742 - DNA, 17 bp, Homo sapiens
tgagcaaggacattgcc

SEQ ID NO: 3997743 - DNA, 23 bp, Homo sapiens
tgagcaaggagcacaagccacaa

SEQ ID NO: 3997744 - DNA, 15 bp, Homo sapiens
tgagcagccgccagc

SEQ ID NO: 3997745 - DNA, 23 bp, Homo sapiens
tgagcagccgccagctgggagca

SEQ ID NO: 3997746 - DNA, 15 bp, Homo sapiens
tgagcagtcacactg

SEQ ID NO: 3997747 - DNA, 17 bp, Homo sapiens
tgagcagtcgcctgcct

SEQ ID NO: 3997748 - DNA, 18 bp, Homo sapiens
tgagcagtcgcctgcctg

SEQ ID NO: 3997749 - DNA, 19 bp, Homo sapiens
tgagcagtcgcctgcctgc

SEQ ID NO: 3997750 - DNA, 18 bp, Homo sapiens
tgagcatgtaaaagcgga

SEQ ID NO: 3997751 - DNA, 16 bp, Homo sapiens
tgagcattacaggcaa

SEQ ID NO: 3997752 - DNA, 12 bp, Homo sapiens
tgagccaccacg

SEQ ID NO: 3997753 - DNA, 14 bp, Homo sapiens
tgagccagacaaat

SEQ ID NO: 3997754 - DNA, 20 bp, Homo sapiens
tgagccagacaaatggagga

SEQ ID NO: 3997755 - DNA, 15 bp, Homo sapiens
tgagccatcactaga

SEQ ID NO: 3997756 - DNA, 17 bp, Homo sapiens
tgagcccagagaacagc

SEQ ID NO: 3997757 - DNA, 17 bp, Homo sapiens
tgagcccagctgcctgg

SEQ ID NO: 3997758 - DNA, 15 bp, Homo sapiens
tgagcccctggaggc

SEQ ID NO: 3997759 - DNA, 15 bp, Homo sapiens
tgagcccctggtcct

SEQ ID NO: 3997760 - DNA, 13 bp, Homo sapiens
tgagccctggctg

SEQ ID NO: 3997761 - DNA, 12 bp, Homo sapiens
tgagccctgggg

SEQ ID NO: 3997762 - DNA, 20 bp, Homo sapiens
tgagccgggcccctgggctt

SEQ ID NO: 3997763 - DNA, 14 bp, Homo sapiens
tgagccgtgaactg

SEQ ID NO: 3997764 - DNA, 12 bp, Homo sapiens
tgagcctctgct

SEQ ID NO: 3997765 - DNA, 13 bp, Homo sapiens
tgagcctgctgga

SEQ ID NO: 3997766 - DNA, 15 bp, Homo sapiens
tgagcctggtcctgg

SEQ ID NO: 3997767 - DNA, 16 bp, Homo sapiens
tgagcctggtcctggc

SEQ ID NO: 3997768 - DNA, 14 bp, Homo sapiens
tgagccttcagagt

SEQ ID NO: 3997769 - DNA, 13 bp, Homo sapiens
tgagccttcagtc

SEQ ID NO: 3997770 - DNA, 14 bp, Homo sapiens
tgagccttctgagc

SEQ ID NO: 3997771 - DNA, 16 bp, Homo sapiens
tgagccttttccctct

SEQ ID NO: 3997772 - DNA, 23 bp, Homo sapiens
tgagcgattattatctaaagtgt

SEQ ID NO: 3997773 - DNA, 12 bp, Homo sapiens
tgagcgggaggc

SEQ ID NO: 3997774 - DNA, 19 bp, Homo sapiens
tgagctatttccattccag

SEQ ID NO: 3997775 - DNA, 24 bp, Homo sapiens
tgagctattttcctctggccgcag

SEQ ID NO: 3997776 - DNA, 16 bp, Homo sapiens
tgagctccccagatct

SEQ ID NO: 3997777 - DNA, 22 bp, Homo sapiens
tgagctccccagatctcccact

SEQ ID NO: 3997778 - DNA, 15 bp, Homo sapiens
tgagctcctgctgcg

SEQ ID NO: 3997779 - DNA, 13 bp, Homo sapiens
tgagctcttccct

SEQ ID NO: 3997780 - DNA, 14 bp, Homo sapiens
tgagctgagtggcc

SEQ ID NO: 3997781 - DNA, 17 bp, Homo sapiens
tgagctgagtggccagc

SEQ ID NO: 3997782 - DNA, 16 bp, Homo sapiens
tgagctgatataaatt

SEQ ID NO: 3997783 - DNA, 16 bp, Homo sapiens
tgagctgcagcctggc

SEQ ID NO: 3997784 - DNA, 20 bp, Homo sapiens
tgagctgcagcctggctggt

SEQ ID NO: 3997785 - DNA, 23 bp, Homo sapiens
tgagctgcagcctggctggtcct

SEQ ID NO: 3997786 - DNA, 11 bp, Homo sapiens
tgagctgcctt

SEQ ID NO: 3997787 - DNA, 12 bp, Homo sapiens
tgagctgccttc

SEQ ID NO: 3997788 - DNA, 18 bp, Homo sapiens
tgagctggccaggccctg

SEQ ID NO: 3997789 - DNA, 17 bp, Homo sapiens
tgagctggggactcagg

SEQ ID NO: 3997790 - DNA, 19 bp, Homo sapiens
tgagctggggactcaggga

SEQ ID NO: 3997791 - DNA, 20 bp, Homo sapiens
tgagctggggactcagggac

SEQ ID NO: 3997792 - DNA, 21 bp, Homo sapiens
tgagctggggactcagggacc

SEQ ID NO: 3997793 - DNA, 11 bp, Homo sapiens
tgagctgtttt

SEQ ID NO: 3997794 - DNA, 21 bp, Homo sapiens
tgagcttcggttctccagaat

SEQ ID NO: 3997795 - DNA, 23 bp, Homo sapiens
tgagcttcggttctccagaatgt

SEQ ID NO: 3997796 - DNA, 21 bp, Homo sapiens
tgaggaaatccattgtttaaa

SEQ ID NO: 3997797 - DNA, 23 bp, Homo sapiens
tgaggaaatccattgtttaaaga

SEQ ID NO: 3997798 - DNA, 22 bp, Homo sapiens
tgaggacaaagtggaggagggc

SEQ ID NO: 3997799 - DNA, 14 bp, Homo sapiens
tgaggagaatgaaa

SEQ ID NO: 3997800 - DNA, 16 bp, Homo sapiens
tgaggagatgaccagg

SEQ ID NO: 3997801 - DNA, 12 bp, Homo sapiens
tgaggagctgca

SEQ ID NO: 3997802 - DNA, 14 bp, Homo sapiens
tgaggagctgcact

SEQ ID NO: 3997803 - DNA, 14 bp, Homo sapiens
tgaggagctgctgg

SEQ ID NO: 3997804 - DNA, 20 bp, Homo sapiens
tgaggagctggggatccctc

SEQ ID NO: 3997805 - DNA, 22 bp, Homo sapiens
tgaggaggatgtccctgggcca

SEQ ID NO: 3997806 - DNA, 14 bp, Homo sapiens
tgatttgcatggat

SEQ ID NO: 3997807 - DNA, 21 bp, Homo sapiens
tgatttgcatggattttggat

SEQ ID NO: 3997808 - DNA, 18 bp, Homo sapiens
tgatttgcattgaacaca

SEQ ID NO: 3997809 - DNA, 22 bp, Homo sapiens
tgatttgggggaggctttggga

SEQ ID NO: 3997810 - DNA, 18 bp, Homo sapiens
tgatttgggttggggaag

SEQ ID NO: 3997811 - DNA, 18 bp, Homo sapiens
tgatttgtagtggaaaca

SEQ ID NO: 3997812 - DNA, 15 bp, Homo sapiens
tgatttgtcactgct

SEQ ID NO: 3997813 - DNA, 13 bp, Homo sapiens
tgattttaacaat

SEQ ID NO: 3997814 - DNA, 16 bp, Homo sapiens
tgattttaacaataac

SEQ ID NO: 3997815 - DNA, 14 bp, Homo sapiens
tgattttaatacat

SEQ ID NO: 3997816 - DNA, 15 bp, Homo sapiens
tgattttaattttat

SEQ ID NO: 3997817 - DNA, 15 bp, Homo sapiens
tgattttatctgtga

SEQ ID NO: 3997818 - DNA, 17 bp, Homo sapiens
tgattttcatttcatga

SEQ ID NO: 3997819 - DNA, 22 bp, Homo sapiens
tgattttcctttgtagctactt

SEQ ID NO: 3997820 - DNA, 20 bp, Homo sapiens
tgattttgcaaaatgagttg

SEQ ID NO: 3997821 - DNA, 13 bp, Homo sapiens
tgatttttgtctc

SEQ ID NO: 3997822 - DNA, 18 bp, Homo sapiens
tgatttttttattatttt

SEQ ID NO: 3997823 - DNA, 22 bp, Homo sapiens
tgcaaaaatatttataaaactt

SEQ ID NO: 3997824 - DNA, 22 bp, Homo sapiens
tgcaaaaggttcactaaagcag

SEQ ID NO: 3997825 - DNA, 15 bp, Homo sapiens
tgcaaacagaacagg

SEQ ID NO: 3997826 - DNA, 12 bp, Homo sapiens
tgcaaagaaaat

SEQ ID NO: 3997827 - DNA, 23 bp, Homo sapiens
tgcaaagatctgtcctcagcctt

SEQ ID NO: 3997828 - DNA, 19 bp, Homo sapiens
tgcaaataggcagaatgga

SEQ ID NO: 3997829 - DNA, 15 bp, Homo sapiens
tgcaaatataaacat

SEQ ID NO: 3997830 - DNA, 17 bp, Homo sapiens
tgcaaatataaacatct

SEQ ID NO: 3997831 - DNA, 14 bp, Homo sapiens
tgcaaatgggagct

SEQ ID NO: 3997832 - DNA, 22 bp, Homo sapiens
tgcaaatgggagctgagcagcc

SEQ ID NO: 3997833 - DNA, 15 bp, Homo sapiens
tgcaaattttaactg

SEQ ID NO: 3997834 - DNA, 20 bp, Homo sapiens
tgcaaccaaactcccatcag

SEQ ID NO: 3997835 - DNA, 15 bp, Homo sapiens
tgcaacccttacccc

SEQ ID NO: 3997836 - DNA, 13 bp, Homo sapiens
tgcaacctcacct

SEQ ID NO: 3997837 - DNA, 19 bp, Homo sapiens
tgcaacctcaccttcctgt

SEQ ID NO: 3997838 - DNA, 13 bp, Homo sapiens
tgcaacctcacta

SEQ ID NO: 3997839 - DNA, 16 bp, Homo sapiens
tgcaacggcttagact

SEQ ID NO: 3997840 - DNA, 16 bp, Homo sapiens
tgcaactcaaggactt

SEQ ID NO: 3997841 - DNA, 15 bp, Homo sapiens
tgcaagagtgattgc

SEQ ID NO: 3997842 - DNA, 19 bp, Homo sapiens
tgcaagagtgattgcagct

SEQ ID NO: 3997843 - DNA, 20 bp, Homo sapiens
tgcaagagtgattgcagctt

SEQ ID NO: 3997844 - DNA, 15 bp, Homo sapiens
tgcaagatgcttggt

SEQ ID NO: 3997845 - DNA, 13 bp, Homo sapiens
tgcaagatgtgaa

SEQ ID NO: 3997846 - DNA, 18 bp, Homo sapiens
tgcaagcctgtctgagac

SEQ ID NO: 3997847 - DNA, 19 bp, Homo sapiens
tgcaagcctgtctgagact

SEQ ID NO: 3997848 - DNA, 20 bp, Homo sapiens
tgcaagctgtccagagaaaa

SEQ ID NO: 3997849 - DNA, 15 bp, Homo sapiens
tgcaagcttcttgct

SEQ ID NO: 3997850 - DNA, 15 bp, Homo sapiens
tgcaaggaaggaaag

SEQ ID NO: 3997851 - DNA, 16 bp, Homo sapiens
tgcaaggaaggaaaga

SEQ ID NO: 3997852 - DNA, 15 bp, Homo sapiens
tgcaaggaccaggac

SEQ ID NO: 3997853 - DNA, 17 bp, Homo sapiens
tgcaaggaccaggactc

SEQ ID NO: 3997854 - DNA, 19 bp, Homo sapiens
tgcaaggactcccggagcc

SEQ ID NO: 3997855 - DNA, 14 bp, Homo sapiens
tgcaaggtggcctt

SEQ ID NO: 3997856 - DNA, 15 bp, Homo sapiens
tgcaaggtggccttt

SEQ ID NO: 3997857 - DNA, 23 bp, Homo sapiens
tgcaaggtggcctttgtgctgcg

SEQ ID NO: 3997858 - DNA, 23 bp, Homo sapiens
tgcaagttatattagtgaagatg

SEQ ID NO: 3997859 - DNA, 19 bp, Homo sapiens
tgcaataaatctgacccag

SEQ ID NO: 3997860 - DNA, 14 bp, Homo sapiens
tgcaataacttctg

SEQ ID NO: 3997861 - DNA, 17 bp, Homo sapiens
tgcaataacttctgacc

SEQ ID NO: 3997862 - DNA, 12 bp, Homo sapiens
tgcaataatttt

SEQ ID NO: 3997863 - DNA, 13 bp, Homo sapiens
tgcaatagaaata

SEQ ID NO: 3997864 - DNA, 19 bp, Homo sapiens
tgcaatagagactgtagat

SEQ ID NO: 3997865 - DNA, 14 bp, Homo sapiens
tgcaatattccttt

SEQ ID NO: 3997866 - DNA, 16 bp, Homo sapiens
tgcaatgacatcttca

SEQ ID NO: 3997867 - DNA, 17 bp, Homo sapiens
tgcaatggttaacatct

SEQ ID NO: 3997868 - DNA, 23 bp, Homo sapiens
tgcaattaggtttttccttattt

SEQ ID NO: 3997869 - DNA, 15 bp, Homo sapiens
tgcaattgcttagga

SEQ ID NO: 3997870 - DNA, 18 bp, Homo sapiens
tgcaatttgtttaaagaa

SEQ ID NO: 3997871 - DNA, 14 bp, Homo sapiens
tgcacaagaatgga

SEQ ID NO: 3997872 - DNA, 20 bp, Homo sapiens
tgcacaagaatggatcacaa

SEQ ID NO: 3997873 - DNA, 23 bp, Homo sapiens
tgcacaagaatggatcacaagat

SEQ ID NO: 3997874 - DNA, 19 bp, Homo sapiens
tgcacactagcctctccag

SEQ ID NO: 3997875 - DNA, 15 bp, Homo sapiens
tgcacactccaggcc

SEQ ID NO: 3997876 - DNA, 16 bp, Homo sapiens
tgcacactccaggcct

SEQ ID NO: 3997877 - DNA, 17 bp, Homo sapiens
tgcacagatatttccat

SEQ ID NO: 3997878 - DNA, 18 bp, Homo sapiens
tgcacaggaaagagtcac

SEQ ID NO: 3997879 - DNA, 18 bp, Homo sapiens
tgcacaggatgctggcct

SEQ ID NO: 3997880 - DNA, 23 bp, Homo sapiens
tgcacaggcagagcccagaccct

SEQ ID NO: 3997881 - DNA, 14 bp, Homo sapiens
tgcacagtaaaaat

SEQ ID NO: 3997882 - DNA, 17 bp, Homo sapiens
tgcacagtgcatctcag

SEQ ID NO: 3997883 - DNA, 18 bp, Homo sapiens
tgcacagttgccacattt

SEQ ID NO: 3997884 - DNA, 12 bp, Homo sapiens
tgcacatccctg

SEQ ID NO: 3997885 - DNA, 24 bp, Homo sapiens
tgcacatcttggctatgtaattct

SEQ ID NO: 3997886 - DNA, 22 bp, Homo sapiens
tgcaccatactccttgcttcct

SEQ ID NO: 3997887 - DNA, 15 bp, Homo sapiens
tgcacccaactactg

SEQ ID NO: 3997888 - DNA, 16 bp, Homo sapiens
tgcacccaactactga

SEQ ID NO: 3997889 - DNA, 16 bp, Homo sapiens
tgcacccagctccagg

SEQ ID NO: 3997890 - DNA, 17 bp, Homo sapiens
tgcacccagctccaggg

SEQ ID NO: 3997891 - DNA, 21 bp, Homo sapiens
tgcacccatgggctctgacag

SEQ ID NO: 3997892 - DNA, 22 bp, Homo sapiens
tgcacccatgggctctgacaga

SEQ ID NO: 3997893 - DNA, 18 bp, Homo sapiens
tgcaccccaaagctttcc

SEQ ID NO: 3997894 - DNA, 23 bp, Homo sapiens
tgcaccccaaagctttcctgccc

SEQ ID NO: 3997895 - DNA, 14 bp, Homo sapiens
tgcacccctgggcc

SEQ ID NO: 3997896 - DNA, 18 bp, Homo sapiens
tgcacccggcctggatgc

SEQ ID NO: 3997897 - DNA, 21 bp, Homo sapiens
tgcacccggcctggatgccag

SEQ ID NO: 3997898 - DNA, 22 bp, Homo sapiens
tgcaccctggggcctggacctg

SEQ ID NO: 3997899 - DNA, 16 bp, Homo sapiens
tgcacctgtccccacc

SEQ ID NO: 3997900 - DNA, 21 bp, Homo sapiens
tgcacctgtccccaccctcca

SEQ ID NO: 3997901 - DNA, 12 bp, Homo sapiens
tgcacctgtgca

SEQ ID NO: 3997902 - DNA, 12 bp, Homo sapiens
tgcacgtggaga

SEQ ID NO: 3997903 - DNA, 16 bp, Homo sapiens
tgcacgtggagagctg

SEQ ID NO: 3997904 - DNA, 18 bp, Homo sapiens
tgcacgttcataaccaac

SEQ ID NO: 3997905 - DNA, 22 bp, Homo sapiens
tgcacgttcataaccaacaata

SEQ ID NO: 3997906 - DNA, 17 bp, Homo sapiens
tgcactaaagccagcct

SEQ ID NO: 3997907 - DNA, 22 bp, Homo sapiens
tgcactaagagaaaattgcact

SEQ ID NO: 3997908 - DNA, 14 bp, Homo sapiens
tgcactactgacat

SEQ ID NO: 3997909 - DNA, 15 bp, Homo sapiens
tgcagtcctgaggag

SEQ ID NO: 3997910 - DNA, 21 bp, Homo sapiens
tgcagtcttatttccaagtaa

SEQ ID NO: 3997911 - DNA, 22 bp, Homo sapiens
tgcagtgatatggcagaagaca

SEQ ID NO: 3997912 - DNA, 23 bp, Homo sapiens
tgcagtgatatggcagaagacac

SEQ ID NO: 3997913 - DNA, 16 bp, Homo sapiens
tgcagtgcttccaagg

SEQ ID NO: 3997914 - DNA, 18 bp, Homo sapiens
tgcagttcagcaccaccc

SEQ ID NO: 3997915 - DNA, 19 bp, Homo sapiens
tgcagttcagcaccaccct

SEQ ID NO: 3997916 - DNA, 16 bp, Homo sapiens
tgcagttcattatttt

SEQ ID NO: 3997917 - DNA, 19 bp, Homo sapiens
tgcagtttaagagcagaac

SEQ ID NO: 3997918 - DNA, 16 bp, Homo sapiens
tgcagttttaagaatt

SEQ ID NO: 3997919 - DNA, 21 bp, Homo sapiens
tgcagttttggtttgatgtaa

SEQ ID NO: 3997920 - DNA, 22 bp, Homo sapiens
tgcataaaagggtcaaacctgt

SEQ ID NO: 3997921 - DNA, 15 bp, Homo sapiens
tgcataaatatgcag

SEQ ID NO: 3997922 - DNA, 14 bp, Homo sapiens
tgcataagtgaaaa

SEQ ID NO: 3997923 - DNA, 22 bp, Homo sapiens
tgcataataagctaaagaggct

SEQ ID NO: 3997924 - DNA, 23 bp, Homo sapiens
tgcataataagctaaagaggctg

SEQ ID NO: 3997925 - DNA, 17 bp, Homo sapiens
tgcataatgataaaata

SEQ ID NO: 3997926 - DNA, 18 bp, Homo sapiens
tgcatagaacaaaagatt

SEQ ID NO: 3997927 - DNA, 16 bp, Homo sapiens
tgcatatcctgagcca

SEQ ID NO: 3997928 - DNA, 13 bp, Homo sapiens
tgcatatgttgaa

SEQ ID NO: 3997929 - DNA, 15 bp, Homo sapiens
tgcatatgttgaata

SEQ ID NO: 3997930 - DNA, 13 bp, Homo sapiens
tgcatattctatt

SEQ ID NO: 3997931 - DNA, 15 bp, Homo sapiens
tgcatattctattgt

SEQ ID NO: 3997932 - DNA, 22 bp, Homo sapiens
tgcatattctattgtattattt

SEQ ID NO: 3997933 - DNA, 23 bp, Homo sapiens
tgcatattctattgtattatttg

SEQ ID NO: 3997934 - DNA, 15 bp, Homo sapiens
tgcatattttgagaa

SEQ ID NO: 3997935 - DNA, 21 bp, Homo sapiens
tgcatcacgtaccccactggg

SEQ ID NO: 3997936 - DNA, 12 bp, Homo sapiens
tgcatcactggg

SEQ ID NO: 3997937 - DNA, 13 bp, Homo sapiens
tgcatcaggtcct

SEQ ID NO: 3997938 - DNA, 16 bp, Homo sapiens
tgcatcatctgtagat

SEQ ID NO: 3997939 - DNA, 12 bp, Homo sapiens
tgcatcccagca

SEQ ID NO: 3997940 - DNA, 17 bp, Homo sapiens
tgcatcccccctgctca

SEQ ID NO: 3997941 - DNA, 16 bp, Homo sapiens
tgcatccccttggctg

SEQ ID NO: 3997942 - DNA, 14 bp, Homo sapiens
tgcatccctgagac

SEQ ID NO: 3997943 - DNA, 21 bp, Homo sapiens
tgcatctcactggatgcaaag

SEQ ID NO: 3997944 - DNA, 15 bp, Homo sapiens
tgcatctcagcccac

SEQ ID NO: 3997945 - DNA, 20 bp, Homo sapiens
tgcatctgggattcccacca

SEQ ID NO: 3997946 - DNA, 13 bp, Homo sapiens
tgcatctggggcc

SEQ ID NO: 3997947 - DNA, 20 bp, Homo sapiens
tgcatctttgttacttcctt

SEQ ID NO: 3997948 - DNA, 18 bp, Homo sapiens
tgcatgaagagaagcaat

SEQ ID NO: 3997949 - DNA, 14 bp, Homo sapiens
tgcatgaagcaacg

SEQ ID NO: 3997950 - DNA, 22 bp, Homo sapiens
tgcatgaagcaacgataaaatt

SEQ ID NO: 3997951 - DNA, 14 bp, Homo sapiens
tgcatgattttgta

SEQ ID NO: 3997952 - DNA, 17 bp, Homo sapiens
tgcatgcatgccctctc

SEQ ID NO: 3997953 - DNA, 17 bp, Homo sapiens
tgcatggacctaacatt

SEQ ID NO: 3997954 - DNA, 16 bp, Homo sapiens
tgcatggaggccctcc

SEQ ID NO: 3997955 - DNA, 16 bp, Homo sapiens
tgcatggctccagaaa

SEQ ID NO: 3997956 - DNA, 16 bp, Homo sapiens
tgcatgggtgaaggga

SEQ ID NO: 3997957 - DNA, 23 bp, Homo sapiens
tgcatggtgcagttgacagcagg

SEQ ID NO: 3997958 - DNA, 18 bp, Homo sapiens
tgcatggtgccccaggac

SEQ ID NO: 3997959 - DNA, 17 bp, Homo sapiens
tgcatgtactgtatatt

SEQ ID NO: 3997960 - DNA, 23 bp, Homo sapiens
tgcatgtcctttgcgcctgtgac

SEQ ID NO: 3997961 - DNA, 15 bp, Homo sapiens
tgcatgtctgttctt

SEQ ID NO: 3997962 - DNA, 16 bp, Homo sapiens
tgcatgtctgttcttc

SEQ ID NO: 3997963 - DNA, 14 bp, Homo sapiens
tgcatgtgtgtgtg

SEQ ID NO: 3997964 - DNA, 14 bp, Homo sapiens
tgcatgttaccatc

SEQ ID NO: 3997965 - DNA, 16 bp, Homo sapiens
tgcatgtttgaaatga

SEQ ID NO: 3997966 - DNA, 18 bp, Homo sapiens
tgcattaaaatttcttat

SEQ ID NO: 3997967 - DNA, 19 bp, Homo sapiens
tgcattaaaatttcttatt

SEQ ID NO: 3997968 - DNA, 15 bp, Homo sapiens
tgcattaaattcaca

SEQ ID NO: 3997969 - DNA, 17 bp, Homo sapiens
tgcattaaattcacaaa

SEQ ID NO: 3997970 - DNA, 19 bp, Homo sapiens
tgcattaaattcacaaact

SEQ ID NO: 3997971 - DNA, 22 bp, Homo sapiens
tgcattagaaatagacagtata

SEQ ID NO: 3997972 - DNA, 13 bp, Homo sapiens
tgcattagaaatt

SEQ ID NO: 3997973 - DNA, 15 bp, Homo sapiens
tgcattattctcttt

SEQ ID NO: 3997974 - DNA, 12 bp, Homo sapiens
tgcattcaaatt

SEQ ID NO: 3997975 - DNA, 15 bp, Homo sapiens
tgcattcatttttat

SEQ ID NO: 3997976 - DNA, 13 bp, Homo sapiens
tgcattccagaat

SEQ ID NO: 3997977 - DNA, 16 bp, Homo sapiens
tgcattccagaatctt

SEQ ID NO: 3997978 - DNA, 21 bp, Homo sapiens
tgcattccagaatcttgactt

SEQ ID NO: 3997979 - DNA, 14 bp, Homo sapiens
tgcattcccagtgg

SEQ ID NO: 3997980 - DNA, 22 bp, Homo sapiens
tgcattccctgaatctgtgcct

SEQ ID NO: 3997981 - DNA, 12 bp, Homo sapiens
tgcattctagta

SEQ ID NO: 3997982 - DNA, 22 bp, Homo sapiens
tgcattctatcgttattataaa

SEQ ID NO: 3997983 - DNA, 18 bp, Homo sapiens
tgcattctattgccttct

SEQ ID NO: 3997984 - DNA, 13 bp, Homo sapiens
tgcattgaacaca

SEQ ID NO: 3997985 - DNA, 15 bp, Homo sapiens
tgcattgaacacaaa

SEQ ID NO: 3997986 - DNA, 17 bp, Homo sapiens
tgcattgaacacaaact

SEQ ID NO: 3997987 - DNA, 21 bp, Homo sapiens
tgcattgaacacaaactgtaa

SEQ ID NO: 3997988 - DNA, 23 bp, Homo sapiens
tgcattgaacacaaactgtaaat

SEQ ID NO: 3997989 - DNA, 15 bp, Homo sapiens
tgcattgctagataa

SEQ ID NO: 3997990 - DNA, 14 bp, Homo sapiens
tgcattgttggcta

SEQ ID NO: 3997991 - DNA, 17 bp, Homo sapiens
tgcattgttggctattt

SEQ ID NO: 3997992 - DNA, 14 bp, Homo sapiens
tgcatttagaaatc

SEQ ID NO: 3997993 - DNA, 14 bp, Homo sapiens
tgcatttagcttct

SEQ ID NO: 3997994 - DNA, 15 bp, Homo sapiens
tgcatttagcttctt

SEQ ID NO: 3997995 - DNA, 23 bp, Homo sapiens
tgcatttcaagcagctgaagaaa

SEQ ID NO: 3997996 - DNA, 18 bp, Homo sapiens
tgcatttgagagaagcca

SEQ ID NO: 3997997 - DNA, 23 bp, Homo sapiens
tgcatttgagagaagccacgctg

SEQ ID NO: 3997998 - DNA, 13 bp, Homo sapiens
tgcatttgttcag

SEQ ID NO: 3997999 - DNA, 16 bp, Homo sapiens
tgcattttgctattgt

SEQ ID NO: 3998000 - DNA, 19 bp, Homo sapiens
tgcattttgctattgtaaa

SEQ ID NO: 3998001 - DNA, 20 bp, Homo sapiens
tgcattttgctattgtaaat

SEQ ID NO: 3998002 - DNA, 15 bp, Homo sapiens
tgcatttttattaaa

SEQ ID NO: 3998003 - DNA, 19 bp, Homo sapiens
tgcatttttgtgaaatgaa

SEQ ID NO: 3998004 - DNA, 19 bp, Homo sapiens
tgccaaaaaaaaaagaagt

SEQ ID NO: 3998005 - DNA, 15 bp, Homo sapiens
tgccaaaaccaggcc

SEQ ID NO: 3998006 - DNA, 18 bp, Homo sapiens
tgccaaaaccaggcctct

SEQ ID NO: 3998007 - DNA, 20 bp, Homo sapiens
tgccaaaaccaggcctctgc

SEQ ID NO: 3998008 - DNA, 16 bp, Homo sapiens
tgccaaaggatgtgat

SEQ ID NO: 3998009 - DNA, 14 bp, Homo sapiens
tgccaaagggaaat

SEQ ID NO: 3998010 - DNA, 18 bp, Homo sapiens
tgccaaagggaaatatca

SEQ ID NO: 3998011 - DNA, 16 bp, Homo sapiens
tgccaaatatgtcctg

SEQ ID NO: 3998012 - DNA, 19 bp, Homo sapiens
tgcccagcttttcattgct

SEQ ID NO: 3998013 - DNA, 20 bp, Homo sapiens
tgcccaggggcccacaggga

SEQ ID NO: 3998014 - DNA, 19 bp, Homo sapiens
tgcccagtgttgtttgtaa

SEQ ID NO: 3998015 - DNA, 20 bp, Homo sapiens
tgcccatcacagggttgggc

SEQ ID NO: 3998016 - DNA, 13 bp, Homo sapiens
tgcccatcctgcc

SEQ ID NO: 3998017 - DNA, 14 bp, Homo sapiens
tgcccatgctgggc

SEQ ID NO: 3998018 - DNA, 18 bp, Homo sapiens
tgcccatgggatatgtgg

SEQ ID NO: 3998019 - DNA, 19 bp, Homo sapiens
tgcccatgggatatgtggt

SEQ ID NO: 3998020 - DNA, 22 bp, Homo sapiens
tgcccatgtgtcccctcactct

SEQ ID NO: 3998021 - DNA, 13 bp, Homo sapiens
tgcccatgtttca

SEQ ID NO: 3998022 - DNA, 15 bp, Homo sapiens
tgcccatgtttcaaa

SEQ ID NO: 3998023 - DNA, 14 bp, Homo sapiens
tgccccaaacaaat

SEQ ID NO: 3998024 - DNA, 16 bp, Homo sapiens
tgccccacacggactc

SEQ ID NO: 3998025 - DNA, 12 bp, Homo sapiens
tgccccacagct

SEQ ID NO: 3998026 - DNA, 13 bp, Homo sapiens
tgccccacccaag

SEQ ID NO: 3998027 - DNA, 15 bp, Homo sapiens
tgccccacccaagcc

SEQ ID NO: 3998028 - DNA, 18 bp, Homo sapiens
tgccccacccaagcccaa

SEQ ID NO: 3998029 - DNA, 20 bp, Homo sapiens
tgccccaccccacctccact

SEQ ID NO: 3998030 - DNA, 19 bp, Homo sapiens
tgccccacggagacagagg

SEQ ID NO: 3998031 - DNA, 17 bp, Homo sapiens
tgccccagagctgttta

SEQ ID NO: 3998032 - DNA, 14 bp, Homo sapiens
tgccccagcccaga

SEQ ID NO: 3998033 - DNA, 13 bp, Homo sapiens
cagcatgattctt

SEQ ID NO: 3998034 - DNA, 17 bp, Homo sapiens
cagcatgccccttggct

SEQ ID NO: 3998035 - DNA, 23 bp, Homo sapiens
cagcatgccccttggctggatca

SEQ ID NO: 3998036 - DNA, 15 bp, Homo sapiens
cagcatgcttcccag

SEQ ID NO: 3998037 - DNA, 16 bp, Homo sapiens
cagcatgcttcccaga

SEQ ID NO: 3998038 - DNA, 17 bp, Homo sapiens
cagcatgcttcccagag

SEQ ID NO: 3998039 - DNA, 19 bp, Homo sapiens
cagcatgcttcccagaggg

SEQ ID NO: 3998040 - DNA, 23 bp, Homo sapiens
cagcatgcttcccagagggagca

SEQ ID NO: 3998041 - DNA, 17 bp, Homo sapiens
cagcatggtccctgcct

SEQ ID NO: 3998042 - DNA, 20 bp, Homo sapiens
cagcatgtacggattttcag

SEQ ID NO: 3998043 - DNA, 22 bp, Homo sapiens
cagcatgtgtatttccagtgca

SEQ ID NO: 3998044 - DNA, 14 bp, Homo sapiens
cagcattctcactc

SEQ ID NO: 3998045 - DNA, 21 bp, Homo sapiens
cagcattcttgtcacaataaa

SEQ ID NO: 3998046 - DNA, 13 bp, Homo sapiens
cagcattgctttc

SEQ ID NO: 3998047 - DNA, 18 bp, Homo sapiens
cagcatttccttccagcc

SEQ ID NO: 3998048 - DNA, 18 bp, Homo sapiens
cagcatttccttgtcccg

SEQ ID NO: 3998049 - DNA, 20 bp, Homo sapiens
cagcatttttaattttcaca

SEQ ID NO: 3998050 - DNA, 16 bp, Homo sapiens
cagccaaaccctgtct

SEQ ID NO: 3998051 - DNA, 20 bp, Homo sapiens
cagccaacacgcacctgcct

SEQ ID NO: 3998052 - DNA, 19 bp, Homo sapiens
cagccaacaggtggcagga

SEQ ID NO: 3998053 - DNA, 23 bp, Homo sapiens
cagccaacaggtggcaggaccag

SEQ ID NO: 3998054 - DNA, 16 bp, Homo sapiens
cagccaactagcccct

SEQ ID NO: 3998055 - DNA, 11 bp, Homo sapiens
cagccaagctt

SEQ ID NO: 3998056 - DNA, 14 bp, Homo sapiens
cagccaagtgtgac

SEQ ID NO: 3998057 - DNA, 18 bp, Homo sapiens
cagccacatccccaagcc

SEQ ID NO: 3998058 - DNA, 12 bp, Homo sapiens
cagccaccagcg

SEQ ID NO: 3998059 - DNA, 21 bp, Homo sapiens
cagccaccccgggctctctgc

SEQ ID NO: 3998060 - DNA, 18 bp, Homo sapiens
cagccacgaggtgcaaca

SEQ ID NO: 3998061 - DNA, 15 bp, Homo sapiens
cagccacgattggag

SEQ ID NO: 3998062 - DNA, 21 bp, Homo sapiens
cagccactcgggaggctgaga

SEQ ID NO: 3998063 - DNA, 16 bp, Homo sapiens
cagccagaactctgtg

SEQ ID NO: 3998064 - DNA, 18 bp, Homo sapiens
cagccagaactctgtgtc

SEQ ID NO: 3998065 - DNA, 23 bp, Homo sapiens
cagccagaagccacccaaagcag

SEQ ID NO: 3998066 - DNA, 13 bp, Homo sapiens
cagccagagctgg

SEQ ID NO: 3998067 - DNA, 17 bp, Homo sapiens
cagccagaggagggcag

SEQ ID NO: 3998068 - DNA, 17 bp, Homo sapiens
cagccagatcctcttgg

SEQ ID NO: 3998069 - DNA, 13 bp, Homo sapiens
cagccagcaatga

SEQ ID NO: 3998070 - DNA, 15 bp, Homo sapiens
cagccagcagagggg

SEQ ID NO: 3998071 - DNA, 13 bp, Homo sapiens
cagccagcagcag

SEQ ID NO: 3998072 - DNA, 16 bp, Homo sapiens
cagccagccgccctgg

SEQ ID NO: 3998073 - DNA, 18 bp, Homo sapiens
cagccagccgccctgggc

SEQ ID NO: 3998074 - DNA, 23 bp, Homo sapiens
cagccagccgccctgggctgtct

SEQ ID NO: 3998075 - DNA, 11 bp, Homo sapiens
cagccagggcc

SEQ ID NO: 3998076 - DNA, 22 bp, Homo sapiens
cagccagtcccgtttcatttag

SEQ ID NO: 3998077 - DNA, 24 bp, Homo sapiens
cagccagtgccattccactccact

SEQ ID NO: 3998078 - DNA, 20 bp, Homo sapiens
cagccatacttatctctctg

SEQ ID NO: 3998079 - DNA, 18 bp, Homo sapiens
cagccataggccctttca

SEQ ID NO: 3998080 - DNA, 17 bp, Homo sapiens
cagccatcaaaatgctt

SEQ ID NO: 3998081 - DNA, 20 bp, Homo sapiens
cagccattgcggccccagga

SEQ ID NO: 3998082 - DNA, 19 bp, Homo sapiens
cagccattggctatttaaa

SEQ ID NO: 3998083 - DNA, 20 bp, Homo sapiens
cagccattggctatttaaaa

SEQ ID NO: 3998084 - DNA, 19 bp, Homo sapiens
cagcccacatagtgatggt

SEQ ID NO: 3998085 - DNA, 24 bp, Homo sapiens
cagcccacattggattcatcagca

SEQ ID NO: 3998086 - DNA, 17 bp, Homo sapiens
cagcccaccctgctcct

SEQ ID NO: 3998087 - DNA, 15 bp, Homo sapiens
cagcccactgcaccg

SEQ ID NO: 3998088 - DNA, 19 bp, Homo sapiens
cagcccactgcaccgcctc

SEQ ID NO: 3998089 - DNA, 11 bp, Homo sapiens
cagcccagaga

SEQ ID NO: 3998090 - DNA, 13 bp, Homo sapiens
cagcccagagaca

SEQ ID NO: 3998091 - DNA, 22 bp, Homo sapiens
cagcccagattcccctgtgtca

SEQ ID NO: 3998092 - DNA, 12 bp, Homo sapiens
cagcccagccag

SEQ ID NO: 3998093 - DNA, 14 bp, Homo sapiens
cagcccagccaggc

SEQ ID NO: 3998094 - DNA, 15 bp, Homo sapiens
cagcccagccaggcc

SEQ ID NO: 3998095 - DNA, 22 bp, Homo sapiens
cagcccatccattaggccagca

SEQ ID NO: 3998096 - DNA, 21 bp, Homo sapiens
cagcccatggtgaatgtatgt

SEQ ID NO: 3998097 - DNA, 15 bp, Homo sapiens
cagccccacaacttt

SEQ ID NO: 3998098 - DNA, 15 bp, Homo sapiens
cagccccacccagga

SEQ ID NO: 3998099 - DNA, 22 bp, Homo sapiens
cagccccacccaggagggaggg

SEQ ID NO: 3998100 - DNA, 12 bp, Homo sapiens
cagccccagaga

SEQ ID NO: 3998101 - DNA, 13 bp, Homo sapiens
cagccccagagag

SEQ ID NO: 3998102 - DNA, 16 bp, Homo sapiens
cagccccatccctgtc

SEQ ID NO: 3998103 - DNA, 18 bp, Homo sapiens
cagccccatccctgtcct

SEQ ID NO: 3998104 - DNA, 20 bp, Homo sapiens
cagccccatccctgtcctca

SEQ ID NO: 3998105 - DNA, 14 bp, Homo sapiens
cagcccccatgggc

SEQ ID NO: 3998106 - DNA, 17 bp, Homo sapiens
cagcccccatgggctcc

SEQ ID NO: 3998107 - DNA, 15 bp, Homo sapiens
cagcccccgccccag

SEQ ID NO: 3998108 - DNA, 17 bp, Homo sapiens
cagcccccgccccagag

SEQ ID NO: 3998109 - DNA, 19 bp, Homo sapiens
cagcccccgccccagagtg

SEQ ID NO: 3998110 - DNA, 13 bp, Homo sapiens
cagccccctccac

SEQ ID NO: 3998111 - DNA, 24 bp, Homo sapiens
cagccccctccacaccagtggcct

SEQ ID NO: 3998112 - DNA, 19 bp, Homo sapiens
cagccccggccctgggctc

SEQ ID NO: 3998113 - DNA, 17 bp, Homo sapiens
cagccccgtctgcccac

SEQ ID NO: 3998114 - DNA, 19 bp, Homo sapiens
cagccccgtctgcccacca

SEQ ID NO: 3998115 - DNA, 20 bp, Homo sapiens
cagccccgtctgcccaccat

SEQ ID NO: 3998116 - DNA, 15 bp, Homo sapiens
cagcccctactgctg

SEQ ID NO: 3998117 - DNA, 22 bp, Homo sapiens
cagcccctatagcactgagctc

SEQ ID NO: 3998118 - DNA, 14 bp, Homo sapiens
cagcccctccccca

SEQ ID NO: 3998119 - DNA, 21 bp, Homo sapiens
cagcccctcccccatctccca

SEQ ID NO: 3998120 - DNA, 18 bp, Homo sapiens
cagccccttctcccagca

SEQ ID NO: 3998121 - DNA, 21 bp, Homo sapiens
cagcccggcctgctcccagca

SEQ ID NO: 3998122 - DNA, 23 bp, Homo sapiens
cagcccggcctgctcccagcagc

SEQ ID NO: 3998123 - DNA, 23 bp, Homo sapiens
cagccctaagtggctgccttctt

SEQ ID NO: 3998124 - DNA, 15 bp, Homo sapiens
cagccctagagcctg

SEQ ID NO: 3998125 - DNA, 18 bp, Homo sapiens
cagccctagagcctgcct

SEQ ID NO: 3998126 - DNA, 13 bp, Homo sapiens
cagccctcaacag

SEQ ID NO: 3998127 - DNA, 19 bp, Homo sapiens
cagccctcaacaggcccag

SEQ ID NO: 3998128 - DNA, 17 bp, Homo sapiens
cagccctccctgcccct

SEQ ID NO: 3998129 - DNA, 17 bp, Homo sapiens
cagccctccgaccctca

SEQ ID NO: 3998130 - DNA, 13 bp, Homo sapiens
cagccctgcagcc

SEQ ID NO: 3998131 - DNA, 21 bp, Homo sapiens
cagccctgctttgggctgccc

SEQ ID NO: 3998132 - DNA, 15 bp, Homo sapiens
cagccctggctctgc

SEQ ID NO: 3998133 - DNA, 13 bp, Homo sapiens
cagccctgtcctg

SEQ ID NO: 3998134 - DNA, 19 bp, Homo sapiens
cagcccttcctctgctccc

SEQ ID NO: 3998135 - DNA, 18 bp, Homo sapiens
cagctaagaacctggaac

SEQ ID NO: 3998136 - DNA, 19 bp, Homo sapiens
cagctaaggacatttccca

SEQ ID NO: 3998137 - DNA, 21 bp, Homo sapiens
cagctaagggaagacatttct

SEQ ID NO: 3998138 - DNA, 23 bp, Homo sapiens
cagctaagggaagacatttcttt

SEQ ID NO: 3998139 - DNA, 19 bp, Homo sapiens
cagctaatcagcattctca

SEQ ID NO: 3998140 - DNA, 14 bp, Homo sapiens
cagctaatctgtag

SEQ ID NO: 3998141 - DNA, 16 bp, Homo sapiens
cagctaatctgtaggg

SEQ ID NO: 3998142 - DNA, 17 bp, Homo sapiens
cagctaatctgtagggc

SEQ ID NO: 3998143 - DNA, 18 bp, Homo sapiens
cagctaccaggtgttcta

SEQ ID NO: 3998144 - DNA, 14 bp, Homo sapiens
cagctacctgagac

SEQ ID NO: 3998145 - DNA, 15 bp, Homo sapiens
cagctacctgagacg

SEQ ID NO: 3998146 - DNA, 20 bp, Homo sapiens
cagctacctgagacgggcat

SEQ ID NO: 3998147 - DNA, 19 bp, Homo sapiens
cagctactcgggaggctga

SEQ ID NO: 3998148 - DNA, 15 bp, Homo sapiens
cagctacttcctcct

SEQ ID NO: 3998149 - DNA, 16 bp, Homo sapiens
cagctacttgggaagc

SEQ ID NO: 3998150 - DNA, 18 bp, Homo sapiens
cagctagaaaacattttt

SEQ ID NO: 3998151 - DNA, 19 bp, Homo sapiens
cagctagtgaagaccagag

SEQ ID NO: 3998152 - DNA, 23 bp, Homo sapiens
cagctagtgaagaccagagcagt

SEQ ID NO: 3998153 - DNA, 13 bp, Homo sapiens
cagctagtgcctt

SEQ ID NO: 3998154 - DNA, 19 bp, Homo sapiens
cagctatcgaacttcacaa

SEQ ID NO: 3998155 - DNA, 23 bp, Homo sapiens
cagctatctgcactctaaactgc

SEQ ID NO: 3998156 - DNA, 14 bp, Homo sapiens
cagctatctgtcat

SEQ ID NO: 3998157 - DNA, 21 bp, Homo sapiens
cagctatgcgcaatgtggcat

SEQ ID NO: 3998158 - DNA, 15 bp, Homo sapiens
cagctatgggagccc

SEQ ID NO: 3998159 - DNA, 17 bp, Homo sapiens
cagctatgggagcccca

SEQ ID NO: 3998160 - DNA, 20 bp, Homo sapiens
cagctcacagtgctgtgtgc

SEQ ID NO: 3998161 - DNA, 20 bp, Homo sapiens
cagctcacccctgggcaggc

SEQ ID NO: 3998162 - DNA, 21 bp, Homo sapiens
cagctcacccctgggcaggcg

SEQ ID NO: 3998163 - DNA, 14 bp, Homo sapiens
cagctcagaggccc

SEQ ID NO: 3998164 - DNA, 12 bp, Homo sapiens
cagctcaggaca

SEQ ID NO: 3998165 - DNA, 14 bp, Homo sapiens
cagctccaacctgc

SEQ ID NO: 3998166 - DNA, 17 bp, Homo sapiens
cagctccaacctgcaaa

SEQ ID NO: 3998167 - DNA, 23 bp, Homo sapiens
cagctccaacctgcaaagatctg

SEQ ID NO: 3998168 - DNA, 13 bp, Homo sapiens
cagctccaggggc

SEQ ID NO: 3998169 - DNA, 21 bp, Homo sapiens
cagctccaggggcccttggga

SEQ ID NO: 3998170 - DNA, 21 bp, Homo sapiens
cagctccaggtggctctgagg

SEQ ID NO: 3998171 - DNA, 15 bp, Homo sapiens
cagctcccccagctc

SEQ ID NO: 3998172 - DNA, 16 bp, Homo sapiens
cagctcccccagctcc

SEQ ID NO: 3998173 - DNA, 17 bp, Homo sapiens
cagctcccccaggctgt

SEQ ID NO: 3998174 - DNA, 20 bp, Homo sapiens
cagctcccgctccgggctcc

SEQ ID NO: 3998175 - DNA, 23 bp, Homo sapiens
cagctcccgctccgggctccgac

SEQ ID NO: 3998176 - DNA, 20 bp, Homo sapiens
cagctccctagactgcatcc

SEQ ID NO: 3998177 - DNA, 21 bp, Homo sapiens
cagctccctcaaagaggcagt

SEQ ID NO: 3998178 - DNA, 17 bp, Homo sapiens
cagctcccttctgttga

SEQ ID NO: 3998179 - DNA, 22 bp, Homo sapiens
cagctccctttctcaggagctt

SEQ ID NO: 3998180 - DNA, 19 bp, Homo sapiens
cagctcctacctctgtgcc

SEQ ID NO: 3998181 - DNA, 20 bp, Homo sapiens
cagctcctacctctgtgcca

SEQ ID NO: 3998182 - DNA, 23 bp, Homo sapiens
cagctcctacctctgtgccaggg

SEQ ID NO: 3998183 - DNA, 21 bp, Homo sapiens
cagctccttttccagagcatt

SEQ ID NO: 3998184 - DNA, 22 bp, Homo sapiens
cagctcgtttttcagcaccccc

SEQ ID NO: 3998185 - DNA, 15 bp, Homo sapiens
cagctctcatgctgc

SEQ ID NO: 3998186 - DNA, 21 bp, Homo sapiens
cagctctctgccctgtgtact

SEQ ID NO: 3998187 - DNA, 13 bp, Homo sapiens
cagctctctggga

SEQ ID NO: 3998188 - DNA, 23 bp, Homo sapiens
cagctctgagacccttttctcag

SEQ ID NO: 3998189 - DNA, 18 bp, Homo sapiens
cagctctgctatgagtgt

SEQ ID NO: 3998190 - DNA, 14 bp, Homo sapiens
cagctctgggagag

SEQ ID NO: 3998191 - DNA, 13 bp, Homo sapiens
cagctcttcctgg

SEQ ID NO: 3998192 - DNA, 15 bp, Homo sapiens
cagctcttggcccct

SEQ ID NO: 3998193 - DNA, 19 bp, Homo sapiens
cagctcttggcccctgtgt

SEQ ID NO: 3998194 - DNA, 20 bp, Homo sapiens
cagctcttggcccctgtgtg

SEQ ID NO: 3998195 - DNA, 16 bp, Homo sapiens
cagctgaattatctat

SEQ ID NO: 3998196 - DNA, 16 bp, Homo sapiens
cagctgactgtggccc

SEQ ID NO: 3998197 - DNA, 19 bp, Homo sapiens
cagctgactgtggccccct

SEQ ID NO: 3998198 - DNA, 13 bp, Homo sapiens
cagctgagccctg

SEQ ID NO: 3998199 - DNA, 14 bp, Homo sapiens
cagctgagccctgg

SEQ ID NO: 3998200 - DNA, 16 bp, Homo sapiens
cagctgagccctgggg

SEQ ID NO: 3998201 - DNA, 17 bp, Homo sapiens
cagctgagccctgggga

SEQ ID NO: 3998202 - DNA, 14 bp, Homo sapiens
cagctgagcctgag

SEQ ID NO: 3998203 - DNA, 15 bp, Homo sapiens
cagctgagccttctg

SEQ ID NO: 3998204 - DNA, 17 bp, Homo sapiens
cagctgagccttctgag

SEQ ID NO: 3998205 - DNA, 16 bp, Homo sapiens
cagctgatacttcatt

SEQ ID NO: 3998206 - DNA, 20 bp, Homo sapiens
cagctgatgagttacagcct

SEQ ID NO: 3998207 - DNA, 20 bp, Homo sapiens
cagctgatgttggaagagaa

SEQ ID NO: 3998208 - DNA, 12 bp, Homo sapiens
cagctgatttta

SEQ ID NO: 3998209 - DNA, 17 bp, Homo sapiens
cagctgattttaacaat

SEQ ID NO: 3998210 - DNA, 18 bp, Homo sapiens
cagctgattttaacaata

SEQ ID NO: 3998211 - DNA, 14 bp, Homo sapiens
cagctgcaagccag

SEQ ID NO: 3998212 - DNA, 19 bp, Homo sapiens
cagctgcaagccagggatg

SEQ ID NO: 3998213 - DNA, 19 bp, Homo sapiens
cagctgcaccagagcaacc

SEQ ID NO: 3998214 - DNA, 11 bp, Homo sapiens
cagctgcagcc

SEQ ID NO: 3998215 - DNA, 15 bp, Homo sapiens
cagctgcaggaatca

SEQ ID NO: 3998216 - DNA, 21 bp, Homo sapiens
cagctgccaaccctcccgggt

SEQ ID NO: 3998217 - DNA, 16 bp, Homo sapiens
cagctgccctagctga

SEQ ID NO: 3998218 - DNA, 18 bp, Homo sapiens
cagctgccctatgggcct

SEQ ID NO: 3998219 - DNA, 20 bp, Homo sapiens
cagctgccctatgggcctgc

SEQ ID NO: 3998220 - DNA, 14 bp, Homo sapiens
cagctgcctcctgc

SEQ ID NO: 3998221 - DNA, 21 bp, Homo sapiens
cagctgcctcctgcgccctgt

SEQ ID NO: 3998222 - DNA, 20 bp, Homo sapiens
cagctgcctgaaacagccat

SEQ ID NO: 3998223 - DNA, 14 bp, Homo sapiens
cagctgcctggaga

SEQ ID NO: 3998224 - DNA, 16 bp, Homo sapiens
cagctgcctggagagg

SEQ ID NO: 3998225 - DNA, 18 bp, Homo sapiens
cagctgcctggagagggt

SEQ ID NO: 3998226 - DNA, 19 bp, Homo sapiens
cagctgcgcttgcttttct

SEQ ID NO: 3998227 - DNA, 18 bp, Homo sapiens
cagctgctatccccatct

SEQ ID NO: 3998228 - DNA, 16 bp, Homo sapiens
cagctgctgttctcag

SEQ ID NO: 3998229 - DNA, 21 bp, Homo sapiens
cagctgctgttctcaggacag

SEQ ID NO: 3998230 - DNA, 22 bp, Homo sapiens
cagctgctgttctcaggacagc

SEQ ID NO: 3998231 - DNA, 17 bp, Homo sapiens
cagctggactctgcatc

SEQ ID NO: 3998232 - DNA, 15 bp, Homo sapiens
cagctggatctgctt

SEQ ID NO: 3998233 - DNA, 21 bp, Homo sapiens
cagctggatgagacttccaaa

SEQ ID NO: 3998234 - DNA, 16 bp, Homo sapiens
cagctgggctctgcaa

SEQ ID NO: 3998235 - DNA, 15 bp, Homo sapiens
cagctggggccagag

SEQ ID NO: 3998236 - DNA, 18 bp, Homo sapiens
cagctggggccagaggct

SEQ ID NO: 3998237 - DNA, 20 bp, Homo sapiens
caggagatgggtccaggggt

SEQ ID NO: 3998238 - DNA, 16 bp, Homo sapiens
caggagcaatgggact

SEQ ID NO: 3998239 - DNA, 17 bp, Homo sapiens
caggagcaatgggactg

SEQ ID NO: 3998240 - DNA, 20 bp, Homo sapiens
caggagcaatgggactggag

SEQ ID NO: 3998241 - DNA, 23 bp, Homo sapiens
caggagcacaggcagctggatga

SEQ ID NO: 3998242 - DNA, 17 bp, Homo sapiens
caggagcagatggacag

SEQ ID NO: 3998243 - DNA, 18 bp, Homo sapiens
caggagcagatggacagc

SEQ ID NO: 3998244 - DNA, 18 bp, Homo sapiens
caggagcctagcggagcc

SEQ ID NO: 3998245 - DNA, 19 bp, Homo sapiens
caggagcctagcggagccc

SEQ ID NO: 3998246 - DNA, 20 bp, Homo sapiens
caggagcctagcggagccca

SEQ ID NO: 3998247 - DNA, 23 bp, Homo sapiens
caggagcctagcggagcccagcc

SEQ ID NO: 3998248 - DNA, 12 bp, Homo sapiens
caggagctcttc

SEQ ID NO: 3998249 - DNA, 15 bp, Homo sapiens
caggagctcttcagg

SEQ ID NO: 3998250 - DNA, 18 bp, Homo sapiens
caggagctcttcaggcct

SEQ ID NO: 3998251 - DNA, 20 bp, Homo sapiens
caggagctcttcaggcctcc

SEQ ID NO: 3998252 - DNA, 15 bp, Homo sapiens
caggagctgatggca

SEQ ID NO: 3998253 - DNA, 16 bp, Homo sapiens
caggagctgatggcag

SEQ ID NO: 3998254 - DNA, 19 bp, Homo sapiens
caggagctgatggcagctg

SEQ ID NO: 3998255 - DNA, 21 bp, Homo sapiens
caggagctgtcaccaaggaaa

SEQ ID NO: 3998256 - DNA, 23 bp, Homo sapiens
caggagcttgggcagtgccccag

SEQ ID NO: 3998257 - DNA, 23 bp, Homo sapiens
caggaggaatcatgtcaggcctg

SEQ ID NO: 3998258 - DNA, 14 bp, Homo sapiens
caggaggccaaact

SEQ ID NO: 3998259 - DNA, 16 bp, Homo sapiens
caggaggccaataaaa

SEQ ID NO: 3998260 - DNA, 20 bp, Homo sapiens
caggaggccaataaaaagtt

SEQ ID NO: 3998261 - DNA, 23 bp, Homo sapiens
caggaggccaataaaaagttcag

SEQ ID NO: 3998262 - DNA, 21 bp, Homo sapiens
caggaggcggcccggccagcg

SEQ ID NO: 3998263 - DNA, 22 bp, Homo sapiens
caggaggcggcccggccagcgg

SEQ ID NO: 3998264 - DNA, 17 bp, Homo sapiens
caggaggctgaggcagg

SEQ ID NO: 3998265 - DNA, 20 bp, Homo sapiens
caggaggctgaggcaggagg

SEQ ID NO: 3998266 - DNA, 13 bp, Homo sapiens
caggaggctggag

SEQ ID NO: 3998267 - DNA, 18 bp, Homo sapiens
caggaggctggaggaagg

SEQ ID NO: 3998268 - DNA, 12 bp, Homo sapiens
caggagggaggt

SEQ ID NO: 3998269 - DNA, 16 bp, Homo sapiens
caggagggcaagggcc

SEQ ID NO: 3998270 - DNA, 17 bp, Homo sapiens
caggagggcaagggcca

SEQ ID NO: 3998271 - DNA, 16 bp, Homo sapiens
caggagggcatccata

SEQ ID NO: 3998272 - DNA, 13 bp, Homo sapiens
caggaggggaact

SEQ ID NO: 3998273 - DNA, 17 bp, Homo sapiens
caggaggttggagggaa

SEQ ID NO: 3998274 - DNA, 19 bp, Homo sapiens
caggagtcccaaggaaagc

SEQ ID NO: 3998275 - DNA, 22 bp, Homo sapiens
caggagtctctgccacccactc

SEQ ID NO: 3998276 - DNA, 24 bp, Homo sapiens
caggagtggtgcagacagaagtct

SEQ ID NO: 3998277 - DNA, 14 bp, Homo sapiens
caggagtgtcctgc

SEQ ID NO: 3998278 - DNA, 19 bp, Homo sapiens
caggagtgtcctgcccatg

SEQ ID NO: 3998279 - DNA, 23 bp, Homo sapiens
caggagtgtcctgcccatgcccc

SEQ ID NO: 3998280 - DNA, 15 bp, Homo sapiens
caggataataatttt

SEQ ID NO: 3998281 - DNA, 14 bp, Homo sapiens
caggatacatgtgc

SEQ ID NO: 3998282 - DNA, 20 bp, Homo sapiens
caggatatccttatcagagc

SEQ ID NO: 3998283 - DNA, 16 bp, Homo sapiens
caggatattagttaat

SEQ ID NO: 3998284 - DNA, 22 bp, Homo sapiens
caggatattagttaatgagcca

SEQ ID NO: 3998285 - DNA, 19 bp, Homo sapiens
caggatcatggtgtaataa

SEQ ID NO: 3998286 - DNA, 21 bp, Homo sapiens
caggatcccaggggcccaagg

SEQ ID NO: 3998287 - DNA, 15 bp, Homo sapiens
caggatgaaagttcc

SEQ ID NO: 3998288 - DNA, 23 bp, Homo sapiens
caggatgaaagttcccccatcag

SEQ ID NO: 3998289 - DNA, 22 bp, Homo sapiens
caggatggactcttctcggctc

SEQ ID NO: 3998290 - DNA, 15 bp, Homo sapiens
caggatggaggggtg

SEQ ID NO: 3998291 - DNA, 23 bp, Homo sapiens
caggatggcccttcccactggag

SEQ ID NO: 3998292 - DNA, 21 bp, Homo sapiens
caggatgggggctggcctctg

SEQ ID NO: 3998293 - DNA, 23 bp, Homo sapiens
caggatgtagttctgccaggcaa

SEQ ID NO: 3998294 - DNA, 15 bp, Homo sapiens
caggattcagccgga

SEQ ID NO: 3998295 - DNA, 19 bp, Homo sapiens
caggattctcaccagctgt

SEQ ID NO: 3998296 - DNA, 15 bp, Homo sapiens
caggattgaagagca

SEQ ID NO: 3998297 - DNA, 22 bp, Homo sapiens
caggatttgaactcagatctgt

SEQ ID NO: 3998298 - DNA, 13 bp, Homo sapiens
caggcacacacag

SEQ ID NO: 3998299 - DNA, 16 bp, Homo sapiens
caggcacacacagccc

SEQ ID NO: 3998300 - DNA, 15 bp, Homo sapiens
caggcacacagcagc

SEQ ID NO: 3998301 - DNA, 18 bp, Homo sapiens
caggcacacagcagcccc

SEQ ID NO: 3998302 - DNA, 21 bp, Homo sapiens
caggcacacagcagcccccca

SEQ ID NO: 3998303 - DNA, 12 bp, Homo sapiens
caggcacagggc

SEQ ID NO: 3998304 - DNA, 13 bp, Homo sapiens
caggcacagggcc

SEQ ID NO: 3998305 - DNA, 13 bp, Homo sapiens
caggcaccagcat

SEQ ID NO: 3998306 - DNA, 17 bp, Homo sapiens
caggcaccagcatccac

SEQ ID NO: 3998307 - DNA, 15 bp, Homo sapiens
caggcaccccctgga

SEQ ID NO: 3998308 - DNA, 16 bp, Homo sapiens
caggcaccccctggag

SEQ ID NO: 3998309 - DNA, 18 bp, Homo sapiens
caggcaccccctggagag

SEQ ID NO: 3998310 - DNA, 13 bp, Homo sapiens
caggcaccctcag

SEQ ID NO: 3998311 - DNA, 13 bp, Homo sapiens
caggcaccgagaa

SEQ ID NO: 3998312 - DNA, 24 bp, Homo sapiens
caggcaccgccacgtcccagcatc

SEQ ID NO: 3998313 - DNA, 14 bp, Homo sapiens
caggcacctcttcc

SEQ ID NO: 3998314 - DNA, 15 bp, Homo sapiens
caggcacctcttcct

SEQ ID NO: 3998315 - DNA, 16 bp, Homo sapiens
caggcactgccttctc

SEQ ID NO: 3998316 - DNA, 21 bp, Homo sapiens
caggcactgccttctcctctc

SEQ ID NO: 3998317 - DNA, 16 bp, Homo sapiens
caggcagactacacag

SEQ ID NO: 3998318 - DNA, 14 bp, Homo sapiens
caggcagagcccag

SEQ ID NO: 3998319 - DNA, 12 bp, Homo sapiens
caggcagagctg

SEQ ID NO: 3998320 - DNA, 22 bp, Homo sapiens
caggcagagctggagcccccag

SEQ ID NO: 3998321 - DNA, 17 bp, Homo sapiens
caggcagatctgtgccc

SEQ ID NO: 3998322 - DNA, 13 bp, Homo sapiens
caggcagcccagc

SEQ ID NO: 3998323 - DNA, 14 bp, Homo sapiens
caggcagcccagca

SEQ ID NO: 3998324 - DNA, 13 bp, Homo sapiens
caggcagcgccaa

SEQ ID NO: 3998325 - DNA, 18 bp, Homo sapiens
caggcagctggatgagac

SEQ ID NO: 3998326 - DNA, 21 bp, Homo sapiens
caggcagcttctactcctgcc

SEQ ID NO: 3998327 - DNA, 14 bp, Homo sapiens
caggcagctttcta

SEQ ID NO: 3998328 - DNA, 18 bp, Homo sapiens
caggcaggaagggcagga

SEQ ID NO: 3998329 - DNA, 21 bp, Homo sapiens
caggcaggccaaggccttctc

SEQ ID NO: 3998330 - DNA, 18 bp, Homo sapiens
caggcaggggccctgcag

SEQ ID NO: 3998331 - DNA, 22 bp, Homo sapiens
caggcaggggccctgcagctct

SEQ ID NO: 3998332 - DNA, 21 bp, Homo sapiens
caggcaggggtgggggtggag

SEQ ID NO: 3998333 - DNA, 23 bp, Homo sapiens
caggcaggggtgggggtggaggc

SEQ ID NO: 3998334 - DNA, 14 bp, Homo sapiens
caggcaggtgcctg

SEQ ID NO: 3998335 - DNA, 17 bp, Homo sapiens
caggcagttggccagag

SEQ ID NO: 3998336 - DNA, 20 bp, Homo sapiens
caggcataaaatagagtaaa

SEQ ID NO: 3998337 - DNA, 17 bp, Homo sapiens
caggcatagaggcttct

SEQ ID NO: 3998338 - DNA, 14 bp, Homo sapiens
caggcataggcctg

SEQ ID NO: 3998339 - DNA, 23 bp, Homo sapiens
cagggaatgcaatccttccctgc

SEQ ID NO: 3998340 - DNA, 18 bp, Homo sapiens
cagggacagaggccccag

SEQ ID NO: 3998341 - DNA, 12 bp, Homo sapiens
cagggacaggat

SEQ ID NO: 3998342 - DNA, 19 bp, Homo sapiens
cagggaccggtgctgcagg

SEQ ID NO: 3998343 - DNA, 22 bp, Homo sapiens
cagggaccggtgctgcaggagt

SEQ ID NO: 3998344 - DNA, 17 bp, Homo sapiens
cagggactatctttgct

SEQ ID NO: 3998345 - DNA, 19 bp, Homo sapiens
cagggagaccgagcgcttt

SEQ ID NO: 3998346 - DNA, 22 bp, Homo sapiens
cagggagactgggtaggaaaga

SEQ ID NO: 3998347 - DNA, 15 bp, Homo sapiens
cagggagcaagacag

SEQ ID NO: 3998348 - DNA, 16 bp, Homo sapiens
cagggagcagggaagg

SEQ ID NO: 3998349 - DNA, 13 bp, Homo sapiens
cagggagcctccc

SEQ ID NO: 3998350 - DNA, 15 bp, Homo sapiens
cagggagcctcccca

SEQ ID NO: 3998351 - DNA, 17 bp, Homo sapiens
cagggagctctggggac

SEQ ID NO: 3998352 - DNA, 19 bp, Homo sapiens
cagggagctctggggacag

SEQ ID NO: 3998353 - DNA, 23 bp, Homo sapiens
cagggagctctggggacagcttc

SEQ ID NO: 3998354 - DNA, 20 bp, Homo sapiens
cagggaggtgtgaggcagga

SEQ ID NO: 3998355 - DNA, 22 bp, Homo sapiens
cagggaggtgtgaggcaggaga

SEQ ID NO: 3998356 - DNA, 22 bp, Homo sapiens
cagggagtccagggtttctctg

SEQ ID NO: 3998357 - DNA, 14 bp, Homo sapiens
cagggagtgctggc

SEQ ID NO: 3998358 - DNA, 17 bp, Homo sapiens
cagggagtgctggctca

SEQ ID NO: 3998359 - DNA, 19 bp, Homo sapiens
cagggatcttgcattccca

SEQ ID NO: 3998360 - DNA, 19 bp, Homo sapiens
cagggatgctgggctgggc

SEQ ID NO: 3998361 - DNA, 21 bp, Homo sapiens
cagggatgggggatgggccag

SEQ ID NO: 3998362 - DNA, 19 bp, Homo sapiens
cagggattaacctctgcac

SEQ ID NO: 3998363 - DNA, 21 bp, Homo sapiens
cagggcaagggttaaggcctg

SEQ ID NO: 3998364 - DNA, 23 bp, Homo sapiens
cagggcaagggttaaggcctgaa

SEQ ID NO: 3998365 - DNA, 13 bp, Homo sapiens
cagggcaccagag

SEQ ID NO: 3998366 - DNA, 14 bp, Homo sapiens
cagggcaccagagg

SEQ ID NO: 3998367 - DNA, 17 bp, Homo sapiens
cagggcacgcaggacca

SEQ ID NO: 3998368 - DNA, 12 bp, Homo sapiens
cagggcagcccc

SEQ ID NO: 3998369 - DNA, 16 bp, Homo sapiens
cagggcagcgccaggc

SEQ ID NO: 3998370 - DNA, 19 bp, Homo sapiens
cagggcagcgccaggctga

SEQ ID NO: 3998371 - DNA, 17 bp, Homo sapiens
cagggcagggtgggcag

SEQ ID NO: 3998372 - DNA, 13 bp, Homo sapiens
cagggcatctcct

SEQ ID NO: 3998373 - DNA, 18 bp, Homo sapiens
cagggcattcgggccaca

SEQ ID NO: 3998374 - DNA, 20 bp, Homo sapiens
cagggcattcgggccacagg

SEQ ID NO: 3998375 - DNA, 21 bp, Homo sapiens
cagggcattcgggccacaggg

SEQ ID NO: 3998376 - DNA, 19 bp, Homo sapiens
cagggccaaaagcttccct

SEQ ID NO: 3998377 - DNA, 19 bp, Homo sapiens
cagggccaacttgagggcc

SEQ ID NO: 3998378 - DNA, 17 bp, Homo sapiens
cagggccactggaagga

SEQ ID NO: 3998379 - DNA, 19 bp, Homo sapiens
cagggccagaagtagcttt

SEQ ID NO: 3998380 - DNA, 15 bp, Homo sapiens
cagggccagagggag

SEQ ID NO: 3998381 - DNA, 13 bp, Homo sapiens
cagggccaggccc

SEQ ID NO: 3998382 - DNA, 21 bp, Homo sapiens
cagggccagtcctcctgggag

SEQ ID NO: 3998383 - DNA, 17 bp, Homo sapiens
cagggccagtggggcct

SEQ ID NO: 3998384 - DNA, 20 bp, Homo sapiens
cagggccagtggggcctgtg

SEQ ID NO: 3998385 - DNA, 22 bp, Homo sapiens
cagggccagtggggcctgtgga

SEQ ID NO: 3998386 - DNA, 17 bp, Homo sapiens
cagggccatgcctgccc

SEQ ID NO: 3998387 - DNA, 18 bp, Homo sapiens
cagggcccaccccagcct

SEQ ID NO: 3998388 - DNA, 14 bp, Homo sapiens
cagggcccagagcc

SEQ ID NO: 3998389 - DNA, 21 bp, Homo sapiens
cagggccccccaaatcccagg

SEQ ID NO: 3998390 - DNA, 20 bp, Homo sapiens
cagggccctaggcccctcct

SEQ ID NO: 3998391 - DNA, 12 bp, Homo sapiens
cagggccctggc

SEQ ID NO: 3998392 - DNA, 14 bp, Homo sapiens
cagggccctggcca

SEQ ID NO: 3998393 - DNA, 17 bp, Homo sapiens
cagggccctggccagcc

SEQ ID NO: 3998394 - DNA, 18 bp, Homo sapiens
cagggccctggccagccg

SEQ ID NO: 3998395 - DNA, 20 bp, Homo sapiens
cagggcccttggggctgggg

SEQ ID NO: 3998396 - DNA, 14 bp, Homo sapiens
cagggccgaggagg

SEQ ID NO: 3998397 - DNA, 22 bp, Homo sapiens
cagggccgaggaggtgcctgga

SEQ ID NO: 3998398 - DNA, 14 bp, Homo sapiens
cagggcctccaggg

SEQ ID NO: 3998399 - DNA, 13 bp, Homo sapiens
cagggcctggagc

SEQ ID NO: 3998400 - DNA, 14 bp, Homo sapiens
cagggcctggagcc

SEQ ID NO: 3998401 - DNA, 18 bp, Homo sapiens
cagggcctggcaggccag

SEQ ID NO: 3998402 - DNA, 18 bp, Homo sapiens
cagggcctggggcctgag

SEQ ID NO: 3998403 - DNA, 13 bp, Homo sapiens
cagggcgagactc

SEQ ID NO: 3998404 - DNA, 20 bp, Homo sapiens
cagggcgggcagagggctgg

SEQ ID NO: 3998405 - DNA, 22 bp, Homo sapiens
cagggcgggcagagggctggag

SEQ ID NO: 3998406 - DNA, 14 bp, Homo sapiens
cagggctagtgact

SEQ ID NO: 3998407 - DNA, 12 bp, Homo sapiens
cagggctctccc

SEQ ID NO: 3998408 - DNA, 23 bp, Homo sapiens
cagggctgccctgagaagctgct

SEQ ID NO: 3998409 - DNA, 13 bp, Homo sapiens
cagggctggctct

SEQ ID NO: 3998410 - DNA, 12 bp, Homo sapiens
cagggctgggga

SEQ ID NO: 3998411 - DNA, 17 bp, Homo sapiens
cagggctggggacagag

SEQ ID NO: 3998412 - DNA, 15 bp, Homo sapiens
cagggctggggcagc

SEQ ID NO: 3998413 - DNA, 20 bp, Homo sapiens
cagggctggggcagcctctg

SEQ ID NO: 3998414 - DNA, 14 bp, Homo sapiens
cagggctgtgcttg

SEQ ID NO: 3998415 - DNA, 19 bp, Homo sapiens
cagggctgtgcttgaaggc

SEQ ID NO: 3998416 - DNA, 14 bp, Homo sapiens
caggggaaaatgaa

SEQ ID NO: 3998417 - DNA, 18 bp, Homo sapiens
caggggaaggccctgagg

SEQ ID NO: 3998418 - DNA, 17 bp, Homo sapiens
caggggactcagccctg

SEQ ID NO: 3998419 - DNA, 18 bp, Homo sapiens
caggggagacaggagcct

SEQ ID NO: 3998420 - DNA, 21 bp, Homo sapiens
caggggagacaggagcctagc

SEQ ID NO: 3998421 - DNA, 16 bp, Homo sapiens
caggggagatggggag

SEQ ID NO: 3998422 - DNA, 18 bp, Homo sapiens
caggggagatggggagga

SEQ ID NO: 3998423 - DNA, 20 bp, Homo sapiens
caggggcccaaggcggcccc

SEQ ID NO: 3998424 - DNA, 16 bp, Homo sapiens
caggggcccacaggga

SEQ ID NO: 3998425 - DNA, 16 bp, Homo sapiens
caggggccctgcagct

SEQ ID NO: 3998426 - DNA, 22 bp, Homo sapiens
caggggcccttgggacagccag

SEQ ID NO: 3998427 - DNA, 22 bp, Homo sapiens
caggggcgtgaggtcccaggaa

SEQ ID NO: 3998428 - DNA, 17 bp, Homo sapiens
caggggctgggctccct

SEQ ID NO: 3998429 - DNA, 14 bp, Homo sapiens
caggggctgggggt

SEQ ID NO: 3998430 - DNA, 18 bp, Homo sapiens
caggggctggtgggacag

SEQ ID NO: 3998431 - DNA, 19 bp, Homo sapiens
cagggggaaggtggggtcc

SEQ ID NO: 3998432 - DNA, 22 bp, Homo sapiens
cagggggatgccactcctccct

SEQ ID NO: 3998433 - DNA, 20 bp, Homo sapiens
cagggggccccgccagggct

SEQ ID NO: 3998434 - DNA, 15 bp, Homo sapiens
caggggggtgaggag

SEQ ID NO: 3998435 - DNA, 20 bp, Homo sapiens
caggggggttgtgaggcctg

SEQ ID NO: 3998436 - DNA, 16 bp, Homo sapiens
caggggtcccccctca

SEQ ID NO: 3998437 - DNA, 15 bp, Homo sapiens
caggggtctccctgg

SEQ ID NO: 3998438 - DNA, 17 bp, Homo sapiens
caggggtctccctggct

SEQ ID NO: 3998439 - DNA, 15 bp, Homo sapiens
caggggttgcagtga

SEQ ID NO: 3998440 - DNA, 23 bp, Homo sapiens
cagggtacccgcctgagctcctg

SEQ ID NO: 3998441 - DNA, 22 bp, Homo sapiens
cagtacctgggtccccagccct

SEQ ID NO: 3998442 - DNA, 17 bp, Homo sapiens
cagtacctttgtcacaa

SEQ ID NO: 3998443 - DNA, 14 bp, Homo sapiens
cagtagaactccag

SEQ ID NO: 3998444 - DNA, 12 bp, Homo sapiens
cagtagaactgt

SEQ ID NO: 3998445 - DNA, 22 bp, Homo sapiens
cagtaggacaaggtgcaggcag

SEQ ID NO: 3998446 - DNA, 23 bp, Homo sapiens
cagtaggacaaggtgcaggcagg

SEQ ID NO: 3998447 - DNA, 17 bp, Homo sapiens
cagtatcatctccatca

SEQ ID NO: 3998448 - DNA, 20 bp, Homo sapiens
cagtatcatgccctgtgcaa

SEQ ID NO: 3998449 - DNA, 16 bp, Homo sapiens
cagtatgctgcccctg

SEQ ID NO: 3998450 - DNA, 17 bp, Homo sapiens
cagtatgtattcttttg

SEQ ID NO: 3998451 - DNA, 20 bp, Homo sapiens
cagtattctcagagcatgtg

SEQ ID NO: 3998452 - DNA, 17 bp, Homo sapiens
cagtattgctgatttta

SEQ ID NO: 3998453 - DNA, 19 bp, Homo sapiens
cagtatttattttgtaatt

SEQ ID NO: 3998454 - DNA, 15 bp, Homo sapiens
cagtcaaaataattc

SEQ ID NO: 3998455 - DNA, 13 bp, Homo sapiens
cagtcaagaagaa

SEQ ID NO: 3998456 - DNA, 14 bp, Homo sapiens
cagtcaagaagaaa

SEQ ID NO: 3998457 - DNA, 20 bp, Homo sapiens
cagtcaagaagaaaaaggtt

SEQ ID NO: 3998458 - DNA, 21 bp, Homo sapiens
cagtcacactgttactccaca

SEQ ID NO: 3998459 - DNA, 23 bp, Homo sapiens
cagtcacactgttactccacagc

SEQ ID NO: 3998460 - DNA, 13 bp, Homo sapiens
cagtcacagccac

SEQ ID NO: 3998461 - DNA, 14 bp, Homo sapiens
cagtcacagccacc

SEQ ID NO: 3998462 - DNA, 23 bp, Homo sapiens
cagtcaccaccacccgaaatgcc

SEQ ID NO: 3998463 - DNA, 21 bp, Homo sapiens
cagtcactccctctgccttca

SEQ ID NO: 3998464 - DNA, 19 bp, Homo sapiens
cagtcagaaaactttaaaa

SEQ ID NO: 3998465 - DNA, 13 bp, Homo sapiens
cagtcagagtcca

SEQ ID NO: 3998466 - DNA, 18 bp, Homo sapiens
cagtcagagtccagtgct

SEQ ID NO: 3998467 - DNA, 13 bp, Homo sapiens
cagtcagcatgct

SEQ ID NO: 3998468 - DNA, 22 bp, Homo sapiens
cagtcaggctctctgggctgac

SEQ ID NO: 3998469 - DNA, 23 bp, Homo sapiens
cagtcagggaaggtgcctctgga

SEQ ID NO: 3998470 - DNA, 16 bp, Homo sapiens
cagtcagtaattgcca

SEQ ID NO: 3998471 - DNA, 13 bp, Homo sapiens
cagtcatcatcag

SEQ ID NO: 3998472 - DNA, 19 bp, Homo sapiens
cagtcatcatcagggcctg

SEQ ID NO: 3998473 - DNA, 13 bp, Homo sapiens
cagtcatgcataa

SEQ ID NO: 3998474 - DNA, 14 bp, Homo sapiens
cagtcatgcataaa

SEQ ID NO: 3998475 - DNA, 17 bp, Homo sapiens
cagtcatgcataaatat

SEQ ID NO: 3998476 - DNA, 18 bp, Homo sapiens
cagtcattagactcctcc

SEQ ID NO: 3998477 - DNA, 13 bp, Homo sapiens
cagtcattatgag

SEQ ID NO: 3998478 - DNA, 23 bp, Homo sapiens
cagtcattatgagaggcaatgat

SEQ ID NO: 3998479 - DNA, 14 bp, Homo sapiens
cagtcattctagga

SEQ ID NO: 3998480 - DNA, 23 bp, Homo sapiens
cagtcattctaggatgtggagct

SEQ ID NO: 3998481 - DNA, 13 bp, Homo sapiens
cagtcattggctg

SEQ ID NO: 3998482 - DNA, 11 bp, Homo sapiens
cagtcatttaa

SEQ ID NO: 3998483 - DNA, 17 bp, Homo sapiens
cagtccaaatgtcctcc

SEQ ID NO: 3998484 - DNA, 22 bp, Homo sapiens
cagtccaaatgtcctccagaag

SEQ ID NO: 3998485 - DNA, 23 bp, Homo sapiens
cagtccagtgtcacctctctcag

SEQ ID NO: 3998486 - DNA, 21 bp, Homo sapiens
cagtcccagacaattccattc

SEQ ID NO: 3998487 - DNA, 12 bp, Homo sapiens
cagtccccaccc

SEQ ID NO: 3998488 - DNA, 15 bp, Homo sapiens
cagtccccacccctg

SEQ ID NO: 3998489 - DNA, 16 bp, Homo sapiens
cagtccccacccctgc

SEQ ID NO: 3998490 - DNA, 13 bp, Homo sapiens
cagtccccagaac

SEQ ID NO: 3998491 - DNA, 14 bp, Homo sapiens
cagtccccccaccc

SEQ ID NO: 3998492 - DNA, 16 bp, Homo sapiens
cagtccccctgtgcat

SEQ ID NO: 3998493 - DNA, 20 bp, Homo sapiens
cagtcctccactcgacccag

SEQ ID NO: 3998494 - DNA, 20 bp, Homo sapiens
cagtcctccagaccaccagc

SEQ ID NO: 3998495 - DNA, 22 bp, Homo sapiens
cagtcctccagaccaccagccg

SEQ ID NO: 3998496 - DNA, 19 bp, Homo sapiens
cagtcctgcctcagcctcc

SEQ ID NO: 3998497 - DNA, 16 bp, Homo sapiens
cagtcctgcctggcca

SEQ ID NO: 3998498 - DNA, 18 bp, Homo sapiens
cagtcctgcctggccagg

SEQ ID NO: 3998499 - DNA, 15 bp, Homo sapiens
cagtccttaaaaatc

SEQ ID NO: 3998500 - DNA, 20 bp, Homo sapiens
cagtcctttgtaaacagtgt

SEQ ID NO: 3998501 - DNA, 21 bp, Homo sapiens
cagtcctttgtaaacagtgtt

SEQ ID NO: 3998502 - DNA, 14 bp, Homo sapiens
cagtcgcctgcctg

SEQ ID NO: 3998503 - DNA, 21 bp, Homo sapiens
cagtcgcctgcctgcagcagg

SEQ ID NO: 3998504 - DNA, 22 bp, Homo sapiens
cagtcgcctttcagcaggcagc

SEQ ID NO: 3998505 - DNA, 19 bp, Homo sapiens
cagtctagttgccaaatct

SEQ ID NO: 3998506 - DNA, 17 bp, Homo sapiens
cagtctattcacagaag

SEQ ID NO: 3998507 - DNA, 22 bp, Homo sapiens
cagtctcactgcagtcttattt

SEQ ID NO: 3998508 - DNA, 13 bp, Homo sapiens
cagtctcccaggc

SEQ ID NO: 3998509 - DNA, 20 bp, Homo sapiens
cagtctcccaggccccctgc

SEQ ID NO: 3998510 - DNA, 23 bp, Homo sapiens
cagtctcccaggccccctgcatc

SEQ ID NO: 3998511 - DNA, 14 bp, Homo sapiens
cagtctctcttaaa

SEQ ID NO: 3998512 - DNA, 20 bp, Homo sapiens
cagtctctttaatcttcagt

SEQ ID NO: 3998513 - DNA, 22 bp, Homo sapiens
cagtctctttaatcttcagttt

SEQ ID NO: 3998514 - DNA, 16 bp, Homo sapiens
cagtctgaatgctgcc

SEQ ID NO: 3998515 - DNA, 16 bp, Homo sapiens
cagtctgataaactga

SEQ ID NO: 3998516 - DNA, 16 bp, Homo sapiens
cagtcttatgcttcca

SEQ ID NO: 3998517 - DNA, 17 bp, Homo sapiens
cagtcttatgcttccag

SEQ ID NO: 3998518 - DNA, 15 bp, Homo sapiens
cagtcttcacttgca

SEQ ID NO: 3998519 - DNA, 22 bp, Homo sapiens
cagtcttgaatttctaaaaaac

SEQ ID NO: 3998520 - DNA, 14 bp, Homo sapiens
cagtgaaatgtgaa

SEQ ID NO: 3998521 - DNA, 16 bp, Homo sapiens
cagtgaaatgtgaagg

SEQ ID NO: 3998522 - DNA, 13 bp, Homo sapiens
cagtgaagatgca

SEQ ID NO: 3998523 - DNA, 12 bp, Homo sapiens
cagtgaattctt

SEQ ID NO: 3998524 - DNA, 14 bp, Homo sapiens
cagtgacaaaccat

SEQ ID NO: 3998525 - DNA, 16 bp, Homo sapiens
cagtgacacttcagag

SEQ ID NO: 3998526 - DNA, 23 bp, Homo sapiens
cagtgacacttcagagagctggt

SEQ ID NO: 3998527 - DNA, 17 bp, Homo sapiens
cagtgacagacaggctc

SEQ ID NO: 3998528 - DNA, 16 bp, Homo sapiens
cagtgacagagttcac

SEQ ID NO: 3998529 - DNA, 20 bp, Homo sapiens
cagtgacagagttcactata

SEQ ID NO: 3998530 - DNA, 13 bp, Homo sapiens
cagtgaccccaga

SEQ ID NO: 3998531 - DNA, 23 bp, Homo sapiens
cagtgacctggaaggcccagcac

SEQ ID NO: 3998532 - DNA, 19 bp, Homo sapiens
cagtgacctttgacctcgg

SEQ ID NO: 3998533 - DNA, 22 bp, Homo sapiens
cagtgactttgtatagagaatt

SEQ ID NO: 3998534 - DNA, 22 bp, Homo sapiens
cagtgagaaaaagctcctgtcc

SEQ ID NO: 3998535 - DNA, 13 bp, Homo sapiens
cagtgagagcaga

SEQ ID NO: 3998536 - DNA, 15 bp, Homo sapiens
cagtgagagcagatg

SEQ ID NO: 3998537 - DNA, 23 bp, Homo sapiens
cagtgagccaagatcgcgccact

SEQ ID NO: 3998538 - DNA, 15 bp, Homo sapiens
cagtgagtctcttca

SEQ ID NO: 3998539 - DNA, 17 bp, Homo sapiens
cagtgagtctcttcaga

SEQ ID NO: 3998540 - DNA, 22 bp, Homo sapiens
cagtgagttacagcgagaggca

SEQ ID NO: 3998541 - DNA, 22 bp, Homo sapiens
cagtgatatggcagaagacacc

SEQ ID NO: 3998542 - DNA, 21 bp, Homo sapiens
cagtgatctccatatgttaca

SEQ ID NO: 3998543 - DNA, 23 bp, Homo sapiens
cagttcaatctcccgctgctgct

SEQ ID NO: 3998544 - DNA, 13 bp, Homo sapiens
cagttcaccctga

SEQ ID NO: 3998545 - DNA, 17 bp, Homo sapiens
cagttcaggagtcccaa

SEQ ID NO: 3998546 - DNA, 23 bp, Homo sapiens
cagttcaggagtcccaaggaaag

SEQ ID NO: 3998547 - DNA, 19 bp, Homo sapiens
cagttcatcgattttctat

SEQ ID NO: 3998548 - DNA, 18 bp, Homo sapiens
cagttcattattttgtgg

SEQ ID NO: 3998549 - DNA, 18 bp, Homo sapiens
cagttcattgcactttga

SEQ ID NO: 3998550 - DNA, 18 bp, Homo sapiens
cagttcccccaacctcag

SEQ ID NO: 3998551 - DNA, 18 bp, Homo sapiens
cagttcccccagtacctc

SEQ ID NO: 3998552 - DNA, 22 bp, Homo sapiens
cagttcccccagtacctccaag

SEQ ID NO: 3998553 - DNA, 13 bp, Homo sapiens
cagttcccttggc

SEQ ID NO: 3998554 - DNA, 15 bp, Homo sapiens
cagttcccttggcct

SEQ ID NO: 3998555 - DNA, 16 bp, Homo sapiens
cagttcccttggcctc

SEQ ID NO: 3998556 - DNA, 22 bp, Homo sapiens
cagttcctttgtgtgtactcac

SEQ ID NO: 3998557 - DNA, 16 bp, Homo sapiens
cagttctcactcctag

SEQ ID NO: 3998558 - DNA, 18 bp, Homo sapiens
cagttctgtcatatgtta

SEQ ID NO: 3998559 - DNA, 23 bp, Homo sapiens
cagttcttggtgactgtcccacc

SEQ ID NO: 3998560 - DNA, 21 bp, Homo sapiens
cagttcttggtgctctgtgtt

SEQ ID NO: 3998561 - DNA, 19 bp, Homo sapiens
cagttctttgggccagaca

SEQ ID NO: 3998562 - DNA, 20 bp, Homo sapiens
cagttctttgggccagacat

SEQ ID NO: 3998563 - DNA, 21 bp, Homo sapiens
cagttctttgggccagacatg

SEQ ID NO: 3998564 - DNA, 19 bp, Homo sapiens
cagttgaagggaggggctg

SEQ ID NO: 3998565 - DNA, 16 bp, Homo sapiens
cagttgacagcaggtg

SEQ ID NO: 3998566 - DNA, 19 bp, Homo sapiens
cagttgagaggacactccc

SEQ ID NO: 3998567 - DNA, 20 bp, Homo sapiens
cagttgagaggacactcccg

SEQ ID NO: 3998568 - DNA, 16 bp, Homo sapiens
cagttgatcttcttca

SEQ ID NO: 3998569 - DNA, 18 bp, Homo sapiens
cagttgccaccacctctg

SEQ ID NO: 3998570 - DNA, 22 bp, Homo sapiens
cagttgcccgaaactaagccag

SEQ ID NO: 3998571 - DNA, 20 bp, Homo sapiens
cagttgccctagcccagact

SEQ ID NO: 3998572 - DNA, 15 bp, Homo sapiens
cagttggactctcag

SEQ ID NO: 3998573 - DNA, 16 bp, Homo sapiens
cagttggactctcagg

SEQ ID NO: 3998574 - DNA, 16 bp, Homo sapiens
cagttgggactcagga

SEQ ID NO: 3998575 - DNA, 14 bp, Homo sapiens
cagttgggagcact

SEQ ID NO: 3998576 - DNA, 15 bp, Homo sapiens
cagttgggagcactg

SEQ ID NO: 3998577 - DNA, 21 bp, Homo sapiens
cagttgggagcactggagtgc

SEQ ID NO: 3998578 - DNA, 17 bp, Homo sapiens
cagttgtcctatggaca

SEQ ID NO: 3998579 - DNA, 17 bp, Homo sapiens
cagttgtgttagcctct

SEQ ID NO: 3998580 - DNA, 16 bp, Homo sapiens
cagtttaaaaaaattg

SEQ ID NO: 3998581 - DNA, 18 bp, Homo sapiens
cagtttaaaaaaattggt

SEQ ID NO: 3998582 - DNA, 18 bp, Homo sapiens
cagtttataccctagtta

SEQ ID NO: 3998583 - DNA, 18 bp, Homo sapiens
cagtttattccagagctg

SEQ ID NO: 3998584 - DNA, 22 bp, Homo sapiens
cagtttattccagagctgccag

SEQ ID NO: 3998585 - DNA, 18 bp, Homo sapiens
cagtttatttttaaagat

SEQ ID NO: 3998586 - DNA, 15 bp, Homo sapiens
cagtttgagacagga

SEQ ID NO: 3998587 - DNA, 16 bp, Homo sapiens
cagtttgagacaggag

SEQ ID NO: 3998588 - DNA, 18 bp, Homo sapiens
cagtttgagacaggagac

SEQ ID NO: 3998589 - DNA, 13 bp, Homo sapiens
cagtttgccaccc

SEQ ID NO: 3998590 - DNA, 21 bp, Homo sapiens
cagtttgccacccctgtccag

SEQ ID NO: 3998591 - DNA, 12 bp, Homo sapiens
cagtttgctttg

SEQ ID NO: 3998592 - DNA, 14 bp, Homo sapiens
cagtttgctttgta

SEQ ID NO: 3998593 - DNA, 22 bp, Homo sapiens
cagtttgggtaaaatactttta

SEQ ID NO: 3998594 - DNA, 15 bp, Homo sapiens
cagttttatttttgc

SEQ ID NO: 3998595 - DNA, 13 bp, Homo sapiens
cagttttcagaaa

SEQ ID NO: 3998596 - DNA, 13 bp, Homo sapiens
cagttttccctgg

SEQ ID NO: 3998597 - DNA, 14 bp, Homo sapiens
cagtttttgtatct

SEQ ID NO: 3998598 - DNA, 15 bp, Homo sapiens
cagtttttgtatctt

SEQ ID NO: 3998599 - DNA, 13 bp, Homo sapiens
cagtttttgtgtt

SEQ ID NO: 3998600 - DNA, 16 bp, Homo sapiens
cagttttttatgctaa

SEQ ID NO: 3998601 - DNA, 12 bp, Homo sapiens
cataaaaagcag

SEQ ID NO: 3998602 - DNA, 21 bp, Homo sapiens
cataaaaagcagaattttaat

SEQ ID NO: 3998603 - DNA, 13 bp, Homo sapiens
cataaaaaggaca

SEQ ID NO: 3998604 - DNA, 21 bp, Homo sapiens
cataaaaaggacatcagcaaa

SEQ ID NO: 3998605 - DNA, 19 bp, Homo sapiens
cataaaagggtcaaacctg

SEQ ID NO: 3998606 - DNA, 20 bp, Homo sapiens
cataaaataaagtatatata

SEQ ID NO: 3998607 - DNA, 21 bp, Homo sapiens
cataaacccagttgccatctg

SEQ ID NO: 3998608 - DNA, 13 bp, Homo sapiens
cataaactgactt

SEQ ID NO: 3998609 - DNA, 15 bp, Homo sapiens
cataaagggttgaaa

SEQ ID NO: 3998610 - DNA, 13 bp, Homo sapiens
cataaatatgcag

SEQ ID NO: 3998611 - DNA, 20 bp, Homo sapiens
cataaatttactttacacaa

SEQ ID NO: 3998612 - DNA, 17 bp, Homo sapiens
cataacgtttttccttt

SEQ ID NO: 3998613 - DNA, 21 bp, Homo sapiens
cataacgtttttcctttaaaa

SEQ ID NO: 3998614 - DNA, 22 bp, Homo sapiens
cataactctgtaaaaacactga

SEQ ID NO: 3998615 - DNA, 13 bp, Homo sapiens
cataacttcctgt

SEQ ID NO: 3998616 - DNA, 23 bp, Homo sapiens
cataacttcctgtacttgaagtc

SEQ ID NO: 3998617 - DNA, 14 bp, Homo sapiens
cataagataaatgt

SEQ ID NO: 3998618 - DNA, 17 bp, Homo sapiens
cataaggacgtgtgtaa

SEQ ID NO: 3998619 - DNA, 17 bp, Homo sapiens
cataagtaattcaagaa

SEQ ID NO: 3998620 - DNA, 16 bp, Homo sapiens
cataagtatacagttc

SEQ ID NO: 3998621 - DNA, 16 bp, Homo sapiens
cataagtgaatttata

SEQ ID NO: 3998622 - DNA, 18 bp, Homo sapiens
cataagtgctattgcaga

SEQ ID NO: 3998623 - DNA, 21 bp, Homo sapiens
cataagttgcatttagaaatc

SEQ ID NO: 3998624 - DNA, 23 bp, Homo sapiens
cataataaaaaattatgacaatg

SEQ ID NO: 3998625 - DNA, 12 bp, Homo sapiens
cataataaagca

SEQ ID NO: 3998626 - DNA, 15 bp, Homo sapiens
cataatcactctaat

SEQ ID NO: 3998627 - DNA, 22 bp, Homo sapiens
cataatgaaaatattttttaca

SEQ ID NO: 3998628 - DNA, 15 bp, Homo sapiens
cataatgataaaata

SEQ ID NO: 3998629 - DNA, 21 bp, Homo sapiens
cataatgctaatttaaagaga

SEQ ID NO: 3998630 - DNA, 14 bp, Homo sapiens
cataatgtattgtt

SEQ ID NO: 3998631 - DNA, 19 bp, Homo sapiens
cataattaaaatttatctt

SEQ ID NO: 3998632 - DNA, 15 bp, Homo sapiens
cataattatgacagt

SEQ ID NO: 3998633 - DNA, 11 bp, Homo sapiens
cataattccta

SEQ ID NO: 3998634 - DNA, 19 bp, Homo sapiens
cataattcctacagcacta

SEQ ID NO: 3998635 - DNA, 17 bp, Homo sapiens
cataattcttgtatatt

SEQ ID NO: 3998636 - DNA, 23 bp, Homo sapiens
cataatttgctggagaagtgtgt

SEQ ID NO: 3998637 - DNA, 15 bp, Homo sapiens
cataatttggaggga

SEQ ID NO: 3998638 - DNA, 14 bp, Homo sapiens
cataattttcttca

SEQ ID NO: 3998639 - DNA, 20 bp, Homo sapiens
cataattttcttcatgcaat

SEQ ID NO: 3998640 - DNA, 12 bp, Homo sapiens
cataattttgca

SEQ ID NO: 3998641 - DNA, 16 bp, Homo sapiens
catacaaaataaatgg

SEQ ID NO: 3998642 - DNA, 14 bp, Homo sapiens
catacaacagaggg

SEQ ID NO: 3998643 - DNA, 15 bp, Homo sapiens
catacacacagcagt

SEQ ID NO: 3998644 - DNA, 23 bp, Homo sapiens
catacacagaggagtgcagcctt

SEQ ID NO: 3998645 - DNA, 20 bp, Homo sapiens
catacactttgttgcaagat

SEQ ID NO: 3998646 - DNA, 19 bp, Homo sapiens
catcaggatgaacccagga

SEQ ID NO: 3998647 - DNA, 17 bp, Homo sapiens
catcagggatctcagag

SEQ ID NO: 3998648 - DNA, 15 bp, Homo sapiens
catcaggtagctgtc

SEQ ID NO: 3998649 - DNA, 19 bp, Homo sapiens
catcagtccccctgtgcat

SEQ ID NO: 3998650 - DNA, 19 bp, Homo sapiens
catcagttcctttgtgtgt

SEQ ID NO: 3998651 - DNA, 18 bp, Homo sapiens
catcataaaataaagtat

SEQ ID NO: 3998652 - DNA, 20 bp, Homo sapiens
catcataaaataaagtatat

SEQ ID NO: 3998653 - DNA, 18 bp, Homo sapiens
catcatatgcctgacccc

SEQ ID NO: 3998654 - DNA, 13 bp, Homo sapiens
catcatcagggcc

SEQ ID NO: 3998655 - DNA, 14 bp, Homo sapiens
catcatcagggcct

SEQ ID NO: 3998656 - DNA, 15 bp, Homo sapiens
catcatcagggcctg

SEQ ID NO: 3998657 - DNA, 18 bp, Homo sapiens
catcatccggtttagtca

SEQ ID NO: 3998658 - DNA, 14 bp, Homo sapiens
catcatcctttgtt

SEQ ID NO: 3998659 - DNA, 21 bp, Homo sapiens
catcatcctttgttctgagca

SEQ ID NO: 3998660 - DNA, 14 bp, Homo sapiens
catcatctctgaag

SEQ ID NO: 3998661 - DNA, 16 bp, Homo sapiens
catcatgaattttaca

SEQ ID NO: 3998662 - DNA, 17 bp, Homo sapiens
catcattacccttccct

SEQ ID NO: 3998663 - DNA, 14 bp, Homo sapiens
catcattccctctc

SEQ ID NO: 3998664 - DNA, 17 bp, Homo sapiens
catcattccttctggcc

SEQ ID NO: 3998665 - DNA, 14 bp, Homo sapiens
catcattgcactct

SEQ ID NO: 3998666 - DNA, 17 bp, Homo sapiens
catcattgtttctgcat

SEQ ID NO: 3998667 - DNA, 16 bp, Homo sapiens
catcattttattataa

SEQ ID NO: 3998668 - DNA, 22 bp, Homo sapiens
catcattttccatatcctggtg

SEQ ID NO: 3998669 - DNA, 20 bp, Homo sapiens
catcattttgcattcaaatt

SEQ ID NO: 3998670 - DNA, 18 bp, Homo sapiens
catccaacaagaagaaat

SEQ ID NO: 3998671 - DNA, 19 bp, Homo sapiens
catccaacaagaagaaata

SEQ ID NO: 3998672 - DNA, 16 bp, Homo sapiens
catccaacttccaaga

SEQ ID NO: 3998673 - DNA, 16 bp, Homo sapiens
catccaatcctcactg

SEQ ID NO: 3998674 - DNA, 18 bp, Homo sapiens
catccaatcctcactggg

SEQ ID NO: 3998675 - DNA, 14 bp, Homo sapiens
catccaccccatcc

SEQ ID NO: 3998676 - DNA, 21 bp, Homo sapiens
catccacccgggggagcccag

SEQ ID NO: 3998677 - DNA, 22 bp, Homo sapiens
catccacccgggggagcccagt

SEQ ID NO: 3998678 - DNA, 21 bp, Homo sapiens
catccaccttggctctgccag

SEQ ID NO: 3998679 - DNA, 23 bp, Homo sapiens
catccaccttggctctgccagtg

SEQ ID NO: 3998680 - DNA, 13 bp, Homo sapiens
catccagcagtgt

SEQ ID NO: 3998681 - DNA, 20 bp, Homo sapiens
catccagcagtgttgctcag

SEQ ID NO: 3998682 - DNA, 11 bp, Homo sapiens
catccagggcc

SEQ ID NO: 3998683 - DNA, 23 bp, Homo sapiens
catccagtctcccaacttgtatt

SEQ ID NO: 3998684 - DNA, 21 bp, Homo sapiens
catccagtttgttctccgggt

SEQ ID NO: 3998685 - DNA, 12 bp, Homo sapiens
catccataaatc

SEQ ID NO: 3998686 - DNA, 17 bp, Homo sapiens
catccataccagctcgc

SEQ ID NO: 3998687 - DNA, 17 bp, Homo sapiens
catccatccctccattc

SEQ ID NO: 3998688 - DNA, 13 bp, Homo sapiens
catccatctccag

SEQ ID NO: 3998689 - DNA, 14 bp, Homo sapiens
catccatctccagg

SEQ ID NO: 3998690 - DNA, 16 bp, Homo sapiens
catccatctccaggga

SEQ ID NO: 3998691 - DNA, 18 bp, Homo sapiens
catccatgtgtggactca

SEQ ID NO: 3998692 - DNA, 20 bp, Homo sapiens
catcccaaccaggcacctct

SEQ ID NO: 3998693 - DNA, 21 bp, Homo sapiens
catcccaacctctttttcctc

SEQ ID NO: 3998694 - DNA, 13 bp, Homo sapiens
catcccaactgtc

SEQ ID NO: 3998695 - DNA, 19 bp, Homo sapiens
catcccaccccatcctcca

SEQ ID NO: 3998696 - DNA, 19 bp, Homo sapiens
catcccacgcactccatga

SEQ ID NO: 3998697 - DNA, 14 bp, Homo sapiens
catcccagcagccc

SEQ ID NO: 3998698 - DNA, 12 bp, Homo sapiens
catcccagcctg

SEQ ID NO: 3998699 - DNA, 14 bp, Homo sapiens
catcccagcctggg

SEQ ID NO: 3998700 - DNA, 18 bp, Homo sapiens
catcccagcctgtggtta

SEQ ID NO: 3998701 - DNA, 15 bp, Homo sapiens
catccccaccagctc

SEQ ID NO: 3998702 - DNA, 16 bp, Homo sapiens
catccccaccagctcg

SEQ ID NO: 3998703 - DNA, 17 bp, Homo sapiens
catccccatcctccaga

SEQ ID NO: 3998704 - DNA, 12 bp, Homo sapiens
catccctacccc

SEQ ID NO: 3998705 - DNA, 14 bp, Homo sapiens
catccctaccccct

SEQ ID NO: 3998706 - DNA, 22 bp, Homo sapiens
catccctaccccctaagagcca

SEQ ID NO: 3998707 - DNA, 20 bp, Homo sapiens
catccctccattcatccttc

SEQ ID NO: 3998708 - DNA, 20 bp, Homo sapiens
catccctcgggaagcagcca

SEQ ID NO: 3998709 - DNA, 22 bp, Homo sapiens
catccctcgggaagcagccagc

SEQ ID NO: 3998710 - DNA, 17 bp, Homo sapiens
catccctgactggccaa

SEQ ID NO: 3998711 - DNA, 20 bp, Homo sapiens
catccctgactggccaaacc

SEQ ID NO: 3998712 - DNA, 13 bp, Homo sapiens
catccctgccaca

SEQ ID NO: 3998713 - DNA, 14 bp, Homo sapiens
catccctgccacat

SEQ ID NO: 3998714 - DNA, 19 bp, Homo sapiens
catccctggagcaggagcc

SEQ ID NO: 3998715 - DNA, 20 bp, Homo sapiens
catccctggagcaggagccc

SEQ ID NO: 3998716 - DNA, 17 bp, Homo sapiens
catccctgggcccctcc

SEQ ID NO: 3998717 - DNA, 22 bp, Homo sapiens
catccctgggcccctccacgcc

SEQ ID NO: 3998718 - DNA, 16 bp, Homo sapiens
catcccttctcttcca

SEQ ID NO: 3998719 - DNA, 22 bp, Homo sapiens
catcccttctcttccaggcagc

SEQ ID NO: 3998720 - DNA, 23 bp, Homo sapiens
catcccttctcttccaggcagcc

SEQ ID NO: 3998721 - DNA, 18 bp, Homo sapiens
catccggggccagctccg

SEQ ID NO: 3998722 - DNA, 16 bp, Homo sapiens
catcctaagaaatatg

SEQ ID NO: 3998723 - DNA, 17 bp, Homo sapiens
catcctaagaaatatgt

SEQ ID NO: 3998724 - DNA, 22 bp, Homo sapiens
catcctaagaaatatgtgagat

SEQ ID NO: 3998725 - DNA, 13 bp, Homo sapiens
catcctcatccct

SEQ ID NO: 3998726 - DNA, 11 bp, Homo sapiens
catcctccaga

SEQ ID NO: 3998727 - DNA, 19 bp, Homo sapiens
catcctccagtaccttgct

SEQ ID NO: 3998728 - DNA, 19 bp, Homo sapiens
catcctccctccacctcaa

SEQ ID NO: 3998729 - DNA, 20 bp, Homo sapiens
catcctccctccacctcaag

SEQ ID NO: 3998730 - DNA, 23 bp, Homo sapiens
catcctcctggaaccttgctgtc

SEQ ID NO: 3998731 - DNA, 19 bp, Homo sapiens
catcctctaaagcagaggc

SEQ ID NO: 3998732 - DNA, 15 bp, Homo sapiens
catcctcttctgctt

SEQ ID NO: 3998733 - DNA, 18 bp, Homo sapiens
catcctcttctgcttagg

SEQ ID NO: 3998734 - DNA, 17 bp, Homo sapiens
catcctgactctgcccc

SEQ ID NO: 3998735 - DNA, 14 bp, Homo sapiens
catcctgccagccc

SEQ ID NO: 3998736 - DNA, 21 bp, Homo sapiens
catcctgccagccccacacag

SEQ ID NO: 3998737 - DNA, 22 bp, Homo sapiens
catcctgccagccccacacagc

SEQ ID NO: 3998738 - DNA, 16 bp, Homo sapiens
catcctgccttcatgg

SEQ ID NO: 3998739 - DNA, 22 bp, Homo sapiens
catcctgccttcatggaactca

SEQ ID NO: 3998740 - DNA, 13 bp, Homo sapiens
catcctggctgcg

SEQ ID NO: 3998741 - DNA, 19 bp, Homo sapiens
catcctgtataagcactga

SEQ ID NO: 3998742 - DNA, 22 bp, Homo sapiens
catccttcaagaactctgggct

SEQ ID NO: 3998743 - DNA, 14 bp, Homo sapiens
catccttccatcca

SEQ ID NO: 3998744 - DNA, 15 bp, Homo sapiens
catccttccatccat

SEQ ID NO: 3998745 - DNA, 16 bp, Homo sapiens
catccttccatccatc

SEQ ID NO: 3998746 - DNA, 15 bp, Homo sapiens
catccttcccactct

SEQ ID NO: 3998747 - DNA, 17 bp, Homo sapiens
catccttcccactctgt

SEQ ID NO: 3998748 - DNA, 20 bp, Homo sapiens
catccttggtctttgtatct

SEQ ID NO: 3998749 - DNA, 22 bp, Homo sapiens
catgacccctcgtccacccccc

SEQ ID NO: 3998750 - DNA, 23 bp, Homo sapiens
catgacctgatcactagcctgtc

SEQ ID NO: 3998751 - DNA, 16 bp, Homo sapiens
catgactgcacccagc

SEQ ID NO: 3998752 - DNA, 17 bp, Homo sapiens
catgactgcacccagct

SEQ ID NO: 3998753 - DNA, 19 bp, Homo sapiens
catgactgcacccagctcc

SEQ ID NO: 3998754 - DNA, 20 bp, Homo sapiens
catgactgcacccagctcca

SEQ ID NO: 3998755 - DNA, 20 bp, Homo sapiens
catgactgggcctcccttgg

SEQ ID NO: 3998756 - DNA, 21 bp, Homo sapiens
catgactgggcctcccttggg

SEQ ID NO: 3998757 - DNA, 22 bp, Homo sapiens
catgactgtgaccaccttctgt

SEQ ID NO: 3998758 - DNA, 17 bp, Homo sapiens
catgagaagagggcctg

SEQ ID NO: 3998759 - DNA, 17 bp, Homo sapiens
catgagaccactgttat

SEQ ID NO: 3998760 - DNA, 16 bp, Homo sapiens
catgagcaccccaagg

SEQ ID NO: 3998761 - DNA, 12 bp, Homo sapiens
catgagcctgct

SEQ ID NO: 3998762 - DNA, 14 bp, Homo sapiens
catgagcctgctgg

SEQ ID NO: 3998763 - DNA, 15 bp, Homo sapiens
catgagcctgctgga

SEQ ID NO: 3998764 - DNA, 16 bp, Homo sapiens
catgagcctgctggaa

SEQ ID NO: 3998765 - DNA, 19 bp, Homo sapiens
catgagcctgctggaagcc

SEQ ID NO: 3998766 - DNA, 20 bp, Homo sapiens
catgagcctgctggaagccc

SEQ ID NO: 3998767 - DNA, 16 bp, Homo sapiens
catgagctatttccat

SEQ ID NO: 3998768 - DNA, 23 bp, Homo sapiens
catgaggcaatgtcaggaacaga

SEQ ID NO: 3998769 - DNA, 18 bp, Homo sapiens
catgaggccatctcagga

SEQ ID NO: 3998770 - DNA, 21 bp, Homo sapiens
catgaggccatctcaggagat

SEQ ID NO: 3998771 - DNA, 14 bp, Homo sapiens
catgagggacaggg

SEQ ID NO: 3998772 - DNA, 15 bp, Homo sapiens
catgagggacagggt

SEQ ID NO: 3998773 - DNA, 18 bp, Homo sapiens
catgaggggagaggagac

SEQ ID NO: 3998774 - DNA, 19 bp, Homo sapiens
catgaggtgttgtgcattt

SEQ ID NO: 3998775 - DNA, 21 bp, Homo sapiens
catgaggtgttgtgcatttgt

SEQ ID NO: 3998776 - DNA, 14 bp, Homo sapiens
catgagtgaataaa

SEQ ID NO: 3998777 - DNA, 14 bp, Homo sapiens
catgagtgtgcccc

SEQ ID NO: 3998778 - DNA, 23 bp, Homo sapiens
catgagttggggtctggcagcct

SEQ ID NO: 3998779 - DNA, 21 bp, Homo sapiens
catgagttgtcagctttgact

SEQ ID NO: 3998780 - DNA, 22 bp, Homo sapiens
catgatccctgtgttgtctcta

SEQ ID NO: 3998781 - DNA, 23 bp, Homo sapiens
catgatctgtatttaatggtttt

SEQ ID NO: 3998782 - DNA, 17 bp, Homo sapiens
catgatgctctttccca

SEQ ID NO: 3998783 - DNA, 15 bp, Homo sapiens
catgatggcaacaga

SEQ ID NO: 3998784 - DNA, 16 bp, Homo sapiens
catgatgggaaaatat

SEQ ID NO: 3998785 - DNA, 22 bp, Homo sapiens
catgatgggaaaatatttcctg

SEQ ID NO: 3998786 - DNA, 21 bp, Homo sapiens
catgattctttaatagaagtt

SEQ ID NO: 3998787 - DNA, 18 bp, Homo sapiens
catgcacccctgagccag

SEQ ID NO: 3998788 - DNA, 16 bp, Homo sapiens
catgcaccctcataca

SEQ ID NO: 3998789 - DNA, 20 bp, Homo sapiens
catgcaccctcatacacaga

SEQ ID NO: 3998790 - DNA, 16 bp, Homo sapiens
catgcactgtgaagga

SEQ ID NO: 3998791 - DNA, 20 bp, Homo sapiens
catgcagcccatgcccacct

SEQ ID NO: 3998792 - DNA, 23 bp, Homo sapiens
catgcagcccatgcccacctgcc

SEQ ID NO: 3998793 - DNA, 12 bp, Homo sapiens
catgcaggccct

SEQ ID NO: 3998794 - DNA, 13 bp, Homo sapiens
catgcaggccctt

SEQ ID NO: 3998795 - DNA, 13 bp, Homo sapiens
catgcataaaagg

SEQ ID NO: 3998796 - DNA, 17 bp, Homo sapiens
catgcataaatatgcag

SEQ ID NO: 3998797 - DNA, 19 bp, Homo sapiens
catgcataaatatgcagtg

SEQ ID NO: 3998798 - DNA, 22 bp, Homo sapiens
catgcataaatatgcagtgata

SEQ ID NO: 3998799 - DNA, 20 bp, Homo sapiens
catgcattgttgaggtggtc

SEQ ID NO: 3998800 - DNA, 22 bp, Homo sapiens
catgcattgttgaggtggtctg

SEQ ID NO: 3998801 - DNA, 18 bp, Homo sapiens
catgcattgttggctatt

SEQ ID NO: 3998802 - DNA, 17 bp, Homo sapiens
catgcatttgaggtcaa

SEQ ID NO: 3998803 - DNA, 20 bp, Homo sapiens
catgcattttgcagcagtga

SEQ ID NO: 3998804 - DNA, 22 bp, Homo sapiens
catgccaaggcctccctcaggc

SEQ ID NO: 3998805 - DNA, 18 bp, Homo sapiens
catgccaccctcacacac

SEQ ID NO: 3998806 - DNA, 14 bp, Homo sapiens
catgccacctggca

SEQ ID NO: 3998807 - DNA, 15 bp, Homo sapiens
catgccacctggcaa

SEQ ID NO: 3998808 - DNA, 19 bp, Homo sapiens
catgccactacactccagc

SEQ ID NO: 3998809 - DNA, 18 bp, Homo sapiens
catgccactgcctgcacc

SEQ ID NO: 3998810 - DNA, 22 bp, Homo sapiens
catgccactgcctgcacctttc

SEQ ID NO: 3998811 - DNA, 18 bp, Homo sapiens
catgccagattctgcctc

SEQ ID NO: 3998812 - DNA, 19 bp, Homo sapiens
catgccagattctgcctct

SEQ ID NO: 3998813 - DNA, 23 bp, Homo sapiens
catgccagattctgcctctctgg

SEQ ID NO: 3998814 - DNA, 19 bp, Homo sapiens
catgccaggaacctgtcct

SEQ ID NO: 3998815 - DNA, 15 bp, Homo sapiens
catgcccaccccctg

SEQ ID NO: 3998816 - DNA, 21 bp, Homo sapiens
catgcccaccccctgccctgc

SEQ ID NO: 3998817 - DNA, 22 bp, Homo sapiens
catgcccaccccctgccctgca

SEQ ID NO: 3998818 - DNA, 15 bp, Homo sapiens
catgcccactgctgg

SEQ ID NO: 3998819 - DNA, 22 bp, Homo sapiens
catgcccactgctggtgccagg

SEQ ID NO: 3998820 - DNA, 15 bp, Homo sapiens
catgcccctggctgg

SEQ ID NO: 3998821 - DNA, 16 bp, Homo sapiens
catgcccctggctggg

SEQ ID NO: 3998822 - DNA, 21 bp, Homo sapiens
catgcccggctaatttttgta

SEQ ID NO: 3998823 - DNA, 21 bp, Homo sapiens
catgccctctctgagtctgga

SEQ ID NO: 3998824 - DNA, 14 bp, Homo sapiens
catgccctgtgcaa

SEQ ID NO: 3998825 - DNA, 18 bp, Homo sapiens
catgccctgtgcaacctc

SEQ ID NO: 3998826 - DNA, 23 bp, Homo sapiens
catgccgggcccctccatccacc

SEQ ID NO: 3998827 - DNA, 14 bp, Homo sapiens
catgcctagcagag

SEQ ID NO: 3998828 - DNA, 23 bp, Homo sapiens
catgcctagcagagtgctggcac

SEQ ID NO: 3998829 - DNA, 13 bp, Homo sapiens
catgcctgagggt

SEQ ID NO: 3998830 - DNA, 16 bp, Homo sapiens
catgcctgagggtgga

SEQ ID NO: 3998831 - DNA, 20 bp, Homo sapiens
catgcctgccccaaacaaat

SEQ ID NO: 3998832 - DNA, 21 bp, Homo sapiens
catgcctgcgcctgctgcctg

SEQ ID NO: 3998833 - DNA, 16 bp, Homo sapiens
catgcctgtccagcct

SEQ ID NO: 3998834 - DNA, 17 bp, Homo sapiens
catgcctgtccagcctg

SEQ ID NO: 3998835 - DNA, 18 bp, Homo sapiens
catgcctgtccagcctgg

SEQ ID NO: 3998836 - DNA, 20 bp, Homo sapiens
catgcctgtccagcctgggc

SEQ ID NO: 3998837 - DNA, 23 bp, Homo sapiens
catgcctgtccagcctgggcagc

SEQ ID NO: 3998838 - DNA, 20 bp, Homo sapiens
catgccttaaacctacctcc

SEQ ID NO: 3998839 - DNA, 16 bp, Homo sapiens
catgccttaaatttgt

SEQ ID NO: 3998840 - DNA, 12 bp, Homo sapiens
catgccttgtgc

SEQ ID NO: 3998841 - DNA, 15 bp, Homo sapiens
catgcctttcatagt

SEQ ID NO: 3998842 - DNA, 16 bp, Homo sapiens
catgcctttgtaagtt

SEQ ID NO: 3998843 - DNA, 16 bp, Homo sapiens
catgctaaaattctat

SEQ ID NO: 3998844 - DNA, 17 bp, Homo sapiens
catgctaacaaagacaa

SEQ ID NO: 3998845 - DNA, 14 bp, Homo sapiens
catgctaggatgcg

SEQ ID NO: 3998846 - DNA, 16 bp, Homo sapiens
catgctcaaccactgt

SEQ ID NO: 3998847 - DNA, 19 bp, Homo sapiens
catgctgaaggctgaaaga

SEQ ID NO: 3998848 - DNA, 19 bp, Homo sapiens
catgctgaagggaccttga

SEQ ID NO: 3998849 - DNA, 16 bp, Homo sapiens
catgctgcccctgcct

SEQ ID NO: 3998850 - DNA, 14 bp, Homo sapiens
catgctgggccact

SEQ ID NO: 3998851 - DNA, 20 bp, Homo sapiens
catgtctgcagtgtgccccc

SEQ ID NO: 3998852 - DNA, 12 bp, Homo sapiens
catgtctgcctg

SEQ ID NO: 3998853 - DNA, 14 bp, Homo sapiens
catgtctgcctgga

SEQ ID NO: 3998854 - DNA, 14 bp, Homo sapiens
catgtctgttcttc

SEQ ID NO: 3998855 - DNA, 20 bp, Homo sapiens
catgtgagccaccgctgcca

SEQ ID NO: 3998856 - DNA, 23 bp, Homo sapiens
catgtgaggaggaaaaggaaaaa

SEQ ID NO: 3998857 - DNA, 16 bp, Homo sapiens
catgtgatcacgcctg

SEQ ID NO: 3998858 - DNA, 19 bp, Homo sapiens
catgtgcacccggcctgga

SEQ ID NO: 3998859 - DNA, 24 bp, Homo sapiens
catgtgccagggcaatgatgaatg

SEQ ID NO: 3998860 - DNA, 11 bp, Homo sapiens
catgtgccttt

SEQ ID NO: 3998861 - DNA, 23 bp, Homo sapiens
catgtgcctttctttgcctctgc

SEQ ID NO: 3998862 - DNA, 16 bp, Homo sapiens
catgtggaaagtgaat

SEQ ID NO: 3998863 - DNA, 18 bp, Homo sapiens
catgtggaaagtgaattt

SEQ ID NO: 3998864 - DNA, 20 bp, Homo sapiens
catgtggaaagtgaatttga

SEQ ID NO: 3998865 - DNA, 21 bp, Homo sapiens
catgtggaaagtgaatttgaa

SEQ ID NO: 3998866 - DNA, 15 bp, Homo sapiens
catgtggagtcagcc

SEQ ID NO: 3998867 - DNA, 18 bp, Homo sapiens
catgtggagtcagcctcg

SEQ ID NO: 3998868 - DNA, 22 bp, Homo sapiens
catgtggctgtagatcccaaga

SEQ ID NO: 3998869 - DNA, 15 bp, Homo sapiens
catgtgggcacggag

SEQ ID NO: 3998870 - DNA, 23 bp, Homo sapiens
catgtgggtgagccagtggaaca

SEQ ID NO: 3998871 - DNA, 23 bp, Homo sapiens
catgtggtggcacaggccccctt

SEQ ID NO: 3998872 - DNA, 12 bp, Homo sapiens
catgtgtatgtg

SEQ ID NO: 3998873 - DNA, 16 bp, Homo sapiens
catgtgtatgtgtctg

SEQ ID NO: 3998874 - DNA, 14 bp, Homo sapiens
catgtgtcccagga

SEQ ID NO: 3998875 - DNA, 18 bp, Homo sapiens
catgtgtcccaggagcag

SEQ ID NO: 3998876 - DNA, 15 bp, Homo sapiens
catgtgtcccctcac

SEQ ID NO: 3998877 - DNA, 24 bp, Homo sapiens
catgtgtcccctcactctgtcagc

SEQ ID NO: 3998878 - DNA, 14 bp, Homo sapiens
catgtgttgaaaaa

SEQ ID NO: 3998879 - DNA, 21 bp, Homo sapiens
catgtgtttattcatccagca

SEQ ID NO: 3998880 - DNA, 17 bp, Homo sapiens
catgttacataagataa

SEQ ID NO: 3998881 - DNA, 17 bp, Homo sapiens
catgttacctcctataa

SEQ ID NO: 3998882 - DNA, 20 bp, Homo sapiens
catgttactacagaggaaag

SEQ ID NO: 3998883 - DNA, 17 bp, Homo sapiens
catgttactgaccagca

SEQ ID NO: 3998884 - DNA, 20 bp, Homo sapiens
catgttcacaccgctgcact

SEQ ID NO: 3998885 - DNA, 13 bp, Homo sapiens
catgttcctcaaa

SEQ ID NO: 3998886 - DNA, 21 bp, Homo sapiens
catgttcctcaaaagcaccct

SEQ ID NO: 3998887 - DNA, 16 bp, Homo sapiens
catgttcttgcagtca

SEQ ID NO: 3998888 - DNA, 19 bp, Homo sapiens
catgtttacttttcagggc

SEQ ID NO: 3998889 - DNA, 21 bp, Homo sapiens
catgtttacttttcagggcat

SEQ ID NO: 3998890 - DNA, 20 bp, Homo sapiens
catgtttatttttcttgtct

SEQ ID NO: 3998891 - DNA, 21 bp, Homo sapiens
catgttttgtgcatttgtaaa

SEQ ID NO: 3998892 - DNA, 15 bp, Homo sapiens
cattaaaattgttac

SEQ ID NO: 3998893 - DNA, 13 bp, Homo sapiens
cattaaacttgaa

SEQ ID NO: 3998894 - DNA, 19 bp, Homo sapiens
cattaaacttttttaacca

SEQ ID NO: 3998895 - DNA, 18 bp, Homo sapiens
cattaaatgcaataattt

SEQ ID NO: 3998896 - DNA, 21 bp, Homo sapiens
cattaaattcacaaactttta

SEQ ID NO: 3998897 - DNA, 16 bp, Homo sapiens
cattaacaaataaaaa

SEQ ID NO: 3998898 - DNA, 13 bp, Homo sapiens
cattaacacaaag

SEQ ID NO: 3998899 - DNA, 13 bp, Homo sapiens
cattaacagtttt

SEQ ID NO: 3998900 - DNA, 17 bp, Homo sapiens
cattaacagttttccat

SEQ ID NO: 3998901 - DNA, 23 bp, Homo sapiens
cattaacagttttccatgaaaac

SEQ ID NO: 3998902 - DNA, 13 bp, Homo sapiens
cattaaggtattt

SEQ ID NO: 3998903 - DNA, 20 bp, Homo sapiens
cattaagtaatcaataaaga

SEQ ID NO: 3998904 - DNA, 21 bp, Homo sapiens
cattaagtaatcaataaagaa

SEQ ID NO: 3998905 - DNA, 20 bp, Homo sapiens
cattaatagcagcctttctc

SEQ ID NO: 3998906 - DNA, 16 bp, Homo sapiens
cattaattaatggctt

SEQ ID NO: 3998907 - DNA, 19 bp, Homo sapiens
cattaatttttaattgaaa

SEQ ID NO: 3998908 - DNA, 15 bp, Homo sapiens
cattacagagaggag

SEQ ID NO: 3998909 - DNA, 20 bp, Homo sapiens
cattacagagaggagaaaca

SEQ ID NO: 3998910 - DNA, 22 bp, Homo sapiens
cattacagagaggagaaacaca

SEQ ID NO: 3998911 - DNA, 16 bp, Homo sapiens
cattaccactcaggca

SEQ ID NO: 3998912 - DNA, 15 bp, Homo sapiens
cattacccttccctg

SEQ ID NO: 3998913 - DNA, 21 bp, Homo sapiens
cattacctccatccatccttc

SEQ ID NO: 3998914 - DNA, 20 bp, Homo sapiens
cattactgtttaagacactt

SEQ ID NO: 3998915 - DNA, 14 bp, Homo sapiens
cattagaaaaagag

SEQ ID NO: 3998916 - DNA, 19 bp, Homo sapiens
cattagattttattttact

SEQ ID NO: 3998917 - DNA, 21 bp, Homo sapiens
cattaggaattaagttatctt

SEQ ID NO: 3998918 - DNA, 18 bp, Homo sapiens
cattaggttgtcctagaa

SEQ ID NO: 3998919 - DNA, 22 bp, Homo sapiens
cattagtaaatgtctttgtaag

SEQ ID NO: 3998920 - DNA, 16 bp, Homo sapiens
cattagtaactttgaa

SEQ ID NO: 3998921 - DNA, 16 bp, Homo sapiens
cattagttttagaggc

SEQ ID NO: 3998922 - DNA, 13 bp, Homo sapiens
cattataaaaaga

SEQ ID NO: 3998923 - DNA, 13 bp, Homo sapiens
cattataaacgct

SEQ ID NO: 3998924 - DNA, 13 bp, Homo sapiens
cattataaacgtg

SEQ ID NO: 3998925 - DNA, 18 bp, Homo sapiens
cattataatcaccagggc

SEQ ID NO: 3998926 - DNA, 16 bp, Homo sapiens
cattatctcacttagt

SEQ ID NO: 3998927 - DNA, 17 bp, Homo sapiens
cattatcttatgaataa

SEQ ID NO: 3998928 - DNA, 16 bp, Homo sapiens
cattatgagaggcaat

SEQ ID NO: 3998929 - DNA, 22 bp, Homo sapiens
cattatgagaggcaatgattgt

SEQ ID NO: 3998930 - DNA, 13 bp, Homo sapiens
cattatgattctt

SEQ ID NO: 3998931 - DNA, 16 bp, Homo sapiens
cattatgccacttcct

SEQ ID NO: 3998932 - DNA, 23 bp, Homo sapiens
cattatgccacttccttttaact

SEQ ID NO: 3998933 - DNA, 20 bp, Homo sapiens
cattattcatttagtgagtt

SEQ ID NO: 3998934 - DNA, 15 bp, Homo sapiens
cattattctctttta

SEQ ID NO: 3998935 - DNA, 18 bp, Homo sapiens
cattattctcttttatct

SEQ ID NO: 3998936 - DNA, 14 bp, Homo sapiens
cattattggaatta

SEQ ID NO: 3998937 - DNA, 18 bp, Homo sapiens
cattattggaattaacct

SEQ ID NO: 3998938 - DNA, 20 bp, Homo sapiens
cattatttctagtccaaaat

SEQ ID NO: 3998939 - DNA, 19 bp, Homo sapiens
cattatttgcatgttacct

SEQ ID NO: 3998940 - DNA, 19 bp, Homo sapiens
cattattttgggaagaaaa

SEQ ID NO: 3998941 - DNA, 13 bp, Homo sapiens
cattattttgtgg

SEQ ID NO: 3998942 - DNA, 22 bp, Homo sapiens
cattatttttccactttgttct

SEQ ID NO: 3998943 - DNA, 22 bp, Homo sapiens
cattcaactttagtatttttac

SEQ ID NO: 3998944 - DNA, 18 bp, Homo sapiens
cattcaattccagagaac

SEQ ID NO: 3998945 - DNA, 15 bp, Homo sapiens
cattcacttgcattt

SEQ ID NO: 3998946 - DNA, 16 bp, Homo sapiens
cattcagatcactgaa

SEQ ID NO: 3998947 - DNA, 19 bp, Homo sapiens
cattcagtgattactgtca

SEQ ID NO: 3998948 - DNA, 16 bp, Homo sapiens
cattcataattaaaat

SEQ ID NO: 3998949 - DNA, 14 bp, Homo sapiens
cattccactccact

SEQ ID NO: 3998950 - DNA, 18 bp, Homo sapiens
cattccactgttggtatt

SEQ ID NO: 3998951 - DNA, 14 bp, Homo sapiens
cattccagaatctt

SEQ ID NO: 3998952 - DNA, 22 bp, Homo sapiens
cattccagctgtcactctgtgc

SEQ ID NO: 3998953 - DNA, 13 bp, Homo sapiens
cattttacagtga

SEQ ID NO: 3998954 - DNA, 23 bp, Homo sapiens
cattttacagtgaccttttcttc

SEQ ID NO: 3998955 - DNA, 23 bp, Homo sapiens
cattttacccttgcagttttact

SEQ ID NO: 3998956 - DNA, 16 bp, Homo sapiens
cattttcatatccaag

SEQ ID NO: 3998957 - DNA, 15 bp, Homo sapiens
cattttcatcactgg

SEQ ID NO: 3998958 - DNA, 12 bp, Homo sapiens
cattttcccaga

SEQ ID NO: 3998959 - DNA, 14 bp, Homo sapiens
cattttcccatcat

SEQ ID NO: 3998960 - DNA, 20 bp, Homo sapiens
cattttccccccactctccc

SEQ ID NO: 3998961 - DNA, 22 bp, Homo sapiens
cattttccccccactctcccca

SEQ ID NO: 3998962 - DNA, 15 bp, Homo sapiens
cattttcctgttcag

SEQ ID NO: 3998963 - DNA, 19 bp, Homo sapiens
cattttctataacagatat

SEQ ID NO: 3998964 - DNA, 17 bp, Homo sapiens
cattttctgacatgcat

SEQ ID NO: 3998965 - DNA, 22 bp, Homo sapiens
cattttctggtttggcatggtg

SEQ ID NO: 3998966 - DNA, 17 bp, Homo sapiens
cattttgagtgactcga

SEQ ID NO: 3998967 - DNA, 13 bp, Homo sapiens
cattttgcaaaat

SEQ ID NO: 3998968 - DNA, 14 bp, Homo sapiens
cattttgcaaaatt

SEQ ID NO: 3998969 - DNA, 16 bp, Homo sapiens
cattttgcagcagtga

SEQ ID NO: 3998970 - DNA, 18 bp, Homo sapiens
cattttgcagcagtgagt

SEQ ID NO: 3998971 - DNA, 19 bp, Homo sapiens
cattttgctattgtaaata

SEQ ID NO: 3998972 - DNA, 20 bp, Homo sapiens
cattttggaagttttcagga

SEQ ID NO: 3998973 - DNA, 20 bp, Homo sapiens
cattttgggggtttttaatc

SEQ ID NO: 3998974 - DNA, 15 bp, Homo sapiens
cattttggtgagaaa

SEQ ID NO: 3998975 - DNA, 18 bp, Homo sapiens
cattttggtttatttttg

SEQ ID NO: 3998976 - DNA, 20 bp, Homo sapiens
cattttggttttgtgttttg

SEQ ID NO: 3998977 - DNA, 12 bp, Homo sapiens
cattttgtgaat

SEQ ID NO: 3998978 - DNA, 16 bp, Homo sapiens
catttttaatttaaca

SEQ ID NO: 3998979 - DNA, 20 bp, Homo sapiens
catttttactattgttacat

SEQ ID NO: 3998980 - DNA, 23 bp, Homo sapiens
catttttattaaagcatttccta

SEQ ID NO: 3998981 - DNA, 21 bp, Homo sapiens
catttttcaatatattgaact

SEQ ID NO: 3998982 - DNA, 19 bp, Homo sapiens
catttttccgtttgctttt

SEQ ID NO: 3998983 - DNA, 21 bp, Homo sapiens
catttttctcccaagaaacct

SEQ ID NO: 3998984 - DNA, 16 bp, Homo sapiens
ccaaaaaaaggaaaaa

SEQ ID NO: 3998985 - DNA, 14 bp, Homo sapiens
ccaaaacttctctt

SEQ ID NO: 3998986 - DNA, 12 bp, Homo sapiens
ccaaaagaaaaa

SEQ ID NO: 3998987 - DNA, 18 bp, Homo sapiens
ccaaaagattgctgaaaa

SEQ ID NO: 3998988 - DNA, 15 bp, Homo sapiens
ccaaaagcgccctca

SEQ ID NO: 3998989 - DNA, 15 bp, Homo sapiens
ccaaacatcagacct

SEQ ID NO: 3998990 - DNA, 23 bp, Homo sapiens
ccaaacccttgctttcctgggcc

SEQ ID NO: 3998991 - DNA, 21 bp, Homo sapiens
ccaaacgccctttcctcctca

SEQ ID NO: 3998992 - DNA, 22 bp, Homo sapiens
ccaaacgccctttcctcctcag

SEQ ID NO: 3998993 - DNA, 14 bp, Homo sapiens
ccaaactcatcttg

SEQ ID NO: 3998994 - DNA, 21 bp, Homo sapiens
ccaaactgtccctcccttgct

SEQ ID NO: 3998995 - DNA, 18 bp, Homo sapiens
ccaaacttggatttttga

SEQ ID NO: 3998996 - DNA, 15 bp, Homo sapiens
ccaaagagcctggag

SEQ ID NO: 3998997 - DNA, 14 bp, Homo sapiens
ccaaagaggctgcc

SEQ ID NO: 3998998 - DNA, 17 bp, Homo sapiens
ccaaagaggctgcccct

SEQ ID NO: 3998999 - DNA, 20 bp, Homo sapiens
ccaaagaggctgcccctctc

SEQ ID NO: 3999000 - DNA, 21 bp, Homo sapiens
ccaaagaggctgcccctctca

SEQ ID NO: 3999001 - DNA, 9 bp, Homo sapiens
ccaaagagt

SEQ ID NO: 3999002 - DNA, 21 bp, Homo sapiens
ccaaagatatatacacaggat

SEQ ID NO: 3999003 - DNA, 17 bp, Homo sapiens
ccaaagcaaagaaaata

SEQ ID NO: 3999004 - DNA, 14 bp, Homo sapiens
ccaaagcagacagc

SEQ ID NO: 3999005 - DNA, 13 bp, Homo sapiens
ccaaagccagtga

SEQ ID NO: 3999006 - DNA, 19 bp, Homo sapiens
ccaaagcgggacgccgcag

SEQ ID NO: 3999007 - DNA, 16 bp, Homo sapiens
ccaaagcggtccctgt

SEQ ID NO: 3999008 - DNA, 18 bp, Homo sapiens
ccaaagctagggtggccc

SEQ ID NO: 3999009 - DNA, 20 bp, Homo sapiens
ccaaagctgcaggtgccagg

SEQ ID NO: 3999010 - DNA, 13 bp, Homo sapiens
ccaaagctttcct

SEQ ID NO: 3999011 - DNA, 15 bp, Homo sapiens
ccaaagctttcctgc

SEQ ID NO: 3999012 - DNA, 19 bp, Homo sapiens
ccaaagctttcctgcccca

SEQ ID NO: 3999013 - DNA, 12 bp, Homo sapiens
ccaaaggaggct

SEQ ID NO: 3999014 - DNA, 15 bp, Homo sapiens
ccaaaggaggctggc

SEQ ID NO: 3999015 - DNA, 19 bp, Homo sapiens
ccaaaggatgtgatatata

SEQ ID NO: 3999016 - DNA, 16 bp, Homo sapiens
ccaaaggcatcccagc

SEQ ID NO: 3999017 - DNA, 19 bp, Homo sapiens
ccaaaggcatcccagcctg

SEQ ID NO: 3999018 - DNA, 20 bp, Homo sapiens
ccaaaggcatcccagcctgg

SEQ ID NO: 3999019 - DNA, 21 bp, Homo sapiens
ccaaaggcatcccagcctggg

SEQ ID NO: 3999020 - DNA, 14 bp, Homo sapiens
ccaaaggcccccta

SEQ ID NO: 3999021 - DNA, 15 bp, Homo sapiens
ccaaaggctggtggc

SEQ ID NO: 3999022 - DNA, 23 bp, Homo sapiens
ccaaagggtgaagctatttatct

SEQ ID NO: 3999023 - DNA, 12 bp, Homo sapiens
ccaaagtacctt

SEQ ID NO: 3999024 - DNA, 13 bp, Homo sapiens
ccaaagtgctgag

SEQ ID NO: 3999025 - DNA, 19 bp, Homo sapiens
ccaaagttgttgtaacctg

SEQ ID NO: 3999026 - DNA, 17 bp, Homo sapiens
ccaaataagaaacctaa

SEQ ID NO: 3999027 - DNA, 18 bp, Homo sapiens
ccaaatatcaccaggact

SEQ ID NO: 3999028 - DNA, 15 bp, Homo sapiens
ccaaatcagctgcta

SEQ ID NO: 3999029 - DNA, 23 bp, Homo sapiens
ccaaatcagctgctactactcct

SEQ ID NO: 3999030 - DNA, 15 bp, Homo sapiens
ccaaatcccagggaa

SEQ ID NO: 3999031 - DNA, 20 bp, Homo sapiens
ccaaatctcttgcttgtcat

SEQ ID NO: 3999032 - DNA, 15 bp, Homo sapiens
ccaaatgcaatttga

SEQ ID NO: 3999033 - DNA, 21 bp, Homo sapiens
ccaaatgcagggaggggaggc

SEQ ID NO: 3999034 - DNA, 16 bp, Homo sapiens
ccaaatgctggggcag

SEQ ID NO: 3999035 - DNA, 19 bp, Homo sapiens
ccaaattcagtttcataaa

SEQ ID NO: 3999036 - DNA, 15 bp, Homo sapiens
ccaaattctttcagt

SEQ ID NO: 3999037 - DNA, 22 bp, Homo sapiens
ccaaattctttcagtggctacc

SEQ ID NO: 3999038 - DNA, 14 bp, Homo sapiens
ccaaatttatcaaa

SEQ ID NO: 3999039 - DNA, 12 bp, Homo sapiens
ccaacaaaccat

SEQ ID NO: 3999040 - DNA, 13 bp, Homo sapiens
ccaacaaaccatc

SEQ ID NO: 3999041 - DNA, 15 bp, Homo sapiens
ccaacaagaagaaat

SEQ ID NO: 3999042 - DNA, 19 bp, Homo sapiens
ccaacaagaagaaatatga

SEQ ID NO: 3999043 - DNA, 17 bp, Homo sapiens
ccaacaccaagcacagc

SEQ ID NO: 3999044 - DNA, 23 bp, Homo sapiens
ccaacaccaagcacagcagcctg

SEQ ID NO: 3999045 - DNA, 15 bp, Homo sapiens
ccaacaccacagaaa

SEQ ID NO: 3999046 - DNA, 14 bp, Homo sapiens
ccaacaccacagac

SEQ ID NO: 3999047 - DNA, 15 bp, Homo sapiens
ccaacaccacagaca

SEQ ID NO: 3999048 - DNA, 21 bp, Homo sapiens
ccaacaccacagacacacaca

SEQ ID NO: 3999049 - DNA, 21 bp, Homo sapiens
ccaacacgcacctgcctcagg

SEQ ID NO: 3999050 - DNA, 15 bp, Homo sapiens
ccaacagcacctccc

SEQ ID NO: 3999051 - DNA, 14 bp, Homo sapiens
ccaacagcagtgat

SEQ ID NO: 3999052 - DNA, 19 bp, Homo sapiens
ccaacagtcaaaacagaga

SEQ ID NO: 3999053 - DNA, 16 bp, Homo sapiens
ccaacatcaacatctt

SEQ ID NO: 3999054 - DNA, 12 bp, Homo sapiens
ccaaccaggcag

SEQ ID NO: 3999055 - DNA, 19 bp, Homo sapiens
ccaacccccaccccacact

SEQ ID NO: 3999056 - DNA, 15 bp, Homo sapiens
ccacccaccagggcg

SEQ ID NO: 3999057 - DNA, 18 bp, Homo sapiens
ccacccacctccacccag

SEQ ID NO: 3999058 - DNA, 13 bp, Homo sapiens
ccacccactcagg

SEQ ID NO: 3999059 - DNA, 12 bp, Homo sapiens
ccacccagcccc

SEQ ID NO: 3999060 - DNA, 14 bp, Homo sapiens
ccacccatgtcacc

SEQ ID NO: 3999061 - DNA, 13 bp, Homo sapiens
ccaccccctgccc

SEQ ID NO: 3999062 - DNA, 13 bp, Homo sapiens
ccacccccttctc

SEQ ID NO: 3999063 - DNA, 16 bp, Homo sapiens
ccaccccgcctgccct

SEQ ID NO: 3999064 - DNA, 21 bp, Homo sapiens
ccaccccggggaccctgtgac

SEQ ID NO: 3999065 - DNA, 13 bp, Homo sapiens
ccacccctacaca

SEQ ID NO: 3999066 - DNA, 14 bp, Homo sapiens
ccacccctacacac

SEQ ID NO: 3999067 - DNA, 16 bp, Homo sapiens
ccacccctacacacac

SEQ ID NO: 3999068 - DNA, 14 bp, Homo sapiens
ccacccctcactcc

SEQ ID NO: 3999069 - DNA, 15 bp, Homo sapiens
ccacccctcactccc

SEQ ID NO: 3999070 - DNA, 20 bp, Homo sapiens
ccacccctcactccccaggg

SEQ ID NO: 3999071 - DNA, 21 bp, Homo sapiens
ccacccctcactccccaggga

SEQ ID NO: 3999072 - DNA, 13 bp, Homo sapiens
ccacccctccaga

SEQ ID NO: 3999073 - DNA, 14 bp, Homo sapiens
ccacccctggaaga

SEQ ID NO: 3999074 - DNA, 15 bp, Homo sapiens
ccacccctgtccaga

SEQ ID NO: 3999075 - DNA, 21 bp, Homo sapiens
ccacccgacctggctgcccct

SEQ ID NO: 3999076 - DNA, 22 bp, Homo sapiens
ccacccgccccgcgcaccccac

SEQ ID NO: 3999077 - DNA, 20 bp, Homo sapiens
ccacccggttcagtgtttct

SEQ ID NO: 3999078 - DNA, 22 bp, Homo sapiens
ccacccgttctgctggcctgga

SEQ ID NO: 3999079 - DNA, 11 bp, Homo sapiens
ccaccctcaca

SEQ ID NO: 3999080 - DNA, 14 bp, Homo sapiens
ccaccctcacacac

SEQ ID NO: 3999081 - DNA, 13 bp, Homo sapiens
ccaccctccactc

SEQ ID NO: 3999082 - DNA, 16 bp, Homo sapiens
ccaccctccctggagt

SEQ ID NO: 3999083 - DNA, 14 bp, Homo sapiens
ccaccctcctgccc

SEQ ID NO: 3999084 - DNA, 16 bp, Homo sapiens
ccaccctcctgcccca

SEQ ID NO: 3999085 - DNA, 23 bp, Homo sapiens
ccaccctcctgccccacactccc

SEQ ID NO: 3999086 - DNA, 22 bp, Homo sapiens
ccaccctggccgagtccaagct

SEQ ID NO: 3999087 - DNA, 15 bp, Homo sapiens
ccaccctgggagaca

SEQ ID NO: 3999088 - DNA, 11 bp, Homo sapiens
ccaccctgggg

SEQ ID NO: 3999089 - DNA, 21 bp, Homo sapiens
ccaccctgtacctcatcccat

SEQ ID NO: 3999090 - DNA, 15 bp, Homo sapiens
ccaccctgtgcagaa

SEQ ID NO: 3999091 - DNA, 14 bp, Homo sapiens
ccacccttcagacc

SEQ ID NO: 3999092 - DNA, 20 bp, Homo sapiens
ccaccctttcccccttctct

SEQ ID NO: 3999093 - DNA, 22 bp, Homo sapiens
ccaccgaagtggactggcccct

SEQ ID NO: 3999094 - DNA, 16 bp, Homo sapiens
ccaccgaccaactgcc

SEQ ID NO: 3999095 - DNA, 17 bp, Homo sapiens
ccaccgaccaactgccc

SEQ ID NO: 3999096 - DNA, 16 bp, Homo sapiens
ccaccgagctggagcg

SEQ ID NO: 3999097 - DNA, 14 bp, Homo sapiens
ccaccgatggagcc

SEQ ID NO: 3999098 - DNA, 18 bp, Homo sapiens
ccaccgatggagccccca

SEQ ID NO: 3999099 - DNA, 17 bp, Homo sapiens
ccaccgggacagacctg

SEQ ID NO: 3999100 - DNA, 22 bp, Homo sapiens
ccaccgggacagacctggacac

SEQ ID NO: 3999101 - DNA, 14 bp, Homo sapiens
ccaccgggagcctc

SEQ ID NO: 3999102 - DNA, 22 bp, Homo sapiens
ccaccgggagcctccccctcag

SEQ ID NO: 3999103 - DNA, 19 bp, Homo sapiens
ccaccgggcatgtctgcct

SEQ ID NO: 3999104 - DNA, 20 bp, Homo sapiens
ccaccgggcatgtctgcctg

SEQ ID NO: 3999105 - DNA, 23 bp, Homo sapiens
ccaccgtgaaccagagggtgtgg

SEQ ID NO: 3999106 - DNA, 14 bp, Homo sapiens
ccaccgtgcctggc

SEQ ID NO: 3999107 - DNA, 13 bp, Homo sapiens
ccaccgtggagga

SEQ ID NO: 3999108 - DNA, 13 bp, Homo sapiens
ccacctagcagca

SEQ ID NO: 3999109 - DNA, 21 bp, Homo sapiens
ccacctccacccagcccctgg

SEQ ID NO: 3999110 - DNA, 15 bp, Homo sapiens
ccacctccactccca

SEQ ID NO: 3999111 - DNA, 17 bp, Homo sapiens
ccacctccactcccacc

SEQ ID NO: 3999112 - DNA, 15 bp, Homo sapiens
ccacctcccaccctg

SEQ ID NO: 3999113 - DNA, 17 bp, Homo sapiens
ccacctcccaccctgac

SEQ ID NO: 3999114 - DNA, 19 bp, Homo sapiens
ccacctcggtcactccaac

SEQ ID NO: 3999115 - DNA, 21 bp, Homo sapiens
ccacctctccaagtctctctg

SEQ ID NO: 3999116 - DNA, 12 bp, Homo sapiens
ccacctctccct

SEQ ID NO: 3999117 - DNA, 12 bp, Homo sapiens
ccacctctcctg

SEQ ID NO: 3999118 - DNA, 17 bp, Homo sapiens
ccacctctctcctttgc

SEQ ID NO: 3999119 - DNA, 24 bp, Homo sapiens
ccacctctctcctttgctgaggcc

SEQ ID NO: 3999120 - DNA, 21 bp, Homo sapiens
ccacctctgtggcattgaaat

SEQ ID NO: 3999121 - DNA, 22 bp, Homo sapiens
ccacctcttgtgcaaggtggcc

SEQ ID NO: 3999122 - DNA, 17 bp, Homo sapiens
ccacctgcagctccctc

SEQ ID NO: 3999123 - DNA, 18 bp, Homo sapiens
ccacctgcatctggggcc

SEQ ID NO: 3999124 - DNA, 23 bp, Homo sapiens
ccacctgcccatcacagggttgg

SEQ ID NO: 3999125 - DNA, 15 bp, Homo sapiens
ccacctgctctgctg

SEQ ID NO: 3999126 - DNA, 13 bp, Homo sapiens
ccacctgcttctg

SEQ ID NO: 3999127 - DNA, 23 bp, Homo sapiens
ccacctggatctatccctgcggc

SEQ ID NO: 3999128 - DNA, 21 bp, Homo sapiens
ccacctgtagccatctgcaca

SEQ ID NO: 3999129 - DNA, 11 bp, Homo sapiens
ccacctgtctc

SEQ ID NO: 3999130 - DNA, 19 bp, Homo sapiens
ccaccttgccaagctttct

SEQ ID NO: 3999131 - DNA, 18 bp, Homo sapiens
ccaccttggctctgccag

SEQ ID NO: 3999132 - DNA, 16 bp, Homo sapiens
ccacgagggtcaggac

SEQ ID NO: 3999133 - DNA, 13 bp, Homo sapiens
ccacgattctccc

SEQ ID NO: 3999134 - DNA, 15 bp, Homo sapiens
ccacgattggagaat

SEQ ID NO: 3999135 - DNA, 20 bp, Homo sapiens
ccacgcactgggccacggag

SEQ ID NO: 3999136 - DNA, 18 bp, Homo sapiens
ccacgctttgctgctacc

SEQ ID NO: 3999137 - DNA, 20 bp, Homo sapiens
ccacggcgttgtacctgtag

SEQ ID NO: 3999138 - DNA, 12 bp, Homo sapiens
ccacgtcccagc

SEQ ID NO: 3999139 - DNA, 13 bp, Homo sapiens
ccacgtctggcca

SEQ ID NO: 3999140 - DNA, 23 bp, Homo sapiens
ccacgtcttcttgctgcagcctg

SEQ ID NO: 3999141 - DNA, 17 bp, Homo sapiens
ccacgtgcgtgttttct

SEQ ID NO: 3999142 - DNA, 13 bp, Homo sapiens
ccacgtggagaaa

SEQ ID NO: 3999143 - DNA, 16 bp, Homo sapiens
ccacgtggtcactgtg

SEQ ID NO: 3999144 - DNA, 21 bp, Homo sapiens
ccacgtggtcactgtgcactg

SEQ ID NO: 3999145 - DNA, 14 bp, Homo sapiens
ccactaaaaatatt

SEQ ID NO: 3999146 - DNA, 22 bp, Homo sapiens
ccactaaaagatcgcagtttgc

SEQ ID NO: 3999147 - DNA, 15 bp, Homo sapiens
ccactaaagcttcag

SEQ ID NO: 3999148 - DNA, 23 bp, Homo sapiens
ccactaaatgagctcctgcggga

SEQ ID NO: 3999149 - DNA, 13 bp, Homo sapiens
ccactacacctgg

SEQ ID NO: 3999150 - DNA, 14 bp, Homo sapiens
ccactacacctggc

SEQ ID NO: 3999151 - DNA, 16 bp, Homo sapiens
ccactacacctggctg

SEQ ID NO: 3999152 - DNA, 17 bp, Homo sapiens
ccactacacctggctga

SEQ ID NO: 3999153 - DNA, 18 bp, Homo sapiens
ccactaccccacaccagc

SEQ ID NO: 3999154 - DNA, 22 bp, Homo sapiens
ccactaccccacaccagccttg

SEQ ID NO: 3999155 - DNA, 20 bp, Homo sapiens
ccactactgcagcacctcca

SEQ ID NO: 3999156 - DNA, 16 bp, Homo sapiens
ccactagactcttcac

SEQ ID NO: 3999157 - DNA, 19 bp, Homo sapiens
ccactaggaatcccagagg

SEQ ID NO: 3999158 - DNA, 16 bp, Homo sapiens
ccactatccttcgtga

SEQ ID NO: 3999159 - DNA, 20 bp, Homo sapiens
ccactatctccgttccatct

SEQ ID NO: 3999160 - DNA, 22 bp, Homo sapiens
ccactatctccgttccatctgg

SEQ ID NO: 3999161 - DNA, 20 bp, Homo sapiens
ccactcaggaggctgaggca

SEQ ID NO: 3999162 - DNA, 18 bp, Homo sapiens
ccactcaggttcttcagg

SEQ ID NO: 3999163 - DNA, 14 bp, Homo sapiens
ccactccaagccag

SEQ ID NO: 3999164 - DNA, 18 bp, Homo sapiens
ccactccagcgctgagtg

SEQ ID NO: 3999165 - DNA, 13 bp, Homo sapiens
ccactccagctct

SEQ ID NO: 3999166 - DNA, 20 bp, Homo sapiens
ccactcccccgtttctcctt

SEQ ID NO: 3999167 - DNA, 13 bp, Homo sapiens
ccactccctatct

SEQ ID NO: 3999168 - DNA, 13 bp, Homo sapiens
ccactccctgctc

SEQ ID NO: 3999169 - DNA, 16 bp, Homo sapiens
ccactccctgctccac

SEQ ID NO: 3999170 - DNA, 14 bp, Homo sapiens
ccactccctgggac

SEQ ID NO: 3999171 - DNA, 15 bp, Homo sapiens
ccactccctgggaca

SEQ ID NO: 3999172 - DNA, 21 bp, Homo sapiens
ccactctaccctcccaccccc

SEQ ID NO: 3999173 - DNA, 22 bp, Homo sapiens
ccactctaggggtcaggctcca

SEQ ID NO: 3999174 - DNA, 16 bp, Homo sapiens
ccactctccccacact

SEQ ID NO: 3999175 - DNA, 13 bp, Homo sapiens
ccactctcttccc

SEQ ID NO: 3999176 - DNA, 17 bp, Homo sapiens
ccactgacagcctccca

SEQ ID NO: 3999177 - DNA, 19 bp, Homo sapiens
ccactgagtaccaggggct

SEQ ID NO: 3999178 - DNA, 17 bp, Homo sapiens
ccactgatgctgttctc

SEQ ID NO: 3999179 - DNA, 13 bp, Homo sapiens
ccactgcaccgcc

SEQ ID NO: 3999180 - DNA, 23 bp, Homo sapiens
ccactgcccgagctggtgcatta

SEQ ID NO: 3999181 - DNA, 20 bp, Homo sapiens
ccactgcctctggaattgct

SEQ ID NO: 3999182 - DNA, 12 bp, Homo sapiens
ccactgcctgca

SEQ ID NO: 3999183 - DNA, 14 bp, Homo sapiens
ccactgctccattt

SEQ ID NO: 3999184 - DNA, 22 bp, Homo sapiens
ccactgctggtgccagggtggg

SEQ ID NO: 3999185 - DNA, 16 bp, Homo sapiens
ccactggaaggaacat

SEQ ID NO: 3999186 - DNA, 20 bp, Homo sapiens
ccactgggccagccctgcag

SEQ ID NO: 3999187 - DNA, 17 bp, Homo sapiens
ccactggggactttatt

SEQ ID NO: 3999188 - DNA, 18 bp, Homo sapiens
ccactggggactttattt

SEQ ID NO: 3999189 - DNA, 21 bp, Homo sapiens
ccactggggaggaatcctgga

SEQ ID NO: 3999190 - DNA, 16 bp, Homo sapiens
ccactggtaacatgtg

SEQ ID NO: 3999191 - DNA, 18 bp, Homo sapiens
ccactgtaaaatgaaatt

SEQ ID NO: 3999192 - DNA, 22 bp, Homo sapiens
ccactgtaatacgtagctctct

SEQ ID NO: 3999193 - DNA, 24 bp, Homo sapiens
ccactgtcactgtttctctgctgt

SEQ ID NO: 3999194 - DNA, 22 bp, Homo sapiens
ccactgtccccctacccaccga

SEQ ID NO: 3999195 - DNA, 20 bp, Homo sapiens
ccactgtcctgggcctgcag

SEQ ID NO: 3999196 - DNA, 16 bp, Homo sapiens
ccactgtggcgttctg

SEQ ID NO: 3999197 - DNA, 13 bp, Homo sapiens
ccactgtggtggc

SEQ ID NO: 3999198 - DNA, 16 bp, Homo sapiens
ccacttaaaaaatgtc

SEQ ID NO: 3999199 - DNA, 19 bp, Homo sapiens
ccacttagaaattgcattt

SEQ ID NO: 3999200 - DNA, 17 bp, Homo sapiens
ccacttcaagtgaccac

SEQ ID NO: 3999201 - DNA, 13 bp, Homo sapiens
ccacttcaataga

SEQ ID NO: 3999202 - DNA, 20 bp, Homo sapiens
ccacttcaatgcacatggtg

SEQ ID NO: 3999203 - DNA, 19 bp, Homo sapiens
ccacttccaggggaacctg

SEQ ID NO: 3999204 - DNA, 18 bp, Homo sapiens
ccacttcctgctacagga

SEQ ID NO: 3999205 - DNA, 20 bp, Homo sapiens
ccacttcctgctacaggagg

SEQ ID NO: 3999206 - DNA, 20 bp, Homo sapiens
ccacttcggccaggtcacac

SEQ ID NO: 3999207 - DNA, 11 bp, Homo sapiens
ccacttctccc

SEQ ID NO: 3999208 - DNA, 13 bp, Homo sapiens
ccacttcttcctt

SEQ ID NO: 3999209 - DNA, 23 bp, Homo sapiens
ccacttcttcctttctctttctc

SEQ ID NO: 3999210 - DNA, 20 bp, Homo sapiens
ccacttcttgttccccactg

SEQ ID NO: 3999211 - DNA, 17 bp, Homo sapiens
ccacttgaaatgttagt

SEQ ID NO: 3999212 - DNA, 16 bp, Homo sapiens
ccacttgggtcttccc

SEQ ID NO: 3999213 - DNA, 19 bp, Homo sapiens
ccactttcatctacctttt

SEQ ID NO: 3999214 - DNA, 20 bp, Homo sapiens
ccactttccaagtcactgca

SEQ ID NO: 3999215 - DNA, 21 bp, Homo sapiens
ccactttgcatatgagccgtg

SEQ ID NO: 3999216 - DNA, 15 bp, Homo sapiens
ccactttgttcttta

SEQ ID NO: 3999217 - DNA, 21 bp, Homo sapiens
ccagaaacagtgggagccctg

SEQ ID NO: 3999218 - DNA, 22 bp, Homo sapiens
ccagaaacagtgggagccctga

SEQ ID NO: 3999219 - DNA, 16 bp, Homo sapiens
ccagaaaggatattta

SEQ ID NO: 3999220 - DNA, 17 bp, Homo sapiens
ccagaaaggatatttaa

SEQ ID NO: 3999221 - DNA, 22 bp, Homo sapiens
ccagaaatgtccctttcttctc

SEQ ID NO: 3999222 - DNA, 17 bp, Homo sapiens
ccagaactctgcctgcc

SEQ ID NO: 3999223 - DNA, 14 bp, Homo sapiens
ccagaactcttcct

SEQ ID NO: 3999224 - DNA, 15 bp, Homo sapiens
ccagaactcttcctc

SEQ ID NO: 3999225 - DNA, 24 bp, Homo sapiens
ccagaactcttcctccaaggacag

SEQ ID NO: 3999226 - DNA, 18 bp, Homo sapiens
ccagaactgcccccactg

SEQ ID NO: 3999227 - DNA, 21 bp, Homo sapiens
ccagaactgcccccactgtcc

SEQ ID NO: 3999228 - DNA, 18 bp, Homo sapiens
ccagaagaagagaagctg

SEQ ID NO: 3999229 - DNA, 19 bp, Homo sapiens
ccagaagaagagaagctgc

SEQ ID NO: 3999230 - DNA, 21 bp, Homo sapiens
ccagaagaagagaagctgctg

SEQ ID NO: 3999231 - DNA, 22 bp, Homo sapiens
ccagaagaagagaagctgctga

SEQ ID NO: 3999232 - DNA, 18 bp, Homo sapiens
ccagaagaatattcagga

SEQ ID NO: 3999233 - DNA, 20 bp, Homo sapiens
ccagaagaatattcaggact

SEQ ID NO: 3999234 - DNA, 22 bp, Homo sapiens
ccagaagatcccctcaggactg

SEQ ID NO: 3999235 - DNA, 24 bp, Homo sapiens
ccagaagatcccctcaggactgca

SEQ ID NO: 3999236 - DNA, 16 bp, Homo sapiens
ccagaagccaaagact

SEQ ID NO: 3999237 - DNA, 16 bp, Homo sapiens
ccagaagcctctggct

SEQ ID NO: 3999238 - DNA, 19 bp, Homo sapiens
ccagaagccttggaaccag

SEQ ID NO: 3999239 - DNA, 19 bp, Homo sapiens
ccagaagtggctactgact

SEQ ID NO: 3999240 - DNA, 16 bp, Homo sapiens
ccagaatcttgacttt

SEQ ID NO: 3999241 - DNA, 21 bp, Homo sapiens
ccagaatgctgtacatctatt

SEQ ID NO: 3999242 - DNA, 12 bp, Homo sapiens
ccagaatgtaag

SEQ ID NO: 3999243 - DNA, 16 bp, Homo sapiens
ccagaatgtaagaaaa

SEQ ID NO: 3999244 - DNA, 17 bp, Homo sapiens
ccagaatgtaagaaaac

SEQ ID NO: 3999245 - DNA, 21 bp, Homo sapiens
ccagaatttaccatcatctct

SEQ ID NO: 3999246 - DNA, 15 bp, Homo sapiens
ccagacaagctgttg

SEQ ID NO: 3999247 - DNA, 17 bp, Homo sapiens
ccagacaattccattca

SEQ ID NO: 3999248 - DNA, 12 bp, Homo sapiens
ccagacacaaac

SEQ ID NO: 3999249 - DNA, 19 bp, Homo sapiens
ccagacacaggccctccct

SEQ ID NO: 3999250 - DNA, 15 bp, Homo sapiens
ccagacacccaggac

SEQ ID NO: 3999251 - DNA, 22 bp, Homo sapiens
ccagacagacatctctgcaccc

SEQ ID NO: 3999252 - DNA, 19 bp, Homo sapiens
ccagacatcatgaatttta

SEQ ID NO: 3999253 - DNA, 14 bp, Homo sapiens
ccagacatgccaca

SEQ ID NO: 3999254 - DNA, 17 bp, Homo sapiens
ccagaccccaggctgga

SEQ ID NO: 3999255 - DNA, 16 bp, Homo sapiens
ccagaccccagggcag

SEQ ID NO: 3999256 - DNA, 21 bp, Homo sapiens
ccagacccctctggccaggat

SEQ ID NO: 3999257 - DNA, 23 bp, Homo sapiens
ccagacccctctggccaggatgg

SEQ ID NO: 3999258 - DNA, 24 bp, Homo sapiens
ccagacccctctggccaggatgga

SEQ ID NO: 3999259 - DNA, 16 bp, Homo sapiens
ccagacccctggcttt

SEQ ID NO: 3999260 - DNA, 17 bp, Homo sapiens
ccagacccctggctttt

SEQ ID NO: 3999261 - DNA, 16 bp, Homo sapiens
ccagcacttgtccagc

SEQ ID NO: 3999262 - DNA, 20 bp, Homo sapiens
ccagcacttgtccagctgag

SEQ ID NO: 3999263 - DNA, 21 bp, Homo sapiens
ccagcactttgggaggccaag

SEQ ID NO: 3999264 - DNA, 18 bp, Homo sapiens
ccagcagaggcaggctgg

SEQ ID NO: 3999265 - DNA, 15 bp, Homo sapiens
ccagcagcagcccaa

SEQ ID NO: 3999266 - DNA, 13 bp, Homo sapiens
ccagcagcatggc

SEQ ID NO: 3999267 - DNA, 12 bp, Homo sapiens
ccagcagcccta

SEQ ID NO: 3999268 - DNA, 22 bp, Homo sapiens
ccagcagccctcaacaggccca

SEQ ID NO: 3999269 - DNA, 15 bp, Homo sapiens
ccagcaggtgctgac

SEQ ID NO: 3999270 - DNA, 15 bp, Homo sapiens
ccagcagtgtggaga

SEQ ID NO: 3999271 - DNA, 18 bp, Homo sapiens
ccagcagtgtggagaccc

SEQ ID NO: 3999272 - DNA, 18 bp, Homo sapiens
ccagcagtgttgctcagc

SEQ ID NO: 3999273 - DNA, 21 bp, Homo sapiens
ccagcagtgttgctcagctcc

SEQ ID NO: 3999274 - DNA, 22 bp, Homo sapiens
ccagcagtgttgctcagctcct

SEQ ID NO: 3999275 - DNA, 12 bp, Homo sapiens
ccagcatccctg

SEQ ID NO: 3999276 - DNA, 13 bp, Homo sapiens
ccagcatccctgg

SEQ ID NO: 3999277 - DNA, 16 bp, Homo sapiens
ccagcatccctggagc

SEQ ID NO: 3999278 - DNA, 19 bp, Homo sapiens
ccagcatccctggagcagg

SEQ ID NO: 3999279 - DNA, 18 bp, Homo sapiens
ccagcatctggaagatgt

SEQ ID NO: 3999280 - DNA, 18 bp, Homo sapiens
ccagccaaaccctgtctg

SEQ ID NO: 3999281 - DNA, 19 bp, Homo sapiens
ccagccaaaccctgtctga

SEQ ID NO: 3999282 - DNA, 22 bp, Homo sapiens
ccagccaacttttgcatgtttt

SEQ ID NO: 3999283 - DNA, 13 bp, Homo sapiens
ccagccaccccgg

SEQ ID NO: 3999284 - DNA, 20 bp, Homo sapiens
ccagccagaggcatctgagg

SEQ ID NO: 3999285 - DNA, 13 bp, Homo sapiens
ccagccagatcct

SEQ ID NO: 3999286 - DNA, 18 bp, Homo sapiens
ccagccagatcctcttgg

SEQ ID NO: 3999287 - DNA, 19 bp, Homo sapiens
ccagccagatcctcttggt

SEQ ID NO: 3999288 - DNA, 16 bp, Homo sapiens
ccagccaggccaacag

SEQ ID NO: 3999289 - DNA, 20 bp, Homo sapiens
ccagccaggccaacagcacc

SEQ ID NO: 3999290 - DNA, 15 bp, Homo sapiens
ccagccatgcctgag

SEQ ID NO: 3999291 - DNA, 15 bp, Homo sapiens
ccagcccaccctgct

SEQ ID NO: 3999292 - DNA, 16 bp, Homo sapiens
ccagcccaccctgctc

SEQ ID NO: 3999293 - DNA, 12 bp, Homo sapiens
ccagcccagagc

SEQ ID NO: 3999294 - DNA, 21 bp, Homo sapiens
ccagcccatccattaggccag

SEQ ID NO: 3999295 - DNA, 14 bp, Homo sapiens
ccagccccacacag

SEQ ID NO: 3999296 - DNA, 16 bp, Homo sapiens
ccagccccacacagct

SEQ ID NO: 3999297 - DNA, 13 bp, Homo sapiens
ccagccccatccc

SEQ ID NO: 3999298 - DNA, 18 bp, Homo sapiens
ccagcccccgccccagag

SEQ ID NO: 3999299 - DNA, 17 bp, Homo sapiens
ccagccccggggtgagt

SEQ ID NO: 3999300 - DNA, 20 bp, Homo sapiens
ccagccccggtggctgggca

SEQ ID NO: 3999301 - DNA, 14 bp, Homo sapiens
ccagcccctactgc

SEQ ID NO: 3999302 - DNA, 15 bp, Homo sapiens
ccagcccctactgct

SEQ ID NO: 3999303 - DNA, 16 bp, Homo sapiens
ccagcccctcccccat

SEQ ID NO: 3999304 - DNA, 17 bp, Homo sapiens
ccagccccttctcccag

SEQ ID NO: 3999305 - DNA, 14 bp, Homo sapiens
ccagcccggcctgc

SEQ ID NO: 3999306 - DNA, 15 bp, Homo sapiens
ccagcccggcctgct

SEQ ID NO: 3999307 - DNA, 20 bp, Homo sapiens
ccagcccggcctgctcccag

SEQ ID NO: 3999308 - DNA, 13 bp, Homo sapiens
ccagccctgtcct

SEQ ID NO: 3999309 - DNA, 23 bp, Homo sapiens
ccagccgccattgccaccaggag

SEQ ID NO: 3999310 - DNA, 18 bp, Homo sapiens
ccagccgccccagcccct

SEQ ID NO: 3999311 - DNA, 17 bp, Homo sapiens
ccagccgccctgggctg

SEQ ID NO: 3999312 - DNA, 21 bp, Homo sapiens
ccagccgtgatgctcaggctt

SEQ ID NO: 3999313 - DNA, 15 bp, Homo sapiens
ccagcctccctgaag

SEQ ID NO: 3999314 - DNA, 21 bp, Homo sapiens
ccagcctccctgaagcctttg

SEQ ID NO: 3999315 - DNA, 13 bp, Homo sapiens
ccagcctccctgt

SEQ ID NO: 3999316 - DNA, 15 bp, Homo sapiens
ccagcctccctgtct

SEQ ID NO: 3999317 - DNA, 22 bp, Homo sapiens
ccagcctccctgtctccagctg

SEQ ID NO: 3999318 - DNA, 11 bp, Homo sapiens
ccagcctcctc

SEQ ID NO: 3999319 - DNA, 15 bp, Homo sapiens
ccagcctcctctgga

SEQ ID NO: 3999320 - DNA, 16 bp, Homo sapiens
ccagcctcctctggac

SEQ ID NO: 3999321 - DNA, 17 bp, Homo sapiens
ccagcctcgcctgtcac

SEQ ID NO: 3999322 - DNA, 19 bp, Homo sapiens
ccagcctcgttggaagagg

SEQ ID NO: 3999323 - DNA, 22 bp, Homo sapiens
ccagcctcgttggaagaggaac

SEQ ID NO: 3999324 - DNA, 14 bp, Homo sapiens
ccagcctctttccc

SEQ ID NO: 3999325 - DNA, 19 bp, Homo sapiens
ccagcctgaacagaagctc

SEQ ID NO: 3999326 - DNA, 18 bp, Homo sapiens
ccagcctgacctgagact

SEQ ID NO: 3999327 - DNA, 13 bp, Homo sapiens
ccagcctgaggca

SEQ ID NO: 3999328 - DNA, 23 bp, Homo sapiens
ccagcctgcccaagcccaggcca

SEQ ID NO: 3999329 - DNA, 21 bp, Homo sapiens
ccagcctgctgagagccccca

SEQ ID NO: 3999330 - DNA, 15 bp, Homo sapiens
ccagcctgggagccc

SEQ ID NO: 3999331 - DNA, 16 bp, Homo sapiens
ccagcctgggagccca

SEQ ID NO: 3999332 - DNA, 17 bp, Homo sapiens
ccagcctgggagcccag

SEQ ID NO: 3999333 - DNA, 21 bp, Homo sapiens
ccagcctgggataggggcaga

SEQ ID NO: 3999334 - DNA, 13 bp, Homo sapiens
ccagcctgggggc

SEQ ID NO: 3999335 - DNA, 16 bp, Homo sapiens
ccagcctgggggccag

SEQ ID NO: 3999336 - DNA, 20 bp, Homo sapiens
ccagcctgggggccagtggg

SEQ ID NO: 3999337 - DNA, 13 bp, Homo sapiens
ccagcctgtggtt

SEQ ID NO: 3999338 - DNA, 17 bp, Homo sapiens
ccagccttgagccctgg

SEQ ID NO: 3999339 - DNA, 19 bp, Homo sapiens
ccagccttgagccctggct

SEQ ID NO: 3999340 - DNA, 20 bp, Homo sapiens
ccagccttgagccctggctg

SEQ ID NO: 3999341 - DNA, 14 bp, Homo sapiens
ccagccttggtgcc

SEQ ID NO: 3999342 - DNA, 16 bp, Homo sapiens
ccagcgcggccagcgt

SEQ ID NO: 3999343 - DNA, 14 bp, Homo sapiens
ccagcgctgagtgg

SEQ ID NO: 3999344 - DNA, 13 bp, Homo sapiens
ccagcgggcacag

SEQ ID NO: 3999345 - DNA, 15 bp, Homo sapiens
ccagcgggcagatgg

SEQ ID NO: 3999346 - DNA, 21 bp, Homo sapiens
ccagcgtcccagtctctggca

SEQ ID NO: 3999347 - DNA, 14 bp, Homo sapiens
ccagctaagaacct

SEQ ID NO: 3999348 - DNA, 17 bp, Homo sapiens
ccagctaagaacctgga

SEQ ID NO: 3999349 - DNA, 18 bp, Homo sapiens
ccagctaagaacctggaa

SEQ ID NO: 3999350 - DNA, 20 bp, Homo sapiens
ccagctaatctgtagggctg

SEQ ID NO: 3999351 - DNA, 23 bp, Homo sapiens
ccagctaatctgtagggctggac

SEQ ID NO: 3999352 - DNA, 17 bp, Homo sapiens
ccagctacttcctcctc

SEQ ID NO: 3999353 - DNA, 20 bp, Homo sapiens
ccagctacttgggaggctga

SEQ ID NO: 3999354 - DNA, 15 bp, Homo sapiens
ccagctatctgtcat

SEQ ID NO: 3999355 - DNA, 19 bp, Homo sapiens
ccagctcagaggcccagga

SEQ ID NO: 3999356 - DNA, 14 bp, Homo sapiens
ccagctccaacctg

SEQ ID NO: 3999357 - DNA, 15 bp, Homo sapiens
ccagctccaacctgc

SEQ ID NO: 3999358 - DNA, 14 bp, Homo sapiens
ccagctccccccac

SEQ ID NO: 3999359 - DNA, 19 bp, Homo sapiens
ccagctccccccacctccc

SEQ ID NO: 3999360 - DNA, 18 bp, Homo sapiens
ccagctccctagactgca

SEQ ID NO: 3999361 - DNA, 21 bp, Homo sapiens
ccagctccctagactgcatcc

SEQ ID NO: 3999362 - DNA, 14 bp, Homo sapiens
ccagctccctagga

SEQ ID NO: 3999363 - DNA, 19 bp, Homo sapiens
ccagctcttggcccctgtg

SEQ ID NO: 3999364 - DNA, 19 bp, Homo sapiens
ccaggccctcctctcccat

SEQ ID NO: 3999365 - DNA, 20 bp, Homo sapiens
ccaggccgggcttgggccct

SEQ ID NO: 3999366 - DNA, 14 bp, Homo sapiens
ccaggcctctgctg

SEQ ID NO: 3999367 - DNA, 17 bp, Homo sapiens
ccaggcctctgtgtcct

SEQ ID NO: 3999368 - DNA, 12 bp, Homo sapiens
ccaggcctggct

SEQ ID NO: 3999369 - DNA, 17 bp, Homo sapiens
ccaggcctgggtctgtg

SEQ ID NO: 3999370 - DNA, 23 bp, Homo sapiens
ccaggcgctagcacagctccctt

SEQ ID NO: 3999371 - DNA, 15 bp, Homo sapiens
ccaggctgaccacag

SEQ ID NO: 3999372 - DNA, 18 bp, Homo sapiens
ccaggctgaccacagcac

SEQ ID NO: 3999373 - DNA, 20 bp, Homo sapiens
ccaggctgaccacagcacag

SEQ ID NO: 3999374 - DNA, 23 bp, Homo sapiens
ccaggctgaccacagcacagcca

SEQ ID NO: 3999375 - DNA, 23 bp, Homo sapiens
ccaggctgagtgagccacagacc

SEQ ID NO: 3999376 - DNA, 13 bp, Homo sapiens
ccaggctgccaag

SEQ ID NO: 3999377 - DNA, 16 bp, Homo sapiens
ccaggctgcctcctgc

SEQ ID NO: 3999378 - DNA, 20 bp, Homo sapiens
ccaggctgcctcctgccctt

SEQ ID NO: 3999379 - DNA, 18 bp, Homo sapiens
ccaggctggagtgcagtg

SEQ ID NO: 3999380 - DNA, 11 bp, Homo sapiens
ccaggctggga

SEQ ID NO: 3999381 - DNA, 21 bp, Homo sapiens
ccaggctgtgggtagatgtgc

SEQ ID NO: 3999382 - DNA, 17 bp, Homo sapiens
ccaggcttcttcctaca

SEQ ID NO: 3999383 - DNA, 14 bp, Homo sapiens
ccaggcttggcctt

SEQ ID NO: 3999384 - DNA, 19 bp, Homo sapiens
ccagggaaggtggccacag

SEQ ID NO: 3999385 - DNA, 22 bp, Homo sapiens
ccagggaaggtggccacagcaa

SEQ ID NO: 3999386 - DNA, 22 bp, Homo sapiens
ccagggacagaggccccagcct

SEQ ID NO: 3999387 - DNA, 12 bp, Homo sapiens
ccagggagcctt

SEQ ID NO: 3999388 - DNA, 18 bp, Homo sapiens
ccagggagcctttggttc

SEQ ID NO: 3999389 - DNA, 17 bp, Homo sapiens
ccagggagctctgggga

SEQ ID NO: 3999390 - DNA, 23 bp, Homo sapiens
ccagggagctctggggacagctt

SEQ ID NO: 3999391 - DNA, 24 bp, Homo sapiens
ccagggagggaagtgtgagcgcct

SEQ ID NO: 3999392 - DNA, 14 bp, Homo sapiens
ccagggagtccagg

SEQ ID NO: 3999393 - DNA, 23 bp, Homo sapiens
ccagggagtccagggtttctctg

SEQ ID NO: 3999394 - DNA, 13 bp, Homo sapiens
ccagggatgctgg

SEQ ID NO: 3999395 - DNA, 14 bp, Homo sapiens
ccagggatgctggg

SEQ ID NO: 3999396 - DNA, 18 bp, Homo sapiens
ccagggatgctgggctgg

SEQ ID NO: 3999397 - DNA, 19 bp, Homo sapiens
ccagggatgctgggctggg

SEQ ID NO: 3999398 - DNA, 22 bp, Homo sapiens
ccagggcaccctgtggccctgg

SEQ ID NO: 3999399 - DNA, 23 bp, Homo sapiens
ccagggcagggtgggcagcctat

SEQ ID NO: 3999400 - DNA, 19 bp, Homo sapiens
ccagggcatcttgctggct

SEQ ID NO: 3999401 - DNA, 21 bp, Homo sapiens
ccagggcatgtgtatgtgtct

SEQ ID NO: 3999402 - DNA, 22 bp, Homo sapiens
ccagggcatgtgtatgtgtctg

SEQ ID NO: 3999403 - DNA, 23 bp, Homo sapiens
ccagggcatgtgtatgtgtctgc

SEQ ID NO: 3999404 - DNA, 19 bp, Homo sapiens
ccagggcattcgggccaca

SEQ ID NO: 3999405 - DNA, 16 bp, Homo sapiens
ccagggccacgctcca

SEQ ID NO: 3999406 - DNA, 13 bp, Homo sapiens
ccagggccagaag

SEQ ID NO: 3999407 - DNA, 15 bp, Homo sapiens
ccagggccaggggtc

SEQ ID NO: 3999408 - DNA, 15 bp, Homo sapiens
ccagggcccacccca

SEQ ID NO: 3999409 - DNA, 16 bp, Homo sapiens
ccagggcccaccccag

SEQ ID NO: 3999410 - DNA, 17 bp, Homo sapiens
ccagggcccaccccagc

SEQ ID NO: 3999411 - DNA, 20 bp, Homo sapiens
ccagggcccaccccagcctc

SEQ ID NO: 3999412 - DNA, 17 bp, Homo sapiens
ccagggcccagagccca

SEQ ID NO: 3999413 - DNA, 21 bp, Homo sapiens
ccagggcccagagcccagctc

SEQ ID NO: 3999414 - DNA, 23 bp, Homo sapiens
ccagggcccagagcccagctcca

SEQ ID NO: 3999415 - DNA, 12 bp, Homo sapiens
ccagggccctgg

SEQ ID NO: 3999416 - DNA, 13 bp, Homo sapiens
ccagggccctggc

SEQ ID NO: 3999417 - DNA, 17 bp, Homo sapiens
ccagggccctggccagc

SEQ ID NO: 3999418 - DNA, 18 bp, Homo sapiens
ccagggccctggccagcc

SEQ ID NO: 3999419 - DNA, 12 bp, Homo sapiens
ccagggcctcca

SEQ ID NO: 3999420 - DNA, 15 bp, Homo sapiens
ccagggcctccaggg

SEQ ID NO: 3999421 - DNA, 14 bp, Homo sapiens
ccagggcctgacac

SEQ ID NO: 3999422 - DNA, 15 bp, Homo sapiens
ccagggcctgacacc

SEQ ID NO: 3999423 - DNA, 16 bp, Homo sapiens
ccagggcctgacaccc

SEQ ID NO: 3999424 - DNA, 16 bp, Homo sapiens
ccagggctagtgactt

SEQ ID NO: 3999425 - DNA, 19 bp, Homo sapiens
ccagggctgccctgagaag

SEQ ID NO: 3999426 - DNA, 13 bp, Homo sapiens
ccagggctggctc

SEQ ID NO: 3999427 - DNA, 15 bp, Homo sapiens
ccaggggaacctgcc

SEQ ID NO: 3999428 - DNA, 16 bp, Homo sapiens
ccaggggaacctgcca

SEQ ID NO: 3999429 - DNA, 15 bp, Homo sapiens
ccaggggcaggactg

SEQ ID NO: 3999430 - DNA, 18 bp, Homo sapiens
ccaggggctgggctccct

SEQ ID NO: 3999431 - DNA, 18 bp, Homo sapiens
ccagggggatgccactcc

SEQ ID NO: 3999432 - DNA, 18 bp, Homo sapiens
ccaggggtcccagccacc

SEQ ID NO: 3999433 - DNA, 14 bp, Homo sapiens
ccaggggtctccct

SEQ ID NO: 3999434 - DNA, 19 bp, Homo sapiens
ccaggggtctccctggagt

SEQ ID NO: 3999435 - DNA, 17 bp, Homo sapiens
ccaggggtctccctggc

SEQ ID NO: 3999436 - DNA, 21 bp, Homo sapiens
ccaggggtctccctggctccc

SEQ ID NO: 3999437 - DNA, 19 bp, Homo sapiens
ccaggggtctgtctgcttt

SEQ ID NO: 3999438 - DNA, 19 bp, Homo sapiens
ccaggggtgatttcagaga

SEQ ID NO: 3999439 - DNA, 20 bp, Homo sapiens
ccaggggtgatttcagagag

SEQ ID NO: 3999440 - DNA, 18 bp, Homo sapiens
ccagggtacccgcctgag

SEQ ID NO: 3999441 - DNA, 16 bp, Homo sapiens
ccagggtctctccctc

SEQ ID NO: 3999442 - DNA, 14 bp, Homo sapiens
ccagggtcttccct

SEQ ID NO: 3999443 - DNA, 16 bp, Homo sapiens
ccagggtgagagctgc

SEQ ID NO: 3999444 - DNA, 17 bp, Homo sapiens
ccagggtgagagctgct

SEQ ID NO: 3999445 - DNA, 21 bp, Homo sapiens
ccagggtgggtgtccatgtgc

SEQ ID NO: 3999446 - DNA, 23 bp, Homo sapiens
ccaggtaatgagggactggaacc

SEQ ID NO: 3999447 - DNA, 16 bp, Homo sapiens
ccaggtaccacccttc

SEQ ID NO: 3999448 - DNA, 16 bp, Homo sapiens
ccaggtatctccagga

SEQ ID NO: 3999449 - DNA, 17 bp, Homo sapiens
ccaggtatctccaggat

SEQ ID NO: 3999450 - DNA, 14 bp, Homo sapiens
ccaggtcctctgat

SEQ ID NO: 3999451 - DNA, 16 bp, Homo sapiens
ccaggtctcacgggca

SEQ ID NO: 3999452 - DNA, 21 bp, Homo sapiens
ccaggtcttgactcatggcag

SEQ ID NO: 3999453 - DNA, 16 bp, Homo sapiens
ccaggtgaaggaggct

SEQ ID NO: 3999454 - DNA, 20 bp, Homo sapiens
ccaggtgaaggaggctccag

SEQ ID NO: 3999455 - DNA, 15 bp, Homo sapiens
ccaggtggaaggcag

SEQ ID NO: 3999456 - DNA, 13 bp, Homo sapiens
ccaggtgggagcg

SEQ ID NO: 3999457 - DNA, 22 bp, Homo sapiens
ccaggtggtgggcattctctct

SEQ ID NO: 3999458 - DNA, 13 bp, Homo sapiens
ccaggtgtgtgct

SEQ ID NO: 3999459 - DNA, 23 bp, Homo sapiens
ccaggtgtgtgctttaggcgtgg

SEQ ID NO: 3999460 - DNA, 21 bp, Homo sapiens
ccaggtgttactgtaattcct

SEQ ID NO: 3999461 - DNA, 15 bp, Homo sapiens
ccaggttcccccagc

SEQ ID NO: 3999462 - DNA, 17 bp, Homo sapiens
ccaggttcccccagcaa

SEQ ID NO: 3999463 - DNA, 17 bp, Homo sapiens
ccaggttcgagacccaa

SEQ ID NO: 3999464 - DNA, 17 bp, Homo sapiens
ccaggttgtcactgaga

SEQ ID NO: 3999465 - DNA, 16 bp, Homo sapiens
ccaggtttagacagta

SEQ ID NO: 3999466 - DNA, 18 bp, Homo sapiens
ccatatcaaaagacacag

SEQ ID NO: 3999467 - DNA, 18 bp, Homo sapiens
ccatatccttaccctcct

SEQ ID NO: 3999468 - DNA, 19 bp, Homo sapiens
ccatatctccatggccctg

SEQ ID NO: 3999469 - DNA, 16 bp, Homo sapiens
ccatattacctggatt

SEQ ID NO: 3999470 - DNA, 12 bp, Homo sapiens
ccatatttacat

SEQ ID NO: 3999471 - DNA, 21 bp, Homo sapiens
ccatcaactcccaacttcttc

SEQ ID NO: 3999472 - DNA, 16 bp, Homo sapiens
ccatcacaatacagat

SEQ ID NO: 3999473 - DNA, 13 bp, Homo sapiens
ccatcacagggtt

SEQ ID NO: 3999474 - DNA, 17 bp, Homo sapiens
ccatcagaacctgagct

SEQ ID NO: 3999475 - DNA, 18 bp, Homo sapiens
ccatcagaacctgagcta

SEQ ID NO: 3999476 - DNA, 12 bp, Homo sapiens
ccatcagctccc

SEQ ID NO: 3999477 - DNA, 19 bp, Homo sapiens
ccatcagggttctcttagc

SEQ ID NO: 3999478 - DNA, 21 bp, Homo sapiens
ccatcagttcccccagtacct

SEQ ID NO: 3999479 - DNA, 17 bp, Homo sapiens
ccatcatcctttgttct

SEQ ID NO: 3999480 - DNA, 13 bp, Homo sapiens
ccatcatctctga

SEQ ID NO: 3999481 - DNA, 15 bp, Homo sapiens
ccatcatctctgaag

SEQ ID NO: 3999482 - DNA, 23 bp, Homo sapiens
ccatcatgcggtgggtgctgcca

SEQ ID NO: 3999483 - DNA, 22 bp, Homo sapiens
ccatcattttccatatcctggt

SEQ ID NO: 3999484 - DNA, 15 bp, Homo sapiens
ccatccaaacactga

SEQ ID NO: 3999485 - DNA, 18 bp, Homo sapiens
ccatccaaacactgaggc

SEQ ID NO: 3999486 - DNA, 20 bp, Homo sapiens
ccatccaaataagaaaccta

SEQ ID NO: 3999487 - DNA, 17 bp, Homo sapiens
ccatccacctttcccaa

SEQ ID NO: 3999488 - DNA, 16 bp, Homo sapiens
ccatccactctaccct

SEQ ID NO: 3999489 - DNA, 16 bp, Homo sapiens
ccatccagacctggct

SEQ ID NO: 3999490 - DNA, 17 bp, Homo sapiens
ccatccatcagctccct

SEQ ID NO: 3999491 - DNA, 14 bp, Homo sapiens
ccatcccacaccct

SEQ ID NO: 3999492 - DNA, 15 bp, Homo sapiens
ccatcccctggactg

SEQ ID NO: 3999493 - DNA, 14 bp, Homo sapiens
ccatccctgatggc

SEQ ID NO: 3999494 - DNA, 13 bp, Homo sapiens
ccatccctgccac

SEQ ID NO: 3999495 - DNA, 13 bp, Homo sapiens
ccatccctgggcc

SEQ ID NO: 3999496 - DNA, 14 bp, Homo sapiens
ccatccctgggccc

SEQ ID NO: 3999497 - DNA, 16 bp, Homo sapiens
ccatccctgggcccct

SEQ ID NO: 3999498 - DNA, 19 bp, Homo sapiens
ccatccctgggcccctcca

SEQ ID NO: 3999499 - DNA, 14 bp, Homo sapiens
ccatccctgggggc

SEQ ID NO: 3999500 - DNA, 17 bp, Homo sapiens
ccatcctcatccctgac

SEQ ID NO: 3999501 - DNA, 16 bp, Homo sapiens
ccatcctcctccttcc

SEQ ID NO: 3999502 - DNA, 12 bp, Homo sapiens
ccatcctgactg

SEQ ID NO: 3999503 - DNA, 17 bp, Homo sapiens
ccatcctgccatcctca

SEQ ID NO: 3999504 - DNA, 19 bp, Homo sapiens
ccatctaatgcttgtttat

SEQ ID NO: 3999505 - DNA, 21 bp, Homo sapiens
ccatctagactagcaatctct

SEQ ID NO: 3999506 - DNA, 23 bp, Homo sapiens
ccatctagccagcccctcttccc

SEQ ID NO: 3999507 - DNA, 17 bp, Homo sapiens
ccatctagtacttgaaa

SEQ ID NO: 3999508 - DNA, 23 bp, Homo sapiens
ccatctcagcctcctgagcctgt

SEQ ID NO: 3999509 - DNA, 12 bp, Homo sapiens
ccatctcaggag

SEQ ID NO: 3999510 - DNA, 13 bp, Homo sapiens
ccatctcaggaga

SEQ ID NO: 3999511 - DNA, 17 bp, Homo sapiens
ccatctcaggagatgga

SEQ ID NO: 3999512 - DNA, 20 bp, Homo sapiens
ccatctcatgaggggagagg

SEQ ID NO: 3999513 - DNA, 20 bp, Homo sapiens
ccatctcatgcccctggctg

SEQ ID NO: 3999514 - DNA, 16 bp, Homo sapiens
ccatctcccaccctgt

SEQ ID NO: 3999515 - DNA, 13 bp, Homo sapiens
ccatctccctgcc

SEQ ID NO: 3999516 - DNA, 17 bp, Homo sapiens
ccatctccctgcctggc

SEQ ID NO: 3999517 - DNA, 18 bp, Homo sapiens
ccatctccctgcctggcc

SEQ ID NO: 3999518 - DNA, 13 bp, Homo sapiens
ccatctcctgctc

SEQ ID NO: 3999519 - DNA, 21 bp, Homo sapiens
ccatctcttctgcaagcctca

SEQ ID NO: 3999520 - DNA, 21 bp, Homo sapiens
ccatctgcacacacctccgag

SEQ ID NO: 3999521 - DNA, 23 bp, Homo sapiens
ccatctgcacacacctccgagac

SEQ ID NO: 3999522 - DNA, 14 bp, Homo sapiens
ccatctgcacccct

SEQ ID NO: 3999523 - DNA, 20 bp, Homo sapiens
ccatctgcctgttctgagga

SEQ ID NO: 3999524 - DNA, 22 bp, Homo sapiens
ccatctgcgtgacaataaaaca

SEQ ID NO: 3999525 - DNA, 12 bp, Homo sapiens
ccatctgggctc

SEQ ID NO: 3999526 - DNA, 18 bp, Homo sapiens
ccatctgggtccttgcac

SEQ ID NO: 3999527 - DNA, 22 bp, Homo sapiens
ccatctgggtccttgcacccct

SEQ ID NO: 3999528 - DNA, 15 bp, Homo sapiens
ccatctgtccagctg

SEQ ID NO: 3999529 - DNA, 20 bp, Homo sapiens
ccatctttttaacctctgtt

SEQ ID NO: 3999530 - DNA, 23 bp, Homo sapiens
ccatgaaaacgttttattgtgtt

SEQ ID NO: 3999531 - DNA, 12 bp, Homo sapiens
ccatgaagacag

SEQ ID NO: 3999532 - DNA, 18 bp, Homo sapiens
ccatgaatgtatcaggaa

SEQ ID NO: 3999533 - DNA, 14 bp, Homo sapiens
ccatgacagaggct

SEQ ID NO: 3999534 - DNA, 15 bp, Homo sapiens
ccatgacagaggctg

SEQ ID NO: 3999535 - DNA, 17 bp, Homo sapiens
ccatgacagaggctgca

SEQ ID NO: 3999536 - DNA, 14 bp, Homo sapiens
ccatgaccatactg

SEQ ID NO: 3999537 - DNA, 13 bp, Homo sapiens
ccatgactgcacc

SEQ ID NO: 3999538 - DNA, 23 bp, Homo sapiens
ccatgagcctgcccgctgcaatg

SEQ ID NO: 3999539 - DNA, 20 bp, Homo sapiens
ccatgagggacagggtcttt

SEQ ID NO: 3999540 - DNA, 21 bp, Homo sapiens
ccatgagttggggtctggcag

SEQ ID NO: 3999541 - DNA, 23 bp, Homo sapiens
ccatgagttggggtctggcagcc

SEQ ID NO: 3999542 - DNA, 16 bp, Homo sapiens
ccatgatccctgtgtt

SEQ ID NO: 3999543 - DNA, 12 bp, Homo sapiens
ccatgatctgta

SEQ ID NO: 3999544 - DNA, 15 bp, Homo sapiens
ccatgatctgtattt

SEQ ID NO: 3999545 - DNA, 15 bp, Homo sapiens
ccatgatggcaacag

SEQ ID NO: 3999546 - DNA, 12 bp, Homo sapiens
ccatgcaactgg

SEQ ID NO: 3999547 - DNA, 15 bp, Homo sapiens
ccatgcactgtgaag

SEQ ID NO: 3999548 - DNA, 13 bp, Homo sapiens
ccatgcaggccct

SEQ ID NO: 3999549 - DNA, 14 bp, Homo sapiens
ccatgcaggccctt

SEQ ID NO: 3999550 - DNA, 18 bp, Homo sapiens
ccatgccacgttccacag

SEQ ID NO: 3999551 - DNA, 23 bp, Homo sapiens
ccatgccagattctgcctctctg

SEQ ID NO: 3999552 - DNA, 14 bp, Homo sapiens
ccatgccaggaacc

SEQ ID NO: 3999553 - DNA, 17 bp, Homo sapiens
ccatgcccacctgccca

SEQ ID NO: 3999554 - DNA, 15 bp, Homo sapiens
ccatgcccactgctg

SEQ ID NO: 3999555 - DNA, 17 bp, Homo sapiens
ccatgcccactgctggt

SEQ ID NO: 3999556 - DNA, 20 bp, Homo sapiens
ccatgcccactgctggtgcc

SEQ ID NO: 3999557 - DNA, 12 bp, Homo sapiens
ccatgcctgagg

SEQ ID NO: 3999558 - DNA, 15 bp, Homo sapiens
ccatgcctgagggtg

SEQ ID NO: 3999559 - DNA, 14 bp, Homo sapiens
ccatgcctgtccag

SEQ ID NO: 3999560 - DNA, 16 bp, Homo sapiens
ccatgctcaaccactg

SEQ ID NO: 3999561 - DNA, 19 bp, Homo sapiens
ccatgctcaaccactgtgg

SEQ ID NO: 3999562 - DNA, 15 bp, Homo sapiens
ccatgctcctcacct

SEQ ID NO: 3999563 - DNA, 16 bp, Homo sapiens
ccatgctgaagggacc

SEQ ID NO: 3999564 - DNA, 19 bp, Homo sapiens
ccatggacaggctggctcc

SEQ ID NO: 3999565 - DNA, 14 bp, Homo sapiens
ccatggagccagct

SEQ ID NO: 3999566 - DNA, 20 bp, Homo sapiens
ccatggatttttacaagatc

SEQ ID NO: 3999567 - DNA, 23 bp, Homo sapiens
ccatggatttttacaagatccat

SEQ ID NO: 3999568 - DNA, 11 bp, Homo sapiens
ccatggccctg

SEQ ID NO: 3999569 - DNA, 17 bp, Homo sapiens
cccaaagctttcctgcc

SEQ ID NO: 3999570 - DNA, 20 bp, Homo sapiens
cccaaaggacgcctgcagga

SEQ ID NO: 3999571 - DNA, 16 bp, Homo sapiens
cccaaaggcatcccag

SEQ ID NO: 3999572 - DNA, 19 bp, Homo sapiens
cccaaaggcatcccagcct

SEQ ID NO: 3999573 - DNA, 22 bp, Homo sapiens
cccaaaggcatcccagcctggg

SEQ ID NO: 3999574 - DNA, 19 bp, Homo sapiens
cccaaatatgtattttcct

SEQ ID NO: 3999575 - DNA, 16 bp, Homo sapiens
cccaaatcaatacact

SEQ ID NO: 3999576 - DNA, 21 bp, Homo sapiens
cccaaattgtcacctgcttct

SEQ ID NO: 3999577 - DNA, 17 bp, Homo sapiens
cccaacaaaccatccag

SEQ ID NO: 3999578 - DNA, 23 bp, Homo sapiens
cccaacagccttagctgccagtg

SEQ ID NO: 3999579 - DNA, 20 bp, Homo sapiens
cccaaccaggcacctcttcc

SEQ ID NO: 3999580 - DNA, 14 bp, Homo sapiens
cccaacccccaccc

SEQ ID NO: 3999581 - DNA, 20 bp, Homo sapiens
cccaacctcagggctcccag

SEQ ID NO: 3999582 - DNA, 14 bp, Homo sapiens
cccaacctgctgaa

SEQ ID NO: 3999583 - DNA, 16 bp, Homo sapiens
cccaacggccctgcag

SEQ ID NO: 3999584 - DNA, 20 bp, Homo sapiens
cccaacggccctgcagccag

SEQ ID NO: 3999585 - DNA, 22 bp, Homo sapiens
cccaacggccctgcagccagct

SEQ ID NO: 3999586 - DNA, 14 bp, Homo sapiens
cccaactctttatc

SEQ ID NO: 3999587 - DNA, 13 bp, Homo sapiens
cccaactgtcttt

SEQ ID NO: 3999588 - DNA, 19 bp, Homo sapiens
cccaacttcatactggcag

SEQ ID NO: 3999589 - DNA, 13 bp, Homo sapiens
cccaacttcttcc

SEQ ID NO: 3999590 - DNA, 16 bp, Homo sapiens
cccaagaaacctgact

SEQ ID NO: 3999591 - DNA, 20 bp, Homo sapiens
cccaagaatagatgctgact

SEQ ID NO: 3999592 - DNA, 19 bp, Homo sapiens
cccaagacagatgccccag

SEQ ID NO: 3999593 - DNA, 17 bp, Homo sapiens
cccaagagcagagtctg

SEQ ID NO: 3999594 - DNA, 14 bp, Homo sapiens
cccaagcaggaggc

SEQ ID NO: 3999595 - DNA, 14 bp, Homo sapiens
cccaagcccaccag

SEQ ID NO: 3999596 - DNA, 16 bp, Homo sapiens
cccaagctgcctctgg

SEQ ID NO: 3999597 - DNA, 22 bp, Homo sapiens
cccaaggaaagccccagcacta

SEQ ID NO: 3999598 - DNA, 16 bp, Homo sapiens
cccaaggacaaggggc

SEQ ID NO: 3999599 - DNA, 21 bp, Homo sapiens
cccaaggactgagggactctg

SEQ ID NO: 3999600 - DNA, 19 bp, Homo sapiens
cccaaggccccctgcctgc

SEQ ID NO: 3999601 - DNA, 15 bp, Homo sapiens
cccaaggcggcccct

SEQ ID NO: 3999602 - DNA, 15 bp, Homo sapiens
cccaaggtcccctcc

SEQ ID NO: 3999603 - DNA, 21 bp, Homo sapiens
cccaagtcaaagatgccccat

SEQ ID NO: 3999604 - DNA, 12 bp, Homo sapiens
cccaagtcacac

SEQ ID NO: 3999605 - DNA, 14 bp, Homo sapiens
cccaagtcacacag

SEQ ID NO: 3999606 - DNA, 15 bp, Homo sapiens
cccaagtcacaccca

SEQ ID NO: 3999607 - DNA, 20 bp, Homo sapiens
cccaagtcacacccactccc

SEQ ID NO: 3999608 - DNA, 11 bp, Homo sapiens
cccaatattat

SEQ ID NO: 3999609 - DNA, 12 bp, Homo sapiens
cccaatattata

SEQ ID NO: 3999610 - DNA, 17 bp, Homo sapiens
cccaatattataatttt

SEQ ID NO: 3999611 - DNA, 12 bp, Homo sapiens
cccaatccctga

SEQ ID NO: 3999612 - DNA, 17 bp, Homo sapiens
cccaatccctttattac

SEQ ID NO: 3999613 - DNA, 21 bp, Homo sapiens
cccaatccctttattaccccc

SEQ ID NO: 3999614 - DNA, 21 bp, Homo sapiens
cccaatctgcacactccaggc

SEQ ID NO: 3999615 - DNA, 22 bp, Homo sapiens
cccaatgagactctagggtcca

SEQ ID NO: 3999616 - DNA, 22 bp, Homo sapiens
cccaattactattccctttgac

SEQ ID NO: 3999617 - DNA, 14 bp, Homo sapiens
cccaattaggaagt

SEQ ID NO: 3999618 - DNA, 16 bp, Homo sapiens
cccaattctgcccgct

SEQ ID NO: 3999619 - DNA, 15 bp, Homo sapiens
cccaattgagaaaaa

SEQ ID NO: 3999620 - DNA, 15 bp, Homo sapiens
cccaatttcagactc

SEQ ID NO: 3999621 - DNA, 14 bp, Homo sapiens
cccacaatgatgat

SEQ ID NO: 3999622 - DNA, 15 bp, Homo sapiens
cccacacagctgccc

SEQ ID NO: 3999623 - DNA, 14 bp, Homo sapiens
cccacaccagcctt

SEQ ID NO: 3999624 - DNA, 14 bp, Homo sapiens
cccacaccccagcc

SEQ ID NO: 3999625 - DNA, 17 bp, Homo sapiens
cccacaccttccagggc

SEQ ID NO: 3999626 - DNA, 19 bp, Homo sapiens
cccacaccttccagggccc

SEQ ID NO: 3999627 - DNA, 22 bp, Homo sapiens
cccacaccttccagggccctag

SEQ ID NO: 3999628 - DNA, 18 bp, Homo sapiens
cccacacggactcccggg

SEQ ID NO: 3999629 - DNA, 21 bp, Homo sapiens
cccacacggactcccgggcca

SEQ ID NO: 3999630 - DNA, 14 bp, Homo sapiens
cccacactaacctg

SEQ ID NO: 3999631 - DNA, 23 bp, Homo sapiens
cccacactcccaaggttggagcc

SEQ ID NO: 3999632 - DNA, 14 bp, Homo sapiens
cccacactccccgc

SEQ ID NO: 3999633 - DNA, 17 bp, Homo sapiens
cccacactccccgcctt

SEQ ID NO: 3999634 - DNA, 17 bp, Homo sapiens
cccacacttgttccagc

SEQ ID NO: 3999635 - DNA, 20 bp, Homo sapiens
cccacagatgtctctggggc

SEQ ID NO: 3999636 - DNA, 18 bp, Homo sapiens
cccacagcgtccctggcg

SEQ ID NO: 3999637 - DNA, 14 bp, Homo sapiens
cccacagctacctg

SEQ ID NO: 3999638 - DNA, 18 bp, Homo sapiens
cccacagctacctgagac

SEQ ID NO: 3999639 - DNA, 16 bp, Homo sapiens
cccacaggcccttcct

SEQ ID NO: 3999640 - DNA, 14 bp, Homo sapiens
cccacatcccaggc

SEQ ID NO: 3999641 - DNA, 11 bp, Homo sapiens
cccacatcttt

SEQ ID NO: 3999642 - DNA, 22 bp, Homo sapiens
cccacatgaggccatctcagga

SEQ ID NO: 3999643 - DNA, 18 bp, Homo sapiens
cccacatgcctgcgcctg

SEQ ID NO: 3999644 - DNA, 18 bp, Homo sapiens
cccaccaccccctcaagc

SEQ ID NO: 3999645 - DNA, 16 bp, Homo sapiens
cccaccagacatcacc

SEQ ID NO: 3999646 - DNA, 17 bp, Homo sapiens
cccaccagacatcaccc

SEQ ID NO: 3999647 - DNA, 12 bp, Homo sapiens
cccaccagctcg

SEQ ID NO: 3999648 - DNA, 13 bp, Homo sapiens
cccaccagctcgt

SEQ ID NO: 3999649 - DNA, 16 bp, Homo sapiens
cccaccagctgcagcc

SEQ ID NO: 3999650 - DNA, 19 bp, Homo sapiens
cccaccagctgcagcccct

SEQ ID NO: 3999651 - DNA, 14 bp, Homo sapiens
cccaccagcttcac

SEQ ID NO: 3999652 - DNA, 13 bp, Homo sapiens
cccaccaggtgtc

SEQ ID NO: 3999653 - DNA, 17 bp, Homo sapiens
cccaccattcccggccg

SEQ ID NO: 3999654 - DNA, 17 bp, Homo sapiens
cccaccattctacctga

SEQ ID NO: 3999655 - DNA, 17 bp, Homo sapiens
cccacccaagcccaaac

SEQ ID NO: 3999656 - DNA, 14 bp, Homo sapiens
cccacccacacagc

SEQ ID NO: 3999657 - DNA, 13 bp, Homo sapiens
cccacccagcctg

SEQ ID NO: 3999658 - DNA, 13 bp, Homo sapiens
cccacccaggagg

SEQ ID NO: 3999659 - DNA, 12 bp, Homo sapiens
cccaccccacac

SEQ ID NO: 3999660 - DNA, 13 bp, Homo sapiens
cccaccccacact

SEQ ID NO: 3999661 - DNA, 13 bp, Homo sapiens
cccaccccacctc

SEQ ID NO: 3999662 - DNA, 15 bp, Homo sapiens
cccaccccagcctcg

SEQ ID NO: 3999663 - DNA, 20 bp, Homo sapiens
cccaccccagcctcgcctgt

SEQ ID NO: 3999664 - DNA, 13 bp, Homo sapiens
cccaccccatcct

SEQ ID NO: 3999665 - DNA, 13 bp, Homo sapiens
cccacccccagct

SEQ ID NO: 3999666 - DNA, 15 bp, Homo sapiens
cccaccccctgccct

SEQ ID NO: 3999667 - DNA, 18 bp, Homo sapiens
cccaccccctgccctgca

SEQ ID NO: 3999668 - DNA, 19 bp, Homo sapiens
cccacccccttctctgctc

SEQ ID NO: 3999669 - DNA, 14 bp, Homo sapiens
cccaccccggggac

SEQ ID NO: 3999670 - DNA, 17 bp, Homo sapiens
cccaccccggggaccct

SEQ ID NO: 3999671 - DNA, 18 bp, Homo sapiens
cccacccctacacacaca

SEQ ID NO: 3999672 - DNA, 13 bp, Homo sapiens
cccacccctagcc

SEQ ID NO: 3999673 - DNA, 21 bp, Homo sapiens
cccagccccatccctgtcctc

SEQ ID NO: 3999674 - DNA, 18 bp, Homo sapiens
cccagcccctactgctgt

SEQ ID NO: 3999675 - DNA, 18 bp, Homo sapiens
cccagcccctcccccatc

SEQ ID NO: 3999676 - DNA, 15 bp, Homo sapiens
cccagccccttctcc

SEQ ID NO: 3999677 - DNA, 20 bp, Homo sapiens
cccagccccttctcccagca

SEQ ID NO: 3999678 - DNA, 15 bp, Homo sapiens
cccagccctggctct

SEQ ID NO: 3999679 - DNA, 18 bp, Homo sapiens
cccagccctggctctgca

SEQ ID NO: 3999680 - DNA, 16 bp, Homo sapiens
cccagccctgtcctgg

SEQ ID NO: 3999681 - DNA, 17 bp, Homo sapiens
cccagcctccctgaagc

SEQ ID NO: 3999682 - DNA, 14 bp, Homo sapiens
cccagcctcgcctg

SEQ ID NO: 3999683 - DNA, 15 bp, Homo sapiens
cccagcctctggcat

SEQ ID NO: 3999684 - DNA, 13 bp, Homo sapiens
cccagcctctttc

SEQ ID NO: 3999685 - DNA, 16 bp, Homo sapiens
cccagcctctttccct

SEQ ID NO: 3999686 - DNA, 19 bp, Homo sapiens
cccagcctgctgagagccc

SEQ ID NO: 3999687 - DNA, 19 bp, Homo sapiens
cccagcctgggggccagtg

SEQ ID NO: 3999688 - DNA, 21 bp, Homo sapiens
cccagcctgggggccagtggg

SEQ ID NO: 3999689 - DNA, 19 bp, Homo sapiens
cccagcctgtggttacagt

SEQ ID NO: 3999690 - DNA, 16 bp, Homo sapiens
cccagcgcggccagcg

SEQ ID NO: 3999691 - DNA, 18 bp, Homo sapiens
cccagcgcggccagcgtc

SEQ ID NO: 3999692 - DNA, 21 bp, Homo sapiens
cccagcgctgacgtgtcagga

SEQ ID NO: 3999693 - DNA, 19 bp, Homo sapiens
cccagctaatctgtagggc

SEQ ID NO: 3999694 - DNA, 23 bp, Homo sapiens
cccagctaatctgtagggctgga

SEQ ID NO: 3999695 - DNA, 17 bp, Homo sapiens
cccagctacttgggagg

SEQ ID NO: 3999696 - DNA, 11 bp, Homo sapiens
cccagctcaat

SEQ ID NO: 3999697 - DNA, 18 bp, Homo sapiens
cccagctccaggggccct

SEQ ID NO: 3999698 - DNA, 19 bp, Homo sapiens
cccagctgcctggagaggg

SEQ ID NO: 3999699 - DNA, 20 bp, Homo sapiens
cccagctgcctggagagggt

SEQ ID NO: 3999700 - DNA, 19 bp, Homo sapiens
cccagctgggtcaggcagg

SEQ ID NO: 3999701 - DNA, 21 bp, Homo sapiens
cccagcttaaatcctagcagg

SEQ ID NO: 3999702 - DNA, 17 bp, Homo sapiens
cccagcttcacttctga

SEQ ID NO: 3999703 - DNA, 22 bp, Homo sapiens
cccagcttcacttctgactctt

SEQ ID NO: 3999704 - DNA, 12 bp, Homo sapiens
cccaggaccagc

SEQ ID NO: 3999705 - DNA, 15 bp, Homo sapiens
cccaggaccagctca

SEQ ID NO: 3999706 - DNA, 17 bp, Homo sapiens
cccaggaccagctcagg

SEQ ID NO: 3999707 - DNA, 12 bp, Homo sapiens
cccaggaccctg

SEQ ID NO: 3999708 - DNA, 16 bp, Homo sapiens
cccaggacctggctgc

SEQ ID NO: 3999709 - DNA, 16 bp, Homo sapiens
cccaggacgcttctga

SEQ ID NO: 3999710 - DNA, 20 bp, Homo sapiens
cccaggacgcttctgaatgc

SEQ ID NO: 3999711 - DNA, 14 bp, Homo sapiens
cccaggagggaggg

SEQ ID NO: 3999712 - DNA, 18 bp, Homo sapiens
cccaggagggcatccata

SEQ ID NO: 3999713 - DNA, 24 bp, Homo sapiens
cccaggagttcgaggctgcagtca

SEQ ID NO: 3999714 - DNA, 18 bp, Homo sapiens
cccaggatatttctgaga

SEQ ID NO: 3999715 - DNA, 19 bp, Homo sapiens
cccaggatggactcttctc

SEQ ID NO: 3999716 - DNA, 16 bp, Homo sapiens
cccaggccccctgcat

SEQ ID NO: 3999717 - DNA, 13 bp, Homo sapiens
cccaggccctccc

SEQ ID NO: 3999718 - DNA, 15 bp, Homo sapiens
cccaggccctccctg

SEQ ID NO: 3999719 - DNA, 14 bp, Homo sapiens
cccaggcccttcag

SEQ ID NO: 3999720 - DNA, 19 bp, Homo sapiens
cccaggcccttcaggaact

SEQ ID NO: 3999721 - DNA, 17 bp, Homo sapiens
cccaggccggcccagat

SEQ ID NO: 3999722 - DNA, 20 bp, Homo sapiens
cccaggccggcccagatgtg

SEQ ID NO: 3999723 - DNA, 16 bp, Homo sapiens
cccaggcctcaccacc

SEQ ID NO: 3999724 - DNA, 14 bp, Homo sapiens
cccaggcctgggtt

SEQ ID NO: 3999725 - DNA, 13 bp, Homo sapiens
cccaggcctgtgg

SEQ ID NO: 3999726 - DNA, 14 bp, Homo sapiens
cccaggcctgtggc

SEQ ID NO: 3999727 - DNA, 18 bp, Homo sapiens
cccaggcgccccttcccc

SEQ ID NO: 3999728 - DNA, 19 bp, Homo sapiens
cccaggctggacatgctga

SEQ ID NO: 3999729 - DNA, 14 bp, Homo sapiens
cccaggctggagac

SEQ ID NO: 3999730 - DNA, 13 bp, Homo sapiens
cccaggctgggaa

SEQ ID NO: 3999731 - DNA, 21 bp, Homo sapiens
cccaggctgggaactcatctg

SEQ ID NO: 3999732 - DNA, 23 bp, Homo sapiens
cccaggctgtgcagcgcagctgg

SEQ ID NO: 3999733 - DNA, 19 bp, Homo sapiens
cccaggctgttctccaggc

SEQ ID NO: 3999734 - DNA, 14 bp, Homo sapiens
cccagggagctctg

SEQ ID NO: 3999735 - DNA, 19 bp, Homo sapiens
cccagggagctctggggac

SEQ ID NO: 3999736 - DNA, 22 bp, Homo sapiens
cccagggagggaagtgtgagcg

SEQ ID NO: 3999737 - DNA, 23 bp, Homo sapiens
cccagggcaagggttaaggcctg

SEQ ID NO: 3999738 - DNA, 13 bp, Homo sapiens
cccagggcaccct

SEQ ID NO: 3999739 - DNA, 19 bp, Homo sapiens
cccagggcatcttgctggc

SEQ ID NO: 3999740 - DNA, 15 bp, Homo sapiens
cccagggcccagagc

SEQ ID NO: 3999741 - DNA, 16 bp, Homo sapiens
cccagggcccagagcc

SEQ ID NO: 3999742 - DNA, 13 bp, Homo sapiens
cccagggccctgg

SEQ ID NO: 3999743 - DNA, 16 bp, Homo sapiens
cccagggccctggcca

SEQ ID NO: 3999744 - DNA, 17 bp, Homo sapiens
cccagggccctggccag

SEQ ID NO: 3999745 - DNA, 19 bp, Homo sapiens
cccagggcctccagggccc

SEQ ID NO: 3999746 - DNA, 16 bp, Homo sapiens
cccagggctggctctg

SEQ ID NO: 3999747 - DNA, 18 bp, Homo sapiens
cccagggctggctctgca

SEQ ID NO: 3999748 - DNA, 21 bp, Homo sapiens
cccagggctggctctgcacta

SEQ ID NO: 3999749 - DNA, 17 bp, Homo sapiens
cccaggggaaggccctg

SEQ ID NO: 3999750 - DNA, 18 bp, Homo sapiens
cccaggggacaagggatt

SEQ ID NO: 3999751 - DNA, 14 bp, Homo sapiens
cccaggggtctccc

SEQ ID NO: 3999752 - DNA, 20 bp, Homo sapiens
cccaggggtctccctggctc

SEQ ID NO: 3999753 - DNA, 21 bp, Homo sapiens
cccaggggtctccctggctcc

SEQ ID NO: 3999754 - DNA, 20 bp, Homo sapiens
cccagggtacccgcctgagc

SEQ ID NO: 3999755 - DNA, 19 bp, Homo sapiens
cccaggtaccagctgcgct

SEQ ID NO: 3999756 - DNA, 23 bp, Homo sapiens
cccaggtggaaggcagacagcag

SEQ ID NO: 3999757 - DNA, 16 bp, Homo sapiens
cccaggtggagggcac

SEQ ID NO: 3999758 - DNA, 22 bp, Homo sapiens
cccaggtggagggcacagccct

SEQ ID NO: 3999759 - DNA, 19 bp, Homo sapiens
cccaggttcccccagcaag

SEQ ID NO: 3999760 - DNA, 20 bp, Homo sapiens
cccagtcacctccccacatc

SEQ ID NO: 3999761 - DNA, 23 bp, Homo sapiens
cccagtccaaatgtcctccagaa

SEQ ID NO: 3999762 - DNA, 14 bp, Homo sapiens
cccagtccccaccc

SEQ ID NO: 3999763 - DNA, 15 bp, Homo sapiens
cccagtccccacccc

SEQ ID NO: 3999764 - DNA, 17 bp, Homo sapiens
cccagtctgttccccat

SEQ ID NO: 3999765 - DNA, 18 bp, Homo sapiens
cccagtgaactcctgcca

SEQ ID NO: 3999766 - DNA, 23 bp, Homo sapiens
cccagtgaactcctgccaggcac

SEQ ID NO: 3999767 - DNA, 14 bp, Homo sapiens
cccagtgaagcctc

SEQ ID NO: 3999768 - DNA, 13 bp, Homo sapiens
cccagtgagactg

SEQ ID NO: 3999769 - DNA, 17 bp, Homo sapiens
cccagtgagactgcccc

SEQ ID NO: 3999770 - DNA, 22 bp, Homo sapiens
cccagtgcccccactgaccaga

SEQ ID NO: 3999771 - DNA, 18 bp, Homo sapiens
cccagtgctcaccagccc

SEQ ID NO: 3999772 - DNA, 22 bp, Homo sapiens
cccagtggccactcagcttcct

SEQ ID NO: 3999773 - DNA, 21 bp, Homo sapiens
cccagtgggaagagtgtgggg

SEQ ID NO: 3999774 - DNA, 14 bp, Homo sapiens
cccagtgggacaga

SEQ ID NO: 3999775 - DNA, 14 bp, Homo sapiens
cccccagtgggacc

SEQ ID NO: 3999776 - DNA, 17 bp, Homo sapiens
cccccagtgggaccaca

SEQ ID NO: 3999777 - DNA, 11 bp, Homo sapiens
cccccagtgtg

SEQ ID NO: 3999778 - DNA, 14 bp, Homo sapiens
cccccatgcactgt

SEQ ID NO: 3999779 - DNA, 18 bp, Homo sapiens
cccccatgcactgtgaag

SEQ ID NO: 3999780 - DNA, 21 bp, Homo sapiens
cccccatgggctcctgcccct

SEQ ID NO: 3999781 - DNA, 12 bp, Homo sapiens
ccccccactctc

SEQ ID NO: 3999782 - DNA, 13 bp, Homo sapiens
ccccccagcacta

SEQ ID NO: 3999783 - DNA, 13 bp, Homo sapiens
ccccccagcctct

SEQ ID NO: 3999784 - DNA, 12 bp, Homo sapiens
cccccctctgtc

SEQ ID NO: 3999785 - DNA, 19 bp, Homo sapiens
cccccgagctcttggcctt

SEQ ID NO: 3999786 - DNA, 14 bp, Homo sapiens
cccccgccacctca

SEQ ID NO: 3999787 - DNA, 12 bp, Homo sapiens
cccccgccactc

SEQ ID NO: 3999788 - DNA, 17 bp, Homo sapiens
cccccgccatccttcac

SEQ ID NO: 3999789 - DNA, 13 bp, Homo sapiens
cccccgccccaga

SEQ ID NO: 3999790 - DNA, 14 bp, Homo sapiens
cccccgccctcatg

SEQ ID NO: 3999791 - DNA, 20 bp, Homo sapiens
cccccgcgctcgcccagcag

SEQ ID NO: 3999792 - DNA, 21 bp, Homo sapiens
cccccgcgctcgcccagcagg

SEQ ID NO: 3999793 - DNA, 13 bp, Homo sapiens
cccccggccccct

SEQ ID NO: 3999794 - DNA, 22 bp, Homo sapiens
cccccgtctaaccacagctcct

SEQ ID NO: 3999795 - DNA, 19 bp, Homo sapiens
cccccgtttctccttttcc

SEQ ID NO: 3999796 - DNA, 15 bp, Homo sapiens
ccccctacccaccga

SEQ ID NO: 3999797 - DNA, 17 bp, Homo sapiens
ccccctcaagccccagc

SEQ ID NO: 3999798 - DNA, 12 bp, Homo sapiens
ccccctcacctc

SEQ ID NO: 3999799 - DNA, 12 bp, Homo sapiens
ccccctccacac

SEQ ID NO: 3999800 - DNA, 16 bp, Homo sapiens
ccccctgccccccagc

SEQ ID NO: 3999801 - DNA, 21 bp, Homo sapiens
ccccctgccccccagcctctg

SEQ ID NO: 3999802 - DNA, 12 bp, Homo sapiens
ccccctggagag

SEQ ID NO: 3999803 - DNA, 15 bp, Homo sapiens
ccccctggcctctgt

SEQ ID NO: 3999804 - DNA, 22 bp, Homo sapiens
ccccctggcctctgtgccttct

SEQ ID NO: 3999805 - DNA, 15 bp, Homo sapiens
ccccctggtctctgg

SEQ ID NO: 3999806 - DNA, 15 bp, Homo sapiens
cccccttctctgctc

SEQ ID NO: 3999807 - DNA, 15 bp, Homo sapiens
ccccctttgctgtga

SEQ ID NO: 3999808 - DNA, 23 bp, Homo sapiens
ccccgagctggggggttggcagc

SEQ ID NO: 3999809 - DNA, 18 bp, Homo sapiens
ccccgcagtgtttgtgtg

SEQ ID NO: 3999810 - DNA, 13 bp, Homo sapiens
ccccgccagggct

SEQ ID NO: 3999811 - DNA, 16 bp, Homo sapiens
ccccgcccccagtccc

SEQ ID NO: 3999812 - DNA, 15 bp, Homo sapiens
ccccgcccctgtggc

SEQ ID NO: 3999813 - DNA, 18 bp, Homo sapiens
ccccgcgctcgcccagca

SEQ ID NO: 3999814 - DNA, 21 bp, Homo sapiens
ccccgcgctcgcccagcagga

SEQ ID NO: 3999815 - DNA, 17 bp, Homo sapiens
ccccgctcccgctccca

SEQ ID NO: 3999816 - DNA, 14 bp, Homo sapiens
ccccggaggaagct

SEQ ID NO: 3999817 - DNA, 16 bp, Homo sapiens
ccccggaggaagcttg

SEQ ID NO: 3999818 - DNA, 19 bp, Homo sapiens
ccccggaggaagcttgggg

SEQ ID NO: 3999819 - DNA, 12 bp, Homo sapiens
ccccggccccct

SEQ ID NO: 3999820 - DNA, 12 bp, Homo sapiens
ccccggccctgg

SEQ ID NO: 3999821 - DNA, 21 bp, Homo sapiens
ccccggcctcagggcgctcag

SEQ ID NO: 3999822 - DNA, 15 bp, Homo sapiens
ccccgggctctctgc

SEQ ID NO: 3999823 - DNA, 17 bp, Homo sapiens
ccccggggaccctgtga

SEQ ID NO: 3999824 - DNA, 22 bp, Homo sapiens
ccccggggtgagtccattctcc

SEQ ID NO: 3999825 - DNA, 19 bp, Homo sapiens
ccccgggttcagcctggcc

SEQ ID NO: 3999826 - DNA, 20 bp, Homo sapiens
ccccgggttcagcctggcct

SEQ ID NO: 3999827 - DNA, 18 bp, Homo sapiens
ccccgtctgcccaccatt

SEQ ID NO: 3999828 - DNA, 16 bp, Homo sapiens
cccctacccaccgatg

SEQ ID NO: 3999829 - DNA, 18 bp, Homo sapiens
cccctacgcgccttgtct

SEQ ID NO: 3999830 - DNA, 13 bp, Homo sapiens
cccctactgctgt

SEQ ID NO: 3999831 - DNA, 16 bp, Homo sapiens
cccctagccaccagtg

SEQ ID NO: 3999832 - DNA, 13 bp, Homo sapiens
cccctagttccct

SEQ ID NO: 3999833 - DNA, 15 bp, Homo sapiens
cccctatcctctgag

SEQ ID NO: 3999834 - DNA, 12 bp, Homo sapiens
cccctcaacctc

SEQ ID NO: 3999835 - DNA, 14 bp, Homo sapiens
cccctcacctcctc

SEQ ID NO: 3999836 - DNA, 21 bp, Homo sapiens
cccctcacctctccaggtgct

SEQ ID NO: 3999837 - DNA, 12 bp, Homo sapiens
cccctcaccttg

SEQ ID NO: 3999838 - DNA, 20 bp, Homo sapiens
cccctcagagccctgccctg

SEQ ID NO: 3999839 - DNA, 19 bp, Homo sapiens
cccctccaaacctccagcc

SEQ ID NO: 3999840 - DNA, 14 bp, Homo sapiens
cccctccacatccc

SEQ ID NO: 3999841 - DNA, 13 bp, Homo sapiens
cccctccagcctt

SEQ ID NO: 3999842 - DNA, 15 bp, Homo sapiens
cccctccatccaccc

SEQ ID NO: 3999843 - DNA, 16 bp, Homo sapiens
cccctcccccaacccc

SEQ ID NO: 3999844 - DNA, 13 bp, Homo sapiens
cccctccctggct

SEQ ID NO: 3999845 - DNA, 15 bp, Homo sapiens
cccctccctggctcc

SEQ ID NO: 3999846 - DNA, 18 bp, Homo sapiens
cccctccggactggtgcc

SEQ ID NO: 3999847 - DNA, 13 bp, Homo sapiens
cccctcctccagc

SEQ ID NO: 3999848 - DNA, 22 bp, Homo sapiens
cccctcctccagcccctgtccc

SEQ ID NO: 3999849 - DNA, 19 bp, Homo sapiens
cccctcctctagctgtggg

SEQ ID NO: 3999850 - DNA, 12 bp, Homo sapiens
cccctccttctc

SEQ ID NO: 3999851 - DNA, 14 bp, Homo sapiens
cccctcggacagcc

SEQ ID NO: 3999852 - DNA, 18 bp, Homo sapiens
cccctcgtccacccccca

SEQ ID NO: 3999853 - DNA, 18 bp, Homo sapiens
cccctctgacctgcactg

SEQ ID NO: 3999854 - DNA, 21 bp, Homo sapiens
cccctctgccggtcgggcagc

SEQ ID NO: 3999855 - DNA, 16 bp, Homo sapiens
cccctctgctgctgtc

SEQ ID NO: 3999856 - DNA, 13 bp, Homo sapiens
cccctctggccag

SEQ ID NO: 3999857 - DNA, 16 bp, Homo sapiens
cccctctggccaggat

SEQ ID NO: 3999858 - DNA, 12 bp, Homo sapiens
cccctctggtgt

SEQ ID NO: 3999859 - DNA, 18 bp, Homo sapiens
cccctctgtctacaaata

SEQ ID NO: 3999860 - DNA, 12 bp, Homo sapiens
cccctcttccct

SEQ ID NO: 3999861 - DNA, 18 bp, Homo sapiens
cccctgacctcactgtga

SEQ ID NO: 3999862 - DNA, 19 bp, Homo sapiens
cccctgagatcccctgagc

SEQ ID NO: 3999863 - DNA, 13 bp, Homo sapiens
cccctgagcccca

SEQ ID NO: 3999864 - DNA, 21 bp, Homo sapiens
cccctgcaacttccgctgagg

SEQ ID NO: 3999865 - DNA, 22 bp, Homo sapiens
cccctgcaacttccgctgaggg

SEQ ID NO: 3999866 - DNA, 21 bp, Homo sapiens
cccctgcagttggcagaaagg

SEQ ID NO: 3999867 - DNA, 13 bp, Homo sapiens
cccctgccctgca

SEQ ID NO: 3999868 - DNA, 13 bp, Homo sapiens
cccctgcctgccc

SEQ ID NO: 3999869 - DNA, 24 bp, Homo sapiens
cccctgcggtcaggctgggcagcc

SEQ ID NO: 3999870 - DNA, 15 bp, Homo sapiens
cccctgctccaccag

SEQ ID NO: 3999871 - DNA, 21 bp, Homo sapiens
cccctgctggctcttctgccc

SEQ ID NO: 3999872 - DNA, 12 bp, Homo sapiens
cccctgctgtct

SEQ ID NO: 3999873 - DNA, 16 bp, Homo sapiens
cccctggagccccttc

SEQ ID NO: 3999874 - DNA, 20 bp, Homo sapiens
cccctggaggcactgaagtg

SEQ ID NO: 3999875 - DNA, 11 bp, Homo sapiens
cccctggccca

SEQ ID NO: 3999876 - DNA, 12 bp, Homo sapiens
cccctggcctct

SEQ ID NO: 3999877 - DNA, 10 bp, Homo sapiens
cccctggctt

SEQ ID NO: 3999878 - DNA, 16 bp, Homo sapiens
cccctggctttgcctc

SEQ ID NO: 3999879 - DNA, 18 bp, Homo sapiens
ccgccagcctcctctgga

SEQ ID NO: 3999880 - DNA, 11 bp, Homo sapiens
ccgccagggct

SEQ ID NO: 3999881 - DNA, 12 bp, Homo sapiens
ccgccagggctg

SEQ ID NO: 3999882 - DNA, 15 bp, Homo sapiens
ccgccagtgcacagg

SEQ ID NO: 3999883 - DNA, 16 bp, Homo sapiens
ccgccagtgcacaggg

SEQ ID NO: 3999884 - DNA, 15 bp, Homo sapiens
ccgccattgccacca

SEQ ID NO: 3999885 - DNA, 19 bp, Homo sapiens
ccgccattgccaccaggag

SEQ ID NO: 3999886 - DNA, 23 bp, Homo sapiens
ccgcccacaggaagcctgcagtc

SEQ ID NO: 3999887 - DNA, 18 bp, Homo sapiens
ccgccccagagtggccca

SEQ ID NO: 3999888 - DNA, 14 bp, Homo sapiens
ccgccccagcccct

SEQ ID NO: 3999889 - DNA, 19 bp, Homo sapiens
ccgcccccagtccccaccc

SEQ ID NO: 3999890 - DNA, 12 bp, Homo sapiens
ccgccccctcct

SEQ ID NO: 3999891 - DNA, 18 bp, Homo sapiens
ccgcccctgtggccctgg

SEQ ID NO: 3999892 - DNA, 21 bp, Homo sapiens
ccgcccctgtggccctggcca

SEQ ID NO: 3999893 - DNA, 13 bp, Homo sapiens
ccgccctcctcgg

SEQ ID NO: 3999894 - DNA, 17 bp, Homo sapiens
ccgccctgggctggact

SEQ ID NO: 3999895 - DNA, 18 bp, Homo sapiens
ccgccctgggctgtctgt

SEQ ID NO: 3999896 - DNA, 20 bp, Homo sapiens
ccgccctgggctgtctgtca

SEQ ID NO: 3999897 - DNA, 24 bp, Homo sapiens
ccgccctgggctgtctgtcaccag

SEQ ID NO: 3999898 - DNA, 16 bp, Homo sapiens
ccgcccttcctggagg

SEQ ID NO: 3999899 - DNA, 23 bp, Homo sapiens
ccgcccttcctggaggctgccta

SEQ ID NO: 3999900 - DNA, 16 bp, Homo sapiens
ccgcctagtttactgt

SEQ ID NO: 3999901 - DNA, 15 bp, Homo sapiens
ccgcctcaaaatgtg

SEQ ID NO: 3999902 - DNA, 14 bp, Homo sapiens
ccgcctcagggcca

SEQ ID NO: 3999903 - DNA, 14 bp, Homo sapiens
ccgcctgccctcat

SEQ ID NO: 3999904 - DNA, 23 bp, Homo sapiens
ccgcctgtctctttaagggcatg

SEQ ID NO: 3999905 - DNA, 22 bp, Homo sapiens
ccgcctttagttctccactggg

SEQ ID NO: 3999906 - DNA, 20 bp, Homo sapiens
ccgcgctcgcccagcaggag

SEQ ID NO: 3999907 - DNA, 19 bp, Homo sapiens
ccgcggggaagctggcttt

SEQ ID NO: 3999908 - DNA, 20 bp, Homo sapiens
ccgcggggaagctggctttg

SEQ ID NO: 3999909 - DNA, 17 bp, Homo sapiens
ccgcgggttccgcaggc

SEQ ID NO: 3999910 - DNA, 16 bp, Homo sapiens
ccgctacctccctccc

SEQ ID NO: 3999911 - DNA, 11 bp, Homo sapiens
ccgctcagccc

SEQ ID NO: 3999912 - DNA, 12 bp, Homo sapiens
ccgctcagccct

SEQ ID NO: 3999913 - DNA, 15 bp, Homo sapiens
ccgctcagccctccc

SEQ ID NO: 3999914 - DNA, 15 bp, Homo sapiens
ccgctcccgctccca

SEQ ID NO: 3999915 - DNA, 22 bp, Homo sapiens
ccgctcctgccgcagacgggca

SEQ ID NO: 3999916 - DNA, 18 bp, Homo sapiens
ccgctgcaatgcctagac

SEQ ID NO: 3999917 - DNA, 15 bp, Homo sapiens
ccgctgcaccacggc

SEQ ID NO: 3999918 - DNA, 16 bp, Homo sapiens
ccgctgccagcacaga

SEQ ID NO: 3999919 - DNA, 15 bp, Homo sapiens
ccgctgccagccttg

SEQ ID NO: 3999920 - DNA, 15 bp, Homo sapiens
ccgctgccgctgcac

SEQ ID NO: 3999921 - DNA, 16 bp, Homo sapiens
ccgctgccgctgcacc

SEQ ID NO: 3999922 - DNA, 16 bp, Homo sapiens
ccgctgctgctgctgc

SEQ ID NO: 3999923 - DNA, 15 bp, Homo sapiens
ccgctggcccttaga

SEQ ID NO: 3999924 - DNA, 20 bp, Homo sapiens
ccgctgtataaagcatgtgg

SEQ ID NO: 3999925 - DNA, 19 bp, Homo sapiens
ccgctgtcgccccaggccc

SEQ ID NO: 3999926 - DNA, 20 bp, Homo sapiens
ccgctgtcgccccaggccct

SEQ ID NO: 3999927 - DNA, 22 bp, Homo sapiens
ccgctgtcgccccaggccctcc

SEQ ID NO: 3999928 - DNA, 12 bp, Homo sapiens
ccggaagggctt

SEQ ID NO: 3999929 - DNA, 18 bp, Homo sapiens
ccggacatactctctgcc

SEQ ID NO: 3999930 - DNA, 18 bp, Homo sapiens
ccggactggtgccctcct

SEQ ID NO: 3999931 - DNA, 17 bp, Homo sapiens
ccggagattggacggcc

SEQ ID NO: 3999932 - DNA, 21 bp, Homo sapiens
ccggagattggacggcctgat

SEQ ID NO: 3999933 - DNA, 18 bp, Homo sapiens
ccggagcctgtgcagcct

SEQ ID NO: 3999934 - DNA, 17 bp, Homo sapiens
ccggagggaagggacgg

SEQ ID NO: 3999935 - DNA, 14 bp, Homo sapiens
ccggcaagccacag

SEQ ID NO: 3999936 - DNA, 20 bp, Homo sapiens
ccggcacagggtctgctctt

SEQ ID NO: 3999937 - DNA, 23 bp, Homo sapiens
ccggcagggcgggcagagggctg

SEQ ID NO: 3999938 - DNA, 14 bp, Homo sapiens
ccggcatgggaaag

SEQ ID NO: 3999939 - DNA, 18 bp, Homo sapiens
ccggcatgtttccagcag

SEQ ID NO: 3999940 - DNA, 16 bp, Homo sapiens
ccggccagcgggcaca

SEQ ID NO: 3999941 - DNA, 22 bp, Homo sapiens
ccggccagcgggcacagggcac

SEQ ID NO: 3999942 - DNA, 12 bp, Homo sapiens
ccggcccagatg

SEQ ID NO: 3999943 - DNA, 14 bp, Homo sapiens
ccggcccagatgtg

SEQ ID NO: 3999944 - DNA, 22 bp, Homo sapiens
ccggccctgggctcggaggctg

SEQ ID NO: 3999945 - DNA, 14 bp, Homo sapiens
ccggccggcctggc

SEQ ID NO: 3999946 - DNA, 16 bp, Homo sapiens
ccggcctcagggcgct

SEQ ID NO: 3999947 - DNA, 22 bp, Homo sapiens
ccggcctcctcggagagcagca

SEQ ID NO: 3999948 - DNA, 15 bp, Homo sapiens
ccggcctctctgccc

SEQ ID NO: 3999949 - DNA, 17 bp, Homo sapiens
ccggcctctctgcccca

SEQ ID NO: 3999950 - DNA, 15 bp, Homo sapiens
ccggcctcttcgcct

SEQ ID NO: 3999951 - DNA, 20 bp, Homo sapiens
ccggcctgctcccagcagcc

SEQ ID NO: 3999952 - DNA, 17 bp, Homo sapiens
ccggcctggatgccagc

SEQ ID NO: 3999953 - DNA, 21 bp, Homo sapiens
ccggcctggatgccagctgtg

SEQ ID NO: 3999954 - DNA, 23 bp, Homo sapiens
ccggcctggatgccagctgtgtc

SEQ ID NO: 3999955 - DNA, 17 bp, Homo sapiens
ccggcctggctgcagct

SEQ ID NO: 3999956 - DNA, 23 bp, Homo sapiens
ccggctcgagcagtcctgcctca

SEQ ID NO: 3999957 - DNA, 23 bp, Homo sapiens
ccggctgggtcggccctgcccaa

SEQ ID NO: 3999958 - DNA, 14 bp, Homo sapiens
ccggctgtggagca

SEQ ID NO: 3999959 - DNA, 15 bp, Homo sapiens
ccggctgtggagcaa

SEQ ID NO: 3999960 - DNA, 22 bp, Homo sapiens
ccgggacagacctggacactag

SEQ ID NO: 3999961 - DNA, 15 bp, Homo sapiens
ccgggagcctccccc

SEQ ID NO: 3999962 - DNA, 19 bp, Homo sapiens
ccgggagcctccccctcag

SEQ ID NO: 3999963 - DNA, 16 bp, Homo sapiens
ccgggcaggtcctgcc

SEQ ID NO: 3999964 - DNA, 19 bp, Homo sapiens
ccgggcaggtcctgcccat

SEQ ID NO: 3999965 - DNA, 21 bp, Homo sapiens
ccgggcaggtcctgcccatgt

SEQ ID NO: 3999966 - DNA, 20 bp, Homo sapiens
ccgggcatgtctgcctggag

SEQ ID NO: 3999967 - DNA, 14 bp, Homo sapiens
ccgggcccctgggc

SEQ ID NO: 3999968 - DNA, 13 bp, Homo sapiens
ccgggcctggggc

SEQ ID NO: 3999969 - DNA, 14 bp, Homo sapiens
ccgggcgcggtggc

SEQ ID NO: 3999970 - DNA, 16 bp, Homo sapiens
ccgggctctctgctgt

SEQ ID NO: 3999971 - DNA, 21 bp, Homo sapiens
ccgggctgagggcctgctgga

SEQ ID NO: 3999972 - DNA, 20 bp, Homo sapiens
ccgggcttgggccctgcaca

SEQ ID NO: 3999973 - DNA, 15 bp, Homo sapiens
ccggggaccctgtga

SEQ ID NO: 3999974 - DNA, 19 bp, Homo sapiens
ccggggccttatcgggctc

SEQ ID NO: 3999975 - DNA, 21 bp, Homo sapiens
ccggggtgtaacttcctgctg

SEQ ID NO: 3999976 - DNA, 23 bp, Homo sapiens
ccggggtgtaacttcctgctgca

SEQ ID NO: 3999977 - DNA, 21 bp, Homo sapiens
ccgggtcttcctactcttctc

SEQ ID NO: 3999978 - DNA, 15 bp, Homo sapiens
ccgggtgtggcctca

SEQ ID NO: 3999979 - DNA, 22 bp, Homo sapiens
ccgggtgtggcctcagccctca

SEQ ID NO: 3999980 - DNA, 14 bp, Homo sapiens
ccgggttcagcctg

SEQ ID NO: 3999981 - DNA, 12 bp, Homo sapiens
cctccagtgaag

SEQ ID NO: 3999982 - DNA, 16 bp, Homo sapiens
cctccatccatccttc

SEQ ID NO: 3999983 - DNA, 21 bp, Homo sapiens
cctccatcctatccactgggc

SEQ ID NO: 3999984 - DNA, 18 bp, Homo sapiens
cctccatcctcctccttc

SEQ ID NO: 3999985 - DNA, 19 bp, Homo sapiens
cctccatcctcctccttcc

SEQ ID NO: 3999986 - DNA, 20 bp, Homo sapiens
cctccatcctcctccttcct

SEQ ID NO: 3999987 - DNA, 21 bp, Homo sapiens
cctccatcctcctccttccta

SEQ ID NO: 3999988 - DNA, 15 bp, Homo sapiens
cctccatctttctac

SEQ ID NO: 3999989 - DNA, 23 bp, Homo sapiens
cctccatgctcctcacctgtcta

SEQ ID NO: 3999990 - DNA, 16 bp, Homo sapiens
cctccattcatccttc

SEQ ID NO: 3999991 - DNA, 18 bp, Homo sapiens
cctccattgggcacagtc

SEQ ID NO: 3999992 - DNA, 22 bp, Homo sapiens
cctccattgggcacagtccaga

SEQ ID NO: 3999993 - DNA, 17 bp, Homo sapiens
cctccatttgagaaaat

SEQ ID NO: 3999994 - DNA, 14 bp, Homo sapiens
cctcccaacccagc

SEQ ID NO: 3999995 - DNA, 18 bp, Homo sapiens
cctcccaaggtcctctca

SEQ ID NO: 3999996 - DNA, 19 bp, Homo sapiens
cctcccacactcccaaggt

SEQ ID NO: 3999997 - DNA, 14 bp, Homo sapiens
cctcccacactcgc

SEQ ID NO: 3999998 - DNA, 15 bp, Homo sapiens
cctcccacacttgct

SEQ ID NO: 3999999 - DNA, 21 bp, Homo sapiens
cctcccacccccttctctgct

SEQ ID NO: 4000000 - DNA, 16 bp, Homo sapiens
cctcccacttcactgc

SEQ ID NO: 4000001 - DNA, 11 bp, Homo sapiens
cctcccagctt

SEQ ID NO: 4000002 - DNA, 21 bp, Homo sapiens
cctcccagcttaaatcctagc

SEQ ID NO: 4000003 - DNA, 24 bp, Homo sapiens
cctcccagcttaaatcctagcagg

SEQ ID NO: 4000004 - DNA, 23 bp, Homo sapiens
cctcccatcattacccttccctg

SEQ ID NO: 4000005 - DNA, 15 bp, Homo sapiens
cctcccatccagggc

SEQ ID NO: 4000006 - DNA, 14 bp, Homo sapiens
cctcccatcccctg

SEQ ID NO: 4000007 - DNA, 17 bp, Homo sapiens
cctcccatcccctggac

SEQ ID NO: 4000008 - DNA, 20 bp, Homo sapiens
cctccccaaatcaatacact

SEQ ID NO: 4000009 - DNA, 14 bp, Homo sapiens
cctccccacatcgc

SEQ ID NO: 4000010 - DNA, 23 bp, Homo sapiens
cctccccacatcgcacactgggg

SEQ ID NO: 4000011 - DNA, 14 bp, Homo sapiens
cctccccacccagg

SEQ ID NO: 4000012 - DNA, 22 bp, Homo sapiens
cctccccaggctggagaccccc

SEQ ID NO: 4000013 - DNA, 18 bp, Homo sapiens
cctccccatctgtccagc

SEQ ID NO: 4000014 - DNA, 15 bp, Homo sapiens
cctccccatttccca

SEQ ID NO: 4000015 - DNA, 22 bp, Homo sapiens
cctccccatttcccatctgcac

SEQ ID NO: 4000016 - DNA, 16 bp, Homo sapiens
cctcccccgccactcc

SEQ ID NO: 4000017 - DNA, 17 bp, Homo sapiens
cctcccccgccactcct

SEQ ID NO: 4000018 - DNA, 14 bp, Homo sapiens
cctccccctcaacc

SEQ ID NO: 4000019 - DNA, 15 bp, Homo sapiens
cctccccctcaacct

SEQ ID NO: 4000020 - DNA, 16 bp, Homo sapiens
cctccccctggcactg

SEQ ID NO: 4000021 - DNA, 14 bp, Homo sapiens
cctccccctgtccc

SEQ ID NO: 4000022 - DNA, 23 bp, Homo sapiens
cctccccggctcgagcagtcctg

SEQ ID NO: 4000023 - DNA, 21 bp, Homo sapiens
cctcccctccggactggtgcc

SEQ ID NO: 4000024 - DNA, 14 bp, Homo sapiens
cctcccctgccatt

SEQ ID NO: 4000025 - DNA, 18 bp, Homo sapiens
cctcccgccccttcccac

SEQ ID NO: 4000026 - DNA, 16 bp, Homo sapiens
cctcccgcccttccat

SEQ ID NO: 4000027 - DNA, 15 bp, Homo sapiens
cctcccggcatggga

SEQ ID NO: 4000028 - DNA, 13 bp, Homo sapiens
cctcccggtgccc

SEQ ID NO: 4000029 - DNA, 17 bp, Homo sapiens
cctccctcactgaagga

SEQ ID NO: 4000030 - DNA, 17 bp, Homo sapiens
cctccctcaggctctgt

SEQ ID NO: 4000031 - DNA, 14 bp, Homo sapiens
cctccctccttggg

SEQ ID NO: 4000032 - DNA, 13 bp, Homo sapiens
cctccctctctct

SEQ ID NO: 4000033 - DNA, 18 bp, Homo sapiens
cctccctctctcttctgc

SEQ ID NO: 4000034 - DNA, 18 bp, Homo sapiens
cctccctctgatttttca

SEQ ID NO: 4000035 - DNA, 20 bp, Homo sapiens
cctccctgaaaatgtttttc

SEQ ID NO: 4000036 - DNA, 19 bp, Homo sapiens
cctccctgactccctgtgg

SEQ ID NO: 4000037 - DNA, 22 bp, Homo sapiens
cctccctgcccctcccttcaac

SEQ ID NO: 4000038 - DNA, 24 bp, Homo sapiens
cctccctgcccctcccttcaacca

SEQ ID NO: 4000039 - DNA, 13 bp, Homo sapiens
cctccctgcctga

SEQ ID NO: 4000040 - DNA, 22 bp, Homo sapiens
cctccctgctgtcattgcttct

SEQ ID NO: 4000041 - DNA, 20 bp, Homo sapiens
cctccctggctcccatgacc

SEQ ID NO: 4000042 - DNA, 14 bp, Homo sapiens
cctccctgtctcca

SEQ ID NO: 4000043 - DNA, 16 bp, Homo sapiens
cctccctgtctccagc

SEQ ID NO: 4000044 - DNA, 17 bp, Homo sapiens
cctccctgtctccagct

SEQ ID NO: 4000045 - DNA, 22 bp, Homo sapiens
cctccctgtctccagctgcctg

SEQ ID NO: 4000046 - DNA, 15 bp, Homo sapiens
cctcccttccttttc

SEQ ID NO: 4000047 - DNA, 16 bp, Homo sapiens
cctcccttgctgaaca

SEQ ID NO: 4000048 - DNA, 21 bp, Homo sapiens
cctcccttgctgaacacacac

SEQ ID NO: 4000049 - DNA, 15 bp, Homo sapiens
cctcccttggcgtgg

SEQ ID NO: 4000050 - DNA, 18 bp, Homo sapiens
cctccggccatactgcct

SEQ ID NO: 4000051 - DNA, 14 bp, Homo sapiens
cctccgtagggtct

SEQ ID NO: 4000052 - DNA, 18 bp, Homo sapiens
cctccgtgatccatccat

SEQ ID NO: 4000053 - DNA, 16 bp, Homo sapiens
cctcctagctctccca

SEQ ID NO: 4000054 - DNA, 17 bp, Homo sapiens
cctcctagctctcccag

SEQ ID NO: 4000055 - DNA, 18 bp, Homo sapiens
cctcctagctctcccagt

SEQ ID NO: 4000056 - DNA, 19 bp, Homo sapiens
cctcctagctctcccagtg

SEQ ID NO: 4000057 - DNA, 16 bp, Homo sapiens
cctcctcacctcatgc

SEQ ID NO: 4000058 - DNA, 22 bp, Homo sapiens
cctcctcacctcatgcccaccc

SEQ ID NO: 4000059 - DNA, 13 bp, Homo sapiens
cctcctcacctct

SEQ ID NO: 4000060 - DNA, 17 bp, Homo sapiens
cctcctcaggcacacag

SEQ ID NO: 4000061 - DNA, 20 bp, Homo sapiens
cctcctcatcccgtgttctc

SEQ ID NO: 4000062 - DNA, 12 bp, Homo sapiens
cctcctcatgta

SEQ ID NO: 4000063 - DNA, 21 bp, Homo sapiens
cctcctcatgtacataccctg

SEQ ID NO: 4000064 - DNA, 12 bp, Homo sapiens
cctcctccagcc

SEQ ID NO: 4000065 - DNA, 14 bp, Homo sapiens
cctcctccttccta

SEQ ID NO: 4000066 - DNA, 21 bp, Homo sapiens
cctcctcggagagcagcagca

SEQ ID NO: 4000067 - DNA, 13 bp, Homo sapiens
cctcctctcagtg

SEQ ID NO: 4000068 - DNA, 19 bp, Homo sapiens
cctcctctcccatccttga

SEQ ID NO: 4000069 - DNA, 14 bp, Homo sapiens
cctcctctgtctgc

SEQ ID NO: 4000070 - DNA, 15 bp, Homo sapiens
cctcctgacctgtca

SEQ ID NO: 4000071 - DNA, 13 bp, Homo sapiens
cctcctgagcctg

SEQ ID NO: 4000072 - DNA, 22 bp, Homo sapiens
cctcctgagttgaagtcatgct

SEQ ID NO: 4000073 - DNA, 16 bp, Homo sapiens
cctcctgccctgtccc

SEQ ID NO: 4000074 - DNA, 20 bp, Homo sapiens
cctcctgccctgtccctgtc

SEQ ID NO: 4000075 - DNA, 12 bp, Homo sapiens
cctcctgccctt

SEQ ID NO: 4000076 - DNA, 13 bp, Homo sapiens
cctcctgcctcag

SEQ ID NO: 4000077 - DNA, 14 bp, Homo sapiens
cctcctgcctcagc

SEQ ID NO: 4000078 - DNA, 16 bp, Homo sapiens
cctcctgcctcagcct

SEQ ID NO: 4000079 - DNA, 17 bp, Homo sapiens
cctcctggaaccttgct

SEQ ID NO: 4000080 - DNA, 18 bp, Homo sapiens
cctcctggaaccttgctg

SEQ ID NO: 4000081 - DNA, 12 bp, Homo sapiens
cctcctggacac

SEQ ID NO: 4000082 - DNA, 11 bp, Homo sapiens
cctcctggcca

SEQ ID NO: 4000083 - DNA, 12 bp, Homo sapiens
cctcctgggagc

SEQ ID NO: 4000084 - DNA, 20 bp, Homo sapiens
cctgcttggcccggccggcc

SEQ ID NO: 4000085 - DNA, 13 bp, Homo sapiens
cctgctttgcaaa

SEQ ID NO: 4000086 - DNA, 15 bp, Homo sapiens
cctgctttggcgggc

SEQ ID NO: 4000087 - DNA, 22 bp, Homo sapiens
cctgctttgggctgccctggtg

SEQ ID NO: 4000088 - DNA, 17 bp, Homo sapiens
cctgcttttctgtcctg

SEQ ID NO: 4000089 - DNA, 14 bp, Homo sapiens
cctggaaccaatcc

SEQ ID NO: 4000090 - DNA, 16 bp, Homo sapiens
cctggaaccttgctgt

SEQ ID NO: 4000091 - DNA, 20 bp, Homo sapiens
cctggaaccttgctgtcctg

SEQ ID NO: 4000092 - DNA, 21 bp, Homo sapiens
cctggaaccttgctgtcctga

SEQ ID NO: 4000093 - DNA, 13 bp, Homo sapiens
cctggaacttggg

SEQ ID NO: 4000094 - DNA, 17 bp, Homo sapiens
cctggaacttggggagt

SEQ ID NO: 4000095 - DNA, 18 bp, Homo sapiens
cctggaatctacaagcca

SEQ ID NO: 4000096 - DNA, 11 bp, Homo sapiens
cctggacacat

SEQ ID NO: 4000097 - DNA, 13 bp, Homo sapiens
cctggacactagg

SEQ ID NO: 4000098 - DNA, 14 bp, Homo sapiens
cctggacaggccag

SEQ ID NO: 4000099 - DNA, 13 bp, Homo sapiens
cctggacctgcct

SEQ ID NO: 4000100 - DNA, 14 bp, Homo sapiens
cctggactctgccc

SEQ ID NO: 4000101 - DNA, 17 bp, Homo sapiens
cctggactgggaggtag

SEQ ID NO: 4000102 - DNA, 16 bp, Homo sapiens
cctggactttcctgca

SEQ ID NO: 4000103 - DNA, 22 bp, Homo sapiens
cctggagacgtggaacctctgt

SEQ ID NO: 4000104 - DNA, 14 bp, Homo sapiens
cctggagagggtct

SEQ ID NO: 4000105 - DNA, 23 bp, Homo sapiens
cctggagagggtctcgctgtcac

SEQ ID NO: 4000106 - DNA, 18 bp, Homo sapiens
cctggagcagaccacccc

SEQ ID NO: 4000107 - DNA, 14 bp, Homo sapiens
cctggagcaggagc

SEQ ID NO: 4000108 - DNA, 17 bp, Homo sapiens
cctggagcaggagcccc

SEQ ID NO: 4000109 - DNA, 18 bp, Homo sapiens
cctggagcaggagccccg

SEQ ID NO: 4000110 - DNA, 12 bp, Homo sapiens
cctggagccaga

SEQ ID NO: 4000111 - DNA, 22 bp, Homo sapiens
cctggagccccatcggccaaga

SEQ ID NO: 4000112 - DNA, 19 bp, Homo sapiens
cctggaggaattcagctca

SEQ ID NO: 4000113 - DNA, 15 bp, Homo sapiens
cctggagtgctgtgc

SEQ ID NO: 4000114 - DNA, 17 bp, Homo sapiens
cctggagttttgatttg

SEQ ID NO: 4000115 - DNA, 22 bp, Homo sapiens
cctggatcacgacgctgcagag

SEQ ID NO: 4000116 - DNA, 18 bp, Homo sapiens
cctggatccagcactggt

SEQ ID NO: 4000117 - DNA, 18 bp, Homo sapiens
cctggatcccctctgtct

SEQ ID NO: 4000118 - DNA, 19 bp, Homo sapiens
cctggatctccccactcta

SEQ ID NO: 4000119 - DNA, 16 bp, Homo sapiens
cctggatgccagctgt

SEQ ID NO: 4000120 - DNA, 18 bp, Homo sapiens
cctggattaccagggact

SEQ ID NO: 4000121 - DNA, 18 bp, Homo sapiens
cctggcacagggcagtgg

SEQ ID NO: 4000122 - DNA, 22 bp, Homo sapiens
cctggcacggtggctcaggcct

SEQ ID NO: 4000123 - DNA, 23 bp, Homo sapiens
cctggcactaacgttgagcccct

SEQ ID NO: 4000124 - DNA, 18 bp, Homo sapiens
cctggcactgggaggcag

SEQ ID NO: 4000125 - DNA, 19 bp, Homo sapiens
cctggcagccgtgccttca

SEQ ID NO: 4000126 - DNA, 21 bp, Homo sapiens
cctggcagccgtgccttcagc

SEQ ID NO: 4000127 - DNA, 15 bp, Homo sapiens
cctggcaggcagggg

SEQ ID NO: 4000128 - DNA, 12 bp, Homo sapiens
cctggcaggcca

SEQ ID NO: 4000129 - DNA, 13 bp, Homo sapiens
cctggcaggccag

SEQ ID NO: 4000130 - DNA, 18 bp, Homo sapiens
cctggcaggccagtgtct

SEQ ID NO: 4000131 - DNA, 20 bp, Homo sapiens
cctggcatcatggtggatat

SEQ ID NO: 4000132 - DNA, 14 bp, Homo sapiens
cctggccaccagcc

SEQ ID NO: 4000133 - DNA, 22 bp, Homo sapiens
cctggccaccagccatcctccc

SEQ ID NO: 4000134 - DNA, 21 bp, Homo sapiens
cctggccactaaagcttcaga

SEQ ID NO: 4000135 - DNA, 15 bp, Homo sapiens
cctggccagacacag

SEQ ID NO: 4000136 - DNA, 16 bp, Homo sapiens
cctggccagacacagg

SEQ ID NO: 4000137 - DNA, 19 bp, Homo sapiens
cctggccagacacaggccc

SEQ ID NO: 4000138 - DNA, 12 bp, Homo sapiens
cctggccagatt

SEQ ID NO: 4000139 - DNA, 23 bp, Homo sapiens
cctggccagccgggagcttggct

SEQ ID NO: 4000140 - DNA, 12 bp, Homo sapiens
cctggccaggac

SEQ ID NO: 4000141 - DNA, 14 bp, Homo sapiens
cctggccaggagct

SEQ ID NO: 4000142 - DNA, 19 bp, Homo sapiens
cctggccaggagctcttca

SEQ ID NO: 4000143 - DNA, 21 bp, Homo sapiens
cctggccaggcaccccctgga

SEQ ID NO: 4000144 - DNA, 22 bp, Homo sapiens
cctggccaggcagatctgtgcc

SEQ ID NO: 4000145 - DNA, 23 bp, Homo sapiens
cctggccatttccaagaggctgt

SEQ ID NO: 4000146 - DNA, 17 bp, Homo sapiens
cctggcccatctcagcc

SEQ ID NO: 4000147 - DNA, 23 bp, Homo sapiens
cctggcccatctcagcctcctga

SEQ ID NO: 4000148 - DNA, 13 bp, Homo sapiens
cctggccccagga

SEQ ID NO: 4000149 - DNA, 18 bp, Homo sapiens
cctggccccaggccccag

SEQ ID NO: 4000150 - DNA, 19 bp, Homo sapiens
cctggccccaggccccaga

SEQ ID NO: 4000151 - DNA, 20 bp, Homo sapiens
cctggcccccaacctcaggg

SEQ ID NO: 4000152 - DNA, 22 bp, Homo sapiens
cctggcccccaacctcagggct

SEQ ID NO: 4000153 - DNA, 15 bp, Homo sapiens
cctggcccctcgcct

SEQ ID NO: 4000154 - DNA, 17 bp, Homo sapiens
cctggcccctcgcctgt

SEQ ID NO: 4000155 - DNA, 18 bp, Homo sapiens
cctggcccttacttgctt

SEQ ID NO: 4000156 - DNA, 19 bp, Homo sapiens
cctggccgagtccaagctg

SEQ ID NO: 4000157 - DNA, 15 bp, Homo sapiens
cctggccgccccctg

SEQ ID NO: 4000158 - DNA, 21 bp, Homo sapiens
cctggcctatccgctgccagc

SEQ ID NO: 4000159 - DNA, 13 bp, Homo sapiens
cctggcctctgcc

SEQ ID NO: 4000160 - DNA, 14 bp, Homo sapiens
cctggcctctgcct

SEQ ID NO: 4000161 - DNA, 23 bp, Homo sapiens
cctggcctctgcctccaccctcc

SEQ ID NO: 4000162 - DNA, 17 bp, Homo sapiens
cctggcctgaactgagg

SEQ ID NO: 4000163 - DNA, 21 bp, Homo sapiens
cctggcctgaactgaggagat

SEQ ID NO: 4000164 - DNA, 13 bp, Homo sapiens
cctggcctgagag

SEQ ID NO: 4000165 - DNA, 21 bp, Homo sapiens
cctggcctgcccgtgccctgg

SEQ ID NO: 4000166 - DNA, 17 bp, Homo sapiens
cctggcctgtctcggaa

SEQ ID NO: 4000167 - DNA, 16 bp, Homo sapiens
cctggcctttcctggt

SEQ ID NO: 4000168 - DNA, 19 bp, Homo sapiens
cctggcgcaggtgggctgg

SEQ ID NO: 4000169 - DNA, 23 bp, Homo sapiens
cctggcgcaggtgggctggactt

SEQ ID NO: 4000170 - DNA, 18 bp, Homo sapiens
cctggctacatcccagcc

SEQ ID NO: 4000171 - DNA, 22 bp, Homo sapiens
cctggctcccatgaccatactg

SEQ ID NO: 4000172 - DNA, 15 bp, Homo sapiens
cctggctcctgaggg

SEQ ID NO: 4000173 - DNA, 23 bp, Homo sapiens
cctggctcctgaggggcatctgc

SEQ ID NO: 4000174 - DNA, 16 bp, Homo sapiens
cctggctctcagaagg

SEQ ID NO: 4000175 - DNA, 22 bp, Homo sapiens
cctggctctgcaatgggcactg

SEQ ID NO: 4000176 - DNA, 23 bp, Homo sapiens
cctggctgaccccaaagagcctg

SEQ ID NO: 4000177 - DNA, 12 bp, Homo sapiens
cctggctgagca

SEQ ID NO: 4000178 - DNA, 17 bp, Homo sapiens
cctggctgagggcagct

SEQ ID NO: 4000179 - DNA, 19 bp, Homo sapiens
cctggctgaggttcctctg

SEQ ID NO: 4000180 - DNA, 20 bp, Homo sapiens
cctggctgaggttcctctgc

SEQ ID NO: 4000181 - DNA, 24 bp, Homo sapiens
cctggctgaggttcctctgcctgc

SEQ ID NO: 4000182 - DNA, 21 bp, Homo sapiens
cctggctgcagctgggcagca

SEQ ID NO: 4000183 - DNA, 16 bp, Homo sapiens
cctggctgcccctcac

SEQ ID NO: 4000184 - DNA, 17 bp, Homo sapiens
cctggctgcccctcacc

SEQ ID NO: 4000185 - DNA, 20 bp, Homo sapiens
cctggctgcccctcaccttg

SEQ ID NO: 4000186 - DNA, 18 bp, Homo sapiens
cctttaacacagacccct

SEQ ID NO: 4000187 - DNA, 22 bp, Homo sapiens
cctttaacttttttttctctct

SEQ ID NO: 4000188 - DNA, 23 bp, Homo sapiens
cctttaacttttttttctctctt

SEQ ID NO: 4000189 - DNA, 19 bp, Homo sapiens
cctttaagatatccatctt

SEQ ID NO: 4000190 - DNA, 16 bp, Homo sapiens
cctttacaaaagaaat

SEQ ID NO: 4000191 - DNA, 18 bp, Homo sapiens
cctttacaccaactccta

SEQ ID NO: 4000192 - DNA, 19 bp, Homo sapiens
cctttagccaaacccttgt

SEQ ID NO: 4000193 - DNA, 17 bp, Homo sapiens
cctttagtatcagtgtt

SEQ ID NO: 4000194 - DNA, 18 bp, Homo sapiens
cctttagtatcagtgttt

SEQ ID NO: 4000195 - DNA, 21 bp, Homo sapiens
cctttagtatcagtgttttaa

SEQ ID NO: 4000196 - DNA, 17 bp, Homo sapiens
cctttatactgtgaagt

SEQ ID NO: 4000197 - DNA, 13 bp, Homo sapiens
cctttatgtgaat

SEQ ID NO: 4000198 - DNA, 17 bp, Homo sapiens
cctttatgtgaattttt

SEQ ID NO: 4000199 - DNA, 23 bp, Homo sapiens
cctttatgtgaatttttaagctg

SEQ ID NO: 4000200 - DNA, 17 bp, Homo sapiens
cctttcacttctttccc

SEQ ID NO: 4000201 - DNA, 18 bp, Homo sapiens
cctttcacttctttccct

SEQ ID NO: 4000202 - DNA, 16 bp, Homo sapiens
cctttcagcaggcagc

SEQ ID NO: 4000203 - DNA, 17 bp, Homo sapiens
cctttcagcaggcagcc

SEQ ID NO: 4000204 - DNA, 19 bp, Homo sapiens
cctttcaggcctacagcca

SEQ ID NO: 4000205 - DNA, 11 bp, Homo sapiens
cctttccataa

SEQ ID NO: 4000206 - DNA, 12 bp, Homo sapiens
cctttcccaccc

SEQ ID NO: 4000207 - DNA, 14 bp, Homo sapiens
cctttccccagcat

SEQ ID NO: 4000208 - DNA, 15 bp, Homo sapiens
cctttcccttcttgg

SEQ ID NO: 4000209 - DNA, 21 bp, Homo sapiens
cctttccgcggagcccttggc

SEQ ID NO: 4000210 - DNA, 17 bp, Homo sapiens
cctttcctcctttatca

SEQ ID NO: 4000211 - DNA, 18 bp, Homo sapiens
cctttcctcctttatcac

SEQ ID NO: 4000212 - DNA, 18 bp, Homo sapiens
cctttccttccatcccta

SEQ ID NO: 4000213 - DNA, 16 bp, Homo sapiens
cctttcgaggcctgaa

SEQ ID NO: 4000214 - DNA, 18 bp, Homo sapiens
cctttcgaggcctgaagc

SEQ ID NO: 4000215 - DNA, 20 bp, Homo sapiens
cctttctccagccagcaatg

SEQ ID NO: 4000216 - DNA, 16 bp, Homo sapiens
cctttctctttctctc

SEQ ID NO: 4000217 - DNA, 14 bp, Homo sapiens
cctttctgggagca

SEQ ID NO: 4000218 - DNA, 23 bp, Homo sapiens
cctttctgtcccactacatctgg

SEQ ID NO: 4000219 - DNA, 13 bp, Homo sapiens
cctttctgtgccc

SEQ ID NO: 4000220 - DNA, 19 bp, Homo sapiens
cctttctgtgccctactca

SEQ ID NO: 4000221 - DNA, 12 bp, Homo sapiens
cctttcttcctc

SEQ ID NO: 4000222 - DNA, 12 bp, Homo sapiens
cctttctttgcc

SEQ ID NO: 4000223 - DNA, 15 bp, Homo sapiens
cctttctttgcctct

SEQ ID NO: 4000224 - DNA, 16 bp, Homo sapiens
cctttctttgcctctg

SEQ ID NO: 4000225 - DNA, 14 bp, Homo sapiens
cctttgaagcctca

SEQ ID NO: 4000226 - DNA, 15 bp, Homo sapiens
cctttgacttcagct

SEQ ID NO: 4000227 - DNA, 13 bp, Homo sapiens
cctttgagacagt

SEQ ID NO: 4000228 - DNA, 15 bp, Homo sapiens
cctttgagacagttt

SEQ ID NO: 4000229 - DNA, 13 bp, Homo sapiens
cctttgcactgag

SEQ ID NO: 4000230 - DNA, 22 bp, Homo sapiens
cctttgcagttggactctcagg

SEQ ID NO: 4000231 - DNA, 22 bp, Homo sapiens
cctttgcctttcttctgccctt

SEQ ID NO: 4000232 - DNA, 13 bp, Homo sapiens
cctttgctctttc

SEQ ID NO: 4000233 - DNA, 19 bp, Homo sapiens
cctttggatgaccagaaca

SEQ ID NO: 4000234 - DNA, 11 bp, Homo sapiens
cctttggcctg

SEQ ID NO: 4000235 - DNA, 21 bp, Homo sapiens
cctttggcctggggtgcatct

SEQ ID NO: 4000236 - DNA, 22 bp, Homo sapiens
cctttggcctggggtgcatctc

SEQ ID NO: 4000237 - DNA, 23 bp, Homo sapiens
cctttgggcctctgcttctctca

SEQ ID NO: 4000238 - DNA, 14 bp, Homo sapiens
cctttggttctggc

SEQ ID NO: 4000239 - DNA, 12 bp, Homo sapiens
cctttgtaagtt

SEQ ID NO: 4000240 - DNA, 21 bp, Homo sapiens
cctttgtcctcctgctgccag

SEQ ID NO: 4000241 - DNA, 22 bp, Homo sapiens
cctttgtgcacatttatttcct

SEQ ID NO: 4000242 - DNA, 21 bp, Homo sapiens
cctttgtgctgcgcctgcagg

SEQ ID NO: 4000243 - DNA, 15 bp, Homo sapiens
cctttgttctgagca

SEQ ID NO: 4000244 - DNA, 16 bp, Homo sapiens
ccttttaaagtgtttc

SEQ ID NO: 4000245 - DNA, 17 bp, Homo sapiens
ccttttacttttttata

SEQ ID NO: 4000246 - DNA, 22 bp, Homo sapiens
ccttttataggtgagaaaaaaa

SEQ ID NO: 4000247 - DNA, 17 bp, Homo sapiens
ccttttatctgcagaac

SEQ ID NO: 4000248 - DNA, 12 bp, Homo sapiens
ccttttcaggaa

SEQ ID NO: 4000249 - DNA, 12 bp, Homo sapiens
ccttttcattta

SEQ ID NO: 4000250 - DNA, 15 bp, Homo sapiens
ccttttccagagcat

SEQ ID NO: 4000251 - DNA, 20 bp, Homo sapiens
ccttttccccaaccacagag

SEQ ID NO: 4000252 - DNA, 17 bp, Homo sapiens
ccttttcccctacagaa

SEQ ID NO: 4000253 - DNA, 18 bp, Homo sapiens
ccttttcccctacagaat

SEQ ID NO: 4000254 - DNA, 13 bp, Homo sapiens
ccttttccctgct

SEQ ID NO: 4000255 - DNA, 14 bp, Homo sapiens
ccttttccctgctt

SEQ ID NO: 4000256 - DNA, 10 bp, Homo sapiens
ccttttccta

SEQ ID NO: 4000257 - DNA, 17 bp, Homo sapiens
ccttttctctcacccat

SEQ ID NO: 4000258 - DNA, 13 bp, Homo sapiens
ccttttctgtgtt

SEQ ID NO: 4000259 - DNA, 16 bp, Homo sapiens
ccttttcttcattttg

SEQ ID NO: 4000260 - DNA, 16 bp, Homo sapiens
ccttttgaggagcccc

SEQ ID NO: 4000261 - DNA, 15 bp, Homo sapiens
ccttttgcagaagag

SEQ ID NO: 4000262 - DNA, 12 bp, Homo sapiens
ccttttgccaat

SEQ ID NO: 4000263 - DNA, 14 bp, Homo sapiens
ccttttgctctctg

SEQ ID NO: 4000264 - DNA, 16 bp, Homo sapiens
ccttttgctgcgcacc

SEQ ID NO: 4000265 - DNA, 22 bp, Homo sapiens
ccttttggataagtttctattc

SEQ ID NO: 4000266 - DNA, 12 bp, Homo sapiens
ccttttgggaag

SEQ ID NO: 4000267 - DNA, 17 bp, Homo sapiens
ccttttggggttctaca

SEQ ID NO: 4000268 - DNA, 11 bp, Homo sapiens
ccttttgtgtt

SEQ ID NO: 4000269 - DNA, 21 bp, Homo sapiens
cctttttaaatgtgaattttt

SEQ ID NO: 4000270 - DNA, 12 bp, Homo sapiens
cctttttcaatg

SEQ ID NO: 4000271 - DNA, 21 bp, Homo sapiens
cctttttcaatgaattttata

SEQ ID NO: 4000272 - DNA, 14 bp, Homo sapiens
cctttttctccagc

SEQ ID NO: 4000273 - DNA, 16 bp, Homo sapiens
cctttttctttataaa

SEQ ID NO: 4000274 - DNA, 13 bp, Homo sapiens
cctttttgacact

SEQ ID NO: 4000275 - DNA, 22 bp, Homo sapiens
cctttttgtaaatactgcttga

SEQ ID NO: 4000276 - DNA, 18 bp, Homo sapiens
ccttttttaagatttttc

SEQ ID NO: 4000277 - DNA, 15 bp, Homo sapiens
cctttttttttgaaa

SEQ ID NO: 4000278 - DNA, 13 bp, Homo sapiens
cgaaactgccaag

SEQ ID NO: 4000279 - DNA, 22 bp, Homo sapiens
cgaaataaaaatggcaaatgca

SEQ ID NO: 4000280 - DNA, 20 bp, Homo sapiens
cgaaataacaatgttaagga

SEQ ID NO: 4000281 - DNA, 11 bp, Homo sapiens
cgaaatgccac

SEQ ID NO: 4000282 - DNA, 13 bp, Homo sapiens
cgaaatgttattt

SEQ ID NO: 4000283 - DNA, 22 bp, Homo sapiens
cgaaatgttattttttaattat

SEQ ID NO: 4000284 - DNA, 19 bp, Homo sapiens
cgaacatccaaccttccca

SEQ ID NO: 4000285 - DNA, 21 bp, Homo sapiens
cgaacccaatctgcacactcc

SEQ ID NO: 4000286 - DNA, 13 bp, Homo sapiens
cgaagcagagagg

SEQ ID NO: 4000287 - DNA, 15 bp, Homo sapiens
cgaaggtgcctcaga

SEQ ID NO: 4000288 - DNA, 17 bp, Homo sapiens
cgaagtctttgccttct

SEQ ID NO: 4000289 - DNA, 20 bp, Homo sapiens
cgaagtctttgccttctctg

SEQ ID NO: 4000290 - DNA, 15 bp, Homo sapiens
cggctccccatgtgt

SEQ ID NO: 4000291 - DNA, 20 bp, Homo sapiens
cggctcgagcagtcctgcct

SEQ ID NO: 4000292 - DNA, 16 bp, Homo sapiens
cggctcggaggaagcc

SEQ ID NO: 4000293 - DNA, 15 bp, Homo sapiens
cggctgagccttcag

SEQ ID NO: 4000294 - DNA, 16 bp, Homo sapiens
cggctgagccttcaga

SEQ ID NO: 4000295 - DNA, 14 bp, Homo sapiens
cggctgggtctgtg

SEQ ID NO: 4000296 - DNA, 22 bp, Homo sapiens
cggctgtggaccgtggacaggc

SEQ ID NO: 4000297 - DNA, 23 bp, Homo sapiens
cggctgtggaccgtggacaggcc

SEQ ID NO: 4000298 - DNA, 16 bp, Homo sapiens
cggcttcatgccagct

SEQ ID NO: 4000299 - DNA, 19 bp, Homo sapiens
cggcttcatgccagctact

SEQ ID NO: 4000300 - DNA, 18 bp, Homo sapiens
cggctttttgccatctgt

SEQ ID NO: 4000301 - DNA, 15 bp, Homo sapiens
cgggaacagacaaca

SEQ ID NO: 4000302 - DNA, 22 bp, Homo sapiens
cgggaagcagccagctccccac

SEQ ID NO: 4000303 - DNA, 17 bp, Homo sapiens
cgggaaggtcaccagca

SEQ ID NO: 4000304 - DNA, 15 bp, Homo sapiens
cgggacagacctgga

SEQ ID NO: 4000305 - DNA, 21 bp, Homo sapiens
cgggacgagaccctacaggag

SEQ ID NO: 4000306 - DNA, 16 bp, Homo sapiens
cgggagaatcatgtga

SEQ ID NO: 4000307 - DNA, 16 bp, Homo sapiens
cgggagacctgtgcta

SEQ ID NO: 4000308 - DNA, 14 bp, Homo sapiens
cgggagcacccaga

SEQ ID NO: 4000309 - DNA, 16 bp, Homo sapiens
cgggagcacccagagc

SEQ ID NO: 4000310 - DNA, 14 bp, Homo sapiens
cgggagcagtgtct

SEQ ID NO: 4000311 - DNA, 23 bp, Homo sapiens
cgggagcagtgtcttccataatg

SEQ ID NO: 4000312 - DNA, 22 bp, Homo sapiens
cgggaggcggagcttgcagtga

SEQ ID NO: 4000313 - DNA, 17 bp, Homo sapiens
cgggaggctgagacagg

SEQ ID NO: 4000314 - DNA, 12 bp, Homo sapiens
cgggaggctggg

SEQ ID NO: 4000315 - DNA, 15 bp, Homo sapiens
cgggaggctgggcac

SEQ ID NO: 4000316 - DNA, 18 bp, Homo sapiens
cgggaggggaaaggctgc

SEQ ID NO: 4000317 - DNA, 14 bp, Homo sapiens
cgggatgtcagcag

SEQ ID NO: 4000318 - DNA, 16 bp, Homo sapiens
cgggcaccagccagcg

SEQ ID NO: 4000319 - DNA, 21 bp, Homo sapiens
cgggcacggtcacacggccac

SEQ ID NO: 4000320 - DNA, 12 bp, Homo sapiens
cgggcagagcac

SEQ ID NO: 4000321 - DNA, 15 bp, Homo sapiens
cgggcagagggctgg

SEQ ID NO: 4000322 - DNA, 18 bp, Homo sapiens
cgggcagagggctggagg

SEQ ID NO: 4000323 - DNA, 19 bp, Homo sapiens
cgggcagagggctggaggc

SEQ ID NO: 4000324 - DNA, 13 bp, Homo sapiens
cgggcagatgggc

SEQ ID NO: 4000325 - DNA, 20 bp, Homo sapiens
cgggcagatgggcggacggc

SEQ ID NO: 4000326 - DNA, 15 bp, Homo sapiens
cgggcagcgggccag

SEQ ID NO: 4000327 - DNA, 16 bp, Homo sapiens
cgggcagcgggccagg

SEQ ID NO: 4000328 - DNA, 21 bp, Homo sapiens
cgggcaggtcctgcccatgtg

SEQ ID NO: 4000329 - DNA, 21 bp, Homo sapiens
cgggcatggtggctcatgcct

SEQ ID NO: 4000330 - DNA, 17 bp, Homo sapiens
cgggccagggctgcccc

SEQ ID NO: 4000331 - DNA, 16 bp, Homo sapiens
cgggccatgagggaca

SEQ ID NO: 4000332 - DNA, 16 bp, Homo sapiens
cgggccgaggcccagc

SEQ ID NO: 4000333 - DNA, 17 bp, Homo sapiens
cgggccgaggcccagcg

SEQ ID NO: 4000334 - DNA, 20 bp, Homo sapiens
cgggccgaggcccagcgggc

SEQ ID NO: 4000335 - DNA, 20 bp, Homo sapiens
cgggcctggagaactagaga

SEQ ID NO: 4000336 - DNA, 20 bp, Homo sapiens
cgggcgcgatcccacacagg

SEQ ID NO: 4000337 - DNA, 14 bp, Homo sapiens
cgggcgcggtggct

SEQ ID NO: 4000338 - DNA, 16 bp, Homo sapiens
cgggcgcggtggctca

SEQ ID NO: 4000339 - DNA, 19 bp, Homo sapiens
cgggctaacgggaggctgg

SEQ ID NO: 4000340 - DNA, 14 bp, Homo sapiens
cgggctccagccat

SEQ ID NO: 4000341 - DNA, 22 bp, Homo sapiens
cgggctccgacttgtgcacagg

SEQ ID NO: 4000342 - DNA, 14 bp, Homo sapiens
cgggctctgcaccc

SEQ ID NO: 4000343 - DNA, 15 bp, Homo sapiens
cgggctgaggccaga

SEQ ID NO: 4000344 - DNA, 15 bp, Homo sapiens
cgggctgagggcctg

SEQ ID NO: 4000345 - DNA, 16 bp, Homo sapiens
cgggcttgggccctgc

SEQ ID NO: 4000346 - DNA, 17 bp, Homo sapiens
cgggcttgggccctgca

SEQ ID NO: 4000347 - DNA, 18 bp, Homo sapiens
cgggcttgggccctgcac

SEQ ID NO: 4000348 - DNA, 20 bp, Homo sapiens
cggggaagctgccagcccag

SEQ ID NO: 4000349 - DNA, 15 bp, Homo sapiens
cggggaagctggctt

SEQ ID NO: 4000350 - DNA, 14 bp, Homo sapiens
cggggccagctccg

SEQ ID NO: 4000351 - DNA, 17 bp, Homo sapiens
cggggcctccaacccat

SEQ ID NO: 4000352 - DNA, 21 bp, Homo sapiens
cggggccttatcgggctccag

SEQ ID NO: 4000353 - DNA, 15 bp, Homo sapiens
cgggggagcccagtg

SEQ ID NO: 4000354 - DNA, 16 bp, Homo sapiens
cgggggagcccagtga

SEQ ID NO: 4000355 - DNA, 13 bp, Homo sapiens
cggggggagggtt

SEQ ID NO: 4000356 - DNA, 14 bp, Homo sapiens
cggggtatgaagag

SEQ ID NO: 4000357 - DNA, 15 bp, Homo sapiens
cggggtgctgtggtg

SEQ ID NO: 4000358 - DNA, 20 bp, Homo sapiens
cggggtgtaacttcctgctg

SEQ ID NO: 4000359 - DNA, 15 bp, Homo sapiens
cgggtgatggccagc

SEQ ID NO: 4000360 - DNA, 14 bp, Homo sapiens
cgggtgcagcatct

SEQ ID NO: 4000361 - DNA, 23 bp, Homo sapiens
cgggtgcatttgagagaagccac

SEQ ID NO: 4000362 - DNA, 21 bp, Homo sapiens
cgggtgcctgctgcggcagac

SEQ ID NO: 4000363 - DNA, 14 bp, Homo sapiens
cgggtgtggcctca

SEQ ID NO: 4000364 - DNA, 17 bp, Homo sapiens
cgggtgtggcctcagcc

SEQ ID NO: 4000365 - DNA, 20 bp, Homo sapiens
cgggtgtggcctcagccctc

SEQ ID NO: 4000366 - DNA, 18 bp, Homo sapiens
cgggttcagcctggcctg

SEQ ID NO: 4000367 - DNA, 13 bp, Homo sapiens
cggtaactgtcct

SEQ ID NO: 4000368 - DNA, 14 bp, Homo sapiens
cggtaactgtcctg

SEQ ID NO: 4000369 - DNA, 19 bp, Homo sapiens
cggtaccaatgcagaactc

SEQ ID NO: 4000370 - DNA, 21 bp, Homo sapiens
cggtagccagcacacagggca

SEQ ID NO: 4000371 - DNA, 16 bp, Homo sapiens
cggtagggaggcagcc

SEQ ID NO: 4000372 - DNA, 11 bp, Homo sapiens
tttttctgatt

SEQ ID NO: 4000373 - DNA, 13 bp, Homo sapiens
cttattctgtatc

SEQ ID NO: 4000374 - DNA, 12 bp, Homo sapiens
cttattgttcca

SEQ ID NO: 4000375 - DNA, 14 bp, Homo sapiens
cttattgttccaag

SEQ ID NO: 4000376 - DNA, 15 bp, Homo sapiens
cttattgttccaaga

SEQ ID NO: 4000377 - DNA, 17 bp, Homo sapiens
cttattgttccaagaca

SEQ ID NO: 4000378 - DNA, 13 bp, Homo sapiens
cttatttaaaatt

SEQ ID NO: 4000379 - DNA, 18 bp, Homo sapiens
cttatttaatgaaagact

SEQ ID NO: 4000380 - DNA, 19 bp, Homo sapiens
cttatttacccttttcccc

SEQ ID NO: 4000381 - DNA, 12 bp, Homo sapiens
cttatttccaag

SEQ ID NO: 4000382 - DNA, 22 bp, Homo sapiens
tggtccagaaactcctgtttct

SEQ ID NO: 4000383 - DNA, 12 bp, Homo sapiens
tggtccagctct

SEQ ID NO: 4000384 - DNA, 22 bp, Homo sapiens
tggtccagctcttggcccctgt

SEQ ID NO: 4000385 - DNA, 19 bp, Homo sapiens
tggtccatgcccactgctg

SEQ ID NO: 4000386 - DNA, 18 bp, Homo sapiens
tggtccatttgttcctgc

SEQ ID NO: 4000387 - DNA, 13 bp, Homo sapiens
tggtccctgagga

SEQ ID NO: 4000388 - DNA, 19 bp, Homo sapiens
tggtccctgggaggaaatt

SEQ ID NO: 4000389 - DNA, 16 bp, Homo sapiens
tggtccggacactcct

SEQ ID NO: 4000390 - DNA, 19 bp, Homo sapiens
tggtcctgactcaacatgt

SEQ ID NO: 4000391 - DNA, 14 bp, Homo sapiens
tggtcctgagacct

SEQ ID NO: 4000392 - DNA, 13 bp, Homo sapiens
gctccccttcccc

SEQ ID NO: 4000393 - DNA, 16 bp, Homo sapiens
gctccccttccccttc

SEQ ID NO: 4000394 - DNA, 16 bp, Homo sapiens
gctccctagactgcat

SEQ ID NO: 4000395 - DNA, 17 bp, Homo sapiens
gctccctcaaagaggca

SEQ ID NO: 4000396 - DNA, 16 bp, Homo sapiens
gctccctcagcctcag

SEQ ID NO: 4000397 - DNA, 17 bp, Homo sapiens
gctccctcagcctcaga

SEQ ID NO: 4000398 - DNA, 20 bp, Homo sapiens
gctccctcagcctcagagga

SEQ ID NO: 4000399 - DNA, 18 bp, Homo sapiens
gctccctcctccaggcct

SEQ ID NO: 4000400 - DNA, 23 bp, Homo sapiens
gctccctgatgacacccaccctg

SEQ ID NO: 4000401 - DNA, 21 bp, Homo sapiens
gctccctgctttggctgaggg

SEQ ID NO: 4000402 - DNA, 22 bp, Homo sapiens
gctccctgctttggctgagggg

SEQ ID NO: 4000403 - DNA, 19 bp, Homo sapiens
gctcccttcaatgctagaa

SEQ ID NO: 4000404 - DNA, 13 bp, Homo sapiens
gctcccttcagcc

SEQ ID NO: 4000405 - DNA, 15 bp, Homo sapiens
gctcccttcagcccc

SEQ ID NO: 4000406 - DNA, 20 bp, Homo sapiens
gctccgccatggtgtcccgg

SEQ ID NO: 4000407 - DNA, 22 bp, Homo sapiens
gctccgctgctccttggcttac

SEQ ID NO: 4000408 - DNA, 22 bp, Homo sapiens
gctccgtgagtgaaccatcatt

SEQ ID NO: 4000409 - DNA, 19 bp, Homo sapiens
gctcctagcagacagaaac

SEQ ID NO: 4000410 - DNA, 11 bp, Homo sapiens
gctcctcagag

SEQ ID NO: 4000411 - DNA, 14 bp, Homo sapiens
gctcctcccggtgc

SEQ ID NO: 4000412 - DNA, 19 bp, Homo sapiens
gctcctcccggtgcccaag

SEQ ID NO: 4000413 - DNA, 18 bp, Homo sapiens
gctcctctccccagccca

SEQ ID NO: 4000414 - DNA, 20 bp, Homo sapiens
gctcctctccccagcccaga

SEQ ID NO: 4000415 - DNA, 16 bp, Homo sapiens
gctcctctcctggagg

SEQ ID NO: 4000416 - DNA, 17 bp, Homo sapiens
gctcctcttgattcctg

SEQ ID NO: 4000417 - DNA, 19 bp, Homo sapiens
gctcctcttgattcctggt

SEQ ID NO: 4000418 - DNA, 18 bp, Homo sapiens
gctcctgaggggcatctg

SEQ ID NO: 4000419 - DNA, 13 bp, Homo sapiens
gctcctgcccctt

SEQ ID NO: 4000420 - DNA, 12 bp, Homo sapiens
gctcctgctgcg

SEQ ID NO: 4000421 - DNA, 20 bp, Homo sapiens
gctcctgcttttctgtcctg

SEQ ID NO: 4000422 - DNA, 22 bp, Homo sapiens
gctcctgcttttctgtcctggg

SEQ ID NO: 4000423 - DNA, 19 bp, Homo sapiens
gctcctggtcttgagatgt

SEQ ID NO: 4000424 - DNA, 21 bp, Homo sapiens
gctccttcaacaaggcttgct

SEQ ID NO: 4000425 - DNA, 17 bp, Homo sapiens
gctccttgagtaaaaag

SEQ ID NO: 4000426 - DNA, 23 bp, Homo sapiens
gctcctttacaaaagaaatacct

SEQ ID NO: 4000427 - DNA, 14 bp, Homo sapiens
gctcctttctccag

SEQ ID NO: 4000428 - DNA, 21 bp, Homo sapiens
gctccttttccgttctgttct

SEQ ID NO: 4000429 - DNA, 23 bp, Homo sapiens
gctccttttccgttctgttctgc

SEQ ID NO: 4000430 - DNA, 18 bp, Homo sapiens
gctcgactatagaaaact

SEQ ID NO: 4000431 - DNA, 16 bp, Homo sapiens
gctcgatgcagacagg

SEQ ID NO: 4000432 - DNA, 20 bp, Homo sapiens
gctcgcacccccctgttcta

SEQ ID NO: 4000433 - DNA, 13 bp, Homo sapiens
gctcgcccagcag

SEQ ID NO: 4000434 - DNA, 19 bp, Homo sapiens
gctcgccctcctttctgtg

SEQ ID NO: 4000435 - DNA, 17 bp, Homo sapiens
gctcgcgggcagcgggc

SEQ ID NO: 4000436 - DNA, 18 bp, Homo sapiens
gctcgcgggcagcgggcc

SEQ ID NO: 4000437 - DNA, 20 bp, Homo sapiens
gctcgcgggcagcgggccag

SEQ ID NO: 4000438 - DNA, 23 bp, Homo sapiens
gctcgcgggcagcgggccaggcc

SEQ ID NO: 4000439 - DNA, 15 bp, Homo sapiens
gctcggaggctgccc

SEQ ID NO: 4000440 - DNA, 17 bp, Homo sapiens
gctctacatcttctgcc

SEQ ID NO: 4000441 - DNA, 18 bp, Homo sapiens
gctctacccatgagcctg

SEQ ID NO: 4000442 - DNA, 19 bp, Homo sapiens
gctctacccatgagcctgc

SEQ ID NO: 4000443 - DNA, 16 bp, Homo sapiens
gctctaccctgctccc

SEQ ID NO: 4000444 - DNA, 23 bp, Homo sapiens
gctctaccttcctgtccctgagg

SEQ ID NO: 4000445 - DNA, 21 bp, Homo sapiens
gctctagtgggacagcccaga

SEQ ID NO: 4000446 - DNA, 14 bp, Homo sapiens
gctctatctctcaa

SEQ ID NO: 4000447 - DNA, 18 bp, Homo sapiens
gctctatctctcaaaact

SEQ ID NO: 4000448 - DNA, 18 bp, Homo sapiens
gctctcagctcagcgcca

SEQ ID NO: 4000449 - DNA, 22 bp, Homo sapiens
aaagaggctgcccctctcacca

SEQ ID NO: 4000450 - DNA, 13 bp, Homo sapiens
aaagagtagaatt

SEQ ID NO: 4000451 - DNA, 21 bp, Homo sapiens
aaagataaacctggagatatt

SEQ ID NO: 4000452 - DNA, 13 bp, Homo sapiens
aaagataaagatg

SEQ ID NO: 4000453 - DNA, 17 bp, Homo sapiens
aaagataatattactgt

SEQ ID NO: 4000454 - DNA, 22 bp, Homo sapiens
aaagatacgactttattttctg

SEQ ID NO: 4000455 - DNA, 21 bp, Homo sapiens
aaagatctgtcctcagccttg

SEQ ID NO: 4000456 - DNA, 16 bp, Homo sapiens
aaagatctgttttgaa

SEQ ID NO: 4000457 - DNA, 21 bp, Homo sapiens
aaagatctgttttgaaggcaa

SEQ ID NO: 4000458 - DNA, 18 bp, Homo sapiens
aaagatgctagaaaaatg

SEQ ID NO: 4000459 - DNA, 13 bp, Homo sapiens
aaagatggataaa

SEQ ID NO: 4000460 - DNA, 14 bp, Homo sapiens
aaagatggataaac

SEQ ID NO: 4000461 - DNA, 11 bp, Homo sapiens
aaagattaaac

SEQ ID NO: 4000462 - DNA, 23 bp, Homo sapiens
aaagattaatgtgtattaaaaca

SEQ ID NO: 4000463 - DNA, 13 bp, Homo sapiens
aaagattagcaag

SEQ ID NO: 4000464 - DNA, 21 bp, Homo sapiens
aaagatttaagcacaaacttt

SEQ ID NO: 4000465 - DNA, 18 bp, Homo sapiens
aaagattttattgtataa

SEQ ID NO: 4000466 - DNA, 15 bp, Homo sapiens
aaagattttatttat

SEQ ID NO: 4000467 - DNA, 13 bp, Homo sapiens
aaagattttcaga

SEQ ID NO: 4000468 - DNA, 14 bp, Homo sapiens
aaagattttcagaa

SEQ ID NO: 4000469 - DNA, 19 bp, Homo sapiens
aaagattttttttaatcta

SEQ ID NO: 4000470 - DNA, 13 bp, Homo sapiens
aaagcaaaaggca

SEQ ID NO: 4000471 - DNA, 15 bp, Homo sapiens
aaagcaaagaaaata

SEQ ID NO: 4000472 - DNA, 18 bp, Homo sapiens
aaagcaaatctacagatc

SEQ ID NO: 4000473 - DNA, 14 bp, Homo sapiens
aaagcaagactgtt

SEQ ID NO: 4000474 - DNA, 17 bp, Homo sapiens
aaagcaataaatgaatg

SEQ ID NO: 4000475 - DNA, 13 bp, Homo sapiens
aaagcaatctgat

SEQ ID NO: 4000476 - DNA, 22 bp, Homo sapiens
aaagcaccagcttctccaggct

SEQ ID NO: 4000477 - DNA, 14 bp, Homo sapiens
aaagcacggactct

SEQ ID NO: 4000478 - DNA, 16 bp, Homo sapiens
aaagcacgtgcaagga

SEQ ID NO: 4000479 - DNA, 18 bp, Homo sapiens
aaagcacttttgttattc

SEQ ID NO: 4000480 - DNA, 15 bp, Homo sapiens
aaagcagaattttaa

SEQ ID NO: 4000481 - DNA, 17 bp, Homo sapiens
aaagcagaattttaatg

SEQ ID NO: 4000482 - DNA, 20 bp, Homo sapiens
aaagcagaggcaacactgga

SEQ ID NO: 4000483 - DNA, 12 bp, Homo sapiens
aaagcagccacg

SEQ ID NO: 4000484 - DNA, 21 bp, Homo sapiens
aaagcaggatgtagttctgcc

SEQ ID NO: 4000485 - DNA, 21 bp, Homo sapiens
aaagcagtcctcttattccta

SEQ ID NO: 4000486 - DNA, 17 bp, Homo sapiens
aaagcatagatgttttg

SEQ ID NO: 4000487 - DNA, 18 bp, Homo sapiens
aaagcatgatgggaaaat

SEQ ID NO: 4000488 - DNA, 19 bp, Homo sapiens
aaagcatgatgggaaaata

SEQ ID NO: 4000489 - DNA, 20 bp, Homo sapiens
aaagcatgtggtcttatagt

SEQ ID NO: 4000490 - DNA, 17 bp, Homo sapiens
aaagcattgcttttatt

SEQ ID NO: 4000491 - DNA, 11 bp, Homo sapiens
aaagcattttt

SEQ ID NO: 4000492 - DNA, 13 bp, Homo sapiens
aaagcatttttca

SEQ ID NO: 4000493 - DNA, 23 bp, Homo sapiens
aaagccaacagtcaaaacagaga

SEQ ID NO: 4000494 - DNA, 17 bp, Homo sapiens
aaagccacaaggctggc

SEQ ID NO: 4000495 - DNA, 19 bp, Homo sapiens
aaagccacaaggctggcca

SEQ ID NO: 4000496 - DNA, 21 bp, Homo sapiens
aaagccacaaggctggccagc

SEQ ID NO: 4000497 - DNA, 20 bp, Homo sapiens
aaagccacattatttctagt

SEQ ID NO: 4000498 - DNA, 20 bp, Homo sapiens
aaagccacctctgtcatttg

SEQ ID NO: 4000499 - DNA, 13 bp, Homo sapiens
aaagccagtgaaa

SEQ ID NO: 4000500 - DNA, 19 bp, Homo sapiens
aaagccagtgaaatgtgaa

SEQ ID NO: 4000501 - DNA, 18 bp, Homo sapiens
aaagccattgaccaccca

SEQ ID NO: 4000502 - DNA, 23 bp, Homo sapiens
aaagcccattttcaactgctttg

SEQ ID NO: 4000503 - DNA, 17 bp, Homo sapiens
aaagccctcccccttcc

SEQ ID NO: 4000504 - DNA, 13 bp, Homo sapiens
aaagcctgcaatt

SEQ ID NO: 4000505 - DNA, 18 bp, Homo sapiens
aaagcctgggtgacattt

SEQ ID NO: 4000506 - DNA, 14 bp, Homo sapiens
aaagcctggttttt

SEQ ID NO: 4000507 - DNA, 22 bp, Homo sapiens
aaagcctgtaagcctgcaagcc

SEQ ID NO: 4000508 - DNA, 10 bp, Homo sapiens
aaagccttcc

SEQ ID NO: 4000509 - DNA, 18 bp, Homo sapiens
aaagccttgtgtatattt

SEQ ID NO: 4000510 - DNA, 23 bp, Homo sapiens
aaagccttgtgtatatttgtata

SEQ ID NO: 4000511 - DNA, 15 bp, Homo sapiens
aaagctattagccag

SEQ ID NO: 4000512 - DNA, 13 bp, Homo sapiens
aaagctcctgtcc

SEQ ID NO: 4000513 - DNA, 9 bp, Homo sapiens
aaagctggc

SEQ ID NO: 4000514 - DNA, 13 bp, Homo sapiens
aaagctggccctg

SEQ ID NO: 4000515 - DNA, 14 bp, Homo sapiens
aaagctggccctgc

SEQ ID NO: 4000516 - DNA, 17 bp, Homo sapiens
aaagctggccctgcctc

SEQ ID NO: 4000517 - DNA, 21 bp, Homo sapiens
aaagcttcagactcaagtacc

SEQ ID NO: 4000518 - DNA, 17 bp, Homo sapiens
aaagcttccatgattct

SEQ ID NO: 4000519 - DNA, 19 bp, Homo sapiens
aaagcttctatcccaggag

SEQ ID NO: 4000520 - DNA, 17 bp, Homo sapiens
aaagcttcttaattaat

SEQ ID NO: 4000521 - DNA, 18 bp, Homo sapiens
aaagctttattaccagtg

SEQ ID NO: 4000522 - DNA, 15 bp, Homo sapiens
aaagcttttagaaat

SEQ ID NO: 4000523 - DNA, 14 bp, Homo sapiens
aaaggaaaaataat

SEQ ID NO: 4000524 - DNA, 14 bp, Homo sapiens
aaaggaaaccaagt

SEQ ID NO: 4000525 - DNA, 14 bp, Homo sapiens
aaaggaagccaaag

SEQ ID NO: 4000526 - DNA, 24 bp, Homo sapiens
aaaggacaggaggaggagatggcc

SEQ ID NO: 4000527 - DNA, 19 bp, Homo sapiens
aaaggacgcctgcaggaga

SEQ ID NO: 4000528 - DNA, 21 bp, Homo sapiens
aaaggacgcctgcaggagaga

SEQ ID NO: 4000529 - DNA, 13 bp, Homo sapiens
aaaggactgtaat

SEQ ID NO: 4000530 - DNA, 22 bp, Homo sapiens
aaaggagcatttttttattcag

SEQ ID NO: 4000531 - DNA, 22 bp, Homo sapiens
aaaggagctcgaaggatattgt

SEQ ID NO: 4000532 - DNA, 21 bp, Homo sapiens
aaaggatagatcaaagtcaaa

SEQ ID NO: 4000533 - DNA, 13 bp, Homo sapiens
aaaggatatttaa

SEQ ID NO: 4000534 - DNA, 21 bp, Homo sapiens
aaaggatatttaagaaaatac

SEQ ID NO: 4000535 - DNA, 15 bp, Homo sapiens
aaaggatattttctt

SEQ ID NO: 4000536 - DNA, 14 bp, Homo sapiens
aaaggatgtgatat

SEQ ID NO: 4000537 - DNA, 19 bp, Homo sapiens
aaaggatgtgatatataag

SEQ ID NO: 4000538 - DNA, 13 bp, Homo sapiens
aaaggatgtgatt

SEQ ID NO: 4000539 - DNA, 18 bp, Homo sapiens
aaaggatgttttgtccca

SEQ ID NO: 4000540 - DNA, 23 bp, Homo sapiens
aaaggcagctcacccctgggcag

SEQ ID NO: 4000541 - DNA, 12 bp, Homo sapiens
aaaggcagctgt

SEQ ID NO: 4000542 - DNA, 15 bp, Homo sapiens
aaaggcatattgctt

SEQ ID NO: 4000543 - DNA, 12 bp, Homo sapiens
aaaggcccccta

SEQ ID NO: 4000544 - DNA, 21 bp, Homo sapiens
aaaggcgcagtgcttctctac

SEQ ID NO: 4000545 - DNA, 13 bp, Homo sapiens
aaaggctgccgag

SEQ ID NO: 4000546 - DNA, 18 bp, Homo sapiens
aaagggacacccctacac

SEQ ID NO: 4000547 - DNA, 23 bp, Homo sapiens
aaagggctggctccccctcccca

SEQ ID NO: 4000548 - DNA, 18 bp, Homo sapiens
aaaggggcagaaaaactc

SEQ ID NO: 4000549 - DNA, 14 bp, Homo sapiens
aaagggtgaagcta

SEQ ID NO: 4000550 - DNA, 15 bp, Homo sapiens
aaagggttgaaaatg

SEQ ID NO: 4000551 - DNA, 16 bp, Homo sapiens
aaaggtataattttat

SEQ ID NO: 4000552 - DNA, 20 bp, Homo sapiens
aaattcagtttttgtatctt

SEQ ID NO: 4000553 - DNA, 21 bp, Homo sapiens
aaattccagaaaggatattta

SEQ ID NO: 4000554 - DNA, 20 bp, Homo sapiens
aaattccagcaataagaaat

SEQ ID NO: 4000555 - DNA, 15 bp, Homo sapiens
aaattcgtgtgtttt

SEQ ID NO: 4000556 - DNA, 19 bp, Homo sapiens
aaattctataggaacatat

SEQ ID NO: 4000557 - DNA, 15 bp, Homo sapiens
aaattctatgttaaa

SEQ ID NO: 4000558 - DNA, 18 bp, Homo sapiens
aaattctatgttaaatac

SEQ ID NO: 4000559 - DNA, 20 bp, Homo sapiens
aaattctatgttaaatactg

SEQ ID NO: 4000560 - DNA, 13 bp, Homo sapiens
aaattctgattct

SEQ ID NO: 4000561 - DNA, 9 bp, Homo sapiens
aaattctgt

SEQ ID NO: 4000562 - DNA, 17 bp, Homo sapiens
aaattctgttaaaatct

SEQ ID NO: 4000563 - DNA, 19 bp, Homo sapiens
aaattctgttaaaatctat

SEQ ID NO: 4000564 - DNA, 12 bp, Homo sapiens
aaattgaaattg

SEQ ID NO: 4000565 - DNA, 12 bp, Homo sapiens
aaattgaagaga

SEQ ID NO: 4000566 - DNA, 13 bp, Homo sapiens
aaattgcaaatct

SEQ ID NO: 4000567 - DNA, 14 bp, Homo sapiens
aaattgcaaatctt

SEQ ID NO: 4000568 - DNA, 16 bp, Homo sapiens
aaattgcaacatatta

SEQ ID NO: 4000569 - DNA, 15 bp, Homo sapiens
aaattgcactaaatg

SEQ ID NO: 4000570 - DNA, 21 bp, Homo sapiens
aaattgccattggacagttgt

SEQ ID NO: 4000571 - DNA, 15 bp, Homo sapiens
aaattgcctgatttg

SEQ ID NO: 4000572 - DNA, 23 bp, Homo sapiens
aaattgctgtgctttatggatag

SEQ ID NO: 4000573 - DNA, 15 bp, Homo sapiens
aaattggcaccatgt

SEQ ID NO: 4000574 - DNA, 19 bp, Homo sapiens
aaattggggaggagggggc

SEQ ID NO: 4000575 - DNA, 13 bp, Homo sapiens
aaattgtcagcaa

SEQ ID NO: 4000576 - DNA, 19 bp, Homo sapiens
aaattgtgttgtcttcagc

SEQ ID NO: 4000577 - DNA, 13 bp, Homo sapiens
aaatttaaaatta

SEQ ID NO: 4000578 - DNA, 14 bp, Homo sapiens
aaatttaagcattg

SEQ ID NO: 4000579 - DNA, 16 bp, Homo sapiens
aaatttaagcattgtt

SEQ ID NO: 4000580 - DNA, 21 bp, Homo sapiens
aaatttaagtgcgtgtgtaga

SEQ ID NO: 4000581 - DNA, 12 bp, Homo sapiens
aaatttatcaaa

SEQ ID NO: 4000582 - DNA, 17 bp, Homo sapiens
aaatttatcaaagcata

SEQ ID NO: 4000583 - DNA, 19 bp, Homo sapiens
aaatttattttaatgtaaa

SEQ ID NO: 4000584 - DNA, 16 bp, Homo sapiens
aaatttctaagagagc

SEQ ID NO: 4000585 - DNA, 23 bp, Homo sapiens
aaatttctcatcacagggattta

SEQ ID NO: 4000586 - DNA, 15 bp, Homo sapiens
aaatttcttatgtga

SEQ ID NO: 4000587 - DNA, 17 bp, Homo sapiens
aaatttcttatgtgaca

SEQ ID NO: 4000588 - DNA, 15 bp, Homo sapiens
aaatttgattgattt

SEQ ID NO: 4000589 - DNA, 17 bp, Homo sapiens
aaatttgcaaaatcact

SEQ ID NO: 4000590 - DNA, 15 bp, Homo sapiens
aaatttggttctaat

SEQ ID NO: 4000591 - DNA, 19 bp, Homo sapiens
aaatttgtaagtttcaggt

SEQ ID NO: 4000592 - DNA, 22 bp, Homo sapiens
aaatttgtaagtttcaggtgac

SEQ ID NO: 4000593 - DNA, 17 bp, Homo sapiens
aaatttgtttaattaaa

SEQ ID NO: 4000594 - DNA, 18 bp, Homo sapiens
aaatttgtttgaaatctt

SEQ ID NO: 4000595 - DNA, 12 bp, Homo sapiens
aaattttaactg

SEQ ID NO: 4000596 - DNA, 18 bp, Homo sapiens
aaattttatttcctggac

SEQ ID NO: 4000597 - DNA, 13 bp, Homo sapiens
aaattttgcaaat

SEQ ID NO: 4000598 - DNA, 16 bp, Homo sapiens
aaattttgcaaatata

SEQ ID NO: 4000599 - DNA, 12 bp, Homo sapiens
aaattttggcca

SEQ ID NO: 4000600 - DNA, 12 bp, Homo sapiens
aaattttgtaag

SEQ ID NO: 4000601 - DNA, 14 bp, Homo sapiens
aaattttgtaagaa

SEQ ID NO: 4000602 - DNA, 20 bp, Homo sapiens
aaatttttcagatgcttctg

SEQ ID NO: 4000603 - DNA, 13 bp, Homo sapiens
aaattttttgact

SEQ ID NO: 4000604 - DNA, 15 bp, Homo sapiens
aaattttttttacat

SEQ ID NO: 4000605 - DNA, 16 bp, Homo sapiens
aaattttttttacatt

SEQ ID NO: 4000606 - DNA, 21 bp, Homo sapiens
aacaaaaagttttttttttgt

SEQ ID NO: 4000607 - DNA, 21 bp, Homo sapiens
aacaaaattttattttgtgct

SEQ ID NO: 4000608 - DNA, 17 bp, Homo sapiens
aacaaacagatgctctg

SEQ ID NO: 4000609 - DNA, 11 bp, Homo sapiens
aacaaaccatc

SEQ ID NO: 4000610 - DNA, 18 bp, Homo sapiens
aacaaacgtgttttttaa

SEQ ID NO: 4000611 - DNA, 23 bp, Homo sapiens
aacaaactaaaaatattcctcca

SEQ ID NO: 4000612 - DNA, 14 bp, Homo sapiens
aacaaagcagccac

SEQ ID NO: 4000613 - DNA, 20 bp, Homo sapiens
aacaaagtgactgtttggct

SEQ ID NO: 4000614 - DNA, 23 bp, Homo sapiens
aacaaagttactaggtaacttca

SEQ ID NO: 4000615 - DNA, 13 bp, Homo sapiens
aacaaatatgcaa

SEQ ID NO: 4000616 - DNA, 18 bp, Homo sapiens
aacaaattcatattctgt

SEQ ID NO: 4000617 - DNA, 19 bp, Homo sapiens
aacaacaattggtaaaact

SEQ ID NO: 4000618 - DNA, 20 bp, Homo sapiens
aacaagagtttgttctgttc

SEQ ID NO: 4000619 - DNA, 23 bp, Homo sapiens
aacaagagtttgttctgttctgg

SEQ ID NO: 4000620 - DNA, 16 bp, Homo sapiens
aacaaggcttgctgca

SEQ ID NO: 4000621 - DNA, 16 bp, Homo sapiens
aacaaggtagttttta

SEQ ID NO: 4000622 - DNA, 21 bp, Homo sapiens
aacaagtgaaataacaaaatg

SEQ ID NO: 4000623 - DNA, 15 bp, Homo sapiens
aacaataaatgtgca

SEQ ID NO: 4000624 - DNA, 19 bp, Homo sapiens
aacaataaatgttggcttg

SEQ ID NO: 4000625 - DNA, 15 bp, Homo sapiens
aacaatacaaatgga

SEQ ID NO: 4000626 - DNA, 18 bp, Homo sapiens
aacaataggctgttccca

SEQ ID NO: 4000627 - DNA, 18 bp, Homo sapiens
aacaatgaaaactctttg

SEQ ID NO: 4000628 - DNA, 18 bp, Homo sapiens
aacaatgaagataaaaag

SEQ ID NO: 4000629 - DNA, 19 bp, Homo sapiens
aacaatgacactagaaaac

SEQ ID NO: 4000630 - DNA, 19 bp, Homo sapiens
aacaatgcagcaaggccct

SEQ ID NO: 4000631 - DNA, 21 bp, Homo sapiens
aacaatgttaaggaaactctt

SEQ ID NO: 4000632 - DNA, 20 bp, Homo sapiens
aacaattcatgcctttcata

SEQ ID NO: 4000633 - DNA, 16 bp, Homo sapiens
aacaattgaagtaaac

SEQ ID NO: 4000634 - DNA, 23 bp, Homo sapiens
aacaattgaagtaaactttttgt

SEQ ID NO: 4000635 - DNA, 16 bp, Homo sapiens
aacaattggtaaaact

SEQ ID NO: 4000636 - DNA, 23 bp, Homo sapiens
aacaattggtaaaactcactgtg

SEQ ID NO: 4000637 - DNA, 22 bp, Homo sapiens
aacaattgtgtagcctttttgt

SEQ ID NO: 4000638 - DNA, 13 bp, Homo sapiens
aacacaaactgta

SEQ ID NO: 4000639 - DNA, 22 bp, Homo sapiens
aacacagagaagcggatttcca

SEQ ID NO: 4000640 - DNA, 16 bp, Homo sapiens
aacacagcatgtgtat

SEQ ID NO: 4000641 - DNA, 20 bp, Homo sapiens
aacacagcttacaatcgcaa

SEQ ID NO: 4000642 - DNA, 22 bp, Homo sapiens
aacacataaacaattcatgcct

SEQ ID NO: 4000643 - DNA, 21 bp, Homo sapiens
aacacatacaggaaggtagaa

SEQ ID NO: 4000644 - DNA, 15 bp, Homo sapiens
aacacattatgtatc

SEQ ID NO: 4000645 - DNA, 18 bp, Homo sapiens
aacacatttgattctgtg

SEQ ID NO: 4000646 - DNA, 21 bp, Homo sapiens
aacaccaagcacagcagcctg

SEQ ID NO: 4000647 - DNA, 13 bp, Homo sapiens
aacaccacagaca

SEQ ID NO: 4000648 - DNA, 14 bp, Homo sapiens
aacaccacagacac

SEQ ID NO: 4000649 - DNA, 18 bp, Homo sapiens
aacaccacagacacacac

SEQ ID NO: 4000650 - DNA, 23 bp, Homo sapiens
aacaccacagacacacacacgca

SEQ ID NO: 4000651 - DNA, 20 bp, Homo sapiens
aacacccttagaaaatgtgt

SEQ ID NO: 4000652 - DNA, 15 bp, Homo sapiens
aacacctgacacatc

SEQ ID NO: 4000653 - DNA, 17 bp, Homo sapiens
aacacctgacacatctt

SEQ ID NO: 4000654 - DNA, 18 bp, Homo sapiens
aacacctgacagcccctc

SEQ ID NO: 4000655 - DNA, 18 bp, Homo sapiens
aagaaaaaaaataacaca

SEQ ID NO: 4000656 - DNA, 20 bp, Homo sapiens
aagaaaaaaactataaatac

SEQ ID NO: 4000657 - DNA, 17 bp, Homo sapiens
aagaaaaagcaaaaggc

SEQ ID NO: 4000658 - DNA, 12 bp, Homo sapiens
aagaaaacaaaa

SEQ ID NO: 4000659 - DNA, 14 bp, Homo sapiens
aagaaaacaacttc

SEQ ID NO: 4000660 - DNA, 11 bp, Homo sapiens
aagaaaagata

SEQ ID NO: 4000661 - DNA, 12 bp, Homo sapiens
aagaaaagcact

SEQ ID NO: 4000662 - DNA, 16 bp, Homo sapiens
aagaaaagcacttttg

SEQ ID NO: 4000663 - DNA, 18 bp, Homo sapiens
aagaaaagcacttttgtt

SEQ ID NO: 4000664 - DNA, 14 bp, Homo sapiens
aagaaaagtatttt

SEQ ID NO: 4000665 - DNA, 21 bp, Homo sapiens
aagaaaagtattttgaagttt

SEQ ID NO: 4000666 - DNA, 23 bp, Homo sapiens
aagaaaagtattttgaagtttac

SEQ ID NO: 4000667 - DNA, 17 bp, Homo sapiens
aagaaaatacaataaac

SEQ ID NO: 4000668 - DNA, 19 bp, Homo sapiens
aagaaaatacataagacca

SEQ ID NO: 4000669 - DNA, 14 bp, Homo sapiens
aagaaacagccagc

SEQ ID NO: 4000670 - DNA, 17 bp, Homo sapiens
aagaaaccttgctctcc

SEQ ID NO: 4000671 - DNA, 20 bp, Homo sapiens
aagaaactatgaagatctga

SEQ ID NO: 4000672 - DNA, 15 bp, Homo sapiens
aagaaagaaggaagt

SEQ ID NO: 4000673 - DNA, 20 bp, Homo sapiens
aagaaagactatctaaatgt

SEQ ID NO: 4000674 - DNA, 22 bp, Homo sapiens
aagaaagactatctaaatgttg

SEQ ID NO: 4000675 - DNA, 16 bp, Homo sapiens
aagaaagtgttttatt

SEQ ID NO: 4000676 - DNA, 21 bp, Homo sapiens
aagaaataaaaggaagccaaa

SEQ ID NO: 4000677 - DNA, 13 bp, Homo sapiens
aagaaatatgtga

SEQ ID NO: 4000678 - DNA, 15 bp, Homo sapiens
aagaaatatgtgaga

SEQ ID NO: 4000679 - DNA, 17 bp, Homo sapiens
aagaaatatttacctaa

SEQ ID NO: 4000680 - DNA, 16 bp, Homo sapiens
aagaaatcatgtccat

SEQ ID NO: 4000681 - DNA, 23 bp, Homo sapiens
aagaaatccctgtttaatattta

SEQ ID NO: 4000682 - DNA, 16 bp, Homo sapiens
aagaaatgaacaaaag

SEQ ID NO: 4000683 - DNA, 16 bp, Homo sapiens
aagaaatgactaatta

SEQ ID NO: 4000684 - DNA, 20 bp, Homo sapiens
aagaaattaggggttaaagc

SEQ ID NO: 4000685 - DNA, 15 bp, Homo sapiens
aagaaatttgcagtt

SEQ ID NO: 4000686 - DNA, 15 bp, Homo sapiens
aagaaattttttaaa

SEQ ID NO: 4000687 - DNA, 21 bp, Homo sapiens
aagaacaaagagaaaaaatac

SEQ ID NO: 4000688 - DNA, 14 bp, Homo sapiens
aagaacaagaattt

SEQ ID NO: 4000689 - DNA, 21 bp, Homo sapiens
aagaacatggacttgtatatt

SEQ ID NO: 4000690 - DNA, 21 bp, Homo sapiens
aagaaccctctgtcccacccc

SEQ ID NO: 4000691 - DNA, 14 bp, Homo sapiens
aagaacctggaact

SEQ ID NO: 4000692 - DNA, 22 bp, Homo sapiens
aagaactacccccttttcagct

SEQ ID NO: 4000693 - DNA, 11 bp, Homo sapiens
aagaactgcat

SEQ ID NO: 4000694 - DNA, 18 bp, Homo sapiens
aagaactgcatggaccta

SEQ ID NO: 4000695 - DNA, 13 bp, Homo sapiens
aagaacttcattt

SEQ ID NO: 4000696 - DNA, 12 bp, Homo sapiens
aagaagaaaaag

SEQ ID NO: 4000697 - DNA, 14 bp, Homo sapiens
aagaagaaaaaggt

SEQ ID NO: 4000698 - DNA, 11 bp, Homo sapiens
aagaagacata

SEQ ID NO: 4000699 - DNA, 14 bp, Homo sapiens
aagaagagaagctg

SEQ ID NO: 4000700 - DNA, 17 bp, Homo sapiens
aagaagatgttgaagaa

SEQ ID NO: 4000701 - DNA, 19 bp, Homo sapiens
aagaagccacagacctagg

SEQ ID NO: 4000702 - DNA, 11 bp, Homo sapiens
aagaagccata

SEQ ID NO: 4000703 - DNA, 16 bp, Homo sapiens
aagaagcccccagcta

SEQ ID NO: 4000704 - DNA, 18 bp, Homo sapiens
aagaagctgttgtacatt

SEQ ID NO: 4000705 - DNA, 23 bp, Homo sapiens
aagaagctgttgtacatttatga

SEQ ID NO: 4000706 - DNA, 17 bp, Homo sapiens
aagaagggagaagaaag

SEQ ID NO: 4000707 - DNA, 18 bp, Homo sapiens
aagaaggtggacctttta

SEQ ID NO: 4000708 - DNA, 20 bp, Homo sapiens
aagaagtggctgccacaccc

SEQ ID NO: 4000709 - DNA, 18 bp, Homo sapiens
aagaagtgtccgagaact

SEQ ID NO: 4000710 - DNA, 19 bp, Homo sapiens
aagaagtgtccgagaacta

SEQ ID NO: 4000711 - DNA, 19 bp, Homo sapiens
aagaagttactttgtaatt

SEQ ID NO: 4000712 - DNA, 19 bp, Homo sapiens
aagaagtttattctcattt

SEQ ID NO: 4000713 - DNA, 14 bp, Homo sapiens
aagaatacagaaag

SEQ ID NO: 4000714 - DNA, 13 bp, Homo sapiens
aagaatagaaaca

SEQ ID NO: 4000715 - DNA, 15 bp, Homo sapiens
aagaatagaaacaag

SEQ ID NO: 4000716 - DNA, 18 bp, Homo sapiens
aagaatatgtttccttgt

SEQ ID NO: 4000717 - DNA, 13 bp, Homo sapiens
aagaatattcagg

SEQ ID NO: 4000718 - DNA, 16 bp, Homo sapiens
aagaatatttaagaaa

SEQ ID NO: 4000719 - DNA, 22 bp, Homo sapiens
aagaatatttaagaaaagcact

SEQ ID NO: 4000720 - DNA, 16 bp, Homo sapiens
aagaatcagagtagaa

SEQ ID NO: 4000721 - DNA, 18 bp, Homo sapiens
aagaatgactatataatt

SEQ ID NO: 4000722 - DNA, 19 bp, Homo sapiens
aagaatgctggttttccta

SEQ ID NO: 4000723 - DNA, 12 bp, Homo sapiens
aagaattaatga

SEQ ID NO: 4000724 - DNA, 14 bp, Homo sapiens
aagaattatttttg

SEQ ID NO: 4000725 - DNA, 17 bp, Homo sapiens
aagaattatttttgtgt

SEQ ID NO: 4000726 - DNA, 22 bp, Homo sapiens
aagaattatttttgtgtttcta

SEQ ID NO: 4000727 - DNA, 12 bp, Homo sapiens
aagaattcttat

SEQ ID NO: 4000728 - DNA, 20 bp, Homo sapiens
aagaattgaccatctgcttt

SEQ ID NO: 4000729 - DNA, 21 bp, Homo sapiens
aagaattgaccatctgctttt

SEQ ID NO: 4000730 - DNA, 23 bp, Homo sapiens
aagaattgccaatcttgttttaa

SEQ ID NO: 4000731 - DNA, 13 bp, Homo sapiens
aagaatttttaaa

SEQ ID NO: 4000732 - DNA, 16 bp, Homo sapiens
aagacaaaagtctgtc

SEQ ID NO: 4000733 - DNA, 22 bp, Homo sapiens
aagacaaaagtctgtctttcct

SEQ ID NO: 4000734 - DNA, 23 bp, Homo sapiens
aagacaatgatattgacactgtc

SEQ ID NO: 4000735 - DNA, 17 bp, Homo sapiens
aagacaatttgatacat

SEQ ID NO: 4000736 - DNA, 20 bp, Homo sapiens
aagacaatttgatacataat

SEQ ID NO: 4000737 - DNA, 21 bp, Homo sapiens
aagacaccagagcagatgcag

SEQ ID NO: 4000738 - DNA, 23 bp, Homo sapiens
aagacaccagagcagatgcagag

SEQ ID NO: 4000739 - DNA, 13 bp, Homo sapiens
aagacagaaaagt

SEQ ID NO: 4000740 - DNA, 14 bp, Homo sapiens
aagacagaaaagtg

SEQ ID NO: 4000741 - DNA, 15 bp, Homo sapiens
aagacagaatggtgg

SEQ ID NO: 4000742 - DNA, 21 bp, Homo sapiens
aagacagagacgcaggaatgg

SEQ ID NO: 4000743 - DNA, 22 bp, Homo sapiens
aagacagatgccccagagctgt

SEQ ID NO: 4000744 - DNA, 20 bp, Homo sapiens
aagacataacgtttttcctt

SEQ ID NO: 4000745 - DNA, 21 bp, Homo sapiens
aagacataacgtttttccttt

SEQ ID NO: 4000746 - DNA, 23 bp, Homo sapiens
aagacatactgcttgattttaat

SEQ ID NO: 4000747 - DNA, 14 bp, Homo sapiens
aagacatgatttcc

SEQ ID NO: 4000748 - DNA, 20 bp, Homo sapiens
aagacatgatttccttgaat

SEQ ID NO: 4000749 - DNA, 21 bp, Homo sapiens
aagacatgatttccttgaatg

SEQ ID NO: 4000750 - DNA, 19 bp, Homo sapiens
aagacatggagactcctgc

SEQ ID NO: 4000751 - DNA, 19 bp, Homo sapiens
aagacatgtgaggaggaaa

SEQ ID NO: 4000752 - DNA, 20 bp, Homo sapiens
aagacatgtgaggaggaaaa

SEQ ID NO: 4000753 - DNA, 23 bp, Homo sapiens
aagacatgtgaggaggaaaagga

SEQ ID NO: 4000754 - DNA, 21 bp, Homo sapiens
aagacattcttccaaaaagat

SEQ ID NO: 4000755 - DNA, 12 bp, Homo sapiens
aagacatttctt

SEQ ID NO: 4000756 - DNA, 15 bp, Homo sapiens
aagacatttcttttc

SEQ ID NO: 4000757 - DNA, 17 bp, Homo sapiens
aagacattttttgctat

SEQ ID NO: 4000758 - DNA, 21 bp, Homo sapiens
aagatggataaactgagcctc

SEQ ID NO: 4000759 - DNA, 14 bp, Homo sapiens
aagatggattctca

SEQ ID NO: 4000760 - DNA, 23 bp, Homo sapiens
aagatgggggcagggctgtgctt

SEQ ID NO: 4000761 - DNA, 15 bp, Homo sapiens
aagatggtccatttg

SEQ ID NO: 4000762 - DNA, 20 bp, Homo sapiens
aagatggtccatttgttcct

SEQ ID NO: 4000763 - DNA, 22 bp, Homo sapiens
aagatggtccatttgttcctgc

SEQ ID NO: 4000764 - DNA, 16 bp, Homo sapiens
aagatgtcaaagatat

SEQ ID NO: 4000765 - DNA, 11 bp, Homo sapiens
aagatgtgaat

SEQ ID NO: 4000766 - DNA, 12 bp, Homo sapiens
aagatgtgaatt

SEQ ID NO: 4000767 - DNA, 13 bp, Homo sapiens
aagatgtgaatta

SEQ ID NO: 4000768 - DNA, 15 bp, Homo sapiens
aagatgtgaattatt

SEQ ID NO: 4000769 - DNA, 18 bp, Homo sapiens
aagatgtgaattattgac

SEQ ID NO: 4000770 - DNA, 24 bp, Homo sapiens
aagattagcaaggtcatttcttca

SEQ ID NO: 4000771 - DNA, 18 bp, Homo sapiens
aagattaggagaaacaca

SEQ ID NO: 4000772 - DNA, 21 bp, Homo sapiens
aagattcacacatgcctatat

SEQ ID NO: 4000773 - DNA, 19 bp, Homo sapiens
aagattgcttaataaattg

SEQ ID NO: 4000774 - DNA, 21 bp, Homo sapiens
aagatttaagcacaaacttta

SEQ ID NO: 4000775 - DNA, 22 bp, Homo sapiens
aagatttgatgctggagaggtt

SEQ ID NO: 4000776 - DNA, 13 bp, Homo sapiens
aagattttaaatt

SEQ ID NO: 4000777 - DNA, 13 bp, Homo sapiens
aagattttattta

SEQ ID NO: 4000778 - DNA, 22 bp, Homo sapiens
aagattttatttatggaattaa

SEQ ID NO: 4000779 - DNA, 19 bp, Homo sapiens
aagattttgaaatttttat

SEQ ID NO: 4000780 - DNA, 15 bp, Homo sapiens
aagattttgaatgct

SEQ ID NO: 4000781 - DNA, 21 bp, Homo sapiens
aagattttgaatgcttcctga

SEQ ID NO: 4000782 - DNA, 21 bp, Homo sapiens
aagattttggaggagaaggac

SEQ ID NO: 4000783 - DNA, 15 bp, Homo sapiens
aagatttttctcaaa

SEQ ID NO: 4000784 - DNA, 19 bp, Homo sapiens
aagatttttctcaaagttt

SEQ ID NO: 4000785 - DNA, 20 bp, Homo sapiens
aagatttttctcaaagtttt

SEQ ID NO: 4000786 - DNA, 13 bp, Homo sapiens
aagcaaaagaaaa

SEQ ID NO: 4000787 - DNA, 14 bp, Homo sapiens
aagcaaaatattat

SEQ ID NO: 4000788 - DNA, 11 bp, Homo sapiens
aagcaaaggtg

SEQ ID NO: 4000789 - DNA, 16 bp, Homo sapiens
aagcaaatgcattcta

SEQ ID NO: 4000790 - DNA, 14 bp, Homo sapiens
aagcaaattgatga

SEQ ID NO: 4000791 - DNA, 14 bp, Homo sapiens
aagcaacaggtttt

SEQ ID NO: 4000792 - DNA, 13 bp, Homo sapiens
aagcaacatttgt

SEQ ID NO: 4000793 - DNA, 21 bp, Homo sapiens
aagcaacatttgtatggattt

SEQ ID NO: 4000794 - DNA, 12 bp, Homo sapiens
aagcaagccaga

SEQ ID NO: 4000795 - DNA, 22 bp, Homo sapiens
aagcaagggagaaaagagaaac

SEQ ID NO: 4000796 - DNA, 14 bp, Homo sapiens
aagcaataaatgaa

SEQ ID NO: 4000797 - DNA, 15 bp, Homo sapiens
aagcaatccacctgc

SEQ ID NO: 4000798 - DNA, 19 bp, Homo sapiens
aagcaatccacctgccttg

SEQ ID NO: 4000799 - DNA, 17 bp, Homo sapiens
aagcaattatttttaaa

SEQ ID NO: 4000800 - DNA, 15 bp, Homo sapiens
aagcaatttcttgct

SEQ ID NO: 4000801 - DNA, 17 bp, Homo sapiens
aagcacagagcctggcc

SEQ ID NO: 4000802 - DNA, 21 bp, Homo sapiens
aagcacagagcctggccccag

SEQ ID NO: 4000803 - DNA, 11 bp, Homo sapiens
aagcacagcag

SEQ ID NO: 4000804 - DNA, 16 bp, Homo sapiens
aagcacagcagcctgg

SEQ ID NO: 4000805 - DNA, 11 bp, Homo sapiens
aagcacataca

SEQ ID NO: 4000806 - DNA, 12 bp, Homo sapiens
aagcacatacat

SEQ ID NO: 4000807 - DNA, 16 bp, Homo sapiens
aagcacatacattaaa

SEQ ID NO: 4000808 - DNA, 18 bp, Homo sapiens
aagcacatacattaaaac

SEQ ID NO: 4000809 - DNA, 22 bp, Homo sapiens
aagcacctgttaataaaggtct

SEQ ID NO: 4000810 - DNA, 14 bp, Homo sapiens
aagcacgtgcaagg

SEQ ID NO: 4000811 - DNA, 19 bp, Homo sapiens
aagcactacaccttgcctt

SEQ ID NO: 4000812 - DNA, 17 bp, Homo sapiens
aagcactcttaaagcaa

SEQ ID NO: 4000813 - DNA, 18 bp, Homo sapiens
aagcactttaatggcctg

SEQ ID NO: 4000814 - DNA, 21 bp, Homo sapiens
aagcactttaatggcctggag

SEQ ID NO: 4000815 - DNA, 19 bp, Homo sapiens
aagcagaaaataaaggaag

SEQ ID NO: 4000816 - DNA, 21 bp, Homo sapiens
aagcagaattttaatgtgaag

SEQ ID NO: 4000817 - DNA, 14 bp, Homo sapiens
aagcagcatggaaa

SEQ ID NO: 4000818 - DNA, 15 bp, Homo sapiens
aagcagcatggaaaa

SEQ ID NO: 4000819 - DNA, 19 bp, Homo sapiens
aagcagcatggaaaaatgg

SEQ ID NO: 4000820 - DNA, 19 bp, Homo sapiens
aagcagcgaccgccccctc

SEQ ID NO: 4000821 - DNA, 13 bp, Homo sapiens
aagcagcgggcta

SEQ ID NO: 4000822 - DNA, 16 bp, Homo sapiens
aagcagctgaagaaaa

SEQ ID NO: 4000823 - DNA, 15 bp, Homo sapiens
aagcaggaattatgt

SEQ ID NO: 4000824 - DNA, 13 bp, Homo sapiens
aagcaggacctgg

SEQ ID NO: 4000825 - DNA, 15 bp, Homo sapiens
aagcaggacctggca

SEQ ID NO: 4000826 - DNA, 16 bp, Homo sapiens
aagcaggacctggcat

SEQ ID NO: 4000827 - DNA, 22 bp, Homo sapiens
aagcagggaatttctatctaaa

SEQ ID NO: 4000828 - DNA, 20 bp, Homo sapiens
aagcaggtggatctatttca

SEQ ID NO: 4000829 - DNA, 14 bp, Homo sapiens
aagcagtaaaaact

SEQ ID NO: 4000830 - DNA, 15 bp, Homo sapiens
aagcagtgccttcca

SEQ ID NO: 4000831 - DNA, 18 bp, Homo sapiens
aagcagtgccttccataa

SEQ ID NO: 4000832 - DNA, 20 bp, Homo sapiens
aagcagtgccttccataatt

SEQ ID NO: 4000833 - DNA, 23 bp, Homo sapiens
aagcatacatgcaaaaagaaatg

SEQ ID NO: 4000834 - DNA, 15 bp, Homo sapiens
aagcatagatgtttt

SEQ ID NO: 4000835 - DNA, 15 bp, Homo sapiens
aagcatatagagatg

SEQ ID NO: 4000836 - DNA, 19 bp, Homo sapiens
aagcatccatgtgtggact

SEQ ID NO: 4000837 - DNA, 12 bp, Homo sapiens
aagcatgaacag

SEQ ID NO: 4000838 - DNA, 20 bp, Homo sapiens
aagcatgaacagtgcacctg

SEQ ID NO: 4000839 - DNA, 22 bp, Homo sapiens
aagcatgatgggaaaatatttc

SEQ ID NO: 4000840 - DNA, 13 bp, Homo sapiens
aagcatgtggcat

SEQ ID NO: 4000841 - DNA, 19 bp, Homo sapiens
aagcatgtggcatgttcat

SEQ ID NO: 4000842 - DNA, 18 bp, Homo sapiens
aagcattaccactcaggc

SEQ ID NO: 4000843 - DNA, 14 bp, Homo sapiens
aagcattccttctt

SEQ ID NO: 4000844 - DNA, 23 bp, Homo sapiens
aagcattccttctttgataatgt

SEQ ID NO: 4000845 - DNA, 13 bp, Homo sapiens
aagcattgaaatt

SEQ ID NO: 4000846 - DNA, 14 bp, Homo sapiens
aagcattgaaatta

SEQ ID NO: 4000847 - DNA, 14 bp, Homo sapiens
aagcattgtttgct

SEQ ID NO: 4000848 - DNA, 23 bp, Homo sapiens
aagcattgtttgcttattgttcc

SEQ ID NO: 4000849 - DNA, 13 bp, Homo sapiens
aagccaaagaaaa

SEQ ID NO: 4000850 - DNA, 21 bp, Homo sapiens
aagccaaagaaaaataaccct

SEQ ID NO: 4000851 - DNA, 14 bp, Homo sapiens
aagccaaatttatc

SEQ ID NO: 4000852 - DNA, 16 bp, Homo sapiens
aagccaaatttatcaa

SEQ ID NO: 4000853 - DNA, 16 bp, Homo sapiens
aagccaacttgtaaat

SEQ ID NO: 4000854 - DNA, 20 bp, Homo sapiens
aagccaagcaaaccaatggt

SEQ ID NO: 4000855 - DNA, 14 bp, Homo sapiens
aagccaagggaaag

SEQ ID NO: 4000856 - DNA, 15 bp, Homo sapiens
aagccacaaggctgg

SEQ ID NO: 4000857 - DNA, 16 bp, Homo sapiens
aagccacccaaagcag

SEQ ID NO: 4000858 - DNA, 13 bp, Homo sapiens
aagccacctctcc

SEQ ID NO: 4000859 - DNA, 22 bp, Homo sapiens
aagccacgctgtcctctcgagc

SEQ ID NO: 4000860 - DNA, 21 bp, Homo sapiens
aagccagacctagcaggctgt

SEQ ID NO: 4000861 - DNA, 16 bp, Homo sapiens
aaggaagccttgctca

SEQ ID NO: 4000862 - DNA, 16 bp, Homo sapiens
aaggaagctccactgt

SEQ ID NO: 4000863 - DNA, 11 bp, Homo sapiens
aaggaaggaaa

SEQ ID NO: 4000864 - DNA, 12 bp, Homo sapiens
aaggaaggaaag

SEQ ID NO: 4000865 - DNA, 14 bp, Homo sapiens
aaggaagtgaagag

SEQ ID NO: 4000866 - DNA, 14 bp, Homo sapiens
aaggaagtggggtg

SEQ ID NO: 4000867 - DNA, 18 bp, Homo sapiens
aaggaatcattccagtgc

SEQ ID NO: 4000868 - DNA, 16 bp, Homo sapiens
aaggacaggaagctgg

SEQ ID NO: 4000869 - DNA, 17 bp, Homo sapiens
aaggacatcagcaaaca

SEQ ID NO: 4000870 - DNA, 18 bp, Homo sapiens
aaggacattgccccaaga

SEQ ID NO: 4000871 - DNA, 19 bp, Homo sapiens
aaggaccacattttatatt

SEQ ID NO: 4000872 - DNA, 19 bp, Homo sapiens
aaggacgcctgcaggagag

SEQ ID NO: 4000873 - DNA, 16 bp, Homo sapiens
aaggacgtgtgtaaat

SEQ ID NO: 4000874 - DNA, 18 bp, Homo sapiens
aaggactcccggagcctg

SEQ ID NO: 4000875 - DNA, 22 bp, Homo sapiens
aaggactcccggagcctgtgca

SEQ ID NO: 4000876 - DNA, 23 bp, Homo sapiens
aaggactcccggagcctgtgcag

SEQ ID NO: 4000877 - DNA, 21 bp, Homo sapiens
aaggactgagcaccctctgga

SEQ ID NO: 4000878 - DNA, 13 bp, Homo sapiens
aaggactgaggga

SEQ ID NO: 4000879 - DNA, 17 bp, Homo sapiens
aaggactgagggactct

SEQ ID NO: 4000880 - DNA, 13 bp, Homo sapiens
aaggacttctgca

SEQ ID NO: 4000881 - DNA, 22 bp, Homo sapiens
aaggacttgaaagcatccatgt

SEQ ID NO: 4000882 - DNA, 15 bp, Homo sapiens
aaggagaaccagcac

SEQ ID NO: 4000883 - DNA, 18 bp, Homo sapiens
aaggagatgtcttggaac

SEQ ID NO: 4000884 - DNA, 23 bp, Homo sapiens
aaggagcatttttttattcagca

SEQ ID NO: 4000885 - DNA, 18 bp, Homo sapiens
aaggaggctccaggcagc

SEQ ID NO: 4000886 - DNA, 19 bp, Homo sapiens
aaggagggtacagctgggc

SEQ ID NO: 4000887 - DNA, 17 bp, Homo sapiens
aaggagtcaaaactaca

SEQ ID NO: 4000888 - DNA, 20 bp, Homo sapiens
aaggagtcagacattttaag

SEQ ID NO: 4000889 - DNA, 19 bp, Homo sapiens
aaggagtgagatcattttc

SEQ ID NO: 4000890 - DNA, 13 bp, Homo sapiens
aaggagttaagag

SEQ ID NO: 4000891 - DNA, 22 bp, Homo sapiens
aaggagttacagggaagtggtc

SEQ ID NO: 4000892 - DNA, 20 bp, Homo sapiens
aaggagttccatgaagacca

SEQ ID NO: 4000893 - DNA, 19 bp, Homo sapiens
aaggatagatcaaagtcaa

SEQ ID NO: 4000894 - DNA, 20 bp, Homo sapiens
aaggatagatgctggcccag

SEQ ID NO: 4000895 - DNA, 19 bp, Homo sapiens
aaggatatttaagaaaata

SEQ ID NO: 4000896 - DNA, 13 bp, Homo sapiens
aaggatccaagac

SEQ ID NO: 4000897 - DNA, 17 bp, Homo sapiens
aaggatcggactctgcc

SEQ ID NO: 4000898 - DNA, 15 bp, Homo sapiens
aaggatgtgattgtg

SEQ ID NO: 4000899 - DNA, 17 bp, Homo sapiens
aaggatgtgattgtgga

SEQ ID NO: 4000900 - DNA, 22 bp, Homo sapiens
aaggatgtgattgtggaatgga

SEQ ID NO: 4000901 - DNA, 13 bp, Homo sapiens
aaggattgtaaaa

SEQ ID NO: 4000902 - DNA, 23 bp, Homo sapiens
aaggcaaaaaactcttaatctgt

SEQ ID NO: 4000903 - DNA, 14 bp, Homo sapiens
aaggcaaaattgca

SEQ ID NO: 4000904 - DNA, 13 bp, Homo sapiens
aaggcaagagggg

SEQ ID NO: 4000905 - DNA, 17 bp, Homo sapiens
aaggcaagtgcaataat

SEQ ID NO: 4000906 - DNA, 17 bp, Homo sapiens
aaggcaatattaaccta

SEQ ID NO: 4000907 - DNA, 14 bp, Homo sapiens
aaggcagacagcag

SEQ ID NO: 4000908 - DNA, 22 bp, Homo sapiens
aaggcagctcacccctgggcag

SEQ ID NO: 4000909 - DNA, 18 bp, Homo sapiens
aaggcagctgttgtctct

SEQ ID NO: 4000910 - DNA, 22 bp, Homo sapiens
aaggcagggcccttggggctgg

SEQ ID NO: 4000911 - DNA, 22 bp, Homo sapiens
aaggcaggttggatgggagtgg

SEQ ID NO: 4000912 - DNA, 23 bp, Homo sapiens
aaggcagtagaactccaggccct

SEQ ID NO: 4000913 - DNA, 21 bp, Homo sapiens
aaggcatacgagagcagaggt

SEQ ID NO: 4000914 - DNA, 22 bp, Homo sapiens
aaggcatacgagagcagaggtc

SEQ ID NO: 4000915 - DNA, 23 bp, Homo sapiens
aaggcatcagtccccctgtgcat

SEQ ID NO: 4000916 - DNA, 13 bp, Homo sapiens
aaggcatgagaaa

SEQ ID NO: 4000917 - DNA, 20 bp, Homo sapiens
aaggccagagtggcctggcc

SEQ ID NO: 4000918 - DNA, 21 bp, Homo sapiens
aaggccagagtggcctggcca

SEQ ID NO: 4000919 - DNA, 23 bp, Homo sapiens
aaggccagagtggcctggccagg

SEQ ID NO: 4000920 - DNA, 15 bp, Homo sapiens
aaggccagcaacatt

SEQ ID NO: 4000921 - DNA, 22 bp, Homo sapiens
aaggccatctgggctcctccag

SEQ ID NO: 4000922 - DNA, 15 bp, Homo sapiens
aaggcccaagagcag

SEQ ID NO: 4000923 - DNA, 14 bp, Homo sapiens
aaggccccctacgc

SEQ ID NO: 4000924 - DNA, 21 bp, Homo sapiens
aaggcctccctcaggctctgt

SEQ ID NO: 4000925 - DNA, 21 bp, Homo sapiens
aaggcctcttgtaaagactgg

SEQ ID NO: 4000926 - DNA, 13 bp, Homo sapiens
aaggctaaaaagt

SEQ ID NO: 4000927 - DNA, 13 bp, Homo sapiens
aaggctctcaccc

SEQ ID NO: 4000928 - DNA, 14 bp, Homo sapiens
aaggctctcacccc

SEQ ID NO: 4000929 - DNA, 15 bp, Homo sapiens
aaggctgcttagaat

SEQ ID NO: 4000930 - DNA, 22 bp, Homo sapiens
aaggctggccagcaaggcaggt

SEQ ID NO: 4000931 - DNA, 23 bp, Homo sapiens
aaggctggccagcaaggcaggtt

SEQ ID NO: 4000932 - DNA, 18 bp, Homo sapiens
aaggctggtaagagaagt

SEQ ID NO: 4000933 - DNA, 20 bp, Homo sapiens
aaggctggtaagagaagtga

SEQ ID NO: 4000934 - DNA, 19 bp, Homo sapiens
aaggcttgggatttgctgt

SEQ ID NO: 4000935 - DNA, 13 bp, Homo sapiens
aagggaaatatca

SEQ ID NO: 4000936 - DNA, 16 bp, Homo sapiens
aagggaaatatcattt

SEQ ID NO: 4000937 - DNA, 20 bp, Homo sapiens
aagggaagaaggaggaatgc

SEQ ID NO: 4000938 - DNA, 16 bp, Homo sapiens
aagggaagacatttct

SEQ ID NO: 4000939 - DNA, 13 bp, Homo sapiens
aagggagaaaaag

SEQ ID NO: 4000940 - DNA, 18 bp, Homo sapiens
aagggagaaaagagaaac

SEQ ID NO: 4000941 - DNA, 24 bp, Homo sapiens
aagggatggaggtcacactggtag

SEQ ID NO: 4000942 - DNA, 13 bp, Homo sapiens
aagggcatgcctt

SEQ ID NO: 4000943 - DNA, 11 bp, Homo sapiens
aagggccagag

SEQ ID NO: 4000944 - DNA, 14 bp, Homo sapiens
aagggccagagcca

SEQ ID NO: 4000945 - DNA, 16 bp, Homo sapiens
aagggccagagccagg

SEQ ID NO: 4000946 - DNA, 18 bp, Homo sapiens
aagggccagtctgggctg

SEQ ID NO: 4000947 - DNA, 16 bp, Homo sapiens
aagggcccagattcta

SEQ ID NO: 4000948 - DNA, 19 bp, Homo sapiens
aagggcctgcctggcccct

SEQ ID NO: 4000949 - DNA, 23 bp, Homo sapiens
aagggctggctccccctccccag

SEQ ID NO: 4000950 - DNA, 14 bp, Homo sapiens
aagggctttcctgt

SEQ ID NO: 4000951 - DNA, 22 bp, Homo sapiens
aagggctttggttccttctctg

SEQ ID NO: 4000952 - DNA, 12 bp, Homo sapiens
aaggggagagcc

SEQ ID NO: 4000953 - DNA, 14 bp, Homo sapiens
aaggggagagcctg

SEQ ID NO: 4000954 - DNA, 22 bp, Homo sapiens
aaggggcccaaattctttcagt

SEQ ID NO: 4000955 - DNA, 23 bp, Homo sapiens
aaggggcctcaccgagtgggggc

SEQ ID NO: 4000956 - DNA, 15 bp, Homo sapiens
aagggggaggggaag

SEQ ID NO: 4000957 - DNA, 18 bp, Homo sapiens
aaggggggcagggagtga

SEQ ID NO: 4000958 - DNA, 14 bp, Homo sapiens
aaggggttcctcaa

SEQ ID NO: 4000959 - DNA, 18 bp, Homo sapiens
aaggggttcctcaaattt

SEQ ID NO: 4000960 - DNA, 16 bp, Homo sapiens
aagggtcatagaaagg

SEQ ID NO: 4000961 - DNA, 17 bp, Homo sapiens
aagggtgggtgctcaga

SEQ ID NO: 4000962 - DNA, 19 bp, Homo sapiens
aagggtgggtgctcagaat

SEQ ID NO: 4000963 - DNA, 19 bp, Homo sapiens
aataatttttatatttaat

SEQ ID NO: 4000964 - DNA, 21 bp, Homo sapiens
aatacaaaaaattagccgggc

SEQ ID NO: 4000965 - DNA, 12 bp, Homo sapiens
aatacaaaactt

SEQ ID NO: 4000966 - DNA, 17 bp, Homo sapiens
aatacaaagtaaataca

SEQ ID NO: 4000967 - DNA, 21 bp, Homo sapiens
aatacaaatctgtataaatgt

SEQ ID NO: 4000968 - DNA, 13 bp, Homo sapiens
aatacaaatgtta

SEQ ID NO: 4000969 - DNA, 13 bp, Homo sapiens
aatacaagactgt

SEQ ID NO: 4000970 - DNA, 20 bp, Homo sapiens
aatacaccacctcactcctg

SEQ ID NO: 4000971 - DNA, 22 bp, Homo sapiens
aatacaccacctcactcctgtt

SEQ ID NO: 4000972 - DNA, 16 bp, Homo sapiens
aatacactagttgttt

SEQ ID NO: 4000973 - DNA, 22 bp, Homo sapiens
aatacacttgtgattataaaat

SEQ ID NO: 4000974 - DNA, 15 bp, Homo sapiens
aatacagacactaag

SEQ ID NO: 4000975 - DNA, 20 bp, Homo sapiens
aatacagacactaagttata

SEQ ID NO: 4000976 - DNA, 16 bp, Homo sapiens
aatacagggcatgcat

SEQ ID NO: 4000977 - DNA, 16 bp, Homo sapiens
aatacagttctgctct

SEQ ID NO: 4000978 - DNA, 16 bp, Homo sapiens
aataccaagtatttat

SEQ ID NO: 4000979 - DNA, 15 bp, Homo sapiens
aatacctcatgcttc

SEQ ID NO: 4000980 - DNA, 14 bp, Homo sapiens
aatactaaaagcaa

SEQ ID NO: 4000981 - DNA, 19 bp, Homo sapiens
aatactaaaagcaaatcta

SEQ ID NO: 4000982 - DNA, 16 bp, Homo sapiens
aatactaccttgaaaa

SEQ ID NO: 4000983 - DNA, 18 bp, Homo sapiens
aatactaccttgaaaata

SEQ ID NO: 4000984 - DNA, 20 bp, Homo sapiens
aatactcaaatgagtaacat

SEQ ID NO: 4000985 - DNA, 23 bp, Homo sapiens
aatactgctacagcaatttctaa

SEQ ID NO: 4000986 - DNA, 19 bp, Homo sapiens
aatactggaataatttgta

SEQ ID NO: 4000987 - DNA, 20 bp, Homo sapiens
aatactggaataatttgtaa

SEQ ID NO: 4000988 - DNA, 20 bp, Homo sapiens
aatacttgtcaatatttaaa

SEQ ID NO: 4000989 - DNA, 14 bp, Homo sapiens
aatactttaaagga

SEQ ID NO: 4000990 - DNA, 19 bp, Homo sapiens
aatactttctatgtgacat

SEQ ID NO: 4000991 - DNA, 15 bp, Homo sapiens
aatactttttacaat

SEQ ID NO: 4000992 - DNA, 13 bp, Homo sapiens
aatagaaaatggt

SEQ ID NO: 4000993 - DNA, 21 bp, Homo sapiens
aatagaaactcaccatgtaaa

SEQ ID NO: 4000994 - DNA, 18 bp, Homo sapiens
aatagaaattttgtaaga

SEQ ID NO: 4000995 - DNA, 14 bp, Homo sapiens
aatagaactatctg

SEQ ID NO: 4000996 - DNA, 19 bp, Homo sapiens
aatagacaaatagaaaatg

SEQ ID NO: 4000997 - DNA, 23 bp, Homo sapiens
aatagacactccccgaagtcttt

SEQ ID NO: 4000998 - DNA, 15 bp, Homo sapiens
aatagacagtatatt

SEQ ID NO: 4000999 - DNA, 20 bp, Homo sapiens
aatagacagtatatttatag

SEQ ID NO: 4001000 - DNA, 16 bp, Homo sapiens
aatagagtatatgcac

SEQ ID NO: 4001001 - DNA, 18 bp, Homo sapiens
aatagagtatatgcactt

SEQ ID NO: 4001002 - DNA, 17 bp, Homo sapiens
aatagccctccccctca

SEQ ID NO: 4001003 - DNA, 14 bp, Homo sapiens
aatagccttcaaaa

SEQ ID NO: 4001004 - DNA, 22 bp, Homo sapiens
aatagctaatttatttccccag

SEQ ID NO: 4001005 - DNA, 23 bp, Homo sapiens
aatagctaatttatttccccagg

SEQ ID NO: 4001006 - DNA, 19 bp, Homo sapiens
aatagctctttcagggggg

SEQ ID NO: 4001007 - DNA, 20 bp, Homo sapiens
aataggagaggatgagagcc

SEQ ID NO: 4001008 - DNA, 15 bp, Homo sapiens
aatagggtagaatga

SEQ ID NO: 4001009 - DNA, 16 bp, Homo sapiens
aatagggtagaatgat

SEQ ID NO: 4001010 - DNA, 15 bp, Homo sapiens
aataggtagtttgga

SEQ ID NO: 4001011 - DNA, 13 bp, Homo sapiens
aatagtatttatg

SEQ ID NO: 4001012 - DNA, 23 bp, Homo sapiens
aatagtgtgttctgattagaaat

SEQ ID NO: 4001013 - DNA, 19 bp, Homo sapiens
aatagtttacatgtagtag

SEQ ID NO: 4001014 - DNA, 16 bp, Homo sapiens
aatagtttgtctattt

SEQ ID NO: 4001015 - DNA, 18 bp, Homo sapiens
aatagtttgtctatttta

SEQ ID NO: 4001016 - DNA, 23 bp, Homo sapiens
aatataaaatatgaagacataaa

SEQ ID NO: 4001017 - DNA, 12 bp, Homo sapiens
aatataaagctt

SEQ ID NO: 4001018 - DNA, 21 bp, Homo sapiens
aatataacttaaaaatgtaaa

SEQ ID NO: 4001019 - DNA, 23 bp, Homo sapiens
aatataagacatttgtttgctgt

SEQ ID NO: 4001020 - DNA, 19 bp, Homo sapiens
aatataaggaaagcaataa

SEQ ID NO: 4001021 - DNA, 21 bp, Homo sapiens
aatataaggaaagcaataaat

SEQ ID NO: 4001022 - DNA, 15 bp, Homo sapiens
aatataattctgtaa

SEQ ID NO: 4001023 - DNA, 16 bp, Homo sapiens
aatataattctgtaaa

SEQ ID NO: 4001024 - DNA, 23 bp, Homo sapiens
aatatacatgaagaatagaaaca

SEQ ID NO: 4001025 - DNA, 19 bp, Homo sapiens
aatatacattcaaacttaa

SEQ ID NO: 4001026 - DNA, 17 bp, Homo sapiens
aatatactatatttatg

SEQ ID NO: 4001027 - DNA, 15 bp, Homo sapiens
aatatagaagcattt

SEQ ID NO: 4001028 - DNA, 12 bp, Homo sapiens
aatatatgtatt

SEQ ID NO: 4001029 - DNA, 14 bp, Homo sapiens
aatatatgtattat

SEQ ID NO: 4001030 - DNA, 17 bp, Homo sapiens
aatatatgtgtgcctat

SEQ ID NO: 4001031 - DNA, 20 bp, Homo sapiens
aatatattgaacttttgtac

SEQ ID NO: 4001032 - DNA, 15 bp, Homo sapiens
aatatatttaagata

SEQ ID NO: 4001033 - DNA, 17 bp, Homo sapiens
aatatccctcttgtaag

SEQ ID NO: 4001034 - DNA, 14 bp, Homo sapiens
aatatctaatatat

SEQ ID NO: 4001035 - DNA, 22 bp, Homo sapiens
aatatctaatatatatgaataa

SEQ ID NO: 4001036 - DNA, 17 bp, Homo sapiens
aatatctgtaatggtac

SEQ ID NO: 4001037 - DNA, 19 bp, Homo sapiens
aatatctttgtgataattt

SEQ ID NO: 4001038 - DNA, 22 bp, Homo sapiens
aatatctttgtgataatttaag

SEQ ID NO: 4001039 - DNA, 14 bp, Homo sapiens
aatatcttttatgt

SEQ ID NO: 4001040 - DNA, 18 bp, Homo sapiens
aatatcttttatgtttga

SEQ ID NO: 4001041 - DNA, 23 bp, Homo sapiens
aatatcttttatgtttgaatatg

SEQ ID NO: 4001042 - DNA, 13 bp, Homo sapiens
aatatgaaaactt

SEQ ID NO: 4001043 - DNA, 21 bp, Homo sapiens
aatatgacggaagaacataga

SEQ ID NO: 4001044 - DNA, 17 bp, Homo sapiens
aatatgagtacaaatgc

SEQ ID NO: 4001045 - DNA, 19 bp, Homo sapiens
aatatgagtacaaatgcct

SEQ ID NO: 4001046 - DNA, 23 bp, Homo sapiens
aatatgcctgcaatctgagccag

SEQ ID NO: 4001047 - DNA, 16 bp, Homo sapiens
aatatgcttaaaataa

SEQ ID NO: 4001048 - DNA, 23 bp, Homo sapiens
aatatgcttaaaataagcaggtg

SEQ ID NO: 4001049 - DNA, 21 bp, Homo sapiens
aatatggaaccttccctccaa

SEQ ID NO: 4001050 - DNA, 16 bp, Homo sapiens
aatatggaacttacat

SEQ ID NO: 4001051 - DNA, 14 bp, Homo sapiens
aatatggacaagag

SEQ ID NO: 4001052 - DNA, 17 bp, Homo sapiens
aatatggacacttaata

SEQ ID NO: 4001053 - DNA, 17 bp, Homo sapiens
aatatgtaatgcttcca

SEQ ID NO: 4001054 - DNA, 16 bp, Homo sapiens
aatatgtgagattttt

SEQ ID NO: 4001055 - DNA, 19 bp, Homo sapiens
aatatgtgagattttttat

SEQ ID NO: 4001056 - DNA, 22 bp, Homo sapiens
aatatgtgagattttttattgc

SEQ ID NO: 4001057 - DNA, 21 bp, Homo sapiens
aatatgttaacctcagtgtca

SEQ ID NO: 4001058 - DNA, 17 bp, Homo sapiens
aatattaaaccctggat

SEQ ID NO: 4001059 - DNA, 22 bp, Homo sapiens
aatattaaatacagacactaag

SEQ ID NO: 4001060 - DNA, 13 bp, Homo sapiens
aatattaaatctg

SEQ ID NO: 4001061 - DNA, 22 bp, Homo sapiens
aatattaacctaatcaccatgt

SEQ ID NO: 4001062 - DNA, 22 bp, Homo sapiens
aatattactcagtttatgttgt

SEQ ID NO: 4001063 - DNA, 15 bp, Homo sapiens
aatattatactaaga

SEQ ID NO: 4001064 - DNA, 22 bp, Homo sapiens
aatattatactaagaaaagata

SEQ ID NO: 4001065 - DNA, 15 bp, Homo sapiens
aattactacaaaatt

SEQ ID NO: 4001066 - DNA, 15 bp, Homo sapiens
aattagactgtgatt

SEQ ID NO: 4001067 - DNA, 21 bp, Homo sapiens
aattagactgtgattcagaaa

SEQ ID NO: 4001068 - DNA, 23 bp, Homo sapiens
aattagataaattgtagggcttt

SEQ ID NO: 4001069 - DNA, 14 bp, Homo sapiens
aattagccgggcgt

SEQ ID NO: 4001070 - DNA, 21 bp, Homo sapiens
aattaggaagtgtaacagctg

SEQ ID NO: 4001071 - DNA, 17 bp, Homo sapiens
aattaggggttgctaag

SEQ ID NO: 4001072 - DNA, 20 bp, Homo sapiens
aattaggggttgctaagaag

SEQ ID NO: 4001073 - DNA, 17 bp, Homo sapiens
aattagggtacatttat

SEQ ID NO: 4001074 - DNA, 19 bp, Homo sapiens
aattagggtacatttataa

SEQ ID NO: 4001075 - DNA, 13 bp, Homo sapiens
aattagtttcctt

SEQ ID NO: 4001076 - DNA, 20 bp, Homo sapiens
aattataaactcattttgct

SEQ ID NO: 4001077 - DNA, 14 bp, Homo sapiens
aattataagtcaca

SEQ ID NO: 4001078 - DNA, 16 bp, Homo sapiens
aattataagtcacaaa

SEQ ID NO: 4001079 - DNA, 16 bp, Homo sapiens
aattataatatactat

SEQ ID NO: 4001080 - DNA, 21 bp, Homo sapiens
aattataggagccttaatttt

SEQ ID NO: 4001081 - DNA, 13 bp, Homo sapiens
aattatagtttca

SEQ ID NO: 4001082 - DNA, 20 bp, Homo sapiens
aattatcaatatctaatata

SEQ ID NO: 4001083 - DNA, 20 bp, Homo sapiens
aattatcgggaacagtgttt

SEQ ID NO: 4001084 - DNA, 23 bp, Homo sapiens
aattatcgggaacagtgtttccc

SEQ ID NO: 4001085 - DNA, 14 bp, Homo sapiens
aattatctatacat

SEQ ID NO: 4001086 - DNA, 22 bp, Homo sapiens
aattatctatagctaagtacac

SEQ ID NO: 4001087 - DNA, 23 bp, Homo sapiens
aattatctatagctaagtacaca

SEQ ID NO: 4001088 - DNA, 12 bp, Homo sapiens
aattatgacagt

SEQ ID NO: 4001089 - DNA, 13 bp, Homo sapiens
aattatgacagtt

SEQ ID NO: 4001090 - DNA, 13 bp, Homo sapiens
aattatgatttgg

SEQ ID NO: 4001091 - DNA, 15 bp, Homo sapiens
aattatgtataaaca

SEQ ID NO: 4001092 - DNA, 21 bp, Homo sapiens
aattatgtatgtttacatatc

SEQ ID NO: 4001093 - DNA, 18 bp, Homo sapiens
aattattaactacattta

SEQ ID NO: 4001094 - DNA, 18 bp, Homo sapiens
aattattataagcattga

SEQ ID NO: 4001095 - DNA, 13 bp, Homo sapiens
aattattattctt

SEQ ID NO: 4001096 - DNA, 21 bp, Homo sapiens
aattattattcttcataacaa

SEQ ID NO: 4001097 - DNA, 22 bp, Homo sapiens
aattattatttatatatgtatt

SEQ ID NO: 4001098 - DNA, 15 bp, Homo sapiens
aattattatttgtgt

SEQ ID NO: 4001099 - DNA, 16 bp, Homo sapiens
aattattatttgtgtt

SEQ ID NO: 4001100 - DNA, 14 bp, Homo sapiens
aattattgacactg

SEQ ID NO: 4001101 - DNA, 15 bp, Homo sapiens
aattattgacactga

SEQ ID NO: 4001102 - DNA, 16 bp, Homo sapiens
aattattgacactgaa

SEQ ID NO: 4001103 - DNA, 14 bp, Homo sapiens
aattattgattgct

SEQ ID NO: 4001104 - DNA, 17 bp, Homo sapiens
aattattgattgctttt

SEQ ID NO: 4001105 - DNA, 12 bp, Homo sapiens
aattatttgcta

SEQ ID NO: 4001106 - DNA, 14 bp, Homo sapiens
aattatttgctaag

SEQ ID NO: 4001107 - DNA, 19 bp, Homo sapiens
aattattttaaaatattta

SEQ ID NO: 4001108 - DNA, 11 bp, Homo sapiens
aattattttgg

SEQ ID NO: 4001109 - DNA, 20 bp, Homo sapiens
aattattttggtacttttat

SEQ ID NO: 4001110 - DNA, 20 bp, Homo sapiens
aattcaaactggggcctcca

SEQ ID NO: 4001111 - DNA, 19 bp, Homo sapiens
aattcacaaacttttatac

SEQ ID NO: 4001112 - DNA, 17 bp, Homo sapiens
aattcacctatgttatt

SEQ ID NO: 4001113 - DNA, 17 bp, Homo sapiens
aattcagattgtcttgc

SEQ ID NO: 4001114 - DNA, 15 bp, Homo sapiens
aattcagcactgatt

SEQ ID NO: 4001115 - DNA, 20 bp, Homo sapiens
aattcagcactgatttcaca

SEQ ID NO: 4001116 - DNA, 13 bp, Homo sapiens
aattcagctcagc

SEQ ID NO: 4001117 - DNA, 12 bp, Homo sapiens
aattcagttttt

SEQ ID NO: 4001118 - DNA, 14 bp, Homo sapiens
aattcatgcctttc

SEQ ID NO: 4001119 - DNA, 17 bp, Homo sapiens
aattcatgcctttcata

SEQ ID NO: 4001120 - DNA, 12 bp, Homo sapiens
aattccaaggag

SEQ ID NO: 4001121 - DNA, 14 bp, Homo sapiens
aattccactgtcaa

SEQ ID NO: 4001122 - DNA, 22 bp, Homo sapiens
aattccactgtcaagaaagagc

SEQ ID NO: 4001123 - DNA, 17 bp, Homo sapiens
aattccagcaataagaa

SEQ ID NO: 4001124 - DNA, 22 bp, Homo sapiens
aattccagcaataagaaatgaa

SEQ ID NO: 4001125 - DNA, 14 bp, Homo sapiens
aattccattatctt

SEQ ID NO: 4001126 - DNA, 22 bp, Homo sapiens
aattccctatcttttagtttta

SEQ ID NO: 4001127 - DNA, 18 bp, Homo sapiens
aattccctctctcagcac

SEQ ID NO: 4001128 - DNA, 14 bp, Homo sapiens
aattcctacagcac

SEQ ID NO: 4001129 - DNA, 15 bp, Homo sapiens
aattcctacagcact

SEQ ID NO: 4001130 - DNA, 20 bp, Homo sapiens
aattcctagataaaaagatg

SEQ ID NO: 4001131 - DNA, 13 bp, Homo sapiens
aattctaaatgaa

SEQ ID NO: 4001132 - DNA, 15 bp, Homo sapiens
aattctacattgtca

SEQ ID NO: 4001133 - DNA, 14 bp, Homo sapiens
aattctagctgtat

SEQ ID NO: 4001134 - DNA, 16 bp, Homo sapiens
aattctataaggccat

SEQ ID NO: 4001135 - DNA, 13 bp, Homo sapiens
aattctatgttaa

SEQ ID NO: 4001136 - DNA, 20 bp, Homo sapiens
aattctatgttaaatactgt

SEQ ID NO: 4001137 - DNA, 14 bp, Homo sapiens
aattctcacatccc

SEQ ID NO: 4001138 - DNA, 15 bp, Homo sapiens
aattctcccctccct

SEQ ID NO: 4001139 - DNA, 18 bp, Homo sapiens
aattctccctatcttgtg

SEQ ID NO: 4001140 - DNA, 19 bp, Homo sapiens
aattctcctgcctcagcct

SEQ ID NO: 4001141 - DNA, 14 bp, Homo sapiens
aattctctttcaaa

SEQ ID NO: 4001142 - DNA, 10 bp, Homo sapiens
aattctgaat

SEQ ID NO: 4001143 - DNA, 21 bp, Homo sapiens
aattctgagaaaacttctttt

SEQ ID NO: 4001144 - DNA, 17 bp, Homo sapiens
aattcttcacatgttta

SEQ ID NO: 4001145 - DNA, 23 bp, Homo sapiens
aattcttcacctgttatgtatga

SEQ ID NO: 4001146 - DNA, 20 bp, Homo sapiens
aattcttcagttggttgtgt

SEQ ID NO: 4001147 - DNA, 15 bp, Homo sapiens
aattcttgaaggaaa

SEQ ID NO: 4001148 - DNA, 21 bp, Homo sapiens
aattcttgaaggaaaatgata

SEQ ID NO: 4001149 - DNA, 15 bp, Homo sapiens
aattcttgtatatta

SEQ ID NO: 4001150 - DNA, 17 bp, Homo sapiens
aattctttaaaattaca

SEQ ID NO: 4001151 - DNA, 15 bp, Homo sapiens
aattgaaactagtta

SEQ ID NO: 4001152 - DNA, 17 bp, Homo sapiens
aattgaagtaaactttt

SEQ ID NO: 4001153 - DNA, 22 bp, Homo sapiens
aattgaccttgaccattaataa

SEQ ID NO: 4001154 - DNA, 17 bp, Homo sapiens
aattgaggggattaata

SEQ ID NO: 4001155 - DNA, 16 bp, Homo sapiens
aattgagtaatggtgt

SEQ ID NO: 4001156 - DNA, 20 bp, Homo sapiens
aattgatgtatatgtttata

SEQ ID NO: 4001157 - DNA, 22 bp, Homo sapiens
aattgatttgcattgaacacaa

SEQ ID NO: 4001158 - DNA, 18 bp, Homo sapiens
aattgcaaatcttgaaat

SEQ ID NO: 4001159 - DNA, 16 bp, Homo sapiens
aattgcaacatgaagt

SEQ ID NO: 4001160 - DNA, 20 bp, Homo sapiens
aattgcagataactttgact

SEQ ID NO: 4001161 - DNA, 14 bp, Homo sapiens
aattgccaaagctg

SEQ ID NO: 4001162 - DNA, 16 bp, Homo sapiens
aattgccaatcttgtt

SEQ ID NO: 4001163 - DNA, 19 bp, Homo sapiens
aattgcctgcagagagaag

SEQ ID NO: 4001164 - DNA, 14 bp, Homo sapiens
aattgctatgttac

SEQ ID NO: 4001165 - DNA, 19 bp, Homo sapiens
aattgctatgttactattt

SEQ ID NO: 4001166 - DNA, 18 bp, Homo sapiens
aattgctcataagcaata

SEQ ID NO: 4001167 - DNA, 15 bp, Homo sapiens
aattgcttacatttt

SEQ ID NO: 4001168 - DNA, 18 bp, Homo sapiens
acacagaaatgctgctgg

SEQ ID NO: 4001169 - DNA, 21 bp, Homo sapiens
acacagaaatgctgctggcca

SEQ ID NO: 4001170 - DNA, 21 bp, Homo sapiens
acacagagtggtctttctgga

SEQ ID NO: 4001171 - DNA, 23 bp, Homo sapiens
acacagagtggtctttctggaga

SEQ ID NO: 4001172 - DNA, 16 bp, Homo sapiens
acacagatacacacac

SEQ ID NO: 4001173 - DNA, 22 bp, Homo sapiens
acacagcagcttcaccagagca

SEQ ID NO: 4001174 - DNA, 15 bp, Homo sapiens
acacagcatgtgtat

SEQ ID NO: 4001175 - DNA, 17 bp, Homo sapiens
acacagctactctcccc

SEQ ID NO: 4001176 - DNA, 17 bp, Homo sapiens
acacagctgagcactta

SEQ ID NO: 4001177 - DNA, 13 bp, Homo sapiens
acacagctgccct

SEQ ID NO: 4001178 - DNA, 18 bp, Homo sapiens
acacagctgccctagctg

SEQ ID NO: 4001179 - DNA, 12 bp, Homo sapiens
acacagctgggc

SEQ ID NO: 4001180 - DNA, 17 bp, Homo sapiens
acacagctgggcaaagc

SEQ ID NO: 4001181 - DNA, 18 bp, Homo sapiens
acacagctgggcaaagcc

SEQ ID NO: 4001182 - DNA, 16 bp, Homo sapiens
acacaggccctccctg

SEQ ID NO: 4001183 - DNA, 12 bp, Homo sapiens
acacaggctggc

SEQ ID NO: 4001184 - DNA, 16 bp, Homo sapiens
acacaggctgtcctta

SEQ ID NO: 4001185 - DNA, 21 bp, Homo sapiens
acacaggggacacccagaaac

SEQ ID NO: 4001186 - DNA, 22 bp, Homo sapiens
acacaggtggggactgggcaca

SEQ ID NO: 4001187 - DNA, 15 bp, Homo sapiens
acacagtcaaaataa

SEQ ID NO: 4001188 - DNA, 19 bp, Homo sapiens
acacagtcaaaataattct

SEQ ID NO: 4001189 - DNA, 20 bp, Homo sapiens
acacagtgggtggtggatct

SEQ ID NO: 4001190 - DNA, 14 bp, Homo sapiens
acacataaacaatt

SEQ ID NO: 4001191 - DNA, 17 bp, Homo sapiens
acacatccagacatcat

SEQ ID NO: 4001192 - DNA, 12 bp, Homo sapiens
acacatctcctc

SEQ ID NO: 4001193 - DNA, 23 bp, Homo sapiens
acacatgccttaaatttgtttaa

SEQ ID NO: 4001194 - DNA, 15 bp, Homo sapiens
acacattcccccacc

SEQ ID NO: 4001195 - DNA, 23 bp, Homo sapiens
acacattcccccaccagctgcag

SEQ ID NO: 4001196 - DNA, 15 bp, Homo sapiens
acacatttttaaatt

SEQ ID NO: 4001197 - DNA, 19 bp, Homo sapiens
acaccaaaaaaatccagaa

SEQ ID NO: 4001198 - DNA, 14 bp, Homo sapiens
acaccaaataaata

SEQ ID NO: 4001199 - DNA, 18 bp, Homo sapiens
acaccaagcacagcagcc

SEQ ID NO: 4001200 - DNA, 20 bp, Homo sapiens
acaccaagcacagcagcctg

SEQ ID NO: 4001201 - DNA, 14 bp, Homo sapiens
acaccaatcccagg

SEQ ID NO: 4001202 - DNA, 20 bp, Homo sapiens
acaccaatcccagggctggc

SEQ ID NO: 4001203 - DNA, 14 bp, Homo sapiens
acaccacagacaca

SEQ ID NO: 4001204 - DNA, 18 bp, Homo sapiens
acaccacagacacacaca

SEQ ID NO: 4001205 - DNA, 13 bp, Homo sapiens
acaccagagcaga

SEQ ID NO: 4001206 - DNA, 19 bp, Homo sapiens
acaccagagcagatgcaga

SEQ ID NO: 4001207 - DNA, 12 bp, Homo sapiens
acaccagccttg

SEQ ID NO: 4001208 - DNA, 12 bp, Homo sapiens
acaccaggctgt

SEQ ID NO: 4001209 - DNA, 14 bp, Homo sapiens
acaccaggctgtgg

SEQ ID NO: 4001210 - DNA, 18 bp, Homo sapiens
acaccaggctgtgggcct

SEQ ID NO: 4001211 - DNA, 17 bp, Homo sapiens
acaccagtcacatgacc

SEQ ID NO: 4001212 - DNA, 20 bp, Homo sapiens
acaccatcgatcatgatgta

SEQ ID NO: 4001213 - DNA, 22 bp, Homo sapiens
acacccaggggaaggccctgag

SEQ ID NO: 4001214 - DNA, 12 bp, Homo sapiens
acaccccagccc

SEQ ID NO: 4001215 - DNA, 19 bp, Homo sapiens
acacccccatccctcggga

SEQ ID NO: 4001216 - DNA, 12 bp, Homo sapiens
acaccccctccc

SEQ ID NO: 4001217 - DNA, 22 bp, Homo sapiens
acaccccctccccgcccctgtg

SEQ ID NO: 4001218 - DNA, 13 bp, Homo sapiens
acacccctgctct

SEQ ID NO: 4001219 - DNA, 17 bp, Homo sapiens
acaccccttatccagga

SEQ ID NO: 4001220 - DNA, 20 bp, Homo sapiens
acaccccttatccaggactc

SEQ ID NO: 4001221 - DNA, 13 bp, Homo sapiens
acaccctcccccg

SEQ ID NO: 4001222 - DNA, 16 bp, Homo sapiens
acaccctcccccgcca

SEQ ID NO: 4001223 - DNA, 13 bp, Homo sapiens
acaccctggcctg

SEQ ID NO: 4001224 - DNA, 13 bp, Homo sapiens
acaccctgtactg

SEQ ID NO: 4001225 - DNA, 22 bp, Homo sapiens
acaccctgtactgttctgtgtc

SEQ ID NO: 4001226 - DNA, 13 bp, Homo sapiens
acacccttagaaa

SEQ ID NO: 4001227 - DNA, 13 bp, Homo sapiens
acaccgactagcc

SEQ ID NO: 4001228 - DNA, 18 bp, Homo sapiens
acaccgtacatctgcaat

SEQ ID NO: 4001229 - DNA, 19 bp, Homo sapiens
acaccgtgtaaaccaaagc

SEQ ID NO: 4001230 - DNA, 20 bp, Homo sapiens
acaccgtgtaaaccaaagcc

SEQ ID NO: 4001231 - DNA, 18 bp, Homo sapiens
acacctaccaaaaaataa

SEQ ID NO: 4001232 - DNA, 18 bp, Homo sapiens
acacctagctttattctt

SEQ ID NO: 4001233 - DNA, 19 bp, Homo sapiens
acacctgcagattctagga

SEQ ID NO: 4001234 - DNA, 14 bp, Homo sapiens
acacctgccctgcc

SEQ ID NO: 4001235 - DNA, 19 bp, Homo sapiens
acacctggctgaggttcct

SEQ ID NO: 4001236 - DNA, 15 bp, Homo sapiens
acacctgtgcctcct

SEQ ID NO: 4001237 - DNA, 16 bp, Homo sapiens
acaccttccagctcct

SEQ ID NO: 4001238 - DNA, 17 bp, Homo sapiens
acaccttttaactcacc

SEQ ID NO: 4001239 - DNA, 22 bp, Homo sapiens
acacgaccggggccagcaccac

SEQ ID NO: 4001240 - DNA, 19 bp, Homo sapiens
acacgcacaaacacacaca

SEQ ID NO: 4001241 - DNA, 14 bp, Homo sapiens
acacgcacctgcct

SEQ ID NO: 4001242 - DNA, 17 bp, Homo sapiens
acacgcacgcacacaca

SEQ ID NO: 4001243 - DNA, 19 bp, Homo sapiens
acacgcaggaactcccagc

SEQ ID NO: 4001244 - DNA, 20 bp, Homo sapiens
acacgcatggtcaaccctca

SEQ ID NO: 4001245 - DNA, 18 bp, Homo sapiens
acacggagcccagccctc

SEQ ID NO: 4001246 - DNA, 22 bp, Homo sapiens
acacggagcccagccctcccca

SEQ ID NO: 4001247 - DNA, 23 bp, Homo sapiens
acacggagcggattgcaaagcaa

SEQ ID NO: 4001248 - DNA, 12 bp, Homo sapiens
acacggccacat

SEQ ID NO: 4001249 - DNA, 13 bp, Homo sapiens
acacggccacccg

SEQ ID NO: 4001250 - DNA, 22 bp, Homo sapiens
acacggctgcctgacactgagc

SEQ ID NO: 4001251 - DNA, 23 bp, Homo sapiens
acactaaaagcagcgtcactcta

SEQ ID NO: 4001252 - DNA, 13 bp, Homo sapiens
acactaaacattc

SEQ ID NO: 4001253 - DNA, 18 bp, Homo sapiens
acactaaccaaatctctc

SEQ ID NO: 4001254 - DNA, 23 bp, Homo sapiens
acactaaccaagctgagtttcct

SEQ ID NO: 4001255 - DNA, 14 bp, Homo sapiens
acactaagggtgta

SEQ ID NO: 4001256 - DNA, 19 bp, Homo sapiens
acactaagttatagtatat

SEQ ID NO: 4001257 - DNA, 23 bp, Homo sapiens
acactaagttatagtatatctgg

SEQ ID NO: 4001258 - DNA, 20 bp, Homo sapiens
acactaccccatatacacct

SEQ ID NO: 4001259 - DNA, 15 bp, Homo sapiens
acactagcctctcca

SEQ ID NO: 4001260 - DNA, 17 bp, Homo sapiens
acactagggtcaggcgg

SEQ ID NO: 4001261 - DNA, 23 bp, Homo sapiens
acactagttttgtgccagccgtg

SEQ ID NO: 4001262 - DNA, 16 bp, Homo sapiens
acactatggggtgggg

SEQ ID NO: 4001263 - DNA, 17 bp, Homo sapiens
acactatggtatttgag

SEQ ID NO: 4001264 - DNA, 18 bp, Homo sapiens
acactatggtatttgagt

SEQ ID NO: 4001265 - DNA, 22 bp, Homo sapiens
acactatggtatttgagtgttt

SEQ ID NO: 4001266 - DNA, 14 bp, Homo sapiens
acactcaataaatt

SEQ ID NO: 4001267 - DNA, 20 bp, Homo sapiens
acactcaccatgaagcgaaa

SEQ ID NO: 4001268 - DNA, 16 bp, Homo sapiens
acactccagtgccagc

SEQ ID NO: 4001269 - DNA, 21 bp, Homo sapiens
acactccagtgccagcaatga

SEQ ID NO: 4001270 - DNA, 16 bp, Homo sapiens
acactccatctcctgc

SEQ ID NO: 4001271 - DNA, 20 bp, Homo sapiens
acagttgtctagagatatat

SEQ ID NO: 4001272 - DNA, 19 bp, Homo sapiens
acagtttaccagttgcctt

SEQ ID NO: 4001273 - DNA, 22 bp, Homo sapiens
acagtttaccagttgcctttta

SEQ ID NO: 4001274 - DNA, 22 bp, Homo sapiens
acagtttcttagctttttaatt

SEQ ID NO: 4001275 - DNA, 19 bp, Homo sapiens
acagtttcttttttcttac

SEQ ID NO: 4001276 - DNA, 21 bp, Homo sapiens
acagttttcagaaaaagaaat

SEQ ID NO: 4001277 - DNA, 14 bp, Homo sapiens
acagttttccatga

SEQ ID NO: 4001278 - DNA, 16 bp, Homo sapiens
acagttttccatgaaa

SEQ ID NO: 4001279 - DNA, 18 bp, Homo sapiens
acagttttccatgaaaac

SEQ ID NO: 4001280 - DNA, 21 bp, Homo sapiens
acagttttccatgaaaacgtt

SEQ ID NO: 4001281 - DNA, 23 bp, Homo sapiens
acagttttccatgaaaacgtttt

SEQ ID NO: 4001282 - DNA, 20 bp, Homo sapiens
acataaaaagcagaatttta

SEQ ID NO: 4001283 - DNA, 21 bp, Homo sapiens
acataaaaagcagaattttaa

SEQ ID NO: 4001284 - DNA, 15 bp, Homo sapiens
acataaaaaggacat

SEQ ID NO: 4001285 - DNA, 16 bp, Homo sapiens
acataaacaattcatg

SEQ ID NO: 4001286 - DNA, 16 bp, Homo sapiens
acataacggaaagttt

SEQ ID NO: 4001287 - DNA, 16 bp, Homo sapiens
acataagataaatgtg

SEQ ID NO: 4001288 - DNA, 17 bp, Homo sapiens
acataagctaaatcata

SEQ ID NO: 4001289 - DNA, 15 bp, Homo sapiens
acataagttgcattt

SEQ ID NO: 4001290 - DNA, 24 bp, Homo sapiens
acataagttgcatttagaaatcaa

SEQ ID NO: 4001291 - DNA, 18 bp, Homo sapiens
acataataaatcacacat

SEQ ID NO: 4001292 - DNA, 21 bp, Homo sapiens
acataataaatcacacattca

SEQ ID NO: 4001293 - DNA, 19 bp, Homo sapiens
acataatgcttaatttcta

SEQ ID NO: 4001294 - DNA, 20 bp, Homo sapiens
acataatgcttaatttctaa

SEQ ID NO: 4001295 - DNA, 21 bp, Homo sapiens
acataattttttttttttaac

SEQ ID NO: 4001296 - DNA, 10 bp, Homo sapiens
acatacatta

SEQ ID NO: 4001297 - DNA, 11 bp, Homo sapiens
acatacattaa

SEQ ID NO: 4001298 - DNA, 15 bp, Homo sapiens
acatacattaaaact

SEQ ID NO: 4001299 - DNA, 15 bp, Homo sapiens
acataccagcttaga

SEQ ID NO: 4001300 - DNA, 20 bp, Homo sapiens
acataccctggccgccccct

SEQ ID NO: 4001301 - DNA, 24 bp, Homo sapiens
acatactccttccatcaaatagaa

SEQ ID NO: 4001302 - DNA, 14 bp, Homo sapiens
acatactctgctta

SEQ ID NO: 4001303 - DNA, 18 bp, Homo sapiens
acatactggcctggactg

SEQ ID NO: 4001304 - DNA, 19 bp, Homo sapiens
acatacttcaaaaataatg

SEQ ID NO: 4001305 - DNA, 20 bp, Homo sapiens
acatacttcaaaaataatgt

SEQ ID NO: 4001306 - DNA, 22 bp, Homo sapiens
acatacttcaaaaataatgtgc

SEQ ID NO: 4001307 - DNA, 18 bp, Homo sapiens
acatacttgaagggccag

SEQ ID NO: 4001308 - DNA, 15 bp, Homo sapiens
acatagatgtccctt

SEQ ID NO: 4001309 - DNA, 13 bp, Homo sapiens
acatagcccctgc

SEQ ID NO: 4001310 - DNA, 15 bp, Homo sapiens
acatagcccctgccc

SEQ ID NO: 4001311 - DNA, 19 bp, Homo sapiens
acatagctatcaagtgtgc

SEQ ID NO: 4001312 - DNA, 16 bp, Homo sapiens
acatagtgatggttcc

SEQ ID NO: 4001313 - DNA, 21 bp, Homo sapiens
acatagttggtaatgcttgga

SEQ ID NO: 4001314 - DNA, 15 bp, Homo sapiens
acatatacagaaaaa

SEQ ID NO: 4001315 - DNA, 16 bp, Homo sapiens
acatatattatttatt

SEQ ID NO: 4001316 - DNA, 14 bp, Homo sapiens
acatatatttattg

SEQ ID NO: 4001317 - DNA, 21 bp, Homo sapiens
acatatatttttaaaaaatga

SEQ ID NO: 4001318 - DNA, 15 bp, Homo sapiens
acatatgaaaataca

SEQ ID NO: 4001319 - DNA, 21 bp, Homo sapiens
acatatgagtgtggaagccgg

SEQ ID NO: 4001320 - DNA, 16 bp, Homo sapiens
acatatgtaaacataa

SEQ ID NO: 4001321 - DNA, 13 bp, Homo sapiens
acatatgtagata

SEQ ID NO: 4001322 - DNA, 19 bp, Homo sapiens
acatattactgttgcattt

SEQ ID NO: 4001323 - DNA, 21 bp, Homo sapiens
acatattatgcctgaatgact

SEQ ID NO: 4001324 - DNA, 18 bp, Homo sapiens
acatcaacatcttggtca

SEQ ID NO: 4001325 - DNA, 18 bp, Homo sapiens
acatcaacccgagtcatt

SEQ ID NO: 4001326 - DNA, 16 bp, Homo sapiens
acatcaatgttcattg

SEQ ID NO: 4001327 - DNA, 23 bp, Homo sapiens
acatcaccgacgcgtctcctgtt

SEQ ID NO: 4001328 - DNA, 22 bp, Homo sapiens
acatcactgcttgatgaagcaa

SEQ ID NO: 4001329 - DNA, 12 bp, Homo sapiens
acatcagataag

SEQ ID NO: 4001330 - DNA, 13 bp, Homo sapiens
acatcagcaaaca

SEQ ID NO: 4001331 - DNA, 17 bp, Homo sapiens
acatcatgaattttaca

SEQ ID NO: 4001332 - DNA, 20 bp, Homo sapiens
acatccaatattttctttaa

SEQ ID NO: 4001333 - DNA, 15 bp, Homo sapiens
acatccacagtctcc

SEQ ID NO: 4001334 - DNA, 20 bp, Homo sapiens
acatccccaagcccaccagg

SEQ ID NO: 4001335 - DNA, 19 bp, Homo sapiens
acatccggggccagctccg

SEQ ID NO: 4001336 - DNA, 13 bp, Homo sapiens
acatcctcttctg

SEQ ID NO: 4001337 - DNA, 15 bp, Homo sapiens
acatcctcttctgct

SEQ ID NO: 4001338 - DNA, 18 bp, Homo sapiens
acatcctgccagccccac

SEQ ID NO: 4001339 - DNA, 16 bp, Homo sapiens
acatcctgtataagca

SEQ ID NO: 4001340 - DNA, 19 bp, Homo sapiens
acatcctttgcagggcagc

SEQ ID NO: 4001341 - DNA, 14 bp, Homo sapiens
acatcgatatgtat

SEQ ID NO: 4001342 - DNA, 17 bp, Homo sapiens
acatcgtgaaaccctgt

SEQ ID NO: 4001343 - DNA, 14 bp, Homo sapiens
acatctatgatata

SEQ ID NO: 4001344 - DNA, 12 bp, Homo sapiens
acatctcagacc

SEQ ID NO: 4001345 - DNA, 22 bp, Homo sapiens
acatctcagaccctttagccaa

SEQ ID NO: 4001346 - DNA, 20 bp, Homo sapiens
acatctcaggggccagagga

SEQ ID NO: 4001347 - DNA, 15 bp, Homo sapiens
acatctctattcccc

SEQ ID NO: 4001348 - DNA, 14 bp, Homo sapiens
acatctgccagacc

SEQ ID NO: 4001349 - DNA, 15 bp, Homo sapiens
acatctgccagacct

SEQ ID NO: 4001350 - DNA, 16 bp, Homo sapiens
acatctgttttaaatt

SEQ ID NO: 4001351 - DNA, 17 bp, Homo sapiens
acatctgttttaaattt

SEQ ID NO: 4001352 - DNA, 13 bp, Homo sapiens
acatcttcaaagc

SEQ ID NO: 4001353 - DNA, 20 bp, Homo sapiens
acatcttctgtgaaatataa

SEQ ID NO: 4001354 - DNA, 16 bp, Homo sapiens
acatcttcttcccagt

SEQ ID NO: 4001355 - DNA, 20 bp, Homo sapiens
acatctttcctcaagtatct

SEQ ID NO: 4001356 - DNA, 14 bp, Homo sapiens
acatgaaaatttta

SEQ ID NO: 4001357 - DNA, 16 bp, Homo sapiens
acatgaaaattttaaa

SEQ ID NO: 4001358 - DNA, 23 bp, Homo sapiens
acatgaaaattttaaaaatacat

SEQ ID NO: 4001359 - DNA, 20 bp, Homo sapiens
acatgaaacctacacactgt

SEQ ID NO: 4001360 - DNA, 23 bp, Homo sapiens
acatgaaacctacacactgtcat

SEQ ID NO: 4001361 - DNA, 16 bp, Homo sapiens
acatgaaagttttgca

SEQ ID NO: 4001362 - DNA, 18 bp, Homo sapiens
acatgaagaatagaaaca

SEQ ID NO: 4001363 - DNA, 22 bp, Homo sapiens
acatgaagcaattagtctgaaa

SEQ ID NO: 4001364 - DNA, 18 bp, Homo sapiens
acatgaattgcattttac

SEQ ID NO: 4001365 - DNA, 14 bp, Homo sapiens
acatgactgggcct

SEQ ID NO: 4001366 - DNA, 16 bp, Homo sapiens
acatgactgggcctcc

SEQ ID NO: 4001367 - DNA, 23 bp, Homo sapiens
acatgagctatttccattccaga

SEQ ID NO: 4001368 - DNA, 17 bp, Homo sapiens
acatgatcttctttata

SEQ ID NO: 4001369 - DNA, 16 bp, Homo sapiens
acatgattgtataagc

SEQ ID NO: 4001370 - DNA, 23 bp, Homo sapiens
acatgatttccttgaatgtggct

SEQ ID NO: 4001371 - DNA, 15 bp, Homo sapiens
acatgcaaaaagaaa

SEQ ID NO: 4001372 - DNA, 18 bp, Homo sapiens
acatgcaaaaagaaatga

SEQ ID NO: 4001373 - DNA, 17 bp, Homo sapiens
acccactcccttcccca

SEQ ID NO: 4001374 - DNA, 15 bp, Homo sapiens
acccactcggtccca

SEQ ID NO: 4001375 - DNA, 21 bp, Homo sapiens
acccagaaacgccacatcccc

SEQ ID NO: 4001376 - DNA, 15 bp, Homo sapiens
acccagactcagaca

SEQ ID NO: 4001377 - DNA, 14 bp, Homo sapiens
acccagagaatata

SEQ ID NO: 4001378 - DNA, 11 bp, Homo sapiens
acccagatgcc

SEQ ID NO: 4001379 - DNA, 20 bp, Homo sapiens
acccagattttgctgtatat

SEQ ID NO: 4001380 - DNA, 13 bp, Homo sapiens
acccagcccctgg

SEQ ID NO: 4001381 - DNA, 14 bp, Homo sapiens
acccagcccctggc

SEQ ID NO: 4001382 - DNA, 20 bp, Homo sapiens
acccagccccttgagaaacc

SEQ ID NO: 4001383 - DNA, 21 bp, Homo sapiens
acccagccccttgagaaacct

SEQ ID NO: 4001384 - DNA, 11 bp, Homo sapiens
acccagcctgg

SEQ ID NO: 4001385 - DNA, 14 bp, Homo sapiens
acccagctccaggg

SEQ ID NO: 4001386 - DNA, 14 bp, Homo sapiens
acccaggaccaagc

SEQ ID NO: 4001387 - DNA, 18 bp, Homo sapiens
acccaggacgcttctgaa

SEQ ID NO: 4001388 - DNA, 23 bp, Homo sapiens
acccaggacttatttaaactctg

SEQ ID NO: 4001389 - DNA, 23 bp, Homo sapiens
acccaggagatggaagttgcagt

SEQ ID NO: 4001390 - DNA, 17 bp, Homo sapiens
acccaggagtgtggcca

SEQ ID NO: 4001391 - DNA, 20 bp, Homo sapiens
acccaggctggagtgcagtg

SEQ ID NO: 4001392 - DNA, 18 bp, Homo sapiens
acccaggggaaggccctg

SEQ ID NO: 4001393 - DNA, 20 bp, Homo sapiens
acccaggggaaggccctgag

SEQ ID NO: 4001394 - DNA, 15 bp, Homo sapiens
acccaggtggagggc

SEQ ID NO: 4001395 - DNA, 20 bp, Homo sapiens
acccaggtggagggcacagc

SEQ ID NO: 4001396 - DNA, 22 bp, Homo sapiens
acccaggtggagggcacagccc

SEQ ID NO: 4001397 - DNA, 20 bp, Homo sapiens
acccagtcacctccccacat

SEQ ID NO: 4001398 - DNA, 16 bp, Homo sapiens
acccagtctgttcccc

SEQ ID NO: 4001399 - DNA, 15 bp, Homo sapiens
acccagtgcccccac

SEQ ID NO: 4001400 - DNA, 15 bp, Homo sapiens
acccagtgggacaga

SEQ ID NO: 4001401 - DNA, 18 bp, Homo sapiens
acccagtgggtctgggat

SEQ ID NO: 4001402 - DNA, 17 bp, Homo sapiens
acccagttgccatctgc

SEQ ID NO: 4001403 - DNA, 15 bp, Homo sapiens
acccataaacagtaa

SEQ ID NO: 4001404 - DNA, 23 bp, Homo sapiens
acccatatccttaccctccttgg

SEQ ID NO: 4001405 - DNA, 12 bp, Homo sapiens
acccatgaagat

SEQ ID NO: 4001406 - DNA, 23 bp, Homo sapiens
acccatgactttatatggatgat

SEQ ID NO: 4001407 - DNA, 12 bp, Homo sapiens
acccatgagcct

SEQ ID NO: 4001408 - DNA, 15 bp, Homo sapiens
acccatgagcctgcc

SEQ ID NO: 4001409 - DNA, 20 bp, Homo sapiens
acccatgagcctgcccgctg

SEQ ID NO: 4001410 - DNA, 12 bp, Homo sapiens
acccatgtcacc

SEQ ID NO: 4001411 - DNA, 20 bp, Homo sapiens
acccatgtcaccggtcagtg

SEQ ID NO: 4001412 - DNA, 15 bp, Homo sapiens
acccattatctggaa

SEQ ID NO: 4001413 - DNA, 23 bp, Homo sapiens
acccattctgttttcccccagca

SEQ ID NO: 4001414 - DNA, 23 bp, Homo sapiens
accccaaacaccttccagctcct

SEQ ID NO: 4001415 - DNA, 19 bp, Homo sapiens
accccaaagagcctggaga

SEQ ID NO: 4001416 - DNA, 15 bp, Homo sapiens
accccaaagctttcc

SEQ ID NO: 4001417 - DNA, 18 bp, Homo sapiens
accccaaagctttcctgc

SEQ ID NO: 4001418 - DNA, 14 bp, Homo sapiens
accccaacctcaga

SEQ ID NO: 4001419 - DNA, 21 bp, Homo sapiens
accccacacttgttccagctc

SEQ ID NO: 4001420 - DNA, 14 bp, Homo sapiens
accccacagaacct

SEQ ID NO: 4001421 - DNA, 20 bp, Homo sapiens
accccacagaaccttcaacc

SEQ ID NO: 4001422 - DNA, 16 bp, Homo sapiens
accccaccctccctgg

SEQ ID NO: 4001423 - DNA, 18 bp, Homo sapiens
accccaccctccctggag

SEQ ID NO: 4001424 - DNA, 14 bp, Homo sapiens
accccacctccact

SEQ ID NO: 4001425 - DNA, 21 bp, Homo sapiens
accccacctccactcccacct

SEQ ID NO: 4001426 - DNA, 17 bp, Homo sapiens
accccacgccctgttca

SEQ ID NO: 4001427 - DNA, 14 bp, Homo sapiens
accccactgccaag

SEQ ID NO: 4001428 - DNA, 19 bp, Homo sapiens
accccactgggccagccct

SEQ ID NO: 4001429 - DNA, 12 bp, Homo sapiens
accccagcccac

SEQ ID NO: 4001430 - DNA, 21 bp, Homo sapiens
accccagcctgacctgagact

SEQ ID NO: 4001431 - DNA, 20 bp, Homo sapiens
accccaggctgaagcaggtt

SEQ ID NO: 4001432 - DNA, 23 bp, Homo sapiens
accccaggctggacatgctgact

SEQ ID NO: 4001433 - DNA, 12 bp, Homo sapiens
accccagggccc

SEQ ID NO: 4001434 - DNA, 17 bp, Homo sapiens
accccagggccctggcc

SEQ ID NO: 4001435 - DNA, 19 bp, Homo sapiens
accccagggccctggccag

SEQ ID NO: 4001436 - DNA, 22 bp, Homo sapiens
accccagggccctggccagccg

SEQ ID NO: 4001437 - DNA, 19 bp, Homo sapiens
accccagttctaggggaga

SEQ ID NO: 4001438 - DNA, 15 bp, Homo sapiens
accccatcatccctt

SEQ ID NO: 4001439 - DNA, 17 bp, Homo sapiens
accccatccctccccag

SEQ ID NO: 4001440 - DNA, 14 bp, Homo sapiens
accccattcctgat

SEQ ID NO: 4001441 - DNA, 15 bp, Homo sapiens
acccccacacctcag

SEQ ID NO: 4001442 - DNA, 12 bp, Homo sapiens
acccccacccac

SEQ ID NO: 4001443 - DNA, 21 bp, Homo sapiens
acccccacccacctccaccca

SEQ ID NO: 4001444 - DNA, 15 bp, Homo sapiens
acccccacccccagc

SEQ ID NO: 4001445 - DNA, 18 bp, Homo sapiens
acccccacccccagctca

SEQ ID NO: 4001446 - DNA, 20 bp, Homo sapiens
acccccaccctgcactttcc

SEQ ID NO: 4001447 - DNA, 17 bp, Homo sapiens
acccccactcccgcctc

SEQ ID NO: 4001448 - DNA, 12 bp, Homo sapiens
acccccagctca

SEQ ID NO: 4001449 - DNA, 18 bp, Homo sapiens
acccccagctccggcctg

SEQ ID NO: 4001450 - DNA, 13 bp, Homo sapiens
acccccagctggg

SEQ ID NO: 4001451 - DNA, 15 bp, Homo sapiens
acccccattctgtcc

SEQ ID NO: 4001452 - DNA, 15 bp, Homo sapiens
accccccacacacac

SEQ ID NO: 4001453 - DNA, 22 bp, Homo sapiens
acccccccagcttcacttctga

SEQ ID NO: 4001454 - DNA, 13 bp, Homo sapiens
accccccccccac

SEQ ID NO: 4001455 - DNA, 19 bp, Homo sapiens
acccccctgttctaagggg

SEQ ID NO: 4001456 - DNA, 16 bp, Homo sapiens
acccccgaggggaggg

SEQ ID NO: 4001457 - DNA, 17 bp, Homo sapiens
acccccgccacctcagg

SEQ ID NO: 4001458 - DNA, 20 bp, Homo sapiens
accccctcaagccccagcag

SEQ ID NO: 4001459 - DNA, 23 bp, Homo sapiens
accccctccccgcccctgtggcc

SEQ ID NO: 4001460 - DNA, 20 bp, Homo sapiens
accccctccctacacacaca

SEQ ID NO: 4001461 - DNA, 11 bp, Homo sapiens
accccctcctt

SEQ ID NO: 4001462 - DNA, 15 bp, Homo sapiens
accccctccttcaga

SEQ ID NO: 4001463 - DNA, 16 bp, Homo sapiens
accccctccttcagac

SEQ ID NO: 4001464 - DNA, 17 bp, Homo sapiens
accccctccttcagaca

SEQ ID NO: 4001465 - DNA, 13 bp, Homo sapiens
accccctgccctg

SEQ ID NO: 4001466 - DNA, 21 bp, Homo sapiens
accccctgctccaccagcagc

SEQ ID NO: 4001467 - DNA, 22 bp, Homo sapiens
accccctgctccaccagcagca

SEQ ID NO: 4001468 - DNA, 19 bp, Homo sapiens
acccccttctactgagcct

SEQ ID NO: 4001469 - DNA, 14 bp, Homo sapiens
acccccttctctgc

SEQ ID NO: 4001470 - DNA, 16 bp, Homo sapiens
acccccttctctgctc

SEQ ID NO: 4001471 - DNA, 18 bp, Homo sapiens
acccccttctctgctcca

SEQ ID NO: 4001472 - DNA, 19 bp, Homo sapiens
acccccttctctgctccac

SEQ ID NO: 4001473 - DNA, 23 bp, Homo sapiens
acccccttctctgctccaccaca

SEQ ID NO: 4001474 - DNA, 21 bp, Homo sapiens
acccccttttcagctgagccc

SEQ ID NO: 4001475 - DNA, 22 bp, Homo sapiens
acccccttttcagctgagccct

SEQ ID NO: 4001476 - DNA, 13 bp, Homo sapiens
gtaaagaaatgtc

SEQ ID NO: 4001477 - DNA, 16 bp, Homo sapiens
gtaaagactgtagaag

SEQ ID NO: 4001478 - DNA, 20 bp, Homo sapiens
gtaaagctaaaatgatttta

SEQ ID NO: 4001479 - DNA, 13 bp, Homo sapiens
gtaaagctggccc

SEQ ID NO: 4001480 - DNA, 14 bp, Homo sapiens
gtaaagctggccct

SEQ ID NO: 4001481 - DNA, 15 bp, Homo sapiens
gtaaagctggccctg

SEQ ID NO: 4001482 - DNA, 14 bp, Homo sapiens
gtaaataaaccact

SEQ ID NO: 4001483 - DNA, 13 bp, Homo sapiens
gtaaataagagat

SEQ ID NO: 4001484 - DNA, 15 bp, Homo sapiens
gtaaataatttattt

SEQ ID NO: 4001485 - DNA, 18 bp, Homo sapiens
gtaaatacaagactgttg

SEQ ID NO: 4001486 - DNA, 12 bp, Homo sapiens
gtaaatacacca

SEQ ID NO: 4001487 - DNA, 15 bp, Homo sapiens
gtaaatagtatttga

SEQ ID NO: 4001488 - DNA, 16 bp, Homo sapiens
gtaaatatgaatctgc

SEQ ID NO: 4001489 - DNA, 23 bp, Homo sapiens
gtaaatatgaatctgctcacttt

SEQ ID NO: 4001490 - DNA, 13 bp, Homo sapiens
gtaaatattctat

SEQ ID NO: 4001491 - DNA, 17 bp, Homo sapiens
gtaaatcctgccattta

SEQ ID NO: 4001492 - DNA, 19 bp, Homo sapiens
gtaaatcctgccatttaaa

SEQ ID NO: 4001493 - DNA, 18 bp, Homo sapiens
gtaaatctcttctgtgtt

SEQ ID NO: 4001494 - DNA, 12 bp, Homo sapiens
gtaaatctgcca

SEQ ID NO: 4001495 - DNA, 13 bp, Homo sapiens
gtaaatctgccac

SEQ ID NO: 4001496 - DNA, 15 bp, Homo sapiens
gtaaatctgccacaa

SEQ ID NO: 4001497 - DNA, 14 bp, Homo sapiens
gtaaatcttttaca

SEQ ID NO: 4001498 - DNA, 13 bp, Homo sapiens
gtaaatgatttta

SEQ ID NO: 4001499 - DNA, 21 bp, Homo sapiens
gtaaatgggagggcattccat

SEQ ID NO: 4001500 - DNA, 16 bp, Homo sapiens
gtaaatggtgtacata

SEQ ID NO: 4001501 - DNA, 13 bp, Homo sapiens
gtaaatgtctttg

SEQ ID NO: 4001502 - DNA, 14 bp, Homo sapiens
gtaaatgtctttgt

SEQ ID NO: 4001503 - DNA, 17 bp, Homo sapiens
gtaacaatacaaatgga

SEQ ID NO: 4001504 - DNA, 19 bp, Homo sapiens
gtaacaattttaatgctat

SEQ ID NO: 4001505 - DNA, 14 bp, Homo sapiens
gtaacacataaaca

SEQ ID NO: 4001506 - DNA, 18 bp, Homo sapiens
gtaacagaacagcttcag

SEQ ID NO: 4001507 - DNA, 20 bp, Homo sapiens
gtaacaggaaaattttaaaa

SEQ ID NO: 4001508 - DNA, 12 bp, Homo sapiens
gtaacatgttta

SEQ ID NO: 4001509 - DNA, 11 bp, Homo sapiens
gtaaccagcca

SEQ ID NO: 4001510 - DNA, 12 bp, Homo sapiens
gtaaccagccag

SEQ ID NO: 4001511 - DNA, 20 bp, Homo sapiens
gtaaccagccagatcctctt

SEQ ID NO: 4001512 - DNA, 17 bp, Homo sapiens
gtaaccttatatttaca

SEQ ID NO: 4001513 - DNA, 16 bp, Homo sapiens
gtaacgcgtcttcctg

SEQ ID NO: 4001514 - DNA, 17 bp, Homo sapiens
gtaacgcgtcttcctga

SEQ ID NO: 4001515 - DNA, 19 bp, Homo sapiens
gtaactctaattcccattt

SEQ ID NO: 4001516 - DNA, 23 bp, Homo sapiens
gtaactctaattcccattttgca

SEQ ID NO: 4001517 - DNA, 17 bp, Homo sapiens
gtaactgctttctgttc

SEQ ID NO: 4001518 - DNA, 15 bp, Homo sapiens
gtaactgtcctgtcc

SEQ ID NO: 4001519 - DNA, 17 bp, Homo sapiens
gtaactgtcctgtcctg

SEQ ID NO: 4001520 - DNA, 14 bp, Homo sapiens
gtaacttaaaatag

SEQ ID NO: 4001521 - DNA, 16 bp, Homo sapiens
gtaacttaaggacctt

SEQ ID NO: 4001522 - DNA, 15 bp, Homo sapiens
gtaacttatattgaa

SEQ ID NO: 4001523 - DNA, 15 bp, Homo sapiens
gtaacttattagaaa

SEQ ID NO: 4001524 - DNA, 20 bp, Homo sapiens
gtaacttcctgctgcaccct

SEQ ID NO: 4001525 - DNA, 12 bp, Homo sapiens
gtaactttgaaa

SEQ ID NO: 4001526 - DNA, 11 bp, Homo sapiens
gtaagaaggca

SEQ ID NO: 4001527 - DNA, 21 bp, Homo sapiens
gtaagagcaccttcctcactt

SEQ ID NO: 4001528 - DNA, 22 bp, Homo sapiens
gtaagagtgtagaagcattcct

SEQ ID NO: 4001529 - DNA, 23 bp, Homo sapiens
gtaagatacaagtttcagacagg

SEQ ID NO: 4001530 - DNA, 20 bp, Homo sapiens
gtaagcaggagagaaatttc

SEQ ID NO: 4001531 - DNA, 23 bp, Homo sapiens
gtaagcataagcttatgcttaaa

SEQ ID NO: 4001532 - DNA, 16 bp, Homo sapiens
gtaagcggctcaagcc

SEQ ID NO: 4001533 - DNA, 22 bp, Homo sapiens
gtaagcggctcaagcccaggag

SEQ ID NO: 4001534 - DNA, 13 bp, Homo sapiens
gtaagctctggct

SEQ ID NO: 4001535 - DNA, 17 bp, Homo sapiens
gtaagctctggctttct

SEQ ID NO: 4001536 - DNA, 22 bp, Homo sapiens
gtaaggtcttacattgcctgac

SEQ ID NO: 4001537 - DNA, 12 bp, Homo sapiens
gtaagtcatcta

SEQ ID NO: 4001538 - DNA, 22 bp, Homo sapiens
gtaagtcatctacttaataaat

SEQ ID NO: 4001539 - DNA, 17 bp, Homo sapiens
gtaagtggagtcctgga

SEQ ID NO: 4001540 - DNA, 14 bp, Homo sapiens
gtaagttgtacaaa

SEQ ID NO: 4001541 - DNA, 22 bp, Homo sapiens
gtaagtttcaggtgacatgtga

SEQ ID NO: 4001542 - DNA, 16 bp, Homo sapiens
gtaataactgtgaagt

SEQ ID NO: 4001543 - DNA, 13 bp, Homo sapiens
gtaataagacata

SEQ ID NO: 4001544 - DNA, 19 bp, Homo sapiens
gtaatacgtagctctctta

SEQ ID NO: 4001545 - DNA, 12 bp, Homo sapiens
gtaatactggaa

SEQ ID NO: 4001546 - DNA, 17 bp, Homo sapiens
gtaatactggaataatt

SEQ ID NO: 4001547 - DNA, 18 bp, Homo sapiens
gtaatactggaataattt

SEQ ID NO: 4001548 - DNA, 16 bp, Homo sapiens
gtaatattgacttgta

SEQ ID NO: 4001549 - DNA, 19 bp, Homo sapiens
gtaatattgacttgtatat

SEQ ID NO: 4001550 - DNA, 18 bp, Homo sapiens
gtaatatttatatattta

SEQ ID NO: 4001551 - DNA, 14 bp, Homo sapiens
gtaatcaatgtttc

SEQ ID NO: 4001552 - DNA, 16 bp, Homo sapiens
gtaatcaggattgaat

SEQ ID NO: 4001553 - DNA, 18 bp, Homo sapiens
gtaatccaggcacagctg

SEQ ID NO: 4001554 - DNA, 20 bp, Homo sapiens
gtaatccaggcacagctgag

SEQ ID NO: 4001555 - DNA, 15 bp, Homo sapiens
gtaatccaggggtgt

SEQ ID NO: 4001556 - DNA, 20 bp, Homo sapiens
gtaatcccagcactttggga

SEQ ID NO: 4001557 - DNA, 18 bp, Homo sapiens
gtaatcccgccacctatc

SEQ ID NO: 4001558 - DNA, 17 bp, Homo sapiens
gtaatctctctgcagct

SEQ ID NO: 4001559 - DNA, 17 bp, Homo sapiens
gtaatgaaaatgaatat

SEQ ID NO: 4001560 - DNA, 15 bp, Homo sapiens
gtaatgagggactgg

SEQ ID NO: 4001561 - DNA, 23 bp, Homo sapiens
gtaatgggtacaatgaagaagtt

SEQ ID NO: 4001562 - DNA, 16 bp, Homo sapiens
gtaatgtgaataaatt

SEQ ID NO: 4001563 - DNA, 18 bp, Homo sapiens
gtaatgtgtggtggcctc

SEQ ID NO: 4001564 - DNA, 13 bp, Homo sapiens
gtaatgttactga

SEQ ID NO: 4001565 - DNA, 20 bp, Homo sapiens
gtaatgttactgatcatgca

SEQ ID NO: 4001566 - DNA, 21 bp, Homo sapiens
gtaatgttactgatcatgcat

SEQ ID NO: 4001567 - DNA, 17 bp, Homo sapiens
gtaattaagtactatgt

SEQ ID NO: 4001568 - DNA, 21 bp, Homo sapiens
gtaattatcgggaacagtgtt

SEQ ID NO: 4001569 - DNA, 22 bp, Homo sapiens
gtaattatcgggaacagtgttt

SEQ ID NO: 4001570 - DNA, 13 bp, Homo sapiens
gtaattatgattt

SEQ ID NO: 4001571 - DNA, 14 bp, Homo sapiens
gtaattcaagaaaa

SEQ ID NO: 4001572 - DNA, 12 bp, Homo sapiens
gtaattctaaat

SEQ ID NO: 4001573 - DNA, 15 bp, Homo sapiens
gtaattctaaatgaa

SEQ ID NO: 4001574 - DNA, 23 bp, Homo sapiens
gtaattctaccaaggtcttctta

SEQ ID NO: 4001575 - DNA, 15 bp, Homo sapiens
gtaattcttcagttg

SEQ ID NO: 4001576 - DNA, 15 bp, Homo sapiens
gtaattgaacttatc

SEQ ID NO: 4001577 - DNA, 16 bp, Homo sapiens
gtaattgaataaagtt

SEQ ID NO: 4001578 - DNA, 17 bp, Homo sapiens
gtaattgcttacatttt

SEQ ID NO: 4001579 - DNA, 22 bp, Homo sapiens
gtaattgcttacatttttacaa

SEQ ID NO: 4001580 - DNA, 23 bp, Homo sapiens
gtaattgcttacatttttacaat

SEQ ID NO: 4001581 - DNA, 9 bp, Homo sapiens
gtaattgtg

SEQ ID NO: 4001582 - DNA, 14 bp, Homo sapiens
gtaattgtgaaaaa

SEQ ID NO: 4001583 - DNA, 15 bp, Homo sapiens
gtaattttatatgaa

SEQ ID NO: 4001584 - DNA, 17 bp, Homo sapiens
gtaattttggattttgc

SEQ ID NO: 4001585 - DNA, 19 bp, Homo sapiens
gtacaaaaaaaaagtttta

SEQ ID NO: 4001586 - DNA, 20 bp, Homo sapiens
gtacaaaatccagctatgaa

SEQ ID NO: 4001587 - DNA, 16 bp, Homo sapiens
gtacaaatgtattttg

SEQ ID NO: 4001588 - DNA, 16 bp, Homo sapiens
gtacaatgtacacact

SEQ ID NO: 4001589 - DNA, 20 bp, Homo sapiens
gtacacaataagcaaaaaca

SEQ ID NO: 4001590 - DNA, 14 bp, Homo sapiens
gtacactctgctgt

SEQ ID NO: 4001591 - DNA, 14 bp, Homo sapiens
gtacactgaatatt

SEQ ID NO: 4001592 - DNA, 14 bp, Homo sapiens
gtacagaatatttc

SEQ ID NO: 4001593 - DNA, 17 bp, Homo sapiens
gtacagaatatttctat

SEQ ID NO: 4001594 - DNA, 11 bp, Homo sapiens
gtacagaattt

SEQ ID NO: 4001595 - DNA, 16 bp, Homo sapiens
gtacagaatttccact

SEQ ID NO: 4001596 - DNA, 15 bp, Homo sapiens
gtacagcatgtgcct

SEQ ID NO: 4001597 - DNA, 13 bp, Homo sapiens
gtacagcggctcc

SEQ ID NO: 4001598 - DNA, 21 bp, Homo sapiens
gtacagcggctcccctctgct

SEQ ID NO: 4001599 - DNA, 16 bp, Homo sapiens
gtacagggtttttacc

SEQ ID NO: 4001600 - DNA, 12 bp, Homo sapiens
gtacagtgttac

SEQ ID NO: 4001601 - DNA, 22 bp, Homo sapiens
gtacataaattgcataaagcat

SEQ ID NO: 4001602 - DNA, 22 bp, Homo sapiens
gtacataccctggccgccccct

SEQ ID NO: 4001603 - DNA, 21 bp, Homo sapiens
gtacatagttatttttctctt

SEQ ID NO: 4001604 - DNA, 18 bp, Homo sapiens
gtacatgttcgggtgtgg

SEQ ID NO: 4001605 - DNA, 21 bp, Homo sapiens
gtacatgttcgggtgtgggtt

SEQ ID NO: 4001606 - DNA, 14 bp, Homo sapiens
gtacatttaaaatt

SEQ ID NO: 4001607 - DNA, 15 bp, Homo sapiens
gtacatttaaaattg

SEQ ID NO: 4001608 - DNA, 14 bp, Homo sapiens
gtacatttatgatt

SEQ ID NO: 4001609 - DNA, 16 bp, Homo sapiens
gtacatttatgattta

SEQ ID NO: 4001610 - DNA, 18 bp, Homo sapiens
gtacatttatgatttaat

SEQ ID NO: 4001611 - DNA, 19 bp, Homo sapiens
gtacatttatgatttaata

SEQ ID NO: 4001612 - DNA, 23 bp, Homo sapiens
gtacatttatttattactgtccc

SEQ ID NO: 4001613 - DNA, 21 bp, Homo sapiens
gtaccaaagttttatcaagtt

SEQ ID NO: 4001614 - DNA, 18 bp, Homo sapiens
gtaccaaatctgacatat

SEQ ID NO: 4001615 - DNA, 17 bp, Homo sapiens
gtaccagctgcgcttgc

SEQ ID NO: 4001616 - DNA, 19 bp, Homo sapiens
gtaccaggggctgggctcc

SEQ ID NO: 4001617 - DNA, 15 bp, Homo sapiens
gtaccatcattttat

SEQ ID NO: 4001618 - DNA, 19 bp, Homo sapiens
gtaccatcattttattata

SEQ ID NO: 4001619 - DNA, 19 bp, Homo sapiens
gtaccatttatacaaatta

SEQ ID NO: 4001620 - DNA, 14 bp, Homo sapiens
gtaccatttgcatg

SEQ ID NO: 4001621 - DNA, 22 bp, Homo sapiens
gtaccccactgggccagccctg

SEQ ID NO: 4001622 - DNA, 17 bp, Homo sapiens
gtaccctctcagctcca

SEQ ID NO: 4001623 - DNA, 14 bp, Homo sapiens
gtacctcatcccat

SEQ ID NO: 4001624 - DNA, 16 bp, Homo sapiens
gtacctcctctcagtg

SEQ ID NO: 4001625 - DNA, 16 bp, Homo sapiens
gtacctgggtccccag

SEQ ID NO: 4001626 - DNA, 22 bp, Homo sapiens
gtaccttccatacacagaggag

SEQ ID NO: 4001627 - DNA, 13 bp, Homo sapiens
gtaccttgcttct

SEQ ID NO: 4001628 - DNA, 23 bp, Homo sapiens
gtaccttgcttcttactgataat

SEQ ID NO: 4001629 - DNA, 23 bp, Homo sapiens
gtaccttttgaggagccccagct

SEQ ID NO: 4001630 - DNA, 23 bp, Homo sapiens
gtactacacatttttaaattgtt

SEQ ID NO: 4001631 - DNA, 15 bp, Homo sapiens
gtactacctgtgtat

SEQ ID NO: 4001632 - DNA, 21 bp, Homo sapiens
gtactactagatgtctttagg

SEQ ID NO: 4001633 - DNA, 14 bp, Homo sapiens
gtactagtgttctg

SEQ ID NO: 4001634 - DNA, 15 bp, Homo sapiens
gtactagtgttctgt

SEQ ID NO: 4001635 - DNA, 17 bp, Homo sapiens
gtactagtgttctgttt

SEQ ID NO: 4001636 - DNA, 16 bp, Homo sapiens
gtactctcacatgtgg

SEQ ID NO: 4001637 - DNA, 14 bp, Homo sapiens
gtactgaaagcctt

SEQ ID NO: 4001638 - DNA, 22 bp, Homo sapiens
gtactgaaagccttagggaagc

SEQ ID NO: 4001639 - DNA, 14 bp, Homo sapiens
gtactgaatttttt

SEQ ID NO: 4001640 - DNA, 20 bp, Homo sapiens
gtactgactttgcttgcttt

SEQ ID NO: 4001641 - DNA, 14 bp, Homo sapiens
gtactgtagttttt

SEQ ID NO: 4001642 - DNA, 22 bp, Homo sapiens
gtactgttcggaaggggttcct

SEQ ID NO: 4001643 - DNA, 14 bp, Homo sapiens
gtactgttctgtgt

SEQ ID NO: 4001644 - DNA, 15 bp, Homo sapiens
gtactgttctgtgtc

SEQ ID NO: 4001645 - DNA, 18 bp, Homo sapiens
gtactgttctgtgtcttt

SEQ ID NO: 4001646 - DNA, 17 bp, Homo sapiens
gtacttaaatgaaagca

SEQ ID NO: 4001647 - DNA, 14 bp, Homo sapiens
gtacttaactattc

SEQ ID NO: 4001648 - DNA, 20 bp, Homo sapiens
gtacttagagtttctgtttg

SEQ ID NO: 4001649 - DNA, 18 bp, Homo sapiens
gtacttgagtgtaatgtt

SEQ ID NO: 4001650 - DNA, 23 bp, Homo sapiens
gtacttgatttgatgtgactttt

SEQ ID NO: 4001651 - DNA, 22 bp, Homo sapiens
gtacttgtgaaacacagctgtt

SEQ ID NO: 4001652 - DNA, 15 bp, Homo sapiens
gtacttgtttcatct

SEQ ID NO: 4001653 - DNA, 12 bp, Homo sapiens
gtacttgtttgc

SEQ ID NO: 4001654 - DNA, 22 bp, Homo sapiens
gtacttttatgatgtatattta

SEQ ID NO: 4001655 - DNA, 16 bp, Homo sapiens
gtagaaaagttgcaga

SEQ ID NO: 4001656 - DNA, 17 bp, Homo sapiens
gtagaaaagttgcagat

SEQ ID NO: 4001657 - DNA, 16 bp, Homo sapiens
gtagaaataatatgca

SEQ ID NO: 4001658 - DNA, 23 bp, Homo sapiens
gtagaaatatctgaaaatgtatg

SEQ ID NO: 4001659 - DNA, 22 bp, Homo sapiens
gtagaactcactctgggctgta

SEQ ID NO: 4001660 - DNA, 20 bp, Homo sapiens
gtagaagatttgatgctgga

SEQ ID NO: 4001661 - DNA, 22 bp, Homo sapiens
gtagaagcattccttctttgat

SEQ ID NO: 4001662 - DNA, 21 bp, Homo sapiens
gtagaagtcttagatgtatat

SEQ ID NO: 4001663 - DNA, 14 bp, Homo sapiens
gtagaattgcattg

SEQ ID NO: 4001664 - DNA, 20 bp, Homo sapiens
gtagacctagggaggacctt

SEQ ID NO: 4001665 - DNA, 21 bp, Homo sapiens
gtagacggctcagtatagata

SEQ ID NO: 4001666 - DNA, 10 bp, Homo sapiens
gtagactagt

SEQ ID NO: 4001667 - DNA, 17 bp, Homo sapiens
gtagactgtgccagagg

SEQ ID NO: 4001668 - DNA, 21 bp, Homo sapiens
gtagactgtgccagaggccag

SEQ ID NO: 4001669 - DNA, 13 bp, Homo sapiens
gtagactttgctt

SEQ ID NO: 4001670 - DNA, 12 bp, Homo sapiens
gtagagttaaga

SEQ ID NO: 4001671 - DNA, 17 bp, Homo sapiens
gtagagttaagaagctg

SEQ ID NO: 4001672 - DNA, 19 bp, Homo sapiens
gtagagttgatcaaaatca

SEQ ID NO: 4001673 - DNA, 14 bp, Homo sapiens
gtagagttgctgag

SEQ ID NO: 4001674 - DNA, 14 bp, Homo sapiens
gtagatgcagaaaa

SEQ ID NO: 4001675 - DNA, 19 bp, Homo sapiens
gtagatgcagaaaaagaaa

SEQ ID NO: 4001676 - DNA, 19 bp, Homo sapiens
gtagatgggggaactgtga

SEQ ID NO: 4001677 - DNA, 14 bp, Homo sapiens
gtagattgcttctg

SEQ ID NO: 4001678 - DNA, 12 bp, Homo sapiens
gtagcactgagg

SEQ ID NO: 4001679 - DNA, 19 bp, Homo sapiens
gtagcagggtcgggaaagg

SEQ ID NO: 4001680 - DNA, 18 bp, Homo sapiens
gtagcataaataaaactg

SEQ ID NO: 4001681 - DNA, 20 bp, Homo sapiens
gtagcataaataaaactgaa

SEQ ID NO: 4001682 - DNA, 13 bp, Homo sapiens
gtagcatacattt

SEQ ID NO: 4001683 - DNA, 12 bp, Homo sapiens
gtagcatgagag

SEQ ID NO: 4001684 - DNA, 21 bp, Homo sapiens
gtagcatgttgagccaggcct

SEQ ID NO: 4001685 - DNA, 18 bp, Homo sapiens
gtagccagcacacagggc

SEQ ID NO: 4001686 - DNA, 19 bp, Homo sapiens
gtagccagcacacagggca

SEQ ID NO: 4001687 - DNA, 14 bp, Homo sapiens
gtagccagctgtgc

SEQ ID NO: 4001688 - DNA, 14 bp, Homo sapiens
gtagcccagcactg

SEQ ID NO: 4001689 - DNA, 17 bp, Homo sapiens
gtagcccagcactgtga

SEQ ID NO: 4001690 - DNA, 21 bp, Homo sapiens
gtagcggaaaagttgtcttaa

SEQ ID NO: 4001691 - DNA, 13 bp, Homo sapiens
gtagcgtttttta

SEQ ID NO: 4001692 - DNA, 16 bp, Homo sapiens
gtagcttaagaaaaaa

SEQ ID NO: 4001693 - DNA, 18 bp, Homo sapiens
gtagcttcttctgaaaga

SEQ ID NO: 4001694 - DNA, 13 bp, Homo sapiens
gtagctttgcact

SEQ ID NO: 4001695 - DNA, 16 bp, Homo sapiens
gtaggaaagaggaagc

SEQ ID NO: 4001696 - DNA, 18 bp, Homo sapiens
gtaggaaggttaatgttc

SEQ ID NO: 4001697 - DNA, 14 bp, Homo sapiens
gtaggagctgcctt

SEQ ID NO: 4001698 - DNA, 14 bp, Homo sapiens
gtaggaggtttgga

SEQ ID NO: 4001699 - DNA, 14 bp, Homo sapiens
gtaggcagagcctt

SEQ ID NO: 4001700 - DNA, 21 bp, Homo sapiens
gtaggctggggcggggcccag

SEQ ID NO: 4001701 - DNA, 18 bp, Homo sapiens
gtagggagtacctgctgc

SEQ ID NO: 4001702 - DNA, 12 bp, Homo sapiens
gtagggctgact

SEQ ID NO: 4001703 - DNA, 18 bp, Homo sapiens
gtaggggcttagaggcat

SEQ ID NO: 4001704 - DNA, 15 bp, Homo sapiens
gtaggggtagggagc

SEQ ID NO: 4001705 - DNA, 15 bp, Homo sapiens
gtagggtgggagtgg

SEQ ID NO: 4001706 - DNA, 19 bp, Homo sapiens
gtaggttatttaaaataaa

SEQ ID NO: 4001707 - DNA, 22 bp, Homo sapiens
gtagtactcctgcaaaatttta

SEQ ID NO: 4001708 - DNA, 22 bp, Homo sapiens
gtagtagcgttttttaaatgta

SEQ ID NO: 4001709 - DNA, 23 bp, Homo sapiens
gtagtcccagctacttgggaggc

SEQ ID NO: 4001710 - DNA, 14 bp, Homo sapiens
gtagtccttggcat

SEQ ID NO: 4001711 - DNA, 21 bp, Homo sapiens
gtagtccttggcatagacatg

SEQ ID NO: 4001712 - DNA, 18 bp, Homo sapiens
gtagtctcattacttttg

SEQ ID NO: 4001713 - DNA, 19 bp, Homo sapiens
gtagtgaagactccagaaa

SEQ ID NO: 4001714 - DNA, 17 bp, Homo sapiens
gtagtgtagtcaggtgc

SEQ ID NO: 4001715 - DNA, 20 bp, Homo sapiens
gtagtgtagtcaggtgctca

SEQ ID NO: 4001716 - DNA, 21 bp, Homo sapiens
gtagtgtagtcaggtgctcaa

SEQ ID NO: 4001717 - DNA, 13 bp, Homo sapiens
gtagttaatttat

SEQ ID NO: 4001718 - DNA, 15 bp, Homo sapiens
gtagttaatttatct

SEQ ID NO: 4001719 - DNA, 13 bp, Homo sapiens
gtagttagtagca

SEQ ID NO: 4001720 - DNA, 12 bp, Homo sapiens
gtagttgtcttt

SEQ ID NO: 4001721 - DNA, 16 bp, Homo sapiens
gtagttgtctttcctg

SEQ ID NO: 4001722 - DNA, 19 bp, Homo sapiens
gtataaacataagttgcat

SEQ ID NO: 4001723 - DNA, 22 bp, Homo sapiens
gtataaacataagttgcattta

SEQ ID NO: 4001724 - DNA, 12 bp, Homo sapiens
gtataaagaaca

SEQ ID NO: 4001725 - DNA, 13 bp, Homo sapiens
gtataaataggag

SEQ ID NO: 4001726 - DNA, 20 bp, Homo sapiens
gtataaccccaccttgccaa

SEQ ID NO: 4001727 - DNA, 22 bp, Homo sapiens
gtataagcactgaaaaacaaca

SEQ ID NO: 4001728 - DNA, 15 bp, Homo sapiens
gtataagcatgcttt

SEQ ID NO: 4001729 - DNA, 21 bp, Homo sapiens
gtataatttcgagatttgtag

SEQ ID NO: 4001730 - DNA, 22 bp, Homo sapiens
gtatagaccaaagcaaagaaaa

SEQ ID NO: 4001731 - DNA, 21 bp, Homo sapiens
gtatataatttttttatgttt

SEQ ID NO: 4001732 - DNA, 12 bp, Homo sapiens
gtatatacagtt

SEQ ID NO: 4001733 - DNA, 12 bp, Homo sapiens
gtatatactttt

SEQ ID NO: 4001734 - DNA, 13 bp, Homo sapiens
gtatatacttttt

SEQ ID NO: 4001735 - DNA, 14 bp, Homo sapiens
gtatatatagaatc

SEQ ID NO: 4001736 - DNA, 20 bp, Homo sapiens
gtatatatatgccatgatgg

SEQ ID NO: 4001737 - DNA, 22 bp, Homo sapiens
gtatatcattctacagaataat

SEQ ID NO: 4001738 - DNA, 20 bp, Homo sapiens
gtatatccttttctgtgttt

SEQ ID NO: 4001739 - DNA, 21 bp, Homo sapiens
gtatatctggacaagccaact

SEQ ID NO: 4001740 - DNA, 16 bp, Homo sapiens
gtatatgtttatatac

SEQ ID NO: 4001741 - DNA, 19 bp, Homo sapiens
gtatatgtttatatactgg

SEQ ID NO: 4001742 - DNA, 15 bp, Homo sapiens
gtatattcatatatt

SEQ ID NO: 4001743 - DNA, 22 bp, Homo sapiens
gtatattgtataggggcaactg

SEQ ID NO: 4001744 - DNA, 22 bp, Homo sapiens
gtatatttatagtcacaagagc

SEQ ID NO: 4001745 - DNA, 15 bp, Homo sapiens
gtatatttgtacaaa

SEQ ID NO: 4001746 - DNA, 20 bp, Homo sapiens
gtatatttgtgatagcactt

SEQ ID NO: 4001747 - DNA, 19 bp, Homo sapiens
gtatatttttttaatttaa

SEQ ID NO: 4001748 - DNA, 15 bp, Homo sapiens
gtatcagtgttttaa

SEQ ID NO: 4001749 - DNA, 13 bp, Homo sapiens
gtatcatctccat

SEQ ID NO: 4001750 - DNA, 17 bp, Homo sapiens
gtatcatgccctgtgca

SEQ ID NO: 4001751 - DNA, 14 bp, Homo sapiens
gtatcattaatgta

SEQ ID NO: 4001752 - DNA, 20 bp, Homo sapiens
gtatccaaaaatagccctgc

SEQ ID NO: 4001753 - DNA, 16 bp, Homo sapiens
gtatcctgcccagtgt

SEQ ID NO: 4001754 - DNA, 20 bp, Homo sapiens
gtatcctgtgacatgtaaca

SEQ ID NO: 4001755 - DNA, 17 bp, Homo sapiens
gtatcggagacagtgat

SEQ ID NO: 4001756 - DNA, 14 bp, Homo sapiens
gtatctagcaatca

SEQ ID NO: 4001757 - DNA, 15 bp, Homo sapiens
gtatctagtgcagct

SEQ ID NO: 4001758 - DNA, 22 bp, Homo sapiens
gtatctcagaaagtgcctgaca

SEQ ID NO: 4001759 - DNA, 19 bp, Homo sapiens
gtatctcatttaatttgtt

SEQ ID NO: 4001760 - DNA, 14 bp, Homo sapiens
gtatctccaggatt

SEQ ID NO: 4001761 - DNA, 22 bp, Homo sapiens
gtatctctttcacattgtttgc

SEQ ID NO: 4001762 - DNA, 12 bp, Homo sapiens
gtatctgagcag

SEQ ID NO: 4001763 - DNA, 21 bp, Homo sapiens
gtatcttccatatttggaaga

SEQ ID NO: 4001764 - DNA, 22 bp, Homo sapiens
gtatcttccatatttggaagaa

SEQ ID NO: 4001765 - DNA, 15 bp, Homo sapiens
gtatcttctattttt

SEQ ID NO: 4001766 - DNA, 17 bp, Homo sapiens
gtatcttctatttttat

SEQ ID NO: 4001767 - DNA, 18 bp, Homo sapiens
gtatcttggggcaagact

SEQ ID NO: 4001768 - DNA, 21 bp, Homo sapiens
gtatcttttatcctgggagca

SEQ ID NO: 4001769 - DNA, 16 bp, Homo sapiens
gtatcttttttcaaaa

SEQ ID NO: 4001770 - DNA, 19 bp, Homo sapiens
gtatgaagagcttgctttg

SEQ ID NO: 4001771 - DNA, 19 bp, Homo sapiens
gtatgaataaagacaccta

SEQ ID NO: 4001772 - DNA, 21 bp, Homo sapiens
gtatgaccagtgataatgccc

SEQ ID NO: 4001773 - DNA, 14 bp, Homo sapiens
gtatgactaaagag

SEQ ID NO: 4001774 - DNA, 14 bp, Homo sapiens
gtatgagctgaggg

SEQ ID NO: 4001775 - DNA, 20 bp, Homo sapiens
gtatgatctctctagctttg

SEQ ID NO: 4001776 - DNA, 21 bp, Homo sapiens
gtatgatctctctagctttgt

SEQ ID NO: 4001777 - DNA, 23 bp, Homo sapiens
gtatgatttataaacagacaata

SEQ ID NO: 4001778 - DNA, 14 bp, Homo sapiens
gtatgctggccagc

SEQ ID NO: 4001779 - DNA, 15 bp, Homo sapiens
gtatgctggccagca

SEQ ID NO: 4001780 - DNA, 18 bp, Homo sapiens
gtatgctggccagcaccc

SEQ ID NO: 4001781 - DNA, 19 bp, Homo sapiens
gtatgctggccagcaccct

SEQ ID NO: 4001782 - DNA, 20 bp, Homo sapiens
gtatgctggccagcaccctc

SEQ ID NO: 4001783 - DNA, 21 bp, Homo sapiens
gtatggaaaaaccatttgaag

SEQ ID NO: 4001784 - DNA, 18 bp, Homo sapiens
gtatggaatacagtgtta

SEQ ID NO: 4001785 - DNA, 14 bp, Homo sapiens
gtatggctctgcac

SEQ ID NO: 4001786 - DNA, 20 bp, Homo sapiens
gtatggctctgcacccctct

SEQ ID NO: 4001787 - DNA, 19 bp, Homo sapiens
gtatgggtagggtaaatca

SEQ ID NO: 4001788 - DNA, 22 bp, Homo sapiens
gtatgtaatgtgtggtggcctc

SEQ ID NO: 4001789 - DNA, 15 bp, Homo sapiens
gtatgtaatttatgc

SEQ ID NO: 4001790 - DNA, 13 bp, Homo sapiens
gtatgtctgccat

SEQ ID NO: 4001791 - DNA, 15 bp, Homo sapiens
gtatgttatgaacat

SEQ ID NO: 4001792 - DNA, 19 bp, Homo sapiens
gtatgtttaatctgttatg

SEQ ID NO: 4001793 - DNA, 14 bp, Homo sapiens
gtatgtttgcacac

SEQ ID NO: 4001794 - DNA, 22 bp, Homo sapiens
gtattagctgtattatccattt

SEQ ID NO: 4001795 - DNA, 14 bp, Homo sapiens
gtattatctgtgtt

SEQ ID NO: 4001796 - DNA, 17 bp, Homo sapiens
gtattatgcatatataa

SEQ ID NO: 4001797 - DNA, 14 bp, Homo sapiens
gtattatttggagt

SEQ ID NO: 4001798 - DNA, 20 bp, Homo sapiens
gtattccttttgtgtacagt

SEQ ID NO: 4001799 - DNA, 23 bp, Homo sapiens
gtattccttttgtgtacagtgtg

SEQ ID NO: 4001800 - DNA, 12 bp, Homo sapiens
gtattctcagag

SEQ ID NO: 4001801 - DNA, 14 bp, Homo sapiens
gtattctcagagca

SEQ ID NO: 4001802 - DNA, 21 bp, Homo sapiens
gtattctcagagcatgtgtca

SEQ ID NO: 4001803 - DNA, 22 bp, Homo sapiens
gtattgacaactgcacatgaaa

SEQ ID NO: 4001804 - DNA, 21 bp, Homo sapiens
gtattgactgtaccacagaca

SEQ ID NO: 4001805 - DNA, 20 bp, Homo sapiens
gtattgctgctgtgcgtgga

SEQ ID NO: 4001806 - DNA, 23 bp, Homo sapiens
gtattggagcacatgttactgct

SEQ ID NO: 4001807 - DNA, 18 bp, Homo sapiens
gtatttaaactatcttgt

SEQ ID NO: 4001808 - DNA, 22 bp, Homo sapiens
gtatttaaactatcttgtgtga

SEQ ID NO: 4001809 - DNA, 16 bp, Homo sapiens
gtatttacgctttgat

SEQ ID NO: 4001810 - DNA, 12 bp, Homo sapiens
gtatttataata

SEQ ID NO: 4001811 - DNA, 16 bp, Homo sapiens
gtatttattcctctgt

SEQ ID NO: 4001812 - DNA, 13 bp, Homo sapiens
gtatttattttgt

SEQ ID NO: 4001813 - DNA, 23 bp, Homo sapiens
gtatttattttgtaattatgatt

SEQ ID NO: 4001814 - DNA, 18 bp, Homo sapiens
gtatttcatgtggctgta

SEQ ID NO: 4001815 - DNA, 13 bp, Homo sapiens
gtatttcatttct

SEQ ID NO: 4001816 - DNA, 14 bp, Homo sapiens
gtatttctcaggaa

SEQ ID NO: 4001817 - DNA, 18 bp, Homo sapiens
gtatttgaattaaaactt

SEQ ID NO: 4001818 - DNA, 22 bp, Homo sapiens
gtatttggtccaaaaaaaggaa

SEQ ID NO: 4001819 - DNA, 17 bp, Homo sapiens
gtattttaagaagacat

SEQ ID NO: 4001820 - DNA, 22 bp, Homo sapiens
gtattttatcttattttctcaa

SEQ ID NO: 4001821 - DNA, 17 bp, Homo sapiens
gtattttgaagaatatt

SEQ ID NO: 4001822 - DNA, 12 bp, Homo sapiens
gtattttgaagt

SEQ ID NO: 4001823 - DNA, 18 bp, Homo sapiens
gtattttgaagtttacat

SEQ ID NO: 4001824 - DNA, 19 bp, Homo sapiens
gtattttgaagtttacatt

SEQ ID NO: 4001825 - DNA, 15 bp, Homo sapiens
gtatttttactatta

SEQ ID NO: 4001826 - DNA, 18 bp, Homo sapiens
gtatttttgttagtttac

SEQ ID NO: 4001827 - DNA, 17 bp, Homo sapiens
gtattttttaaaacact

SEQ ID NO: 4001828 - DNA, 20 bp, Homo sapiens
gtattttttaaaacactaaa

SEQ ID NO: 4001829 - DNA, 18 bp, Homo sapiens
gtattttttaattgattt

SEQ ID NO: 4001830 - DNA, 18 bp, Homo sapiens
gtatttttttttctaaga

SEQ ID NO: 4001831 - DNA, 22 bp, Homo sapiens
gtatttttttttctaagagaag

SEQ ID NO: 4001832 - DNA, 15 bp, Homo sapiens
gtcaaaagttggtgt

SEQ ID NO: 4001833 - DNA, 17 bp, Homo sapiens
gtcaaacattcgtgagc

SEQ ID NO: 4001834 - DNA, 21 bp, Homo sapiens
gtcaaaccgcactcacccatg

SEQ ID NO: 4001835 - DNA, 22 bp, Homo sapiens
gtcaaaccgcactcacccatgt

SEQ ID NO: 4001836 - DNA, 16 bp, Homo sapiens
gtcaaagacagaatgg

SEQ ID NO: 4001837 - DNA, 19 bp, Homo sapiens
gtcaaagacagaatggtgg

SEQ ID NO: 4001838 - DNA, 11 bp, Homo sapiens
gtcaacaaact

SEQ ID NO: 4001839 - DNA, 17 bp, Homo sapiens
gtcaaccctcaggggaa

SEQ ID NO: 4001840 - DNA, 12 bp, Homo sapiens
gtcaagaagaaa

SEQ ID NO: 4001841 - DNA, 12 bp, Homo sapiens
gtcaagctgctc

SEQ ID NO: 4001842 - DNA, 19 bp, Homo sapiens
gtcaagctgctctgagcca

SEQ ID NO: 4001843 - DNA, 14 bp, Homo sapiens
gtcaagtaagaaga

SEQ ID NO: 4001844 - DNA, 16 bp, Homo sapiens
gtcaagtgggatctgt

SEQ ID NO: 4001845 - DNA, 17 bp, Homo sapiens
gtcaagttaacaaggaa

SEQ ID NO: 4001846 - DNA, 18 bp, Homo sapiens
gtcaagttaacaaggaat

SEQ ID NO: 4001847 - DNA, 17 bp, Homo sapiens
gtcaataaacaacagct

SEQ ID NO: 4001848 - DNA, 23 bp, Homo sapiens
gtcaataaacttagaggaaaatg

SEQ ID NO: 4001849 - DNA, 20 bp, Homo sapiens
gtcaatattaaatacagaca

SEQ ID NO: 4001850 - DNA, 23 bp, Homo sapiens
gtcaatattaaatacagacacta

SEQ ID NO: 4001851 - DNA, 14 bp, Homo sapiens
gtcaatcatttctc

SEQ ID NO: 4001852 - DNA, 16 bp, Homo sapiens
gtcaatcatttctcac

SEQ ID NO: 4001853 - DNA, 14 bp, Homo sapiens
gtcaatttccctca

SEQ ID NO: 4001854 - DNA, 11 bp, Homo sapiens
gtcacaataaa

SEQ ID NO: 4001855 - DNA, 16 bp, Homo sapiens
gtcacactgtggccag

SEQ ID NO: 4001856 - DNA, 13 bp, Homo sapiens
gtcacagctggat

SEQ ID NO: 4001857 - DNA, 16 bp, Homo sapiens
gtcacagctggatctg

SEQ ID NO: 4001858 - DNA, 22 bp, Homo sapiens
gtcacagttcttggtgactgtc

SEQ ID NO: 4001859 - DNA, 14 bp, Homo sapiens
gtcacatccatccc

SEQ ID NO: 4001860 - DNA, 19 bp, Homo sapiens
gtcacatccatccctccat

SEQ ID NO: 4001861 - DNA, 16 bp, Homo sapiens
gtcacattcaggaaga

SEQ ID NO: 4001862 - DNA, 13 bp, Homo sapiens
gtcaccaaggaaa

SEQ ID NO: 4001863 - DNA, 14 bp, Homo sapiens
gtcaccaaggaaac

SEQ ID NO: 4001864 - DNA, 22 bp, Homo sapiens
gtcaccaccacccgaaatgcca

SEQ ID NO: 4001865 - DNA, 19 bp, Homo sapiens
gtcaccagctatctgtcat

SEQ ID NO: 4001866 - DNA, 20 bp, Homo sapiens
gtcacccaggctggactgca

SEQ ID NO: 4001867 - DNA, 17 bp, Homo sapiens
gtcaccggtcagtgcct

SEQ ID NO: 4001868 - DNA, 15 bp, Homo sapiens
gtcacctagcaagct

SEQ ID NO: 4001869 - DNA, 19 bp, Homo sapiens
gtcacctagcaagctgccg

SEQ ID NO: 4001870 - DNA, 13 bp, Homo sapiens
gtcacctccccac

SEQ ID NO: 4001871 - DNA, 21 bp, Homo sapiens
gtcacctctctcagagcatct

SEQ ID NO: 4001872 - DNA, 15 bp, Homo sapiens
gtcacctgctccaga

SEQ ID NO: 4001873 - DNA, 16 bp, Homo sapiens
gtcacctgctccagaa

SEQ ID NO: 4001874 - DNA, 13 bp, Homo sapiens
gtcacctgcttct

SEQ ID NO: 4001875 - DNA, 19 bp, Homo sapiens
gtcacgctggggctctctg

SEQ ID NO: 4001876 - DNA, 21 bp, Homo sapiens
gtcacgctggggctctctgag

SEQ ID NO: 4001877 - DNA, 19 bp, Homo sapiens
gtcactatgggatgagaaa

SEQ ID NO: 4001878 - DNA, 18 bp, Homo sapiens
gtcactcattgctgagcc

SEQ ID NO: 4001879 - DNA, 19 bp, Homo sapiens
gtcactcattgctgagcct

SEQ ID NO: 4001880 - DNA, 22 bp, Homo sapiens
gtcactcattgctgagcctctg

SEQ ID NO: 4001881 - DNA, 23 bp, Homo sapiens
gtcactcattgctgagcctctgc

SEQ ID NO: 4001882 - DNA, 12 bp, Homo sapiens
gtcactcctggg

SEQ ID NO: 4001883 - DNA, 13 bp, Homo sapiens
gtcactcctgggg

SEQ ID NO: 4001884 - DNA, 23 bp, Homo sapiens
gtcactgcacagtgcatctcagc

SEQ ID NO: 4001885 - DNA, 15 bp, Homo sapiens
gtcactggaaagggg

SEQ ID NO: 4001886 - DNA, 18 bp, Homo sapiens
gtcactggaaaggggaga

SEQ ID NO: 4001887 - DNA, 13 bp, Homo sapiens
gtcactggctggc

SEQ ID NO: 4001888 - DNA, 20 bp, Homo sapiens
gtcactgtactgacttgagg

SEQ ID NO: 4001889 - DNA, 23 bp, Homo sapiens
gtcacttgatgtgccattttaaa

SEQ ID NO: 4001890 - DNA, 23 bp, Homo sapiens
gtcactttgctctgggtggaagt

SEQ ID NO: 4001891 - DNA, 22 bp, Homo sapiens
gtcagaagagagggtgagtcct

SEQ ID NO: 4001892 - DNA, 18 bp, Homo sapiens
gtcagaagcctccaagcc

SEQ ID NO: 4001893 - DNA, 18 bp, Homo sapiens
gtcagaatcagaatcatg

SEQ ID NO: 4001894 - DNA, 23 bp, Homo sapiens
gtcagaatcagaatcatggagaa

SEQ ID NO: 4001895 - DNA, 18 bp, Homo sapiens
gtcagacagaacttgaat

SEQ ID NO: 4001896 - DNA, 16 bp, Homo sapiens
gtcagagccctggctg

SEQ ID NO: 4001897 - DNA, 17 bp, Homo sapiens
gtcagagccctggctgg

SEQ ID NO: 4001898 - DNA, 17 bp, Homo sapiens
gtcagagtccagtgctc

SEQ ID NO: 4001899 - DNA, 19 bp, Homo sapiens
gtcagatgagcaaggacat

SEQ ID NO: 4001900 - DNA, 20 bp, Homo sapiens
gtcagatgagcaaggacatt

SEQ ID NO: 4001901 - DNA, 22 bp, Homo sapiens
gtcagatggaggttctcagagc

SEQ ID NO: 4001902 - DNA, 12 bp, Homo sapiens
gtcagcagacac

SEQ ID NO: 4001903 - DNA, 19 bp, Homo sapiens
gtcagcatgcttcccagag

SEQ ID NO: 4001904 - DNA, 19 bp, Homo sapiens
gtcagctactaatgatgtt

SEQ ID NO: 4001905 - DNA, 12 bp, Homo sapiens
gtcagctccagc

SEQ ID NO: 4001906 - DNA, 13 bp, Homo sapiens
gtcagctccagct

SEQ ID NO: 4001907 - DNA, 14 bp, Homo sapiens
gtcagctctctgcc

SEQ ID NO: 4001908 - DNA, 21 bp, Homo sapiens
gtcagctctctgccctgtgta

SEQ ID NO: 4001909 - DNA, 22 bp, Homo sapiens
gtcagctgtttctagagttcct

SEQ ID NO: 4001910 - DNA, 16 bp, Homo sapiens
gtcaggaacagaagga

SEQ ID NO: 4001911 - DNA, 16 bp, Homo sapiens
gtcaggaacagtggct

SEQ ID NO: 4001912 - DNA, 20 bp, Homo sapiens
gtcaggaacagtggctgggt

SEQ ID NO: 4001913 - DNA, 15 bp, Homo sapiens
gtcaggacggctcct

SEQ ID NO: 4001914 - DNA, 21 bp, Homo sapiens
gtcaggacggctcctcagagc

SEQ ID NO: 4001915 - DNA, 21 bp, Homo sapiens
gtcaggagatcgagaccatcc

SEQ ID NO: 4001916 - DNA, 13 bp, Homo sapiens
gtcaggagttcct

SEQ ID NO: 4001917 - DNA, 22 bp, Homo sapiens
gtcaggccctgactcctctggc

SEQ ID NO: 4001918 - DNA, 16 bp, Homo sapiens
gtcaggccgggcagag

SEQ ID NO: 4001919 - DNA, 20 bp, Homo sapiens
gtcaggctaatgttggcaga

SEQ ID NO: 4001920 - DNA, 12 bp, Homo sapiens
gtcaggctccat

SEQ ID NO: 4001921 - DNA, 17 bp, Homo sapiens
gtcaggctccattagga

SEQ ID NO: 4001922 - DNA, 14 bp, Homo sapiens
gtcaggctgggcag

SEQ ID NO: 4001923 - DNA, 17 bp, Homo sapiens
gtcaggctgggcagccc

SEQ ID NO: 4001924 - DNA, 20 bp, Homo sapiens
gtcaggctgggcagccccag

SEQ ID NO: 4001925 - DNA, 21 bp, Homo sapiens
gtcaggctgggcagccccaga

SEQ ID NO: 4001926 - DNA, 23 bp, Homo sapiens
gtcaggctgggcagccccagaga

SEQ ID NO: 4001927 - DNA, 22 bp, Homo sapiens
gtcagggagtgctggctcacag

SEQ ID NO: 4001928 - DNA, 14 bp, Homo sapiens
gtcagtatccaggc

SEQ ID NO: 4001929 - DNA, 16 bp, Homo sapiens
gtcagtcacagccacc

SEQ ID NO: 4001930 - DNA, 19 bp, Homo sapiens
gtcagtcatgatggcacca

SEQ ID NO: 4001931 - DNA, 22 bp, Homo sapiens
gtcatatactgccatgtactag

SEQ ID NO: 4001932 - DNA, 14 bp, Homo sapiens
gtcatatagtaaac

SEQ ID NO: 4001933 - DNA, 15 bp, Homo sapiens
gtcatatagtaaaca

SEQ ID NO: 4001934 - DNA, 16 bp, Homo sapiens
gtcatatgttaagcag

SEQ ID NO: 4001935 - DNA, 15 bp, Homo sapiens
gtcatcatcagggcc

SEQ ID NO: 4001936 - DNA, 16 bp, Homo sapiens
gtcatcatcagggcct

SEQ ID NO: 4001937 - DNA, 22 bp, Homo sapiens
gtcatccttggtctttgtatct

SEQ ID NO: 4001938 - DNA, 22 bp, Homo sapiens
gtcatcggaggctgggcccctg

SEQ ID NO: 4001939 - DNA, 18 bp, Homo sapiens
gtcatctcattccactgt

SEQ ID NO: 4001940 - DNA, 17 bp, Homo sapiens
gtcatctgttagggcct

SEQ ID NO: 4001941 - DNA, 14 bp, Homo sapiens
gtcatgcataaata

SEQ ID NO: 4001942 - DNA, 17 bp, Homo sapiens
gtcatgctcccctgtgc

SEQ ID NO: 4001943 - DNA, 15 bp, Homo sapiens
gtcatggcttaatgt

SEQ ID NO: 4001944 - DNA, 20 bp, Homo sapiens
gtcatggcttaatgtttatt

SEQ ID NO: 4001945 - DNA, 15 bp, Homo sapiens
gtcatgtctgcttgt

SEQ ID NO: 4001946 - DNA, 19 bp, Homo sapiens
gtcatgtctgcttgtcaaa

SEQ ID NO: 4001947 - DNA, 13 bp, Homo sapiens
gtcattaaaattg

SEQ ID NO: 4001948 - DNA, 21 bp, Homo sapiens
gtcattatgagaggcaatgat

SEQ ID NO: 4001949 - DNA, 12 bp, Homo sapiens
gtcattccagag

SEQ ID NO: 4001950 - DNA, 16 bp, Homo sapiens
gtcattcgttctgtgg

SEQ ID NO: 4001951 - DNA, 16 bp, Homo sapiens
gtcattgacctctcag

SEQ ID NO: 4001952 - DNA, 17 bp, Homo sapiens
gtcattgacctctcagg

SEQ ID NO: 4001953 - DNA, 18 bp, Homo sapiens
gtcattgacctctcaggg

SEQ ID NO: 4001954 - DNA, 18 bp, Homo sapiens
gtcattgcagtttaagag

SEQ ID NO: 4001955 - DNA, 22 bp, Homo sapiens
gtcattgctgttgtccctctgc

SEQ ID NO: 4001956 - DNA, 22 bp, Homo sapiens
gtcattgcttcttctgaggcct

SEQ ID NO: 4001957 - DNA, 14 bp, Homo sapiens
gtcattgttctcct

SEQ ID NO: 4001958 - DNA, 13 bp, Homo sapiens
gtcatttaaatgt

SEQ ID NO: 4001959 - DNA, 12 bp, Homo sapiens
gtcatttcattc

SEQ ID NO: 4001960 - DNA, 14 bp, Homo sapiens
gtcatttcattcca

SEQ ID NO: 4001961 - DNA, 21 bp, Homo sapiens
gtcatttgttgtgatgtcttt

SEQ ID NO: 4001962 - DNA, 21 bp, Homo sapiens
gtcattttaactttatcacat

SEQ ID NO: 4001963 - DNA, 19 bp, Homo sapiens
gtccaaaaaaaggaaaaat

SEQ ID NO: 4001964 - DNA, 21 bp, Homo sapiens
gtccaaaaaaaggaaaaataa

SEQ ID NO: 4001965 - DNA, 17 bp, Homo sapiens
gtccaaaagcgccctca

SEQ ID NO: 4001966 - DNA, 14 bp, Homo sapiens
gtccaaaggaggct

SEQ ID NO: 4001967 - DNA, 20 bp, Homo sapiens
gtccaaaggaggctggcagg

SEQ ID NO: 4001968 - DNA, 20 bp, Homo sapiens
gtccaaataacaagtaccaa

SEQ ID NO: 4001969 - DNA, 22 bp, Homo sapiens
gtccaaatgtcctccagaagcc

SEQ ID NO: 4001970 - DNA, 14 bp, Homo sapiens
gtccaacaagaatg

SEQ ID NO: 4001971 - DNA, 13 bp, Homo sapiens
gtccaagcagatt

SEQ ID NO: 4001972 - DNA, 15 bp, Homo sapiens
gtccaagctgggaga

SEQ ID NO: 4001973 - DNA, 22 bp, Homo sapiens
gtccaaggaaacttgaatcaaa

SEQ ID NO: 4001974 - DNA, 18 bp, Homo sapiens
gtccaaggccagtcccca

SEQ ID NO: 4001975 - DNA, 22 bp, Homo sapiens
gtccaaggggtcccctccagga

SEQ ID NO: 4001976 - DNA, 12 bp, Homo sapiens
gtccaatgtggc

SEQ ID NO: 4001977 - DNA, 16 bp, Homo sapiens
gtccaattagtttcct

SEQ ID NO: 4001978 - DNA, 19 bp, Homo sapiens
gtccaatttgtaaaaacag

SEQ ID NO: 4001979 - DNA, 13 bp, Homo sapiens
gtccacagagagg

SEQ ID NO: 4001980 - DNA, 14 bp, Homo sapiens
gtccaccccccaca

SEQ ID NO: 4001981 - DNA, 15 bp, Homo sapiens
gtccaccccccacac

SEQ ID NO: 4001982 - DNA, 16 bp, Homo sapiens
gtccactccctgctcc

SEQ ID NO: 4001983 - DNA, 13 bp, Homo sapiens
gtccactggggtg

SEQ ID NO: 4001984 - DNA, 21 bp, Homo sapiens
gtccactggggtggcctgact

SEQ ID NO: 4001985 - DNA, 18 bp, Homo sapiens
gtccagaaactcctgttt

SEQ ID NO: 4001986 - DNA, 19 bp, Homo sapiens
gtccagaagaatattcagg

SEQ ID NO: 4001987 - DNA, 22 bp, Homo sapiens
gtccagaagaatattcaggact

SEQ ID NO: 4001988 - DNA, 17 bp, Homo sapiens
gtccagagctgcttccc

SEQ ID NO: 4001989 - DNA, 12 bp, Homo sapiens
gtccagagcttg

SEQ ID NO: 4001990 - DNA, 20 bp, Homo sapiens
gtccagccgccattgccacc

SEQ ID NO: 4001991 - DNA, 17 bp, Homo sapiens
gtccagctgagcgccag

SEQ ID NO: 4001992 - DNA, 22 bp, Homo sapiens
gtccagctggggccagaggctg

SEQ ID NO: 4001993 - DNA, 12 bp, Homo sapiens
gtccaggatctc

SEQ ID NO: 4001994 - DNA, 22 bp, Homo sapiens
gtccaggatctccactgataag

SEQ ID NO: 4001995 - DNA, 20 bp, Homo sapiens
gtccagggaagctggccgag

SEQ ID NO: 4001996 - DNA, 22 bp, Homo sapiens
gtccaggggtctgtctgctttg

SEQ ID NO: 4001997 - DNA, 17 bp, Homo sapiens
gtccagggtttctctgc

SEQ ID NO: 4001998 - DNA, 12 bp, Homo sapiens
gtccagtgctct

SEQ ID NO: 4001999 - DNA, 17 bp, Homo sapiens
gtccagtgctctgcctc

SEQ ID NO: 4002000 - DNA, 18 bp, Homo sapiens
gtccagtgtcacctctct

SEQ ID NO: 4002001 - DNA, 22 bp, Homo sapiens
gtccagtgtcacctctctcaga

SEQ ID NO: 4002002 - DNA, 13 bp, Homo sapiens
gtccatagctgtg

SEQ ID NO: 4002003 - DNA, 16 bp, Homo sapiens
gtccatagctgtggtg

SEQ ID NO: 4002004 - DNA, 21 bp, Homo sapiens
gtccatatttacattctagtt

SEQ ID NO: 4002005 - DNA, 15 bp, Homo sapiens
gtccatcagcccctc

SEQ ID NO: 4002006 - DNA, 23 bp, Homo sapiens
gtccatcagggatctcagaggct

SEQ ID NO: 4002007 - DNA, 10 bp, Homo sapiens
gtccatgccc

SEQ ID NO: 4002008 - DNA, 19 bp, Homo sapiens
gtccatgctaacaaagaca

SEQ ID NO: 4002009 - DNA, 22 bp, Homo sapiens
gtccatttatatatgaaaacta

SEQ ID NO: 4002010 - DNA, 16 bp, Homo sapiens
gtccatttgttcctgc

SEQ ID NO: 4002011 - DNA, 22 bp, Homo sapiens
gtcccaaatatgtattttccta

SEQ ID NO: 4002012 - DNA, 17 bp, Homo sapiens
gtcccaaggttctgggt

SEQ ID NO: 4002013 - DNA, 21 bp, Homo sapiens
gtcccacccacacagctgccc

SEQ ID NO: 4002014 - DNA, 22 bp, Homo sapiens
gtcccacccacacagctgccct

SEQ ID NO: 4002015 - DNA, 14 bp, Homo sapiens
gtcccacccccacc

SEQ ID NO: 4002016 - DNA, 22 bp, Homo sapiens
gtcccacccccacccccagctc

SEQ ID NO: 4002017 - DNA, 23 bp, Homo sapiens
gtcccacccccacccccagctca

SEQ ID NO: 4002018 - DNA, 17 bp, Homo sapiens
gtcccacccctagccac

SEQ ID NO: 4002019 - DNA, 18 bp, Homo sapiens
gtcccaccgggagcctcc

SEQ ID NO: 4002020 - DNA, 19 bp, Homo sapiens
gtcccaccgggagcctccc

SEQ ID NO: 4002021 - DNA, 17 bp, Homo sapiens
gtcccacgtctggccag

SEQ ID NO: 4002022 - DNA, 20 bp, Homo sapiens
gtcccacgtctggccaggca

SEQ ID NO: 4002023 - DNA, 14 bp, Homo sapiens
gtcccacgtgtctt

SEQ ID NO: 4002024 - DNA, 21 bp, Homo sapiens
gtcccagactaaaggatccag

SEQ ID NO: 4002025 - DNA, 22 bp, Homo sapiens
gtcccagactaaaggatccaga

SEQ ID NO: 4002026 - DNA, 15 bp, Homo sapiens
gtcccagagtggctg

SEQ ID NO: 4002027 - DNA, 17 bp, Homo sapiens
gtcccagcatccctgga

SEQ ID NO: 4002028 - DNA, 19 bp, Homo sapiens
gtcccagcatccctggagc

SEQ ID NO: 4002029 - DNA, 20 bp, Homo sapiens
gtcccagcatccctggagca

SEQ ID NO: 4002030 - DNA, 14 bp, Homo sapiens
gtcccagccacccc

SEQ ID NO: 4002031 - DNA, 18 bp, Homo sapiens
gtcccagtattctcagag

SEQ ID NO: 4002032 - DNA, 17 bp, Homo sapiens
gtcccagtctctggcag

SEQ ID NO: 4002033 - DNA, 23 bp, Homo sapiens
gtcccatcctctaaagcagaggc

SEQ ID NO: 4002034 - DNA, 16 bp, Homo sapiens
gtcccatgcaggccct

SEQ ID NO: 4002035 - DNA, 21 bp, Homo sapiens
gtcccatggacactccagtgc

SEQ ID NO: 4002036 - DNA, 23 bp, Homo sapiens
gtcccatggacactccagtgcca

SEQ ID NO: 4002037 - DNA, 20 bp, Homo sapiens
gtcccatgtgagctgctgcc

SEQ ID NO: 4002038 - DNA, 22 bp, Homo sapiens
gtcccattgttggcgctgaggt

SEQ ID NO: 4002039 - DNA, 15 bp, Homo sapiens
gtccccacctgggac

SEQ ID NO: 4002040 - DNA, 18 bp, Homo sapiens
gtccccagccctgtcctg

SEQ ID NO: 4002041 - DNA, 22 bp, Homo sapiens
gtccccagcccttcctctgctc

SEQ ID NO: 4002042 - DNA, 15 bp, Homo sapiens
gtccccatccccacc

SEQ ID NO: 4002043 - DNA, 17 bp, Homo sapiens
gtccccatttctgcctc

SEQ ID NO: 4002044 - DNA, 13 bp, Homo sapiens
gtcccccaggctg

SEQ ID NO: 4002045 - DNA, 14 bp, Homo sapiens
gtcccccaggctgg

SEQ ID NO: 4002046 - DNA, 18 bp, Homo sapiens
gtcccccaggctggagtg

SEQ ID NO: 4002047 - DNA, 11 bp, Homo sapiens
gtccccccacc

SEQ ID NO: 4002048 - DNA, 12 bp, Homo sapiens
gtccccccaccc

SEQ ID NO: 4002049 - DNA, 21 bp, Homo sapiens
gtcccccccaggccttgtcct

SEQ ID NO: 4002050 - DNA, 13 bp, Homo sapiens
gtccccctaccca

SEQ ID NO: 4002051 - DNA, 17 bp, Homo sapiens
gtccccctacccaccga

SEQ ID NO: 4002052 - DNA, 20 bp, Homo sapiens
gtccccctcccctcccagtc

SEQ ID NO: 4002053 - DNA, 15 bp, Homo sapiens
gtcccctccaggaag

SEQ ID NO: 4002054 - DNA, 15 bp, Homo sapiens
gtcccctccttccct

SEQ ID NO: 4002055 - DNA, 21 bp, Homo sapiens
gtcccggggccagcacttcca

SEQ ID NO: 4002056 - DNA, 15 bp, Homo sapiens
gtcccggggctccac

SEQ ID NO: 4002057 - DNA, 21 bp, Homo sapiens
gtcccggttcagacccctgcc

SEQ ID NO: 4002058 - DNA, 22 bp, Homo sapiens
gtcccggttcagacccctgcct

SEQ ID NO: 4002059 - DNA, 11 bp, Homo sapiens
gtccctccctg

SEQ ID NO: 4002060 - DNA, 13 bp, Homo sapiens
gtccctccctgcc

SEQ ID NO: 4002061 - DNA, 16 bp, Homo sapiens
gtccctccctgcctga

SEQ ID NO: 4002062 - DNA, 17 bp, Homo sapiens
gtccctccctgcctgag

SEQ ID NO: 4002063 - DNA, 22 bp, Homo sapiens
gtccctgaggatgggtcagagc

SEQ ID NO: 4002064 - DNA, 14 bp, Homo sapiens
gtccctgggccagg

SEQ ID NO: 4002065 - DNA, 21 bp, Homo sapiens
gtccctgtgtgtaggctgggg

SEQ ID NO: 4002066 - DNA, 20 bp, Homo sapiens
gtcccttcccctccctggct

SEQ ID NO: 4002067 - DNA, 19 bp, Homo sapiens
gtcccttctcttaatttaa

SEQ ID NO: 4002068 - DNA, 20 bp, Homo sapiens
gtcccttgaactactgggtg

SEQ ID NO: 4002069 - DNA, 16 bp, Homo sapiens
gtcccttgcctctgcc

SEQ ID NO: 4002070 - DNA, 21 bp, Homo sapiens
gtcccttgcctctgccctgga

SEQ ID NO: 4002071 - DNA, 13 bp, Homo sapiens
gtccctttcccta

SEQ ID NO: 4002072 - DNA, 15 bp, Homo sapiens
gtcccttttccctta

SEQ ID NO: 4002073 - DNA, 20 bp, Homo sapiens
gtccgacctggcctgtctgt

SEQ ID NO: 4002074 - DNA, 18 bp, Homo sapiens
gtccggacactcctagag

SEQ ID NO: 4002075 - DNA, 18 bp, Homo sapiens
gtcctaaggaaccttcct

SEQ ID NO: 4002076 - DNA, 19 bp, Homo sapiens
gtcctaattcttctgtcct

SEQ ID NO: 4002077 - DNA, 18 bp, Homo sapiens
gtcctaccagttgcccta

SEQ ID NO: 4002078 - DNA, 19 bp, Homo sapiens
gtcctaccagttgccctag

SEQ ID NO: 4002079 - DNA, 24 bp, Homo sapiens
gtcctacgtccaaggtggcagatg

SEQ ID NO: 4002080 - DNA, 19 bp, Homo sapiens
gtcctagccactcaggagg

SEQ ID NO: 4002081 - DNA, 16 bp, Homo sapiens
gtcctagcccttccct

SEQ ID NO: 4002082 - DNA, 18 bp, Homo sapiens
gtcctagcccttccctga

SEQ ID NO: 4002083 - DNA, 20 bp, Homo sapiens
gtcctagcccttccctgagt

SEQ ID NO: 4002084 - DNA, 20 bp, Homo sapiens
gtcctatggacaacttattt

SEQ ID NO: 4002085 - DNA, 17 bp, Homo sapiens
gtcctcactcccagtcc

SEQ ID NO: 4002086 - DNA, 21 bp, Homo sapiens
gtcctcagccttgccagagat

SEQ ID NO: 4002087 - DNA, 16 bp, Homo sapiens
gtcctcagggagcagg

SEQ ID NO: 4002088 - DNA, 15 bp, Homo sapiens
gtcctcagtccattt

SEQ ID NO: 4002089 - DNA, 17 bp, Homo sapiens
gtcctccaagtgccccc

SEQ ID NO: 4002090 - DNA, 21 bp, Homo sapiens
gtcctccaagtgccccctcac

SEQ ID NO: 4002091 - DNA, 12 bp, Homo sapiens
gtcctccagaac

SEQ ID NO: 4002092 - DNA, 20 bp, Homo sapiens
gtcctccagaactcttcctc

SEQ ID NO: 4002093 - DNA, 13 bp, Homo sapiens
gtcctccagaagc

SEQ ID NO: 4002094 - DNA, 20 bp, Homo sapiens
gtcctccagaagcctctggc

SEQ ID NO: 4002095 - DNA, 21 bp, Homo sapiens
gtcctcccaatttcagactcc

SEQ ID NO: 4002096 - DNA, 16 bp, Homo sapiens
gtcctcccatcccctg

SEQ ID NO: 4002097 - DNA, 17 bp, Homo sapiens
gtcctcccatcccctgg

SEQ ID NO: 4002098 - DNA, 13 bp, Homo sapiens
gtcctcccatttc

SEQ ID NO: 4002099 - DNA, 17 bp, Homo sapiens
gtcctcctcacctcatg

SEQ ID NO: 4002100 - DNA, 21 bp, Homo sapiens
gtcctcctcacctcatgccca

SEQ ID NO: 4002101 - DNA, 16 bp, Homo sapiens
gtcctcctgctgccag

SEQ ID NO: 4002102 - DNA, 17 bp, Homo sapiens
gtcctcctgctgccagt

SEQ ID NO: 4002103 - DNA, 17 bp, Homo sapiens
gtcctctcccctccagc

SEQ ID NO: 4002104 - DNA, 13 bp, Homo sapiens
gtcctctcgagcc

SEQ ID NO: 4002105 - DNA, 23 bp, Homo sapiens
gtcctctgtcagtcacagccacc

SEQ ID NO: 4002106 - DNA, 14 bp, Homo sapiens
gtcctcttattcct

SEQ ID NO: 4002107 - DNA, 20 bp, Homo sapiens
gtcctcttccctctctgcag

SEQ ID NO: 4002108 - DNA, 15 bp, Homo sapiens
gtcctcttctgctct

SEQ ID NO: 4002109 - DNA, 23 bp, Homo sapiens
gtcctcttctgctcttttcctgg

SEQ ID NO: 4002110 - DNA, 21 bp, Homo sapiens
gtcctgacggcgcccccagtg

SEQ ID NO: 4002111 - DNA, 20 bp, Homo sapiens
gtcctgagcaccacacccag

SEQ ID NO: 4002112 - DNA, 17 bp, Homo sapiens
gtcctgcctcagcctcc

SEQ ID NO: 4002113 - DNA, 15 bp, Homo sapiens
gtcctgcctggcact

SEQ ID NO: 4002114 - DNA, 18 bp, Homo sapiens
gtcctgcctgtctgcccc

SEQ ID NO: 4002115 - DNA, 21 bp, Homo sapiens
gtcctgcctgtctgccccagc

SEQ ID NO: 4002116 - DNA, 17 bp, Homo sapiens
gtcctggatgttgtgtg

SEQ ID NO: 4002117 - DNA, 22 bp, Homo sapiens
gtcctggccagatggcccggat

SEQ ID NO: 4002118 - DNA, 21 bp, Homo sapiens
gtcctggctacatcccagcct

SEQ ID NO: 4002119 - DNA, 11 bp, Homo sapiens
gtcctggctcc

SEQ ID NO: 4002120 - DNA, 14 bp, Homo sapiens
gtcctggctcctga

SEQ ID NO: 4002121 - DNA, 22 bp, Homo sapiens
gtcctgggcatgggtccagggc

SEQ ID NO: 4002122 - DNA, 17 bp, Homo sapiens
gtcctgggcctgcagaa

SEQ ID NO: 4002123 - DNA, 16 bp, Homo sapiens
gtcctgggcctgcccc

SEQ ID NO: 4002124 - DNA, 19 bp, Homo sapiens
gtccttaaaaatcacactg

SEQ ID NO: 4002125 - DNA, 22 bp, Homo sapiens
gtccttaaaaatcacactgtaa

SEQ ID NO: 4002126 - DNA, 16 bp, Homo sapiens
gtccttaccagagacg

SEQ ID NO: 4002127 - DNA, 17 bp, Homo sapiens
gtccttagaacatttta

SEQ ID NO: 4002128 - DNA, 17 bp, Homo sapiens
gtccttatctagctgca

SEQ ID NO: 4002129 - DNA, 15 bp, Homo sapiens
gtccttatgtcctgt

SEQ ID NO: 4002130 - DNA, 15 bp, Homo sapiens
gtccttcagatggaa

SEQ ID NO: 4002131 - DNA, 16 bp, Homo sapiens
gtccttccctcaaaga

SEQ ID NO: 4002132 - DNA, 18 bp, Homo sapiens
gtccttctaatgaagaca

SEQ ID NO: 4002133 - DNA, 18 bp, Homo sapiens
gtcctttgcgcctgtgac

SEQ ID NO: 4002134 - DNA, 21 bp, Homo sapiens
gtcctttggggcatagatcag

SEQ ID NO: 4002135 - DNA, 15 bp, Homo sapiens
gtcctttgtgaatat

SEQ ID NO: 4002136 - DNA, 20 bp, Homo sapiens
gtccttttcccctacagaat

SEQ ID NO: 4002137 - DNA, 21 bp, Homo sapiens
gtccttttgggaagaatccag

SEQ ID NO: 4002138 - DNA, 19 bp, Homo sapiens
gtcctttttttccatcttt

SEQ ID NO: 4002139 - DNA, 12 bp, Homo sapiens
gtcgagacactt

SEQ ID NO: 4002140 - DNA, 21 bp, Homo sapiens
gtcgagcctgggggctggagc

SEQ ID NO: 4002141 - DNA, 15 bp, Homo sapiens
gtcgaggagtaacaa

SEQ ID NO: 4002142 - DNA, 16 bp, Homo sapiens
gtcgaggggctctcag

SEQ ID NO: 4002143 - DNA, 18 bp, Homo sapiens
gtcgccccaggccctccc

SEQ ID NO: 4002144 - DNA, 23 bp, Homo sapiens
gtcgccccaggccctccctgact

SEQ ID NO: 4002145 - DNA, 21 bp, Homo sapiens
gtcgcccgctgagctgagtgg

SEQ ID NO: 4002146 - DNA, 20 bp, Homo sapiens
gtcgcctgcctgcagcaggc

SEQ ID NO: 4002147 - DNA, 15 bp, Homo sapiens
gtcgctttctcagtg

SEQ ID NO: 4002148 - DNA, 19 bp, Homo sapiens
gtcggagaggctgtctggg

SEQ ID NO: 4002149 - DNA, 16 bp, Homo sapiens
gtcgggatgtcagcag

SEQ ID NO: 4002150 - DNA, 20 bp, Homo sapiens
gtcgggatgtcagcagacac

SEQ ID NO: 4002151 - DNA, 13 bp, Homo sapiens
gtcgggcagccag

SEQ ID NO: 4002152 - DNA, 14 bp, Homo sapiens
gtcgggcagccagc

SEQ ID NO: 4002153 - DNA, 21 bp, Homo sapiens
gtcgtgcctccttccacctcc

SEQ ID NO: 4002154 - DNA, 21 bp, Homo sapiens
gtcgttgttgtggaagcatgt

SEQ ID NO: 4002155 - DNA, 15 bp, Homo sapiens
gtcgttttaaaaaca

SEQ ID NO: 4002156 - DNA, 18 bp, Homo sapiens
gtctaacccccagctggg

SEQ ID NO: 4002157 - DNA, 16 bp, Homo sapiens
gtctaactcagaatta

SEQ ID NO: 4002158 - DNA, 22 bp, Homo sapiens
gtctaattaaaacactttcaaa

SEQ ID NO: 4002159 - DNA, 20 bp, Homo sapiens
gtctacaaatataagatttt

SEQ ID NO: 4002160 - DNA, 20 bp, Homo sapiens
gtctacaagtatatgtgaaa

SEQ ID NO: 4002161 - DNA, 13 bp, Homo sapiens
gtctacagctccc

SEQ ID NO: 4002162 - DNA, 16 bp, Homo sapiens
gtctagaatgtggatt

SEQ ID NO: 4002163 - DNA, 16 bp, Homo sapiens
gtctaggtctcctcag

SEQ ID NO: 4002164 - DNA, 19 bp, Homo sapiens
gtctaggtctcctcagggt

SEQ ID NO: 4002165 - DNA, 21 bp, Homo sapiens
gtctataatcccagcactttg

SEQ ID NO: 4002166 - DNA, 15 bp, Homo sapiens
gtctattttaaaata

SEQ ID NO: 4002167 - DNA, 22 bp, Homo sapiens
gtctatttttttaactgaaaat

SEQ ID NO: 4002168 - DNA, 16 bp, Homo sapiens
gtctcaaactcctggg

SEQ ID NO: 4002169 - DNA, 22 bp, Homo sapiens
gtctcaaacttgtggcctcaag

SEQ ID NO: 4002170 - DNA, 22 bp, Homo sapiens
gtctcaagagggcactggtggc

SEQ ID NO: 4002171 - DNA, 22 bp, Homo sapiens
gtctcacccattatctggaata

SEQ ID NO: 4002172 - DNA, 13 bp, Homo sapiens
gtctcactgttct

SEQ ID NO: 4002173 - DNA, 18 bp, Homo sapiens
gtctcagtggcttcatct

SEQ ID NO: 4002174 - DNA, 14 bp, Homo sapiens
gtctcatcctcctg

SEQ ID NO: 4002175 - DNA, 14 bp, Homo sapiens
gtctcatgtcctgc

SEQ ID NO: 4002176 - DNA, 20 bp, Homo sapiens
gtctcattccgttgtctgtg

SEQ ID NO: 4002177 - DNA, 15 bp, Homo sapiens
gtctccagctgcctg

SEQ ID NO: 4002178 - DNA, 23 bp, Homo sapiens
gtctccagctgcctgggcccgga

SEQ ID NO: 4002179 - DNA, 18 bp, Homo sapiens
gtctccatgaagagcttg

SEQ ID NO: 4002180 - DNA, 20 bp, Homo sapiens
gtctcccagttatgaatcag

SEQ ID NO: 4002181 - DNA, 10 bp, Homo sapiens
gtctccctcg

SEQ ID NO: 4002182 - DNA, 16 bp, Homo sapiens
gtctccctggagtgca

SEQ ID NO: 4002183 - DNA, 11 bp, Homo sapiens
gtctccctggc

SEQ ID NO: 4002184 - DNA, 14 bp, Homo sapiens
gtctccctggctcc

SEQ ID NO: 4002185 - DNA, 15 bp, Homo sapiens
gtctccctggctccc

SEQ ID NO: 4002186 - DNA, 14 bp, Homo sapiens
gtctcctactcctg

SEQ ID NO: 4002187 - DNA, 15 bp, Homo sapiens
gtctcctactcctga

SEQ ID NO: 4002188 - DNA, 17 bp, Homo sapiens
gtctcctactcctgact

SEQ ID NO: 4002189 - DNA, 13 bp, Homo sapiens
gtctcctcagggt

SEQ ID NO: 4002190 - DNA, 13 bp, Homo sapiens
gtctcctctctga

SEQ ID NO: 4002191 - DNA, 22 bp, Homo sapiens
gtctcctgtgcccacatcccag

SEQ ID NO: 4002192 - DNA, 15 bp, Homo sapiens
gtctcgctgtcactg

SEQ ID NO: 4002193 - DNA, 16 bp, Homo sapiens
gtctctcacagatgtg

SEQ ID NO: 4002194 - DNA, 14 bp, Homo sapiens
gtctctccctcagg

SEQ ID NO: 4002195 - DNA, 14 bp, Homo sapiens
gtctctcctggctg

SEQ ID NO: 4002196 - DNA, 19 bp, Homo sapiens
gtctctcctggctgggcca

SEQ ID NO: 4002197 - DNA, 12 bp, Homo sapiens
gtctctctgtga

SEQ ID NO: 4002198 - DNA, 18 bp, Homo sapiens
gtctctctgtgaatacaa

SEQ ID NO: 4002199 - DNA, 13 bp, Homo sapiens
gtctctgccaccc

SEQ ID NO: 4002200 - DNA, 14 bp, Homo sapiens
gtctctgccaccca

SEQ ID NO: 4002201 - DNA, 15 bp, Homo sapiens
gtctctgccacccac

SEQ ID NO: 4002202 - DNA, 16 bp, Homo sapiens
gtctctgccacccact

SEQ ID NO: 4002203 - DNA, 23 bp, Homo sapiens
gtctctgccctgcctacttttag

SEQ ID NO: 4002204 - DNA, 15 bp, Homo sapiens
gtctctgctcgccct

SEQ ID NO: 4002205 - DNA, 12 bp, Homo sapiens
gtctctgctgaa

SEQ ID NO: 4002206 - DNA, 13 bp, Homo sapiens
gtctctgctggcc

SEQ ID NO: 4002207 - DNA, 16 bp, Homo sapiens
gtctctgctggcccag

SEQ ID NO: 4002208 - DNA, 17 bp, Homo sapiens
gtctctgctggcccagc

SEQ ID NO: 4002209 - DNA, 16 bp, Homo sapiens
gtctctggcagttctg

SEQ ID NO: 4002210 - DNA, 11 bp, Homo sapiens
gtctctggggc

SEQ ID NO: 4002211 - DNA, 11 bp, Homo sapiens
gtctcttctcc

SEQ ID NO: 4002212 - DNA, 12 bp, Homo sapiens
gtctgaaactgg

SEQ ID NO: 4002213 - DNA, 14 bp, Homo sapiens
gtctgaaactggct

SEQ ID NO: 4002214 - DNA, 21 bp, Homo sapiens
gtctgaaactggcttccccac

SEQ ID NO: 4002215 - DNA, 22 bp, Homo sapiens
gtctgaaactggcttccccact

SEQ ID NO: 4002216 - DNA, 22 bp, Homo sapiens
gtctgaaggactggattggcca

SEQ ID NO: 4002217 - DNA, 16 bp, Homo sapiens
gtctgaagtcactgca

SEQ ID NO: 4002218 - DNA, 17 bp, Homo sapiens
gtctgaagtcactgcac

SEQ ID NO: 4002219 - DNA, 14 bp, Homo sapiens
gtctgaatgttctg

SEQ ID NO: 4002220 - DNA, 15 bp, Homo sapiens
gtctgaatgttctga

SEQ ID NO: 4002221 - DNA, 14 bp, Homo sapiens
gtctgagtgaacct

SEQ ID NO: 4002222 - DNA, 16 bp, Homo sapiens
gtctgattttctcact

SEQ ID NO: 4002223 - DNA, 16 bp, Homo sapiens
gtctgccatgttgccc

SEQ ID NO: 4002224 - DNA, 14 bp, Homo sapiens
gtctgcccaccatt

SEQ ID NO: 4002225 - DNA, 21 bp, Homo sapiens
gtctgcccaccattcccggcc

SEQ ID NO: 4002226 - DNA, 12 bp, Homo sapiens
gtctgcctggag

SEQ ID NO: 4002227 - DNA, 16 bp, Homo sapiens
gtctgctccagctctg

SEQ ID NO: 4002228 - DNA, 18 bp, Homo sapiens
gtctgctccagctctggc

SEQ ID NO: 4002229 - DNA, 17 bp, Homo sapiens
gtctgctctttctctgc

SEQ ID NO: 4002230 - DNA, 18 bp, Homo sapiens
gtctggagtgggcagagc

SEQ ID NO: 4002231 - DNA, 14 bp, Homo sapiens
gtctggcctgaggt

SEQ ID NO: 4002232 - DNA, 15 bp, Homo sapiens
gtctggctgagctga

SEQ ID NO: 4002233 - DNA, 18 bp, Homo sapiens
gtctggctttttcctctg

SEQ ID NO: 4002234 - DNA, 19 bp, Homo sapiens
gtctggctttttcctctga

SEQ ID NO: 4002235 - DNA, 20 bp, Homo sapiens
gtctggctttttcctctgag

SEQ ID NO: 4002236 - DNA, 21 bp, Homo sapiens
gtctggctttttcctctgagc

SEQ ID NO: 4002237 - DNA, 18 bp, Homo sapiens
gtctgggatatggctgcc

SEQ ID NO: 4002238 - DNA, 22 bp, Homo sapiens
gtctgggatatggctgcccagg

SEQ ID NO: 4002239 - DNA, 15 bp, Homo sapiens
gtctggggtgtgggg

SEQ ID NO: 4002240 - DNA, 19 bp, Homo sapiens
gtctgggtttttcttgtgg

SEQ ID NO: 4002241 - DNA, 14 bp, Homo sapiens
gtctgtatttcatg

SEQ ID NO: 4002242 - DNA, 16 bp, Homo sapiens
gtctgtgtgaatgtgg

SEQ ID NO: 4002243 - DNA, 21 bp, Homo sapiens
gtctgttccccatggccactt

SEQ ID NO: 4002244 - DNA, 17 bp, Homo sapiens
gtctgtttaaagtggca

SEQ ID NO: 4002245 - DNA, 20 bp, Homo sapiens
gtctgtttaagaaaagtatt

SEQ ID NO: 4002246 - DNA, 21 bp, Homo sapiens
gtctgtttggactgcagaagc

SEQ ID NO: 4002247 - DNA, 23 bp, Homo sapiens
gtctgtttgtttcaagaacctgg

SEQ ID NO: 4002248 - DNA, 17 bp, Homo sapiens
gtcttaaatgctcattt

SEQ ID NO: 4002249 - DNA, 23 bp, Homo sapiens
gtcttaaatgctcattttctggt

SEQ ID NO: 4002250 - DNA, 21 bp, Homo sapiens
gtcttaacaaaccaacatctt

SEQ ID NO: 4002251 - DNA, 13 bp, Homo sapiens
gtcttaattatta

SEQ ID NO: 4002252 - DNA, 19 bp, Homo sapiens
gtcttaattattatttgtg

SEQ ID NO: 4002253 - DNA, 17 bp, Homo sapiens
gtcttacattgcctgac

SEQ ID NO: 4002254 - DNA, 15 bp, Homo sapiens
gtcttagagcctttt

SEQ ID NO: 4002255 - DNA, 20 bp, Homo sapiens
gtcttagagccttttatctg

SEQ ID NO: 4002256 - DNA, 15 bp, Homo sapiens
gtcttagatgtatat

SEQ ID NO: 4002257 - DNA, 21 bp, Homo sapiens
gtcttatagtgtttggacagc

SEQ ID NO: 4002258 - DNA, 14 bp, Homo sapiens
gtcttatgcttcca

SEQ ID NO: 4002259 - DNA, 21 bp, Homo sapiens
gtcttatgcttccagaaacac

SEQ ID NO: 4002260 - DNA, 19 bp, Homo sapiens
gtcttatggtccagaaact

SEQ ID NO: 4002261 - DNA, 20 bp, Homo sapiens
gtcttatggtccagaaactc

SEQ ID NO: 4002262 - DNA, 16 bp, Homo sapiens
gtcttcaacatcctgc

SEQ ID NO: 4002263 - DNA, 19 bp, Homo sapiens
gtcttcaacatcctgccag

SEQ ID NO: 4002264 - DNA, 22 bp, Homo sapiens
gtcttcaacatcctgccagccc

SEQ ID NO: 4002265 - DNA, 11 bp, Homo sapiens
gtcttcataaa

SEQ ID NO: 4002266 - DNA, 19 bp, Homo sapiens
gtcttccaaggagaccaag

SEQ ID NO: 4002267 - DNA, 17 bp, Homo sapiens
gtcttccataatgtata

SEQ ID NO: 4002268 - DNA, 16 bp, Homo sapiens
gtcttccctacctcag

SEQ ID NO: 4002269 - DNA, 16 bp, Homo sapiens
gtcttccctgggctgc

SEQ ID NO: 4002270 - DNA, 18 bp, Homo sapiens
gtcttccctgggctgcca

SEQ ID NO: 4002271 - DNA, 16 bp, Homo sapiens
gtcttcctactcttct

SEQ ID NO: 4002272 - DNA, 14 bp, Homo sapiens
gtcttctaaacttc

SEQ ID NO: 4002273 - DNA, 23 bp, Homo sapiens
gtcttctaatttcaaaaatataa

SEQ ID NO: 4002274 - DNA, 20 bp, Homo sapiens
gtcttctcatagcattaact

SEQ ID NO: 4002275 - DNA, 23 bp, Homo sapiens
gtcttctcatagcattaactaat

SEQ ID NO: 4002276 - DNA, 16 bp, Homo sapiens
gtcttgaaagtggcac

SEQ ID NO: 4002277 - DNA, 19 bp, Homo sapiens
gtcttgggggtcagggggg

SEQ ID NO: 4002278 - DNA, 18 bp, Homo sapiens
gtcttggggtcccactgc

SEQ ID NO: 4002279 - DNA, 22 bp, Homo sapiens
gtcttggtgccttttgtgtgat

SEQ ID NO: 4002280 - DNA, 16 bp, Homo sapiens
gtctttcacagctcct

SEQ ID NO: 4002281 - DNA, 10 bp, Homo sapiens
gtctttccca

SEQ ID NO: 4002282 - DNA, 13 bp, Homo sapiens
gtctttctggaga

SEQ ID NO: 4002283 - DNA, 15 bp, Homo sapiens
gtctttgccttctct

SEQ ID NO: 4002284 - DNA, 14 bp, Homo sapiens
gtctttgtaagagt

SEQ ID NO: 4002285 - DNA, 23 bp, Homo sapiens
gtctttgtaagtcagtgttgaga

SEQ ID NO: 4002286 - DNA, 16 bp, Homo sapiens
gtcttttgacatgtgg

SEQ ID NO: 4002287 - DNA, 19 bp, Homo sapiens
gtcttttgacatgtggaaa

SEQ ID NO: 4002288 - DNA, 16 bp, Homo sapiens
gtctttttctggactg

SEQ ID NO: 4002289 - DNA, 16 bp, Homo sapiens
gtcttttttcatttct

SEQ ID NO: 4002290 - DNA, 22 bp, Homo sapiens
gtcttttttcatttcttcctca

SEQ ID NO: 4002291 - DNA, 20 bp, Homo sapiens
gtgaaacacaccaggctgtg

SEQ ID NO: 4002292 - DNA, 21 bp, Homo sapiens
gtgaaacacaccaggctgtgg

SEQ ID NO: 4002293 - DNA, 13 bp, Homo sapiens
gtgaaacacagct

SEQ ID NO: 4002294 - DNA, 15 bp, Homo sapiens
gtgaaacacagctgt

SEQ ID NO: 4002295 - DNA, 12 bp, Homo sapiens
gtgaaaccctgt

SEQ ID NO: 4002296 - DNA, 17 bp, Homo sapiens
gtgaaaccttttttaag

SEQ ID NO: 4002297 - DNA, 18 bp, Homo sapiens
atttcatttcaactgttt

SEQ ID NO: 4002298 - DNA, 21 bp, Homo sapiens
atttcatttcttgtcaattat

SEQ ID NO: 4002299 - DNA, 23 bp, Homo sapiens
atttccaacaccacagacacaca

SEQ ID NO: 4002300 - DNA, 19 bp, Homo sapiens
atttccaactcgaatctgt

SEQ ID NO: 4002301 - DNA, 16 bp, Homo sapiens
tcatccaacaagaaga

SEQ ID NO: 4002302 - DNA, 15 bp, Homo sapiens
tcatccaacttccaa

SEQ ID NO: 4002303 - DNA, 18 bp, Homo sapiens
tcatccaatcctcactgg

SEQ ID NO: 4002304 - DNA, 23 bp, Homo sapiens
tcatcccaacctctttttcctcc

SEQ ID NO: 4002305 - DNA, 20 bp, Homo sapiens
tcatcccattaatcatttcc

SEQ ID NO: 4002306 - DNA, 22 bp, Homo sapiens
tcatcccattaatcatttcccc

SEQ ID NO: 4002307 - DNA, 20 bp, Homo sapiens
tcatccccacagctggctct

SEQ ID NO: 4002308 - DNA, 16 bp, Homo sapiens
tcatcccttctcttcc

SEQ ID NO: 4002309 - DNA, 12 bp, Homo sapiens
tcatcctcctgg

SEQ ID NO: 4002310 - DNA, 13 bp, Homo sapiens
tcatcctcctgga

SEQ ID NO: 4002311 - DNA, 14 bp, Homo sapiens
tcatcctcctggaa

SEQ ID NO: 4002312 - DNA, 15 bp, Homo sapiens
tcatcctcctggaac

SEQ ID NO: 4002313 - DNA, 16 bp, Homo sapiens
tcatcctcctggaacc

SEQ ID NO: 4002314 - DNA, 22 bp, Homo sapiens
tcatcctcctggaaccttgctg

SEQ ID NO: 4002315 - DNA, 16 bp, Homo sapiens
tcatcctgactctgcc

SEQ ID NO: 4002316 - DNA, 19 bp, Homo sapiens
tcatcctgactctgccccc

SEQ ID NO: 4002317 - DNA, 15 bp, Homo sapiens
tcatccttccatcca

SEQ ID NO: 4002318 - DNA, 13 bp, Homo sapiens
tcatccttcccac

SEQ ID NO: 4002319 - DNA, 21 bp, Homo sapiens
tcatccttggtctttgtatct

SEQ ID NO: 4002320 - DNA, 22 bp, Homo sapiens
tcatcctttcacttctttccct

SEQ ID NO: 4002321 - DNA, 20 bp, Homo sapiens
tcatcctttgttctgagcat

SEQ ID NO: 4002322 - DNA, 21 bp, Homo sapiens
tcatcgaatctactaattcca

SEQ ID NO: 4002323 - DNA, 14 bp, Homo sapiens
tcatcgccagaggt

SEQ ID NO: 4002324 - DNA, 15 bp, Homo sapiens
tcatcgccagaggtg

SEQ ID NO: 4002325 - DNA, 14 bp, Homo sapiens
tcatcggaggctgg

SEQ ID NO: 4002326 - DNA, 22 bp, Homo sapiens
tcatcggagtcagccaggagct

SEQ ID NO: 4002327 - DNA, 15 bp, Homo sapiens
tcatctaccttttct

SEQ ID NO: 4002328 - DNA, 16 bp, Homo sapiens
tcatctaccttttctg

SEQ ID NO: 4002329 - DNA, 16 bp, Homo sapiens
tcatctcattcaaacc

SEQ ID NO: 4002330 - DNA, 22 bp, Homo sapiens
tcatctcccacctagcagcacc

SEQ ID NO: 4002331 - DNA, 14 bp, Homo sapiens
tcatctctctgccc

SEQ ID NO: 4002332 - DNA, 15 bp, Homo sapiens
tcatctctctggggc

SEQ ID NO: 4002333 - DNA, 17 bp, Homo sapiens
tcatctgaaacccacag

SEQ ID NO: 4002334 - DNA, 16 bp, Homo sapiens
tcatctgagaggctct

SEQ ID NO: 4002335 - DNA, 13 bp, Homo sapiens
tcatctgcaaaag

SEQ ID NO: 4002336 - DNA, 22 bp, Homo sapiens
tcatctggggttggcaacagga

SEQ ID NO: 4002337 - DNA, 15 bp, Homo sapiens
tcatctggttttatt

SEQ ID NO: 4002338 - DNA, 21 bp, Homo sapiens
tcatctgtccatggcctttct

SEQ ID NO: 4002339 - DNA, 22 bp, Homo sapiens
tcatctgtccatggcctttcta

SEQ ID NO: 4002340 - DNA, 12 bp, Homo sapiens
tcatctgtgcac

SEQ ID NO: 4002341 - DNA, 21 bp, Homo sapiens
tcatcttcactgcaattttgt

SEQ ID NO: 4002342 - DNA, 16 bp, Homo sapiens
tcatcttcctgtgtcc

SEQ ID NO: 4002343 - DNA, 19 bp, Homo sapiens
tcatcttgacagagcctgc

SEQ ID NO: 4002344 - DNA, 15 bp, Homo sapiens
tcatgaaatgattgg

SEQ ID NO: 4002345 - DNA, 16 bp, Homo sapiens
tcatgacaagcatttt

SEQ ID NO: 4002346 - DNA, 15 bp, Homo sapiens
tcatgaccagtaaag

SEQ ID NO: 4002347 - DNA, 22 bp, Homo sapiens
tcatgacccctcgtccaccccc

SEQ ID NO: 4002348 - DNA, 14 bp, Homo sapiens
tcatgaggggagag

SEQ ID NO: 4002349 - DNA, 17 bp, Homo sapiens
tcatgatgctctttccc

SEQ ID NO: 4002350 - DNA, 20 bp, Homo sapiens
tcatgcaaaccgttaggaaa

SEQ ID NO: 4002351 - DNA, 17 bp, Homo sapiens
tcatgcacccctgagcc

SEQ ID NO: 4002352 - DNA, 15 bp, Homo sapiens
tcatgcataaatatg

SEQ ID NO: 4002353 - DNA, 24 bp, Homo sapiens
tcatgccaaccctgggctattgct

SEQ ID NO: 4002354 - DNA, 18 bp, Homo sapiens
tcatgcccaccccctgcc

SEQ ID NO: 4002355 - DNA, 23 bp, Homo sapiens
tcatgcccaccccctgccctgca

SEQ ID NO: 4002356 - DNA, 16 bp, Homo sapiens
tcatgcccctggctgg

SEQ ID NO: 4002357 - DNA, 14 bp, Homo sapiens
tcatgcctttcata

SEQ ID NO: 4002358 - DNA, 16 bp, Homo sapiens
tcatgcctttcatagt

SEQ ID NO: 4002359 - DNA, 14 bp, Homo sapiens
tcatgcctttgtaa

SEQ ID NO: 4002360 - DNA, 16 bp, Homo sapiens
tcatgcgtacgtccca

SEQ ID NO: 4002361 - DNA, 23 bp, Homo sapiens
tcatgctcccctgtgccagccca

SEQ ID NO: 4002362 - DNA, 24 bp, Homo sapiens
tcatgctcccctgtgccagcccag

SEQ ID NO: 4002363 - DNA, 20 bp, Homo sapiens
tccaaacactgaggcagcct

SEQ ID NO: 4002364 - DNA, 13 bp, Homo sapiens
tccaaagaggctg

SEQ ID NO: 4002365 - DNA, 19 bp, Homo sapiens
tccaaagaggctgcccctc

SEQ ID NO: 4002366 - DNA, 19 bp, Homo sapiens
tccaaagcacattgaaaga

SEQ ID NO: 4002367 - DNA, 14 bp, Homo sapiens
tccaaagcagacag

SEQ ID NO: 4002368 - DNA, 15 bp, Homo sapiens
tccaaagcagacagc

SEQ ID NO: 4002369 - DNA, 12 bp, Homo sapiens
tccaaagcagag

SEQ ID NO: 4002370 - DNA, 13 bp, Homo sapiens
tccaaagccagtg

SEQ ID NO: 4002371 - DNA, 20 bp, Homo sapiens
tccaaagctttattaccagt

SEQ ID NO: 4002372 - DNA, 21 bp, Homo sapiens
tccaaagctttattaccagtg

SEQ ID NO: 4002373 - DNA, 23 bp, Homo sapiens
tccaaaggaatctccagttttca

SEQ ID NO: 4002374 - DNA, 13 bp, Homo sapiens
tccaaaggaggct

SEQ ID NO: 4002375 - DNA, 15 bp, Homo sapiens
tccaaaggaggctgg

SEQ ID NO: 4002376 - DNA, 17 bp, Homo sapiens
tccaaataagaaaccta

SEQ ID NO: 4002377 - DNA, 20 bp, Homo sapiens
tccaaatctcttgcttgtca

SEQ ID NO: 4002378 - DNA, 21 bp, Homo sapiens
tccaaatctcttgcttgtcat

SEQ ID NO: 4002379 - DNA, 19 bp, Homo sapiens
tccaaatgtcctccagaag

SEQ ID NO: 4002380 - DNA, 12 bp, Homo sapiens
tccaaattcagt

SEQ ID NO: 4002381 - DNA, 14 bp, Homo sapiens
tccaaattcagttt

SEQ ID NO: 4002382 - DNA, 19 bp, Homo sapiens
tccaaattcagtttcataa

SEQ ID NO: 4002383 - DNA, 14 bp, Homo sapiens
tccaacaagaagaa

SEQ ID NO: 4002384 - DNA, 16 bp, Homo sapiens
tccaacaagaatgcat

SEQ ID NO: 4002385 - DNA, 23 bp, Homo sapiens
tccaacacaaggctccaagacct

SEQ ID NO: 4002386 - DNA, 17 bp, Homo sapiens
tccaacaccacagacac

SEQ ID NO: 4002387 - DNA, 19 bp, Homo sapiens
tccaacaccacagacacac

SEQ ID NO: 4002388 - DNA, 20 bp, Homo sapiens
tccaacagaactaaatgttc

SEQ ID NO: 4002389 - DNA, 19 bp, Homo sapiens
tccaacatatatttattga

SEQ ID NO: 4002390 - DNA, 12 bp, Homo sapiens
tccaaccaggca

SEQ ID NO: 4002391 - DNA, 22 bp, Homo sapiens
tccaacccccgccacctcaggg

SEQ ID NO: 4002392 - DNA, 16 bp, Homo sapiens
tccaagcacagagcct

SEQ ID NO: 4002393 - DNA, 17 bp, Homo sapiens
tccaagcacagagcctg

SEQ ID NO: 4002394 - DNA, 21 bp, Homo sapiens
tccaagcacagagcctggccc

SEQ ID NO: 4002395 - DNA, 23 bp, Homo sapiens
tccaagcacagagcctggcccca

SEQ ID NO: 4002396 - DNA, 16 bp, Homo sapiens
tccaagcagagtgttt

SEQ ID NO: 4002397 - DNA, 17 bp, Homo sapiens
tccaagcctgcctccca

SEQ ID NO: 4002398 - DNA, 19 bp, Homo sapiens
tccaagcctgcctcccaag

SEQ ID NO: 4002399 - DNA, 23 bp, Homo sapiens
tccaaggagaccaagtcctggct

SEQ ID NO: 4002400 - DNA, 12 bp, Homo sapiens
tccaaggagttc

SEQ ID NO: 4002401 - DNA, 19 bp, Homo sapiens
tccaagggaccctttgcct

SEQ ID NO: 4002402 - DNA, 18 bp, Homo sapiens
tccaaggtggcagatgtc

SEQ ID NO: 4002403 - DNA, 19 bp, Homo sapiens
tccaagtctctctgtgaat

SEQ ID NO: 4002404 - DNA, 14 bp, Homo sapiens
tccaagtgccccct

SEQ ID NO: 4002405 - DNA, 19 bp, Homo sapiens
tccaagttcttcacctcta

SEQ ID NO: 4002406 - DNA, 22 bp, Homo sapiens
tccaataaaaacattttgaagt

SEQ ID NO: 4002407 - DNA, 22 bp, Homo sapiens
tccaatcccatagatgggtctg

SEQ ID NO: 4002408 - DNA, 16 bp, Homo sapiens
tccaatcctcactggg

SEQ ID NO: 4002409 - DNA, 14 bp, Homo sapiens
tccaatgcacagtt

SEQ ID NO: 4002410 - DNA, 19 bp, Homo sapiens
tccaattagtttccttttt

SEQ ID NO: 4002411 - DNA, 23 bp, Homo sapiens
tccaattagtttcctttttaata

SEQ ID NO: 4002412 - DNA, 13 bp, Homo sapiens
tccaattgatgta

SEQ ID NO: 4002413 - DNA, 16 bp, Homo sapiens
tccaattgatgtatat

SEQ ID NO: 4002414 - DNA, 21 bp, Homo sapiens
tccacaagacagaagctgaag

SEQ ID NO: 4002415 - DNA, 18 bp, Homo sapiens
tccacaagttaaataaat

SEQ ID NO: 4002416 - DNA, 19 bp, Homo sapiens
tccacaattattggcaaag

SEQ ID NO: 4002417 - DNA, 13 bp, Homo sapiens
tccacacacacaa

SEQ ID NO: 4002418 - DNA, 14 bp, Homo sapiens
tccacacacacaaa

SEQ ID NO: 4002419 - DNA, 21 bp, Homo sapiens
tccacacacacaaaaaaagac

SEQ ID NO: 4002420 - DNA, 14 bp, Homo sapiens
tccacacacgcagg

SEQ ID NO: 4002421 - DNA, 19 bp, Homo sapiens
tccacacacgcaggaactc

SEQ ID NO: 4002422 - DNA, 22 bp, Homo sapiens
tccacagagagggagagcagag

SEQ ID NO: 4002423 - DNA, 19 bp, Homo sapiens
tccacagagtgagccagtg

SEQ ID NO: 4002424 - DNA, 18 bp, Homo sapiens
tccacagcctgcaagtca

SEQ ID NO: 4002425 - DNA, 23 bp, Homo sapiens
tccacagcggaggagaccagctc

SEQ ID NO: 4002426 - DNA, 14 bp, Homo sapiens
tccacagttgccac

SEQ ID NO: 4002427 - DNA, 14 bp, Homo sapiens
tccacatctgcctt

SEQ ID NO: 4002428 - DNA, 18 bp, Homo sapiens
tccacatctgccttaaaa

SEQ ID NO: 4002429 - DNA, 18 bp, Homo sapiens
tccaccacatctgccaga

SEQ ID NO: 4002430 - DNA, 14 bp, Homo sapiens
tccaccacctccct

SEQ ID NO: 4002431 - DNA, 20 bp, Homo sapiens
tccaccaggccgtgccttgt

SEQ ID NO: 4002432 - DNA, 14 bp, Homo sapiens
tccacccagcccct

SEQ ID NO: 4002433 - DNA, 15 bp, Homo sapiens
tccacccagcccctg

SEQ ID NO: 4002434 - DNA, 17 bp, Homo sapiens
tccaccccccacacaca

SEQ ID NO: 4002435 - DNA, 15 bp, Homo sapiens
tccacccttggcctg

SEQ ID NO: 4002436 - DNA, 18 bp, Homo sapiens
tccacctcaagaccccca

SEQ ID NO: 4002437 - DNA, 19 bp, Homo sapiens
tccacctcccaccctgacc

SEQ ID NO: 4002438 - DNA, 13 bp, Homo sapiens
tccacctctggga

SEQ ID NO: 4002439 - DNA, 12 bp, Homo sapiens
tccacctgcctt

SEQ ID NO: 4002440 - DNA, 14 bp, Homo sapiens
tccacctgccttgg

SEQ ID NO: 4002441 - DNA, 15 bp, Homo sapiens
tccacctgctctgct

SEQ ID NO: 4002442 - DNA, 16 bp, Homo sapiens
tccacctgctctgctg

SEQ ID NO: 4002443 - DNA, 16 bp, Homo sapiens
tccacctgtctcagcc

SEQ ID NO: 4002444 - DNA, 20 bp, Homo sapiens
tccacctgtctcagcctccc

SEQ ID NO: 4002445 - DNA, 23 bp, Homo sapiens
tccaccttggctgggaagactat

SEQ ID NO: 4002446 - DNA, 19 bp, Homo sapiens
tccactaaatgagctcctg

SEQ ID NO: 4002447 - DNA, 21 bp, Homo sapiens
tccactaaatgagctcctgcg

SEQ ID NO: 4002448 - DNA, 15 bp, Homo sapiens
tccactacacctggc

SEQ ID NO: 4002449 - DNA, 16 bp, Homo sapiens
tccactacacctggct

SEQ ID NO: 4002450 - DNA, 22 bp, Homo sapiens
tccactcagctgtcctgcagca

SEQ ID NO: 4002451 - DNA, 18 bp, Homo sapiens
tccactcccacctcaccc

SEQ ID NO: 4002452 - DNA, 16 bp, Homo sapiens
tccactccctgctcca

SEQ ID NO: 4002453 - DNA, 17 bp, Homo sapiens
tccactctaccctccca

SEQ ID NO: 4002454 - DNA, 19 bp, Homo sapiens
tccactcttgatctctctt

SEQ ID NO: 4002455 - DNA, 17 bp, Homo sapiens
tccacttcttcctttct

SEQ ID NO: 4002456 - DNA, 17 bp, Homo sapiens
tccagaaacacccacag

SEQ ID NO: 4002457 - DNA, 18 bp, Homo sapiens
tccagaaactcctgtttc

SEQ ID NO: 4002458 - DNA, 19 bp, Homo sapiens
tccagaaaggatatttaag

SEQ ID NO: 4002459 - DNA, 16 bp, Homo sapiens
tccagaaatgtccctt

SEQ ID NO: 4002460 - DNA, 16 bp, Homo sapiens
tccagaagaatattca

SEQ ID NO: 4002461 - DNA, 20 bp, Homo sapiens
tccagaagaatattcaggac

SEQ ID NO: 4002462 - DNA, 16 bp, Homo sapiens
tccagaagatgccagc

SEQ ID NO: 4002463 - DNA, 20 bp, Homo sapiens
tccagaagatgccagcttct

SEQ ID NO: 4002464 - DNA, 12 bp, Homo sapiens
cttacatttgtg

SEQ ID NO: 4002465 - DNA, 13 bp, Homo sapiens
cttaccagagacg

SEQ ID NO: 4002466 - DNA, 16 bp, Homo sapiens
cttaccagagacgccc

SEQ ID NO: 4002467 - DNA, 18 bp, Homo sapiens
cttaccagagacgcccag

SEQ ID NO: 4002468 - DNA, 20 bp, Homo sapiens
cttaccagagacgcccagcc

SEQ ID NO: 4002469 - DNA, 16 bp, Homo sapiens
cttaccatctctacca

SEQ ID NO: 4002470 - DNA, 15 bp, Homo sapiens
cttacccaatttccc

SEQ ID NO: 4002471 - DNA, 20 bp, Homo sapiens
cttaccccttagcctccctg

SEQ ID NO: 4002472 - DNA, 19 bp, Homo sapiens
cttacctaaacagatataa

SEQ ID NO: 4002473 - DNA, 22 bp, Homo sapiens
cttacctaaacagatataaatg

SEQ ID NO: 4002474 - DNA, 13 bp, Homo sapiens
cttacctcttccg

SEQ ID NO: 4002475 - DNA, 15 bp, Homo sapiens
cttacctcttccgga

SEQ ID NO: 4002476 - DNA, 17 bp, Homo sapiens
cttacctgacctcttgc

SEQ ID NO: 4002477 - DNA, 23 bp, Homo sapiens
cttactaagctttgccagctgct

SEQ ID NO: 4002478 - DNA, 16 bp, Homo sapiens
cttactacactgagga

SEQ ID NO: 4002479 - DNA, 13 bp, Homo sapiens
cttactatttctg

SEQ ID NO: 4002480 - DNA, 12 bp, Homo sapiens
cttactattttg

SEQ ID NO: 4002481 - DNA, 16 bp, Homo sapiens
cttactctgtccattt

SEQ ID NO: 4002482 - DNA, 15 bp, Homo sapiens
cttactctttcctat

SEQ ID NO: 4002483 - DNA, 19 bp, Homo sapiens
cttactgggtgaggaaatc

SEQ ID NO: 4002484 - DNA, 17 bp, Homo sapiens
cttactggtccttacca

SEQ ID NO: 4002485 - DNA, 17 bp, Homo sapiens
cttactttgcttgagaa

SEQ ID NO: 4002486 - DNA, 20 bp, Homo sapiens
cttactttgcttgagaatcc

SEQ ID NO: 4002487 - DNA, 13 bp, Homo sapiens
cttagaaaatgtg

SEQ ID NO: 4002488 - DNA, 15 bp, Homo sapiens
cttagaacattttaa

SEQ ID NO: 4002489 - DNA, 18 bp, Homo sapiens
cttagaacctttctgtgt

SEQ ID NO: 4002490 - DNA, 17 bp, Homo sapiens
cttagaatccaaacttg

SEQ ID NO: 4002491 - DNA, 16 bp, Homo sapiens
cttagaattatttgca

SEQ ID NO: 4002492 - DNA, 17 bp, Homo sapiens
cttagagagaggaggca

SEQ ID NO: 4002493 - DNA, 20 bp, Homo sapiens
cttagagattgcatttttat

SEQ ID NO: 4002494 - DNA, 21 bp, Homo sapiens
cttagagcctcgtccctccct

SEQ ID NO: 4002495 - DNA, 18 bp, Homo sapiens
cttagagtttctgtttga

SEQ ID NO: 4002496 - DNA, 23 bp, Homo sapiens
cttagagtttctgtttgattctt

SEQ ID NO: 4002497 - DNA, 13 bp, Homo sapiens
cttagatttcata

SEQ ID NO: 4002498 - DNA, 14 bp, Homo sapiens
cttagatttcatag

SEQ ID NO: 4002499 - DNA, 21 bp, Homo sapiens
cttagatttcatagttcagaa

SEQ ID NO: 4002500 - DNA, 17 bp, Homo sapiens
cttagcagcttccagat

SEQ ID NO: 4002501 - DNA, 19 bp, Homo sapiens
cttagcatcctaagaaata

SEQ ID NO: 4002502 - DNA, 18 bp, Homo sapiens
cttagcctggatttcctt

SEQ ID NO: 4002503 - DNA, 14 bp, Homo sapiens
cttagctactgtat

SEQ ID NO: 4002504 - DNA, 19 bp, Homo sapiens
cttagctgccagtgctggt

SEQ ID NO: 4002505 - DNA, 23 bp, Homo sapiens
cttagcttctattatagccacat

SEQ ID NO: 4002506 - DNA, 22 bp, Homo sapiens
cttaggaagagaaaccagggag

SEQ ID NO: 4002507 - DNA, 12 bp, Homo sapiens
cttaggccttcc

SEQ ID NO: 4002508 - DNA, 15 bp, Homo sapiens
cttaggccttcctct

SEQ ID NO: 4002509 - DNA, 22 bp, Homo sapiens
cttagggaaagatgtagaaaga

SEQ ID NO: 4002510 - DNA, 20 bp, Homo sapiens
cttagggaagctggcctgag

SEQ ID NO: 4002511 - DNA, 17 bp, Homo sapiens
cttagggcactgggctg

SEQ ID NO: 4002512 - DNA, 16 bp, Homo sapiens
cttagggtgaaccact

SEQ ID NO: 4002513 - DNA, 21 bp, Homo sapiens
cttaggtggcaagctgtgact

SEQ ID NO: 4002514 - DNA, 14 bp, Homo sapiens
cttcaccccagtgg

SEQ ID NO: 4002515 - DNA, 19 bp, Homo sapiens
cttcaccccagtggccact

SEQ ID NO: 4002516 - DNA, 23 bp, Homo sapiens
cttcaccccagtggccactcagc

SEQ ID NO: 4002517 - DNA, 11 bp, Homo sapiens
cttcacctcta

SEQ ID NO: 4002518 - DNA, 15 bp, Homo sapiens
cttcacctgttatgt

SEQ ID NO: 4002519 - DNA, 19 bp, Homo sapiens
cttcacctgttatgtatga

SEQ ID NO: 4002520 - DNA, 17 bp, Homo sapiens
cttcacgcccttggcca

SEQ ID NO: 4002521 - DNA, 18 bp, Homo sapiens
cttcactactttaataaa

SEQ ID NO: 4002522 - DNA, 15 bp, Homo sapiens
cttcactctctgaag

SEQ ID NO: 4002523 - DNA, 16 bp, Homo sapiens
cttcactgtataaata

SEQ ID NO: 4002524 - DNA, 14 bp, Homo sapiens
cttcacttctgact

SEQ ID NO: 4002525 - DNA, 19 bp, Homo sapiens
cttcagacacaaaagtcca

SEQ ID NO: 4002526 - DNA, 11 bp, Homo sapiens
cttcagagagc

SEQ ID NO: 4002527 - DNA, 14 bp, Homo sapiens
cttcagagagctgg

SEQ ID NO: 4002528 - DNA, 15 bp, Homo sapiens
cttcagagagctggt

SEQ ID NO: 4002529 - DNA, 12 bp, Homo sapiens
cttcagagcagg

SEQ ID NO: 4002530 - DNA, 22 bp, Homo sapiens
cttcagagtacgtcctgcctgg

SEQ ID NO: 4002531 - DNA, 19 bp, Homo sapiens
cttcagagtgaagaatctt

SEQ ID NO: 4002532 - DNA, 19 bp, Homo sapiens
cttcagatattattgcttt

SEQ ID NO: 4002533 - DNA, 18 bp, Homo sapiens
cttcagcccccagcccct

SEQ ID NO: 4002534 - DNA, 21 bp, Homo sapiens
cttcagcccccagcccctccc

SEQ ID NO: 4002535 - DNA, 15 bp, Homo sapiens
cttcagctgttgcag

SEQ ID NO: 4002536 - DNA, 19 bp, Homo sapiens
cttcaggcaccagcatcca

SEQ ID NO: 4002537 - DNA, 23 bp, Homo sapiens
cttcaggccccgccccatgggcc

SEQ ID NO: 4002538 - DNA, 19 bp, Homo sapiens
cttcaggctcttctccttt

SEQ ID NO: 4002539 - DNA, 22 bp, Homo sapiens
cttcaggctcttctcctttcac

SEQ ID NO: 4002540 - DNA, 21 bp, Homo sapiens
cttcaggcttcctgcaatttt

SEQ ID NO: 4002541 - DNA, 17 bp, Homo sapiens
cttcagggagtcagctg

SEQ ID NO: 4002542 - DNA, 15 bp, Homo sapiens
cttcagggctgagtt

SEQ ID NO: 4002543 - DNA, 19 bp, Homo sapiens
cttcagggctgagttctgg

SEQ ID NO: 4002544 - DNA, 21 bp, Homo sapiens
cttcaggttatcgaaataaca

SEQ ID NO: 4002545 - DNA, 22 bp, Homo sapiens
cttcaggttatcgaaataacaa

SEQ ID NO: 4002546 - DNA, 15 bp, Homo sapiens
cttcagttggttgtg

SEQ ID NO: 4002547 - DNA, 21 bp, Homo sapiens
cttcagttggttgtgtctttt

SEQ ID NO: 4002548 - DNA, 14 bp, Homo sapiens
cttcataaatgaag

SEQ ID NO: 4002549 - DNA, 15 bp, Homo sapiens
cttcataacaatttt

SEQ ID NO: 4002550 - DNA, 16 bp, Homo sapiens
cttcatactggcagga

SEQ ID NO: 4002551 - DNA, 16 bp, Homo sapiens
cttcatagtattggag

SEQ ID NO: 4002552 - DNA, 15 bp, Homo sapiens
cttcatattgctgag

SEQ ID NO: 4002553 - DNA, 17 bp, Homo sapiens
cttcatccaacttccaa

SEQ ID NO: 4002554 - DNA, 19 bp, Homo sapiens
cttcatctcccacctagca

SEQ ID NO: 4002555 - DNA, 20 bp, Homo sapiens
cttcatctcccacctagcag

SEQ ID NO: 4002556 - DNA, 22 bp, Homo sapiens
cttcatcttcctgtgtcctgaa

SEQ ID NO: 4002557 - DNA, 21 bp, Homo sapiens
cttcatgagcattcataatta

SEQ ID NO: 4002558 - DNA, 15 bp, Homo sapiens
cttcatgccagctac

SEQ ID NO: 4002559 - DNA, 16 bp, Homo sapiens
cttcatgccagctact

SEQ ID NO: 4002560 - DNA, 17 bp, Homo sapiens
cttcatgcctttgtaag

SEQ ID NO: 4002561 - DNA, 19 bp, Homo sapiens
cttcatgctcagccctgac

SEQ ID NO: 4002562 - DNA, 14 bp, Homo sapiens
cttcatggaactca

SEQ ID NO: 4002563 - DNA, 20 bp, Homo sapiens
cttcatggaatggacatcct

SEQ ID NO: 4002564 - DNA, 23 bp, Homo sapiens
cttcatggatgggggaactcaga

SEQ ID NO: 4002565 - DNA, 19 bp, Homo sapiens
cttcatggccatagctttt

SEQ ID NO: 4002566 - DNA, 20 bp, Homo sapiens
cttcatgttcccacttcaaa

SEQ ID NO: 4002567 - DNA, 15 bp, Homo sapiens
cttcattattctctg

SEQ ID NO: 4002568 - DNA, 14 bp, Homo sapiens
cttcattattttaa

SEQ ID NO: 4002569 - DNA, 18 bp, Homo sapiens
gcccctgggcttggcctg

SEQ ID NO: 4002570 - DNA, 23 bp, Homo sapiens
gcccctgggcttggcctgctgtg

SEQ ID NO: 4002571 - DNA, 20 bp, Homo sapiens
gcccctggggctcccgaaga

SEQ ID NO: 4002572 - DNA, 15 bp, Homo sapiens
gcccctgggtttctt

SEQ ID NO: 4002573 - DNA, 16 bp, Homo sapiens
gcccctggtcctgagg

SEQ ID NO: 4002574 - DNA, 15 bp, Homo sapiens
gcccctgtcccaccc

SEQ ID NO: 4002575 - DNA, 17 bp, Homo sapiens
gcccctgtggccctggc

SEQ ID NO: 4002576 - DNA, 18 bp, Homo sapiens
gcccctgtggccctggcc

SEQ ID NO: 4002577 - DNA, 18 bp, Homo sapiens
gcccctgtgtgagttgag

SEQ ID NO: 4002578 - DNA, 16 bp, Homo sapiens
gccccttcgggagcag

SEQ ID NO: 4002579 - DNA, 19 bp, Homo sapiens
gccccttctctccctgcca

SEQ ID NO: 4002580 - DNA, 23 bp, Homo sapiens
gccccttctctccctgccagagg

SEQ ID NO: 4002581 - DNA, 17 bp, Homo sapiens
gccccttctgctcagct

SEQ ID NO: 4002582 - DNA, 18 bp, Homo sapiens
gccccttctgctcagctc

SEQ ID NO: 4002583 - DNA, 13 bp, Homo sapiens
gccccttggctgg

SEQ ID NO: 4002584 - DNA, 16 bp, Homo sapiens
gcccctttcaggccta

SEQ ID NO: 4002585 - DNA, 19 bp, Homo sapiens
gccccttttacttttttat

SEQ ID NO: 4002586 - DNA, 23 bp, Homo sapiens
gcccctttttcatatgttgctca

SEQ ID NO: 4002587 - DNA, 18 bp, Homo sapiens
gcccgaaactaagccagg

SEQ ID NO: 4002588 - DNA, 22 bp, Homo sapiens
gcccgaaactaagccaggcctg

SEQ ID NO: 4002589 - DNA, 15 bp, Homo sapiens
gcccgagctggtgca

SEQ ID NO: 4002590 - DNA, 17 bp, Homo sapiens
gcccgcagtgctgggac

SEQ ID NO: 4002591 - DNA, 23 bp, Homo sapiens
gcccgcagtgctgggaccagagc

SEQ ID NO: 4002592 - DNA, 18 bp, Homo sapiens
gcccgctcctgccgcaga

SEQ ID NO: 4002593 - DNA, 22 bp, Homo sapiens
gcccgctgagctgagtggccag

SEQ ID NO: 4002594 - DNA, 20 bp, Homo sapiens
gcccgctgcaatgcctagac

SEQ ID NO: 4002595 - DNA, 15 bp, Homo sapiens
gcccggatgctgctt

SEQ ID NO: 4002596 - DNA, 22 bp, Homo sapiens
gccctggtgaatcacctggctg

SEQ ID NO: 4002597 - DNA, 15 bp, Homo sapiens
gccctggtgctgcca

SEQ ID NO: 4002598 - DNA, 17 bp, Homo sapiens
gccctggtgctgccaca

SEQ ID NO: 4002599 - DNA, 15 bp, Homo sapiens
gccctgtcaggaggc

SEQ ID NO: 4002600 - DNA, 18 bp, Homo sapiens
gccctgtcaggaggcaga

SEQ ID NO: 4002601 - DNA, 22 bp, Homo sapiens
gccctgtccaaaagcgccctca

SEQ ID NO: 4002602 - DNA, 17 bp, Homo sapiens
gccctgtcgagacactt

SEQ ID NO: 4002603 - DNA, 14 bp, Homo sapiens
gccctgtttctgtt

SEQ ID NO: 4002604 - DNA, 14 bp, Homo sapiens
gcccttacacactc

SEQ ID NO: 4002605 - DNA, 13 bp, Homo sapiens
gcccttaccttcc

SEQ ID NO: 4002606 - DNA, 14 bp, Homo sapiens
gcccttaccttccc

SEQ ID NO: 4002607 - DNA, 15 bp, Homo sapiens
gcccttcaccccagt

SEQ ID NO: 4002608 - DNA, 16 bp, Homo sapiens
gcccttccatgtgcct

SEQ ID NO: 4002609 - DNA, 18 bp, Homo sapiens
gcccttccatgtgccttt

SEQ ID NO: 4002610 - DNA, 19 bp, Homo sapiens
gcccttccatgtgcctttc

SEQ ID NO: 4002611 - DNA, 13 bp, Homo sapiens
gcccttccctctg

SEQ ID NO: 4002612 - DNA, 14 bp, Homo sapiens
gcccttccctctgg

SEQ ID NO: 4002613 - DNA, 14 bp, Homo sapiens
gcccttccctgagt

SEQ ID NO: 4002614 - DNA, 15 bp, Homo sapiens
gcccttcctctccac

SEQ ID NO: 4002615 - DNA, 16 bp, Homo sapiens
gcccttcctctccact

SEQ ID NO: 4002616 - DNA, 20 bp, Homo sapiens
gcccttcctctccactgcct

SEQ ID NO: 4002617 - DNA, 21 bp, Homo sapiens
gcccttcggaggaccagggct

SEQ ID NO: 4002618 - DNA, 17 bp, Homo sapiens
gcccttctcaagacttt

SEQ ID NO: 4002619 - DNA, 19 bp, Homo sapiens
gcccttgcagttcagcacc

SEQ ID NO: 4002620 - DNA, 20 bp, Homo sapiens
gcccttgcagttcagcacca

SEQ ID NO: 4002621 - DNA, 17 bp, Homo sapiens
gcccttgggacagccag

SEQ ID NO: 4002622 - DNA, 18 bp, Homo sapiens
gcccttgggacagccaga

SEQ ID NO: 4002623 - DNA, 12 bp, Homo sapiens
gcccttgggcag

SEQ ID NO: 4002624 - DNA, 11 bp, Homo sapiens
gccctttaaaa

SEQ ID NO: 4002625 - DNA, 17 bp, Homo sapiens
gccctttacttgtcttt

SEQ ID NO: 4002626 - DNA, 20 bp, Homo sapiens
gccctttacttgtctttctg

SEQ ID NO: 4002627 - DNA, 21 bp, Homo sapiens
gccctttcctaggcccaggcc

SEQ ID NO: 4002628 - DNA, 22 bp, Homo sapiens
gccctttcctaggcccaggcct

SEQ ID NO: 4002629 - DNA, 16 bp, Homo sapiens
gccctttcctcctcag

SEQ ID NO: 4002630 - DNA, 18 bp, Homo sapiens
gccctttgaagcctcagc

SEQ ID NO: 4002631 - DNA, 24 bp, Homo sapiens
gccctttggagaacgccagtctcc

SEQ ID NO: 4002632 - DNA, 18 bp, Homo sapiens
gccctttgtcctcctgct

SEQ ID NO: 4002633 - DNA, 22 bp, Homo sapiens
gccctttgtcctcctgctgcca

SEQ ID NO: 4002634 - DNA, 18 bp, Homo sapiens
gcccttttcaggaagctc

SEQ ID NO: 4002635 - DNA, 17 bp, Homo sapiens
gccgaaggtgcctcaga

SEQ ID NO: 4002636 - DNA, 20 bp, Homo sapiens
gccgagcgttcccagcaggg

SEQ ID NO: 4002637 - DNA, 14 bp, Homo sapiens
gccgagctggtttc

SEQ ID NO: 4002638 - DNA, 12 bp, Homo sapiens
gccgaggcccag

SEQ ID NO: 4002639 - DNA, 16 bp, Homo sapiens
gccgaggcccagcggg

SEQ ID NO: 4002640 - DNA, 20 bp, Homo sapiens
gccgagggtcctggctcctg

SEQ ID NO: 4002641 - DNA, 18 bp, Homo sapiens
gccgagtccaagctggga

SEQ ID NO: 4002642 - DNA, 17 bp, Homo sapiens
gccgcagacgggcacag

SEQ ID NO: 4002643 - DNA, 23 bp, Homo sapiens
gccgcagacgggcacagacacgc

SEQ ID NO: 4002644 - DNA, 15 bp, Homo sapiens
gccgccagctgggag

SEQ ID NO: 4002645 - DNA, 16 bp, Homo sapiens
gccgccattgccacca

SEQ ID NO: 4002646 - DNA, 14 bp, Homo sapiens
gccgccccagcccc

SEQ ID NO: 4002647 - DNA, 15 bp, Homo sapiens
gccgccccagcccct

SEQ ID NO: 4002648 - DNA, 17 bp, Homo sapiens
gccgccccagccccttc

SEQ ID NO: 4002649 - DNA, 12 bp, Homo sapiens
gccgccctgggc

SEQ ID NO: 4002650 - DNA, 13 bp, Homo sapiens
gccgccctgggct

SEQ ID NO: 4002651 - DNA, 23 bp, Homo sapiens
gccgccctgggctgtctgtcacc

SEQ ID NO: 4002652 - DNA, 24 bp, Homo sapiens
gccgccctgggctgtctgtcacca

SEQ ID NO: 4002653 - DNA, 16 bp, Homo sapiens
gccgcccttcctggag

SEQ ID NO: 4002654 - DNA, 17 bp, Homo sapiens
gccgctacctccctccc

SEQ ID NO: 4002655 - DNA, 15 bp, Homo sapiens
gccggaaccacaggg

SEQ ID NO: 4002656 - DNA, 22 bp, Homo sapiens
gccggaaccacagggccagagg

SEQ ID NO: 4002657 - DNA, 17 bp, Homo sapiens
gccggaaggccgaggtc

SEQ ID NO: 4002658 - DNA, 13 bp, Homo sapiens
gccggcacagggt

SEQ ID NO: 4002659 - DNA, 21 bp, Homo sapiens
gccggcacagggtctgctctt

SEQ ID NO: 4002660 - DNA, 12 bp, Homo sapiens
gccggccagccc

SEQ ID NO: 4002661 - DNA, 14 bp, Homo sapiens
gccggccagcccct

SEQ ID NO: 4002662 - DNA, 13 bp, Homo sapiens
gccggcccagatg

SEQ ID NO: 4002663 - DNA, 14 bp, Homo sapiens
gccgggcaggtcct

SEQ ID NO: 4002664 - DNA, 12 bp, Homo sapiens
gccgggcccctg

SEQ ID NO: 4002665 - DNA, 14 bp, Homo sapiens
gccgggcgcggtgg

SEQ ID NO: 4002666 - DNA, 16 bp, Homo sapiens
gccgggcgcggtggct

SEQ ID NO: 4002667 - DNA, 18 bp, Homo sapiens
gccgggcgcggtggctca

SEQ ID NO: 4002668 - DNA, 22 bp, Homo sapiens
gccgggcgcggtggctcacgcc

SEQ ID NO: 4002669 - DNA, 15 bp, Homo sapiens
gccgggctctgcacc

SEQ ID NO: 4002670 - DNA, 18 bp, Homo sapiens
gccggggaagctgccagc

SEQ ID NO: 4002671 - DNA, 21 bp, Homo sapiens
gccggggacagaggcctgccc

SEQ ID NO: 4002672 - DNA, 23 bp, Homo sapiens
gccggggccttatcgggctccag

SEQ ID NO: 4002673 - DNA, 15 bp, Homo sapiens
gccgggggaggtggg

SEQ ID NO: 4002674 - DNA, 19 bp, Homo sapiens
gccgggtgcggtggctcac

SEQ ID NO: 4002675 - DNA, 16 bp, Homo sapiens
gccggtaactgtcctg

SEQ ID NO: 4002676 - DNA, 22 bp, Homo sapiens
gccggtaactgtcctgtcctgc

SEQ ID NO: 4002677 - DNA, 15 bp, Homo sapiens
gccggtcgggcagcc

SEQ ID NO: 4002678 - DNA, 17 bp, Homo sapiens
gccggtcgggcagccag

SEQ ID NO: 4002679 - DNA, 18 bp, Homo sapiens
gccgtcagccaaatgtaa

SEQ ID NO: 4002680 - DNA, 23 bp, Homo sapiens
gccgtccttctaatgaagacaat

SEQ ID NO: 4002681 - DNA, 13 bp, Homo sapiens
aatagtaatgttt

SEQ ID NO: 4002682 - DNA, 18 bp, Homo sapiens
aatagtatttatgaaatg

SEQ ID NO: 4002683 - DNA, 15 bp, Homo sapiens
aatagtatttgagag

SEQ ID NO: 4002684 - DNA, 22 bp, Homo sapiens
aatagtatttgagagttctaaa

SEQ ID NO: 4002685 - DNA, 23 bp, Homo sapiens
aatagtatttgagagttctaaat

SEQ ID NO: 4002686 - DNA, 23 bp, Homo sapiens
aatagttaagacatgatttcctt

SEQ ID NO: 4002687 - DNA, 17 bp, Homo sapiens
aatagttattatttaat

SEQ ID NO: 4002688 - DNA, 21 bp, Homo sapiens
aatagttattatttaattgca

SEQ ID NO: 4002689 - DNA, 19 bp, Homo sapiens
aatagtttgtctattttaa

SEQ ID NO: 4002690 - DNA, 23 bp, Homo sapiens
aatagtttgtctattttaaaata

SEQ ID NO: 4002691 - DNA, 14 bp, Homo sapiens
aatataagacattt

SEQ ID NO: 4002692 - DNA, 18 bp, Homo sapiens
aatataaggaaagcaata

SEQ ID NO: 4002693 - DNA, 14 bp, Homo sapiens
aatataattatcgg

SEQ ID NO: 4002694 - DNA, 18 bp, Homo sapiens
aatatacattcaaactta

SEQ ID NO: 4002695 - DNA, 15 bp, Homo sapiens
aatatagattagaaa

SEQ ID NO: 4002696 - DNA, 18 bp, Homo sapiens
aatatagattagaaaaat

SEQ ID NO: 4002697 - DNA, 18 bp, Homo sapiens
aatatataaaaagaaaag

SEQ ID NO: 4002698 - DNA, 21 bp, Homo sapiens
aatatatgtattatttataat

SEQ ID NO: 4002699 - DNA, 23 bp, Homo sapiens
aatatattgaacttttgtactga

SEQ ID NO: 4002700 - DNA, 14 bp, Homo sapiens
aatatatttaatga

SEQ ID NO: 4002701 - DNA, 19 bp, Homo sapiens
aatatatttatttaaagca

SEQ ID NO: 4002702 - DNA, 20 bp, Homo sapiens
aatatatttatttaaagcat

SEQ ID NO: 4002703 - DNA, 14 bp, Homo sapiens
aatatcacagtatt

SEQ ID NO: 4002704 - DNA, 23 bp, Homo sapiens
aatatcacagtattatctgtgtt

SEQ ID NO: 4002705 - DNA, 22 bp, Homo sapiens
aatatcatatcatcacattgag

SEQ ID NO: 4002706 - DNA, 13 bp, Homo sapiens
aatatcatttatt

SEQ ID NO: 4002707 - DNA, 23 bp, Homo sapiens
aatatcatttattttttacatta

SEQ ID NO: 4002708 - DNA, 18 bp, Homo sapiens
aatatctaataaaaagtc

SEQ ID NO: 4002709 - DNA, 21 bp, Homo sapiens
aatatctaatatatatgaata

SEQ ID NO: 4002710 - DNA, 15 bp, Homo sapiens
aatatctattaatat

SEQ ID NO: 4002711 - DNA, 19 bp, Homo sapiens
aatatctgaaaatgtatgt

SEQ ID NO: 4002712 - DNA, 21 bp, Homo sapiens
aatatctgtgaggtgctgatg

SEQ ID NO: 4002713 - DNA, 23 bp, Homo sapiens
aatatctgtgaggtgctgatgag

SEQ ID NO: 4002714 - DNA, 18 bp, Homo sapiens
aatatcttcagctctttt

SEQ ID NO: 4002715 - DNA, 20 bp, Homo sapiens
aatatctttgtgataattta

SEQ ID NO: 4002716 - DNA, 21 bp, Homo sapiens
aatatctttgtgataatttaa

SEQ ID NO: 4002717 - DNA, 20 bp, Homo sapiens
aatatcttttatgtttgaat

SEQ ID NO: 4002718 - DNA, 21 bp, Homo sapiens
aatatcttttatgtttgaata

SEQ ID NO: 4002719 - DNA, 20 bp, Homo sapiens
aatatgaaattccagcaata

SEQ ID NO: 4002720 - DNA, 14 bp, Homo sapiens
aatatgagttactg

SEQ ID NO: 4002721 - DNA, 20 bp, Homo sapiens
aatatgcctagtaacacata

SEQ ID NO: 4002722 - DNA, 14 bp, Homo sapiens
aatatgctgccaaa

SEQ ID NO: 4002723 - DNA, 19 bp, Homo sapiens
aatatgctgccaaattttg

SEQ ID NO: 4002724 - DNA, 22 bp, Homo sapiens
aatatgctgccaaattttggcc

SEQ ID NO: 4002725 - DNA, 22 bp, Homo sapiens
aatatgcttaaaataagcaggt

SEQ ID NO: 4002726 - DNA, 24 bp, Homo sapiens
aatatggaacttacattgttcaat

SEQ ID NO: 4002727 - DNA, 18 bp, Homo sapiens
aatatggctataaatata

SEQ ID NO: 4002728 - DNA, 14 bp, Homo sapiens
aatatgtaatgctt

SEQ ID NO: 4002729 - DNA, 22 bp, Homo sapiens
aatatgtacatttgtcttttta

SEQ ID NO: 4002730 - DNA, 19 bp, Homo sapiens
aatatgtatatgacattta

SEQ ID NO: 4002731 - DNA, 11 bp, Homo sapiens
aatatgtatgc

SEQ ID NO: 4002732 - DNA, 13 bp, Homo sapiens
aatatgtcctggg

SEQ ID NO: 4002733 - DNA, 21 bp, Homo sapiens
aatatgtgagattttttattg

SEQ ID NO: 4002734 - DNA, 22 bp, Homo sapiens
aatatgttaacctcagtgtcat

SEQ ID NO: 4002735 - DNA, 20 bp, Homo sapiens
aatatgtttaaaataaaatg

SEQ ID NO: 4002736 - DNA, 17 bp, Homo sapiens
aatattaaatacagaca

SEQ ID NO: 4002737 - DNA, 14 bp, Homo sapiens
aatattagttaatg

SEQ ID NO: 4002738 - DNA, 18 bp, Homo sapiens
aatattatgaaatttcac

SEQ ID NO: 4002739 - DNA, 12 bp, Homo sapiens
aatattcctgaa

SEQ ID NO: 4002740 - DNA, 13 bp, Homo sapiens
aatattcttttgt

SEQ ID NO: 4002741 - DNA, 16 bp, Homo sapiens
aatattcttttgtttc

SEQ ID NO: 4002742 - DNA, 18 bp, Homo sapiens
aatattcttttgtttcca

SEQ ID NO: 4002743 - DNA, 12 bp, Homo sapiens
aatattgacatt

SEQ ID NO: 4002744 - DNA, 14 bp, Homo sapiens
aatattgacttgta

SEQ ID NO: 4002745 - DNA, 17 bp, Homo sapiens
aatattgacttgtatat

SEQ ID NO: 4002746 - DNA, 22 bp, Homo sapiens
aatattgaggctttgtgttgta

SEQ ID NO: 4002747 - DNA, 19 bp, Homo sapiens
aatattgtattgctgctgt

SEQ ID NO: 4002748 - DNA, 22 bp, Homo sapiens
aatattgttgacaactgtgact

SEQ ID NO: 4002749 - DNA, 18 bp, Homo sapiens
aatattgttgtataattt

SEQ ID NO: 4002750 - DNA, 12 bp, Homo sapiens
aatatttaaaca

SEQ ID NO: 4002751 - DNA, 16 bp, Homo sapiens
aatatttaaacagcag

SEQ ID NO: 4002752 - DNA, 13 bp, Homo sapiens
aatatttaaacat

SEQ ID NO: 4002753 - DNA, 15 bp, Homo sapiens
aatatttaaaccttt

SEQ ID NO: 4002754 - DNA, 20 bp, Homo sapiens
aatatttaaacctttttctt

SEQ ID NO: 4002755 - DNA, 21 bp, Homo sapiens
aatatttaacattatttatat

SEQ ID NO: 4002756 - DNA, 14 bp, Homo sapiens
aatatttaagaaaa

SEQ ID NO: 4002757 - DNA, 16 bp, Homo sapiens
aatatttaagaaaagc

SEQ ID NO: 4002758 - DNA, 18 bp, Homo sapiens
aatatttaagaaaagcac

SEQ ID NO: 4002759 - DNA, 14 bp, Homo sapiens
aatatttatatttc

SEQ ID NO: 4002760 - DNA, 19 bp, Homo sapiens
aatatttatggatgcaaca

SEQ ID NO: 4002761 - DNA, 22 bp, Homo sapiens
aatatttattaaataaaatcaa

SEQ ID NO: 4002762 - DNA, 14 bp, Homo sapiens
aatatttattacct

SEQ ID NO: 4002763 - DNA, 17 bp, Homo sapiens
aatatttattacctctg

SEQ ID NO: 4002764 - DNA, 12 bp, Homo sapiens
aatatttattat

SEQ ID NO: 4002765 - DNA, 19 bp, Homo sapiens
aatatttattattttcacc

SEQ ID NO: 4002766 - DNA, 15 bp, Homo sapiens
aatgattaatcaaag

SEQ ID NO: 4002767 - DNA, 15 bp, Homo sapiens
aatgatttgctcttt

SEQ ID NO: 4002768 - DNA, 20 bp, Homo sapiens
aatgattttatctgtgaatt

SEQ ID NO: 4002769 - DNA, 21 bp, Homo sapiens
aatgcaaaaattagccgggcg

SEQ ID NO: 4002770 - DNA, 13 bp, Homo sapiens
aatgcacactagc

SEQ ID NO: 4002771 - DNA, 14 bp, Homo sapiens
aatgcaccaagaaa

SEQ ID NO: 4002772 - DNA, 21 bp, Homo sapiens
aatgcagccacgattggagaa

SEQ ID NO: 4002773 - DNA, 15 bp, Homo sapiens
aatgcagtcatgcaa

SEQ ID NO: 4002774 - DNA, 16 bp, Homo sapiens
aatgcagttttaagaa

SEQ ID NO: 4002775 - DNA, 16 bp, Homo sapiens
aatgcatgattttgta

SEQ ID NO: 4002776 - DNA, 17 bp, Homo sapiens
aatgcatgattttgtaa

SEQ ID NO: 4002777 - DNA, 19 bp, Homo sapiens
aatgcatgattttgtaacc

SEQ ID NO: 4002778 - DNA, 17 bp, Homo sapiens
aatgcattattttgaat

SEQ ID NO: 4002779 - DNA, 16 bp, Homo sapiens
aatgccattatccctg

SEQ ID NO: 4002780 - DNA, 16 bp, Homo sapiens
aatgccccaaggacaa

SEQ ID NO: 4002781 - DNA, 20 bp, Homo sapiens
aatgcctcaatgtgaccagg

SEQ ID NO: 4002782 - DNA, 15 bp, Homo sapiens
aatgcctcctgtggg

SEQ ID NO: 4002783 - DNA, 18 bp, Homo sapiens
aatgcctggagacagata

SEQ ID NO: 4002784 - DNA, 13 bp, Homo sapiens
aatgcctgtgcca

SEQ ID NO: 4002785 - DNA, 22 bp, Homo sapiens
aatgcctttgagacagtttctt

SEQ ID NO: 4002786 - DNA, 19 bp, Homo sapiens
aatgctaggttaattccaa

SEQ ID NO: 4002787 - DNA, 21 bp, Homo sapiens
aatgctaggttaattccaatt

SEQ ID NO: 4002788 - DNA, 19 bp, Homo sapiens
aatgctctctcaaattgtc

SEQ ID NO: 4002789 - DNA, 13 bp, Homo sapiens
aatgctctgtgcc

SEQ ID NO: 4002790 - DNA, 22 bp, Homo sapiens
aatgctgccttcccatgaatct

SEQ ID NO: 4002791 - DNA, 14 bp, Homo sapiens
aatgctgctggcca

SEQ ID NO: 4002792 - DNA, 18 bp, Homo sapiens
aatgctggttttcctaaa

SEQ ID NO: 4002793 - DNA, 22 bp, Homo sapiens
aatgctggttttcctaaatgca

SEQ ID NO: 4002794 - DNA, 12 bp, Homo sapiens
aatgctgtgtta

SEQ ID NO: 4002795 - DNA, 16 bp, Homo sapiens
aatgcttaatttctaa

SEQ ID NO: 4002796 - DNA, 17 bp, Homo sapiens
aatgcttaatttctaaa

SEQ ID NO: 4002797 - DNA, 20 bp, Homo sapiens
aatgcttcattcaatattga

SEQ ID NO: 4002798 - DNA, 15 bp, Homo sapiens
aatgctttctgtatg

SEQ ID NO: 4002799 - DNA, 19 bp, Homo sapiens
aatgctttttatttctgca

SEQ ID NO: 4002800 - DNA, 14 bp, Homo sapiens
aatggaaaaaaaca

SEQ ID NO: 4002801 - DNA, 13 bp, Homo sapiens
aatggaaacatta

SEQ ID NO: 4002802 - DNA, 18 bp, Homo sapiens
aatggaaggtttgtatat

SEQ ID NO: 4002803 - DNA, 22 bp, Homo sapiens
aatggaatgtgcccctggccca

SEQ ID NO: 4002804 - DNA, 21 bp, Homo sapiens
aatggacttatttcttcaaat

SEQ ID NO: 4002805 - DNA, 20 bp, Homo sapiens
aatggagattcagttttcat

SEQ ID NO: 4002806 - DNA, 16 bp, Homo sapiens
aatggagctttctgta

SEQ ID NO: 4002807 - DNA, 17 bp, Homo sapiens
aatggagctttctgtat

SEQ ID NO: 4002808 - DNA, 15 bp, Homo sapiens
aatggaggaatatga

SEQ ID NO: 4002809 - DNA, 14 bp, Homo sapiens
aatggatattatta

SEQ ID NO: 4002810 - DNA, 19 bp, Homo sapiens
aatggatattattagaaat

SEQ ID NO: 4002811 - DNA, 21 bp, Homo sapiens
aatggattggattatttaata

SEQ ID NO: 4002812 - DNA, 23 bp, Homo sapiens
aatggattggattatttaataac

SEQ ID NO: 4002813 - DNA, 15 bp, Homo sapiens
aatggatttcagaag

SEQ ID NO: 4002814 - DNA, 20 bp, Homo sapiens
aatggcaatgttttgctttt

SEQ ID NO: 4002815 - DNA, 18 bp, Homo sapiens
aatggcagctagtgcctt

SEQ ID NO: 4002816 - DNA, 19 bp, Homo sapiens
aatggcagtatttcatttc

SEQ ID NO: 4002817 - DNA, 14 bp, Homo sapiens
aatggccttccttc

SEQ ID NO: 4002818 - DNA, 22 bp, Homo sapiens
aatggcgcctgctccctccaga

SEQ ID NO: 4002819 - DNA, 20 bp, Homo sapiens
aatggcgtctggaagtccaa

SEQ ID NO: 4002820 - DNA, 19 bp, Homo sapiens
aatggcgtgaacccgggag

SEQ ID NO: 4002821 - DNA, 16 bp, Homo sapiens
aatggctatttttgaa

SEQ ID NO: 4002822 - DNA, 13 bp, Homo sapiens
aatgggactggag

SEQ ID NO: 4002823 - DNA, 14 bp, Homo sapiens
aatgggactggagt

SEQ ID NO: 4002824 - DNA, 22 bp, Homo sapiens
aatggggccagatccagcctgg

SEQ ID NO: 4002825 - DNA, 19 bp, Homo sapiens
aatggtacatgtcttccat

SEQ ID NO: 4002826 - DNA, 18 bp, Homo sapiens
aatggtactgactttgct

SEQ ID NO: 4002827 - DNA, 18 bp, Homo sapiens
aatggtatgagctgaggg

SEQ ID NO: 4002828 - DNA, 16 bp, Homo sapiens
aatggtatggaactct

SEQ ID NO: 4002829 - DNA, 15 bp, Homo sapiens
aatggtcgcccagga

SEQ ID NO: 4002830 - DNA, 15 bp, Homo sapiens
aatggtgtagaacac

SEQ ID NO: 4002831 - DNA, 19 bp, Homo sapiens
aatggtgtagaacactaat

SEQ ID NO: 4002832 - DNA, 22 bp, Homo sapiens
aatggtgtgaacccgggagcgg

SEQ ID NO: 4002833 - DNA, 21 bp, Homo sapiens
aatggttccatgcctgagggt

SEQ ID NO: 4002834 - DNA, 16 bp, Homo sapiens
aatggttgatggaaaa

SEQ ID NO: 4002835 - DNA, 14 bp, Homo sapiens
aatggttttcaaaa

SEQ ID NO: 4002836 - DNA, 18 bp, Homo sapiens
aatggtttttatttctcg

SEQ ID NO: 4002837 - DNA, 20 bp, Homo sapiens
aatggtttttgcctaaaata

SEQ ID NO: 4002838 - DNA, 19 bp, Homo sapiens
aatgtaatcaatgtttctt

SEQ ID NO: 4002839 - DNA, 22 bp, Homo sapiens
aatgtacacactggtacttaga

SEQ ID NO: 4002840 - DNA, 17 bp, Homo sapiens
aatgtagctggtttcct

SEQ ID NO: 4002841 - DNA, 21 bp, Homo sapiens
aatgtagctggtttcctcatt

SEQ ID NO: 4002842 - DNA, 13 bp, Homo sapiens
aatgtatcaggaa

SEQ ID NO: 4002843 - DNA, 17 bp, Homo sapiens
aatgtatcttattcaca

SEQ ID NO: 4002844 - DNA, 21 bp, Homo sapiens
aatgtatgtgcactgtcactt

SEQ ID NO: 4002845 - DNA, 14 bp, Homo sapiens
aatgtattattctg

SEQ ID NO: 4002846 - DNA, 18 bp, Homo sapiens
aatgtattattctgcagc

SEQ ID NO: 4002847 - DNA, 14 bp, Homo sapiens
aatgtatttaatta

SEQ ID NO: 4002848 - DNA, 21 bp, Homo sapiens
aatgtattttgaagaatattt

SEQ ID NO: 4002849 - DNA, 23 bp, Homo sapiens
aatgtcaaacagtgccaaatgct

SEQ ID NO: 4002850 - DNA, 12 bp, Homo sapiens
aatgtcagaaca

SEQ ID NO: 4002851 - DNA, 18 bp, Homo sapiens
aatgtcaggaacagaagg

SEQ ID NO: 4002852 - DNA, 16 bp, Homo sapiens
aatgtcagtatttcag

SEQ ID NO: 4002853 - DNA, 15 bp, Homo sapiens
aatgtcatatactgc

SEQ ID NO: 4002854 - DNA, 18 bp, Homo sapiens
aatgtcatatactgccat

SEQ ID NO: 4002855 - DNA, 16 bp, Homo sapiens
aatgtcctgcctttta

SEQ ID NO: 4002856 - DNA, 20 bp, Homo sapiens
aatgtcgagtatattattat

SEQ ID NO: 4002857 - DNA, 15 bp, Homo sapiens
aatgtctaaaattgt

SEQ ID NO: 4002858 - DNA, 17 bp, Homo sapiens
aatgtctaaatgctgaa

SEQ ID NO: 4002859 - DNA, 16 bp, Homo sapiens
aatgtctattattatg

SEQ ID NO: 4002860 - DNA, 18 bp, Homo sapiens
aatgtctattattatgaa

SEQ ID NO: 4002861 - DNA, 15 bp, Homo sapiens
aatgtctcactgttc

SEQ ID NO: 4002862 - DNA, 17 bp, Homo sapiens
aatgtctgagtgaacct

SEQ ID NO: 4002863 - DNA, 18 bp, Homo sapiens
aatgtcttaatttttgaa

SEQ ID NO: 4002864 - DNA, 15 bp, Homo sapiens
aatgtctttgtaagt

SEQ ID NO: 4002865 - DNA, 18 bp, Homo sapiens
aatgtctttgttggaaaa

SEQ ID NO: 4002866 - DNA, 20 bp, Homo sapiens
aatgtgaaaagtatcactct

SEQ ID NO: 4002867 - DNA, 21 bp, Homo sapiens
aatgtgaaaagtatcactcta

SEQ ID NO: 4002868 - DNA, 15 bp, Homo sapiens
aatgtgaatttttat

SEQ ID NO: 4002869 - DNA, 12 bp, Homo sapiens
aaaaaaaaagca

SEQ ID NO: 4002870 - DNA, 14 bp, Homo sapiens
aaaaaaaaatgttc

SEQ ID NO: 4002871 - DNA, 13 bp, Homo sapiens
aaaaaaaatactt

SEQ ID NO: 4002872 - DNA, 12 bp, Homo sapiens
aaaaaaagaagt

SEQ ID NO: 4002873 - DNA, 14 bp, Homo sapiens
aaaaaaagatctgt

SEQ ID NO: 4002874 - DNA, 13 bp, Homo sapiens
aaaaaaaggaaaa

SEQ ID NO: 4002875 - DNA, 12 bp, Homo sapiens
aaaaaaatcttc

SEQ ID NO: 4002876 - DNA, 18 bp, Homo sapiens
aaaaaaccgaggccctca

SEQ ID NO: 4002877 - DNA, 12 bp, Homo sapiens
aaaaaagaagtt

SEQ ID NO: 4002878 - DNA, 15 bp, Homo sapiens
aaaaaagagaattag

SEQ ID NO: 4002879 - DNA, 11 bp, Homo sapiens
aaaaaagcaca

SEQ ID NO: 4002880 - DNA, 15 bp, Homo sapiens
aaaaaagcacataca

SEQ ID NO: 4002881 - DNA, 13 bp, Homo sapiens
aaaaaatacttgt

SEQ ID NO: 4002882 - DNA, 13 bp, Homo sapiens
aaaaaatatttat

SEQ ID NO: 4002883 - DNA, 14 bp, Homo sapiens
aaaaaatttaagtg

SEQ ID NO: 4002884 - DNA, 15 bp, Homo sapiens
aaaaacacctagctt

SEQ ID NO: 4002885 - DNA, 13 bp, Homo sapiens
aaaaacagaaaaa

SEQ ID NO: 4002886 - DNA, 21 bp, Homo sapiens
aaaaacaggtatatactttga

SEQ ID NO: 4002887 - DNA, 15 bp, Homo sapiens
aaaaacatattcttg

SEQ ID NO: 4002888 - DNA, 16 bp, Homo sapiens
aaaaaccacacaaaga

SEQ ID NO: 4002889 - DNA, 21 bp, Homo sapiens
aaaaactataaatacaaatct

SEQ ID NO: 4002890 - DNA, 14 bp, Homo sapiens
aaaaactctttatt

SEQ ID NO: 4002891 - DNA, 14 bp, Homo sapiens
aaaaacttggcact

SEQ ID NO: 4002892 - DNA, 11 bp, Homo sapiens
aaaaagaaaaa

SEQ ID NO: 4002893 - DNA, 19 bp, Homo sapiens
aaaaagaagttactttgta

SEQ ID NO: 4002894 - DNA, 23 bp, Homo sapiens
aaaaagaagttactttgtaattt

SEQ ID NO: 4002895 - DNA, 16 bp, Homo sapiens
aaaaagacgatgttta

SEQ ID NO: 4002896 - DNA, 10 bp, Homo sapiens
aaaaagatat

SEQ ID NO: 4002897 - DNA, 22 bp, Homo sapiens
aaaaagatggcctttgcttatg

SEQ ID NO: 4002898 - DNA, 14 bp, Homo sapiens
aaaaagattagcaa

SEQ ID NO: 4002899 - DNA, 23 bp, Homo sapiens
aaaaagattttcagaaaatatta

SEQ ID NO: 4002900 - DNA, 15 bp, Homo sapiens
aaaaagcacatacat

SEQ ID NO: 4002901 - DNA, 16 bp, Homo sapiens
aaaaagcacatacatt

SEQ ID NO: 4002902 - DNA, 17 bp, Homo sapiens
aaaaagcacatacatta

SEQ ID NO: 4002903 - DNA, 14 bp, Homo sapiens
aaaaagcagtcctc

SEQ ID NO: 4002904 - DNA, 20 bp, Homo sapiens
aaaaagcataaaaacatttt

SEQ ID NO: 4002905 - DNA, 20 bp, Homo sapiens
aaaaagcatgatgggaaaat

SEQ ID NO: 4002906 - DNA, 13 bp, Homo sapiens
aaaaagcttcccc

SEQ ID NO: 4002907 - DNA, 13 bp, Homo sapiens
aaaaaggaaaaat

SEQ ID NO: 4002908 - DNA, 14 bp, Homo sapiens
aaaaagtcaacaaa

SEQ ID NO: 4002909 - DNA, 15 bp, Homo sapiens
aaaaagtgacacagc

SEQ ID NO: 4002910 - DNA, 17 bp, Homo sapiens
aaaaagtgacacagcag

SEQ ID NO: 4002911 - DNA, 20 bp, Homo sapiens
aaaaagtgacacagcagctt

SEQ ID NO: 4002912 - DNA, 12 bp, Homo sapiens
aaaaagtgtcaa

SEQ ID NO: 4002913 - DNA, 13 bp, Homo sapiens
aaaaagttccttc

SEQ ID NO: 4002914 - DNA, 14 bp, Homo sapiens
aaaaagtttccata

SEQ ID NO: 4002915 - DNA, 19 bp, Homo sapiens
acacacagatacacacaca

SEQ ID NO: 4002916 - DNA, 11 bp, Homo sapiens
acacacagctg

SEQ ID NO: 4002917 - DNA, 20 bp, Homo sapiens
acacacagctgggcaaagcc

SEQ ID NO: 4002918 - DNA, 21 bp, Homo sapiens
acacacagctgggcaaagcca

SEQ ID NO: 4002919 - DNA, 22 bp, Homo sapiens
acacaccaggctgtgggcctca

SEQ ID NO: 4002920 - DNA, 22 bp, Homo sapiens
acacacctccgagacagtccag

SEQ ID NO: 4002921 - DNA, 14 bp, Homo sapiens
acacacgcacgcac

SEQ ID NO: 4002922 - DNA, 15 bp, Homo sapiens
acacacgcacgcaca

SEQ ID NO: 4002923 - DNA, 15 bp, Homo sapiens
acacactgatgctta

SEQ ID NO: 4002924 - DNA, 17 bp, Homo sapiens
acacactgatgcttaga

SEQ ID NO: 4002925 - DNA, 22 bp, Homo sapiens
acacactgtcatgcttcatcat

SEQ ID NO: 4002926 - DNA, 20 bp, Homo sapiens
acacagaaaatgttgagaat

SEQ ID NO: 4002927 - DNA, 16 bp, Homo sapiens
acacagaaatgctgct

SEQ ID NO: 4002928 - DNA, 17 bp, Homo sapiens
acacagaggagtgcagc

SEQ ID NO: 4002929 - DNA, 19 bp, Homo sapiens
acacagagtggtctttctg

SEQ ID NO: 4002930 - DNA, 17 bp, Homo sapiens
acacagatacacacaca

SEQ ID NO: 4002931 - DNA, 13 bp, Homo sapiens
acacagcagcccc

SEQ ID NO: 4002932 - DNA, 15 bp, Homo sapiens
acacagctacagctt

SEQ ID NO: 4002933 - DNA, 23 bp, Homo sapiens
acacagctactctccccacgagg

SEQ ID NO: 4002934 - DNA, 23 bp, Homo sapiens
acacagctagtgaagaccagagc

SEQ ID NO: 4002935 - DNA, 14 bp, Homo sapiens
acacagctgagcac

SEQ ID NO: 4002936 - DNA, 12 bp, Homo sapiens
acacagctgccc

SEQ ID NO: 4002937 - DNA, 22 bp, Homo sapiens
acacagctgccctagctgaccc

SEQ ID NO: 4002938 - DNA, 17 bp, Homo sapiens
acacaggcacgggtccc

SEQ ID NO: 4002939 - DNA, 11 bp, Homo sapiens
acacagggcag

SEQ ID NO: 4002940 - DNA, 15 bp, Homo sapiens
acacagttgctgtca

SEQ ID NO: 4002941 - DNA, 17 bp, Homo sapiens
acacatagcatgtaatg

SEQ ID NO: 4002942 - DNA, 20 bp, Homo sapiens
acacatccagacatcatgaa

SEQ ID NO: 4002943 - DNA, 14 bp, Homo sapiens
acacatctcctcca

SEQ ID NO: 4002944 - DNA, 15 bp, Homo sapiens
acacatcttcaacag

SEQ ID NO: 4002945 - DNA, 14 bp, Homo sapiens
acacatcttcccta

SEQ ID NO: 4002946 - DNA, 22 bp, Homo sapiens
acacatgaaaggcatcagtccc

SEQ ID NO: 4002947 - DNA, 20 bp, Homo sapiens
acacatgcctatattatcat

SEQ ID NO: 4002948 - DNA, 18 bp, Homo sapiens
acacatgccttaaatttg

SEQ ID NO: 4002949 - DNA, 23 bp, Homo sapiens
acacattatcgggagcagtgtct

SEQ ID NO: 4002950 - DNA, 17 bp, Homo sapiens
acacattatgtatctta

SEQ ID NO: 4002951 - DNA, 11 bp, Homo sapiens
acacatttgta

SEQ ID NO: 4002952 - DNA, 13 bp, Homo sapiens
acacatttgtaca

SEQ ID NO: 4002953 - DNA, 14 bp, Homo sapiens
acaccaagcacagc

SEQ ID NO: 4002954 - DNA, 16 bp, Homo sapiens
acaccaagcacagcag

SEQ ID NO: 4002955 - DNA, 19 bp, Homo sapiens
acaccaagcacagcagcct

SEQ ID NO: 4002956 - DNA, 16 bp, Homo sapiens
acaccaatcccagggc

SEQ ID NO: 4002957 - DNA, 18 bp, Homo sapiens
acaccaatcccagggctg

SEQ ID NO: 4002958 - DNA, 21 bp, Homo sapiens
acaccaatcccagggctggct

SEQ ID NO: 4002959 - DNA, 15 bp, Homo sapiens
aatctcttcattatt

SEQ ID NO: 4002960 - DNA, 15 bp, Homo sapiens
aatctgaaattctaa

SEQ ID NO: 4002961 - DNA, 16 bp, Homo sapiens
aatctgaaattctaaa

SEQ ID NO: 4002962 - DNA, 15 bp, Homo sapiens
aatctgaactctcaa

SEQ ID NO: 4002963 - DNA, 22 bp, Homo sapiens
aatctgaactctcaaaagtcta

SEQ ID NO: 4002964 - DNA, 12 bp, Homo sapiens
aatctgacatat

SEQ ID NO: 4002965 - DNA, 12 bp, Homo sapiens
aatctgacccag

SEQ ID NO: 4002966 - DNA, 17 bp, Homo sapiens
aatctgacccagtgccc

SEQ ID NO: 4002967 - DNA, 19 bp, Homo sapiens
aatctgagctgcagcctgg

SEQ ID NO: 4002968 - DNA, 17 bp, Homo sapiens
aatctgatggccttaat

SEQ ID NO: 4002969 - DNA, 17 bp, Homo sapiens
aatctgattcagcatca

SEQ ID NO: 4002970 - DNA, 23 bp, Homo sapiens
aatctgattcagcatcactaaac

SEQ ID NO: 4002971 - DNA, 22 bp, Homo sapiens
aatctgctttttaaagaatgct

SEQ ID NO: 4002972 - DNA, 14 bp, Homo sapiens
aatctggagaccag

SEQ ID NO: 4002973 - DNA, 19 bp, Homo sapiens
aatctggcccttacacact

SEQ ID NO: 4002974 - DNA, 20 bp, Homo sapiens
aatctggcccttacacactc

SEQ ID NO: 4002975 - DNA, 19 bp, Homo sapiens
aatctggtccatatttaca

SEQ ID NO: 4002976 - DNA, 16 bp, Homo sapiens
aatctgtagggctgga

SEQ ID NO: 4002977 - DNA, 22 bp, Homo sapiens
aatctgtagggctggacctatg

SEQ ID NO: 4002978 - DNA, 15 bp, Homo sapiens
aatctgtataaatgt

SEQ ID NO: 4002979 - DNA, 18 bp, Homo sapiens
aatctgtataaatgtcta

SEQ ID NO: 4002980 - DNA, 14 bp, Homo sapiens
aatctgtctgctgg

SEQ ID NO: 4002981 - DNA, 12 bp, Homo sapiens
aatctgtgcctg

SEQ ID NO: 4002982 - DNA, 19 bp, Homo sapiens
aatctgtgggtctgggagt

SEQ ID NO: 4002983 - DNA, 20 bp, Homo sapiens
aatctgtgtgaaactttcat

SEQ ID NO: 4002984 - DNA, 14 bp, Homo sapiens
aatctgttatccca

SEQ ID NO: 4002985 - DNA, 20 bp, Homo sapiens
aatctgttatgtactagtgt

SEQ ID NO: 4002986 - DNA, 19 bp, Homo sapiens
aatcttaaatcagaataaa

SEQ ID NO: 4002987 - DNA, 20 bp, Homo sapiens
aatcttaaatcagaataaat

SEQ ID NO: 4002988 - DNA, 21 bp, Homo sapiens
aatcttaaatcagaataaatt

SEQ ID NO: 4002989 - DNA, 20 bp, Homo sapiens
aatcttattagggagaaaat

SEQ ID NO: 4002990 - DNA, 15 bp, Homo sapiens
aatcttccttgtgag

SEQ ID NO: 4002991 - DNA, 16 bp, Homo sapiens
aatcttctccagattt

SEQ ID NO: 4002992 - DNA, 17 bp, Homo sapiens
aatcttgaaattaagaa

SEQ ID NO: 4002993 - DNA, 23 bp, Homo sapiens
aatcttggaagtacatgaataca

SEQ ID NO: 4002994 - DNA, 19 bp, Homo sapiens
aatcttggggggtttttac

SEQ ID NO: 4002995 - DNA, 14 bp, Homo sapiens
aatcttgggtgggt

SEQ ID NO: 4002996 - DNA, 13 bp, Homo sapiens
aatcttgtctaac

SEQ ID NO: 4002997 - DNA, 17 bp, Homo sapiens
aatcttgttttaagcaa

SEQ ID NO: 4002998 - DNA, 23 bp, Homo sapiens
aatcttgttttaagcaaatgcat

SEQ ID NO: 4002999 - DNA, 20 bp, Homo sapiens
aatctttacctgtatacagt

SEQ ID NO: 4003000 - DNA, 22 bp, Homo sapiens
aatctttacctgtatacagtgc

SEQ ID NO: 4003001 - DNA, 23 bp, Homo sapiens
aatctttacctgtatacagtgca

SEQ ID NO: 4003002 - DNA, 19 bp, Homo sapiens
aatctttctttacctgaga

SEQ ID NO: 4003003 - DNA, 22 bp, Homo sapiens
aatctttctttacctgagacca

SEQ ID NO: 4003004 - DNA, 22 bp, Homo sapiens
aatctttgtgacaggaaagccc

SEQ ID NO: 4003005 - DNA, 23 bp, Homo sapiens
aatcttttacaactgcctcgaaa

SEQ ID NO: 4003006 - DNA, 23 bp, Homo sapiens
aatgaaaaatgtaatttagaaac

SEQ ID NO: 4003007 - DNA, 17 bp, Homo sapiens
aatgaaaaattctcagt

SEQ ID NO: 4003008 - DNA, 17 bp, Homo sapiens
aatgaaaaatttaagca

SEQ ID NO: 4003009 - DNA, 13 bp, Homo sapiens
aatgaaaacattt

SEQ ID NO: 4003010 - DNA, 16 bp, Homo sapiens
aatgaaaatgaatatc

SEQ ID NO: 4003011 - DNA, 16 bp, Homo sapiens
aatgaaaatgcagtcc

SEQ ID NO: 4003012 - DNA, 23 bp, Homo sapiens
aatgaaaatgtcagaaaccagtt

SEQ ID NO: 4003013 - DNA, 19 bp, Homo sapiens
aatgaaacactcagttgtt

SEQ ID NO: 4003014 - DNA, 17 bp, Homo sapiens
aatgaaacattttgtca

SEQ ID NO: 4003015 - DNA, 18 bp, Homo sapiens
aatgaaagactgtacaaa

SEQ ID NO: 4003016 - DNA, 20 bp, Homo sapiens
aatgaaagactgtacaaagt

SEQ ID NO: 4003017 - DNA, 21 bp, Homo sapiens
aatgaaagactgtacaaagta

SEQ ID NO: 4003018 - DNA, 15 bp, Homo sapiens
aatgaaagattaaac

SEQ ID NO: 4003019 - DNA, 15 bp, Homo sapiens
aatgaaagcatgtgg

SEQ ID NO: 4003020 - DNA, 22 bp, Homo sapiens
aatgaaagcatgtggcatgttc

SEQ ID NO: 4003021 - DNA, 17 bp, Homo sapiens
aatgaaaggtactatat

SEQ ID NO: 4003022 - DNA, 14 bp, Homo sapiens
aatgaaatacacaa

SEQ ID NO: 4003023 - DNA, 15 bp, Homo sapiens
aatgaaatgtatgtg

SEQ ID NO: 4003024 - DNA, 17 bp, Homo sapiens
aatgaaatgtatgtgct

SEQ ID NO: 4003025 - DNA, 15 bp, Homo sapiens
aatgaaattaacaca

SEQ ID NO: 4003026 - DNA, 20 bp, Homo sapiens
aatgaaattaacacaaagga

SEQ ID NO: 4003027 - DNA, 15 bp, Homo sapiens
aatgaaatttgcaaa

SEQ ID NO: 4003028 - DNA, 12 bp, Homo sapiens
aatgaacaaaag

SEQ ID NO: 4003029 - DNA, 18 bp, Homo sapiens
aatgaacaaaagattgga

SEQ ID NO: 4003030 - DNA, 21 bp, Homo sapiens
aatgaacactcttttgcttta

SEQ ID NO: 4003031 - DNA, 13 bp, Homo sapiens
aatgaacccaaga

SEQ ID NO: 4003032 - DNA, 12 bp, Homo sapiens
aatgaagacaat

SEQ ID NO: 4003033 - DNA, 13 bp, Homo sapiens
aatgaagacaatg

SEQ ID NO: 4003034 - DNA, 19 bp, Homo sapiens
aatgaagcagctttaaaca

SEQ ID NO: 4003035 - DNA, 16 bp, Homo sapiens
aatgaataatttccca

SEQ ID NO: 4003036 - DNA, 18 bp, Homo sapiens
aatgaatatctattaata

SEQ ID NO: 4003037 - DNA, 19 bp, Homo sapiens
aatgaatattgaagtttca

SEQ ID NO: 4003038 - DNA, 23 bp, Homo sapiens
aatttaagcattgtttgcttatt

SEQ ID NO: 4003039 - DNA, 14 bp, Homo sapiens
aatttaagtgcgtg

SEQ ID NO: 4003040 - DNA, 20 bp, Homo sapiens
aatttaagtgcgtgtgtaga

SEQ ID NO: 4003041 - DNA, 21 bp, Homo sapiens
aatttaattaggggttgctaa

SEQ ID NO: 4003042 - DNA, 20 bp, Homo sapiens
aatttaattcctctttttag

SEQ ID NO: 4003043 - DNA, 15 bp, Homo sapiens
aatttacactgccat

SEQ ID NO: 4003044 - DNA, 19 bp, Homo sapiens
aatttacatactctgctta

SEQ ID NO: 4003045 - DNA, 15 bp, Homo sapiens
aatttactttacaca

SEQ ID NO: 4003046 - DNA, 18 bp, Homo sapiens
aatttagaaactgatttc

SEQ ID NO: 4003047 - DNA, 20 bp, Homo sapiens
aatttagacaacctgaaatt

SEQ ID NO: 4003048 - DNA, 21 bp, Homo sapiens
aatttagagataggaaactga

SEQ ID NO: 4003049 - DNA, 18 bp, Homo sapiens
aatttagggtactaaatt

SEQ ID NO: 4003050 - DNA, 18 bp, Homo sapiens
aatttaggtttttattag

SEQ ID NO: 4003051 - DNA, 16 bp, Homo sapiens
aatttatcaaagcata

SEQ ID NO: 4003052 - DNA, 18 bp, Homo sapiens
aatttatcttgtctctgg

SEQ ID NO: 4003053 - DNA, 20 bp, Homo sapiens
aatttatgagtttttgatag

SEQ ID NO: 4003054 - DNA, 21 bp, Homo sapiens
aatttattcaattcctctggg

SEQ ID NO: 4003055 - DNA, 17 bp, Homo sapiens
aatttatttcatccagt

SEQ ID NO: 4003056 - DNA, 21 bp, Homo sapiens
aatttatttccactaaaaata

SEQ ID NO: 4003057 - DNA, 21 bp, Homo sapiens
aatttcaccaccaaatgccaa

SEQ ID NO: 4003058 - DNA, 16 bp, Homo sapiens
aatttcacttatacct

SEQ ID NO: 4003059 - DNA, 23 bp, Homo sapiens
aatttcagactcccattcctgaa

SEQ ID NO: 4003060 - DNA, 19 bp, Homo sapiens
aatttcccaattaggaagt

SEQ ID NO: 4003061 - DNA, 13 bp, Homo sapiens
aatttcccacccc

SEQ ID NO: 4003062 - DNA, 18 bp, Homo sapiens
aatttcccacccccaccc

SEQ ID NO: 4003063 - DNA, 17 bp, Homo sapiens
aatttcccaggaccctg

SEQ ID NO: 4003064 - DNA, 21 bp, Homo sapiens
aatttcccaggaccctgaagg

SEQ ID NO: 4003065 - DNA, 14 bp, Homo sapiens
aatttcctttttga

SEQ ID NO: 4003066 - DNA, 19 bp, Homo sapiens
aatttcctttttgacactg

SEQ ID NO: 4003067 - DNA, 21 bp, Homo sapiens
aatttcctttttgacactgaa

SEQ ID NO: 4003068 - DNA, 22 bp, Homo sapiens
aatttcctttttgacactgaaa

SEQ ID NO: 4003069 - DNA, 18 bp, Homo sapiens
aatttcgccgttgaagag

SEQ ID NO: 4003070 - DNA, 21 bp, Homo sapiens
aatttcgccgttgaagaggaa

SEQ ID NO: 4003071 - DNA, 18 bp, Homo sapiens
aatttcggattttttcca

SEQ ID NO: 4003072 - DNA, 20 bp, Homo sapiens
aatttcggattttttccaaa

SEQ ID NO: 4003073 - DNA, 14 bp, Homo sapiens
aatttctcatcaca

SEQ ID NO: 4003074 - DNA, 16 bp, Homo sapiens
aatttcttatgtgaca

SEQ ID NO: 4003075 - DNA, 15 bp, Homo sapiens
aatttcttatttacc

SEQ ID NO: 4003076 - DNA, 21 bp, Homo sapiens
aatttcttgctctatctctca

SEQ ID NO: 4003077 - DNA, 24 bp, Homo sapiens
aatttcttgctctatctctcaaaa

SEQ ID NO: 4003078 - DNA, 17 bp, Homo sapiens
aatttcttggtaagaag

SEQ ID NO: 4003079 - DNA, 20 bp, Homo sapiens
aatttcttggtaagaagccg

SEQ ID NO: 4003080 - DNA, 18 bp, Homo sapiens
aatttgaaaccaggacat

SEQ ID NO: 4003081 - DNA, 15 bp, Homo sapiens
aatttgaatgaaaaa

SEQ ID NO: 4003082 - DNA, 15 bp, Homo sapiens
aatttgatacataat

SEQ ID NO: 4003083 - DNA, 18 bp, Homo sapiens
aatttgatacataataaa

SEQ ID NO: 4003084 - DNA, 18 bp, Homo sapiens
aatttgatcgttccagtt

SEQ ID NO: 4003085 - DNA, 16 bp, Homo sapiens
aatttgatgaaagctg

SEQ ID NO: 4003086 - DNA, 17 bp, Homo sapiens
aatttgatgaaagctga

SEQ ID NO: 4003087 - DNA, 15 bp, Homo sapiens
aatttgattaacaaa

SEQ ID NO: 4003088 - DNA, 17 bp, Homo sapiens
aatttgattaacaaata

SEQ ID NO: 4003089 - DNA, 12 bp, Homo sapiens
aatttgattgat

SEQ ID NO: 4003090 - DNA, 13 bp, Homo sapiens
aatttgattgatt

SEQ ID NO: 4003091 - DNA, 16 bp, Homo sapiens
aatttgattgatttga

SEQ ID NO: 4003092 - DNA, 19 bp, Homo sapiens
aatttgcatattctattgt

SEQ ID NO: 4003093 - DNA, 23 bp, Homo sapiens
aatttgcatattctattgtatta

SEQ ID NO: 4003094 - DNA, 15 bp, Homo sapiens
aatttgcctgctggg

SEQ ID NO: 4003095 - DNA, 20 bp, Homo sapiens
aatttgctggagaagtgtgt

SEQ ID NO: 4003096 - DNA, 23 bp, Homo sapiens
aatttgggctaaaacttagaaaa

SEQ ID NO: 4003097 - DNA, 18 bp, Homo sapiens
aatttgggggaaaattta

SEQ ID NO: 4003098 - DNA, 15 bp, Homo sapiens
aatttggtctgtata

SEQ ID NO: 4003099 - DNA, 19 bp, Homo sapiens
aatttggtttaaaaataca

SEQ ID NO: 4003100 - DNA, 22 bp, Homo sapiens
aatttgtaaaaacagcattgct

SEQ ID NO: 4003101 - DNA, 16 bp, Homo sapiens
aatttgtaaatgattt

SEQ ID NO: 4003102 - DNA, 15 bp, Homo sapiens
aatttgtaacctcag

SEQ ID NO: 4003103 - DNA, 19 bp, Homo sapiens
aatttgtaagtttcaggtg

SEQ ID NO: 4003104 - DNA, 18 bp, Homo sapiens
acaacttgtacttgtttc

SEQ ID NO: 4003105 - DNA, 15 bp, Homo sapiens
acaagaaatccctgt

SEQ ID NO: 4003106 - DNA, 17 bp, Homo sapiens
acaagaagaaatatgaa

SEQ ID NO: 4003107 - DNA, 18 bp, Homo sapiens
acaagaagaaatatgaaa

SEQ ID NO: 4003108 - DNA, 19 bp, Homo sapiens
acaagaagaaatatgaaat

SEQ ID NO: 4003109 - DNA, 17 bp, Homo sapiens
acaagaataaaggcagc

SEQ ID NO: 4003110 - DNA, 18 bp, Homo sapiens
acaagaataaaggcagct

SEQ ID NO: 4003111 - DNA, 14 bp, Homo sapiens
acaagaatggatca

SEQ ID NO: 4003112 - DNA, 18 bp, Homo sapiens
acaagactgttgtgatct

SEQ ID NO: 4003113 - DNA, 19 bp, Homo sapiens
acaagagtggagagaagct

SEQ ID NO: 4003114 - DNA, 21 bp, Homo sapiens
acaagatccatttgcctttct

SEQ ID NO: 4003115 - DNA, 22 bp, Homo sapiens
acaagatccatttgcctttctg

SEQ ID NO: 4003116 - DNA, 13 bp, Homo sapiens
acaagatctttca

SEQ ID NO: 4003117 - DNA, 15 bp, Homo sapiens
acaagatctttcagg

SEQ ID NO: 4003118 - DNA, 23 bp, Homo sapiens
acaagatggtccatttgttcctg

SEQ ID NO: 4003119 - DNA, 20 bp, Homo sapiens
acaagcacaccacaattctc

SEQ ID NO: 4003120 - DNA, 20 bp, Homo sapiens
acaagcagagtgcacagctg

SEQ ID NO: 4003121 - DNA, 20 bp, Homo sapiens
acaagccacaagtcttccag

SEQ ID NO: 4003122 - DNA, 16 bp, Homo sapiens
acaagctcctggtctt

SEQ ID NO: 4003123 - DNA, 16 bp, Homo sapiens
acaagctggaagcaca

SEQ ID NO: 4003124 - DNA, 20 bp, Homo sapiens
acaagctgttgaccaggcac

SEQ ID NO: 4003125 - DNA, 11 bp, Homo sapiens
acaaggaatgc

SEQ ID NO: 4003126 - DNA, 21 bp, Homo sapiens
acaaggatagatgctggccca

SEQ ID NO: 4003127 - DNA, 22 bp, Homo sapiens
acaaggatagatgctggcccag

SEQ ID NO: 4003128 - DNA, 18 bp, Homo sapiens
acaagggagagacctcat

SEQ ID NO: 4003129 - DNA, 19 bp, Homo sapiens
acaagggagagacctcatc

SEQ ID NO: 4003130 - DNA, 16 bp, Homo sapiens
acaaggtagtttttac

SEQ ID NO: 4003131 - DNA, 22 bp, Homo sapiens
acaaggtccactccctgctcca

SEQ ID NO: 4003132 - DNA, 23 bp, Homo sapiens
acaaggtgagtgtgacttccctt

SEQ ID NO: 4003133 - DNA, 15 bp, Homo sapiens
acaaggtgcaggcag

SEQ ID NO: 4003134 - DNA, 16 bp, Homo sapiens
acaagtatacttatat

SEQ ID NO: 4003135 - DNA, 21 bp, Homo sapiens
acaagtatgaataaagacacc

SEQ ID NO: 4003136 - DNA, 23 bp, Homo sapiens
acaagtcataggttaatatttaa

SEQ ID NO: 4003137 - DNA, 13 bp, Homo sapiens
acaagtcttccag

SEQ ID NO: 4003138 - DNA, 23 bp, Homo sapiens
acaagtgaaataacaaaatggac

SEQ ID NO: 4003139 - DNA, 14 bp, Homo sapiens
acaagtgctgaaca

SEQ ID NO: 4003140 - DNA, 21 bp, Homo sapiens
acaagttggaaaaacaacagc

SEQ ID NO: 4003141 - DNA, 17 bp, Homo sapiens
acaagttgttattgttg

SEQ ID NO: 4003142 - DNA, 12 bp, Homo sapiens
acaagtttcaga

SEQ ID NO: 4003143 - DNA, 17 bp, Homo sapiens
acaagtttcagacaggg

SEQ ID NO: 4003144 - DNA, 14 bp, Homo sapiens
aattattggcaaag

SEQ ID NO: 4003145 - DNA, 17 bp, Homo sapiens
aattattggcaaagttt

SEQ ID NO: 4003146 - DNA, 14 bp, Homo sapiens
aattatttgcatat

SEQ ID NO: 4003147 - DNA, 21 bp, Homo sapiens
aattatttgcatattttgaga

SEQ ID NO: 4003148 - DNA, 11 bp, Homo sapiens
aattattttaa

SEQ ID NO: 4003149 - DNA, 15 bp, Homo sapiens
aattattttaaaata

SEQ ID NO: 4003150 - DNA, 17 bp, Homo sapiens
aattattttaaaatatt

SEQ ID NO: 4003151 - DNA, 18 bp, Homo sapiens
aattattttaaaatattt

SEQ ID NO: 4003152 - DNA, 14 bp, Homo sapiens
aattatttttgtgt

SEQ ID NO: 4003153 - DNA, 21 bp, Homo sapiens
aattcaaccactgtaaaatga

SEQ ID NO: 4003154 - DNA, 19 bp, Homo sapiens
aattcaagaaaataaaact

SEQ ID NO: 4003155 - DNA, 17 bp, Homo sapiens
aattcaatcctactttt

SEQ ID NO: 4003156 - DNA, 13 bp, Homo sapiens
aattcacaaactt

SEQ ID NO: 4003157 - DNA, 20 bp, Homo sapiens
aattcactcaagcactgata

SEQ ID NO: 4003158 - DNA, 20 bp, Homo sapiens
aattcagatatatttttcac

SEQ ID NO: 4003159 - DNA, 15 bp, Homo sapiens
aattcagcaaaccat

SEQ ID NO: 4003160 - DNA, 23 bp, Homo sapiens
aattcagcactgatttcacaaca

SEQ ID NO: 4003161 - DNA, 20 bp, Homo sapiens
aattcagctcagcttcttcc

SEQ ID NO: 4003162 - DNA, 13 bp, Homo sapiens
aattcagtttcat

SEQ ID NO: 4003163 - DNA, 15 bp, Homo sapiens
aattcagtttcataa

SEQ ID NO: 4003164 - DNA, 16 bp, Homo sapiens
aattcagtttcataaa

SEQ ID NO: 4003165 - DNA, 18 bp, Homo sapiens
aattcagtttttgtatct

SEQ ID NO: 4003166 - DNA, 15 bp, Homo sapiens
aattcatttttttca

SEQ ID NO: 4003167 - DNA, 17 bp, Homo sapiens
aattccaattatatgag

SEQ ID NO: 4003168 - DNA, 16 bp, Homo sapiens
aattccacacctttta

SEQ ID NO: 4003169 - DNA, 19 bp, Homo sapiens
aattcccattttgcaaaat

SEQ ID NO: 4003170 - DNA, 21 bp, Homo sapiens
aattcccattttgcaaaattt

SEQ ID NO: 4003171 - DNA, 22 bp, Homo sapiens
aattcccattttgcaaaatttc

SEQ ID NO: 4003172 - DNA, 23 bp, Homo sapiens
aattccctatcttttagttttag

SEQ ID NO: 4003173 - DNA, 15 bp, Homo sapiens
aattcccttttaatc

SEQ ID NO: 4003174 - DNA, 17 bp, Homo sapiens
aattcctacaacttaat

SEQ ID NO: 4003175 - DNA, 18 bp, Homo sapiens
aattcctacaacttaatg

SEQ ID NO: 4003176 - DNA, 21 bp, Homo sapiens
aattcctatatcctgtgactg

SEQ ID NO: 4003177 - DNA, 13 bp, Homo sapiens
aattcctctggga

SEQ ID NO: 4003178 - DNA, 13 bp, Homo sapiens
aattcgtgtgttt

SEQ ID NO: 4003179 - DNA, 16 bp, Homo sapiens
aattctaagttattta

SEQ ID NO: 4003180 - DNA, 19 bp, Homo sapiens
aattctatgttaaatactg

SEQ ID NO: 4003181 - DNA, 21 bp, Homo sapiens
aattctatgttaaatactgtg

SEQ ID NO: 4003182 - DNA, 17 bp, Homo sapiens
aattctcccctccctcc

SEQ ID NO: 4003183 - DNA, 11 bp, Homo sapiens
aattctccttt

SEQ ID NO: 4003184 - DNA, 19 bp, Homo sapiens
aattctgagacatgtgtca

SEQ ID NO: 4003185 - DNA, 16 bp, Homo sapiens
aattctgattcttcta

SEQ ID NO: 4003186 - DNA, 20 bp, Homo sapiens
aattcttaaaaaattgaaaa

SEQ ID NO: 4003187 - DNA, 19 bp, Homo sapiens
aattcttcagcgtaaaatg

SEQ ID NO: 4003188 - DNA, 11 bp, Homo sapiens
aattcttcagt

SEQ ID NO: 4003189 - DNA, 17 bp, Homo sapiens
aattgaccatctgcttt

SEQ ID NO: 4003190 - DNA, 17 bp, Homo sapiens
aattgaccttgaccatt

SEQ ID NO: 4003191 - DNA, 19 bp, Homo sapiens
aattgagaaaaatatatac

SEQ ID NO: 4003192 - DNA, 23 bp, Homo sapiens
aattgagataatatctgtgaggt

SEQ ID NO: 4003193 - DNA, 15 bp, Homo sapiens
aattgagattagagg

SEQ ID NO: 4003194 - DNA, 15 bp, Homo sapiens
aattgatgtatatgt

SEQ ID NO: 4003195 - DNA, 16 bp, Homo sapiens
aattgatgtatatgtt

SEQ ID NO: 4003196 - DNA, 23 bp, Homo sapiens
aattgatgtatatgtttatatac

SEQ ID NO: 4003197 - DNA, 13 bp, Homo sapiens
aattgatgtgttt

SEQ ID NO: 4003198 - DNA, 14 bp, Homo sapiens
aattgatttgcatt

SEQ ID NO: 4003199 - DNA, 14 bp, Homo sapiens
aattgcaaatcttg

SEQ ID NO: 4003200 - DNA, 13 bp, Homo sapiens
aattgcaatttct

SEQ ID NO: 4003201 - DNA, 15 bp, Homo sapiens
aattgcactaaatga

SEQ ID NO: 4003202 - DNA, 15 bp, Homo sapiens
aattgcataaagcat

SEQ ID NO: 4003203 - DNA, 16 bp, Homo sapiens
aattgcataaagcata

SEQ ID NO: 4003204 - DNA, 15 bp, Homo sapiens
aattgccaatcttgt

SEQ ID NO: 4003205 - DNA, 13 bp, Homo sapiens
aattgccccatcc

SEQ ID NO: 4003206 - DNA, 15 bp, Homo sapiens
aattgcctgatttgt

SEQ ID NO: 4003207 - DNA, 20 bp, Homo sapiens
aattggaacagaatgtttta

SEQ ID NO: 4003208 - DNA, 19 bp, Homo sapiens
aattggactttcaaaatta

SEQ ID NO: 4003209 - DNA, 17 bp, Homo sapiens
aattgtaaattgaatca

SEQ ID NO: 4003210 - DNA, 13 bp, Homo sapiens
aattgtaatctga

SEQ ID NO: 4003211 - DNA, 14 bp, Homo sapiens
aattgtagggcttt

SEQ ID NO: 4003212 - DNA, 18 bp, Homo sapiens
aattgtaggggtgtgtgt

SEQ ID NO: 4003213 - DNA, 18 bp, Homo sapiens
aattgtatcatttgaaca

SEQ ID NO: 4003214 - DNA, 20 bp, Homo sapiens
aatgtgcaggtttgttacat

SEQ ID NO: 4003215 - DNA, 22 bp, Homo sapiens
aatgtgcaggtttgttacatag

SEQ ID NO: 4003216 - DNA, 21 bp, Homo sapiens
aatgtgcataatgataaaata

SEQ ID NO: 4003217 - DNA, 12 bp, Homo sapiens
aatgtgcccctg

SEQ ID NO: 4003218 - DNA, 19 bp, Homo sapiens
aatgtgctactgattgttt

SEQ ID NO: 4003219 - DNA, 10 bp, Homo sapiens
aatgtggaga

SEQ ID NO: 4003220 - DNA, 18 bp, Homo sapiens
aatgtggccacttatttc

SEQ ID NO: 4003221 - DNA, 18 bp, Homo sapiens
aatgtgggagcagcggtt

SEQ ID NO: 4003222 - DNA, 18 bp, Homo sapiens
aatgtggtttcaatctaa

SEQ ID NO: 4003223 - DNA, 22 bp, Homo sapiens
aatgtgtgaaaaagatgccaat

SEQ ID NO: 4003224 - DNA, 17 bp, Homo sapiens
aatgttaaatttgtaag

SEQ ID NO: 4003225 - DNA, 21 bp, Homo sapiens
aatgttaaatttgtaagtttc

SEQ ID NO: 4003226 - DNA, 21 bp, Homo sapiens
aatgttaaggacttctgcagc

SEQ ID NO: 4003227 - DNA, 15 bp, Homo sapiens
aatgttacattgttt

SEQ ID NO: 4003228 - DNA, 13 bp, Homo sapiens
aatgttactgatc

SEQ ID NO: 4003229 - DNA, 19 bp, Homo sapiens
aatgttactgatcatgcat

SEQ ID NO: 4003230 - DNA, 21 bp, Homo sapiens
aatgttactgatcatgcattg

SEQ ID NO: 4003231 - DNA, 20 bp, Homo sapiens
aatgttctgacattaacagt

SEQ ID NO: 4003232 - DNA, 20 bp, Homo sapiens
aatgttcttatgcaaaatgg

SEQ ID NO: 4003233 - DNA, 21 bp, Homo sapiens
aatgttcttatgcaaaatgga

SEQ ID NO: 4003234 - DNA, 14 bp, Homo sapiens
aatgttcttccagt

SEQ ID NO: 4003235 - DNA, 11 bp, Homo sapiens
aatgttctttg

SEQ ID NO: 4003236 - DNA, 21 bp, Homo sapiens
aatgttgttcattattggagg

SEQ ID NO: 4003237 - DNA, 11 bp, Homo sapiens
aatgtttaaat

SEQ ID NO: 4003238 - DNA, 12 bp, Homo sapiens
aatgtttaaatc

SEQ ID NO: 4003239 - DNA, 19 bp, Homo sapiens
aatgtttaaatcatgtatg

SEQ ID NO: 4003240 - DNA, 23 bp, Homo sapiens
aatgtttacactctttgtaagag

SEQ ID NO: 4003241 - DNA, 16 bp, Homo sapiens
aatgtttatgagccag

SEQ ID NO: 4003242 - DNA, 17 bp, Homo sapiens
aatgtttatgagccaga

SEQ ID NO: 4003243 - DNA, 22 bp, Homo sapiens
aatgtttatgagccagacaaat

SEQ ID NO: 4003244 - DNA, 21 bp, Homo sapiens
aatgtttatgcaaggaaggaa

SEQ ID NO: 4003245 - DNA, 23 bp, Homo sapiens
aatgtttatgcaaggaaggaaag

SEQ ID NO: 4003246 - DNA, 20 bp, Homo sapiens
aatgtttattcctgataata

SEQ ID NO: 4003247 - DNA, 12 bp, Homo sapiens
aatgtttctatc

SEQ ID NO: 4003248 - DNA, 22 bp, Homo sapiens
aatgtttcttctaggttctaaa

SEQ ID NO: 4003249 - DNA, 23 bp, Homo sapiens
aatgtttcttctaggttctaaaa

SEQ ID NO: 4003250 - DNA, 12 bp, Homo sapiens
aatgtttgctat

SEQ ID NO: 4003251 - DNA, 23 bp, Homo sapiens
aatgtttgggcagaagggagaag

SEQ ID NO: 4003252 - DNA, 18 bp, Homo sapiens
aatgtttgttaaaaataa

SEQ ID NO: 4003253 - DNA, 19 bp, Homo sapiens
aatgtttgttaaaaataaa

SEQ ID NO: 4003254 - DNA, 17 bp, Homo sapiens
aatgttttatactgttt

SEQ ID NO: 4003255 - DNA, 17 bp, Homo sapiens
aatgttttatttatcaa

SEQ ID NO: 4003256 - DNA, 19 bp, Homo sapiens
aatgttttatttatcaaaa

SEQ ID NO: 4003257 - DNA, 14 bp, Homo sapiens
aatgttttgctttt

SEQ ID NO: 4003258 - DNA, 21 bp, Homo sapiens
aatgttttgtatatacagtta

SEQ ID NO: 4003259 - DNA, 21 bp, Homo sapiens
aatgtttttctgccagggagc

SEQ ID NO: 4003260 - DNA, 13 bp, Homo sapiens
aatgttttttgcc

SEQ ID NO: 4003261 - DNA, 13 bp, Homo sapiens
aattaaaacactt

SEQ ID NO: 4003262 - DNA, 14 bp, Homo sapiens
aattaaaacgaaaa

SEQ ID NO: 4003263 - DNA, 10 bp, Homo sapiens
aattaaaact

SEQ ID NO: 4003264 - DNA, 14 bp, Homo sapiens
aattaaaacttctt

SEQ ID NO: 4003265 - DNA, 16 bp, Homo sapiens
aattaaaagtcttttt

SEQ ID NO: 4003266 - DNA, 17 bp, Homo sapiens
aattaaatccaataaaa

SEQ ID NO: 4003267 - DNA, 11 bp, Homo sapiens
aattaaatgta

SEQ ID NO: 4003268 - DNA, 12 bp, Homo sapiens
aattaaatgtag

SEQ ID NO: 4003269 - DNA, 22 bp, Homo sapiens
aattaaattttgagttctacat

SEQ ID NO: 4003270 - DNA, 16 bp, Homo sapiens
aattaaccatttaata

SEQ ID NO: 4003271 - DNA, 22 bp, Homo sapiens
aattaaccatttaataaagaaa

SEQ ID NO: 4003272 - DNA, 18 bp, Homo sapiens
aattaacctggtgctgga

SEQ ID NO: 4003273 - DNA, 14 bp, Homo sapiens
aattaactgaaaca

SEQ ID NO: 4003274 - DNA, 23 bp, Homo sapiens
aattaagaaggcaaaaatgtaaa

SEQ ID NO: 4003275 - DNA, 17 bp, Homo sapiens
aattaagtactatgtat

SEQ ID NO: 4003276 - DNA, 12 bp, Homo sapiens
aattaagtagaa

SEQ ID NO: 4003277 - DNA, 14 bp, Homo sapiens
aattaagtagaaca

SEQ ID NO: 4003278 - DNA, 14 bp, Homo sapiens
aattaatagtttgt

SEQ ID NO: 4003279 - DNA, 20 bp, Homo sapiens
aattaatagtttgtctattt

SEQ ID NO: 4003280 - DNA, 16 bp, Homo sapiens
aattaatggaatcttc

SEQ ID NO: 4003281 - DNA, 21 bp, Homo sapiens
aattaatgtcagtatttcaac

SEQ ID NO: 4003282 - DNA, 13 bp, Homo sapiens
aattaatttgatt

SEQ ID NO: 4003283 - DNA, 14 bp, Homo sapiens
aattacaactaagt

SEQ ID NO: 4003284 - DNA, 16 bp, Homo sapiens
aattacaatatttctg

SEQ ID NO: 4003285 - DNA, 17 bp, Homo sapiens
aattacagcttcaccct

SEQ ID NO: 4003286 - DNA, 16 bp, Homo sapiens
aattaccaagagaagg

SEQ ID NO: 4003287 - DNA, 21 bp, Homo sapiens
aattaccttgagccagtaatt

SEQ ID NO: 4003288 - DNA, 16 bp, Homo sapiens
aattactacaaaattt

SEQ ID NO: 4003289 - DNA, 12 bp, Homo sapiens
aattactggaat

SEQ ID NO: 4003290 - DNA, 15 bp, Homo sapiens
aattactgtgtaaat

SEQ ID NO: 4003291 - DNA, 20 bp, Homo sapiens
aattagaaaaaaattactaa

SEQ ID NO: 4003292 - DNA, 22 bp, Homo sapiens
aattagaaaatgttatttaaca

SEQ ID NO: 4003293 - DNA, 18 bp, Homo sapiens
aattagaaattggctgga

SEQ ID NO: 4003294 - DNA, 15 bp, Homo sapiens
aattagaatagtgtt

SEQ ID NO: 4003295 - DNA, 13 bp, Homo sapiens
aattagatggctt

SEQ ID NO: 4003296 - DNA, 22 bp, Homo sapiens
aattaggaagtgtaacagctga

SEQ ID NO: 4003297 - DNA, 20 bp, Homo sapiens
aattaggcaaggctatgtga

SEQ ID NO: 4003298 - DNA, 16 bp, Homo sapiens
aattagggtacattta

SEQ ID NO: 4003299 - DNA, 18 bp, Homo sapiens
aattaggtttttccttat

SEQ ID NO: 4003300 - DNA, 14 bp, Homo sapiens
aattagtggatttt

SEQ ID NO: 4003301 - DNA, 23 bp, Homo sapiens
aattagtggatttttttgtcatt

SEQ ID NO: 4003302 - DNA, 12 bp, Homo sapiens
aattagtttcct

SEQ ID NO: 4003303 - DNA, 17 bp, Homo sapiens
aattataacttaaaata

SEQ ID NO: 4003304 - DNA, 15 bp, Homo sapiens
aattatccagagttt

SEQ ID NO: 4003305 - DNA, 21 bp, Homo sapiens
aattatcggaagcagtgcctt

SEQ ID NO: 4003306 - DNA, 15 bp, Homo sapiens
aattatgacagttat

SEQ ID NO: 4003307 - DNA, 14 bp, Homo sapiens
aattatgtataaac

SEQ ID NO: 4003308 - DNA, 16 bp, Homo sapiens
aattatgtatgtttac

SEQ ID NO: 4003309 - DNA, 18 bp, Homo sapiens
aattatgtatgtttacat

SEQ ID NO: 4003310 - DNA, 17 bp, Homo sapiens
aattatgtgacatttta

SEQ ID NO: 4003311 - DNA, 22 bp, Homo sapiens
aattatgtgacattttacatta

SEQ ID NO: 4003312 - DNA, 20 bp, Homo sapiens
aattattaactacatttatg

SEQ ID NO: 4003313 - DNA, 18 bp, Homo sapiens
aattattatttatatatg

SEQ ID NO: 4003314 - DNA, 21 bp, Homo sapiens
aattattatttatatatgtat

SEQ ID NO: 4003315 - DNA, 12 bp, Homo sapiens
aattattatttg

SEQ ID NO: 4003316 - DNA, 17 bp, Homo sapiens
aattattgacactgaac

SEQ ID NO: 4003317 - DNA, 19 bp, Homo sapiens
accttccatggctcttttt

SEQ ID NO: 4003318 - DNA, 14 bp, Homo sapiens
accttcccaaacgc

SEQ ID NO: 4003319 - DNA, 19 bp, Homo sapiens
accttcccaaacgcctccc

SEQ ID NO: 4003320 - DNA, 19 bp, Homo sapiens
accttcctgtccctgaggt

SEQ ID NO: 4003321 - DNA, 16 bp, Homo sapiens
accttccttcctgctt

SEQ ID NO: 4003322 - DNA, 14 bp, Homo sapiens
accttccttcctgt

SEQ ID NO: 4003323 - DNA, 17 bp, Homo sapiens
accttctagaattataa

SEQ ID NO: 4003324 - DNA, 19 bp, Homo sapiens
accttctgcctttgatgtt

SEQ ID NO: 4003325 - DNA, 22 bp, Homo sapiens
accttctgtccccagccctgtc

SEQ ID NO: 4003326 - DNA, 12 bp, Homo sapiens
accttctgtggc

SEQ ID NO: 4003327 - DNA, 13 bp, Homo sapiens
accttgaatgctg

SEQ ID NO: 4003328 - DNA, 15 bp, Homo sapiens
accttgaccattaat

SEQ ID NO: 4003329 - DNA, 22 bp, Homo sapiens
accttgatcccaatccttatcc

SEQ ID NO: 4003330 - DNA, 19 bp, Homo sapiens
accttgccaagctttcttc

SEQ ID NO: 4003331 - DNA, 20 bp, Homo sapiens
accttgctaattttctcaaa

SEQ ID NO: 4003332 - DNA, 14 bp, Homo sapiens
accttgctctcctc

SEQ ID NO: 4003333 - DNA, 12 bp, Homo sapiens
acctaacattcg

SEQ ID NO: 4003334 - DNA, 19 bp, Homo sapiens
acctaacattcgatctcat

SEQ ID NO: 4003335 - DNA, 19 bp, Homo sapiens
acctaatgtttatgagcca

SEQ ID NO: 4003336 - DNA, 20 bp, Homo sapiens
acctaatgtttatgagccag

SEQ ID NO: 4003337 - DNA, 16 bp, Homo sapiens
acctaccacagtgtct

SEQ ID NO: 4003338 - DNA, 18 bp, Homo sapiens
acctaccttcatttcagg

SEQ ID NO: 4003339 - DNA, 17 bp, Homo sapiens
acctactatgtgctggg

SEQ ID NO: 4003340 - DNA, 18 bp, Homo sapiens
acctactatgtgctgggt

SEQ ID NO: 4003341 - DNA, 11 bp, Homo sapiens
acctactgagt

SEQ ID NO: 4003342 - DNA, 15 bp, Homo sapiens
acctagaatgtcaga

SEQ ID NO: 4003343 - DNA, 20 bp, Homo sapiens
acctagaatgtcagatttct

SEQ ID NO: 4003344 - DNA, 13 bp, Homo sapiens
acctagagaagat

SEQ ID NO: 4003345 - DNA, 12 bp, Homo sapiens
acctagattttt

SEQ ID NO: 4003346 - DNA, 21 bp, Homo sapiens
acctagcagcaccgttctgtg

SEQ ID NO: 4003347 - DNA, 23 bp, Homo sapiens
acctagcagcaccgttctgtgca

SEQ ID NO: 4003348 - DNA, 20 bp, Homo sapiens
acctaggctcatggacgaga

SEQ ID NO: 4003349 - DNA, 15 bp, Homo sapiens
acctaggtctccagt

SEQ ID NO: 4003350 - DNA, 15 bp, Homo sapiens
acctatcctcactgc

SEQ ID NO: 4003351 - DNA, 15 bp, Homo sapiens
acctatctcgtggga

SEQ ID NO: 4003352 - DNA, 18 bp, Homo sapiens
acctatggaagtggttct

SEQ ID NO: 4003353 - DNA, 17 bp, Homo sapiens
acctatgtcctaaggac

SEQ ID NO: 4003354 - DNA, 19 bp, Homo sapiens
acctatgtcctaaggacac

SEQ ID NO: 4003355 - DNA, 23 bp, Homo sapiens
acctatgtcctaaggacacacta

SEQ ID NO: 4003356 - DNA, 18 bp, Homo sapiens
accccaccttgccaagct

SEQ ID NO: 4003357 - DNA, 18 bp, Homo sapiens
accccacgccctgttcac

SEQ ID NO: 4003358 - DNA, 13 bp, Homo sapiens
accccactgggca

SEQ ID NO: 4003359 - DNA, 22 bp, Homo sapiens
accccactgggccagccctgca

SEQ ID NO: 4003360 - DNA, 10 bp, Homo sapiens
accccagcct

SEQ ID NO: 4003361 - DNA, 21 bp, Homo sapiens
accccagcctcgcctgtcacc

SEQ ID NO: 4003362 - DNA, 15 bp, Homo sapiens
accccagcctgacct

SEQ ID NO: 4003363 - DNA, 16 bp, Homo sapiens
accccagcctgacctg

SEQ ID NO: 4003364 - DNA, 17 bp, Homo sapiens
accccagcctgacctga

SEQ ID NO: 4003365 - DNA, 19 bp, Homo sapiens
accccagcctgacctgaga

SEQ ID NO: 4003366 - DNA, 14 bp, Homo sapiens
accccagctcccta

SEQ ID NO: 4003367 - DNA, 23 bp, Homo sapiens
accccagtggccactcagcttcc

SEQ ID NO: 4003368 - DNA, 15 bp, Homo sapiens
accccagttctaggg

SEQ ID NO: 4003369 - DNA, 21 bp, Homo sapiens
accccatatacacctggaaca

SEQ ID NO: 4003370 - DNA, 17 bp, Homo sapiens
acccccacacctcagtt

SEQ ID NO: 4003371 - DNA, 11 bp, Homo sapiens
acccccaccag

SEQ ID NO: 4003372 - DNA, 14 bp, Homo sapiens
acccccaccagaca

SEQ ID NO: 4003373 - DNA, 17 bp, Homo sapiens
acccccacccacctcca

SEQ ID NO: 4003374 - DNA, 18 bp, Homo sapiens
acccccacccacctccac

SEQ ID NO: 4003375 - DNA, 23 bp, Homo sapiens
acccccacccacctccacccagc

SEQ ID NO: 4003376 - DNA, 14 bp, Homo sapiens
acccccaccccaca

SEQ ID NO: 4003377 - DNA, 19 bp, Homo sapiens
acccccacccccagctcaa

SEQ ID NO: 4003378 - DNA, 20 bp, Homo sapiens
acccccagctcaatggactg

SEQ ID NO: 4003379 - DNA, 21 bp, Homo sapiens
acccccagctcaatggactgg

SEQ ID NO: 4003380 - DNA, 17 bp, Homo sapiens
acccccatccctcggga

SEQ ID NO: 4003381 - DNA, 17 bp, Homo sapiens
acccccatctctccctc

SEQ ID NO: 4003382 - DNA, 16 bp, Homo sapiens
acccccattctgtcct

SEQ ID NO: 4003383 - DNA, 17 bp, Homo sapiens
acccccatttctattta

SEQ ID NO: 4003384 - DNA, 18 bp, Homo sapiens
acccccatttctatttat

SEQ ID NO: 4003385 - DNA, 11 bp, Homo sapiens
acccccctctg

SEQ ID NO: 4003386 - DNA, 14 bp, Homo sapiens
accacctgcctcta

SEQ ID NO: 4003387 - DNA, 20 bp, Homo sapiens
accacctgcttctgaactca

SEQ ID NO: 4003388 - DNA, 16 bp, Homo sapiens
accaccttctgtcccc

SEQ ID NO: 4003389 - DNA, 16 bp, Homo sapiens
accacctttgtctctg

SEQ ID NO: 4003390 - DNA, 16 bp, Homo sapiens
accacgactggccagg

SEQ ID NO: 4003391 - DNA, 14 bp, Homo sapiens
accacgtccagctg

SEQ ID NO: 4003392 - DNA, 16 bp, Homo sapiens
accactaactcctgag

SEQ ID NO: 4003393 - DNA, 13 bp, Homo sapiens
accactagaactc

SEQ ID NO: 4003394 - DNA, 20 bp, Homo sapiens
accactaggaatcccagagg

SEQ ID NO: 4003395 - DNA, 21 bp, Homo sapiens
accactatctccgttccatct

SEQ ID NO: 4003396 - DNA, 22 bp, Homo sapiens
accactatctccgttccatctg

SEQ ID NO: 4003397 - DNA, 19 bp, Homo sapiens
accactgagtaccaggggc

SEQ ID NO: 4003398 - DNA, 16 bp, Homo sapiens
accactggtctgtagg

SEQ ID NO: 4003399 - DNA, 20 bp, Homo sapiens
accactgtaaaatgaaatta

SEQ ID NO: 4003400 - DNA, 12 bp, Homo sapiens
accactgtggcg

SEQ ID NO: 4003401 - DNA, 18 bp, Homo sapiens
accacttaaaaaatgtcc

SEQ ID NO: 4003402 - DNA, 13 bp, Homo sapiens
accacttcattct

SEQ ID NO: 4003403 - DNA, 17 bp, Homo sapiens
accacttcattcttgaa

SEQ ID NO: 4003404 - DNA, 20 bp, Homo sapiens
accacttccaggggaacctg

SEQ ID NO: 4003405 - DNA, 23 bp, Homo sapiens
accacttccaggggaacctgcca

SEQ ID NO: 4003406 - DNA, 14 bp, Homo sapiens
accacttcctgcta

SEQ ID NO: 4003407 - DNA, 15 bp, Homo sapiens
accacttcctttaaa

SEQ ID NO: 4003408 - DNA, 13 bp, Homo sapiens
accagaacaaggt

SEQ ID NO: 4003409 - DNA, 17 bp, Homo sapiens
accagacgtcaggccct

SEQ ID NO: 4003410 - DNA, 21 bp, Homo sapiens
accagactacttgggagcacc

SEQ ID NO: 4003411 - DNA, 19 bp, Homo sapiens
accagagacgcccagcccc

SEQ ID NO: 4003412 - DNA, 19 bp, Homo sapiens
accagagcaacctctcact

SEQ ID NO: 4003413 - DNA, 21 bp, Homo sapiens
accagagccagatgcaggaca

SEQ ID NO: 4003414 - DNA, 15 bp, Homo sapiens
accagagccccccac

SEQ ID NO: 4003415 - DNA, 20 bp, Homo sapiens
accagagccccccacaatga

SEQ ID NO: 4003416 - DNA, 18 bp, Homo sapiens
accagataaatagaacta

SEQ ID NO: 4003417 - DNA, 20 bp, Homo sapiens
accagataagaatgctggtt

SEQ ID NO: 4003418 - DNA, 23 bp, Homo sapiens
accagcaacttgtctttttctgg

SEQ ID NO: 4003419 - DNA, 15 bp, Homo sapiens
accagcactgtctca

SEQ ID NO: 4003420 - DNA, 11 bp, Homo sapiens
accagccagcg

SEQ ID NO: 4003421 - DNA, 22 bp, Homo sapiens
accagccatacttatctctctg

SEQ ID NO: 4003422 - DNA, 17 bp, Homo sapiens
accagccatcctccctc

SEQ ID NO: 4003423 - DNA, 16 bp, Homo sapiens
accagccccatcagaa

SEQ ID NO: 4003424 - DNA, 19 bp, Homo sapiens
accagcccccgccccagag

SEQ ID NO: 4003425 - DNA, 16 bp, Homo sapiens
accagcccggcctgct

SEQ ID NO: 4003426 - DNA, 13 bp, Homo sapiens
accagccctgcag

SEQ ID NO: 4003427 - DNA, 17 bp, Homo sapiens
accagccgccccagccc

SEQ ID NO: 4003428 - DNA, 13 bp, Homo sapiens
accagcctgggca

SEQ ID NO: 4003429 - DNA, 23 bp, Homo sapiens
accagccttggtgccaccaaaag

SEQ ID NO: 4003430 - DNA, 14 bp, Homo sapiens
accagctcatctcc

SEQ ID NO: 4003431 - DNA, 21 bp, Homo sapiens
accagctcgtttttcagcacc

SEQ ID NO: 4003432 - DNA, 11 bp, Homo sapiens
accagctgcag

SEQ ID NO: 4003433 - DNA, 14 bp, Homo sapiens
accagctgcagccc

SEQ ID NO: 4003434 - DNA, 13 bp, Homo sapiens
accagctgtgtcc

SEQ ID NO: 4003435 - DNA, 20 bp, Homo sapiens
accagcttcactctctccgt

SEQ ID NO: 4003436 - DNA, 20 bp, Homo sapiens
accagcttctccaggctctt

SEQ ID NO: 4003437 - DNA, 21 bp, Homo sapiens
accagcttgttctgggctcag

SEQ ID NO: 4003438 - DNA, 20 bp, Homo sapiens
accaggactatagcccaggt

SEQ ID NO: 4003439 - DNA, 18 bp, Homo sapiens
accaggagaaccactaca

SEQ ID NO: 4003440 - DNA, 19 bp, Homo sapiens
accaggagaaccactacat

SEQ ID NO: 4003441 - DNA, 14 bp, Homo sapiens
accaggatttattt

SEQ ID NO: 4003442 - DNA, 15 bp, Homo sapiens
accaggcacctcccc

SEQ ID NO: 4003443 - DNA, 23 bp, Homo sapiens
accaggcacctcccctcccgccc

SEQ ID NO: 4003444 - DNA, 14 bp, Homo sapiens
accaggccgggctt

SEQ ID NO: 4003445 - DNA, 17 bp, Homo sapiens
accaggccgtgccttgt

SEQ ID NO: 4003446 - DNA, 12 bp, Homo sapiens
accaggcctctg

SEQ ID NO: 4003447 - DNA, 23 bp, Homo sapiens
accagggaagaagatcaacgcct

SEQ ID NO: 4003448 - DNA, 13 bp, Homo sapiens
accagggatgctg

SEQ ID NO: 4003449 - DNA, 15 bp, Homo sapiens
accagggatgctggg

SEQ ID NO: 4003450 - DNA, 23 bp, Homo sapiens
accagggcattcgggccacaggg

SEQ ID NO: 4003451 - DNA, 16 bp, Homo sapiens
accagggccgaggagg

SEQ ID NO: 4003452 - DNA, 22 bp, Homo sapiens
accagggcgaacgacaatagct

SEQ ID NO: 4003453 - DNA, 23 bp, Homo sapiens
accagggcgaacgacaatagctt

SEQ ID NO: 4003454 - DNA, 24 bp, Homo sapiens
accaggggtgatttcagagagggc

SEQ ID NO: 4003455 - DNA, 16 bp, Homo sapiens
accaggtgagaagtga

SEQ ID NO: 4003456 - DNA, 14 bp, Homo sapiens
accaggtgggagcg

SEQ ID NO: 4003457 - DNA, 19 bp, Homo sapiens
accaggtgttctacactca

SEQ ID NO: 4003458 - DNA, 23 bp, Homo sapiens
accaggtgttctacactcatctt

SEQ ID NO: 4003459 - DNA, 20 bp, Homo sapiens
accagtaggggcttataata

SEQ ID NO: 4003460 - DNA, 18 bp, Homo sapiens
accagtgtatcaggtcag

SEQ ID NO: 4003461 - DNA, 22 bp, Homo sapiens
accagtgtatcaggtcagggac

SEQ ID NO: 4003462 - DNA, 18 bp, Homo sapiens
accagtgtcccctccact

SEQ ID NO: 4003463 - DNA, 20 bp, Homo sapiens
accagtgtcccctccactgt

SEQ ID NO: 4003464 - DNA, 20 bp, Homo sapiens
accagtgtcctccaagtgcc

SEQ ID NO: 4003465 - DNA, 14 bp, Homo sapiens
accagttaattact

SEQ ID NO: 4003466 - DNA, 13 bp, Homo sapiens
accagttcagaca

SEQ ID NO: 4003467 - DNA, 15 bp, Homo sapiens
accagttcagacact

SEQ ID NO: 4003468 - DNA, 22 bp, Homo sapiens
accagttgccctagcccagact

SEQ ID NO: 4003469 - DNA, 13 bp, Homo sapiens
accagttgccttt

SEQ ID NO: 4003470 - DNA, 15 bp, Homo sapiens
accagttgcctttta

SEQ ID NO: 4003471 - DNA, 23 bp, Homo sapiens
accatatactgttcttcatttta

SEQ ID NO: 4003472 - DNA, 13 bp, Homo sapiens
accatatgaattg

SEQ ID NO: 4003473 - DNA, 17 bp, Homo sapiens
accatattacctggatt

SEQ ID NO: 4003474 - DNA, 19 bp, Homo sapiens
accatcattggaaatgaaa

SEQ ID NO: 4003475 - DNA, 22 bp, Homo sapiens
accatccactctaccctcccac

SEQ ID NO: 4003476 - DNA, 13 bp, Homo sapiens
accatccctgcca

SEQ ID NO: 4003477 - DNA, 15 bp, Homo sapiens
accatccctgccaca

SEQ ID NO: 4003478 - DNA, 18 bp, Homo sapiens
accatctctaccatcatc

SEQ ID NO: 4003479 - DNA, 15 bp, Homo sapiens
accatgaaacaaagc

SEQ ID NO: 4003480 - DNA, 15 bp, Homo sapiens
accatgactgtgacc

SEQ ID NO: 4003481 - DNA, 21 bp, Homo sapiens
accatgagaattttacttcca

SEQ ID NO: 4003482 - DNA, 20 bp, Homo sapiens
accatgcccgactaattttt

SEQ ID NO: 4003483 - DNA, 20 bp, Homo sapiens
accatgcccggctaattttt

SEQ ID NO: 4003484 - DNA, 15 bp, Homo sapiens
accatggccagccaa

SEQ ID NO: 4003485 - DNA, 17 bp, Homo sapiens
accatgtacatgaagaa

SEQ ID NO: 4003486 - DNA, 20 bp, Homo sapiens
acataaattgcataaagcat

SEQ ID NO: 4003487 - DNA, 16 bp, Homo sapiens
acataacgtttttcct

SEQ ID NO: 4003488 - DNA, 18 bp, Homo sapiens
acataacgtttttccttt

SEQ ID NO: 4003489 - DNA, 21 bp, Homo sapiens
acataacgtttttcctttaaa

SEQ ID NO: 4003490 - DNA, 15 bp, Homo sapiens
acataactgccttga

SEQ ID NO: 4003491 - DNA, 14 bp, Homo sapiens
acataagaccataa

SEQ ID NO: 4003492 - DNA, 15 bp, Homo sapiens
acataagataaatgt

SEQ ID NO: 4003493 - DNA, 19 bp, Homo sapiens
acataagtttaggataaaa

SEQ ID NO: 4003494 - DNA, 19 bp, Homo sapiens
acataattaaattttgagt

SEQ ID NO: 4003495 - DNA, 17 bp, Homo sapiens
acatacaggtgctcaat

SEQ ID NO: 4003496 - DNA, 14 bp, Homo sapiens
acatacattaaaac

SEQ ID NO: 4003497 - DNA, 17 bp, Homo sapiens
acatacattaaaactag

SEQ ID NO: 4003498 - DNA, 15 bp, Homo sapiens
acataccccactggg

SEQ ID NO: 4003499 - DNA, 18 bp, Homo sapiens
acataccccactgggcac

SEQ ID NO: 4003500 - DNA, 22 bp, Homo sapiens
acataccccactgggcacacgc

SEQ ID NO: 4003501 - DNA, 23 bp, Homo sapiens
acataccccactgggcacacgca

SEQ ID NO: 4003502 - DNA, 19 bp, Homo sapiens
acatactctctgcctggtg

SEQ ID NO: 4003503 - DNA, 20 bp, Homo sapiens
acatactctctgcctggtgg

SEQ ID NO: 4003504 - DNA, 13 bp, Homo sapiens
acatactgcatgt

SEQ ID NO: 4003505 - DNA, 14 bp, Homo sapiens
acatactgcatgta

SEQ ID NO: 4003506 - DNA, 13 bp, Homo sapiens
acatactgcttga

SEQ ID NO: 4003507 - DNA, 15 bp, Homo sapiens
acatactgtgttcca

SEQ ID NO: 4003508 - DNA, 15 bp, Homo sapiens
acatacttgaagggc

SEQ ID NO: 4003509 - DNA, 16 bp, Homo sapiens
acatacttgaagggcc

SEQ ID NO: 4003510 - DNA, 22 bp, Homo sapiens
acatacttgaagggccagagcc

SEQ ID NO: 4003511 - DNA, 12 bp, Homo sapiens
acatagaaagtt

SEQ ID NO: 4003512 - DNA, 16 bp, Homo sapiens
acatagatattttcac

SEQ ID NO: 4003513 - DNA, 13 bp, Homo sapiens
acatagatgtccc

SEQ ID NO: 4003514 - DNA, 12 bp, Homo sapiens
acatagtgtaat

SEQ ID NO: 4003515 - DNA, 17 bp, Homo sapiens
acatagttttaaactca

SEQ ID NO: 4003516 - DNA, 19 bp, Homo sapiens
acatagttttaaactcatt

SEQ ID NO: 4003517 - DNA, 23 bp, Homo sapiens
acatataatgttgttatttaaag

SEQ ID NO: 4003518 - DNA, 17 bp, Homo sapiens
acatatcgctgacttca

SEQ ID NO: 4003519 - DNA, 18 bp, Homo sapiens
acatatctttattaatca

SEQ ID NO: 4003520 - DNA, 19 bp, Homo sapiens
acatatctttattaatcac

SEQ ID NO: 4003521 - DNA, 15 bp, Homo sapiens
acatatgatttcact

SEQ ID NO: 4003522 - DNA, 16 bp, Homo sapiens
acatatgtacataaat

SEQ ID NO: 4003523 - DNA, 20 bp, Homo sapiens
acatattactgttgcattta

SEQ ID NO: 4003524 - DNA, 17 bp, Homo sapiens
acatattatgcctgaat

SEQ ID NO: 4003525 - DNA, 12 bp, Homo sapiens
acatcaaagagg

SEQ ID NO: 4003526 - DNA, 14 bp, Homo sapiens
acatcaatgttcat

SEQ ID NO: 4003527 - DNA, 17 bp, Homo sapiens
acatcaatgttcattgt

SEQ ID NO: 4003528 - DNA, 15 bp, Homo sapiens
acatcaccctttgcc

SEQ ID NO: 4003529 - DNA, 15 bp, Homo sapiens
acattgaagtaatga

SEQ ID NO: 4003530 - DNA, 16 bp, Homo sapiens
acattgaatgcgcttt

SEQ ID NO: 4003531 - DNA, 16 bp, Homo sapiens
acattgaccaagaact

SEQ ID NO: 4003532 - DNA, 18 bp, Homo sapiens
acattgaccaagaactgc

SEQ ID NO: 4003533 - DNA, 20 bp, Homo sapiens
acattgaccaagaactgcat

SEQ ID NO: 4003534 - DNA, 19 bp, Homo sapiens
acattgacgattccttctc

SEQ ID NO: 4003535 - DNA, 22 bp, Homo sapiens
acattgacgattccttctctga

SEQ ID NO: 4003536 - DNA, 20 bp, Homo sapiens
acattgcttgtgccacaccc

SEQ ID NO: 4003537 - DNA, 13 bp, Homo sapiens
acattgtcaataa

SEQ ID NO: 4003538 - DNA, 17 bp, Homo sapiens
acattgtttgctgctat

SEQ ID NO: 4003539 - DNA, 18 bp, Homo sapiens
acattgtttgctgctatt

SEQ ID NO: 4003540 - DNA, 16 bp, Homo sapiens
acattgtttggatttc

SEQ ID NO: 4003541 - DNA, 12 bp, Homo sapiens
acatttaaaatt

SEQ ID NO: 4003542 - DNA, 20 bp, Homo sapiens
acatttaaagcattgctgtt

SEQ ID NO: 4003543 - DNA, 12 bp, Homo sapiens
acatttaattta

SEQ ID NO: 4003544 - DNA, 14 bp, Homo sapiens
acatttagaacttt

SEQ ID NO: 4003545 - DNA, 20 bp, Homo sapiens
acatttataatgtttgctat

SEQ ID NO: 4003546 - DNA, 14 bp, Homo sapiens
acatttatgattta

SEQ ID NO: 4003547 - DNA, 20 bp, Homo sapiens
acatttatgatttaataaaa

SEQ ID NO: 4003548 - DNA, 14 bp, Homo sapiens
acatttatttcctc

SEQ ID NO: 4003549 - DNA, 15 bp, Homo sapiens
acatttatttcctcc

SEQ ID NO: 4003550 - DNA, 22 bp, Homo sapiens
acatttcactgtctgtctggtc

SEQ ID NO: 4003551 - DNA, 14 bp, Homo sapiens
acatttctcttccc

SEQ ID NO: 4003552 - DNA, 19 bp, Homo sapiens
acatttctgatcagaggtg

SEQ ID NO: 4003553 - DNA, 16 bp, Homo sapiens
acatttctgctctcag

SEQ ID NO: 4003554 - DNA, 18 bp, Homo sapiens
acatttctttgcattcca

SEQ ID NO: 4003555 - DNA, 15 bp, Homo sapiens
acatttcttttcttt

SEQ ID NO: 4003556 - DNA, 20 bp, Homo sapiens
acatttcttttctttttaca

SEQ ID NO: 4003557 - DNA, 13 bp, Homo sapiens
acatttgccttgc

SEQ ID NO: 4003558 - DNA, 15 bp, Homo sapiens
acatttggaatactt

SEQ ID NO: 4003559 - DNA, 16 bp, Homo sapiens
acatttggaatacttt

SEQ ID NO: 4003560 - DNA, 18 bp, Homo sapiens
acatttggaatacttttt

SEQ ID NO: 4003561 - DNA, 18 bp, Homo sapiens
acatttggacatttccag

SEQ ID NO: 4003562 - DNA, 15 bp, Homo sapiens
acatttgtacagaat

SEQ ID NO: 4003563 - DNA, 14 bp, Homo sapiens
acatttgtagttga

SEQ ID NO: 4003564 - DNA, 15 bp, Homo sapiens
acatttgttcctgga

SEQ ID NO: 4003565 - DNA, 18 bp, Homo sapiens
acattttagctctattga

SEQ ID NO: 4003566 - DNA, 15 bp, Homo sapiens
acattttatcattaa

SEQ ID NO: 4003567 - DNA, 18 bp, Homo sapiens
acattttggtgagaaatg

SEQ ID NO: 4003568 - DNA, 21 bp, Homo sapiens
acatttttaatttaacaaact

SEQ ID NO: 4003569 - DNA, 12 bp, Homo sapiens
acatttttacaa

SEQ ID NO: 4003570 - DNA, 14 bp, Homo sapiens
acatttttacaata

SEQ ID NO: 4003571 - DNA, 15 bp, Homo sapiens
acatttttacaataa

SEQ ID NO: 4003572 - DNA, 23 bp, Homo sapiens
acatttttatttatgaagtttaa

SEQ ID NO: 4003573 - DNA, 19 bp, Homo sapiens
acatttttccgtttgcttt

SEQ ID NO: 4003574 - DNA, 19 bp, Homo sapiens
acattttttcttctgaaga

SEQ ID NO: 4003575 - DNA, 14 bp, Homo sapiens
acattttttgctat

SEQ ID NO: 4003576 - DNA, 21 bp, Homo sapiens
acattttttgctataatcatt

SEQ ID NO: 4003577 - DNA, 17 bp, Homo sapiens
accaaaagaatttgcac

SEQ ID NO: 4003578 - DNA, 15 bp, Homo sapiens
accaaagagggcttc

SEQ ID NO: 4003579 - DNA, 23 bp, Homo sapiens
accaaagatatatacacaggatc

SEQ ID NO: 4003580 - DNA, 18 bp, Homo sapiens
accaaataaaaatattgt

SEQ ID NO: 4003581 - DNA, 21 bp, Homo sapiens
accaaatatcaccaggactgt

SEQ ID NO: 4003582 - DNA, 20 bp, Homo sapiens
accaaatctctcaaatctgt

SEQ ID NO: 4003583 - DNA, 13 bp, Homo sapiens
accaaatctgaca

SEQ ID NO: 4003584 - DNA, 14 bp, Homo sapiens
accaaatctgacat

SEQ ID NO: 4003585 - DNA, 22 bp, Homo sapiens
accaacaagaataaaggcagct

SEQ ID NO: 4003586 - DNA, 13 bp, Homo sapiens
accaacatctttg

SEQ ID NO: 4003587 - DNA, 17 bp, Homo sapiens
accaacctttaaaattg

SEQ ID NO: 4003588 - DNA, 13 bp, Homo sapiens
accaactgcccta

SEQ ID NO: 4003589 - DNA, 21 bp, Homo sapiens
accaactgccctaagccccca

SEQ ID NO: 4003590 - DNA, 23 bp, Homo sapiens
accaactgtcactcattgctgag

SEQ ID NO: 4003591 - DNA, 15 bp, Homo sapiens
accaagaaagctcac

SEQ ID NO: 4003592 - DNA, 14 bp, Homo sapiens
acgcttttctttgt

SEQ ID NO: 4003593 - DNA, 21 bp, Homo sapiens
acggactcccgggccacgccc

SEQ ID NO: 4003594 - DNA, 19 bp, Homo sapiens
acggagcggattgcaaagc

SEQ ID NO: 4003595 - DNA, 14 bp, Homo sapiens
acggattttcagtt

SEQ ID NO: 4003596 - DNA, 15 bp, Homo sapiens
acggcaggctcactg

SEQ ID NO: 4003597 - DNA, 18 bp, Homo sapiens
acggccccagcttctcag

SEQ ID NO: 4003598 - DNA, 15 bp, Homo sapiens
acggcctgatgctcc

SEQ ID NO: 4003599 - DNA, 22 bp, Homo sapiens
acggcctgatgctccctcccct

SEQ ID NO: 4003600 - DNA, 21 bp, Homo sapiens
acggccttcaactgaaaagac

SEQ ID NO: 4003601 - DNA, 17 bp, Homo sapiens
acggcgcccccagtgtg

SEQ ID NO: 4003602 - DNA, 17 bp, Homo sapiens
acggcggccaggcacag

SEQ ID NO: 4003603 - DNA, 19 bp, Homo sapiens
acggcggccaggcacaggg

SEQ ID NO: 4003604 - DNA, 19 bp, Homo sapiens
actcagtttgtcagacttt

SEQ ID NO: 4003605 - DNA, 21 bp, Homo sapiens
actcataaaaagcctgcaatt

SEQ ID NO: 4003606 - DNA, 9 bp, Homo sapiens
actcatcat

SEQ ID NO: 4003607 - DNA, 15 bp, Homo sapiens
actcatcataaaata

SEQ ID NO: 4003608 - DNA, 13 bp, Homo sapiens
actcatcatttgt

SEQ ID NO: 4003609 - DNA, 22 bp, Homo sapiens
actcatccccacagctggctct

SEQ ID NO: 4003610 - DNA, 13 bp, Homo sapiens
actcatggcagct

SEQ ID NO: 4003611 - DNA, 13 bp, Homo sapiens
actcattctatcc

SEQ ID NO: 4003612 - DNA, 21 bp, Homo sapiens
actcattgctgagcctctgct

SEQ ID NO: 4003613 - DNA, 19 bp, Homo sapiens
actcatttttgccatacat

SEQ ID NO: 4003614 - DNA, 20 bp, Homo sapiens
actccaatgtctgctgagga

SEQ ID NO: 4003615 - DNA, 21 bp, Homo sapiens
actccaatgtctgctgaggag

SEQ ID NO: 4003616 - DNA, 13 bp, Homo sapiens
actccacagcgga

SEQ ID NO: 4003617 - DNA, 21 bp, Homo sapiens
actccacagcggaggagacca

SEQ ID NO: 4003618 - DNA, 14 bp, Homo sapiens
actccacatctgcc

SEQ ID NO: 4003619 - DNA, 16 bp, Homo sapiens
actccacatctgcctt

SEQ ID NO: 4003620 - DNA, 22 bp, Homo sapiens
actccaccgaccaactgcccta

SEQ ID NO: 4003621 - DNA, 13 bp, Homo sapiens
actccactgtttt

SEQ ID NO: 4003622 - DNA, 15 bp, Homo sapiens
actccagacccctgg

SEQ ID NO: 4003623 - DNA, 19 bp, Homo sapiens
actccagacccctggcttt

SEQ ID NO: 4003624 - DNA, 15 bp, Homo sapiens
actccagatagagaa

SEQ ID NO: 4003625 - DNA, 17 bp, Homo sapiens
actccagatagagaaat

SEQ ID NO: 4003626 - DNA, 17 bp, Homo sapiens
actccaggaaagagcag

SEQ ID NO: 4003627 - DNA, 14 bp, Homo sapiens
actccaggcccaag

SEQ ID NO: 4003628 - DNA, 16 bp, Homo sapiens
actccatctctcatcc

SEQ ID NO: 4003629 - DNA, 21 bp, Homo sapiens
actccatctctcatcctccag

SEQ ID NO: 4003630 - DNA, 13 bp, Homo sapiens
actccatctcttc

SEQ ID NO: 4003631 - DNA, 15 bp, Homo sapiens
actccatctcttctg

SEQ ID NO: 4003632 - DNA, 18 bp, Homo sapiens
actccatctcttctgcaa

SEQ ID NO: 4003633 - DNA, 18 bp, Homo sapiens
actcccacaaccacatgt

SEQ ID NO: 4003634 - DNA, 22 bp, Homo sapiens
actcccagtccaaatgtcctcc

SEQ ID NO: 4003635 - DNA, 14 bp, Homo sapiens
actccccagggagc

SEQ ID NO: 4003636 - DNA, 16 bp, Homo sapiens
actccccagggagctc

SEQ ID NO: 4003637 - DNA, 20 bp, Homo sapiens
actccccagggagctctggg

SEQ ID NO: 4003638 - DNA, 22 bp, Homo sapiens
actccccctaaacccctgtccc

SEQ ID NO: 4003639 - DNA, 14 bp, Homo sapiens
actccccgaagtct

SEQ ID NO: 4003640 - DNA, 14 bp, Homo sapiens
actcccctgggggt

SEQ ID NO: 4003641 - DNA, 14 bp, Homo sapiens
actcccggagcctg

SEQ ID NO: 4003642 - DNA, 17 bp, Homo sapiens
actcccgggccacgccc

SEQ ID NO: 4003643 - DNA, 15 bp, Homo sapiens
actccctcctcacct

SEQ ID NO: 4003644 - DNA, 12 bp, Homo sapiens
actccctgcttg

SEQ ID NO: 4003645 - DNA, 18 bp, Homo sapiens
actccctgcttgcaggag

SEQ ID NO: 4003646 - DNA, 18 bp, Homo sapiens
actccctgggacacagac

SEQ ID NO: 4003647 - DNA, 22 bp, Homo sapiens
actccgccctcctcgggccgag

SEQ ID NO: 4003648 - DNA, 19 bp, Homo sapiens
actcctaattttaaataat

SEQ ID NO: 4003649 - DNA, 22 bp, Homo sapiens
actcctaattttaaataatttc

SEQ ID NO: 4003650 - DNA, 18 bp, Homo sapiens
actcctacctgccctgga

SEQ ID NO: 4003651 - DNA, 20 bp, Homo sapiens
actcctagactttgggatca

SEQ ID NO: 4003652 - DNA, 22 bp, Homo sapiens
actcctagagaacgcagcccta

SEQ ID NO: 4003653 - DNA, 13 bp, Homo sapiens
actcctccctccg

SEQ ID NO: 4003654 - DNA, 22 bp, Homo sapiens
actcctcctccaaaggccccct

SEQ ID NO: 4003655 - DNA, 23 bp, Homo sapiens
actcctcctccaaaggcccccta

SEQ ID NO: 4003656 - DNA, 21 bp, Homo sapiens
actcctctaagccactcttcc

SEQ ID NO: 4003657 - DNA, 19 bp, Homo sapiens
actcctgacgtctgaagct

SEQ ID NO: 4003658 - DNA, 12 bp, Homo sapiens
actcctgactcc

SEQ ID NO: 4003659 - DNA, 22 bp, Homo sapiens
actcctgccctgttgtgtatag

SEQ ID NO: 4003660 - DNA, 19 bp, Homo sapiens
actcctgcctgagtttcca

SEQ ID NO: 4003661 - DNA, 15 bp, Homo sapiens
actcctgctctgctc

SEQ ID NO: 4003662 - DNA, 16 bp, Homo sapiens
actcctgctctgctcg

SEQ ID NO: 4003663 - DNA, 18 bp, Homo sapiens
actcctgggctcaagcaa

SEQ ID NO: 4003664 - DNA, 16 bp, Homo sapiens
actcctggggcctctt

SEQ ID NO: 4003665 - DNA, 21 bp, Homo sapiens
actcctgtcccttttccctta

SEQ ID NO: 4003666 - DNA, 17 bp, Homo sapiens
actcctgttacttacct

SEQ ID NO: 4003667 - DNA, 20 bp, Homo sapiens
actcctgttacttacctaaa

SEQ ID NO: 4003668 - DNA, 15 bp, Homo sapiens
actccttcctggcct

SEQ ID NO: 4003669 - DNA, 17 bp, Homo sapiens
actccttcctggcctga

SEQ ID NO: 4003670 - DNA, 19 bp, Homo sapiens
actccttcctggcctgaga

SEQ ID NO: 4003671 - DNA, 23 bp, Homo sapiens
actccttcctggcctgagagtca

SEQ ID NO: 4003672 - DNA, 13 bp, Homo sapiens
actccttgcttcc

SEQ ID NO: 4003673 - DNA, 13 bp, Homo sapiens
actcgacccagaa

SEQ ID NO: 4003674 - DNA, 23 bp, Homo sapiens
actcgagaccttttcaacttggc

SEQ ID NO: 4003675 - DNA, 20 bp, Homo sapiens
actcgcacctgtgctggagc

SEQ ID NO: 4003676 - DNA, 19 bp, Homo sapiens
actcgccatctcctgggcc

SEQ ID NO: 4003677 - DNA, 20 bp, Homo sapiens
actcgggaggctgagacagg

SEQ ID NO: 4003678 - DNA, 22 bp, Homo sapiens
actcgggaggctgagacaggag

SEQ ID NO: 4003679 - DNA, 16 bp, Homo sapiens
actctaagtgtttgct

SEQ ID NO: 4003680 - DNA, 23 bp, Homo sapiens
actctaagtgtttgctgcaattt

SEQ ID NO: 4003681 - DNA, 14 bp, Homo sapiens
actctaatagtgct

SEQ ID NO: 4003682 - DNA, 21 bp, Homo sapiens
actctaatagtgcttaaaaat

SEQ ID NO: 4003683 - DNA, 22 bp, Homo sapiens
actctaattcccattttgcaaa

SEQ ID NO: 4003684 - DNA, 17 bp, Homo sapiens
actctacccatattaca

SEQ ID NO: 4003685 - DNA, 16 bp, Homo sapiens
actctacccctgctcc

SEQ ID NO: 4003686 - DNA, 18 bp, Homo sapiens
actctacccctgctccca

SEQ ID NO: 4003687 - DNA, 15 bp, Homo sapiens
actctaccctcccac

SEQ ID NO: 4003688 - DNA, 18 bp, Homo sapiens
actctaccctcccacccc

SEQ ID NO: 4003689 - DNA, 16 bp, Homo sapiens
actctacctaatgtct

SEQ ID NO: 4003690 - DNA, 22 bp, Homo sapiens
actctacctcatatcagtttgc

SEQ ID NO: 4003691 - DNA, 20 bp, Homo sapiens
actctacttagcatgtccct

SEQ ID NO: 4003692 - DNA, 20 bp, Homo sapiens
actctagacaagatattgta

SEQ ID NO: 4003693 - DNA, 18 bp, Homo sapiens
actctatagactctagga

SEQ ID NO: 4003694 - DNA, 16 bp, Homo sapiens
actctcaaaagtctat

SEQ ID NO: 4003695 - DNA, 19 bp, Homo sapiens
actctcaaaagtctatttt

SEQ ID NO: 4003696 - DNA, 14 bp, Homo sapiens
actctcacatgtgg

SEQ ID NO: 4003697 - DNA, 15 bp, Homo sapiens
actctcacccataaa

SEQ ID NO: 4003698 - DNA, 21 bp, Homo sapiens
actctcacccataaacagtaa

SEQ ID NO: 4003699 - DNA, 18 bp, Homo sapiens
actctcaggatcaagaaa

SEQ ID NO: 4003700 - DNA, 22 bp, Homo sapiens
actctcaggatcaagaaagtgt

SEQ ID NO: 4003701 - DNA, 15 bp, Homo sapiens
actctcagtgcttct

SEQ ID NO: 4003702 - DNA, 20 bp, Homo sapiens
agctgctttctgttgtcatt

SEQ ID NO: 4003703 - DNA, 12 bp, Homo sapiens
agctggaagcac

SEQ ID NO: 4003704 - DNA, 16 bp, Homo sapiens
agctggactctgcatc

SEQ ID NO: 4003705 - DNA, 19 bp, Homo sapiens
agctggactctgcatccca

SEQ ID NO: 4003706 - DNA, 14 bp, Homo sapiens
agctggagccccca

SEQ ID NO: 4003707 - DNA, 18 bp, Homo sapiens
agctggagcccccagcag

SEQ ID NO: 4003708 - DNA, 14 bp, Homo sapiens
agctggcagaacgg

SEQ ID NO: 4003709 - DNA, 13 bp, Homo sapiens
agctggccaggcc

SEQ ID NO: 4003710 - DNA, 15 bp, Homo sapiens
agctggccctgcctc

SEQ ID NO: 4003711 - DNA, 17 bp, Homo sapiens
agctggccctgcctcct

SEQ ID NO: 4003712 - DNA, 21 bp, Homo sapiens
agctggccgagggtcctggct

SEQ ID NO: 4003713 - DNA, 16 bp, Homo sapiens
agctggctccagcctg

SEQ ID NO: 4003714 - DNA, 18 bp, Homo sapiens
agctggctccagcctgga

SEQ ID NO: 4003715 - DNA, 20 bp, Homo sapiens
agctggctttgaaacctcag

SEQ ID NO: 4003716 - DNA, 18 bp, Homo sapiens
agctgggactacaggtgc

SEQ ID NO: 4003717 - DNA, 22 bp, Homo sapiens
agctgggaggcatggccctggg

SEQ ID NO: 4003718 - DNA, 15 bp, Homo sapiens
agctgggctctgcaa

SEQ ID NO: 4003719 - DNA, 18 bp, Homo sapiens
agctggggactcagggac

SEQ ID NO: 4003720 - DNA, 14 bp, Homo sapiens
agctggggccagag

SEQ ID NO: 4003721 - DNA, 19 bp, Homo sapiens
agctggggccagaggctgg

SEQ ID NO: 4003722 - DNA, 21 bp, Homo sapiens
agctgggggatagaggggctg

SEQ ID NO: 4003723 - DNA, 20 bp, Homo sapiens
agctggggggttggcagccc

SEQ ID NO: 4003724 - DNA, 22 bp, Homo sapiens
agctggggggttggcagcccac

SEQ ID NO: 4003725 - DNA, 20 bp, Homo sapiens
agctgggtcacatccatccc

SEQ ID NO: 4003726 - DNA, 15 bp, Homo sapiens
agctggtagttagta

SEQ ID NO: 4003727 - DNA, 19 bp, Homo sapiens
agctggtagttagtagcat

SEQ ID NO: 4003728 - DNA, 22 bp, Homo sapiens
agctggtagttagtagcatgtt

SEQ ID NO: 4003729 - DNA, 10 bp, Homo sapiens
agctggtgca

SEQ ID NO: 4003730 - DNA, 12 bp, Homo sapiens
agctggtgcatt

SEQ ID NO: 4003731 - DNA, 14 bp, Homo sapiens
agctggtgcattac

SEQ ID NO: 4003732 - DNA, 17 bp, Homo sapiens
agctggtgcattacaga

SEQ ID NO: 4003733 - DNA, 22 bp, Homo sapiens
agctggtgcattacagagagga

SEQ ID NO: 4003734 - DNA, 18 bp, Homo sapiens
agctggttactcagggtt

SEQ ID NO: 4003735 - DNA, 13 bp, Homo sapiens
agctggtttcctg

SEQ ID NO: 4003736 - DNA, 18 bp, Homo sapiens
agctggtttcctgcccag

SEQ ID NO: 4003737 - DNA, 16 bp, Homo sapiens
agctgtaacagttctt

SEQ ID NO: 4003738 - DNA, 22 bp, Homo sapiens
agctgtaagaagagactgggaa

SEQ ID NO: 4003739 - DNA, 11 bp, Homo sapiens
agctgtagtgg

SEQ ID NO: 4003740 - DNA, 13 bp, Homo sapiens
agctgtatgattt

SEQ ID NO: 4003741 - DNA, 21 bp, Homo sapiens
agctgtcacttcgcgtgccct

SEQ ID NO: 4003742 - DNA, 15 bp, Homo sapiens
agctgtcctgcagca

SEQ ID NO: 4003743 - DNA, 21 bp, Homo sapiens
agctgtctaacccccagctgg

SEQ ID NO: 4003744 - DNA, 18 bp, Homo sapiens
agctgtgacttctccagg

SEQ ID NO: 4003745 - DNA, 19 bp, Homo sapiens
agctgtgccttcagctgtt

SEQ ID NO: 4003746 - DNA, 18 bp, Homo sapiens
agctgttatttcttccct

SEQ ID NO: 4003747 - DNA, 19 bp, Homo sapiens
agctgttatttcttccctg

SEQ ID NO: 4003748 - DNA, 15 bp, Homo sapiens
agctgttcttcctgg

SEQ ID NO: 4003749 - DNA, 14 bp, Homo sapiens
agctgttgaccagg

SEQ ID NO: 4003750 - DNA, 18 bp, Homo sapiens
agctgttgaccaggcacc

SEQ ID NO: 4003751 - DNA, 15 bp, Homo sapiens
agctgttgcagatga

SEQ ID NO: 4003752 - DNA, 16 bp, Homo sapiens
agctgttgtacattta

SEQ ID NO: 4003753 - DNA, 18 bp, Homo sapiens
agctgttgtacatttatg

SEQ ID NO: 4003754 - DNA, 16 bp, Homo sapiens
agctgttgtctcttct

SEQ ID NO: 4003755 - DNA, 21 bp, Homo sapiens
agctgtttatggcctcagctg

SEQ ID NO: 4003756 - DNA, 14 bp, Homo sapiens
agctgtttccatag

SEQ ID NO: 4003757 - DNA, 13 bp, Homo sapiens
agctgtttctcat

SEQ ID NO: 4003758 - DNA, 22 bp, Homo sapiens
agctgtttctcatgaagctaat

SEQ ID NO: 4003759 - DNA, 18 bp, Homo sapiens
agctgttttccctgacct

SEQ ID NO: 4003760 - DNA, 16 bp, Homo sapiens
agcttaactaatttga

SEQ ID NO: 4003761 - DNA, 14 bp, Homo sapiens
agcttaagaaaaaa

SEQ ID NO: 4003762 - DNA, 22 bp, Homo sapiens
agcttaatagtagttagcttaa

SEQ ID NO: 4003763 - DNA, 10 bp, Homo sapiens
agcttagaac

SEQ ID NO: 4003764 - DNA, 18 bp, Homo sapiens
agcttagaattatttgca

SEQ ID NO: 4003765 - DNA, 13 bp, Homo sapiens
agcttagatttca

SEQ ID NO: 4003766 - DNA, 14 bp, Homo sapiens
agcttatctctttt

SEQ ID NO: 4003767 - DNA, 23 bp, Homo sapiens
agcttatctcttttatatttgta

SEQ ID NO: 4003768 - DNA, 22 bp, Homo sapiens
agcttattcatctgtttttctt

SEQ ID NO: 4003769 - DNA, 14 bp, Homo sapiens
agcttcaagtgcct

SEQ ID NO: 4003770 - DNA, 15 bp, Homo sapiens
agcttcaagtgcctt

SEQ ID NO: 4003771 - DNA, 15 bp, Homo sapiens
agcttcagactcaag

SEQ ID NO: 4003772 - DNA, 21 bp, Homo sapiens
agcttcagatggtgaagcatt

SEQ ID NO: 4003773 - DNA, 18 bp, Homo sapiens
agcttcaggcaccagcat

SEQ ID NO: 4003774 - DNA, 15 bp, Homo sapiens
agcttcatgcctttg

SEQ ID NO: 4003775 - DNA, 17 bp, Homo sapiens
agcttcatgcctttgta

SEQ ID NO: 4003776 - DNA, 16 bp, Homo sapiens
agcttcattctccttg

SEQ ID NO: 4003777 - DNA, 22 bp, Homo sapiens
agcttccatgattctatttata

SEQ ID NO: 4003778 - DNA, 17 bp, Homo sapiens
aggaatatatgtgtgcc

SEQ ID NO: 4003779 - DNA, 17 bp, Homo sapiens
aggaatcaaaaattgaa

SEQ ID NO: 4003780 - DNA, 20 bp, Homo sapiens
aggaatctgtgcagatgagc

SEQ ID NO: 4003781 - DNA, 14 bp, Homo sapiens
aggaatgcctgtgc

SEQ ID NO: 4003782 - DNA, 15 bp, Homo sapiens
aggaatgcctgtgcc

SEQ ID NO: 4003783 - DNA, 16 bp, Homo sapiens
aggaatgcctgtgcca

SEQ ID NO: 4003784 - DNA, 16 bp, Homo sapiens
aggaatgcctgtgtga

SEQ ID NO: 4003785 - DNA, 16 bp, Homo sapiens
aggaatgctctgtgcc

SEQ ID NO: 4003786 - DNA, 17 bp, Homo sapiens
aggaatgctctgtgcca

SEQ ID NO: 4003787 - DNA, 17 bp, Homo sapiens
aggaatgctggactgga

SEQ ID NO: 4003788 - DNA, 14 bp, Homo sapiens
aggaatggaagtcc

SEQ ID NO: 4003789 - DNA, 14 bp, Homo sapiens
aggaatttatacct

SEQ ID NO: 4003790 - DNA, 17 bp, Homo sapiens
aggaatttcccaggacc

SEQ ID NO: 4003791 - DNA, 20 bp, Homo sapiens
aggaatttcccaggaccctg

SEQ ID NO: 4003792 - DNA, 21 bp, Homo sapiens
aggaatttcccaggaccctga

SEQ ID NO: 4003793 - DNA, 13 bp, Homo sapiens
aggaattttgcta

SEQ ID NO: 4003794 - DNA, 14 bp, Homo sapiens
aggacaaaatgtta

SEQ ID NO: 4003795 - DNA, 12 bp, Homo sapiens
aggacaaggggc

SEQ ID NO: 4003796 - DNA, 18 bp, Homo sapiens
aggacaaggtgcaggcag

SEQ ID NO: 4003797 - DNA, 20 bp, Homo sapiens
aggacaaggtgcaggcaggc

SEQ ID NO: 4003798 - DNA, 23 bp, Homo sapiens
aggacaaggtgcaggcaggctgg

SEQ ID NO: 4003799 - DNA, 22 bp, Homo sapiens
aggacacaccccacaccccagc

SEQ ID NO: 4003800 - DNA, 23 bp, Homo sapiens
aggacacaccccacaccccagcc

SEQ ID NO: 4003801 - DNA, 18 bp, Homo sapiens
aggacagagttcacagga

SEQ ID NO: 4003802 - DNA, 23 bp, Homo sapiens
aggacagagttcacaggaggcca

SEQ ID NO: 4003803 - DNA, 22 bp, Homo sapiens
aggacaggaaagtggcacctgt

SEQ ID NO: 4003804 - DNA, 14 bp, Homo sapiens
aggacaggaagctg

SEQ ID NO: 4003805 - DNA, 18 bp, Homo sapiens
aggacaggaagctggcag

SEQ ID NO: 4003806 - DNA, 20 bp, Homo sapiens
aggacaggcgggaggaggtg

SEQ ID NO: 4003807 - DNA, 16 bp, Homo sapiens
aggacagtttttttgt

SEQ ID NO: 4003808 - DNA, 20 bp, Homo sapiens
agcctccctgtctccagctg

SEQ ID NO: 4003809 - DNA, 21 bp, Homo sapiens
agcctccctgtctccagctgc

SEQ ID NO: 4003810 - DNA, 17 bp, Homo sapiens
agcctccgagagggaga

SEQ ID NO: 4003811 - DNA, 18 bp, Homo sapiens
agcctccgagagggagag

SEQ ID NO: 4003812 - DNA, 15 bp, Homo sapiens
agcctccggaagctg

SEQ ID NO: 4003813 - DNA, 13 bp, Homo sapiens
agcctcctctctc

SEQ ID NO: 4003814 - DNA, 19 bp, Homo sapiens
agcctcctctggacggcag

SEQ ID NO: 4003815 - DNA, 12 bp, Homo sapiens
agcctcctctgt

SEQ ID NO: 4003816 - DNA, 13 bp, Homo sapiens
agcctcctgagcc

SEQ ID NO: 4003817 - DNA, 18 bp, Homo sapiens
agcctcctgagcctgtgg

SEQ ID NO: 4003818 - DNA, 22 bp, Homo sapiens
agcctcctgtgcctggccccag

SEQ ID NO: 4003819 - DNA, 17 bp, Homo sapiens
agcctccttagaaaaaa

SEQ ID NO: 4003820 - DNA, 23 bp, Homo sapiens
agcctcgcaggcctccctgccag

SEQ ID NO: 4003821 - DNA, 13 bp, Homo sapiens
agcctcgtccctc

SEQ ID NO: 4003822 - DNA, 17 bp, Homo sapiens
agcctcgtccctccctc

SEQ ID NO: 4003823 - DNA, 12 bp, Homo sapiens
agcctctccagg

SEQ ID NO: 4003824 - DNA, 14 bp, Homo sapiens
agcctctccaggaa

SEQ ID NO: 4003825 - DNA, 13 bp, Homo sapiens
agcctctgctccc

SEQ ID NO: 4003826 - DNA, 15 bp, Homo sapiens
agcctctgctcccca

SEQ ID NO: 4003827 - DNA, 23 bp, Homo sapiens
agcctctggcattagaattattt

SEQ ID NO: 4003828 - DNA, 20 bp, Homo sapiens
agcctctggctagaggccag

SEQ ID NO: 4003829 - DNA, 13 bp, Homo sapiens
agcctctttccct

SEQ ID NO: 4003830 - DNA, 18 bp, Homo sapiens
agcctgacagccagaact

SEQ ID NO: 4003831 - DNA, 19 bp, Homo sapiens
agcctgacagccagaactc

SEQ ID NO: 4003832 - DNA, 14 bp, Homo sapiens
agcctgacctgaga

SEQ ID NO: 4003833 - DNA, 15 bp, Homo sapiens
agcctgacctgagac

SEQ ID NO: 4003834 - DNA, 16 bp, Homo sapiens
agcctgacctgagact

SEQ ID NO: 4003835 - DNA, 18 bp, Homo sapiens
agcctgacctgagactgt

SEQ ID NO: 4003836 - DNA, 19 bp, Homo sapiens
agcctgaccttccttcctg

SEQ ID NO: 4003837 - DNA, 21 bp, Homo sapiens
agcctgagcaactcttgatta

SEQ ID NO: 4003838 - DNA, 21 bp, Homo sapiens
agcctgaggcagccacttcgg

SEQ ID NO: 4003839 - DNA, 17 bp, Homo sapiens
agcctgagtctcctgtg

SEQ ID NO: 4003840 - DNA, 18 bp, Homo sapiens
agcctgagtctcctgtgc

SEQ ID NO: 4003841 - DNA, 17 bp, Homo sapiens
agcctgcaaactcactg

SEQ ID NO: 4003842 - DNA, 19 bp, Homo sapiens
agcctgcaatttcatatgc

SEQ ID NO: 4003843 - DNA, 18 bp, Homo sapiens
agcctgccccagcgctga

SEQ ID NO: 4003844 - DNA, 21 bp, Homo sapiens
agcctgcccgctgcaatgcct

SEQ ID NO: 4003845 - DNA, 15 bp, Homo sapiens
agcctgcctcccaag

SEQ ID NO: 4003846 - DNA, 15 bp, Homo sapiens
agcctgccttgccca

SEQ ID NO: 4003847 - DNA, 21 bp, Homo sapiens
agcctgcgttggtccagagcg

SEQ ID NO: 4003848 - DNA, 14 bp, Homo sapiens
agcctgctccttcc

SEQ ID NO: 4003849 - DNA, 17 bp, Homo sapiens
agcctgctccttccctt

SEQ ID NO: 4003850 - DNA, 16 bp, Homo sapiens
agcctgctgagagccc

SEQ ID NO: 4003851 - DNA, 19 bp, Homo sapiens
agcctgctgagagccccca

SEQ ID NO: 4003852 - DNA, 13 bp, Homo sapiens
agcctgctgccca

SEQ ID NO: 4003853 - DNA, 10 bp, Homo sapiens
agcctgctgg

SEQ ID NO: 4003854 - DNA, 17 bp, Homo sapiens
agcctgctggcacccac

SEQ ID NO: 4003855 - DNA, 23 bp, Homo sapiens
agcctgctggtcacagcctcctc

SEQ ID NO: 4003856 - DNA, 19 bp, Homo sapiens
agcctggaaacctgtctga

SEQ ID NO: 4003857 - DNA, 18 bp, Homo sapiens
agcctggactctgcccca

SEQ ID NO: 4003858 - DNA, 18 bp, Homo sapiens
agcctggcacagggcagt

SEQ ID NO: 4003859 - DNA, 14 bp, Homo sapiens
agcctggccagaca

SEQ ID NO: 4003860 - DNA, 15 bp, Homo sapiens
agcctggccagacac

SEQ ID NO: 4003861 - DNA, 18 bp, Homo sapiens
agcctggccagacacagg

SEQ ID NO: 4003862 - DNA, 12 bp, Homo sapiens
agcctggcccca

SEQ ID NO: 4003863 - DNA, 13 bp, Homo sapiens
agcctggccccag

SEQ ID NO: 4003864 - DNA, 22 bp, Homo sapiens
agcctggccccaggccccagac

SEQ ID NO: 4003865 - DNA, 13 bp, Homo sapiens
agcctggcctgcc

SEQ ID NO: 4003866 - DNA, 17 bp, Homo sapiens
agcctggctgcccatca

SEQ ID NO: 4003867 - DNA, 20 bp, Homo sapiens
agcctgggataggggcagag

SEQ ID NO: 4003868 - DNA, 22 bp, Homo sapiens
agcctgggataggggcagagga

SEQ ID NO: 4003869 - DNA, 15 bp, Homo sapiens
agcctgggcaacaga

SEQ ID NO: 4003870 - DNA, 18 bp, Homo sapiens
agcctgggcagccaggct

SEQ ID NO: 4003871 - DNA, 16 bp, Homo sapiens
agcctgggggccagtg

SEQ ID NO: 4003872 - DNA, 14 bp, Homo sapiens
agcctggtgctgct

SEQ ID NO: 4003873 - DNA, 16 bp, Homo sapiens
agcctggtgctgctgc

SEQ ID NO: 4003874 - DNA, 13 bp, Homo sapiens
agcctggtttttc

SEQ ID NO: 4003875 - DNA, 16 bp, Homo sapiens
agcctggtttttctca

SEQ ID NO: 4003876 - DNA, 21 bp, Homo sapiens
agcctgtcatccttggtcttt

SEQ ID NO: 4003877 - DNA, 22 bp, Homo sapiens
agcctgtggcatctttgccttg

SEQ ID NO: 4003878 - DNA, 19 bp, Homo sapiens
agcctgtgggtttggtcct

SEQ ID NO: 4003879 - DNA, 11 bp, Homo sapiens
agcctgtgtca

SEQ ID NO: 4003880 - DNA, 18 bp, Homo sapiens
agcctgttttgttggaag

SEQ ID NO: 4003881 - DNA, 22 bp, Homo sapiens
agccttacacagggcgaggggt

SEQ ID NO: 4003882 - DNA, 14 bp, Homo sapiens
agccttacatttgt

SEQ ID NO: 4003883 - DNA, 20 bp, Homo sapiens
agccttaccttgaaatgctg

SEQ ID NO: 4003884 - DNA, 15 bp, Homo sapiens
agccttagggaagct

SEQ ID NO: 4003885 - DNA, 20 bp, Homo sapiens
agccttagggaagctggcct

SEQ ID NO: 4003886 - DNA, 20 bp, Homo sapiens
agccttataaaccaatctta

SEQ ID NO: 4003887 - DNA, 21 bp, Homo sapiens
agccttccaactagctgggac

SEQ ID NO: 4003888 - DNA, 18 bp, Homo sapiens
agccttctcagaagcaca

SEQ ID NO: 4003889 - DNA, 13 bp, Homo sapiens
agccttctgagct

SEQ ID NO: 4003890 - DNA, 17 bp, Homo sapiens
agccttgagccctggct

SEQ ID NO: 4003891 - DNA, 17 bp, Homo sapiens
agccttgccagagatcc

SEQ ID NO: 4003892 - DNA, 12 bp, Homo sapiens
agccttgcttgt

SEQ ID NO: 4003893 - DNA, 21 bp, Homo sapiens
agccttggaaccagccccatc

SEQ ID NO: 4003894 - DNA, 20 bp, Homo sapiens
agccttgtgtatatttgtat

SEQ ID NO: 4003895 - DNA, 24 bp, Homo sapiens
agccttgtgtatatttgtatatta

SEQ ID NO: 4003896 - DNA, 18 bp, Homo sapiens
agcctttagtatcagtgt

SEQ ID NO: 4003897 - DNA, 19 bp, Homo sapiens
agcctttagtatcagtgtt

SEQ ID NO: 4003898 - DNA, 14 bp, Homo sapiens
agcctttccataag

SEQ ID NO: 4003899 - DNA, 13 bp, Homo sapiens
agctcactaccct

SEQ ID NO: 4003900 - DNA, 17 bp, Homo sapiens
agctcactgcagcctca

SEQ ID NO: 4003901 - DNA, 15 bp, Homo sapiens
agctcagaggcccag

SEQ ID NO: 4003902 - DNA, 17 bp, Homo sapiens
agctcagaggcccagga

SEQ ID NO: 4003903 - DNA, 19 bp, Homo sapiens
agctcagccccaactcttt

SEQ ID NO: 4003904 - DNA, 23 bp, Homo sapiens
agctcagccccgagctgtccccg

SEQ ID NO: 4003905 - DNA, 17 bp, Homo sapiens
agctcaggacagatgcc

SEQ ID NO: 4003906 - DNA, 16 bp, Homo sapiens
agctcaggtggggagt

SEQ ID NO: 4003907 - DNA, 13 bp, Homo sapiens
agctcagtcccat

SEQ ID NO: 4003908 - DNA, 21 bp, Homo sapiens
agctcagtcccatcagagagc

SEQ ID NO: 4003909 - DNA, 12 bp, Homo sapiens
agctcagtgctc

SEQ ID NO: 4003910 - DNA, 14 bp, Homo sapiens
agctcagtgctctc

SEQ ID NO: 4003911 - DNA, 18 bp, Homo sapiens
agctcattaaactttttt

SEQ ID NO: 4003912 - DNA, 15 bp, Homo sapiens
agctccaacctgcaa

SEQ ID NO: 4003913 - DNA, 16 bp, Homo sapiens
agctccaacctgcaaa

SEQ ID NO: 4003914 - DNA, 16 bp, Homo sapiens
agcccctccctcctct

SEQ ID NO: 4003915 - DNA, 21 bp, Homo sapiens
agcccctcctccagcccctgt

SEQ ID NO: 4003916 - DNA, 22 bp, Homo sapiens
agcccctcctccagcccctgtc

SEQ ID NO: 4003917 - DNA, 23 bp, Homo sapiens
agcccctcctccagcccctgtcc

SEQ ID NO: 4003918 - DNA, 21 bp, Homo sapiens
agcccctctccccgcagtgtt

SEQ ID NO: 4003919 - DNA, 12 bp, Homo sapiens
agcccctggggc

SEQ ID NO: 4003920 - DNA, 21 bp, Homo sapiens
agcccctggggcccagcccct

SEQ ID NO: 4003921 - DNA, 18 bp, Homo sapiens
agcagcctttaatgcatc

SEQ ID NO: 4003922 - DNA, 18 bp, Homo sapiens
agattgcagaaaattctg

SEQ ID NO: 4003923 - DNA, 20 bp, Homo sapiens
agattgcagaaaattctgtg

SEQ ID NO: 4003924 - DNA, 23 bp, Homo sapiens
agattgcagaaaattctgtgcct

SEQ ID NO: 4003925 - DNA, 15 bp, Homo sapiens
agattgcttctgtag

SEQ ID NO: 4003926 - DNA, 17 bp, Homo sapiens
agattggagctgaagac

SEQ ID NO: 4003927 - DNA, 21 bp, Homo sapiens
agattggtgggattttttgtt

SEQ ID NO: 4003928 - DNA, 22 bp, Homo sapiens
agattgtcttgcaacttcagtt

SEQ ID NO: 4003929 - DNA, 13 bp, Homo sapiens
agattgtgtaaca

SEQ ID NO: 4003930 - DNA, 16 bp, Homo sapiens
agcacagagcctggcc

SEQ ID NO: 4003931 - DNA, 20 bp, Homo sapiens
agcacagagcctggccccag

SEQ ID NO: 4003932 - DNA, 21 bp, Homo sapiens
agcacagagcctggccccagg

SEQ ID NO: 4003933 - DNA, 13 bp, Homo sapiens
agcacagcagcct

SEQ ID NO: 4003934 - DNA, 23 bp, Homo sapiens
agcacagccaacacgcacctgcc

SEQ ID NO: 4003935 - DNA, 12 bp, Homo sapiens
agcacagctccc

SEQ ID NO: 4003936 - DNA, 16 bp, Homo sapiens
agcacagcttagattt

SEQ ID NO: 4003937 - DNA, 12 bp, Homo sapiens
agcacaggcagc

SEQ ID NO: 4003938 - DNA, 16 bp, Homo sapiens
agcacatacattaaaa

SEQ ID NO: 4003939 - DNA, 18 bp, Homo sapiens
agcacatactgtgttcca

SEQ ID NO: 4003940 - DNA, 15 bp, Homo sapiens
agcacatctgcattt

SEQ ID NO: 4003941 - DNA, 23 bp, Homo sapiens
agcaccaccctagtcccttcccc

SEQ ID NO: 4003942 - DNA, 15 bp, Homo sapiens
agcaccaccctcctt

SEQ ID NO: 4003943 - DNA, 18 bp, Homo sapiens
agcaccaccctccttccc

SEQ ID NO: 4003944 - DNA, 18 bp, Homo sapiens
agcaccagcttctccagg

SEQ ID NO: 4003945 - DNA, 19 bp, Homo sapiens
agcaccagcttctccaggc

SEQ ID NO: 4003946 - DNA, 21 bp, Homo sapiens
agcaccagcttctccaggctc

SEQ ID NO: 4003947 - DNA, 14 bp, Homo sapiens
agcacccagagcac

SEQ ID NO: 4003948 - DNA, 22 bp, Homo sapiens
agcacccagagcaccccctgct

SEQ ID NO: 4003949 - DNA, 19 bp, Homo sapiens
agcaccccatgccaaagct

SEQ ID NO: 4003950 - DNA, 14 bp, Homo sapiens
agcacccccaccca

SEQ ID NO: 4003951 - DNA, 15 bp, Homo sapiens
agcacccccacccac

SEQ ID NO: 4003952 - DNA, 17 bp, Homo sapiens
agcacccccacccacct

SEQ ID NO: 4003953 - DNA, 13 bp, Homo sapiens
agcaccctccccc

SEQ ID NO: 4003954 - DNA, 14 bp, Homo sapiens
agcaccctcccccg

SEQ ID NO: 4003955 - DNA, 13 bp, Homo sapiens
agcaccctctcct

SEQ ID NO: 4003956 - DNA, 19 bp, Homo sapiens
agcaccgtgtcaagctgct

SEQ ID NO: 4003957 - DNA, 17 bp, Homo sapiens
agcaccgttctgtgcac

SEQ ID NO: 4003958 - DNA, 18 bp, Homo sapiens
agcaccgttctgtgcaca

SEQ ID NO: 4003959 - DNA, 20 bp, Homo sapiens
agcacctactatgtgctggg

SEQ ID NO: 4003960 - DNA, 23 bp, Homo sapiens
agcacctactatgtgctgggtgc

SEQ ID NO: 4003961 - DNA, 17 bp, Homo sapiens
agcacctccaggcctgt

SEQ ID NO: 4003962 - DNA, 21 bp, Homo sapiens
agcacctccattaaagtctga

SEQ ID NO: 4003963 - DNA, 18 bp, Homo sapiens
agcacctgcctcctcgtt

SEQ ID NO: 4003964 - DNA, 21 bp, Homo sapiens
agcacctgcctcctcgttcct

SEQ ID NO: 4003965 - DNA, 17 bp, Homo sapiens
agcaccttcagggctga

SEQ ID NO: 4003966 - DNA, 19 bp, Homo sapiens
agcaccttcctcacttcca

SEQ ID NO: 4003967 - DNA, 14 bp, Homo sapiens
agcacgtctcagag

SEQ ID NO: 4003968 - DNA, 15 bp, Homo sapiens
agcacgtctcagaga

SEQ ID NO: 4003969 - DNA, 13 bp, Homo sapiens
agcacgtgcaagg

SEQ ID NO: 4003970 - DNA, 16 bp, Homo sapiens
agcacgtgcaaggact

SEQ ID NO: 4003971 - DNA, 17 bp, Homo sapiens
agcactaaggccgtgtc

SEQ ID NO: 4003972 - DNA, 18 bp, Homo sapiens
agcactcattttctataa

SEQ ID NO: 4003973 - DNA, 15 bp, Homo sapiens
agcactctctaaatc

SEQ ID NO: 4003974 - DNA, 17 bp, Homo sapiens
agcactgatttcacaac

SEQ ID NO: 4003975 - DNA, 19 bp, Homo sapiens
agcactggagtgcagggag

SEQ ID NO: 4003976 - DNA, 23 bp, Homo sapiens
agcactggagtgcagggaggaga

SEQ ID NO: 4003977 - DNA, 20 bp, Homo sapiens
agcactggtgtgaactcacc

SEQ ID NO: 4003978 - DNA, 15 bp, Homo sapiens
agcactgtcccttgc

SEQ ID NO: 4003979 - DNA, 14 bp, Homo sapiens
agcactgtctcagt

SEQ ID NO: 4003980 - DNA, 16 bp, Homo sapiens
agcacttccaaaattc

SEQ ID NO: 4003981 - DNA, 23 bp, Homo sapiens
agcacttgaccttttcgacgctt

SEQ ID NO: 4003982 - DNA, 23 bp, Homo sapiens
agcactttaatggcctggaggga

SEQ ID NO: 4003983 - DNA, 14 bp, Homo sapiens
agcactttgggagg

SEQ ID NO: 4003984 - DNA, 16 bp, Homo sapiens
agcacttttgttattc

SEQ ID NO: 4003985 - DNA, 19 bp, Homo sapiens
agcacttttgttattccat

SEQ ID NO: 4003986 - DNA, 17 bp, Homo sapiens
agcagaaacagccattg

SEQ ID NO: 4003987 - DNA, 18 bp, Homo sapiens
agcagaaagctgtgaaca

SEQ ID NO: 4003988 - DNA, 15 bp, Homo sapiens
agcagaaatctagaa

SEQ ID NO: 4003989 - DNA, 21 bp, Homo sapiens
agcagaacggagccccaggcc

SEQ ID NO: 4003990 - DNA, 18 bp, Homo sapiens
agcagaagcagggtaccc

SEQ ID NO: 4003991 - DNA, 19 bp, Homo sapiens
agcagaattttaatgtgaa

SEQ ID NO: 4003992 - DNA, 21 bp, Homo sapiens
agcagacacacatgggcagcc

SEQ ID NO: 4003993 - DNA, 23 bp, Homo sapiens
agcagacacacatgggcagccca

SEQ ID NO: 4003994 - DNA, 12 bp, Homo sapiens
agcagacagaaa

SEQ ID NO: 4003995 - DNA, 13 bp, Homo sapiens
agcagacagaaac

SEQ ID NO: 4003996 - DNA, 19 bp, Homo sapiens
agcagagagcattataatc

SEQ ID NO: 4003997 - DNA, 12 bp, Homo sapiens
agcagaggaggg

SEQ ID NO: 4003998 - DNA, 21 bp, Homo sapiens
agcagaggccctgtggtcccc

SEQ ID NO: 4003999 - DNA, 18 bp, Homo sapiens
agcagagggggagtagcc

SEQ ID NO: 4004000 - DNA, 23 bp, Homo sapiens
agcagaggtggccagagctggga

SEQ ID NO: 4004001 - DNA, 15 bp, Homo sapiens
agcagagtctgggcc

SEQ ID NO: 4004002 - DNA, 19 bp, Homo sapiens
agcagagtctgggcctctg

SEQ ID NO: 4004003 - DNA, 21 bp, Homo sapiens
agcagagtctgggcctctgac

SEQ ID NO: 4004004 - DNA, 16 bp, Homo sapiens
agcagagtgcacagct

SEQ ID NO: 4004005 - DNA, 18 bp, Homo sapiens
agcagatgcagagagcca

SEQ ID NO: 4004006 - DNA, 21 bp, Homo sapiens
agcagatggaatgctgtgtta

SEQ ID NO: 4004007 - DNA, 19 bp, Homo sapiens
agcagatggtttccacatt

SEQ ID NO: 4004008 - DNA, 22 bp, Homo sapiens
agcagattttaattttgaataa

SEQ ID NO: 4004009 - DNA, 17 bp, Homo sapiens
agcagcaactgaagaca

SEQ ID NO: 4004010 - DNA, 20 bp, Homo sapiens
agcagcaccgttctgtgcac

SEQ ID NO: 4004011 - DNA, 14 bp, Homo sapiens
agcagcagcccaag

SEQ ID NO: 4004012 - DNA, 21 bp, Homo sapiens
agcagcagcccaagcttccct

SEQ ID NO: 4004013 - DNA, 17 bp, Homo sapiens
agcagcatggaaaaatg

SEQ ID NO: 4004014 - DNA, 21 bp, Homo sapiens
agcagcatggaaaaatggttg

SEQ ID NO: 4004015 - DNA, 21 bp, Homo sapiens
agcagcatttttaattttcac

SEQ ID NO: 4004016 - DNA, 22 bp, Homo sapiens
agcagcatttttaattttcaca

SEQ ID NO: 4004017 - DNA, 13 bp, Homo sapiens
agcagccacgagg

SEQ ID NO: 4004018 - DNA, 12 bp, Homo sapiens
agcagccagctc

SEQ ID NO: 4004019 - DNA, 18 bp, Homo sapiens
agcagccccccagcacta

SEQ ID NO: 4004020 - DNA, 14 bp, Homo sapiens
agcagccctaagga

SEQ ID NO: 4004021 - DNA, 17 bp, Homo sapiens
agcagccctcaacaggc

SEQ ID NO: 4004022 - DNA, 22 bp, Homo sapiens
agcagccctcaacaggcccagg

SEQ ID NO: 4004023 - DNA, 13 bp, Homo sapiens
agcagcctctgga

SEQ ID NO: 4004024 - DNA, 22 bp, Homo sapiens
agcagcctctggacagccagtg

SEQ ID NO: 4004025 - DNA, 13 bp, Homo sapiens
agcagcctgtggc

SEQ ID NO: 4004026 - DNA, 14 bp, Homo sapiens
agcagcctgtggca

SEQ ID NO: 4004027 - DNA, 16 bp, Homo sapiens
agcagcctttaatgca

SEQ ID NO: 4004028 - DNA, 19 bp, Homo sapiens
agatctgtcctcagccttg

SEQ ID NO: 4004029 - DNA, 13 bp, Homo sapiens
agatctgtgcccc

SEQ ID NO: 4004030 - DNA, 19 bp, Homo sapiens
agatctgtgccccatgcct

SEQ ID NO: 4004031 - DNA, 13 bp, Homo sapiens
agatcttaggtat

SEQ ID NO: 4004032 - DNA, 20 bp, Homo sapiens
agatcttcccataataaagc

SEQ ID NO: 4004033 - DNA, 13 bp, Homo sapiens
agatcttgtctcc

SEQ ID NO: 4004034 - DNA, 12 bp, Homo sapiens
agatctttcagg

SEQ ID NO: 4004035 - DNA, 21 bp, Homo sapiens
agatgaaataaagacccaggg

SEQ ID NO: 4004036 - DNA, 19 bp, Homo sapiens
agatgaagttttacattgt

SEQ ID NO: 4004037 - DNA, 15 bp, Homo sapiens
agatgaccagggatg

SEQ ID NO: 4004038 - DNA, 20 bp, Homo sapiens
agatgagaaatgatgaaaag

SEQ ID NO: 4004039 - DNA, 14 bp, Homo sapiens
agagaatgttccta

SEQ ID NO: 4004040 - DNA, 21 bp, Homo sapiens
agagaatgttcctactcacac

SEQ ID NO: 4004041 - DNA, 14 bp, Homo sapiens
agagaattggctca

SEQ ID NO: 4004042 - DNA, 15 bp, Homo sapiens
agagaattggctcaa

SEQ ID NO: 4004043 - DNA, 19 bp, Homo sapiens
agagaattgtttgaacccg

SEQ ID NO: 4004044 - DNA, 17 bp, Homo sapiens
agagacagacttgagaa

SEQ ID NO: 4004045 - DNA, 19 bp, Homo sapiens
agagacagacttgagaact

SEQ ID NO: 4004046 - DNA, 16 bp, Homo sapiens
agagacctcatcagga

SEQ ID NO: 4004047 - DNA, 19 bp, Homo sapiens
agagacctcatcaggatga

SEQ ID NO: 4004048 - DNA, 15 bp, Homo sapiens
agagactgagcagcc

SEQ ID NO: 4004049 - DNA, 22 bp, Homo sapiens
agagactgagcagccgccagct

SEQ ID NO: 4004050 - DNA, 17 bp, Homo sapiens
agagactgcaagctgct

SEQ ID NO: 4004051 - DNA, 13 bp, Homo sapiens
agagactgggaag

SEQ ID NO: 4004052 - DNA, 13 bp, Homo sapiens
agagactgtagat

SEQ ID NO: 4004053 - DNA, 19 bp, Homo sapiens
agagacttaaaggacagga

SEQ ID NO: 4004054 - DNA, 13 bp, Homo sapiens
agagagaaaaaaa

SEQ ID NO: 4004055 - DNA, 14 bp, Homo sapiens
agagagaaagagag

SEQ ID NO: 4004056 - DNA, 13 bp, Homo sapiens
agagagaaattct

SEQ ID NO: 4004057 - DNA, 19 bp, Homo sapiens
agagagaaattctgttaaa

SEQ ID NO: 4004058 - DNA, 20 bp, Homo sapiens
agagagaacaactactgtga

SEQ ID NO: 4004059 - DNA, 11 bp, Homo sapiens
agagagaagcc

SEQ ID NO: 4004060 - DNA, 12 bp, Homo sapiens
agagagagaaaa

SEQ ID NO: 4004061 - DNA, 23 bp, Homo sapiens
agagctttctgtccttttggcac

SEQ ID NO: 4004062 - DNA, 20 bp, Homo sapiens
agagctttgtgcttgtcatt

SEQ ID NO: 4004063 - DNA, 14 bp, Homo sapiens
agaggaaatctgta

SEQ ID NO: 4004064 - DNA, 20 bp, Homo sapiens
agaggaacccccaccagaca

SEQ ID NO: 4004065 - DNA, 12 bp, Homo sapiens
agaggagccaga

SEQ ID NO: 4004066 - DNA, 13 bp, Homo sapiens
agaggagctctac

SEQ ID NO: 4004067 - DNA, 20 bp, Homo sapiens
agaggagctctaccctgctc

SEQ ID NO: 4004068 - DNA, 16 bp, Homo sapiens
agaggaggcagccccc

SEQ ID NO: 4004069 - DNA, 22 bp, Homo sapiens
agaggagtgattgaaccagctc

SEQ ID NO: 4004070 - DNA, 22 bp, Homo sapiens
agaggagtgcgtggcccaccag

SEQ ID NO: 4004071 - DNA, 21 bp, Homo sapiens
agaggatgaatgtatgtgcac

SEQ ID NO: 4004072 - DNA, 19 bp, Homo sapiens
agaggatggcccagggtga

SEQ ID NO: 4004073 - DNA, 21 bp, Homo sapiens
agaggatgtggaaagcacttt

SEQ ID NO: 4004074 - DNA, 18 bp, Homo sapiens
agaggatttttttctgag

SEQ ID NO: 4004075 - DNA, 21 bp, Homo sapiens
agaggatttttttctgagcga

SEQ ID NO: 4004076 - DNA, 21 bp, Homo sapiens
agaggcactcagtgagcctcc

SEQ ID NO: 4004077 - DNA, 17 bp, Homo sapiens
agaggcagagaaagaag

SEQ ID NO: 4004078 - DNA, 20 bp, Homo sapiens
agaggcagagaaagaagaga

SEQ ID NO: 4004079 - DNA, 22 bp, Homo sapiens
agaggcagagaaagaagagaca

SEQ ID NO: 4004080 - DNA, 14 bp, Homo sapiens
agaggcaggctggg

SEQ ID NO: 4004081 - DNA, 21 bp, Homo sapiens
agaggcatgggcttgctgtgg

SEQ ID NO: 4004082 - DNA, 13 bp, Homo sapiens
agaggccaatgcc

SEQ ID NO: 4004083 - DNA, 21 bp, Homo sapiens
agaggccagccccacccagga

SEQ ID NO: 4004084 - DNA, 20 bp, Homo sapiens
agaggccatggcagaataat

SEQ ID NO: 4004085 - DNA, 13 bp, Homo sapiens
agaggccccagcc

SEQ ID NO: 4004086 - DNA, 15 bp, Homo sapiens
agaggccccagcctc

SEQ ID NO: 4004087 - DNA, 23 bp, Homo sapiens
agaggccccagcctccctgaagc

SEQ ID NO: 4004088 - DNA, 20 bp, Homo sapiens
agaggccgaaggtgcctcag

SEQ ID NO: 4004089 - DNA, 22 bp, Homo sapiens
agaggccgaaggtgcctcagac

SEQ ID NO: 4004090 - DNA, 12 bp, Homo sapiens
agaggcctgccc

SEQ ID NO: 4004091 - DNA, 12 bp, Homo sapiens
agaggctctgga

SEQ ID NO: 4004092 - DNA, 23 bp, Homo sapiens
agaggctctggacagcagaagcc

SEQ ID NO: 4004093 - DNA, 17 bp, Homo sapiens
agaggctctggggcagc

SEQ ID NO: 4004094 - DNA, 19 bp, Homo sapiens
agaggctgaggcctggact

SEQ ID NO: 4004095 - DNA, 23 bp, Homo sapiens
agaggctgcacccctgggccagc

SEQ ID NO: 4004096 - DNA, 12 bp, Homo sapiens
agaggctgcccc

SEQ ID NO: 4004097 - DNA, 22 bp, Homo sapiens
agaggctgggagtccctacctg

SEQ ID NO: 4004098 - DNA, 12 bp, Homo sapiens
agaggcttctcc

SEQ ID NO: 4004099 - DNA, 17 bp, Homo sapiens
agaggcttctccgccag

SEQ ID NO: 4004100 - DNA, 20 bp, Homo sapiens
agaggcttctccgccagcct

SEQ ID NO: 4004101 - DNA, 14 bp, Homo sapiens
agagggaccatgtg

SEQ ID NO: 4004102 - DNA, 19 bp, Homo sapiens
agagggagaagggatggag

SEQ ID NO: 4004103 - DNA, 12 bp, Homo sapiens
agagggagagag

SEQ ID NO: 4004104 - DNA, 14 bp, Homo sapiens
agagggaggtgttt

SEQ ID NO: 4004105 - DNA, 14 bp, Homo sapiens
agagggcaaggaag

SEQ ID NO: 4004106 - DNA, 13 bp, Homo sapiens
agagggcccagcc

SEQ ID NO: 4004107 - DNA, 16 bp, Homo sapiens
agagggcccagcccag

SEQ ID NO: 4004108 - DNA, 17 bp, Homo sapiens
agagggcccagcccaga

SEQ ID NO: 4004109 - DNA, 15 bp, Homo sapiens
agagggcctgtggga

SEQ ID NO: 4004110 - DNA, 19 bp, Homo sapiens
agagggcctgtgggagcct

SEQ ID NO: 4004111 - DNA, 11 bp, Homo sapiens
agagggctgga

SEQ ID NO: 4004112 - DNA, 18 bp, Homo sapiens
agagggcttgtgaacaga

SEQ ID NO: 4004113 - DNA, 19 bp, Homo sapiens
agaggggaaaagctgaaca

SEQ ID NO: 4004114 - DNA, 18 bp, Homo sapiens
agaggggagagctgaaca

SEQ ID NO: 4004115 - DNA, 16 bp, Homo sapiens
agagggggagtagcca

SEQ ID NO: 4004116 - DNA, 22 bp, Homo sapiens
agagggggcctgggacttccat

SEQ ID NO: 4004117 - DNA, 14 bp, Homo sapiens
agagggtgaaaggc

SEQ ID NO: 4004118 - DNA, 23 bp, Homo sapiens
agaggtaaaagtgtgagcagtga

SEQ ID NO: 4004119 - DNA, 22 bp, Homo sapiens
agaggtaacagaacagcttcag

SEQ ID NO: 4004120 - DNA, 15 bp, Homo sapiens
agaggtagccgggct

SEQ ID NO: 4004121 - DNA, 20 bp, Homo sapiens
agaggtcaggacggctcctc

SEQ ID NO: 4004122 - DNA, 22 bp, Homo sapiens
agaggtcaggacggctcctcag

SEQ ID NO: 4004123 - DNA, 16 bp, Homo sapiens
agaggtgcttcaccct

SEQ ID NO: 4004124 - DNA, 15 bp, Homo sapiens
agaggtggaaaaaca

SEQ ID NO: 4004125 - DNA, 20 bp, Homo sapiens
agaggtggagaactgggatt

SEQ ID NO: 4004126 - DNA, 21 bp, Homo sapiens
agaggtgggatcctccctcat

SEQ ID NO: 4004127 - DNA, 16 bp, Homo sapiens
agaggttaaggtgcaa

SEQ ID NO: 4004128 - DNA, 14 bp, Homo sapiens
agaggttaggagta

SEQ ID NO: 4004129 - DNA, 22 bp, Homo sapiens
agaggtttgactagatgatgga

SEQ ID NO: 4004130 - DNA, 18 bp, Homo sapiens
agaggtttggctcctgcc

SEQ ID NO: 4004131 - DNA, 20 bp, Homo sapiens
agaggtttggctcctgccca

SEQ ID NO: 4004132 - DNA, 15 bp, Homo sapiens
agagtaaaaactgaa

SEQ ID NO: 4004133 - DNA, 20 bp, Homo sapiens
agagtaactttactctgtgt

SEQ ID NO: 4004134 - DNA, 16 bp, Homo sapiens
agagtacagtgagcca

SEQ ID NO: 4004135 - DNA, 18 bp, Homo sapiens
agagtacgtcctgcctgg

SEQ ID NO: 4004136 - DNA, 19 bp, Homo sapiens
agagtacgtcctgcctggc

SEQ ID NO: 4004137 - DNA, 15 bp, Homo sapiens
agagtactgggagaa

SEQ ID NO: 4004138 - DNA, 15 bp, Homo sapiens
agagtagaattgcat

SEQ ID NO: 4004139 - DNA, 13 bp, Homo sapiens
agagtcatctcca

SEQ ID NO: 4004140 - DNA, 14 bp, Homo sapiens
agagtcatctccat

SEQ ID NO: 4004141 - DNA, 21 bp, Homo sapiens
agagtcatctccatcagctgt

SEQ ID NO: 4004142 - DNA, 17 bp, Homo sapiens
agagtcatttatgagca

SEQ ID NO: 4004143 - DNA, 20 bp, Homo sapiens
agagtcatttatgagcagaa

SEQ ID NO: 4004144 - DNA, 23 bp, Homo sapiens
agagtccatttcccacatctttc

SEQ ID NO: 4004145 - DNA, 22 bp, Homo sapiens
agagtctggtctgcgccttggg

SEQ ID NO: 4004146 - DNA, 18 bp, Homo sapiens
agaaatcctgcaatgaaa

SEQ ID NO: 4004147 - DNA, 19 bp, Homo sapiens
agaaatgaataatttccca

SEQ ID NO: 4004148 - DNA, 23 bp, Homo sapiens
agaaatgaccaatattatactaa

SEQ ID NO: 4004149 - DNA, 16 bp, Homo sapiens
agaaatggggaattct

SEQ ID NO: 4004150 - DNA, 21 bp, Homo sapiens
agaaatggggaattctctaat

SEQ ID NO: 4004151 - DNA, 21 bp, Homo sapiens
agaaatgtcttaatttttgaa

SEQ ID NO: 4004152 - DNA, 16 bp, Homo sapiens
agaaatgttgttcatt

SEQ ID NO: 4004153 - DNA, 17 bp, Homo sapiens
agaaattagctgtgtga

SEQ ID NO: 4004154 - DNA, 18 bp, Homo sapiens
agaaattcgtgtgttttt

SEQ ID NO: 4004155 - DNA, 18 bp, Homo sapiens
agaaattctgttaaaatc

SEQ ID NO: 4004156 - DNA, 22 bp, Homo sapiens
agaaattctgttaaaatctatt

SEQ ID NO: 4004157 - DNA, 22 bp, Homo sapiens
agaaattggaacagaatgtttt

SEQ ID NO: 4004158 - DNA, 17 bp, Homo sapiens
agaaattttgtaagaag

SEQ ID NO: 4004159 - DNA, 21 bp, Homo sapiens
agaaattttgtaagaaggcaa

SEQ ID NO: 4004160 - DNA, 14 bp, Homo sapiens
agaaatttttatca

SEQ ID NO: 4004161 - DNA, 15 bp, Homo sapiens
agaaatttttatcag

SEQ ID NO: 4004162 - DNA, 16 bp, Homo sapiens
agaaatttttatcagt

SEQ ID NO: 4004163 - DNA, 22 bp, Homo sapiens
agaaatttttatttttctaagg

SEQ ID NO: 4004164 - DNA, 21 bp, Homo sapiens
agaaatttttcagatgcttct

SEQ ID NO: 4004165 - DNA, 20 bp, Homo sapiens
agaacacagcaattcctcag

SEQ ID NO: 4004166 - DNA, 15 bp, Homo sapiens
agaacactaattcat

SEQ ID NO: 4004167 - DNA, 16 bp, Homo sapiens
agaacagatcttttac

SEQ ID NO: 4004168 - DNA, 13 bp, Homo sapiens
agaacagcagagg

SEQ ID NO: 4004169 - DNA, 12 bp, Homo sapiens
agaacagcttca

SEQ ID NO: 4004170 - DNA, 14 bp, Homo sapiens
agaacagcttcagg

SEQ ID NO: 4004171 - DNA, 22 bp, Homo sapiens
agaacagcttcaggttatcgaa

SEQ ID NO: 4004172 - DNA, 21 bp, Homo sapiens
agaacagggtcatgtttgcag

SEQ ID NO: 4004173 - DNA, 14 bp, Homo sapiens
agaacatggacttg

SEQ ID NO: 4004174 - DNA, 19 bp, Homo sapiens
agaacatggacttgtatat

SEQ ID NO: 4004175 - DNA, 13 bp, Homo sapiens
agaacatgtgaga

SEQ ID NO: 4004176 - DNA, 11 bp, Homo sapiens
agaacattgta

SEQ ID NO: 4004177 - DNA, 22 bp, Homo sapiens
agaaccacttcctgctacagga

SEQ ID NO: 4004178 - DNA, 18 bp, Homo sapiens
agaaccagtttcaggtgt

SEQ ID NO: 4004179 - DNA, 17 bp, Homo sapiens
agaaccctctgtcccac

SEQ ID NO: 4004180 - DNA, 16 bp, Homo sapiens
agaaccgagcaaagat

SEQ ID NO: 4004181 - DNA, 20 bp, Homo sapiens
agaaccgagcaaagatcaaa

SEQ ID NO: 4004182 - DNA, 21 bp, Homo sapiens
agaaccgagcaaagatcaaaa

SEQ ID NO: 4004183 - DNA, 20 bp, Homo sapiens
agaacctacagactccatct

SEQ ID NO: 4004184 - DNA, 14 bp, Homo sapiens
agaacctcttcccc

SEQ ID NO: 4004185 - DNA, 20 bp, Homo sapiens
agaacctggaacttggggag

SEQ ID NO: 4004186 - DNA, 13 bp, Homo sapiens
agaacgcagccct

SEQ ID NO: 4004187 - DNA, 23 bp, Homo sapiens
agaacgcagccctagagcctgcc

SEQ ID NO: 4004188 - DNA, 15 bp, Homo sapiens
agaactaaatgttct

SEQ ID NO: 4004189 - DNA, 11 bp, Homo sapiens
agaactacttg

SEQ ID NO: 4004190 - DNA, 19 bp, Homo sapiens
agaactcactctgggctgt

SEQ ID NO: 4004191 - DNA, 20 bp, Homo sapiens
agaactcactctgggctgta

SEQ ID NO: 4004192 - DNA, 16 bp, Homo sapiens
agaactcactggggcc

SEQ ID NO: 4004193 - DNA, 17 bp, Homo sapiens
agaactccaggccctcc

SEQ ID NO: 4004194 - DNA, 13 bp, Homo sapiens
agaactcccacaa

SEQ ID NO: 4004195 - DNA, 20 bp, Homo sapiens
agaactcccacaaccacatg

SEQ ID NO: 4004196 - DNA, 12 bp, Homo sapiens
agaactctgcct

SEQ ID NO: 4004197 - DNA, 14 bp, Homo sapiens
agaactctgcctgc

SEQ ID NO: 4004198 - DNA, 13 bp, Homo sapiens
agaactcttcctc

SEQ ID NO: 4004199 - DNA, 16 bp, Homo sapiens
agaactgcccccactg

SEQ ID NO: 4004200 - DNA, 23 bp, Homo sapiens
agaactgggatttgaacccccgc

SEQ ID NO: 4004201 - DNA, 13 bp, Homo sapiens
agaactgtgccac

SEQ ID NO: 4004202 - DNA, 16 bp, Homo sapiens
agaactgtgccacaat

SEQ ID NO: 4004203 - DNA, 19 bp, Homo sapiens
agaactgtgtttcaagttc

SEQ ID NO: 4004204 - DNA, 20 bp, Homo sapiens
agaacttaaattatgtttta

SEQ ID NO: 4004205 - DNA, 16 bp, Homo sapiens
agaacttcagaaagac

SEQ ID NO: 4004206 - DNA, 13 bp, Homo sapiens
agaacttccctga

SEQ ID NO: 4004207 - DNA, 16 bp, Homo sapiens
agaacttgatttgcat

SEQ ID NO: 4004208 - DNA, 14 bp, Homo sapiens
agaagaaagactct

SEQ ID NO: 4004209 - DNA, 15 bp, Homo sapiens
agaagaaagactcta

SEQ ID NO: 4004210 - DNA, 14 bp, Homo sapiens
agaagaaatgaata

SEQ ID NO: 4004211 - DNA, 18 bp, Homo sapiens
agaagaagagaagctgct

SEQ ID NO: 4004212 - DNA, 20 bp, Homo sapiens
agaagaagagaagctgctga

SEQ ID NO: 4004213 - DNA, 16 bp, Homo sapiens
agaagaatattcagga

SEQ ID NO: 4004214 - DNA, 18 bp, Homo sapiens
agaagaatattcaggact

SEQ ID NO: 4004215 - DNA, 19 bp, Homo sapiens
agaagaatattcaggactt

SEQ ID NO: 4004216 - DNA, 15 bp, Homo sapiens
agaagacaccagagc

SEQ ID NO: 4004217 - DNA, 23 bp, Homo sapiens
agaagacaccagagcagatgcag

SEQ ID NO: 4004218 - DNA, 12 bp, Homo sapiens
agaagacactgc

SEQ ID NO: 4004219 - DNA, 14 bp, Homo sapiens
agaagacagcttaa

SEQ ID NO: 4004220 - DNA, 20 bp, Homo sapiens
agaagagatgggcttgtttt

SEQ ID NO: 4004221 - DNA, 18 bp, Homo sapiens
agaagagggcccagccca

SEQ ID NO: 4004222 - DNA, 14 bp, Homo sapiens
agaagagggcctgt

SEQ ID NO: 4004223 - DNA, 15 bp, Homo sapiens
agaagagggtgtgtt

SEQ ID NO: 4004224 - DNA, 17 bp, Homo sapiens
agaagagggtgtgtttg

SEQ ID NO: 4004225 - DNA, 16 bp, Homo sapiens
agaagagtgccctgct

SEQ ID NO: 4004226 - DNA, 22 bp, Homo sapiens
agaagagtgccctgctttgcaa

SEQ ID NO: 4004227 - DNA, 17 bp, Homo sapiens
agaagataattgttgaa

SEQ ID NO: 4004228 - DNA, 20 bp, Homo sapiens
agaagatcaacgcctcactg

SEQ ID NO: 4004229 - DNA, 23 bp, Homo sapiens
agaagatgccagcttctctctcc

SEQ ID NO: 4004230 - DNA, 13 bp, Homo sapiens
agaagcaagtaaa

SEQ ID NO: 4004231 - DNA, 19 bp, Homo sapiens
agaagcacagaatattttt

SEQ ID NO: 4004232 - DNA, 15 bp, Homo sapiens
agaagcagggtaccc

SEQ ID NO: 4004233 - DNA, 14 bp, Homo sapiens
agaagcattccttc

SEQ ID NO: 4004234 - DNA, 21 bp, Homo sapiens
agaagcatttgatattatcta

SEQ ID NO: 4004235 - DNA, 17 bp, Homo sapiens
agaagccacccaaagca

SEQ ID NO: 4004236 - DNA, 12 bp, Homo sapiens
agaagccaggaa

SEQ ID NO: 4004237 - DNA, 21 bp, Homo sapiens
agaagccatatatgaccagaa

SEQ ID NO: 4004238 - DNA, 23 bp, Homo sapiens
agaagccatatatgaccagaagc

SEQ ID NO: 4004239 - DNA, 21 bp, Homo sapiens
agaagcccaatattataattt

SEQ ID NO: 4004240 - DNA, 17 bp, Homo sapiens
agaagcccccagctaag

SEQ ID NO: 4004241 - DNA, 16 bp, Homo sapiens
agaagccgggaacaga

SEQ ID NO: 4004242 - DNA, 20 bp, Homo sapiens
agaagcctcgttttgatgcc

SEQ ID NO: 4004243 - DNA, 12 bp, Homo sapiens
agaagcctctgg

SEQ ID NO: 4004244 - DNA, 21 bp, Homo sapiens
agaagcctgatgctgacattc

SEQ ID NO: 4004245 - DNA, 22 bp, Homo sapiens
agaagcctggactctgccccac

SEQ ID NO: 4004246 - DNA, 22 bp, Homo sapiens
agaagcgattatgaaagcaaca

SEQ ID NO: 4004247 - DNA, 14 bp, Homo sapiens
agaagctcctctcc

SEQ ID NO: 4004248 - DNA, 20 bp, Homo sapiens
agaagctgctccaggcctgc

SEQ ID NO: 4004249 - DNA, 22 bp, Homo sapiens
agaccctgggtgggctctgtgc

SEQ ID NO: 4004250 - DNA, 14 bp, Homo sapiens
agaccctggtgcct

SEQ ID NO: 4004251 - DNA, 19 bp, Homo sapiens
agaccctggtgcctggctc

SEQ ID NO: 4004252 - DNA, 15 bp, Homo sapiens
agacccttcttgcct

SEQ ID NO: 4004253 - DNA, 16 bp, Homo sapiens
agacccttcttgcctg

SEQ ID NO: 4004254 - DNA, 23 bp, Homo sapiens
agacccttcttgcctgctgggct

SEQ ID NO: 4004255 - DNA, 21 bp, Homo sapiens
agaccgagcgctttctggaaa

SEQ ID NO: 4004256 - DNA, 21 bp, Homo sapiens
agacctaaagtgcttgctttt

SEQ ID NO: 4004257 - DNA, 21 bp, Homo sapiens
agacctacattccctctcctg

SEQ ID NO: 4004258 - DNA, 16 bp, Homo sapiens
agacctagcaggctgt

SEQ ID NO: 4004259 - DNA, 20 bp, Homo sapiens
agacctagcaggctgttcca

SEQ ID NO: 4004260 - DNA, 16 bp, Homo sapiens
agacctatgtaagaat

SEQ ID NO: 4004261 - DNA, 16 bp, Homo sapiens
agacctatttgacata

SEQ ID NO: 4004262 - DNA, 15 bp, Homo sapiens
agacctgaattcttt

SEQ ID NO: 4004263 - DNA, 17 bp, Homo sapiens
agacctgacaagcactg

SEQ ID NO: 4004264 - DNA, 23 bp, Homo sapiens
agacctgatcctggaggcccagt

SEQ ID NO: 4004265 - DNA, 11 bp, Homo sapiens
agacctggcag

SEQ ID NO: 4004266 - DNA, 15 bp, Homo sapiens
agacctggcagctct

SEQ ID NO: 4004267 - DNA, 16 bp, Homo sapiens
agacctggcagctctg

SEQ ID NO: 4004268 - DNA, 15 bp, Homo sapiens
agacctgtcttccaa

SEQ ID NO: 4004269 - DNA, 23 bp, Homo sapiens
agacctgtgctagttttacagat

SEQ ID NO: 4004270 - DNA, 18 bp, Homo sapiens
agacctgttagcagacag

SEQ ID NO: 4004271 - DNA, 22 bp, Homo sapiens
agaccttaataaaggcccccac

SEQ ID NO: 4004272 - DNA, 15 bp, Homo sapiens
agacgcaccatgtgg

SEQ ID NO: 4004273 - DNA, 12 bp, Homo sapiens
agacgcagtccg

SEQ ID NO: 4004274 - DNA, 13 bp, Homo sapiens
agacgcccagccc

SEQ ID NO: 4004275 - DNA, 14 bp, Homo sapiens
agacggattgcatt

SEQ ID NO: 4004276 - DNA, 12 bp, Homo sapiens
agacggcggcca

SEQ ID NO: 4004277 - DNA, 15 bp, Homo sapiens
agacggcggccaggc

SEQ ID NO: 4004278 - DNA, 20 bp, Homo sapiens
agacggcggccaggcacagg

SEQ ID NO: 4004279 - DNA, 22 bp, Homo sapiens
agacggcggccaggcacagggc

SEQ ID NO: 4004280 - DNA, 12 bp, Homo sapiens
agacgggcacag

SEQ ID NO: 4004281 - DNA, 18 bp, Homo sapiens
agacgtggaacctctgtc

SEQ ID NO: 4004282 - DNA, 21 bp, Homo sapiens
agacgtggaacctctgtctca

SEQ ID NO: 4004283 - DNA, 15 bp, Homo sapiens
agacgttgcctgaga

SEQ ID NO: 4004284 - DNA, 21 bp, Homo sapiens
agacgtttttgtgctgtgggc

SEQ ID NO: 4004285 - DNA, 19 bp, Homo sapiens
agactaaaggatccagaga

SEQ ID NO: 4004286 - DNA, 17 bp, Homo sapiens
agactaagaaatattcc

SEQ ID NO: 4004287 - DNA, 13 bp, Homo sapiens
agactaagccctg

SEQ ID NO: 4004288 - DNA, 16 bp, Homo sapiens
agactacacaggatga

SEQ ID NO: 4004289 - DNA, 19 bp, Homo sapiens
agactagattgcctttgtt

SEQ ID NO: 4004290 - DNA, 17 bp, Homo sapiens
agactagcaatctcttc

SEQ ID NO: 4004291 - DNA, 21 bp, Homo sapiens
agactagtgccgtagggagta

SEQ ID NO: 4004292 - DNA, 15 bp, Homo sapiens
agactatctaaatgt

SEQ ID NO: 4004293 - DNA, 19 bp, Homo sapiens
agactattccttttctgta

SEQ ID NO: 4004294 - DNA, 16 bp, Homo sapiens
agactcacaggaagga

SEQ ID NO: 4004295 - DNA, 12 bp, Homo sapiens
agactcagtgtt

SEQ ID NO: 4004296 - DNA, 12 bp, Homo sapiens
agactcagtttg

SEQ ID NO: 4004297 - DNA, 15 bp, Homo sapiens
agactcagtttgtca

SEQ ID NO: 4004298 - DNA, 21 bp, Homo sapiens
agactcagtttgtcagacttt

SEQ ID NO: 4004299 - DNA, 14 bp, Homo sapiens
agactccgccctcc

SEQ ID NO: 4004300 - DNA, 23 bp, Homo sapiens
agactcctcctccaaaggccccc

SEQ ID NO: 4004301 - DNA, 16 bp, Homo sapiens
agactcctgccctgtt

SEQ ID NO: 4004302 - DNA, 20 bp, Homo sapiens
agactctgaaatctcagaat

SEQ ID NO: 4004303 - DNA, 11 bp, Homo sapiens
agactctgagc

SEQ ID NO: 4004304 - DNA, 18 bp, Homo sapiens
agactctttagagcagct

SEQ ID NO: 4004305 - DNA, 20 bp, Homo sapiens
agactgaatgttttatttat

SEQ ID NO: 4004306 - DNA, 19 bp, Homo sapiens
agactgacaacctcatcca

SEQ ID NO: 4004307 - DNA, 16 bp, Homo sapiens
agactgagcacctgct

SEQ ID NO: 4004308 - DNA, 17 bp, Homo sapiens
agactgagtcagatggg

SEQ ID NO: 4004309 - DNA, 15 bp, Homo sapiens
agactgcaagctgct

SEQ ID NO: 4004310 - DNA, 23 bp, Homo sapiens
agactgcatcccgtacctcttcc

SEQ ID NO: 4004311 - DNA, 23 bp, Homo sapiens
agactgccccacggagacagagg

SEQ ID NO: 4004312 - DNA, 20 bp, Homo sapiens
agactggaagctaatttgca

SEQ ID NO: 4004313 - DNA, 21 bp, Homo sapiens
agactgggaagataggctctg

SEQ ID NO: 4004314 - DNA, 22 bp, Homo sapiens
agactgggaaggcttgggattt

SEQ ID NO: 4004315 - DNA, 14 bp, Homo sapiens
agactggttttctg

SEQ ID NO: 4004316 - DNA, 22 bp, Homo sapiens
agactgtagattgcttctgtag

SEQ ID NO: 4004317 - DNA, 23 bp, Homo sapiens
agactgtagattgcttctgtagt

SEQ ID NO: 4004318 - DNA, 17 bp, Homo sapiens
agactgtgattcagaaa

SEQ ID NO: 4004319 - DNA, 19 bp, Homo sapiens
agactgtggctagtgacaa

SEQ ID NO: 4004320 - DNA, 14 bp, Homo sapiens
agactgttgctcaa

SEQ ID NO: 4004321 - DNA, 14 bp, Homo sapiens
agactgttgtgatc

SEQ ID NO: 4004322 - DNA, 15 bp, Homo sapiens
agactgtttttaagt

SEQ ID NO: 4004323 - DNA, 14 bp, Homo sapiens
agacttcagggagt

SEQ ID NO: 4004324 - DNA, 20 bp, Homo sapiens
agacttcgactcaggatcca

SEQ ID NO: 4004325 - DNA, 23 bp, Homo sapiens
agacttgccaacaccacagaaat

SEQ ID NO: 4004326 - DNA, 14 bp, Homo sapiens
agactttaaagaat

SEQ ID NO: 4004327 - DNA, 16 bp, Homo sapiens
agactttagaaataaa

SEQ ID NO: 4004328 - DNA, 18 bp, Homo sapiens
agactttgtttttaaaat

SEQ ID NO: 4004329 - DNA, 13 bp, Homo sapiens
agagaaactttat

SEQ ID NO: 4004330 - DNA, 14 bp, Homo sapiens
agagaaagaagaga

SEQ ID NO: 4004331 - DNA, 19 bp, Homo sapiens
agagaaaggggagcccact

SEQ ID NO: 4004332 - DNA, 19 bp, Homo sapiens
agagaaagtgatttctaga

SEQ ID NO: 4004333 - DNA, 13 bp, Homo sapiens
agagaaattctgt

SEQ ID NO: 4004334 - DNA, 15 bp, Homo sapiens
agagaaccgagcaaa

SEQ ID NO: 4004335 - DNA, 14 bp, Homo sapiens
agagaacctcagat

SEQ ID NO: 4004336 - DNA, 20 bp, Homo sapiens
agagaacctcagattcttca

SEQ ID NO: 4004337 - DNA, 14 bp, Homo sapiens
agagaacgcagccc

SEQ ID NO: 4004338 - DNA, 19 bp, Homo sapiens
agagaagagggcccagccc

SEQ ID NO: 4004339 - DNA, 13 bp, Homo sapiens
agagaagataatt

SEQ ID NO: 4004340 - DNA, 15 bp, Homo sapiens
agagaagcaagtaaa

SEQ ID NO: 4004341 - DNA, 20 bp, Homo sapiens
agagaagccacgctgtcctc

SEQ ID NO: 4004342 - DNA, 12 bp, Homo sapiens
agagaagctgct

SEQ ID NO: 4004343 - DNA, 14 bp, Homo sapiens
agagaagctggact

SEQ ID NO: 4004344 - DNA, 13 bp, Homo sapiens
agagaaggaaaag

SEQ ID NO: 4004345 - DNA, 23 bp, Homo sapiens
agagaaggaaaagactgaatcta

SEQ ID NO: 4004346 - DNA, 17 bp, Homo sapiens
agagaagtgagtggtgt

SEQ ID NO: 4004347 - DNA, 22 bp, Homo sapiens
agagaagtggactggaggagct

SEQ ID NO: 4004348 - DNA, 14 bp, Homo sapiens
agagaagttctcaa

SEQ ID NO: 4004349 - DNA, 14 bp, Homo sapiens
agagaatggagaca

SEQ ID NO: 4004350 - DNA, 17 bp, Homo sapiens
agagaatggagacagag

SEQ ID NO: 4004351 - DNA, 17 bp, Homo sapiens
agagaatgtagatattg

SEQ ID NO: 4004352 - DNA, 20 bp, Homo sapiens
agacaaaattttagtccaaa

SEQ ID NO: 4004353 - DNA, 18 bp, Homo sapiens
agacaaacaagggagaag

SEQ ID NO: 4004354 - DNA, 15 bp, Homo sapiens
agacaacagaagtca

SEQ ID NO: 4004355 - DNA, 17 bp, Homo sapiens
agacaacctgaaattta

SEQ ID NO: 4004356 - DNA, 20 bp, Homo sapiens
agacaagatattgtacataa

SEQ ID NO: 4004357 - DNA, 21 bp, Homo sapiens
agacaagatattgtacataaa

SEQ ID NO: 4004358 - DNA, 18 bp, Homo sapiens
agacaagctgttgaccag

SEQ ID NO: 4004359 - DNA, 15 bp, Homo sapiens
agacaatcttctgtt

SEQ ID NO: 4004360 - DNA, 15 bp, Homo sapiens
agacaatgttttctt

SEQ ID NO: 4004361 - DNA, 17 bp, Homo sapiens
agacaatgttttcttca

SEQ ID NO: 4004362 - DNA, 13 bp, Homo sapiens
agacaatttgata

SEQ ID NO: 4004363 - DNA, 18 bp, Homo sapiens
agacaatttgatacataa

SEQ ID NO: 4004364 - DNA, 16 bp, Homo sapiens
agacacaatatgtatg

SEQ ID NO: 4004365 - DNA, 13 bp, Homo sapiens
agacacacacaca

SEQ ID NO: 4004366 - DNA, 15 bp, Homo sapiens
agacacacacacgca

SEQ ID NO: 4004367 - DNA, 16 bp, Homo sapiens
agacacacacacgcac

SEQ ID NO: 4004368 - DNA, 18 bp, Homo sapiens
agacacacacacgcacgc

SEQ ID NO: 4004369 - DNA, 20 bp, Homo sapiens
agacacacacacgcacgcac

SEQ ID NO: 4004370 - DNA, 21 bp, Homo sapiens
agacacacacacgcacgcaca

SEQ ID NO: 4004371 - DNA, 17 bp, Homo sapiens
agacacacatgggcagc

SEQ ID NO: 4004372 - DNA, 18 bp, Homo sapiens
agacacacatgggcagcc

SEQ ID NO: 4004373 - DNA, 21 bp, Homo sapiens
agacacacatgggcagcccaa

SEQ ID NO: 4004374 - DNA, 13 bp, Homo sapiens
agacacaggccct

SEQ ID NO: 4004375 - DNA, 13 bp, Homo sapiens
agacacaggggac

SEQ ID NO: 4004376 - DNA, 13 bp, Homo sapiens
agacacccaggac

SEQ ID NO: 4004377 - DNA, 19 bp, Homo sapiens
agacacctgttcacagaaa

SEQ ID NO: 4004378 - DNA, 18 bp, Homo sapiens
agacactgaaaaatctaa

SEQ ID NO: 4004379 - DNA, 15 bp, Homo sapiens
agacacttgccttct

SEQ ID NO: 4004380 - DNA, 13 bp, Homo sapiens
agacagaaaagtg

SEQ ID NO: 4004381 - DNA, 20 bp, Homo sapiens
agacagaaaagtgcctgagc

SEQ ID NO: 4004382 - DNA, 22 bp, Homo sapiens
agacagaaaagtgcctgagctg

SEQ ID NO: 4004383 - DNA, 11 bp, Homo sapiens
agacagaaact

SEQ ID NO: 4004384 - DNA, 12 bp, Homo sapiens
agacagaatctc

SEQ ID NO: 4004385 - DNA, 15 bp, Homo sapiens
agacagaatggtgga

SEQ ID NO: 4004386 - DNA, 14 bp, Homo sapiens
agacagacacacac

SEQ ID NO: 4004387 - DNA, 15 bp, Homo sapiens
agacagacacacaca

SEQ ID NO: 4004388 - DNA, 16 bp, Homo sapiens
agacagaccacttgcc

SEQ ID NO: 4004389 - DNA, 18 bp, Homo sapiens
agacagagacgcaggaat

SEQ ID NO: 4004390 - DNA, 20 bp, Homo sapiens
agacagaggaaagggctggc

SEQ ID NO: 4004391 - DNA, 21 bp, Homo sapiens
agacagaggaaagggctggct

SEQ ID NO: 4004392 - DNA, 20 bp, Homo sapiens
agacagagtccctggctcct

SEQ ID NO: 4004393 - DNA, 15 bp, Homo sapiens
agacagatgccccag

SEQ ID NO: 4004394 - DNA, 11 bp, Homo sapiens
agacagcctct

SEQ ID NO: 4004395 - DNA, 11 bp, Homo sapiens
agacaggcagc

SEQ ID NO: 4004396 - DNA, 18 bp, Homo sapiens
agacaggcagcccagcag

SEQ ID NO: 4004397 - DNA, 22 bp, Homo sapiens
agacaggccatgtgagccaccg

SEQ ID NO: 4004398 - DNA, 20 bp, Homo sapiens
agacaggctcttagcagctt

SEQ ID NO: 4004399 - DNA, 15 bp, Homo sapiens
agacagtatatttat

SEQ ID NO: 4004400 - DNA, 13 bp, Homo sapiens
agacagtgatatt

SEQ ID NO: 4004401 - DNA, 18 bp, Homo sapiens
agacagtgatctccatat

SEQ ID NO: 4004402 - DNA, 20 bp, Homo sapiens
agacagtgatctccatatgt

SEQ ID NO: 4004403 - DNA, 13 bp, Homo sapiens
agacagtttctta

SEQ ID NO: 4004404 - DNA, 22 bp, Homo sapiens
agacatactccttccatcaaat

SEQ ID NO: 4004405 - DNA, 15 bp, Homo sapiens
agacatactgcttga

SEQ ID NO: 4004406 - DNA, 14 bp, Homo sapiens
agacatacttgaag

SEQ ID NO: 4004407 - DNA, 23 bp, Homo sapiens
agacatatgggatattcccaagc

SEQ ID NO: 4004408 - DNA, 17 bp, Homo sapiens
agacatcaccctttgcc

SEQ ID NO: 4004409 - DNA, 21 bp, Homo sapiens
agacatcaccctttgccttag

SEQ ID NO: 4004410 - DNA, 20 bp, Homo sapiens
agacatcatgaattttacat

SEQ ID NO: 4004411 - DNA, 14 bp, Homo sapiens
agacatctctgcac

SEQ ID NO: 4004412 - DNA, 14 bp, Homo sapiens
agacatgtgacatt

SEQ ID NO: 4004413 - DNA, 19 bp, Homo sapiens
agacatgtgaggaggaaaa

SEQ ID NO: 4004414 - DNA, 19 bp, Homo sapiens
agacattcttccaaaaaga

SEQ ID NO: 4004415 - DNA, 21 bp, Homo sapiens
agacattgtttggatttcctt

SEQ ID NO: 4004416 - DNA, 14 bp, Homo sapiens
agacatttcttttc

SEQ ID NO: 4004417 - DNA, 18 bp, Homo sapiens
agacatttgtttgctgta

SEQ ID NO: 4004418 - DNA, 17 bp, Homo sapiens
agaccaaggcgggagca

SEQ ID NO: 4004419 - DNA, 16 bp, Homo sapiens
agaccaagtcctggct

SEQ ID NO: 4004420 - DNA, 21 bp, Homo sapiens
agaccacagggttcaaaatgt

SEQ ID NO: 4004421 - DNA, 21 bp, Homo sapiens
agaccaccagccgccccagcc

SEQ ID NO: 4004422 - DNA, 16 bp, Homo sapiens
agaccaccccgcctgc

SEQ ID NO: 4004423 - DNA, 22 bp, Homo sapiens
agaccactgagtaccaggggct

SEQ ID NO: 4004424 - DNA, 13 bp, Homo sapiens
agaccagctcaga

SEQ ID NO: 4004425 - DNA, 15 bp, Homo sapiens
agaccagctcagagg

SEQ ID NO: 4004426 - DNA, 22 bp, Homo sapiens
agaccagctcagaggcccagga

SEQ ID NO: 4004427 - DNA, 16 bp, Homo sapiens
agaccaggatttctaa

SEQ ID NO: 4004428 - DNA, 16 bp, Homo sapiens
agaccaggctgtgtcc

SEQ ID NO: 4004429 - DNA, 15 bp, Homo sapiens
agaccagggagcctt

SEQ ID NO: 4004430 - DNA, 13 bp, Homo sapiens
agaccagtgaccc

SEQ ID NO: 4004431 - DNA, 21 bp, Homo sapiens
agaccagtgtatcaggtcagg

SEQ ID NO: 4004432 - DNA, 13 bp, Homo sapiens
agaccagttggga

SEQ ID NO: 4004433 - DNA, 21 bp, Homo sapiens
agaccagttgggagcactgga

SEQ ID NO: 4004434 - DNA, 22 bp, Homo sapiens
agaccagttgggagcactggag

SEQ ID NO: 4004435 - DNA, 13 bp, Homo sapiens
agaccataatgtt

SEQ ID NO: 4004436 - DNA, 15 bp, Homo sapiens
agaccatagtgacca

SEQ ID NO: 4004437 - DNA, 16 bp, Homo sapiens
agaccatattacctgg

SEQ ID NO: 4004438 - DNA, 14 bp, Homo sapiens
agaccatcctggct

SEQ ID NO: 4004439 - DNA, 15 bp, Homo sapiens
agaccatcctggcta

SEQ ID NO: 4004440 - DNA, 16 bp, Homo sapiens
agaccatgaagtaaat

SEQ ID NO: 4004441 - DNA, 21 bp, Homo sapiens
agaccatgaagtaaattatgt

SEQ ID NO: 4004442 - DNA, 22 bp, Homo sapiens
agaccatgaagtaaattatgta

SEQ ID NO: 4004443 - DNA, 16 bp, Homo sapiens
agacccagcaggaagc

SEQ ID NO: 4004444 - DNA, 20 bp, Homo sapiens
agacccagcaggaagccagg

SEQ ID NO: 4004445 - DNA, 15 bp, Homo sapiens
agaccccagggcagg

SEQ ID NO: 4004446 - DNA, 19 bp, Homo sapiens
agacccccatttgtcccag

SEQ ID NO: 4004447 - DNA, 21 bp, Homo sapiens
agacccccatttgtcccagac

SEQ ID NO: 4004448 - DNA, 13 bp, Homo sapiens
agacccccccatt

SEQ ID NO: 4004449 - DNA, 23 bp, Homo sapiens
agacccccccatttcccgcacat

SEQ ID NO: 4004450 - DNA, 11 bp, Homo sapiens
agacccctgcc

SEQ ID NO: 4004451 - DNA, 13 bp, Homo sapiens
agaccctcgggcc

SEQ ID NO: 4004452 - DNA, 14 bp, Homo sapiens
agaccctcttgccc

SEQ ID NO: 4004453 - DNA, 20 bp, Homo sapiens
agaccctcttgcccatcctg

SEQ ID NO: 4004454 - DNA, 18 bp, Homo sapiens
agaccctgaggccctggg

SEQ ID NO: 4004455 - DNA, 15 bp, Homo sapiens
agaccctgccacagc

SEQ ID NO: 4004456 - DNA, 14 bp, Homo sapiens
agaagctgttgtac

SEQ ID NO: 4004457 - DNA, 18 bp, Homo sapiens
agaagctgttgtacattt

SEQ ID NO: 4004458 - DNA, 17 bp, Homo sapiens
agaaggaaattgagatt

SEQ ID NO: 4004459 - DNA, 9 bp, Homo sapiens
agaaggaag

SEQ ID NO: 4004460 - DNA, 14 bp, Homo sapiens
agaaggatgaatga

SEQ ID NO: 4004461 - DNA, 21 bp, Homo sapiens
agaaggatgaatgaggtccca

SEQ ID NO: 4004462 - DNA, 11 bp, Homo sapiens
agaaggcaaaa

SEQ ID NO: 4004463 - DNA, 15 bp, Homo sapiens
agaaggcatgagaaa

SEQ ID NO: 4004464 - DNA, 18 bp, Homo sapiens
agaagggagctggctcca

SEQ ID NO: 4004465 - DNA, 19 bp, Homo sapiens
agaagggccagtcctgcct

SEQ ID NO: 4004466 - DNA, 20 bp, Homo sapiens
agaagggccagtcctgcctg

SEQ ID NO: 4004467 - DNA, 24 bp, Homo sapiens
agaaggtggaccttttaaagtgtt

SEQ ID NO: 4004468 - DNA, 13 bp, Homo sapiens
agaagtatacata

SEQ ID NO: 4004469 - DNA, 13 bp, Homo sapiens
agaagtcatgaag

SEQ ID NO: 4004470 - DNA, 17 bp, Homo sapiens
agaagtcatgaagccca

SEQ ID NO: 4004471 - DNA, 17 bp, Homo sapiens
agaagtcttagatgtat

SEQ ID NO: 4004472 - DNA, 19 bp, Homo sapiens
agaagtcttagatgtatat

SEQ ID NO: 4004473 - DNA, 22 bp, Homo sapiens
agaagtgagtggtgtgactctt

SEQ ID NO: 4004474 - DNA, 19 bp, Homo sapiens
agaagtgcatttctgaata

SEQ ID NO: 4004475 - DNA, 19 bp, Homo sapiens
agaagtgtccgagaactaa

SEQ ID NO: 4004476 - DNA, 17 bp, Homo sapiens
agaagttactttgtaat

SEQ ID NO: 4004477 - DNA, 23 bp, Homo sapiens
agaagttactttgtaatttttgg

SEQ ID NO: 4004478 - DNA, 18 bp, Homo sapiens
agaagttctcaaagttaa

SEQ ID NO: 4004479 - DNA, 20 bp, Homo sapiens
agaagttgaggattgttgaa

SEQ ID NO: 4004480 - DNA, 17 bp, Homo sapiens
agaagtttattctcatt

SEQ ID NO: 4004481 - DNA, 16 bp, Homo sapiens
agaataaaagctgtgg

SEQ ID NO: 4004482 - DNA, 15 bp, Homo sapiens
agaataaaggcagct

SEQ ID NO: 4004483 - DNA, 17 bp, Homo sapiens
agaataaagttctgagt

SEQ ID NO: 4004484 - DNA, 16 bp, Homo sapiens
agaataaggcaggcat

SEQ ID NO: 4004485 - DNA, 22 bp, Homo sapiens
agaataatccagtattgctgat

SEQ ID NO: 4004486 - DNA, 15 bp, Homo sapiens
agaataatggaaaca

SEQ ID NO: 4004487 - DNA, 14 bp, Homo sapiens
agaataatgttcta

SEQ ID NO: 4004488 - DNA, 21 bp, Homo sapiens
agaataattcaattttaaaga

SEQ ID NO: 4004489 - DNA, 20 bp, Homo sapiens
agaatactgggttcttagtt

SEQ ID NO: 4004490 - DNA, 16 bp, Homo sapiens
agaatactttgcttca

SEQ ID NO: 4004491 - DNA, 19 bp, Homo sapiens
agaatagccacatttggaa

SEQ ID NO: 4004492 - DNA, 20 bp, Homo sapiens
agaatagccacatttggaat

SEQ ID NO: 4004493 - DNA, 15 bp, Homo sapiens
agaatataattatcg

SEQ ID NO: 4004494 - DNA, 14 bp, Homo sapiens
agaatatatttatt

SEQ ID NO: 4004495 - DNA, 21 bp, Homo sapiens
agaatatatttatttaaagca

SEQ ID NO: 4004496 - DNA, 23 bp, Homo sapiens
agaatatatttatttaaagcatt

SEQ ID NO: 4004497 - DNA, 12 bp, Homo sapiens
agaatattcagg

SEQ ID NO: 4004498 - DNA, 12 bp, Homo sapiens
agaatattgtcc

SEQ ID NO: 4004499 - DNA, 21 bp, Homo sapiens
agaatatttaagaaaagcact

SEQ ID NO: 4004500 - DNA, 11 bp, Homo sapiens
agaatatttat

SEQ ID NO: 4004501 - DNA, 16 bp, Homo sapiens
agaatatttattacct

SEQ ID NO: 4004502 - DNA, 19 bp, Homo sapiens
agaatatttattacctctg

SEQ ID NO: 4004503 - DNA, 21 bp, Homo sapiens
agaatatttttatatttcctt

SEQ ID NO: 4004504 - DNA, 16 bp, Homo sapiens
agaatcagagtagaaa

SEQ ID NO: 4004505 - DNA, 21 bp, Homo sapiens
agaatcatgtgcgtcagtcca

SEQ ID NO: 4004506 - DNA, 12 bp, Homo sapiens
agaatccaaact

SEQ ID NO: 4004507 - DNA, 19 bp, Homo sapiens
agaatcccaaatttgattg

SEQ ID NO: 4004508 - DNA, 17 bp, Homo sapiens
agaatcccttaaaatta

SEQ ID NO: 4004509 - DNA, 18 bp, Homo sapiens
agaatcttaatgcttgta

SEQ ID NO: 4004510 - DNA, 19 bp, Homo sapiens
agaatcttgactttctgat

SEQ ID NO: 4004511 - DNA, 22 bp, Homo sapiens
agaatcttgactttctgattgg

SEQ ID NO: 4004512 - DNA, 21 bp, Homo sapiens
agaatgactatataatttatt

SEQ ID NO: 4004513 - DNA, 20 bp, Homo sapiens
agaatgatgataacagaact

SEQ ID NO: 4004514 - DNA, 15 bp, Homo sapiens
agaatgattaatcaa

SEQ ID NO: 4004515 - DNA, 16 bp, Homo sapiens
agaatgcacaagaatg

SEQ ID NO: 4004516 - DNA, 19 bp, Homo sapiens
agaatgcacaagaatggat

SEQ ID NO: 4004517 - DNA, 20 bp, Homo sapiens
agaatgcacaagaatggatc

SEQ ID NO: 4004518 - DNA, 20 bp, Homo sapiens
agaatgcattccctgaatct

SEQ ID NO: 4004519 - DNA, 21 bp, Homo sapiens
agaatgccatttctcacgccc

SEQ ID NO: 4004520 - DNA, 22 bp, Homo sapiens
agaatgctgcaggacttgagaa

SEQ ID NO: 4004521 - DNA, 13 bp, Homo sapiens
agaatgctgtaca

SEQ ID NO: 4004522 - DNA, 18 bp, Homo sapiens
agaatggaactcaagctg

SEQ ID NO: 4004523 - DNA, 14 bp, Homo sapiens
agaatggagacaga

SEQ ID NO: 4004524 - DNA, 19 bp, Homo sapiens
agaatggatcacaagatgg

SEQ ID NO: 4004525 - DNA, 20 bp, Homo sapiens
agaatggatcacaagatgga

SEQ ID NO: 4004526 - DNA, 17 bp, Homo sapiens
agaatgggaatatttta

SEQ ID NO: 4004527 - DNA, 15 bp, Homo sapiens
agaatggtggagtgt

SEQ ID NO: 4004528 - DNA, 19 bp, Homo sapiens
agaatgtaactccagatag

SEQ ID NO: 4004529 - DNA, 21 bp, Homo sapiens
agaatgtaactccagatagag

SEQ ID NO: 4004530 - DNA, 19 bp, Homo sapiens
agaatgtcagatttctggt

SEQ ID NO: 4004531 - DNA, 20 bp, Homo sapiens
agaatgtcagatttctggtt

SEQ ID NO: 4004532 - DNA, 17 bp, Homo sapiens
agaatgtgtgtgtgtgg

SEQ ID NO: 4004533 - DNA, 18 bp, Homo sapiens
agaatgttgtattcagtg

SEQ ID NO: 4004534 - DNA, 19 bp, Homo sapiens
agaatgttttactgtgaaa

SEQ ID NO: 4004535 - DNA, 19 bp, Homo sapiens
agaattaccaagagaaggg

SEQ ID NO: 4004536 - DNA, 17 bp, Homo sapiens
agaattagtgccagaat

SEQ ID NO: 4004537 - DNA, 22 bp, Homo sapiens
agaattagtgccagaattttag

SEQ ID NO: 4004538 - DNA, 18 bp, Homo sapiens
agaattatttttaaaaag

SEQ ID NO: 4004539 - DNA, 17 bp, Homo sapiens
agaattctcttatccaa

SEQ ID NO: 4004540 - DNA, 21 bp, Homo sapiens
agaattgaccatctgctttta

SEQ ID NO: 4004541 - DNA, 17 bp, Homo sapiens
agaattgagtaatggtg

SEQ ID NO: 4004542 - DNA, 22 bp, Homo sapiens
agaattgatcattttcccccca

SEQ ID NO: 4004543 - DNA, 17 bp, Homo sapiens
agaattgccaatcttgt

SEQ ID NO: 4004544 - DNA, 18 bp, Homo sapiens
agaattgtttttgaattt

SEQ ID NO: 4004545 - DNA, 19 bp, Homo sapiens
agaatttaccatcatctct

SEQ ID NO: 4004546 - DNA, 19 bp, Homo sapiens
agaatttagggagaaatgt

SEQ ID NO: 4004547 - DNA, 22 bp, Homo sapiens
agaatttagggagaaatgttgt

SEQ ID NO: 4004548 - DNA, 18 bp, Homo sapiens
agaatttccactgtaatt

SEQ ID NO: 4004549 - DNA, 16 bp, Homo sapiens
agaatttgtatgtatt

SEQ ID NO: 4004550 - DNA, 16 bp, Homo sapiens
agaattttaagtgctt

SEQ ID NO: 4004551 - DNA, 13 bp, Homo sapiens
agaattttaatgt

SEQ ID NO: 4004552 - DNA, 18 bp, Homo sapiens
agaattttaatgtgaaga

SEQ ID NO: 4004553 - DNA, 16 bp, Homo sapiens
agaattttacttccat

SEQ ID NO: 4004554 - DNA, 19 bp, Homo sapiens
agaattttacttccattat

SEQ ID NO: 4004555 - DNA, 13 bp, Homo sapiens
agaattttaggaa

SEQ ID NO: 4004556 - DNA, 20 bp, Homo sapiens
agaattttaggaacttcaga

SEQ ID NO: 4004557 - DNA, 18 bp, Homo sapiens
agacaaaaaaatttaaaa

SEQ ID NO: 4004558 - DNA, 14 bp, Homo sapiens
agacaaaaagacaa

SEQ ID NO: 4004559 - DNA, 19 bp, Homo sapiens
ccaccccagcctcgcctgt

SEQ ID NO: 4004560 - DNA, 15 bp, Homo sapiens
ccacccccaccccca

SEQ ID NO: 4004561 - DNA, 16 bp, Homo sapiens
ccacccccagctcaat

SEQ ID NO: 4004562 - DNA, 14 bp, Homo sapiens
ccaccccctgccct

SEQ ID NO: 4004563 - DNA, 15 bp, Homo sapiens
ccaccccctgccctg

SEQ ID NO: 4004564 - DNA, 16 bp, Homo sapiens
ccaccccctgccctgc

SEQ ID NO: 4004565 - DNA, 18 bp, Homo sapiens
ccacccccttctctgctc

SEQ ID NO: 4004566 - DNA, 20 bp, Homo sapiens
ccacccccttctctgctcca

SEQ ID NO: 4004567 - DNA, 14 bp, Homo sapiens
ccaccccgggctct

SEQ ID NO: 4004568 - DNA, 17 bp, Homo sapiens
ccaccccgggctctctg

SEQ ID NO: 4004569 - DNA, 20 bp, Homo sapiens
ccaccccggggaccctgtga

SEQ ID NO: 4004570 - DNA, 15 bp, Homo sapiens
ccacccctacacaca

SEQ ID NO: 4004571 - DNA, 15 bp, Homo sapiens
ccacccgaaatgcca

SEQ ID NO: 4004572 - DNA, 14 bp, Homo sapiens
ccacccgacctggc

SEQ ID NO: 4004573 - DNA, 21 bp, Homo sapiens
ccacccgccccgcgcacccca

SEQ ID NO: 4004574 - DNA, 18 bp, Homo sapiens
ccacccgggggagcccag

SEQ ID NO: 4004575 - DNA, 20 bp, Homo sapiens
ccacccgggggagcccagtg

SEQ ID NO: 4004576 - DNA, 17 bp, Homo sapiens
ccacccggttcagtgtt

SEQ ID NO: 4004577 - DNA, 17 bp, Homo sapiens
ccaccctccatgctcct

SEQ ID NO: 4004578 - DNA, 14 bp, Homo sapiens
ccaccctcctcctc

SEQ ID NO: 4004579 - DNA, 12 bp, Homo sapiens
ccaccctcctgc

SEQ ID NO: 4004580 - DNA, 21 bp, Homo sapiens
ccaccctcctgccccacactc

SEQ ID NO: 4004581 - DNA, 14 bp, Homo sapiens
ccaccctccttccc

SEQ ID NO: 4004582 - DNA, 15 bp, Homo sapiens
ccaccctgctcctcc

SEQ ID NO: 4004583 - DNA, 13 bp, Homo sapiens
ccaccctgtgcca

SEQ ID NO: 4004584 - DNA, 14 bp, Homo sapiens
ccacccttcccctc

SEQ ID NO: 4004585 - DNA, 15 bp, Homo sapiens
ccaccgaccaactgc

SEQ ID NO: 4004586 - DNA, 19 bp, Homo sapiens
ccaccgaccaactgcccta

SEQ ID NO: 4004587 - DNA, 17 bp, Homo sapiens
ccaccgatggagccccc

SEQ ID NO: 4004588 - DNA, 20 bp, Homo sapiens
ccaccgatggagcccccaga

SEQ ID NO: 4004589 - DNA, 21 bp, Homo sapiens
ccaccgatggagcccccagat

SEQ ID NO: 4004590 - DNA, 19 bp, Homo sapiens
ccaccgggacagacctgga

SEQ ID NO: 4004591 - DNA, 21 bp, Homo sapiens
ccaccgggacagacctggaca

SEQ ID NO: 4004592 - DNA, 17 bp, Homo sapiens
ccaccgggagcctcccc

SEQ ID NO: 4004593 - DNA, 15 bp, Homo sapiens
ccaccgtgaaccaga

SEQ ID NO: 4004594 - DNA, 13 bp, Homo sapiens
ccaccgtgcctgg

SEQ ID NO: 4004595 - DNA, 16 bp, Homo sapiens
ccaccgtgcctggcta

SEQ ID NO: 4004596 - DNA, 16 bp, Homo sapiens
ccaccgtggaggagga

SEQ ID NO: 4004597 - DNA, 18 bp, Homo sapiens
ccacctcacccggcctct

SEQ ID NO: 4004598 - DNA, 15 bp, Homo sapiens
ccacctcactcctgt

SEQ ID NO: 4004599 - DNA, 13 bp, Homo sapiens
ccacctccaccca

SEQ ID NO: 4004600 - DNA, 16 bp, Homo sapiens
ccacctccacccagcc

SEQ ID NO: 4004601 - DNA, 17 bp, Homo sapiens
ccacctccacccagccc

SEQ ID NO: 4004602 - DNA, 22 bp, Homo sapiens
ccacctccacccagcccctggc

SEQ ID NO: 4004603 - DNA, 14 bp, Homo sapiens
ccacctccactccc

SEQ ID NO: 4004604 - DNA, 23 bp, Homo sapiens
ccacctctccaagtctctctgtg

SEQ ID NO: 4004605 - DNA, 19 bp, Homo sapiens
ccacctctctcctttgctg

SEQ ID NO: 4004606 - DNA, 18 bp, Homo sapiens
ccacctctgtcatttgtt

SEQ ID NO: 4004607 - DNA, 14 bp, Homo sapiens
ccacctctgtggca

SEQ ID NO: 4004608 - DNA, 12 bp, Homo sapiens
ccacctgcagct

SEQ ID NO: 4004609 - DNA, 15 bp, Homo sapiens
ccacctgcagctccc

SEQ ID NO: 4004610 - DNA, 14 bp, Homo sapiens
ccacctgcccatca

SEQ ID NO: 4004611 - DNA, 15 bp, Homo sapiens
ccacctgcccatcac

SEQ ID NO: 4004612 - DNA, 16 bp, Homo sapiens
ccacctgcccatcaca

SEQ ID NO: 4004613 - DNA, 15 bp, Homo sapiens
ccacctgccttggcc

SEQ ID NO: 4004614 - DNA, 14 bp, Homo sapiens
ccacctgcttctga

SEQ ID NO: 4004615 - DNA, 22 bp, Homo sapiens
ccacctggcaaaggacccttga

SEQ ID NO: 4004616 - DNA, 15 bp, Homo sapiens
ccacctgtctcagcc

SEQ ID NO: 4004617 - DNA, 20 bp, Homo sapiens
ccacctgtctcagcctccca

SEQ ID NO: 4004618 - DNA, 11 bp, Homo sapiens
ccacctgtggg

SEQ ID NO: 4004619 - DNA, 11 bp, Homo sapiens
ccaccttccca

SEQ ID NO: 4004620 - DNA, 22 bp, Homo sapiens
ccaccttctgtccccagccctg

SEQ ID NO: 4004621 - DNA, 19 bp, Homo sapiens
ccaccttggctctgccagt

SEQ ID NO: 4004622 - DNA, 22 bp, Homo sapiens
ccaccttggctctgccagtgga

SEQ ID NO: 4004623 - DNA, 19 bp, Homo sapiens
ccacgaatttgctggggaa

SEQ ID NO: 4004624 - DNA, 16 bp, Homo sapiens
ccacgagagcgcagca

SEQ ID NO: 4004625 - DNA, 12 bp, Homo sapiens
ccacgagggctg

SEQ ID NO: 4004626 - DNA, 20 bp, Homo sapiens
ccacgagggctggctggcct

SEQ ID NO: 4004627 - DNA, 15 bp, Homo sapiens
ccacgcactgggcca

SEQ ID NO: 4004628 - DNA, 19 bp, Homo sapiens
ccacgcactgggccacgga

SEQ ID NO: 4004629 - DNA, 21 bp, Homo sapiens
ccacgcactgggccacggagg

SEQ ID NO: 4004630 - DNA, 12 bp, Homo sapiens
ccacgcagttct

SEQ ID NO: 4004631 - DNA, 12 bp, Homo sapiens
ccacgccctgtt

SEQ ID NO: 4004632 - DNA, 14 bp, Homo sapiens
ccacgcctcctggc

SEQ ID NO: 4004633 - DNA, 15 bp, Homo sapiens
ccacgcctcctggcc

SEQ ID NO: 4004634 - DNA, 16 bp, Homo sapiens
ccacgcctcctggcca

SEQ ID NO: 4004635 - DNA, 19 bp, Homo sapiens
ccacgcctcctggccagac

SEQ ID NO: 4004636 - DNA, 11 bp, Homo sapiens
ccacgctgtcc

SEQ ID NO: 4004637 - DNA, 12 bp, Homo sapiens
ccacgctgtcct

SEQ ID NO: 4004638 - DNA, 13 bp, Homo sapiens
ccacgctgtcctc

SEQ ID NO: 4004639 - DNA, 23 bp, Homo sapiens
ccacggaggagggatgctgctcc

SEQ ID NO: 4004640 - DNA, 18 bp, Homo sapiens
ccacggctgagccttcag

SEQ ID NO: 4004641 - DNA, 19 bp, Homo sapiens
ccacggctgagccttcaga

SEQ ID NO: 4004642 - DNA, 13 bp, Homo sapiens
ccacgtcccagca

SEQ ID NO: 4004643 - DNA, 17 bp, Homo sapiens
ccacgtgacagtgcctg

SEQ ID NO: 4004644 - DNA, 23 bp, Homo sapiens
ccacgtggtcactgtgcactgcc

SEQ ID NO: 4004645 - DNA, 12 bp, Homo sapiens
ccacgtgtcttc

SEQ ID NO: 4004646 - DNA, 21 bp, Homo sapiens
ccactaaagcttcagactcaa

SEQ ID NO: 4004647 - DNA, 22 bp, Homo sapiens
ccactaaagcttcagactcaag

SEQ ID NO: 4004648 - DNA, 14 bp, Homo sapiens
ccactaaatgagct

SEQ ID NO: 4004649 - DNA, 20 bp, Homo sapiens
ccactaaatgagctcctgcg

SEQ ID NO: 4004650 - DNA, 18 bp, Homo sapiens
ccactaactcctgagaaa

SEQ ID NO: 4004651 - DNA, 22 bp, Homo sapiens
ccactacatgcagcccatgccc

SEQ ID NO: 4004652 - DNA, 13 bp, Homo sapiens
ccactactgcagc

SEQ ID NO: 4004653 - DNA, 23 bp, Homo sapiens
ccactaggaatcccagaggtggg

SEQ ID NO: 4004654 - DNA, 20 bp, Homo sapiens
ccactcaaattaatctttct

SEQ ID NO: 4004655 - DNA, 12 bp, Homo sapiens
ccactcaccccc

SEQ ID NO: 4004656 - DNA, 18 bp, Homo sapiens
ccactcaccccctttgct

SEQ ID NO: 4004657 - DNA, 18 bp, Homo sapiens
ccactcaggcatttgact

SEQ ID NO: 4004658 - DNA, 16 bp, Homo sapiens
ccactccaagccagca

SEQ ID NO: 4004659 - DNA, 15 bp, Homo sapiens
ccactccacaaatga

SEQ ID NO: 4004660 - DNA, 17 bp, Homo sapiens
ccactccagacccctgg

SEQ ID NO: 4004661 - DNA, 20 bp, Homo sapiens
ccactccagacccctggctt

SEQ ID NO: 4004662 - DNA, 22 bp, Homo sapiens
ccactccagacccctggctttt

SEQ ID NO: 4004663 - DNA, 16 bp, Homo sapiens
ccagcccagccaggcc

SEQ ID NO: 4004664 - DNA, 15 bp, Homo sapiens
ccagccccacacagc

SEQ ID NO: 4004665 - DNA, 14 bp, Homo sapiens
ccagccccacccag

SEQ ID NO: 4004666 - DNA, 19 bp, Homo sapiens
ccagccccaccctgttttg

SEQ ID NO: 4004667 - DNA, 16 bp, Homo sapiens
ccagcccccgccccag

SEQ ID NO: 4004668 - DNA, 20 bp, Homo sapiens
ccagcccccgccccagagtg

SEQ ID NO: 4004669 - DNA, 19 bp, Homo sapiens
ccagccccggcaagccaca

SEQ ID NO: 4004670 - DNA, 17 bp, Homo sapiens
ccagccccggccctggg

SEQ ID NO: 4004671 - DNA, 18 bp, Homo sapiens
ccagccccggccctgggc

SEQ ID NO: 4004672 - DNA, 13 bp, Homo sapiens
ccagcccctggcc

SEQ ID NO: 4004673 - DNA, 23 bp, Homo sapiens
ccagcccctggccccaggacctg

SEQ ID NO: 4004674 - DNA, 14 bp, Homo sapiens
ccagcccctggggc

SEQ ID NO: 4004675 - DNA, 16 bp, Homo sapiens
ccagccccttctccca

SEQ ID NO: 4004676 - DNA, 21 bp, Homo sapiens
ccagccccttctcccagcaca

SEQ ID NO: 4004677 - DNA, 21 bp, Homo sapiens
ccagccctccccatggagcca

SEQ ID NO: 4004678 - DNA, 13 bp, Homo sapiens
ccagccctgcagc

SEQ ID NO: 4004679 - DNA, 15 bp, Homo sapiens
ccagccctgtcctgg

SEQ ID NO: 4004680 - DNA, 18 bp, Homo sapiens
ccagcccttcctctgctc

SEQ ID NO: 4004681 - DNA, 20 bp, Homo sapiens
ccagccctttgggaggccga

SEQ ID NO: 4004682 - DNA, 20 bp, Homo sapiens
ccagccgccattgccaccag

SEQ ID NO: 4004683 - DNA, 15 bp, Homo sapiens
ccagccgccccagcc

SEQ ID NO: 4004684 - DNA, 13 bp, Homo sapiens
ccagccggggcct

SEQ ID NO: 4004685 - DNA, 19 bp, Homo sapiens
ccagccgtgatgctcaggc

SEQ ID NO: 4004686 - DNA, 20 bp, Homo sapiens
ccagccgtgatgctcaggct

SEQ ID NO: 4004687 - DNA, 14 bp, Homo sapiens
ccagcctccctgtc

SEQ ID NO: 4004688 - DNA, 19 bp, Homo sapiens
ccagcctccctgtctccag

SEQ ID NO: 4004689 - DNA, 20 bp, Homo sapiens
ccagcctccctgtctccagc

SEQ ID NO: 4004690 - DNA, 23 bp, Homo sapiens
ccagcctccctgtctccagctgc

SEQ ID NO: 4004691 - DNA, 19 bp, Homo sapiens
ccagcctccgagagggaga

SEQ ID NO: 4004692 - DNA, 13 bp, Homo sapiens
ccagcctcgcctg

SEQ ID NO: 4004693 - DNA, 15 bp, Homo sapiens
ccagcctctttccct

SEQ ID NO: 4004694 - DNA, 14 bp, Homo sapiens
ccagcctgacctga

SEQ ID NO: 4004695 - DNA, 17 bp, Homo sapiens
ccagcctgacctgagac

SEQ ID NO: 4004696 - DNA, 19 bp, Homo sapiens
ccagcctgggcaacagagc

SEQ ID NO: 4004697 - DNA, 23 bp, Homo sapiens
ccagcctgggcagccaggctgcc

SEQ ID NO: 4004698 - DNA, 12 bp, Homo sapiens
ccagcctgggcc

SEQ ID NO: 4004699 - DNA, 23 bp, Homo sapiens
ccagcctgtcccatggacactcc

SEQ ID NO: 4004700 - DNA, 12 bp, Homo sapiens
ccagcctgtggt

SEQ ID NO: 4004701 - DNA, 18 bp, Homo sapiens
ccagccttgagccctggc

SEQ ID NO: 4004702 - DNA, 18 bp, Homo sapiens
ccagcgcggccagcgtcc

SEQ ID NO: 4004703 - DNA, 14 bp, Homo sapiens
ccagcgggcacagg

SEQ ID NO: 4004704 - DNA, 15 bp, Homo sapiens
ccagcgggcacaggg

SEQ ID NO: 4004705 - DNA, 16 bp, Homo sapiens
ccagcgggcacagggc

SEQ ID NO: 4004706 - DNA, 19 bp, Homo sapiens
ccagcgggcacagggcacc

SEQ ID NO: 4004707 - DNA, 22 bp, Homo sapiens
ccagcgggcacagggcaccaga

SEQ ID NO: 4004708 - DNA, 12 bp, Homo sapiens
ccagcgggcaga

SEQ ID NO: 4004709 - DNA, 22 bp, Homo sapiens
ccagcgggcagatgggcggacg

SEQ ID NO: 4004710 - DNA, 14 bp, Homo sapiens
ccagcggggctgct

SEQ ID NO: 4004711 - DNA, 13 bp, Homo sapiens
ccagcgtcccagg

SEQ ID NO: 4004712 - DNA, 15 bp, Homo sapiens
ccagcgtcccagtct

SEQ ID NO: 4004713 - DNA, 19 bp, Homo sapiens
ccagctaagaacctggaac

SEQ ID NO: 4004714 - DNA, 17 bp, Homo sapiens
ccagctaatctgtaggg

SEQ ID NO: 4004715 - DNA, 22 bp, Homo sapiens
ccagctaatctgtagggctgga

SEQ ID NO: 4004716 - DNA, 14 bp, Homo sapiens
ccagctaccccttc

SEQ ID NO: 4004717 - DNA, 20 bp, Homo sapiens
ccagctaccccttctttgca

SEQ ID NO: 4004718 - DNA, 21 bp, Homo sapiens
ccagctaccctttttctccag

SEQ ID NO: 4004719 - DNA, 13 bp, Homo sapiens
ccagctactaagg

SEQ ID NO: 4004720 - DNA, 14 bp, Homo sapiens
ccagctacttggga

SEQ ID NO: 4004721 - DNA, 15 bp, Homo sapiens
ccagctacttgggag

SEQ ID NO: 4004722 - DNA, 17 bp, Homo sapiens
ccagctacttgggaggc

SEQ ID NO: 4004723 - DNA, 14 bp, Homo sapiens
ccagctcagaggcc

SEQ ID NO: 4004724 - DNA, 22 bp, Homo sapiens
ccagctcagtcccatcagagag

SEQ ID NO: 4004725 - DNA, 20 bp, Homo sapiens
ccagctccaggggcccttgg

SEQ ID NO: 4004726 - DNA, 14 bp, Homo sapiens
ccagctccctctat

SEQ ID NO: 4004727 - DNA, 19 bp, Homo sapiens
ccagctccggcctgtcctc

SEQ ID NO: 4004728 - DNA, 20 bp, Homo sapiens
ccagctccggcctgtcctcc

SEQ ID NO: 4004729 - DNA, 11 bp, Homo sapiens
ccagctcttgg

SEQ ID NO: 4004730 - DNA, 16 bp, Homo sapiens
ccagctcttggcccct

SEQ ID NO: 4004731 - DNA, 12 bp, Homo sapiens
ccagctgcagcc

SEQ ID NO: 4004732 - DNA, 16 bp, Homo sapiens
ccagctgcaggaatca

SEQ ID NO: 4004733 - DNA, 19 bp, Homo sapiens
ccagctgcaggaatcaaaa

SEQ ID NO: 4004734 - DNA, 20 bp, Homo sapiens
ccagctgcaggaatcaaaaa

SEQ ID NO: 4004735 - DNA, 11 bp, Homo sapiens
ccagctgcctg

SEQ ID NO: 4004736 - DNA, 13 bp, Homo sapiens
ccagctgcctgga

SEQ ID NO: 4004737 - DNA, 19 bp, Homo sapiens
ccagctgcctggagagggt

SEQ ID NO: 4004738 - DNA, 18 bp, Homo sapiens
ccagctgcgcttgctttt

SEQ ID NO: 4004739 - DNA, 20 bp, Homo sapiens
ccagctgcgcttgcttttct

SEQ ID NO: 4004740 - DNA, 13 bp, Homo sapiens
ccagctgctgtct

SEQ ID NO: 4004741 - DNA, 14 bp, Homo sapiens
ccagctgctgtctt

SEQ ID NO: 4004742 - DNA, 18 bp, Homo sapiens
ccagctgggagcactggt

SEQ ID NO: 4004743 - DNA, 19 bp, Homo sapiens
ccagctgggctctgcaatt

SEQ ID NO: 4004744 - DNA, 15 bp, Homo sapiens
ccagctggggccaga

SEQ ID NO: 4004745 - DNA, 16 bp, Homo sapiens
ccagctggggccagag

SEQ ID NO: 4004746 - DNA, 19 bp, Homo sapiens
ccagctggggccagaggct

SEQ ID NO: 4004747 - DNA, 16 bp, Homo sapiens
ccagctgggtcaggca

SEQ ID NO: 4004748 - DNA, 12 bp, Homo sapiens
ccagctgggtct

SEQ ID NO: 4004749 - DNA, 22 bp, Homo sapiens
ccagctgtgcagcacgtctcag

SEQ ID NO: 4004750 - DNA, 13 bp, Homo sapiens
ccagctgtgtcct

SEQ ID NO: 4004751 - DNA, 16 bp, Homo sapiens
ccagcttcacttctga

SEQ ID NO: 4004752 - DNA, 16 bp, Homo sapiens
ccagcttcaggcacca

SEQ ID NO: 4004753 - DNA, 14 bp, Homo sapiens
ccagcttctccagg

SEQ ID NO: 4004754 - DNA, 16 bp, Homo sapiens
ccagcttctccaggct

SEQ ID NO: 4004755 - DNA, 17 bp, Homo sapiens
ccagcttctccaggctc

SEQ ID NO: 4004756 - DNA, 15 bp, Homo sapiens
ccagcttctctctcc

SEQ ID NO: 4004757 - DNA, 16 bp, Homo sapiens
ccagcttctctctcca

SEQ ID NO: 4004758 - DNA, 17 bp, Homo sapiens
ccagcttctctctccag

SEQ ID NO: 4004759 - DNA, 16 bp, Homo sapiens
ccagctttaaaaagaa

SEQ ID NO: 4004760 - DNA, 17 bp, Homo sapiens
ccagctttaaaaagaaa

SEQ ID NO: 4004761 - DNA, 19 bp, Homo sapiens
ccagctttaaaaagaaaaa

SEQ ID NO: 4004762 - DNA, 17 bp, Homo sapiens
ccagcttttactgtttt

SEQ ID NO: 4004763 - DNA, 22 bp, Homo sapiens
ccaggaaactccacatctgcct

SEQ ID NO: 4004764 - DNA, 23 bp, Homo sapiens
ccaggaaactctgcattctagta

SEQ ID NO: 4004765 - DNA, 22 bp, Homo sapiens
ccaggaactcgcacctgtgctg

SEQ ID NO: 4004766 - DNA, 16 bp, Homo sapiens
ccaggaatttcccagg

SEQ ID NO: 4004767 - DNA, 19 bp, Homo sapiens
ccaggaatttcccaggacc

SEQ ID NO: 4004768 - DNA, 17 bp, Homo sapiens
ccaggacaccagtccag

SEQ ID NO: 4004769 - DNA, 17 bp, Homo sapiens
ccaggacatctctgccc

SEQ ID NO: 4004770 - DNA, 14 bp, Homo sapiens
ccaggaccaagcca

SEQ ID NO: 4004771 - DNA, 14 bp, Homo sapiens
ccaggaccagctca

SEQ ID NO: 4004772 - DNA, 17 bp, Homo sapiens
ccaggaccagctcagga

SEQ ID NO: 4004773 - DNA, 14 bp, Homo sapiens
ccaggaccctgaag

SEQ ID NO: 4004774 - DNA, 16 bp, Homo sapiens
ccaggaccctgaaggg

SEQ ID NO: 4004775 - DNA, 18 bp, Homo sapiens
ccaggaccctgaaggggc

SEQ ID NO: 4004776 - DNA, 15 bp, Homo sapiens
ccaggacctggctgc

SEQ ID NO: 4004777 - DNA, 15 bp, Homo sapiens
ccaggacgcttctga

SEQ ID NO: 4004778 - DNA, 16 bp, Homo sapiens
ccaggacgcttctgaa

SEQ ID NO: 4004779 - DNA, 17 bp, Homo sapiens
ccaggacgcttctgaat

SEQ ID NO: 4004780 - DNA, 18 bp, Homo sapiens
ccaggacgcttctgaatg

SEQ ID NO: 4004781 - DNA, 22 bp, Homo sapiens
ccaggacgcttctgaatgctgc

SEQ ID NO: 4004782 - DNA, 19 bp, Homo sapiens
ccaggacgtctggggtgtg

SEQ ID NO: 4004783 - DNA, 18 bp, Homo sapiens
ccaggactatagcccagg

SEQ ID NO: 4004784 - DNA, 15 bp, Homo sapiens
ccaggactccccagg

SEQ ID NO: 4004785 - DNA, 19 bp, Homo sapiens
ccaggactccccaggccag

SEQ ID NO: 4004786 - DNA, 21 bp, Homo sapiens
ccaggactccccaggccaggc

SEQ ID NO: 4004787 - DNA, 16 bp, Homo sapiens
ccaggactccctcctc

SEQ ID NO: 4004788 - DNA, 22 bp, Homo sapiens
ccaggactccctcctcacctct

SEQ ID NO: 4004789 - DNA, 21 bp, Homo sapiens
ccaggacttatttaaactctg

SEQ ID NO: 4004790 - DNA, 15 bp, Homo sapiens
ccaggacttggggtc

SEQ ID NO: 4004791 - DNA, 19 bp, Homo sapiens
ccaggagaaccactacatg

SEQ ID NO: 4004792 - DNA, 21 bp, Homo sapiens
ccaggagaaccactacatgca

SEQ ID NO: 4004793 - DNA, 17 bp, Homo sapiens
ccaggagacagaccact

SEQ ID NO: 4004794 - DNA, 17 bp, Homo sapiens
ccaggagcaatgggact

SEQ ID NO: 4004795 - DNA, 19 bp, Homo sapiens
ccaggagcaatgggactgg

SEQ ID NO: 4004796 - DNA, 18 bp, Homo sapiens
ccaggagctcttcaggcc

SEQ ID NO: 4004797 - DNA, 23 bp, Homo sapiens
ccaggagctcttcaggcctccct

SEQ ID NO: 4004798 - DNA, 21 bp, Homo sapiens
ccaggagcttcttgtttcctt

SEQ ID NO: 4004799 - DNA, 18 bp, Homo sapiens
ccaggagggcatccatac

SEQ ID NO: 4004800 - DNA, 19 bp, Homo sapiens
ccaggagtcccactccaag

SEQ ID NO: 4004801 - DNA, 23 bp, Homo sapiens
ccaggagtcccactccaagccag

SEQ ID NO: 4004802 - DNA, 17 bp, Homo sapiens
ccaggagtttgagacca

SEQ ID NO: 4004803 - DNA, 18 bp, Homo sapiens
ccaggagtttgagaccag

SEQ ID NO: 4004804 - DNA, 15 bp, Homo sapiens
ccaggataaggagac

SEQ ID NO: 4004805 - DNA, 17 bp, Homo sapiens
ccaggataaggagactg

SEQ ID NO: 4004806 - DNA, 20 bp, Homo sapiens
ccaggataaggagactgagg

SEQ ID NO: 4004807 - DNA, 21 bp, Homo sapiens
ccaggataaggagactgaggc

SEQ ID NO: 4004808 - DNA, 23 bp, Homo sapiens
ccaggataaggagactgaggctt

SEQ ID NO: 4004809 - DNA, 14 bp, Homo sapiens
ccaggatcatggtg

SEQ ID NO: 4004810 - DNA, 15 bp, Homo sapiens
ccaggatcatggtgt

SEQ ID NO: 4004811 - DNA, 17 bp, Homo sapiens
ccaggatcatggtgtaa

SEQ ID NO: 4004812 - DNA, 20 bp, Homo sapiens
ccaggatcatggtgtaataa

SEQ ID NO: 4004813 - DNA, 17 bp, Homo sapiens
ccaggatcccaggggcc

SEQ ID NO: 4004814 - DNA, 18 bp, Homo sapiens
ccaggatgacccctgggc

SEQ ID NO: 4004815 - DNA, 21 bp, Homo sapiens
ccaggatgataagttcctttc

SEQ ID NO: 4004816 - DNA, 21 bp, Homo sapiens
ccaggatggaacacggccaca

SEQ ID NO: 4004817 - DNA, 17 bp, Homo sapiens
ccaggatggactcttct

SEQ ID NO: 4004818 - DNA, 18 bp, Homo sapiens
ccaggatggactcttctc

SEQ ID NO: 4004819 - DNA, 16 bp, Homo sapiens
ccaggattgaagagca

SEQ ID NO: 4004820 - DNA, 18 bp, Homo sapiens
ccaggattgaagagcatt

SEQ ID NO: 4004821 - DNA, 19 bp, Homo sapiens
ccaggcacacacagcccct

SEQ ID NO: 4004822 - DNA, 11 bp, Homo sapiens
ccaggcacagg

SEQ ID NO: 4004823 - DNA, 12 bp, Homo sapiens
ccaggcacaggg

SEQ ID NO: 4004824 - DNA, 16 bp, Homo sapiens
ccaggcacagggcccg

SEQ ID NO: 4004825 - DNA, 17 bp, Homo sapiens
ccaggcacagggcccgc

SEQ ID NO: 4004826 - DNA, 19 bp, Homo sapiens
ccaggcacccagctttgtc

SEQ ID NO: 4004827 - DNA, 16 bp, Homo sapiens
ccaggcaccccctgga

SEQ ID NO: 4004828 - DNA, 17 bp, Homo sapiens
ccaggcaccccctggag

SEQ ID NO: 4004829 - DNA, 18 bp, Homo sapiens
ccaggcaccccctggaga

SEQ ID NO: 4004830 - DNA, 13 bp, Homo sapiens
aggagggggaggg

SEQ ID NO: 4004831 - DNA, 21 bp, Homo sapiens
aggagggtgggggagggaggt

SEQ ID NO: 4004832 - DNA, 14 bp, Homo sapiens
aggaggtgcctgga

SEQ ID NO: 4004833 - DNA, 13 bp, Homo sapiens
aggaggtgtgagg

SEQ ID NO: 4004834 - DNA, 19 bp, Homo sapiens
aggaggttggagggaaagc

SEQ ID NO: 4004835 - DNA, 19 bp, Homo sapiens
aggagtaacaatacaaatg

SEQ ID NO: 4004836 - DNA, 16 bp, Homo sapiens
aggagtcccaaggaaa

SEQ ID NO: 4004837 - DNA, 17 bp, Homo sapiens
aggagtcccaaggaaag

SEQ ID NO: 4004838 - DNA, 18 bp, Homo sapiens
aggagtctctgccaccca

SEQ ID NO: 4004839 - DNA, 21 bp, Homo sapiens
aggagtgagatcattttctta

SEQ ID NO: 4004840 - DNA, 22 bp, Homo sapiens
aggagtgattgaaccagctcat

SEQ ID NO: 4004841 - DNA, 16 bp, Homo sapiens
aggagtgcagccttct

SEQ ID NO: 4004842 - DNA, 17 bp, Homo sapiens
aggagtgcagccttctc

SEQ ID NO: 4004843 - DNA, 22 bp, Homo sapiens
aggagtgcgtggcccaccaggc

SEQ ID NO: 4004844 - DNA, 12 bp, Homo sapiens
aggagtggttct

SEQ ID NO: 4004845 - DNA, 18 bp, Homo sapiens
aggagtgtcctgcccatg

SEQ ID NO: 4004846 - DNA, 18 bp, Homo sapiens
aggagtgtgtgatttttt

SEQ ID NO: 4004847 - DNA, 16 bp, Homo sapiens
aggagttaagagtagc

SEQ ID NO: 4004848 - DNA, 18 bp, Homo sapiens
aggagttacagggaagtg

SEQ ID NO: 4004849 - DNA, 17 bp, Homo sapiens
aggagttcgaggctgca

SEQ ID NO: 4004850 - DNA, 20 bp, Homo sapiens
aggagttgtttctgacccac

SEQ ID NO: 4004851 - DNA, 21 bp, Homo sapiens
aggagttttctccatatcaaa

SEQ ID NO: 4004852 - DNA, 13 bp, Homo sapiens
aggatactctgtc

SEQ ID NO: 4004853 - DNA, 15 bp, Homo sapiens
aggatactgcctccc

SEQ ID NO: 4004854 - DNA, 21 bp, Homo sapiens
aggatatccttatcagagcta

SEQ ID NO: 4004855 - DNA, 22 bp, Homo sapiens
aggatatccttatcagagctaa

SEQ ID NO: 4004856 - DNA, 18 bp, Homo sapiens
aggatatttaagaaaata

SEQ ID NO: 4004857 - DNA, 15 bp, Homo sapiens
aggatcagttaacta

SEQ ID NO: 4004858 - DNA, 17 bp, Homo sapiens
aggatcagttaactatt

SEQ ID NO: 4004859 - DNA, 13 bp, Homo sapiens
aggatcagttttt

SEQ ID NO: 4004860 - DNA, 18 bp, Homo sapiens
aggatcatggtgtaataa

SEQ ID NO: 4004861 - DNA, 13 bp, Homo sapiens
aggatccagagag

SEQ ID NO: 4004862 - DNA, 20 bp, Homo sapiens
aggatcctattctcaccagg

SEQ ID NO: 4004863 - DNA, 14 bp, Homo sapiens
aggatcctctccac

SEQ ID NO: 4004864 - DNA, 17 bp, Homo sapiens
aggatcggactctgccc

SEQ ID NO: 4004865 - DNA, 16 bp, Homo sapiens
aggatctagaatgtgt

SEQ ID NO: 4004866 - DNA, 17 bp, Homo sapiens
aggatgagagcccagag

SEQ ID NO: 4004867 - DNA, 19 bp, Homo sapiens
aggatgagagcccagaggt

SEQ ID NO: 4004868 - DNA, 20 bp, Homo sapiens
aggatgagagcccagaggta

SEQ ID NO: 4004869 - DNA, 18 bp, Homo sapiens
aggatgataagttccttt

SEQ ID NO: 4004870 - DNA, 17 bp, Homo sapiens
aggatgctaacatctaa

SEQ ID NO: 4004871 - DNA, 19 bp, Homo sapiens
aggatgctaacatctaaaa

SEQ ID NO: 4004872 - DNA, 12 bp, Homo sapiens
aggatggagggg

SEQ ID NO: 4004873 - DNA, 18 bp, Homo sapiens
aggatggcctttccttcc

SEQ ID NO: 4004874 - DNA, 20 bp, Homo sapiens
aggatggcctttccttccct

SEQ ID NO: 4004875 - DNA, 22 bp, Homo sapiens
aggatggcctttccttccctct

SEQ ID NO: 4004876 - DNA, 16 bp, Homo sapiens
aggatgggtcagagct

SEQ ID NO: 4004877 - DNA, 22 bp, Homo sapiens
aggatgtagttctgccaggcaa

SEQ ID NO: 4004878 - DNA, 16 bp, Homo sapiens
aggatgtcacagggcc

SEQ ID NO: 4004879 - DNA, 21 bp, Homo sapiens
aggatgtccctgggccagggt

SEQ ID NO: 4004880 - DNA, 16 bp, Homo sapiens
aggatgtggaaagcac

SEQ ID NO: 4004881 - DNA, 23 bp, Homo sapiens
aggatgttttgtcccatttcctt

SEQ ID NO: 4004882 - DNA, 14 bp, Homo sapiens
aggattataaatga

SEQ ID NO: 4004883 - DNA, 18 bp, Homo sapiens
aggattatgggtcctgca

SEQ ID NO: 4004884 - DNA, 21 bp, Homo sapiens
aggattatgggtcctgcaatt

SEQ ID NO: 4004885 - DNA, 14 bp, Homo sapiens
aggattcaggggct

SEQ ID NO: 4004886 - DNA, 18 bp, Homo sapiens
aggattctcaccagctgt

SEQ ID NO: 4004887 - DNA, 20 bp, Homo sapiens
aggattctcaccagctgtgt

SEQ ID NO: 4004888 - DNA, 22 bp, Homo sapiens
aggattctcaccagctgtgtcc

SEQ ID NO: 4004889 - DNA, 22 bp, Homo sapiens
aggattgcttgagcccaggagt

SEQ ID NO: 4004890 - DNA, 20 bp, Homo sapiens
aggattgttgaatctatttc

SEQ ID NO: 4004891 - DNA, 16 bp, Homo sapiens
aggatttaacagtcat

SEQ ID NO: 4004892 - DNA, 19 bp, Homo sapiens
aggatttcatgatttcatt

SEQ ID NO: 4004893 - DNA, 16 bp, Homo sapiens
aggatttttttctgag

SEQ ID NO: 4004894 - DNA, 17 bp, Homo sapiens
aggatttttttctgagc

SEQ ID NO: 4004895 - DNA, 20 bp, Homo sapiens
aggcaaaaaagggacagcat

SEQ ID NO: 4004896 - DNA, 15 bp, Homo sapiens
aggcaaaaatgtaaa

SEQ ID NO: 4004897 - DNA, 20 bp, Homo sapiens
aggcaaaattgcaaatcttg

SEQ ID NO: 4004898 - DNA, 19 bp, Homo sapiens
aggcaacttttaaagctca

SEQ ID NO: 4004899 - DNA, 16 bp, Homo sapiens
aggcaagattgatgtt

SEQ ID NO: 4004900 - DNA, 20 bp, Homo sapiens
agagtgtgggggaggcgcac

SEQ ID NO: 4004901 - DNA, 18 bp, Homo sapiens
agagttaagaagctgttg

SEQ ID NO: 4004902 - DNA, 14 bp, Homo sapiens
agagttaagaatgt

SEQ ID NO: 4004903 - DNA, 15 bp, Homo sapiens
agagttcacaggagg

SEQ ID NO: 4004904 - DNA, 18 bp, Homo sapiens
agagttcacaggaggcca

SEQ ID NO: 4004905 - DNA, 12 bp, Homo sapiens
agagttcctcct

SEQ ID NO: 4004906 - DNA, 22 bp, Homo sapiens
agagtttagctgtaacagttct

SEQ ID NO: 4004907 - DNA, 14 bp, Homo sapiens
agagtttctgtttg

SEQ ID NO: 4004908 - DNA, 17 bp, Homo sapiens
agagtttgttctgttct

SEQ ID NO: 4004909 - DNA, 22 bp, Homo sapiens
agagtttgttctgttctggggg

SEQ ID NO: 4004910 - DNA, 15 bp, Homo sapiens
agataaagatgatct

SEQ ID NO: 4004911 - DNA, 13 bp, Homo sapiens
agataaattataa

SEQ ID NO: 4004912 - DNA, 21 bp, Homo sapiens
agataacaagatctttcagga

SEQ ID NO: 4004913 - DNA, 21 bp, Homo sapiens
agataacaatgcagcaaggcc

SEQ ID NO: 4004914 - DNA, 18 bp, Homo sapiens
agataagtgtatttttca

SEQ ID NO: 4004915 - DNA, 20 bp, Homo sapiens
agataagtgtatttttcaat

SEQ ID NO: 4004916 - DNA, 12 bp, Homo sapiens
agataataagat

SEQ ID NO: 4004917 - DNA, 22 bp, Homo sapiens
agataataatgggtttctttca

SEQ ID NO: 4004918 - DNA, 16 bp, Homo sapiens
agataatatctgtgag

SEQ ID NO: 4004919 - DNA, 21 bp, Homo sapiens
agataatatctgtgaggtgct

SEQ ID NO: 4004920 - DNA, 15 bp, Homo sapiens
agataatattactgt

SEQ ID NO: 4004921 - DNA, 12 bp, Homo sapiens
agataattataa

SEQ ID NO: 4004922 - DNA, 16 bp, Homo sapiens
agataattcttaaaag

SEQ ID NO: 4004923 - DNA, 18 bp, Homo sapiens
agataattgttgaaattt

SEQ ID NO: 4004924 - DNA, 14 bp, Homo sapiens
agataatttgcata

SEQ ID NO: 4004925 - DNA, 21 bp, Homo sapiens
agataatttgcatattctatt

SEQ ID NO: 4004926 - DNA, 18 bp, Homo sapiens
agatacaaattaatttta

SEQ ID NO: 4004927 - DNA, 20 bp, Homo sapiens
agatacaagtttcagacagg

SEQ ID NO: 4004928 - DNA, 14 bp, Homo sapiens
agatacgactttat

SEQ ID NO: 4004929 - DNA, 21 bp, Homo sapiens
agatactggaagttttgcatt

SEQ ID NO: 4004930 - DNA, 13 bp, Homo sapiens
agatactggtgga

SEQ ID NO: 4004931 - DNA, 21 bp, Homo sapiens
agatacttggtcacagccagg

SEQ ID NO: 4004932 - DNA, 22 bp, Homo sapiens
agatacttggtcacagccaggc

SEQ ID NO: 4004933 - DNA, 11 bp, Homo sapiens
agatagaaata

SEQ ID NO: 4004934 - DNA, 13 bp, Homo sapiens
agatagagaaata

SEQ ID NO: 4004935 - DNA, 15 bp, Homo sapiens
agatagagaaatagt

SEQ ID NO: 4004936 - DNA, 14 bp, Homo sapiens
agatagagctgggt

SEQ ID NO: 4004937 - DNA, 13 bp, Homo sapiens
agatagctgcatg

SEQ ID NO: 4004938 - DNA, 14 bp, Homo sapiens
agatagctgcatgt

SEQ ID NO: 4004939 - DNA, 16 bp, Homo sapiens
agataggctctgcaca

SEQ ID NO: 4004940 - DNA, 15 bp, Homo sapiens
agataggtaaatacc

SEQ ID NO: 4004941 - DNA, 11 bp, Homo sapiens
agatagtttat

SEQ ID NO: 4004942 - DNA, 17 bp, Homo sapiens
agatataacattcagtt

SEQ ID NO: 4004943 - DNA, 21 bp, Homo sapiens
agatatatctgaaaactggaa

SEQ ID NO: 4004944 - DNA, 14 bp, Homo sapiens
agatatatgccttc

SEQ ID NO: 4004945 - DNA, 15 bp, Homo sapiens
agatatcaaaattct

SEQ ID NO: 4004946 - DNA, 13 bp, Homo sapiens
agatatccatctt

SEQ ID NO: 4004947 - DNA, 22 bp, Homo sapiens
agatatcccagctttaaaaaga

SEQ ID NO: 4004948 - DNA, 22 bp, Homo sapiens
agatatggagtgagtcacctgc

SEQ ID NO: 4004949 - DNA, 14 bp, Homo sapiens
agatattgtacata

SEQ ID NO: 4004950 - DNA, 21 bp, Homo sapiens
agatattgtgaagtacatatt

SEQ ID NO: 4004951 - DNA, 19 bp, Homo sapiens
agatattgttcaaacaata

SEQ ID NO: 4004952 - DNA, 17 bp, Homo sapiens
agatattgttttctgta

SEQ ID NO: 4004953 - DNA, 22 bp, Homo sapiens
agatattgttttctgtaaataa

SEQ ID NO: 4004954 - DNA, 13 bp, Homo sapiens
agatatttatata

SEQ ID NO: 4004955 - DNA, 14 bp, Homo sapiens
agatatttatatat

SEQ ID NO: 4004956 - DNA, 23 bp, Homo sapiens
agatatttattgtttatttatca

SEQ ID NO: 4004957 - DNA, 20 bp, Homo sapiens
agatatttccatttcttcct

SEQ ID NO: 4004958 - DNA, 19 bp, Homo sapiens
agatattttttcagaaata

SEQ ID NO: 4004959 - DNA, 21 bp, Homo sapiens
agatattttttcagaaatatg

SEQ ID NO: 4004960 - DNA, 14 bp, Homo sapiens
agatcaaaataaaa

SEQ ID NO: 4004961 - DNA, 16 bp, Homo sapiens
agatcaaatactttaa

SEQ ID NO: 4004962 - DNA, 16 bp, Homo sapiens
agatcaattccctctc

SEQ ID NO: 4004963 - DNA, 20 bp, Homo sapiens
agatcaattccctctctcag

SEQ ID NO: 4004964 - DNA, 21 bp, Homo sapiens
agatcaatttgtaattgctta

SEQ ID NO: 4004965 - DNA, 21 bp, Homo sapiens
agatcacagcctccagggccc

SEQ ID NO: 4004966 - DNA, 14 bp, Homo sapiens
agatcaccagcccg

SEQ ID NO: 4004967 - DNA, 15 bp, Homo sapiens
agatcaccagcccgg

SEQ ID NO: 4004968 - DNA, 18 bp, Homo sapiens
agatcactgaatttataa

SEQ ID NO: 4004969 - DNA, 22 bp, Homo sapiens
agatccagggacagaggcccca

SEQ ID NO: 4004970 - DNA, 18 bp, Homo sapiens
agatccatttgcctttct

SEQ ID NO: 4004971 - DNA, 19 bp, Homo sapiens
agatccatttgcctttctg

SEQ ID NO: 4004972 - DNA, 20 bp, Homo sapiens
agatccatttgcctttctgg

SEQ ID NO: 4004973 - DNA, 22 bp, Homo sapiens
agatccatttgcctttctggga

SEQ ID NO: 4004974 - DNA, 22 bp, Homo sapiens
agatcccatccatcagctccct

SEQ ID NO: 4004975 - DNA, 23 bp, Homo sapiens
agatcccatgggttgtgtgttta

SEQ ID NO: 4004976 - DNA, 15 bp, Homo sapiens
agatccccagggcag

SEQ ID NO: 4004977 - DNA, 14 bp, Homo sapiens
agatcccctgagcc

SEQ ID NO: 4004978 - DNA, 22 bp, Homo sapiens
agatcccgcctcttcttcttca

SEQ ID NO: 4004979 - DNA, 16 bp, Homo sapiens
agatcctaaggtccaa

SEQ ID NO: 4004980 - DNA, 21 bp, Homo sapiens
agatcctgtctttaaggaaaa

SEQ ID NO: 4004981 - DNA, 21 bp, Homo sapiens
agatccttcgggtgctggaag

SEQ ID NO: 4004982 - DNA, 16 bp, Homo sapiens
agatcgagaccatcct

SEQ ID NO: 4004983 - DNA, 20 bp, Homo sapiens
agatcgcgccactgcactcc

SEQ ID NO: 4004984 - DNA, 16 bp, Homo sapiens
agatcgttagtatcta

SEQ ID NO: 4004985 - DNA, 14 bp, Homo sapiens
agatctataaagcg

SEQ ID NO: 4004986 - DNA, 17 bp, Homo sapiens
agatctctattatatct

SEQ ID NO: 4004987 - DNA, 13 bp, Homo sapiens
agatctggaacct

SEQ ID NO: 4004988 - DNA, 19 bp, Homo sapiens
agatctggaacctcagcct

SEQ ID NO: 4004989 - DNA, 18 bp, Homo sapiens
ccagagactgggatggga

SEQ ID NO: 4004990 - DNA, 18 bp, Homo sapiens
ccagagagcaactctgag

SEQ ID NO: 4004991 - DNA, 22 bp, Homo sapiens
ccagagagtggctcctcccggt

SEQ ID NO: 4004992 - DNA, 21 bp, Homo sapiens
ccagagcaacctctcactccc

SEQ ID NO: 4004993 - DNA, 22 bp, Homo sapiens
ccagagcaacgaccagggccga

SEQ ID NO: 4004994 - DNA, 22 bp, Homo sapiens
ccagagcagatgcagagagcca

SEQ ID NO: 4004995 - DNA, 14 bp, Homo sapiens
ccagagcaggaagc

SEQ ID NO: 4004996 - DNA, 20 bp, Homo sapiens
ccagagcatttccaacacca

SEQ ID NO: 4004997 - DNA, 13 bp, Homo sapiens
ccagagccacctg

SEQ ID NO: 4004998 - DNA, 18 bp, Homo sapiens
ccagagccagatgcagga

SEQ ID NO: 4004999 - DNA, 22 bp, Homo sapiens
ccagagccagatgcaggacagg

SEQ ID NO: 4005000 - DNA, 11 bp, Homo sapiens
ccagagccagg

SEQ ID NO: 4005001 - DNA, 12 bp, Homo sapiens
ccagagccaggg

SEQ ID NO: 4005002 - DNA, 18 bp, Homo sapiens
ccagagcccagctccaag

SEQ ID NO: 4005003 - DNA, 23 bp, Homo sapiens
ccagagccccccacaatgatgat

SEQ ID NO: 4005004 - DNA, 19 bp, Homo sapiens
ccagagcctggctgcccat

SEQ ID NO: 4005005 - DNA, 14 bp, Homo sapiens
ccagagctgccagt

SEQ ID NO: 4005006 - DNA, 23 bp, Homo sapiens
ccagagctgcttccccgtcacct

SEQ ID NO: 4005007 - DNA, 23 bp, Homo sapiens
ccagagctgtctgaactcacgtg

SEQ ID NO: 4005008 - DNA, 21 bp, Homo sapiens
ccagagctgtttatggcctca

SEQ ID NO: 4005009 - DNA, 22 bp, Homo sapiens
ccagagctgtttatggcctcag

SEQ ID NO: 4005010 - DNA, 23 bp, Homo sapiens
ccagagctgtttatggcctcagc

SEQ ID NO: 4005011 - DNA, 19 bp, Homo sapiens
ccagaggaactgtccagag

SEQ ID NO: 4005012 - DNA, 23 bp, Homo sapiens
ccagaggaactgtccagagagca

SEQ ID NO: 4005013 - DNA, 19 bp, Homo sapiens
ccagaggagggcagaggga

SEQ ID NO: 4005014 - DNA, 21 bp, Homo sapiens
ccagaggagggcagagggaga

SEQ ID NO: 4005015 - DNA, 19 bp, Homo sapiens
ccagaggctgggagtccct

SEQ ID NO: 4005016 - DNA, 14 bp, Homo sapiens
ccagagggagcagg

SEQ ID NO: 4005017 - DNA, 15 bp, Homo sapiens
ccagagggtgtggct

SEQ ID NO: 4005018 - DNA, 18 bp, Homo sapiens
ccagagggtgtggctttc

SEQ ID NO: 4005019 - DNA, 19 bp, Homo sapiens
ccagaggtaacagaacagc

SEQ ID NO: 4005020 - DNA, 12 bp, Homo sapiens
ccagaggtgctt

SEQ ID NO: 4005021 - DNA, 21 bp, Homo sapiens
ccagagtcaccttttctgtgg

SEQ ID NO: 4005022 - DNA, 19 bp, Homo sapiens
ccagagtgctgaggccagg

SEQ ID NO: 4005023 - DNA, 15 bp, Homo sapiens
ccagagtggcctggc

SEQ ID NO: 4005024 - DNA, 12 bp, Homo sapiens
ccagagtggctg

SEQ ID NO: 4005025 - DNA, 13 bp, Homo sapiens
ccagataaataga

SEQ ID NO: 4005026 - DNA, 14 bp, Homo sapiens
ccagataaatagaa

SEQ ID NO: 4005027 - DNA, 18 bp, Homo sapiens
ccagatcaccagcccggc

SEQ ID NO: 4005028 - DNA, 16 bp, Homo sapiens
ccagatccagcctggg

SEQ ID NO: 4005029 - DNA, 17 bp, Homo sapiens
ccagatcctcacaacca

SEQ ID NO: 4005030 - DNA, 12 bp, Homo sapiens
ccagatcctggg

SEQ ID NO: 4005031 - DNA, 14 bp, Homo sapiens
ccagatgcaacctc

SEQ ID NO: 4005032 - DNA, 17 bp, Homo sapiens
ccagatgcaacctcact

SEQ ID NO: 4005033 - DNA, 14 bp, Homo sapiens
ccagatgcaggaca

SEQ ID NO: 4005034 - DNA, 19 bp, Homo sapiens
ccagatgcaggacaggagg

SEQ ID NO: 4005035 - DNA, 14 bp, Homo sapiens
ccagatgcagggca

SEQ ID NO: 4005036 - DNA, 21 bp, Homo sapiens
ccagatgggccacggctgagc

SEQ ID NO: 4005037 - DNA, 22 bp, Homo sapiens
ccagatgggccacggctgagcc

SEQ ID NO: 4005038 - DNA, 23 bp, Homo sapiens
ccagatgggccacggctgagcct

SEQ ID NO: 4005039 - DNA, 24 bp, Homo sapiens
ccagatgggccacggctgagcctt

SEQ ID NO: 4005040 - DNA, 16 bp, Homo sapiens
ccagattcccctgtgt

SEQ ID NO: 4005041 - DNA, 18 bp, Homo sapiens
ccagattcccctgtgtca

SEQ ID NO: 4005042 - DNA, 14 bp, Homo sapiens
ccagattctgcctc

SEQ ID NO: 4005043 - DNA, 15 bp, Homo sapiens
ccagattctgcctct

SEQ ID NO: 4005044 - DNA, 17 bp, Homo sapiens
ccagattctgcctctct

SEQ ID NO: 4005045 - DNA, 13 bp, Homo sapiens
ccagattgacgac

SEQ ID NO: 4005046 - DNA, 18 bp, Homo sapiens
ccagattgacgacaagtg

SEQ ID NO: 4005047 - DNA, 21 bp, Homo sapiens
ccagattgacgacaagtgctg

SEQ ID NO: 4005048 - DNA, 21 bp, Homo sapiens
ccagcaaagagtgggctgcat

SEQ ID NO: 4005049 - DNA, 15 bp, Homo sapiens
ccagcaacgcccctc

SEQ ID NO: 4005050 - DNA, 15 bp, Homo sapiens
ccagcaaggcaggtt

SEQ ID NO: 4005051 - DNA, 17 bp, Homo sapiens
ccagcaataagaaatga

SEQ ID NO: 4005052 - DNA, 18 bp, Homo sapiens
ccagcaataagaaatgaa

SEQ ID NO: 4005053 - DNA, 23 bp, Homo sapiens
ccagcaatgacatctcaggggcc

SEQ ID NO: 4005054 - DNA, 21 bp, Homo sapiens
ccagcaattcataaaaactgc

SEQ ID NO: 4005055 - DNA, 16 bp, Homo sapiens
ccagcacacagggcag

SEQ ID NO: 4005056 - DNA, 12 bp, Homo sapiens
ccagcacagaag

SEQ ID NO: 4005057 - DNA, 19 bp, Homo sapiens
ccagcaccaacaccacggt

SEQ ID NO: 4005058 - DNA, 12 bp, Homo sapiens
ccagcaccctct

SEQ ID NO: 4005059 - DNA, 20 bp, Homo sapiens
ccagcaccctctcctggggg

SEQ ID NO: 4005060 - DNA, 15 bp, Homo sapiens
ccagcacctgcctcc

SEQ ID NO: 4005061 - DNA, 12 bp, Homo sapiens
ccagcactaacg

SEQ ID NO: 4005062 - DNA, 16 bp, Homo sapiens
ccagcactttgggagg

SEQ ID NO: 4005063 - DNA, 19 bp, Homo sapiens
ccagcactttgggaggcca

SEQ ID NO: 4005064 - DNA, 14 bp, Homo sapiens
ccagcagaggcagg

SEQ ID NO: 4005065 - DNA, 17 bp, Homo sapiens
ccagcagaggcaggctg

SEQ ID NO: 4005066 - DNA, 21 bp, Homo sapiens
ccagcagaggcaggctgggac

SEQ ID NO: 4005067 - DNA, 22 bp, Homo sapiens
ccagcagaggcaggctgggacg

SEQ ID NO: 4005068 - DNA, 23 bp, Homo sapiens
ccagcagcatggcatagccccgg

SEQ ID NO: 4005069 - DNA, 12 bp, Homo sapiens
ccagcagccccg

SEQ ID NO: 4005070 - DNA, 20 bp, Homo sapiens
ccagcaggaagccaggctga

SEQ ID NO: 4005071 - DNA, 21 bp, Homo sapiens
ccagcaggagagactgagcag

SEQ ID NO: 4005072 - DNA, 23 bp, Homo sapiens
ccagcaggccggatcggtactgt

SEQ ID NO: 4005073 - DNA, 20 bp, Homo sapiens
ccagcagggcatcttggaaa

SEQ ID NO: 4005074 - DNA, 11 bp, Homo sapiens
ccagcagtgtt

SEQ ID NO: 4005075 - DNA, 17 bp, Homo sapiens
ccagcatcactccccaa

SEQ ID NO: 4005076 - DNA, 20 bp, Homo sapiens
ccagcatccaccttggctct

SEQ ID NO: 4005077 - DNA, 21 bp, Homo sapiens
ccagccaccccgggctctctg

SEQ ID NO: 4005078 - DNA, 20 bp, Homo sapiens
ccagccactcgggaggctga

SEQ ID NO: 4005079 - DNA, 22 bp, Homo sapiens
ccagccactcgggaggctgaga

SEQ ID NO: 4005080 - DNA, 22 bp, Homo sapiens
ccagccagcagcagcccaagct

SEQ ID NO: 4005081 - DNA, 14 bp, Homo sapiens
ccagccaggagcag

SEQ ID NO: 4005082 - DNA, 22 bp, Homo sapiens
ccagccatacttatctctctgt

SEQ ID NO: 4005083 - DNA, 16 bp, Homo sapiens
ccagccatcaaaatgc

SEQ ID NO: 4005084 - DNA, 21 bp, Homo sapiens
ccagcccaccctgctcctcct

SEQ ID NO: 4005085 - DNA, 12 bp, Homo sapiens
ccagcccagaga

SEQ ID NO: 4005086 - DNA, 14 bp, Homo sapiens
ccagcccagagaca

SEQ ID NO: 4005087 - DNA, 22 bp, Homo sapiens
ccagcccagagacatacttgaa

SEQ ID NO: 4005088 - DNA, 13 bp, Homo sapiens
ccagcccagagcc

SEQ ID NO: 4005089 - DNA, 16 bp, Homo sapiens
ccagcccagaggccga

SEQ ID NO: 4005090 - DNA, 23 bp, Homo sapiens
ccagcccagattcccctgtgtca

SEQ ID NO: 4005091 - DNA, 14 bp, Homo sapiens
ccactccagctctg

SEQ ID NO: 4005092 - DNA, 16 bp, Homo sapiens
ccactccagctctgag

SEQ ID NO: 4005093 - DNA, 16 bp, Homo sapiens
ccactcccacctcacc

SEQ ID NO: 4005094 - DNA, 21 bp, Homo sapiens
ccactcccccgtttctccttt

SEQ ID NO: 4005095 - DNA, 17 bp, Homo sapiens
ccactccctatctcctt

SEQ ID NO: 4005096 - DNA, 12 bp, Homo sapiens
ccactccctgct

SEQ ID NO: 4005097 - DNA, 14 bp, Homo sapiens
ccactcctccctcc

SEQ ID NO: 4005098 - DNA, 15 bp, Homo sapiens
ccactcctccctccg

SEQ ID NO: 4005099 - DNA, 15 bp, Homo sapiens
ccactcctgtacact

SEQ ID NO: 4005100 - DNA, 20 bp, Homo sapiens
ccactcgacccagaatggag

SEQ ID NO: 4005101 - DNA, 23 bp, Homo sapiens
ccactcggatggaccaacctgct

SEQ ID NO: 4005102 - DNA, 20 bp, Homo sapiens
ccactcgggaggctgagaca

SEQ ID NO: 4005103 - DNA, 18 bp, Homo sapiens
ccactctaccctcccacc

SEQ ID NO: 4005104 - DNA, 21 bp, Homo sapiens
ccactctaggggtcaggctcc

SEQ ID NO: 4005105 - DNA, 23 bp, Homo sapiens
ccactctaggggtcaggctccat

SEQ ID NO: 4005106 - DNA, 14 bp, Homo sapiens
ccactctccccaca

SEQ ID NO: 4005107 - DNA, 23 bp, Homo sapiens
ccactctcttccctttccccagc

SEQ ID NO: 4005108 - DNA, 11 bp, Homo sapiens
ccactcttctc

SEQ ID NO: 4005109 - DNA, 19 bp, Homo sapiens
ccactcttctttaagccat

SEQ ID NO: 4005110 - DNA, 20 bp, Homo sapiens
ccactcttctttaagccata

SEQ ID NO: 4005111 - DNA, 13 bp, Homo sapiens
ccactgaccagaa

SEQ ID NO: 4005112 - DNA, 15 bp, Homo sapiens
ccactgcccgagctg

SEQ ID NO: 4005113 - DNA, 22 bp, Homo sapiens
ccactgcccgagctggtgcatt

SEQ ID NO: 4005114 - DNA, 15 bp, Homo sapiens
ccactgcctgcacct

SEQ ID NO: 4005115 - DNA, 13 bp, Homo sapiens
ccactgcgttgtc

SEQ ID NO: 4005116 - DNA, 11 bp, Homo sapiens
ccactgctggt

SEQ ID NO: 4005117 - DNA, 19 bp, Homo sapiens
ccactggaaggaacatgga

SEQ ID NO: 4005118 - DNA, 17 bp, Homo sapiens
ccactgggccagccctg

SEQ ID NO: 4005119 - DNA, 21 bp, Homo sapiens
ccactggggtggcctgactcc

SEQ ID NO: 4005120 - DNA, 18 bp, Homo sapiens
ccactggtaacatgtgac

SEQ ID NO: 4005121 - DNA, 14 bp, Homo sapiens
ccactgtaaaatga

SEQ ID NO: 4005122 - DNA, 17 bp, Homo sapiens
ccactgtaattaaaact

SEQ ID NO: 4005123 - DNA, 14 bp, Homo sapiens
ccactgtcaccctc

SEQ ID NO: 4005124 - DNA, 23 bp, Homo sapiens
ccactgtcactgtttctctgctg

SEQ ID NO: 4005125 - DNA, 18 bp, Homo sapiens
ccactgtccccctaccca

SEQ ID NO: 4005126 - DNA, 20 bp, Homo sapiens
ccactgtccccctacccacc

SEQ ID NO: 4005127 - DNA, 15 bp, Homo sapiens
ccactgtcctgggcc

SEQ ID NO: 4005128 - DNA, 19 bp, Homo sapiens
ccactgtcctgggcctgca

SEQ ID NO: 4005129 - DNA, 21 bp, Homo sapiens
ccactgtcctgggcctgcaga

SEQ ID NO: 4005130 - DNA, 14 bp, Homo sapiens
ccactgttatcaaa

SEQ ID NO: 4005131 - DNA, 21 bp, Homo sapiens
ccacttaaaaaatgtccatga

SEQ ID NO: 4005132 - DNA, 18 bp, Homo sapiens
ccacttacatatattttt

SEQ ID NO: 4005133 - DNA, 16 bp, Homo sapiens
ccacttattttacatt

SEQ ID NO: 4005134 - DNA, 21 bp, Homo sapiens
ccacttccaggggaacctgcc

SEQ ID NO: 4005135 - DNA, 13 bp, Homo sapiens
ccacttcctgcta

SEQ ID NO: 4005136 - DNA, 13 bp, Homo sapiens
ccacttcctttta

SEQ ID NO: 4005137 - DNA, 21 bp, Homo sapiens
ccacttgtccgctgggtggta

SEQ ID NO: 4005138 - DNA, 21 bp, Homo sapiens
ccagaaacacccacaggcatg

SEQ ID NO: 4005139 - DNA, 22 bp, Homo sapiens
ccagaaactcctgtttctcctt

SEQ ID NO: 4005140 - DNA, 17 bp, Homo sapiens
ccagaaagccctcttgg

SEQ ID NO: 4005141 - DNA, 20 bp, Homo sapiens
ccagaaagccctcttggggg

SEQ ID NO: 4005142 - DNA, 14 bp, Homo sapiens
ccagaaaggagact

SEQ ID NO: 4005143 - DNA, 16 bp, Homo sapiens
ccagaaaggagactag

SEQ ID NO: 4005144 - DNA, 15 bp, Homo sapiens
ccagaaaggatattt

SEQ ID NO: 4005145 - DNA, 18 bp, Homo sapiens
ccagaaatgtccctttct

SEQ ID NO: 4005146 - DNA, 20 bp, Homo sapiens
ccagaacacggctcacgctt

SEQ ID NO: 4005147 - DNA, 16 bp, Homo sapiens
ccagaacctcagcatt

SEQ ID NO: 4005148 - DNA, 16 bp, Homo sapiens
ccagaactgcccccac

SEQ ID NO: 4005149 - DNA, 17 bp, Homo sapiens
ccagaactgcccccact

SEQ ID NO: 4005150 - DNA, 14 bp, Homo sapiens
ccagaacttccctg

SEQ ID NO: 4005151 - DNA, 15 bp, Homo sapiens
ccagaacttccctga

SEQ ID NO: 4005152 - DNA, 20 bp, Homo sapiens
ccagaagaagagaagctgct

SEQ ID NO: 4005153 - DNA, 13 bp, Homo sapiens
ccagaagagccca

SEQ ID NO: 4005154 - DNA, 14 bp, Homo sapiens
ccagaagagcccat

SEQ ID NO: 4005155 - DNA, 17 bp, Homo sapiens
ccagaagatgccagctt

SEQ ID NO: 4005156 - DNA, 20 bp, Homo sapiens
ccagaagccacccaaagcag

SEQ ID NO: 4005157 - DNA, 15 bp, Homo sapiens
ccagaagtagctttg

SEQ ID NO: 4005158 - DNA, 22 bp, Homo sapiens
ccagaatactgggttcttagtt

SEQ ID NO: 4005159 - DNA, 10 bp, Homo sapiens
ccagaatctt

SEQ ID NO: 4005160 - DNA, 17 bp, Homo sapiens
ccagaatgctgtacatc

SEQ ID NO: 4005161 - DNA, 20 bp, Homo sapiens
ccagacaaaaaaatttaaaa

SEQ ID NO: 4005162 - DNA, 23 bp, Homo sapiens
ccagacaagctgttgaccaggca

SEQ ID NO: 4005163 - DNA, 14 bp, Homo sapiens
ccagacacaggccc

SEQ ID NO: 4005164 - DNA, 15 bp, Homo sapiens
ccagacacaggccct

SEQ ID NO: 4005165 - DNA, 14 bp, Homo sapiens
ccagacacccagga

SEQ ID NO: 4005166 - DNA, 23 bp, Homo sapiens
ccagacactgaccatccactcta

SEQ ID NO: 4005167 - DNA, 18 bp, Homo sapiens
ccagacagacatctctgc

SEQ ID NO: 4005168 - DNA, 19 bp, Homo sapiens
ccagacagacatctctgca

SEQ ID NO: 4005169 - DNA, 13 bp, Homo sapiens
ccagacagggtgg

SEQ ID NO: 4005170 - DNA, 12 bp, Homo sapiens
ccagacatcacc

SEQ ID NO: 4005171 - DNA, 18 bp, Homo sapiens
ccagacatcaccctttgc

SEQ ID NO: 4005172 - DNA, 18 bp, Homo sapiens
ccagaccaccagccgccc

SEQ ID NO: 4005173 - DNA, 17 bp, Homo sapiens
ccagaccagccctgcag

SEQ ID NO: 4005174 - DNA, 22 bp, Homo sapiens
ccagacccctctggccaggatg

SEQ ID NO: 4005175 - DNA, 15 bp, Homo sapiens
ccagacccctggctt

SEQ ID NO: 4005176 - DNA, 19 bp, Homo sapiens
ccagacctgatcctggagg

SEQ ID NO: 4005177 - DNA, 19 bp, Homo sapiens
ccagacctggctccactct

SEQ ID NO: 4005178 - DNA, 20 bp, Homo sapiens
ccagacctgttagcagacag

SEQ ID NO: 4005179 - DNA, 21 bp, Homo sapiens
ccagacctgttagcagacagg

SEQ ID NO: 4005180 - DNA, 23 bp, Homo sapiens
ccagacctgttagcagacaggcc

SEQ ID NO: 4005181 - DNA, 24 bp, Homo sapiens
ccagacgctgccgctgccgctgca

SEQ ID NO: 4005182 - DNA, 17 bp, Homo sapiens
ccagacgtcaggccctg

SEQ ID NO: 4005183 - DNA, 21 bp, Homo sapiens
ccagacgtcaggccctgactc

SEQ ID NO: 4005184 - DNA, 15 bp, Homo sapiens
ccagactgttagaaa

SEQ ID NO: 4005185 - DNA, 13 bp, Homo sapiens
ccagacttccttg

SEQ ID NO: 4005186 - DNA, 15 bp, Homo sapiens
ccagacttccttgag

SEQ ID NO: 4005187 - DNA, 19 bp, Homo sapiens
ccagagaaaggggagccca

SEQ ID NO: 4005188 - DNA, 12 bp, Homo sapiens
ccagagaacagc

SEQ ID NO: 4005189 - DNA, 18 bp, Homo sapiens
ccagagacatacttgaag

SEQ ID NO: 4005190 - DNA, 20 bp, Homo sapiens
ccagagacatacttgaaggg

SEQ ID NO: 4005191 - DNA, 20 bp, Homo sapiens
ccagagaccaggctgtgtcc

SEQ ID NO: 4005192 - DNA, 15 bp, Homo sapiens
ccagagacgcccagc

SEQ ID NO: 4005193 - DNA, 17 bp, Homo sapiens
ccagagacgcccagccc

SEQ ID NO: 4005194 - DNA, 20 bp, Homo sapiens
aacctgacagatgtcagccg

SEQ ID NO: 4005195 - DNA, 20 bp, Homo sapiens
aacctgactcaattatttgc

SEQ ID NO: 4005196 - DNA, 21 bp, Homo sapiens
aacctgagctattttcctctg

SEQ ID NO: 4005197 - DNA, 22 bp, Homo sapiens
aacctgagctattttcctctgg

SEQ ID NO: 4005198 - DNA, 17 bp, Homo sapiens
aacctgggattcaggaa

SEQ ID NO: 4005199 - DNA, 17 bp, Homo sapiens
aacctggtggcaccaga

SEQ ID NO: 4005200 - DNA, 20 bp, Homo sapiens
aacctgtatttttgttagtt

SEQ ID NO: 4005201 - DNA, 18 bp, Homo sapiens
aacctgtgagctgcacca

SEQ ID NO: 4005202 - DNA, 16 bp, Homo sapiens
aacctgtgagtaaata

SEQ ID NO: 4005203 - DNA, 18 bp, Homo sapiens
aacctgtttttttttcat

SEQ ID NO: 4005204 - DNA, 15 bp, Homo sapiens
aaccttatatttaca

SEQ ID NO: 4005205 - DNA, 15 bp, Homo sapiens
aaccttattgtacct

SEQ ID NO: 4005206 - DNA, 16 bp, Homo sapiens
aaccttattgtacctc

SEQ ID NO: 4005207 - DNA, 18 bp, Homo sapiens
aaccttattgtacctctc

SEQ ID NO: 4005208 - DNA, 16 bp, Homo sapiens
aaccttgaatgctgcc

SEQ ID NO: 4005209 - DNA, 19 bp, Homo sapiens
aaccttgaatgctgccagt

SEQ ID NO: 4005210 - DNA, 20 bp, Homo sapiens
aaccttgaatgctgccagtg

SEQ ID NO: 4005211 - DNA, 19 bp, Homo sapiens
aaccttgtctctatgccag

SEQ ID NO: 4005212 - DNA, 14 bp, Homo sapiens
aacctttaaaattg

SEQ ID NO: 4005213 - DNA, 16 bp, Homo sapiens
aacctttaaaattgtc

SEQ ID NO: 4005214 - DNA, 19 bp, Homo sapiens
aacctttaaaattgtcacc

SEQ ID NO: 4005215 - DNA, 23 bp, Homo sapiens
aacctttaaaattgtcacctctg

SEQ ID NO: 4005216 - DNA, 22 bp, Homo sapiens
aacctttttcttgatcttaaag

SEQ ID NO: 4005217 - DNA, 16 bp, Homo sapiens
aacctttttgtaaata

SEQ ID NO: 4005218 - DNA, 15 bp, Homo sapiens
aaccttttttaagat

SEQ ID NO: 4005219 - DNA, 18 bp, Homo sapiens
aaccttttttaagatttt

SEQ ID NO: 4005220 - DNA, 17 bp, Homo sapiens
aacctttttttttgaaa

SEQ ID NO: 4005221 - DNA, 14 bp, Homo sapiens
aacgacaatagctt

SEQ ID NO: 4005222 - DNA, 18 bp, Homo sapiens
aacgataaaattacaaaa

SEQ ID NO: 4005223 - DNA, 16 bp, Homo sapiens
aacgatgtgtctgtat

SEQ ID NO: 4005224 - DNA, 13 bp, Homo sapiens
aacgcagccctag

SEQ ID NO: 4005225 - DNA, 21 bp, Homo sapiens
aacgcagccctagagcctgcc

SEQ ID NO: 4005226 - DNA, 23 bp, Homo sapiens
aacgcagccctagagcctgcctg

SEQ ID NO: 4005227 - DNA, 20 bp, Homo sapiens
aacgccagtctcccaggccc

SEQ ID NO: 4005228 - DNA, 11 bp, Homo sapiens
aacgcccctcc

SEQ ID NO: 4005229 - DNA, 23 bp, Homo sapiens
aacgcccctccaaacctccagcc

SEQ ID NO: 4005230 - DNA, 15 bp, Homo sapiens
aacgctacctctctg

SEQ ID NO: 4005231 - DNA, 21 bp, Homo sapiens
aacgggcttgactttggctga

SEQ ID NO: 4005232 - DNA, 13 bp, Homo sapiens
aacgttggacttt

SEQ ID NO: 4005233 - DNA, 15 bp, Homo sapiens
aacgttttgaactaa

SEQ ID NO: 4005234 - DNA, 23 bp, Homo sapiens
aactaaaaatattcctccaaatc

SEQ ID NO: 4005235 - DNA, 13 bp, Homo sapiens
aactaaataatga

SEQ ID NO: 4005236 - DNA, 14 bp, Homo sapiens
aactaaatgttcta

SEQ ID NO: 4005237 - DNA, 19 bp, Homo sapiens
aactaagaaacttaaattt

SEQ ID NO: 4005238 - DNA, 23 bp, Homo sapiens
aactaagaaatatgcacaatagc

SEQ ID NO: 4005239 - DNA, 22 bp, Homo sapiens
aactaccaggtgtgcctggaag

SEQ ID NO: 4005240 - DNA, 15 bp, Homo sapiens
aactactctttgatt

SEQ ID NO: 4005241 - DNA, 16 bp, Homo sapiens
aactactgtgttcctg

SEQ ID NO: 4005242 - DNA, 19 bp, Homo sapiens
aactagaatttattcaatt

SEQ ID NO: 4005243 - DNA, 13 bp, Homo sapiens
aactagagaaggg

SEQ ID NO: 4005244 - DNA, 18 bp, Homo sapiens
aactagcataagtggttt

SEQ ID NO: 4005245 - DNA, 16 bp, Homo sapiens
aactagcccctggggt

SEQ ID NO: 4005246 - DNA, 15 bp, Homo sapiens
aactagctgggacta

SEQ ID NO: 4005247 - DNA, 22 bp, Homo sapiens
aactagctgggactacaggtgc

SEQ ID NO: 4005248 - DNA, 14 bp, Homo sapiens
aactaggtaatgtt

SEQ ID NO: 4005249 - DNA, 18 bp, Homo sapiens
aactatatgtgaaacatt

SEQ ID NO: 4005250 - DNA, 20 bp, Homo sapiens
aactatattcatttccactc

SEQ ID NO: 4005251 - DNA, 18 bp, Homo sapiens
aactatcctgacttctaa

SEQ ID NO: 4005252 - DNA, 17 bp, Homo sapiens
aactatgaactacaaag

SEQ ID NO: 4005253 - DNA, 13 bp, Homo sapiens
aactatgacagat

SEQ ID NO: 4005254 - DNA, 18 bp, Homo sapiens
aactatgacagatatatt

SEQ ID NO: 4005255 - DNA, 18 bp, Homo sapiens
aactatttagtgttagtt

SEQ ID NO: 4005256 - DNA, 13 bp, Homo sapiens
aactatttatctg

SEQ ID NO: 4005257 - DNA, 23 bp, Homo sapiens
aactatttatctgtgtttttgaa

SEQ ID NO: 4005258 - DNA, 21 bp, Homo sapiens
aactcaaatggggccagatcc

SEQ ID NO: 4005259 - DNA, 12 bp, Homo sapiens
aactcaagctgc

SEQ ID NO: 4005260 - DNA, 15 bp, Homo sapiens
aactcaccatgtaaa

SEQ ID NO: 4005261 - DNA, 17 bp, Homo sapiens
aactcacctaatgttta

SEQ ID NO: 4005262 - DNA, 21 bp, Homo sapiens
aactcacctaatgtttatgag

SEQ ID NO: 4005263 - DNA, 17 bp, Homo sapiens
aactcacctctcaaggt

SEQ ID NO: 4005264 - DNA, 14 bp, Homo sapiens
aactcactgctcaa

SEQ ID NO: 4005265 - DNA, 18 bp, Homo sapiens
aactcagaattattttta

SEQ ID NO: 4005266 - DNA, 13 bp, Homo sapiens
aactcagatccag

SEQ ID NO: 4005267 - DNA, 13 bp, Homo sapiens
aactcagggacag

SEQ ID NO: 4005268 - DNA, 17 bp, Homo sapiens
aactcagggacagagcc

SEQ ID NO: 4005269 - DNA, 18 bp, Homo sapiens
aactcagggacagagcca

SEQ ID NO: 4005270 - DNA, 14 bp, Homo sapiens
aactcatcataaaa

SEQ ID NO: 4005271 - DNA, 15 bp, Homo sapiens
aactcatcataaaat

SEQ ID NO: 4005272 - DNA, 18 bp, Homo sapiens
aactcatcataaaataaa

SEQ ID NO: 4005273 - DNA, 17 bp, Homo sapiens
aactcattctatcccca

SEQ ID NO: 4005274 - DNA, 19 bp, Homo sapiens
aactcatttgttaaaatta

SEQ ID NO: 4005275 - DNA, 16 bp, Homo sapiens
aactccacatctgcct

SEQ ID NO: 4005276 - DNA, 21 bp, Homo sapiens
aactccaccgaccaactgccc

SEQ ID NO: 4005277 - DNA, 23 bp, Homo sapiens
aactcccctgggggtttcacctg

SEQ ID NO: 4005278 - DNA, 21 bp, Homo sapiens
aactcctcacacaccctgagg

SEQ ID NO: 4005279 - DNA, 23 bp, Homo sapiens
aactcctgacgtctgaagcttga

SEQ ID NO: 4005280 - DNA, 21 bp, Homo sapiens
aactcctgtttctccttagtt

SEQ ID NO: 4005281 - DNA, 14 bp, Homo sapiens
aactccttcctggc

SEQ ID NO: 4005282 - DNA, 17 bp, Homo sapiens
aactccttcctggcctg

SEQ ID NO: 4005283 - DNA, 15 bp, Homo sapiens
aactcgaatctgtgt

SEQ ID NO: 4005284 - DNA, 22 bp, Homo sapiens
aactctaattcccattttgcaa

SEQ ID NO: 4005285 - DNA, 12 bp, Homo sapiens
aactctctccac

SEQ ID NO: 4005286 - DNA, 14 bp, Homo sapiens
aactctgaactttg

SEQ ID NO: 4005287 - DNA, 17 bp, Homo sapiens
aactctggcttccaggt

SEQ ID NO: 4005288 - DNA, 21 bp, Homo sapiens
aactctgggctgctacccaga

SEQ ID NO: 4005289 - DNA, 22 bp, Homo sapiens
aactctgggctgctacccagaa

SEQ ID NO: 4005290 - DNA, 11 bp, Homo sapiens
aactctggtgc

SEQ ID NO: 4005291 - DNA, 13 bp, Homo sapiens
aactctggtggca

SEQ ID NO: 4005292 - DNA, 16 bp, Homo sapiens
aactctgtggcattat

SEQ ID NO: 4005293 - DNA, 15 bp, Homo sapiens
aactctgttccccca

SEQ ID NO: 4005294 - DNA, 19 bp, Homo sapiens
aactctgttgcaagtgcaa

SEQ ID NO: 4005295 - DNA, 16 bp, Homo sapiens
aactcttaatctgtgt

SEQ ID NO: 4005296 - DNA, 17 bp, Homo sapiens
aagggttctggctgccc

SEQ ID NO: 4005297 - DNA, 20 bp, Homo sapiens
aagggtttgtggctgggggc

SEQ ID NO: 4005298 - DNA, 11 bp, Homo sapiens
aaggtataatt

SEQ ID NO: 4005299 - DNA, 15 bp, Homo sapiens
aaggtatatgactga

SEQ ID NO: 4005300 - DNA, 18 bp, Homo sapiens
aaggtattccttttgtgt

SEQ ID NO: 4005301 - DNA, 21 bp, Homo sapiens
aaggtcaaactaattctcaca

SEQ ID NO: 4005302 - DNA, 23 bp, Homo sapiens
aaggtcctctcagttctctccct

SEQ ID NO: 4005303 - DNA, 13 bp, Homo sapiens
aaggtcctgccct

SEQ ID NO: 4005304 - DNA, 24 bp, Homo sapiens
aaggtcctgctcaactctacccct

SEQ ID NO: 4005305 - DNA, 18 bp, Homo sapiens
aaggtctcagcttgtata

SEQ ID NO: 4005306 - DNA, 22 bp, Homo sapiens
aaggtgagtttgagctgccttc

SEQ ID NO: 4005307 - DNA, 17 bp, Homo sapiens
aaggtgatatatttaaa

SEQ ID NO: 4005308 - DNA, 14 bp, Homo sapiens
aaggtgcaggcagg

SEQ ID NO: 4005309 - DNA, 23 bp, Homo sapiens
aaggtgcagttcccccaacctca

SEQ ID NO: 4005310 - DNA, 13 bp, Homo sapiens
aaggtgcctcaga

SEQ ID NO: 4005311 - DNA, 19 bp, Homo sapiens
aaggtggaccttttaaagt

SEQ ID NO: 4005312 - DNA, 23 bp, Homo sapiens
aaggtggaccttttaaagtgttt

SEQ ID NO: 4005313 - DNA, 18 bp, Homo sapiens
aaggtggcaatgcttaaa

SEQ ID NO: 4005314 - DNA, 17 bp, Homo sapiens
aaggtgtaactctaatt

SEQ ID NO: 4005315 - DNA, 22 bp, Homo sapiens
aaggtgttcattcacttgcatt

SEQ ID NO: 4005316 - DNA, 15 bp, Homo sapiens
aaggttaataaagta

SEQ ID NO: 4005317 - DNA, 22 bp, Homo sapiens
aaggttccaatcagatctttat

SEQ ID NO: 4005318 - DNA, 17 bp, Homo sapiens
aaggttctcataggaaa

SEQ ID NO: 4005319 - DNA, 16 bp, Homo sapiens
aaggttgaactttgcc

SEQ ID NO: 4005320 - DNA, 23 bp, Homo sapiens
aaggttgaactttgccaaaaaaa

SEQ ID NO: 4005321 - DNA, 21 bp, Homo sapiens
aaggttgcatactgagccaag

SEQ ID NO: 4005322 - DNA, 14 bp, Homo sapiens
aaggttggatggat

SEQ ID NO: 4005323 - DNA, 13 bp, Homo sapiens
aaggtttggtgtg

SEQ ID NO: 4005324 - DNA, 17 bp, Homo sapiens
aaggtttgtatattgtc

SEQ ID NO: 4005325 - DNA, 23 bp, Homo sapiens
aaggttttggatcttgaatgtgg

SEQ ID NO: 4005326 - DNA, 12 bp, Homo sapiens
aaggtttttaaa

SEQ ID NO: 4005327 - DNA, 11 bp, Homo sapiens
aaggttttttt

SEQ ID NO: 4005328 - DNA, 22 bp, Homo sapiens
aagtaaatacaagactgttgtg

SEQ ID NO: 4005329 - DNA, 15 bp, Homo sapiens
aagtaaatctcttct

SEQ ID NO: 4005330 - DNA, 16 bp, Homo sapiens
aagtaaatctcttctg

SEQ ID NO: 4005331 - DNA, 14 bp, Homo sapiens
aagtaaattatgta

SEQ ID NO: 4005332 - DNA, 15 bp, Homo sapiens
aagtaacataactag

SEQ ID NO: 4005333 - DNA, 12 bp, Homo sapiens
aagtaactcatt

SEQ ID NO: 4005334 - DNA, 21 bp, Homo sapiens
aagtaactcatttgttaaaat

SEQ ID NO: 4005335 - DNA, 18 bp, Homo sapiens
aagtaagaaagtgaagca

SEQ ID NO: 4005336 - DNA, 18 bp, Homo sapiens
aagtaaggtgcagttccc

SEQ ID NO: 4005337 - DNA, 15 bp, Homo sapiens
aagtaattatcggga

SEQ ID NO: 4005338 - DNA, 16 bp, Homo sapiens
aagtaattgtgaaaaa

SEQ ID NO: 4005339 - DNA, 17 bp, Homo sapiens
aagtacacaataagcaa

SEQ ID NO: 4005340 - DNA, 16 bp, Homo sapiens
aagtacactctgctgt

SEQ ID NO: 4005341 - DNA, 19 bp, Homo sapiens
aagtacactctgctgtttg

SEQ ID NO: 4005342 - DNA, 14 bp, Homo sapiens
aagtacagcctgga

SEQ ID NO: 4005343 - DNA, 12 bp, Homo sapiens
aagtacatttaa

SEQ ID NO: 4005344 - DNA, 13 bp, Homo sapiens
aagtacatttaat

SEQ ID NO: 4005345 - DNA, 16 bp, Homo sapiens
aagtaccaaagtttta

SEQ ID NO: 4005346 - DNA, 18 bp, Homo sapiens
aagtactacacattttta

SEQ ID NO: 4005347 - DNA, 19 bp, Homo sapiens
aagtactagatgcatcact

SEQ ID NO: 4005348 - DNA, 14 bp, Homo sapiens
aagtactctggagc

SEQ ID NO: 4005349 - DNA, 14 bp, Homo sapiens
aagtacttgagtgt

SEQ ID NO: 4005350 - DNA, 20 bp, Homo sapiens
aagtagaaaagttgcagatg

SEQ ID NO: 4005351 - DNA, 21 bp, Homo sapiens
aagtagcaaatgagacagcag

SEQ ID NO: 4005352 - DNA, 22 bp, Homo sapiens
aagtagtttctccaagtacttt

SEQ ID NO: 4005353 - DNA, 18 bp, Homo sapiens
aagtagttttattttaat

SEQ ID NO: 4005354 - DNA, 15 bp, Homo sapiens
aagtatacttatatt

SEQ ID NO: 4005355 - DNA, 22 bp, Homo sapiens
aagtatataatttttttatgtt

SEQ ID NO: 4005356 - DNA, 13 bp, Homo sapiens
aagtatatattta

SEQ ID NO: 4005357 - DNA, 21 bp, Homo sapiens
aagtatatgtgaaaaaaatga

SEQ ID NO: 4005358 - DNA, 20 bp, Homo sapiens
aagtatcttctatttttatc

SEQ ID NO: 4005359 - DNA, 18 bp, Homo sapiens
aagtattcttatttaatg

SEQ ID NO: 4005360 - DNA, 18 bp, Homo sapiens
aagtatttatatatttat

SEQ ID NO: 4005361 - DNA, 13 bp, Homo sapiens
aagtatttgggaa

SEQ ID NO: 4005362 - DNA, 11 bp, Homo sapiens
aagtattttga

SEQ ID NO: 4005363 - DNA, 23 bp, Homo sapiens
aagtattttgaagtttacatttt

SEQ ID NO: 4005364 - DNA, 22 bp, Homo sapiens
aagtatttttgtctcttagaaa

SEQ ID NO: 4005365 - DNA, 16 bp, Homo sapiens
aagtcaatcatttctc

SEQ ID NO: 4005366 - DNA, 17 bp, Homo sapiens
aagtcaatcatttctca

SEQ ID NO: 4005367 - DNA, 18 bp, Homo sapiens
aagtcaatcatttctcac

SEQ ID NO: 4005368 - DNA, 13 bp, Homo sapiens
aagtcacacagct

SEQ ID NO: 4005369 - DNA, 14 bp, Homo sapiens
aagtcacacagcta

SEQ ID NO: 4005370 - DNA, 23 bp, Homo sapiens
aagtcaccaggacttggggtcag

SEQ ID NO: 4005371 - DNA, 12 bp, Homo sapiens
aagtcactgcac

SEQ ID NO: 4005372 - DNA, 15 bp, Homo sapiens
aagtcagctccagct

SEQ ID NO: 4005373 - DNA, 20 bp, Homo sapiens
aagtcagctccagctttctg

SEQ ID NO: 4005374 - DNA, 15 bp, Homo sapiens
aagtcagtgttgaga

SEQ ID NO: 4005375 - DNA, 17 bp, Homo sapiens
aagtcatagccataaat

SEQ ID NO: 4005376 - DNA, 14 bp, Homo sapiens
aagtcatctactta

SEQ ID NO: 4005377 - DNA, 20 bp, Homo sapiens
aagtcatctacttaataaat

SEQ ID NO: 4005378 - DNA, 15 bp, Homo sapiens
aagtcatgtgcattt

SEQ ID NO: 4005379 - DNA, 17 bp, Homo sapiens
aagtcatgtgtgaacac

SEQ ID NO: 4005380 - DNA, 12 bp, Homo sapiens
aagtccaaagtc

SEQ ID NO: 4005381 - DNA, 20 bp, Homo sapiens
aagtccctccctgcctgagg

SEQ ID NO: 4005382 - DNA, 19 bp, Homo sapiens
aagtccgcagaagccctga

SEQ ID NO: 4005383 - DNA, 19 bp, Homo sapiens
aagtcctccctctctactg

SEQ ID NO: 4005384 - DNA, 20 bp, Homo sapiens
aagtcctgactgggctgggt

SEQ ID NO: 4005385 - DNA, 19 bp, Homo sapiens
aagtcctggctacatccca

SEQ ID NO: 4005386 - DNA, 18 bp, Homo sapiens
aagtccttacctcttccg

SEQ ID NO: 4005387 - DNA, 19 bp, Homo sapiens
aagtccttggactgttttg

SEQ ID NO: 4005388 - DNA, 21 bp, Homo sapiens
aagtcctttttttccatcttt

SEQ ID NO: 4005389 - DNA, 12 bp, Homo sapiens
aagtctaaacaa

SEQ ID NO: 4005390 - DNA, 16 bp, Homo sapiens
aagtctaaatatttcc

SEQ ID NO: 4005391 - DNA, 12 bp, Homo sapiens
aagtctattttt

SEQ ID NO: 4005392 - DNA, 21 bp, Homo sapiens
aagtctatttttttaactgaa

SEQ ID NO: 4005393 - DNA, 17 bp, Homo sapiens
aagtctctaggttctga

SEQ ID NO: 4005394 - DNA, 15 bp, Homo sapiens
aagtctctctgtgaa

SEQ ID NO: 4005395 - DNA, 17 bp, Homo sapiens
aagtctctctgtgaata

SEQ ID NO: 4005396 - DNA, 20 bp, Homo sapiens
aagtctctctgtgaatacaa

SEQ ID NO: 4005397 - DNA, 22 bp, Homo sapiens
aagtctgtctttcctgaaccat

SEQ ID NO: 4005398 - DNA, 16 bp, Homo sapiens
aagtcttagatgtata

SEQ ID NO: 4005399 - DNA, 22 bp, Homo sapiens
aatccctgtaatatttagctgt

SEQ ID NO: 4005400 - DNA, 13 bp, Homo sapiens
aatcccttaaaat

SEQ ID NO: 4005401 - DNA, 14 bp, Homo sapiens
aatcccttaaaatt

SEQ ID NO: 4005402 - DNA, 15 bp, Homo sapiens
aatcctaaaagaagc

SEQ ID NO: 4005403 - DNA, 16 bp, Homo sapiens
aatcctaacacattat

SEQ ID NO: 4005404 - DNA, 17 bp, Homo sapiens
aatcctacctgttttgt

SEQ ID NO: 4005405 - DNA, 18 bp, Homo sapiens
aatcctattaaaacacag

SEQ ID NO: 4005406 - DNA, 9 bp, Homo sapiens
aatcctcct

SEQ ID NO: 4005407 - DNA, 13 bp, Homo sapiens
aatcctcctccag

SEQ ID NO: 4005408 - DNA, 19 bp, Homo sapiens
aatcctcctgcctcagcct

SEQ ID NO: 4005409 - DNA, 23 bp, Homo sapiens
aatcctgttaagagataattctt

SEQ ID NO: 4005410 - DNA, 13 bp, Homo sapiens
aatccttccctgc

SEQ ID NO: 4005411 - DNA, 19 bp, Homo sapiens
aatcgagtgagacaaaatt

SEQ ID NO: 4005412 - DNA, 15 bp, Homo sapiens
aatcgatttcctccc

SEQ ID NO: 4005413 - DNA, 20 bp, Homo sapiens
aatctaaaagctctgttcca

SEQ ID NO: 4005414 - DNA, 17 bp, Homo sapiens
aatctaaatctatttat

SEQ ID NO: 4005415 - DNA, 15 bp, Homo sapiens
aatctaagtgatata

SEQ ID NO: 4005416 - DNA, 17 bp, Homo sapiens
aatctactaattccaca

SEQ ID NO: 4005417 - DNA, 17 bp, Homo sapiens
aatctataaagaaggat

SEQ ID NO: 4005418 - DNA, 21 bp, Homo sapiens
aatctatccaaatctgaagat

SEQ ID NO: 4005419 - DNA, 16 bp, Homo sapiens
aatctattgggttcat

SEQ ID NO: 4005420 - DNA, 16 bp, Homo sapiens
aatctatttattaata

SEQ ID NO: 4005421 - DNA, 17 bp, Homo sapiens
aatctatttattaatat

SEQ ID NO: 4005422 - DNA, 13 bp, Homo sapiens
aatctcaaataac

SEQ ID NO: 4005423 - DNA, 19 bp, Homo sapiens
aatctcaatgaagccagct

SEQ ID NO: 4005424 - DNA, 17 bp, Homo sapiens
aatctcccgctgctgct

SEQ ID NO: 4005425 - DNA, 19 bp, Homo sapiens
aatctcccgctgctgctgc

SEQ ID NO: 4005426 - DNA, 18 bp, Homo sapiens
aatctcctcttttatctt

SEQ ID NO: 4005427 - DNA, 18 bp, Homo sapiens
aatctctccctcctcagt

SEQ ID NO: 4005428 - DNA, 15 bp, Homo sapiens
aatctctctgcagct

SEQ ID NO: 4005429 - DNA, 16 bp, Homo sapiens
aatctctctgcagctg

SEQ ID NO: 4005430 - DNA, 17 bp, Homo sapiens
aatctctctgcagctgc

SEQ ID NO: 4005431 - DNA, 18 bp, Homo sapiens
aatctctctgcagctgcc

SEQ ID NO: 4005432 - DNA, 19 bp, Homo sapiens
aatctctctgcagctgccg

SEQ ID NO: 4005433 - DNA, 14 bp, Homo sapiens
aatctctgtaggaa

SEQ ID NO: 4005434 - DNA, 17 bp, Homo sapiens
aatctcttcaaattctt

SEQ ID NO: 4005435 - DNA, 18 bp, Homo sapiens
aatctcttcattattctc

SEQ ID NO: 4005436 - DNA, 21 bp, Homo sapiens
aatctcttcattattctctgc

SEQ ID NO: 4005437 - DNA, 15 bp, Homo sapiens
aatctcttgcttgtc

SEQ ID NO: 4005438 - DNA, 16 bp, Homo sapiens
aatctcttgcttgtca

SEQ ID NO: 4005439 - DNA, 18 bp, Homo sapiens
aatctcttgcttgtcatt

SEQ ID NO: 4005440 - DNA, 13 bp, Homo sapiens
aatctgacatatt

SEQ ID NO: 4005441 - DNA, 14 bp, Homo sapiens
aatctgacatatta

SEQ ID NO: 4005442 - DNA, 15 bp, Homo sapiens
aatctgacccagtgc

SEQ ID NO: 4005443 - DNA, 19 bp, Homo sapiens
aatctgatggccttaattt

SEQ ID NO: 4005444 - DNA, 21 bp, Homo sapiens
aatctgatggccttaatttcc

SEQ ID NO: 4005445 - DNA, 22 bp, Homo sapiens
aatctgatggccttaatttcct

SEQ ID NO: 4005446 - DNA, 23 bp, Homo sapiens
aatctgatggccttaatttcctt

SEQ ID NO: 4005447 - DNA, 16 bp, Homo sapiens
aatctgcacactccag

SEQ ID NO: 4005448 - DNA, 20 bp, Homo sapiens
aatctgcacactccaggcct

SEQ ID NO: 4005449 - DNA, 14 bp, Homo sapiens
aatctgctcacttt

SEQ ID NO: 4005450 - DNA, 15 bp, Homo sapiens
aatctggagaccagg

SEQ ID NO: 4005451 - DNA, 11 bp, Homo sapiens
aatctggccct

SEQ ID NO: 4005452 - DNA, 14 bp, Homo sapiens
aatctggcccttac

SEQ ID NO: 4005453 - DNA, 16 bp, Homo sapiens
aatctggtccatattt

SEQ ID NO: 4005454 - DNA, 14 bp, Homo sapiens
aatctggtcttgtt

SEQ ID NO: 4005455 - DNA, 11 bp, Homo sapiens
aatctgtaaaa

SEQ ID NO: 4005456 - DNA, 21 bp, Homo sapiens
aatctgtaacaggtattttgt

SEQ ID NO: 4005457 - DNA, 19 bp, Homo sapiens
aatctgtagggctggacct

SEQ ID NO: 4005458 - DNA, 13 bp, Homo sapiens
aatctgtataaat

SEQ ID NO: 4005459 - DNA, 16 bp, Homo sapiens
aatctgtcagcatctg

SEQ ID NO: 4005460 - DNA, 21 bp, Homo sapiens
aatctgtccaaaggaggctgg

SEQ ID NO: 4005461 - DNA, 12 bp, Homo sapiens
aatctgttatcc

SEQ ID NO: 4005462 - DNA, 23 bp, Homo sapiens
aatctgttatgtactagtgttct

SEQ ID NO: 4005463 - DNA, 19 bp, Homo sapiens
aatctgttctgggctcttt

SEQ ID NO: 4005464 - DNA, 15 bp, Homo sapiens
aatcttaaacataat

SEQ ID NO: 4005465 - DNA, 18 bp, Homo sapiens
aatcttgactttctgatt

SEQ ID NO: 4005466 - DNA, 12 bp, Homo sapiens
aatcttgctttg

SEQ ID NO: 4005467 - DNA, 13 bp, Homo sapiens
aatcttgttttaa

SEQ ID NO: 4005468 - DNA, 18 bp, Homo sapiens
aatctttcatccaaaata

SEQ ID NO: 4005469 - DNA, 21 bp, Homo sapiens
aatctttctttacctgagacc

SEQ ID NO: 4005470 - DNA, 21 bp, Homo sapiens
aatcttttaaaaattcaaatg

SEQ ID NO: 4005471 - DNA, 21 bp, Homo sapiens
aatcttttttagcataaaatt

SEQ ID NO: 4005472 - DNA, 19 bp, Homo sapiens
aatgaaaaatttaagcatt

SEQ ID NO: 4005473 - DNA, 21 bp, Homo sapiens
aatgaaaaatttaagcattgt

SEQ ID NO: 4005474 - DNA, 18 bp, Homo sapiens
aatgaaaacattttattt

SEQ ID NO: 4005475 - DNA, 19 bp, Homo sapiens
aatgaaaacattttatttt

SEQ ID NO: 4005476 - DNA, 18 bp, Homo sapiens
aatgaaaactctttgctg

SEQ ID NO: 4005477 - DNA, 14 bp, Homo sapiens
aatgaaaatgtcag

SEQ ID NO: 4005478 - DNA, 13 bp, Homo sapiens
aatgaaaattgta

SEQ ID NO: 4005479 - DNA, 17 bp, Homo sapiens
aatgaaaattgtattat

SEQ ID NO: 4005480 - DNA, 16 bp, Homo sapiens
aatgaaagactgtaca

SEQ ID NO: 4005481 - DNA, 13 bp, Homo sapiens
aatgaaagattaa

SEQ ID NO: 4005482 - DNA, 20 bp, Homo sapiens
aatgaaaggtactatatttg

SEQ ID NO: 4005483 - DNA, 18 bp, Homo sapiens
aatgaaagtgactttaaa

SEQ ID NO: 4005484 - DNA, 12 bp, Homo sapiens
aatgaaataatc

SEQ ID NO: 4005485 - DNA, 19 bp, Homo sapiens
aatgaaatattgtttccaa

SEQ ID NO: 4005486 - DNA, 16 bp, Homo sapiens
aatgaaatttgcaaaa

SEQ ID NO: 4005487 - DNA, 15 bp, Homo sapiens
aatgaacactctttt

SEQ ID NO: 4005488 - DNA, 23 bp, Homo sapiens
aatgaactatgtcgatgcacagt

SEQ ID NO: 4005489 - DNA, 14 bp, Homo sapiens
aatgaactgaagtt

SEQ ID NO: 4005490 - DNA, 13 bp, Homo sapiens
aatgaagattacc

SEQ ID NO: 4005491 - DNA, 15 bp, Homo sapiens
aatgaagcagcttta

SEQ ID NO: 4005492 - DNA, 22 bp, Homo sapiens
aatgaagcagctttaaacaaat

SEQ ID NO: 4005493 - DNA, 15 bp, Homo sapiens
aatgaagctttttaa

SEQ ID NO: 4005494 - DNA, 14 bp, Homo sapiens
aatgaataaactga

SEQ ID NO: 4005495 - DNA, 21 bp, Homo sapiens
aatgaataataattatccaga

SEQ ID NO: 4005496 - DNA, 14 bp, Homo sapiens
aatgaatatctatt

SEQ ID NO: 4005497 - DNA, 19 bp, Homo sapiens
aatgaatatctattaatat

SEQ ID NO: 4005498 - DNA, 14 bp, Homo sapiens
aatgaatgaaacat

SEQ ID NO: 4005499 - DNA, 23 bp, Homo sapiens
aatgaatgtttacactctttgta

SEQ ID NO: 4005500 - DNA, 12 bp, Homo sapiens
aatgactactta

SEQ ID NO: 4005501 - DNA, 15 bp, Homo sapiens
aatgactatataatt

SEQ ID NO: 4005502 - DNA, 17 bp, Homo sapiens
aattgcttttttaaata

SEQ ID NO: 4005503 - DNA, 20 bp, Homo sapiens
aattggtaaaactcactgtg

SEQ ID NO: 4005504 - DNA, 24 bp, Homo sapiens
aattgtaaattgaatcagtataaa

SEQ ID NO: 4005505 - DNA, 19 bp, Homo sapiens
aattgtaacctgcattttt

SEQ ID NO: 4005506 - DNA, 23 bp, Homo sapiens
aattgtcacctctgttaaggttg

SEQ ID NO: 4005507 - DNA, 19 bp, Homo sapiens
aattgtcactttttatgct

SEQ ID NO: 4005508 - DNA, 19 bp, Homo sapiens
aattgtctaaaatgtcagt

SEQ ID NO: 4005509 - DNA, 12 bp, Homo sapiens
aattgtctattt

SEQ ID NO: 4005510 - DNA, 21 bp, Homo sapiens
aattgtctatttatcttttat

SEQ ID NO: 4005511 - DNA, 12 bp, Homo sapiens
aattgtgaaaaa

SEQ ID NO: 4005512 - DNA, 13 bp, Homo sapiens
aattgtgctgcca

SEQ ID NO: 4005513 - DNA, 17 bp, Homo sapiens
aattgtgtagccttttt

SEQ ID NO: 4005514 - DNA, 21 bp, Homo sapiens
aattgtgtagcctttttgtat

SEQ ID NO: 4005515 - DNA, 23 bp, Homo sapiens
aattgtgtgtgatgtgaagccaa

SEQ ID NO: 4005516 - DNA, 12 bp, Homo sapiens
aattgttgtttc

SEQ ID NO: 4005517 - DNA, 23 bp, Homo sapiens
aattgttgtttctttctagtggt

SEQ ID NO: 4005518 - DNA, 14 bp, Homo sapiens
aattgtttagaaat

SEQ ID NO: 4005519 - DNA, 14 bp, Homo sapiens
aattgtttcagaat

SEQ ID NO: 4005520 - DNA, 18 bp, Homo sapiens
aattgttttaatctgaaa

SEQ ID NO: 4005521 - DNA, 20 bp, Homo sapiens
aattgtttttattgttttct

SEQ ID NO: 4005522 - DNA, 13 bp, Homo sapiens
aatttaaagatat

SEQ ID NO: 4005523 - DNA, 14 bp, Homo sapiens
aatttaaatataat

SEQ ID NO: 4005524 - DNA, 19 bp, Homo sapiens
aatttaaatataattctgt

SEQ ID NO: 4005525 - DNA, 11 bp, Homo sapiens
aatttaaattt

SEQ ID NO: 4005526 - DNA, 15 bp, Homo sapiens
aatttaaatttaaag

SEQ ID NO: 4005527 - DNA, 14 bp, Homo sapiens
aatttaacaaacta

SEQ ID NO: 4005528 - DNA, 16 bp, Homo sapiens
aatttaacaaactaaa

SEQ ID NO: 4005529 - DNA, 21 bp, Homo sapiens
aatttaactagacacagataa

SEQ ID NO: 4005530 - DNA, 14 bp, Homo sapiens
aatttaagcattgt

SEQ ID NO: 4005531 - DNA, 16 bp, Homo sapiens
aatttaagtgcgtgtg

SEQ ID NO: 4005532 - DNA, 19 bp, Homo sapiens
aatttaatccttctttgta

SEQ ID NO: 4005533 - DNA, 20 bp, Homo sapiens
aatttaatccttctttgtaa

SEQ ID NO: 4005534 - DNA, 18 bp, Homo sapiens
aatttacaaaaatataaa

SEQ ID NO: 4005535 - DNA, 19 bp, Homo sapiens
aatttagccctttaaaacg

SEQ ID NO: 4005536 - DNA, 16 bp, Homo sapiens
aatttagggtactaaa

SEQ ID NO: 4005537 - DNA, 20 bp, Homo sapiens
aatttaggtttttattagta

SEQ ID NO: 4005538 - DNA, 15 bp, Homo sapiens
aatttataaagtacc

SEQ ID NO: 4005539 - DNA, 15 bp, Homo sapiens
aatttatacaatatc

SEQ ID NO: 4005540 - DNA, 21 bp, Homo sapiens
aatttatacctacctgtgtgg

SEQ ID NO: 4005541 - DNA, 22 bp, Homo sapiens
aatttatcaaagcatagatgtt

SEQ ID NO: 4005542 - DNA, 22 bp, Homo sapiens
aatttatgtgaaatgctttctg

SEQ ID NO: 4005543 - DNA, 17 bp, Homo sapiens
aatttatttattaagat

SEQ ID NO: 4005544 - DNA, 22 bp, Homo sapiens
aatttatttattaagatggatt

SEQ ID NO: 4005545 - DNA, 20 bp, Homo sapiens
aatttatttcaataaatctt

SEQ ID NO: 4005546 - DNA, 14 bp, Homo sapiens
aatttatttccact

SEQ ID NO: 4005547 - DNA, 20 bp, Homo sapiens
aatttatttccactaaaaat

SEQ ID NO: 4005548 - DNA, 14 bp, Homo sapiens
aatttatttcccca

SEQ ID NO: 4005549 - DNA, 17 bp, Homo sapiens
aatttcaaaaatataac

SEQ ID NO: 4005550 - DNA, 16 bp, Homo sapiens
aatttcatatgctgta

SEQ ID NO: 4005551 - DNA, 16 bp, Homo sapiens
aatttcatgtaaaaca

SEQ ID NO: 4005552 - DNA, 18 bp, Homo sapiens
aatttcatgtaaaacaga

SEQ ID NO: 4005553 - DNA, 15 bp, Homo sapiens
aatttccagtacctt

SEQ ID NO: 4005554 - DNA, 20 bp, Homo sapiens
aatttccagtacctttgtca

SEQ ID NO: 4005555 - DNA, 22 bp, Homo sapiens
aatttcccacaccgtgtaaacc

SEQ ID NO: 4005556 - DNA, 15 bp, Homo sapiens
aatttcccaggaccc

SEQ ID NO: 4005557 - DNA, 12 bp, Homo sapiens
aatttccctcag

SEQ ID NO: 4005558 - DNA, 15 bp, Homo sapiens
aatttccctcaggtt

SEQ ID NO: 4005559 - DNA, 20 bp, Homo sapiens
aatttcctttttgacactga

SEQ ID NO: 4005560 - DNA, 17 bp, Homo sapiens
aatttctaaaaagatta

SEQ ID NO: 4005561 - DNA, 22 bp, Homo sapiens
aatttctaaaaagattagcaag

SEQ ID NO: 4005562 - DNA, 13 bp, Homo sapiens
aatttctaaagat

SEQ ID NO: 4005563 - DNA, 14 bp, Homo sapiens
aatttctcctccct

SEQ ID NO: 4005564 - DNA, 20 bp, Homo sapiens
aatttctcctcccttccttt

SEQ ID NO: 4005565 - DNA, 12 bp, Homo sapiens
aatttcttttcc

SEQ ID NO: 4005566 - DNA, 18 bp, Homo sapiens
aatttgattaacaaatat

SEQ ID NO: 4005567 - DNA, 17 bp, Homo sapiens
aatttgcattaaattca

SEQ ID NO: 4005568 - DNA, 13 bp, Homo sapiens
aatttgcctgctg

SEQ ID NO: 4005569 - DNA, 23 bp, Homo sapiens
aatttgtaaaaacagcattgctt

SEQ ID NO: 4005570 - DNA, 12 bp, Homo sapiens
aatttgtaaatg

SEQ ID NO: 4005571 - DNA, 13 bp, Homo sapiens
aatttgtaaatga

SEQ ID NO: 4005572 - DNA, 20 bp, Homo sapiens
aatttgtaaatgattttaat

SEQ ID NO: 4005573 - DNA, 14 bp, Homo sapiens
aatttgtaagtttc

SEQ ID NO: 4005574 - DNA, 18 bp, Homo sapiens
aatttgtaagtttcaggt

SEQ ID NO: 4005575 - DNA, 15 bp, Homo sapiens
aatttgtaattgctt

SEQ ID NO: 4005576 - DNA, 20 bp, Homo sapiens
aatttgtcagcgttctacca

SEQ ID NO: 4005577 - DNA, 23 bp, Homo sapiens
aatttgttataaggtagtactga

SEQ ID NO: 4005578 - DNA, 18 bp, Homo sapiens
aatttgtttaaagaataa

SEQ ID NO: 4005579 - DNA, 20 bp, Homo sapiens
aatttgtttaaagaataaag

SEQ ID NO: 4005580 - DNA, 21 bp, Homo sapiens
aatttgtttaaagaataaagt

SEQ ID NO: 4005581 - DNA, 14 bp, Homo sapiens
aattttaaaaatac

SEQ ID NO: 4005582 - DNA, 18 bp, Homo sapiens
aattttaaaaatacatat

SEQ ID NO: 4005583 - DNA, 17 bp, Homo sapiens
aattttaaataaaagtg

SEQ ID NO: 4005584 - DNA, 18 bp, Homo sapiens
aattttaaataaaagtga

SEQ ID NO: 4005585 - DNA, 22 bp, Homo sapiens
aattttaaataaaagtgatcaa

SEQ ID NO: 4005586 - DNA, 19 bp, Homo sapiens
aattttaatattcttttgt

SEQ ID NO: 4005587 - DNA, 20 bp, Homo sapiens
aattttaatattcttttgtt

SEQ ID NO: 4005588 - DNA, 23 bp, Homo sapiens
aattttactccataaacagactg

SEQ ID NO: 4005589 - DNA, 11 bp, Homo sapiens
aattttacttc

SEQ ID NO: 4005590 - DNA, 23 bp, Homo sapiens
aattttaggcactcttaaatgat

SEQ ID NO: 4005591 - DNA, 20 bp, Homo sapiens
aattttatccctcacctgta

SEQ ID NO: 4005592 - DNA, 13 bp, Homo sapiens
aattttattttgt

SEQ ID NO: 4005593 - DNA, 19 bp, Homo sapiens
aattttcaagtaattgtga

SEQ ID NO: 4005594 - DNA, 20 bp, Homo sapiens
aattttcagtataatttaac

SEQ ID NO: 4005595 - DNA, 23 bp, Homo sapiens
aattttctccctttatgtatctc

SEQ ID NO: 4005596 - DNA, 22 bp, Homo sapiens
aattttcttcatgcaatgacat

SEQ ID NO: 4005597 - DNA, 23 bp, Homo sapiens
aattttgataaaaatttagaaca

SEQ ID NO: 4005598 - DNA, 12 bp, Homo sapiens
aatttttaaaaa

SEQ ID NO: 4005599 - DNA, 19 bp, Homo sapiens
aatttttaaaaatacactt

SEQ ID NO: 4005600 - DNA, 20 bp, Homo sapiens
aatttttaaatgtaaaacat

SEQ ID NO: 4005601 - DNA, 11 bp, Homo sapiens
aatttttaagc

SEQ ID NO: 4005602 - DNA, 17 bp, Homo sapiens
aatttttaagctgcaaa

SEQ ID NO: 4005603 - DNA, 22 bp, Homo sapiens
aatttttaccctaatgtcttca

SEQ ID NO: 4005604 - DNA, 12 bp, Homo sapiens
acagatctggaa

SEQ ID NO: 4005605 - DNA, 12 bp, Homo sapiens
acagatgaaaat

SEQ ID NO: 4005606 - DNA, 14 bp, Homo sapiens
acagatgaatgtat

SEQ ID NO: 4005607 - DNA, 20 bp, Homo sapiens
acagatgatgagaatttcta

SEQ ID NO: 4005608 - DNA, 13 bp, Homo sapiens
acagatgccccag

SEQ ID NO: 4005609 - DNA, 18 bp, Homo sapiens
acagatgccccagagctg

SEQ ID NO: 4005610 - DNA, 19 bp, Homo sapiens
acagatgctaataaactgt

SEQ ID NO: 4005611 - DNA, 16 bp, Homo sapiens
acagatgtctctgggg

SEQ ID NO: 4005612 - DNA, 12 bp, Homo sapiens
acagatgttgaa

SEQ ID NO: 4005613 - DNA, 19 bp, Homo sapiens
acagattcaggccagccca

SEQ ID NO: 4005614 - DNA, 22 bp, Homo sapiens
acagattcaggccagcccagcc

SEQ ID NO: 4005615 - DNA, 13 bp, Homo sapiens
acagattgcctcc

SEQ ID NO: 4005616 - DNA, 14 bp, Homo sapiens
acagattgcctcct

SEQ ID NO: 4005617 - DNA, 16 bp, Homo sapiens
acagatttcatacctc

SEQ ID NO: 4005618 - DNA, 16 bp, Homo sapiens
acagatttttacaaat

SEQ ID NO: 4005619 - DNA, 19 bp, Homo sapiens
acagcaattcctcaggcta

SEQ ID NO: 4005620 - DNA, 14 bp, Homo sapiens
acagcaatttctaa

SEQ ID NO: 4005621 - DNA, 19 bp, Homo sapiens
acagcactactgggtgtca

SEQ ID NO: 4005622 - DNA, 14 bp, Homo sapiens
acagcactggggag

SEQ ID NO: 4005623 - DNA, 22 bp, Homo sapiens
acagcagtcccagtattctcag

SEQ ID NO: 4005624 - DNA, 22 bp, Homo sapiens
acagcagtcttatgcttccaga

SEQ ID NO: 4005625 - DNA, 22 bp, Homo sapiens
acagcagtgatctcagggcaga

SEQ ID NO: 4005626 - DNA, 16 bp, Homo sapiens
acagcagtgtcatcag

SEQ ID NO: 4005627 - DNA, 18 bp, Homo sapiens
acagcagtgttctcacag

SEQ ID NO: 4005628 - DNA, 16 bp, Homo sapiens
acagcatcattttgca

SEQ ID NO: 4005629 - DNA, 15 bp, Homo sapiens
acagcatcccttccc

SEQ ID NO: 4005630 - DNA, 16 bp, Homo sapiens
acagcatcccttccca

SEQ ID NO: 4005631 - DNA, 21 bp, Homo sapiens
acagcatcgggagcacccaga

SEQ ID NO: 4005632 - DNA, 22 bp, Homo sapiens
acagcatcgggagcacccagag

SEQ ID NO: 4005633 - DNA, 20 bp, Homo sapiens
acagcatgaggtgttgtgca

SEQ ID NO: 4005634 - DNA, 17 bp, Homo sapiens
acagcatgccccttggc

SEQ ID NO: 4005635 - DNA, 19 bp, Homo sapiens
acagcatgccccttggctg

SEQ ID NO: 4005636 - DNA, 21 bp, Homo sapiens
acagcatgccccttggctgga

SEQ ID NO: 4005637 - DNA, 22 bp, Homo sapiens
acagcatgtacggattttcagt

SEQ ID NO: 4005638 - DNA, 13 bp, Homo sapiens
acagcatgtgtat

SEQ ID NO: 4005639 - DNA, 22 bp, Homo sapiens
acagccaacacgcacctgcctc

SEQ ID NO: 4005640 - DNA, 19 bp, Homo sapiens
acagccaactagcccctgg

SEQ ID NO: 4005641 - DNA, 20 bp, Homo sapiens
acagccaagattttcctctt

SEQ ID NO: 4005642 - DNA, 13 bp, Homo sapiens
acagccaagtgcc

SEQ ID NO: 4005643 - DNA, 18 bp, Homo sapiens
acagccaagtgccaaatg

SEQ ID NO: 4005644 - DNA, 20 bp, Homo sapiens
acagccacatccccaagccc

SEQ ID NO: 4005645 - DNA, 20 bp, Homo sapiens
acagccagaactctgtgtcc

SEQ ID NO: 4005646 - DNA, 13 bp, Homo sapiens
acagccagagctg

SEQ ID NO: 4005647 - DNA, 13 bp, Homo sapiens
acagccagaggag

SEQ ID NO: 4005648 - DNA, 18 bp, Homo sapiens
acagccatgtccaagttc

SEQ ID NO: 4005649 - DNA, 20 bp, Homo sapiens
acagcccctatagcactgag

SEQ ID NO: 4005650 - DNA, 13 bp, Homo sapiens
acagccgctccag

SEQ ID NO: 4005651 - DNA, 17 bp, Homo sapiens
acagccgtcagccaaat

SEQ ID NO: 4005652 - DNA, 18 bp, Homo sapiens
acagcctcacttgaatgt

SEQ ID NO: 4005653 - DNA, 16 bp, Homo sapiens
acagcctccagggccc

SEQ ID NO: 4005654 - DNA, 16 bp, Homo sapiens
acagcctcccaccccc

SEQ ID NO: 4005655 - DNA, 12 bp, Homo sapiens
acagcctcctct

SEQ ID NO: 4005656 - DNA, 17 bp, Homo sapiens
acagcctcctctgtctg

SEQ ID NO: 4005657 - DNA, 23 bp, Homo sapiens
acagcctcctctgtctgcccttc

SEQ ID NO: 4005658 - DNA, 14 bp, Homo sapiens
acagcctcttactt

SEQ ID NO: 4005659 - DNA, 21 bp, Homo sapiens
acagcctggtcgccttccacc

SEQ ID NO: 4005660 - DNA, 16 bp, Homo sapiens
acagccttgtccccct

SEQ ID NO: 4005661 - DNA, 14 bp, Homo sapiens
acagcgagaggcag

SEQ ID NO: 4005662 - DNA, 22 bp, Homo sapiens
acagcgagaggcagagaaagaa

SEQ ID NO: 4005663 - DNA, 13 bp, Homo sapiens
acagcggcccctg

SEQ ID NO: 4005664 - DNA, 19 bp, Homo sapiens
acagcggctcccctctgct

SEQ ID NO: 4005665 - DNA, 22 bp, Homo sapiens
acagcggtcagatagcatcaga

SEQ ID NO: 4005666 - DNA, 15 bp, Homo sapiens
acagcgtccctggcg

SEQ ID NO: 4005667 - DNA, 21 bp, Homo sapiens
acagctacttggtttgtgttc

SEQ ID NO: 4005668 - DNA, 21 bp, Homo sapiens
acagctagtgaagaccagagc

SEQ ID NO: 4005669 - DNA, 23 bp, Homo sapiens
acagctagtgaagaccagagcag

SEQ ID NO: 4005670 - DNA, 14 bp, Homo sapiens
acagctcattaaac

SEQ ID NO: 4005671 - DNA, 17 bp, Homo sapiens
acagctcattaaacttt

SEQ ID NO: 4005672 - DNA, 17 bp, Homo sapiens
acagctccaccctggcc

SEQ ID NO: 4005673 - DNA, 15 bp, Homo sapiens
acagctctggccaca

SEQ ID NO: 4005674 - DNA, 16 bp, Homo sapiens
acagctcttaaatgta

SEQ ID NO: 4005675 - DNA, 14 bp, Homo sapiens
acagctcttcacac

SEQ ID NO: 4005676 - DNA, 16 bp, Homo sapiens
acagctcttcacacca

SEQ ID NO: 4005677 - DNA, 14 bp, Homo sapiens
acagctgagcactt

SEQ ID NO: 4005678 - DNA, 20 bp, Homo sapiens
acagctgcattagaaaaaga

SEQ ID NO: 4005679 - DNA, 10 bp, Homo sapiens
acagctgccc

SEQ ID NO: 4005680 - DNA, 12 bp, Homo sapiens
acagctgcccta

SEQ ID NO: 4005681 - DNA, 15 bp, Homo sapiens
acagctgccctagct

SEQ ID NO: 4005682 - DNA, 17 bp, Homo sapiens
acagctgctgttctcag

SEQ ID NO: 4005683 - DNA, 22 bp, Homo sapiens
acagctgctgttctcaggacag

SEQ ID NO: 4005684 - DNA, 13 bp, Homo sapiens
acagctgctttct

SEQ ID NO: 4005685 - DNA, 15 bp, Homo sapiens
acagctgctttctgt

SEQ ID NO: 4005686 - DNA, 15 bp, Homo sapiens
acagctggagctctc

SEQ ID NO: 4005687 - DNA, 18 bp, Homo sapiens
acagctggatctgcttgt

SEQ ID NO: 4005688 - DNA, 11 bp, Homo sapiens
acagctgggca

SEQ ID NO: 4005689 - DNA, 21 bp, Homo sapiens
acagctgttcttctgttctgc

SEQ ID NO: 4005690 - DNA, 23 bp, Homo sapiens
acagcttaatagtagttagctta

SEQ ID NO: 4005691 - DNA, 12 bp, Homo sapiens
acagcttagaat

SEQ ID NO: 4005692 - DNA, 17 bp, Homo sapiens
acagcttagatttcata

SEQ ID NO: 4005693 - DNA, 17 bp, Homo sapiens
acagcttcatgcctttg

SEQ ID NO: 4005694 - DNA, 19 bp, Homo sapiens
acagcttcatgcctttgta

SEQ ID NO: 4005695 - DNA, 11 bp, Homo sapiens
acagcttcctc

SEQ ID NO: 4005696 - DNA, 13 bp, Homo sapiens
acagcttcctcac

SEQ ID NO: 4005697 - DNA, 16 bp, Homo sapiens
acagcttcctcacacc

SEQ ID NO: 4005698 - DNA, 16 bp, Homo sapiens
acagcttgagccgggc

SEQ ID NO: 4005699 - DNA, 17 bp, Homo sapiens
acagctttcttgctccc

SEQ ID NO: 4005700 - DNA, 22 bp, Homo sapiens
acagcttttgcaacttaatact

SEQ ID NO: 4005701 - DNA, 16 bp, Homo sapiens
acaggaaagccctccc

SEQ ID NO: 4005702 - DNA, 15 bp, Homo sapiens
acaggaagcacccca

SEQ ID NO: 4005703 - DNA, 15 bp, Homo sapiens
acaggaagctggcag

SEQ ID NO: 4005704 - DNA, 13 bp, Homo sapiens
acaggacagagtt

SEQ ID NO: 4005705 - DNA, 20 bp, Homo sapiens
acaggacagagttcacagga

SEQ ID NO: 4005706 - DNA, 22 bp, Homo sapiens
acaggacatgcggtagccagca

SEQ ID NO: 4005707 - DNA, 21 bp, Homo sapiens
acatttctgatcagaggtgta

SEQ ID NO: 4005708 - DNA, 20 bp, Homo sapiens
acatttgagggcccagccag

SEQ ID NO: 4005709 - DNA, 14 bp, Homo sapiens
acatttgccttgct

SEQ ID NO: 4005710 - DNA, 19 bp, Homo sapiens
acatttgggagacatgtga

SEQ ID NO: 4005711 - DNA, 20 bp, Homo sapiens
acatttgggagacatgtgac

SEQ ID NO: 4005712 - DNA, 21 bp, Homo sapiens
acatttgggagacatgtgaca

SEQ ID NO: 4005713 - DNA, 15 bp, Homo sapiens
acatttgtcacagaa

SEQ ID NO: 4005714 - DNA, 18 bp, Homo sapiens
acatttgtcacagaaatc

SEQ ID NO: 4005715 - DNA, 14 bp, Homo sapiens
acatttgttcctgg

SEQ ID NO: 4005716 - DNA, 18 bp, Homo sapiens
acattttaaaaacataga

SEQ ID NO: 4005717 - DNA, 13 bp, Homo sapiens
acattttaattca

SEQ ID NO: 4005718 - DNA, 22 bp, Homo sapiens
acattttatttttaaaatatta

SEQ ID NO: 4005719 - DNA, 12 bp, Homo sapiens
acattttgaagt

SEQ ID NO: 4005720 - DNA, 13 bp, Homo sapiens
acattttgaagtg

SEQ ID NO: 4005721 - DNA, 22 bp, Homo sapiens
acatttttaatttaacaaacta

SEQ ID NO: 4005722 - DNA, 18 bp, Homo sapiens
acatttttagcctgtgtc

SEQ ID NO: 4005723 - DNA, 13 bp, Homo sapiens
acatttttattta

SEQ ID NO: 4005724 - DNA, 17 bp, Homo sapiens
acatttttatttatgaa

SEQ ID NO: 4005725 - DNA, 15 bp, Homo sapiens
accaaaagaacaaga

SEQ ID NO: 4005726 - DNA, 15 bp, Homo sapiens
accaaactcccatca

SEQ ID NO: 4005727 - DNA, 22 bp, Homo sapiens
accaaagatatatacacaggat

SEQ ID NO: 4005728 - DNA, 19 bp, Homo sapiens
accaaatcagctgctacta

SEQ ID NO: 4005729 - DNA, 17 bp, Homo sapiens
accaaatttttctatca

SEQ ID NO: 4005730 - DNA, 14 bp, Homo sapiens
accaacatctttgc

SEQ ID NO: 4005731 - DNA, 22 bp, Homo sapiens
accaacatctttgcgaaaagat

SEQ ID NO: 4005732 - DNA, 13 bp, Homo sapiens
accaaccacagca

SEQ ID NO: 4005733 - DNA, 19 bp, Homo sapiens
accaacctgaagacaccgt

SEQ ID NO: 4005734 - DNA, 15 bp, Homo sapiens
accaacctgctctgt

SEQ ID NO: 4005735 - DNA, 13 bp, Homo sapiens
accaacctttaaa

SEQ ID NO: 4005736 - DNA, 15 bp, Homo sapiens
accaacctttaaaat

SEQ ID NO: 4005737 - DNA, 20 bp, Homo sapiens
accaactgccctaagccccc

SEQ ID NO: 4005738 - DNA, 14 bp, Homo sapiens
accaagaaagcagg

SEQ ID NO: 4005739 - DNA, 14 bp, Homo sapiens
accaagaactgcat

SEQ ID NO: 4005740 - DNA, 15 bp, Homo sapiens
accaagaactgcatg

SEQ ID NO: 4005741 - DNA, 13 bp, Homo sapiens
accaagagaaggg

SEQ ID NO: 4005742 - DNA, 17 bp, Homo sapiens
accaagcagtggccttt

SEQ ID NO: 4005743 - DNA, 15 bp, Homo sapiens
accaagccgtggctt

SEQ ID NO: 4005744 - DNA, 14 bp, Homo sapiens
accaagctgagttt

SEQ ID NO: 4005745 - DNA, 19 bp, Homo sapiens
accaagctgagtttcctat

SEQ ID NO: 4005746 - DNA, 11 bp, Homo sapiens
accaaggaaac

SEQ ID NO: 4005747 - DNA, 20 bp, Homo sapiens
accaaggaaacgctacctct

SEQ ID NO: 4005748 - DNA, 17 bp, Homo sapiens
accaaggaagcagcctc

SEQ ID NO: 4005749 - DNA, 15 bp, Homo sapiens
accaagtatttatta

SEQ ID NO: 4005750 - DNA, 19 bp, Homo sapiens
accaagtcggaacagcaga

SEQ ID NO: 4005751 - DNA, 23 bp, Homo sapiens
accaagttggaacatccttggaa

SEQ ID NO: 4005752 - DNA, 14 bp, Homo sapiens
accaagtttattca

SEQ ID NO: 4005753 - DNA, 18 bp, Homo sapiens
accaagtttattcagtaa

SEQ ID NO: 4005754 - DNA, 21 bp, Homo sapiens
accaagtttattcagtaaaca

SEQ ID NO: 4005755 - DNA, 13 bp, Homo sapiens
accaatcccaact

SEQ ID NO: 4005756 - DNA, 16 bp, Homo sapiens
accaatcccagggctg

SEQ ID NO: 4005757 - DNA, 19 bp, Homo sapiens
accaatcccagggctggct

SEQ ID NO: 4005758 - DNA, 23 bp, Homo sapiens
accaatcccagggctggctctgc

SEQ ID NO: 4005759 - DNA, 23 bp, Homo sapiens
accaatcccgtgaaagaattatt

SEQ ID NO: 4005760 - DNA, 16 bp, Homo sapiens
accaatgcccagcagg

SEQ ID NO: 4005761 - DNA, 15 bp, Homo sapiens
accaattgtgctgcc

SEQ ID NO: 4005762 - DNA, 14 bp, Homo sapiens
accacaaaaatgaa

SEQ ID NO: 4005763 - DNA, 17 bp, Homo sapiens
accacaccctgtactgt

SEQ ID NO: 4005764 - DNA, 12 bp, Homo sapiens
accacagacaca

SEQ ID NO: 4005765 - DNA, 13 bp, Homo sapiens
accacagacacac

SEQ ID NO: 4005766 - DNA, 14 bp, Homo sapiens
accacagacacaca

SEQ ID NO: 4005767 - DNA, 18 bp, Homo sapiens
accacagacacacacacg

SEQ ID NO: 4005768 - DNA, 21 bp, Homo sapiens
accacagcagctgaacagcca

SEQ ID NO: 4005769 - DNA, 16 bp, Homo sapiens
accacagcatcatttt

SEQ ID NO: 4005770 - DNA, 21 bp, Homo sapiens
accacagctccttttccagag

SEQ ID NO: 4005771 - DNA, 17 bp, Homo sapiens
accacaggcatctacac

SEQ ID NO: 4005772 - DNA, 23 bp, Homo sapiens
accacaggcatctacacagcctg

SEQ ID NO: 4005773 - DNA, 17 bp, Homo sapiens
accacagggttcaaaat

SEQ ID NO: 4005774 - DNA, 22 bp, Homo sapiens
accacagggttcaaaatgtctg

SEQ ID NO: 4005775 - DNA, 23 bp, Homo sapiens
accacagggttcaaaatgtctgt

SEQ ID NO: 4005776 - DNA, 22 bp, Homo sapiens
accacaggttcatgccaccatg

SEQ ID NO: 4005777 - DNA, 12 bp, Homo sapiens
accacagtgtct

SEQ ID NO: 4005778 - DNA, 23 bp, Homo sapiens
accacatccacacacgcaggaac

SEQ ID NO: 4005779 - DNA, 17 bp, Homo sapiens
accacatgccactgcct

SEQ ID NO: 4005780 - DNA, 18 bp, Homo sapiens
accaccccaacaaaccat

SEQ ID NO: 4005781 - DNA, 20 bp, Homo sapiens
accaccctagtcccttcccc

SEQ ID NO: 4005782 - DNA, 12 bp, Homo sapiens
accaccctcctt

SEQ ID NO: 4005783 - DNA, 15 bp, Homo sapiens
accacctgcttctga

SEQ ID NO: 4005784 - DNA, 18 bp, Homo sapiens
accacggcgtttttttac

SEQ ID NO: 4005785 - DNA, 20 bp, Homo sapiens
accacgttgggacagggagg

SEQ ID NO: 4005786 - DNA, 19 bp, Homo sapiens
accactaggaatcccagag

SEQ ID NO: 4005787 - DNA, 14 bp, Homo sapiens
accactatttaagt

SEQ ID NO: 4005788 - DNA, 14 bp, Homo sapiens
accactcgtgcatc

SEQ ID NO: 4005789 - DNA, 19 bp, Homo sapiens
accactgtaaaatgaaatt

SEQ ID NO: 4005790 - DNA, 14 bp, Homo sapiens
accacttccagggg

SEQ ID NO: 4005791 - DNA, 22 bp, Homo sapiens
accacttcctgctacaggaggg

SEQ ID NO: 4005792 - DNA, 21 bp, Homo sapiens
accactttcttattctgtatc

SEQ ID NO: 4005793 - DNA, 15 bp, Homo sapiens
accagaagccttgga

SEQ ID NO: 4005794 - DNA, 14 bp, Homo sapiens
accagacaagctgt

SEQ ID NO: 4005795 - DNA, 23 bp, Homo sapiens
accagactacttgggagcaccgc

SEQ ID NO: 4005796 - DNA, 12 bp, Homo sapiens
accagagcagat

SEQ ID NO: 4005797 - DNA, 17 bp, Homo sapiens
accagagcagatgcaga

SEQ ID NO: 4005798 - DNA, 22 bp, Homo sapiens
accagagcagatgcagagagcc

SEQ ID NO: 4005799 - DNA, 19 bp, Homo sapiens
accagagccccccacaatg

SEQ ID NO: 4005800 - DNA, 11 bp, Homo sapiens
accagaggccg

SEQ ID NO: 4005801 - DNA, 23 bp, Homo sapiens
accagaggccgaaggtgcctcag

SEQ ID NO: 4005802 - DNA, 16 bp, Homo sapiens
accagagggtgtggct

SEQ ID NO: 4005803 - DNA, 22 bp, Homo sapiens
accagagtgctgaaggaatgga

SEQ ID NO: 4005804 - DNA, 17 bp, Homo sapiens
accagataaatagaact

SEQ ID NO: 4005805 - DNA, 23 bp, Homo sapiens
accagataaatagaactatctgc

SEQ ID NO: 4005806 - DNA, 17 bp, Homo sapiens
accagcaatatatctga

SEQ ID NO: 4005807 - DNA, 16 bp, Homo sapiens
accagcactgtctcag

SEQ ID NO: 4005808 - DNA, 14 bp, Homo sapiens
accagcatctggaa

SEQ ID NO: 4005809 - DNA, 15 bp, Homo sapiens
accagccagatcctc

SEQ ID NO: 4005810 - DNA, 13 bp, Homo sapiens
accctggggcctg

SEQ ID NO: 4005811 - DNA, 18 bp, Homo sapiens
accctgggtgggctctgt

SEQ ID NO: 4005812 - DNA, 20 bp, Homo sapiens
accctggtctgaggatgtag

SEQ ID NO: 4005813 - DNA, 17 bp, Homo sapiens
accctgtacctcatccc

SEQ ID NO: 4005814 - DNA, 21 bp, Homo sapiens
accctgtcaagttaacaagga

SEQ ID NO: 4005815 - DNA, 22 bp, Homo sapiens
accctgtcaagttaacaaggaa

SEQ ID NO: 4005816 - DNA, 17 bp, Homo sapiens
accctgtcttctgggca

SEQ ID NO: 4005817 - DNA, 19 bp, Homo sapiens
accctgtgacatggtgcct

SEQ ID NO: 4005818 - DNA, 21 bp, Homo sapiens
accctgtgacatggtgcctga

SEQ ID NO: 4005819 - DNA, 18 bp, Homo sapiens
accctgttttgagccctg

SEQ ID NO: 4005820 - DNA, 19 bp, Homo sapiens
acccttaccccttagcctc

SEQ ID NO: 4005821 - DNA, 21 bp, Homo sapiens
acccttcacaccccaggccct

SEQ ID NO: 4005822 - DNA, 12 bp, Homo sapiens
acccttcagacc

SEQ ID NO: 4005823 - DNA, 14 bp, Homo sapiens
acccttcagacccc

SEQ ID NO: 4005824 - DNA, 16 bp, Homo sapiens
acccttcagaccccag

SEQ ID NO: 4005825 - DNA, 17 bp, Homo sapiens
acccttcatcttcctgt

SEQ ID NO: 4005826 - DNA, 19 bp, Homo sapiens
acccttcatcttcctgtgt

SEQ ID NO: 4005827 - DNA, 22 bp, Homo sapiens
acccttcccgcctccctctcag

SEQ ID NO: 4005828 - DNA, 13 bp, Homo sapiens
acccttccctgca

SEQ ID NO: 4005829 - DNA, 20 bp, Homo sapiens
acccttgctttcctgggcct

SEQ ID NO: 4005830 - DNA, 12 bp, Homo sapiens
acccttggcctg

SEQ ID NO: 4005831 - DNA, 18 bp, Homo sapiens
acccttgtgagagcccat

SEQ ID NO: 4005832 - DNA, 22 bp, Homo sapiens
accctttgctgtgaggctgtcc

SEQ ID NO: 4005833 - DNA, 23 bp, Homo sapiens
accctttgctgtgaggctgtcct

SEQ ID NO: 4005834 - DNA, 12 bp, Homo sapiens
accctttggttt

SEQ ID NO: 4005835 - DNA, 21 bp, Homo sapiens
acccttttcccccttcccatt

SEQ ID NO: 4005836 - DNA, 15 bp, Homo sapiens
accgaccaactgccc

SEQ ID NO: 4005837 - DNA, 18 bp, Homo sapiens
accgagcgctttctggaa

SEQ ID NO: 4005838 - DNA, 20 bp, Homo sapiens
accgagcgctttctggaaaa

SEQ ID NO: 4005839 - DNA, 16 bp, Homo sapiens
accgagtctcttctcc

SEQ ID NO: 4005840 - DNA, 18 bp, Homo sapiens
accgagtctcttctccac

SEQ ID NO: 4005841 - DNA, 14 bp, Homo sapiens
accgagtgaaccta

SEQ ID NO: 4005842 - DNA, 16 bp, Homo sapiens
accgataatgcatgaa

SEQ ID NO: 4005843 - DNA, 18 bp, Homo sapiens
accgcaactcacacattc

SEQ ID NO: 4005844 - DNA, 20 bp, Homo sapiens
accgccacgtcccagcatcc

SEQ ID NO: 4005845 - DNA, 12 bp, Homo sapiens
accgccccctcc

SEQ ID NO: 4005846 - DNA, 14 bp, Homo sapiens
accgccccctcctc

SEQ ID NO: 4005847 - DNA, 18 bp, Homo sapiens
accgccctgggctggact

SEQ ID NO: 4005848 - DNA, 19 bp, Homo sapiens
accgcctagtttactgttt

SEQ ID NO: 4005849 - DNA, 16 bp, Homo sapiens
accgcgactaatttca

SEQ ID NO: 4005850 - DNA, 18 bp, Homo sapiens
accgctggcccttagaga

SEQ ID NO: 4005851 - DNA, 15 bp, Homo sapiens
accgcttctgccttt

SEQ ID NO: 4005852 - DNA, 15 bp, Homo sapiens
accggaaggttttta

SEQ ID NO: 4005853 - DNA, 18 bp, Homo sapiens
accggcctggctgcagct

SEQ ID NO: 4005854 - DNA, 19 bp, Homo sapiens
accgggacagacctggaca

SEQ ID NO: 4005855 - DNA, 18 bp, Homo sapiens
accgggagaaggcatgag

SEQ ID NO: 4005856 - DNA, 19 bp, Homo sapiens
accgggagaaggcatgaga

SEQ ID NO: 4005857 - DNA, 13 bp, Homo sapiens
accggtcagtgcc

SEQ ID NO: 4005858 - DNA, 14 bp, Homo sapiens
accggtggggctgg

SEQ ID NO: 4005859 - DNA, 17 bp, Homo sapiens
accgtaataattattat

SEQ ID NO: 4005860 - DNA, 13 bp, Homo sapiens
accgtactctcac

SEQ ID NO: 4005861 - DNA, 19 bp, Homo sapiens
accgtactctcacatgtgg

SEQ ID NO: 4005862 - DNA, 12 bp, Homo sapiens
accgtgcctggc

SEQ ID NO: 4005863 - DNA, 14 bp, Homo sapiens
accgtggacaggcc

SEQ ID NO: 4005864 - DNA, 16 bp, Homo sapiens
accgtggacaggccca

SEQ ID NO: 4005865 - DNA, 16 bp, Homo sapiens
accgtgggcagggagc

SEQ ID NO: 4005866 - DNA, 14 bp, Homo sapiens
accgtgtcaagctg

SEQ ID NO: 4005867 - DNA, 16 bp, Homo sapiens
accgtgtccagcacag

SEQ ID NO: 4005868 - DNA, 23 bp, Homo sapiens
accgtgtccagcacagaaggaat

SEQ ID NO: 4005869 - DNA, 19 bp, Homo sapiens
accgttcagtgtcccaggc

SEQ ID NO: 4005870 - DNA, 21 bp, Homo sapiens
accgttcagtgtcccaggcag

SEQ ID NO: 4005871 - DNA, 22 bp, Homo sapiens
accgttcagtgtcccaggcagc

SEQ ID NO: 4005872 - DNA, 16 bp, Homo sapiens
accgttgcttgaaatt

SEQ ID NO: 4005873 - DNA, 10 bp, Homo sapiens
acctaaagac

SEQ ID NO: 4005874 - DNA, 22 bp, Homo sapiens
acctaaagacgtctctttttgg

SEQ ID NO: 4005875 - DNA, 16 bp, Homo sapiens
acctaatcaggctgag

SEQ ID NO: 4005876 - DNA, 15 bp, Homo sapiens
acctaatccaggcag

SEQ ID NO: 4005877 - DNA, 17 bp, Homo sapiens
agtaagaaatttgcagt

SEQ ID NO: 4005878 - DNA, 20 bp, Homo sapiens
agtccgacctggcctgtctg

SEQ ID NO: 4005879 - DNA, 17 bp, Homo sapiens
agtcctcactcccagtc

SEQ ID NO: 4005880 - DNA, 17 bp, Homo sapiens
agtcctcataaaaagca

SEQ ID NO: 4005881 - DNA, 16 bp, Homo sapiens
agtcctccactcgacc

SEQ ID NO: 4005882 - DNA, 14 bp, Homo sapiens
agtcctccagaact

SEQ ID NO: 4005883 - DNA, 13 bp, Homo sapiens
agtcctcctggga

SEQ ID NO: 4005884 - DNA, 17 bp, Homo sapiens
agtcctctagcaggcct

SEQ ID NO: 4005885 - DNA, 16 bp, Homo sapiens
agtcctcttattccta

SEQ ID NO: 4005886 - DNA, 20 bp, Homo sapiens
agtcctgactgggctgggtt

SEQ ID NO: 4005887 - DNA, 21 bp, Homo sapiens
agtcctgactgggctgggttt

SEQ ID NO: 4005888 - DNA, 17 bp, Homo sapiens
agtcctgcctggccagg

SEQ ID NO: 4005889 - DNA, 19 bp, Homo sapiens
agtcctgctacctcccttg

SEQ ID NO: 4005890 - DNA, 21 bp, Homo sapiens
agtcctgctacctcccttgcc

SEQ ID NO: 4005891 - DNA, 18 bp, Homo sapiens
agtcctggctacatccca

SEQ ID NO: 4005892 - DNA, 21 bp, Homo sapiens
agtccttaaaaatcacactgt

SEQ ID NO: 4005893 - DNA, 18 bp, Homo sapiens
agtccttatctagctgca

SEQ ID NO: 4005894 - DNA, 22 bp, Homo sapiens
agtcctttgtgaatattttcaa

SEQ ID NO: 4005895 - DNA, 16 bp, Homo sapiens
agtcctttttttccat

SEQ ID NO: 4005896 - DNA, 21 bp, Homo sapiens
agtcctttttttccatcttta

SEQ ID NO: 4005897 - DNA, 17 bp, Homo sapiens
agtcgcagaccagagct

SEQ ID NO: 4005898 - DNA, 14 bp, Homo sapiens
agtcgcctgcctgc

SEQ ID NO: 4005899 - DNA, 15 bp, Homo sapiens
agtcgcctgcctgca

SEQ ID NO: 4005900 - DNA, 17 bp, Homo sapiens
agtcgcctgcctgcagc

SEQ ID NO: 4005901 - DNA, 15 bp, Homo sapiens
agtcggccccatctc

SEQ ID NO: 4005902 - DNA, 21 bp, Homo sapiens
agtcgtggctttggcagtgtt

SEQ ID NO: 4005903 - DNA, 22 bp, Homo sapiens
agtctaaacaaaattgcaattt

SEQ ID NO: 4005904 - DNA, 17 bp, Homo sapiens
agtctaaatatttcctt

SEQ ID NO: 4005905 - DNA, 23 bp, Homo sapiens
agtctaaatatttccttaaactg

SEQ ID NO: 4005906 - DNA, 21 bp, Homo sapiens
agtctagcgtagtgcagcagg

SEQ ID NO: 4005907 - DNA, 23 bp, Homo sapiens
agtctagcgtagtgcagcagggc

SEQ ID NO: 4005908 - DNA, 11 bp, Homo sapiens
agtctattttt

SEQ ID NO: 4005909 - DNA, 21 bp, Homo sapiens
agtctatttttttaactgaaa

SEQ ID NO: 4005910 - DNA, 19 bp, Homo sapiens
agtctcagtggcttcatct

SEQ ID NO: 4005911 - DNA, 18 bp, Homo sapiens
agtctcattacttttgaa

SEQ ID NO: 4005912 - DNA, 15 bp, Homo sapiens
agtctcatttctcat

SEQ ID NO: 4005913 - DNA, 12 bp, Homo sapiens
agtctccctctg

SEQ ID NO: 4005914 - DNA, 15 bp, Homo sapiens
agtctcccttcctat

SEQ ID NO: 4005915 - DNA, 14 bp, Homo sapiens
agtctcctctctga

SEQ ID NO: 4005916 - DNA, 15 bp, Homo sapiens
agtctcctctctgag

SEQ ID NO: 4005917 - DNA, 16 bp, Homo sapiens
agtctcctctctgaga

SEQ ID NO: 4005918 - DNA, 14 bp, Homo sapiens
agtctccttcccct

SEQ ID NO: 4005919 - DNA, 19 bp, Homo sapiens
agtctcctttgcactgagg

SEQ ID NO: 4005920 - DNA, 22 bp, Homo sapiens
agtctcctttgcactgagggcc

SEQ ID NO: 4005921 - DNA, 23 bp, Homo sapiens
agtctcctttgcactgagggcca

SEQ ID NO: 4005922 - DNA, 23 bp, Homo sapiens
agtctctctgtgaatacaattaa

SEQ ID NO: 4005923 - DNA, 14 bp, Homo sapiens
agtctctgccaccc

SEQ ID NO: 4005924 - DNA, 18 bp, Homo sapiens
agtctctgccacccactc

SEQ ID NO: 4005925 - DNA, 17 bp, Homo sapiens
agtctctgctggcccag

SEQ ID NO: 4005926 - DNA, 14 bp, Homo sapiens
agtctcttctccac

SEQ ID NO: 4005927 - DNA, 15 bp, Homo sapiens
agtctcttctccact

SEQ ID NO: 4005928 - DNA, 15 bp, Homo sapiens
agtctctttaatctt

SEQ ID NO: 4005929 - DNA, 16 bp, Homo sapiens
agtctgaacagctgta

SEQ ID NO: 4005930 - DNA, 18 bp, Homo sapiens
agtctgaacagctgtaat

SEQ ID NO: 4005931 - DNA, 16 bp, Homo sapiens
agtctgaatgctgcca

SEQ ID NO: 4005932 - DNA, 17 bp, Homo sapiens
agtctgaatgctgccac

SEQ ID NO: 4005933 - DNA, 14 bp, Homo sapiens
agtctgggcctctg

SEQ ID NO: 4005934 - DNA, 15 bp, Homo sapiens
agtctgggcctctga

SEQ ID NO: 4005935 - DNA, 20 bp, Homo sapiens
agtctgggcctctgactctg

SEQ ID NO: 4005936 - DNA, 23 bp, Homo sapiens
agtctgggcctctgactctgagt

SEQ ID NO: 4005937 - DNA, 16 bp, Homo sapiens
agtctgggctgccggg

SEQ ID NO: 4005938 - DNA, 15 bp, Homo sapiens
agtctggggacctgg

SEQ ID NO: 4005939 - DNA, 16 bp, Homo sapiens
agtctggggacctggc

SEQ ID NO: 4005940 - DNA, 17 bp, Homo sapiens
agtctggtgggaggacg

SEQ ID NO: 4005941 - DNA, 15 bp, Homo sapiens
agtctggtttctaga

SEQ ID NO: 4005942 - DNA, 20 bp, Homo sapiens
agtctggtttctagacttgt

SEQ ID NO: 4005943 - DNA, 16 bp, Homo sapiens
agtctgtcctgtgacg

SEQ ID NO: 4005944 - DNA, 12 bp, Homo sapiens
agtctgtgtgaa

SEQ ID NO: 4005945 - DNA, 15 bp, Homo sapiens
agtctgtgtgaaggt

SEQ ID NO: 4005946 - DNA, 22 bp, Homo sapiens
agtcttatttccaagtaagagt

SEQ ID NO: 4005947 - DNA, 17 bp, Homo sapiens
agtcttcactctctgaa

SEQ ID NO: 4005948 - DNA, 12 bp, Homo sapiens
agtcttctcata

SEQ ID NO: 4005949 - DNA, 16 bp, Homo sapiens
agtcttgaatttctga

SEQ ID NO: 4005950 - DNA, 18 bp, Homo sapiens
agtcttgggtctgaattt

SEQ ID NO: 4005951 - DNA, 16 bp, Homo sapiens
agtctttgccttctct

SEQ ID NO: 4005952 - DNA, 17 bp, Homo sapiens
agtcttttgttcgcatg

SEQ ID NO: 4005953 - DNA, 17 bp, Homo sapiens
agtgaaaagattttatt

SEQ ID NO: 4005954 - DNA, 22 bp, Homo sapiens
agtgaaaatcttggagaccctg

SEQ ID NO: 4005955 - DNA, 21 bp, Homo sapiens
agtgaaaatttttacattcat

SEQ ID NO: 4005956 - DNA, 15 bp, Homo sapiens
agtgaaaccatgact

SEQ ID NO: 4005957 - DNA, 17 bp, Homo sapiens
agtgaaaccatgactgt

SEQ ID NO: 4005958 - DNA, 17 bp, Homo sapiens
agtgaaagagattactt

SEQ ID NO: 4005959 - DNA, 12 bp, Homo sapiens
agtgaaatgtga

SEQ ID NO: 4005960 - DNA, 17 bp, Homo sapiens
agtgaacctaccttcat

SEQ ID NO: 4005961 - DNA, 13 bp, Homo sapiens
agtgaagaatctt

SEQ ID NO: 4005962 - DNA, 19 bp, Homo sapiens
agtgaagaccagagcagtt

SEQ ID NO: 4005963 - DNA, 16 bp, Homo sapiens
agtgaagactccagaa

SEQ ID NO: 4005964 - DNA, 22 bp, Homo sapiens
agtgaagccagctgcaggaatc

SEQ ID NO: 4005965 - DNA, 20 bp, Homo sapiens
agtgaatactgctacagcaa

SEQ ID NO: 4005966 - DNA, 21 bp, Homo sapiens
agtgaatacttactataattt

SEQ ID NO: 4005967 - DNA, 16 bp, Homo sapiens
agtgaatctaaggata

SEQ ID NO: 4005968 - DNA, 13 bp, Homo sapiens
agtgaatgaaaca

SEQ ID NO: 4005969 - DNA, 15 bp, Homo sapiens
agtgaatgaaagatt

SEQ ID NO: 4005970 - DNA, 13 bp, Homo sapiens
agtgaatttgaat

SEQ ID NO: 4005971 - DNA, 13 bp, Homo sapiens
agtgacaaaccat

SEQ ID NO: 4005972 - DNA, 24 bp, Homo sapiens
agtgacaaataaattaggaccaag

SEQ ID NO: 4005973 - DNA, 17 bp, Homo sapiens
agtgacacaagcacttt

SEQ ID NO: 4005974 - DNA, 24 bp, Homo sapiens
agtgacacacctcacgcaggctga

SEQ ID NO: 4005975 - DNA, 18 bp, Homo sapiens
agtgacacagcagcttca

SEQ ID NO: 4005976 - DNA, 18 bp, Homo sapiens
agtgacacttcagagagc

SEQ ID NO: 4005977 - DNA, 23 bp, Homo sapiens
agtgacacttcagagagctggta

SEQ ID NO: 4005978 - DNA, 17 bp, Homo sapiens
agtgacagacaggctct

SEQ ID NO: 4005979 - DNA, 21 bp, Homo sapiens
agtgacagaccacatctttat

SEQ ID NO: 4005980 - DNA, 23 bp, Homo sapiens
agtgggaagagggggctggccat

SEQ ID NO: 4005981 - DNA, 15 bp, Homo sapiens
agtgggacagcccag

SEQ ID NO: 4005982 - DNA, 15 bp, Homo sapiens
agtgggatgaaccag

SEQ ID NO: 4005983 - DNA, 20 bp, Homo sapiens
agtgggcagagcccccagga

SEQ ID NO: 4005984 - DNA, 22 bp, Homo sapiens
agtgggccagggctgccctgag

SEQ ID NO: 4005985 - DNA, 16 bp, Homo sapiens
agtggggaactgaggg

SEQ ID NO: 4005986 - DNA, 21 bp, Homo sapiens
agtggggatggggcctccctc

SEQ ID NO: 4005987 - DNA, 14 bp, Homo sapiens
agtggggcctgtgg

SEQ ID NO: 4005988 - DNA, 19 bp, Homo sapiens
agtggggttgcaaccactg

SEQ ID NO: 4005989 - DNA, 16 bp, Homo sapiens
agtggtaatcatatgt

SEQ ID NO: 4005990 - DNA, 23 bp, Homo sapiens
agtggtcaaaccgcactcaccca

SEQ ID NO: 4005991 - DNA, 20 bp, Homo sapiens
agtggtctttgtaagagtgt

SEQ ID NO: 4005992 - DNA, 24 bp, Homo sapiens
agtggtctttgtaagagtgtagaa

SEQ ID NO: 4005993 - DNA, 14 bp, Homo sapiens
agtggtgcagacag

SEQ ID NO: 4005994 - DNA, 19 bp, Homo sapiens
agtggtgtgactcttactc

SEQ ID NO: 4005995 - DNA, 15 bp, Homo sapiens
agtggtgtgatctca

SEQ ID NO: 4005996 - DNA, 14 bp, Homo sapiens
agtggttaggcagc

SEQ ID NO: 4005997 - DNA, 23 bp, Homo sapiens
agtggtttaggctatttgtaaat

SEQ ID NO: 4005998 - DNA, 20 bp, Homo sapiens
agtggttttatactgaagga

SEQ ID NO: 4005999 - DNA, 16 bp, Homo sapiens
agtggttttcttcagg

SEQ ID NO: 4006000 - DNA, 13 bp, Homo sapiens
agtgtaagtgtga

SEQ ID NO: 4006001 - DNA, 14 bp, Homo sapiens
agtgtacatagtgt

SEQ ID NO: 4006002 - DNA, 21 bp, Homo sapiens
agtgtacatggaataacatgt

SEQ ID NO: 4006003 - DNA, 13 bp, Homo sapiens
agtgtagaagcat

SEQ ID NO: 4006004 - DNA, 17 bp, Homo sapiens
agtgtagaagcattcct

SEQ ID NO: 4006005 - DNA, 22 bp, Homo sapiens
agtgtagaagcattccttcttt

SEQ ID NO: 4006006 - DNA, 18 bp, Homo sapiens
agtgtagcccacacttga

SEQ ID NO: 4006007 - DNA, 21 bp, Homo sapiens
agtgtagcccacacttgagag

SEQ ID NO: 4006008 - DNA, 23 bp, Homo sapiens
agtgtagcccacacttgagagga

SEQ ID NO: 4006009 - DNA, 15 bp, Homo sapiens
agtgtagttaattta

SEQ ID NO: 4006010 - DNA, 20 bp, Homo sapiens
agtgtatcaggtcagggact

SEQ ID NO: 4006011 - DNA, 14 bp, Homo sapiens
agtgtcaagtcctg

SEQ ID NO: 4006012 - DNA, 18 bp, Homo sapiens
agtgtcacctctctcaga

SEQ ID NO: 4006013 - DNA, 20 bp, Homo sapiens
agtgtcacctctctcagagc

SEQ ID NO: 4006014 - DNA, 16 bp, Homo sapiens
agtgtcaggcccccag

SEQ ID NO: 4006015 - DNA, 19 bp, Homo sapiens
agtgtcatttatgaaaaga

SEQ ID NO: 4006016 - DNA, 15 bp, Homo sapiens
agtgtcccaggcagc

SEQ ID NO: 4006017 - DNA, 17 bp, Homo sapiens
agtgtcccctccactgt

SEQ ID NO: 4006018 - DNA, 19 bp, Homo sapiens
agtgtcccctccactgtca

SEQ ID NO: 4006019 - DNA, 15 bp, Homo sapiens
agtgtcctccaagtg

SEQ ID NO: 4006020 - DNA, 15 bp, Homo sapiens
agtgtcctgcccatg

SEQ ID NO: 4006021 - DNA, 17 bp, Homo sapiens
agtgtccttcttgctcc

SEQ ID NO: 4006022 - DNA, 13 bp, Homo sapiens
agtgtcctttcca

SEQ ID NO: 4006023 - DNA, 19 bp, Homo sapiens
agtgtctataaaagaaaca

SEQ ID NO: 4006024 - DNA, 12 bp, Homo sapiens
agtgtctggctt

SEQ ID NO: 4006025 - DNA, 16 bp, Homo sapiens
agtgtctggctttttc

SEQ ID NO: 4006026 - DNA, 18 bp, Homo sapiens
agtgtctgtgagaggcag

SEQ ID NO: 4006027 - DNA, 19 bp, Homo sapiens
agtgtctgtgccatggatt

SEQ ID NO: 4006028 - DNA, 16 bp, Homo sapiens
agtgtgaatagcctgg

SEQ ID NO: 4006029 - DNA, 21 bp, Homo sapiens
agtgtgaatagcctggccacc

SEQ ID NO: 4006030 - DNA, 22 bp, Homo sapiens
agtgtgacagggccagtggggc

SEQ ID NO: 4006031 - DNA, 14 bp, Homo sapiens
agtgtgaccaggca

SEQ ID NO: 4006032 - DNA, 19 bp, Homo sapiens
agtgtgacttcccttctaa

SEQ ID NO: 4006033 - DNA, 12 bp, Homo sapiens
agtgtgagaatc

SEQ ID NO: 4006034 - DNA, 14 bp, Homo sapiens
agtgtgagcgcctt

SEQ ID NO: 4006035 - DNA, 17 bp, Homo sapiens
agtgtgagcgccttggt

SEQ ID NO: 4006036 - DNA, 18 bp, Homo sapiens
agtgtgagcgccttggta

SEQ ID NO: 4006037 - DNA, 15 bp, Homo sapiens
agtgtgagctcttcc

SEQ ID NO: 4006038 - DNA, 16 bp, Homo sapiens
agtgtgagtaagagct

SEQ ID NO: 4006039 - DNA, 19 bp, Homo sapiens
agtgtgagtaagagctggt

SEQ ID NO: 4006040 - DNA, 19 bp, Homo sapiens
agtgtgcatggaggccctc

SEQ ID NO: 4006041 - DNA, 17 bp, Homo sapiens
agtgtggacttggcagg

SEQ ID NO: 4006042 - DNA, 22 bp, Homo sapiens
agtgtggagtgggtaatccagg

SEQ ID NO: 4006043 - DNA, 16 bp, Homo sapiens
agtgtgggcttgacca

SEQ ID NO: 4006044 - DNA, 21 bp, Homo sapiens
agtgtggtagggacttaaaaa

SEQ ID NO: 4006045 - DNA, 21 bp, Homo sapiens
agtgtgtgattttttgcattc

SEQ ID NO: 4006046 - DNA, 17 bp, Homo sapiens
agtgtgtgtgcagagtc

SEQ ID NO: 4006047 - DNA, 12 bp, Homo sapiens
agtgtgttctga

SEQ ID NO: 4006048 - DNA, 20 bp, Homo sapiens
agtgtgttctgattagaaat

SEQ ID NO: 4006049 - DNA, 22 bp, Homo sapiens
agtgtgttgttgctttaggctc

SEQ ID NO: 4006050 - DNA, 14 bp, Homo sapiens
agtgttagagaaat

SEQ ID NO: 4006051 - DNA, 15 bp, Homo sapiens
agtgttagagaaatc

SEQ ID NO: 4006052 - DNA, 17 bp, Homo sapiens
agtgttagagaaatcct

SEQ ID NO: 4006053 - DNA, 16 bp, Homo sapiens
agtgttatcagtcata

SEQ ID NO: 4006054 - DNA, 23 bp, Homo sapiens
agtgttatcagtcataactaaat

SEQ ID NO: 4006055 - DNA, 18 bp, Homo sapiens
agtgttccctttcctact

SEQ ID NO: 4006056 - DNA, 20 bp, Homo sapiens
agtgttcctttttaaatgtg

SEQ ID NO: 4006057 - DNA, 14 bp, Homo sapiens
agtgttctgctcct

SEQ ID NO: 4006058 - DNA, 17 bp, Homo sapiens
agtgttctgctcctgct

SEQ ID NO: 4006059 - DNA, 19 bp, Homo sapiens
agtgttctgctcctgcttt

SEQ ID NO: 4006060 - DNA, 12 bp, Homo sapiens
agtgttgaaggg

SEQ ID NO: 4006061 - DNA, 17 bp, Homo sapiens
agtgttgagacccaggc

SEQ ID NO: 4006062 - DNA, 16 bp, Homo sapiens
agtgttggggttgaca

SEQ ID NO: 4006063 - DNA, 19 bp, Homo sapiens
agtgttggggttgacattt

SEQ ID NO: 4006064 - DNA, 23 bp, Homo sapiens
agtgttgtgttcctggctgatga

SEQ ID NO: 4006065 - DNA, 14 bp, Homo sapiens
agtgttgtttgtaa

SEQ ID NO: 4006066 - DNA, 13 bp, Homo sapiens
agtgtttcagcta

SEQ ID NO: 4006067 - DNA, 19 bp, Homo sapiens
agtgtttcgacagctgatt

SEQ ID NO: 4006068 - DNA, 21 bp, Homo sapiens
agtgtttctagctaaataaat

SEQ ID NO: 4006069 - DNA, 16 bp, Homo sapiens
agtgtttggacagctg

SEQ ID NO: 4006070 - DNA, 14 bp, Homo sapiens
agtgttttggactc

SEQ ID NO: 4006071 - DNA, 20 bp, Homo sapiens
agtgttttggactccatctc

SEQ ID NO: 4006072 - DNA, 17 bp, Homo sapiens
agttaactattgcattt

SEQ ID NO: 4006073 - DNA, 24 bp, Homo sapiens
agttaactattgcatttatatgta

SEQ ID NO: 4006074 - DNA, 16 bp, Homo sapiens
agttaagaagctgttg

SEQ ID NO: 4006075 - DNA, 18 bp, Homo sapiens
agttaagaagctgttgta

SEQ ID NO: 4006076 - DNA, 19 bp, Homo sapiens
agttaagacatgatttcct

SEQ ID NO: 4006077 - DNA, 13 bp, Homo sapiens
agttaagacctgg

SEQ ID NO: 4006078 - DNA, 18 bp, Homo sapiens
agttaatttatctaaatt

SEQ ID NO: 4006079 - DNA, 21 bp, Homo sapiens
agttaattttttttgtattct

SEQ ID NO: 4006080 - DNA, 20 bp, Homo sapiens
agttacacagaaatgctgct

SEQ ID NO: 4006081 - DNA, 17 bp, Homo sapiens
agttacagcgagaggca

SEQ ID NO: 4006082 - DNA, 21 bp, Homo sapiens
agttgcattagtaactttgaa

SEQ ID NO: 4006083 - DNA, 18 bp, Homo sapiens
agttgcatttagaaatca

SEQ ID NO: 4006084 - DNA, 19 bp, Homo sapiens
agttgcatttagaaatcaa

SEQ ID NO: 4006085 - DNA, 14 bp, Homo sapiens
agttgccacattta

SEQ ID NO: 4006086 - DNA, 15 bp, Homo sapiens
agttgccacatttag

SEQ ID NO: 4006087 - DNA, 22 bp, Homo sapiens
agttgcccgaaactaagccagg

SEQ ID NO: 4006088 - DNA, 21 bp, Homo sapiens
agttgcctttatttgctgtta

SEQ ID NO: 4006089 - DNA, 13 bp, Homo sapiens
agttgccttttat

SEQ ID NO: 4006090 - DNA, 22 bp, Homo sapiens
agttggaaccgtgtccagcaca

SEQ ID NO: 4006091 - DNA, 14 bp, Homo sapiens
agttggactctcag

SEQ ID NO: 4006092 - DNA, 16 bp, Homo sapiens
agttggactctcaggg

SEQ ID NO: 4006093 - DNA, 13 bp, Homo sapiens
agttggactgggt

SEQ ID NO: 4006094 - DNA, 14 bp, Homo sapiens
agttggcagaaagg

SEQ ID NO: 4006095 - DNA, 11 bp, Homo sapiens
agttggctgga

SEQ ID NO: 4006096 - DNA, 19 bp, Homo sapiens
agttggctttgcccacccc

SEQ ID NO: 4006097 - DNA, 23 bp, Homo sapiens
agttgggaacttcagatggacct

SEQ ID NO: 4006098 - DNA, 16 bp, Homo sapiens
agttgggagcactgga

SEQ ID NO: 4006099 - DNA, 21 bp, Homo sapiens
agttggggtctggcagcctcc

SEQ ID NO: 4006100 - DNA, 15 bp, Homo sapiens
agttgtacaaatgta

SEQ ID NO: 4006101 - DNA, 21 bp, Homo sapiens
agttgtacaaatgtattttga

SEQ ID NO: 4006102 - DNA, 18 bp, Homo sapiens
agttgtagcagattgttt

SEQ ID NO: 4006103 - DNA, 19 bp, Homo sapiens
agttgtattcttctgtatt

SEQ ID NO: 4006104 - DNA, 17 bp, Homo sapiens
agttgtgttagcctctt

SEQ ID NO: 4006105 - DNA, 17 bp, Homo sapiens
agttgttattgttgaac

SEQ ID NO: 4006106 - DNA, 16 bp, Homo sapiens
agttgttgtaacctgc

SEQ ID NO: 4006107 - DNA, 16 bp, Homo sapiens
agttgtttctgaccca

SEQ ID NO: 4006108 - DNA, 18 bp, Homo sapiens
agttgttttttgtgtttc

SEQ ID NO: 4006109 - DNA, 21 bp, Homo sapiens
agttgttttttgtgtttccat

SEQ ID NO: 4006110 - DNA, 14 bp, Homo sapiens
agtttaaaaaaatt

SEQ ID NO: 4006111 - DNA, 14 bp, Homo sapiens
agtttaaagttgca

SEQ ID NO: 4006112 - DNA, 19 bp, Homo sapiens
agtttaaagttgcacatga

SEQ ID NO: 4006113 - DNA, 23 bp, Homo sapiens
agtttacaacttgattttttcaa

SEQ ID NO: 4006114 - DNA, 14 bp, Homo sapiens
agtttacaatatta

SEQ ID NO: 4006115 - DNA, 22 bp, Homo sapiens
agtttacatttttatttatgaa

SEQ ID NO: 4006116 - DNA, 20 bp, Homo sapiens
agtttaccagttgcctttta

SEQ ID NO: 4006117 - DNA, 14 bp, Homo sapiens
agtttaccatttgt

SEQ ID NO: 4006118 - DNA, 16 bp, Homo sapiens
agtttaccatttgtaa

SEQ ID NO: 4006119 - DNA, 17 bp, Homo sapiens
agtttaccatttgtaat

SEQ ID NO: 4006120 - DNA, 14 bp, Homo sapiens
agtttaccttgtat

SEQ ID NO: 4006121 - DNA, 20 bp, Homo sapiens
agtttaccttgtatactgta

SEQ ID NO: 4006122 - DNA, 14 bp, Homo sapiens
agtttaggagaaac

SEQ ID NO: 4006123 - DNA, 19 bp, Homo sapiens
agtttagtgtgtgtgcaga

SEQ ID NO: 4006124 - DNA, 17 bp, Homo sapiens
agtttatggcagaaggg

SEQ ID NO: 4006125 - DNA, 19 bp, Homo sapiens
agtttattattattaaagt

SEQ ID NO: 4006126 - DNA, 16 bp, Homo sapiens
agtttattccagagct

SEQ ID NO: 4006127 - DNA, 22 bp, Homo sapiens
agtttattccagagctgccagt

SEQ ID NO: 4006128 - DNA, 20 bp, Homo sapiens
agtttatttttaaagataga

SEQ ID NO: 4006129 - DNA, 19 bp, Homo sapiens
agtttcaaacttactattt

SEQ ID NO: 4006130 - DNA, 21 bp, Homo sapiens
agtttcaaacttactattttg

SEQ ID NO: 4006131 - DNA, 23 bp, Homo sapiens
agtttcacaggtcaataaactta

SEQ ID NO: 4006132 - DNA, 15 bp, Homo sapiens
agtttcagacagggt

SEQ ID NO: 4006133 - DNA, 16 bp, Homo sapiens
agtttcaggtgacatg

SEQ ID NO: 4006134 - DNA, 18 bp, Homo sapiens
agtttcaggtgacatgtg

SEQ ID NO: 4006135 - DNA, 22 bp, Homo sapiens
agtttcaggtgacatgtgaaac

SEQ ID NO: 4006136 - DNA, 18 bp, Homo sapiens
agtttcaggtgtttagtt

SEQ ID NO: 4006137 - DNA, 22 bp, Homo sapiens
agtttcagtattagatgcactt

SEQ ID NO: 4006138 - DNA, 19 bp, Homo sapiens
agtttcatctggttgtgac

SEQ ID NO: 4006139 - DNA, 18 bp, Homo sapiens
agtttcatgtacaagatg

SEQ ID NO: 4006140 - DNA, 17 bp, Homo sapiens
agtttcattctcctgcc

SEQ ID NO: 4006141 - DNA, 20 bp, Homo sapiens
agtttcattctcctgcctgt

SEQ ID NO: 4006142 - DNA, 15 bp, Homo sapiens
agtttcccctctggc

SEQ ID NO: 4006143 - DNA, 17 bp, Homo sapiens
agtttcccctctggctt

SEQ ID NO: 4006144 - DNA, 18 bp, Homo sapiens
agtttcccctctggcttg

SEQ ID NO: 4006145 - DNA, 12 bp, Homo sapiens
agtttcctgaaa

SEQ ID NO: 4006146 - DNA, 16 bp, Homo sapiens
agtttcctttttaata

SEQ ID NO: 4006147 - DNA, 21 bp, Homo sapiens
agtttctagctagaaatatga

SEQ ID NO: 4006148 - DNA, 21 bp, Homo sapiens
agtttctattctgtcagtgtt

SEQ ID NO: 4006149 - DNA, 11 bp, Homo sapiens
agtttctctgt

SEQ ID NO: 4006150 - DNA, 12 bp, Homo sapiens
agtttctctgtt

SEQ ID NO: 4006151 - DNA, 16 bp, Homo sapiens
agtttctggccctggc

SEQ ID NO: 4006152 - DNA, 17 bp, Homo sapiens
agtttcttagcttttta

SEQ ID NO: 4006153 - DNA, 22 bp, Homo sapiens
agtttgaacctttttttttgaa

SEQ ID NO: 4006154 - DNA, 23 bp, Homo sapiens
agtttgagctgccttccctagct

SEQ ID NO: 4006155 - DNA, 12 bp, Homo sapiens
agtttgccaccc

SEQ ID NO: 4006156 - DNA, 13 bp, Homo sapiens
agtttgcttagaa

SEQ ID NO: 4006157 - DNA, 20 bp, Homo sapiens
agtttggatatttttgtact

SEQ ID NO: 4006158 - DNA, 21 bp, Homo sapiens
agtttggatatttttgtactt

SEQ ID NO: 4006159 - DNA, 20 bp, Homo sapiens
agtttgggtaaaatactttt

SEQ ID NO: 4006160 - DNA, 13 bp, Homo sapiens
agtttgtctattt

SEQ ID NO: 4006161 - DNA, 14 bp, Homo sapiens
agtttgtctatttt

SEQ ID NO: 4006162 - DNA, 21 bp, Homo sapiens
agtttgtgtctgttgcttgta

SEQ ID NO: 4006163 - DNA, 22 bp, Homo sapiens
agtttgtgtgtcttaattatta

SEQ ID NO: 4006164 - DNA, 15 bp, Homo sapiens
agtttgttctccggg

SEQ ID NO: 4006165 - DNA, 23 bp, Homo sapiens
agttttaaactcatttttgccat

SEQ ID NO: 4006166 - DNA, 22 bp, Homo sapiens
agttttaagaattgtttttgaa

SEQ ID NO: 4006167 - DNA, 16 bp, Homo sapiens
agttttaatccagaat

SEQ ID NO: 4006168 - DNA, 20 bp, Homo sapiens
agttttagggtacagtttgg

SEQ ID NO: 4006169 - DNA, 13 bp, Homo sapiens
agttttatcattt

SEQ ID NO: 4006170 - DNA, 19 bp, Homo sapiens
agttttcagaaaaagaaat

SEQ ID NO: 4006171 - DNA, 16 bp, Homo sapiens
agttttcagaacctct

SEQ ID NO: 4006172 - DNA, 17 bp, Homo sapiens
agttttcagaacctctt

SEQ ID NO: 4006173 - DNA, 13 bp, Homo sapiens
agttttccatgaa

SEQ ID NO: 4006174 - DNA, 12 bp, Homo sapiens
agttttccctgg

SEQ ID NO: 4006175 - DNA, 15 bp, Homo sapiens
agttttgaaaagcta

SEQ ID NO: 4006176 - DNA, 21 bp, Homo sapiens
agttttgaatgttaagaattg

SEQ ID NO: 4006177 - DNA, 23 bp, Homo sapiens
agttttgcttttagtttttctgt

SEQ ID NO: 4006178 - DNA, 15 bp, Homo sapiens
agttttgtttatgca

SEQ ID NO: 4006179 - DNA, 21 bp, Homo sapiens
agtttttacctaccacagtgt

SEQ ID NO: 4006180 - DNA, 18 bp, Homo sapiens
agtttttagaatgttgaa

SEQ ID NO: 4006181 - DNA, 19 bp, Homo sapiens
agtttttagaatgttgaaa

SEQ ID NO: 4006182 - DNA, 18 bp, Homo sapiens
agtttttattccttgtga

SEQ ID NO: 4006183 - DNA, 11 bp, Homo sapiens
agtttttctgt

SEQ ID NO: 4006184 - DNA, 23 bp, Homo sapiens
ataaattcccaacttctcttgct

SEQ ID NO: 4006185 - DNA, 17 bp, Homo sapiens
ataaattgcataaagca

SEQ ID NO: 4006186 - DNA, 18 bp, Homo sapiens
ataaattgcataaagcat

SEQ ID NO: 4006187 - DNA, 22 bp, Homo sapiens
ataaattgtagggctttagctt

SEQ ID NO: 4006188 - DNA, 21 bp, Homo sapiens
ataaatttaaacttacaaact

SEQ ID NO: 4006189 - DNA, 14 bp, Homo sapiens
ataacaagatcttt

SEQ ID NO: 4006190 - DNA, 19 bp, Homo sapiens
ataacaagatctttcagga

SEQ ID NO: 4006191 - DNA, 22 bp, Homo sapiens
ataacaatgttaaggaaactct

SEQ ID NO: 4006192 - DNA, 14 bp, Homo sapiens
ataacacaatatga

SEQ ID NO: 4006193 - DNA, 11 bp, Homo sapiens
ataacacacat

SEQ ID NO: 4006194 - DNA, 22 bp, Homo sapiens
ataacaccaatcccagggctgg

SEQ ID NO: 4006195 - DNA, 16 bp, Homo sapiens
ataacagccgctccag

SEQ ID NO: 4006196 - DNA, 17 bp, Homo sapiens
ataacagccgctccaga

SEQ ID NO: 4006197 - DNA, 19 bp, Homo sapiens
ataacattaccttactgtg

SEQ ID NO: 4006198 - DNA, 16 bp, Homo sapiens
ataacattcagttccc

SEQ ID NO: 4006199 - DNA, 20 bp, Homo sapiens
ataaccaagtttattcagta

SEQ ID NO: 4006200 - DNA, 22 bp, Homo sapiens
ataaccacttaaaaaatgtcca

SEQ ID NO: 4006201 - DNA, 14 bp, Homo sapiens
ataaccccagcctg

SEQ ID NO: 4006202 - DNA, 15 bp, Homo sapiens
ataaccccagcctga

SEQ ID NO: 4006203 - DNA, 17 bp, Homo sapiens
ataacgtttttccttta

SEQ ID NO: 4006204 - DNA, 13 bp, Homo sapiens
ataactactgtgt

SEQ ID NO: 4006205 - DNA, 20 bp, Homo sapiens
ataactcagaatattgtctg

SEQ ID NO: 4006206 - DNA, 15 bp, Homo sapiens
ataactcatcataaa

SEQ ID NO: 4006207 - DNA, 19 bp, Homo sapiens
ataactcatcataaaataa

SEQ ID NO: 4006208 - DNA, 17 bp, Homo sapiens
ataactcctgtcccttt

SEQ ID NO: 4006209 - DNA, 20 bp, Homo sapiens
ataactccttcttgtagtag

SEQ ID NO: 4006210 - DNA, 12 bp, Homo sapiens
ataactgagaat

SEQ ID NO: 4006211 - DNA, 17 bp, Homo sapiens
ataactgccttgaacct

SEQ ID NO: 4006212 - DNA, 19 bp, Homo sapiens
ataacttaaaaaaatgaca

SEQ ID NO: 4006213 - DNA, 19 bp, Homo sapiens
ataacttaaaaatgtaaat

SEQ ID NO: 4006214 - DNA, 12 bp, Homo sapiens
ataacttaaaat

SEQ ID NO: 4006215 - DNA, 16 bp, Homo sapiens
ataacttaaaatattt

SEQ ID NO: 4006216 - DNA, 22 bp, Homo sapiens
ataacttagcttgcacatgaat

SEQ ID NO: 4006217 - DNA, 11 bp, Homo sapiens
ataacttctga

SEQ ID NO: 4006218 - DNA, 11 bp, Homo sapiens
ataagaaatga

SEQ ID NO: 4006219 - DNA, 15 bp, Homo sapiens
ataagaaatgaacaa

SEQ ID NO: 4006220 - DNA, 20 bp, Homo sapiens
ataagaaatgaacaaaagat

SEQ ID NO: 4006221 - DNA, 16 bp, Homo sapiens
ataagaatgctggttt

SEQ ID NO: 4006222 - DNA, 18 bp, Homo sapiens
ataagacatttgtttgct

SEQ ID NO: 4006223 - DNA, 22 bp, Homo sapiens
ataagactgtttttaagtaact

SEQ ID NO: 4006224 - DNA, 20 bp, Homo sapiens
ataagagagaacaactactg

SEQ ID NO: 4006225 - DNA, 22 bp, Homo sapiens
ataagagcatgaaatttttaaa

SEQ ID NO: 4006226 - DNA, 13 bp, Homo sapiens
ataagataaatgt

SEQ ID NO: 4006227 - DNA, 15 bp, Homo sapiens
ataagattagttgga

SEQ ID NO: 4006228 - DNA, 12 bp, Homo sapiens
ataagcaagaga

SEQ ID NO: 4006229 - DNA, 21 bp, Homo sapiens
ataagcacttgaatcagtttt

SEQ ID NO: 4006230 - DNA, 16 bp, Homo sapiens
ataagcagatttaaca

SEQ ID NO: 4006231 - DNA, 13 bp, Homo sapiens
ataagcaggtgga

SEQ ID NO: 4006232 - DNA, 18 bp, Homo sapiens
ataagcattgaaattata

SEQ ID NO: 4006233 - DNA, 20 bp, Homo sapiens
ataagcattgacttgccgtc

SEQ ID NO: 4006234 - DNA, 21 bp, Homo sapiens
ataagcctccatttagttctt

SEQ ID NO: 4006235 - DNA, 18 bp, Homo sapiens
ataagcttatgcttaaat

SEQ ID NO: 4006236 - DNA, 12 bp, Homo sapiens
ataagggagagc

SEQ ID NO: 4006237 - DNA, 17 bp, Homo sapiens
ataagtaattcaagaaa

SEQ ID NO: 4006238 - DNA, 16 bp, Homo sapiens
ataagtgaaaatctta

SEQ ID NO: 4006239 - DNA, 21 bp, Homo sapiens
ataagtgaaatggatactaca

SEQ ID NO: 4006240 - DNA, 14 bp, Homo sapiens
ataagtgaatttat

SEQ ID NO: 4006241 - DNA, 22 bp, Homo sapiens
ataagtggacaaattttgagtt

SEQ ID NO: 4006242 - DNA, 21 bp, Homo sapiens
ataagtggttttcttcaggaa

SEQ ID NO: 4006243 - DNA, 19 bp, Homo sapiens
ataagtgtacgattcttaa

SEQ ID NO: 4006244 - DNA, 20 bp, Homo sapiens
ataagtgtgtggtagaaaca

SEQ ID NO: 4006245 - DNA, 19 bp, Homo sapiens
ataagttatttttgtacat

SEQ ID NO: 4006246 - DNA, 15 bp, Homo sapiens
ataagttcacaaaat

SEQ ID NO: 4006247 - DNA, 16 bp, Homo sapiens
ataagttcctttcctt

SEQ ID NO: 4006248 - DNA, 20 bp, Homo sapiens
ataagttgcatttagaaatc

SEQ ID NO: 4006249 - DNA, 21 bp, Homo sapiens
ataataaacataatgaaaata

SEQ ID NO: 4006250 - DNA, 11 bp, Homo sapiens
ataataaagaa

SEQ ID NO: 4006251 - DNA, 15 bp, Homo sapiens
ataataaagcaatct

SEQ ID NO: 4006252 - DNA, 13 bp, Homo sapiens
ataataaaggact

SEQ ID NO: 4006253 - DNA, 14 bp, Homo sapiens
ataataaagtgttt

SEQ ID NO: 4006254 - DNA, 15 bp, Homo sapiens
ataataaatgtacat

SEQ ID NO: 4006255 - DNA, 15 bp, Homo sapiens
ataataagctaaaga

SEQ ID NO: 4006256 - DNA, 14 bp, Homo sapiens
ataataataataaa

SEQ ID NO: 4006257 - DNA, 17 bp, Homo sapiens
ataatagttattattta

SEQ ID NO: 4006258 - DNA, 20 bp, Homo sapiens
ataatagtttacatgtagta

SEQ ID NO: 4006259 - DNA, 15 bp, Homo sapiens
ataatatctgtgagg

SEQ ID NO: 4006260 - DNA, 22 bp, Homo sapiens
ataatatctttgtgataattta

SEQ ID NO: 4006261 - DNA, 13 bp, Homo sapiens
ataatatggctat

SEQ ID NO: 4006262 - DNA, 22 bp, Homo sapiens
ataatatggctatgcttaaaag

SEQ ID NO: 4006263 - DNA, 12 bp, Homo sapiens
ataatcaagatt

SEQ ID NO: 4006264 - DNA, 16 bp, Homo sapiens
ataatcaagattttag

SEQ ID NO: 4006265 - DNA, 15 bp, Homo sapiens
ataatcaccagggcc

SEQ ID NO: 4006266 - DNA, 17 bp, Homo sapiens
ataatcagtgactgaaa

SEQ ID NO: 4006267 - DNA, 15 bp, Homo sapiens
ataatcccagcactt

SEQ ID NO: 4006268 - DNA, 17 bp, Homo sapiens
ataatcccagcactttg

SEQ ID NO: 4006269 - DNA, 17 bp, Homo sapiens
ataatgaaaatattttt

SEQ ID NO: 4006270 - DNA, 15 bp, Homo sapiens
ataatgaaataatca

SEQ ID NO: 4006271 - DNA, 17 bp, Homo sapiens
ataatgaataaactgaa

SEQ ID NO: 4006272 - DNA, 18 bp, Homo sapiens
ataatgaggagtttatga

SEQ ID NO: 4006273 - DNA, 15 bp, Homo sapiens
ataatgataaaataa

SEQ ID NO: 4006274 - DNA, 14 bp, Homo sapiens
ataatgcatgaagc

SEQ ID NO: 4006275 - DNA, 16 bp, Homo sapiens
ataatgccccaaggac

SEQ ID NO: 4006276 - DNA, 17 bp, Homo sapiens
ataatgccccaaggaca

SEQ ID NO: 4006277 - DNA, 21 bp, Homo sapiens
ataatgctaatttaaagagac

SEQ ID NO: 4006278 - DNA, 14 bp, Homo sapiens
ataatgcttcagat

SEQ ID NO: 4006279 - DNA, 12 bp, Homo sapiens
ataatggaaaca

SEQ ID NO: 4006280 - DNA, 21 bp, Homo sapiens
ataatggaaacattacagttc

SEQ ID NO: 4006281 - DNA, 11 bp, Homo sapiens
ataatgttaaa

SEQ ID NO: 4006282 - DNA, 22 bp, Homo sapiens
ataatgttaaatttgtaagttt

SEQ ID NO: 4006283 - DNA, 12 bp, Homo sapiens
ataatgttaaca

SEQ ID NO: 4006284 - DNA, 19 bp, Homo sapiens
ataatgttgttatttaaag

SEQ ID NO: 4006285 - DNA, 13 bp, Homo sapiens
ataatgtttaaat

SEQ ID NO: 4006286 - DNA, 17 bp, Homo sapiens
ataatgtttaaatcatg

SEQ ID NO: 4006287 - DNA, 17 bp, Homo sapiens
atactcagcctgctgcc

SEQ ID NO: 4006288 - DNA, 13 bp, Homo sapiens
atactccagtgta

SEQ ID NO: 4006289 - DNA, 16 bp, Homo sapiens
atactccagtgtacat

SEQ ID NO: 4006290 - DNA, 17 bp, Homo sapiens
atactccagtgtacata

SEQ ID NO: 4006291 - DNA, 23 bp, Homo sapiens
atactccagtgtacatagtgtaa

SEQ ID NO: 4006292 - DNA, 13 bp, Homo sapiens
atactcctgggct

SEQ ID NO: 4006293 - DNA, 15 bp, Homo sapiens
atactccttgcttcc

SEQ ID NO: 4006294 - DNA, 19 bp, Homo sapiens
atactccttgcttcctgat

SEQ ID NO: 4006295 - DNA, 13 bp, Homo sapiens
atactctctgcct

SEQ ID NO: 4006296 - DNA, 21 bp, Homo sapiens
atactcttaggaagagaaacc

SEQ ID NO: 4006297 - DNA, 14 bp, Homo sapiens
atactctttctgta

SEQ ID NO: 4006298 - DNA, 17 bp, Homo sapiens
atactctttctgtatat

SEQ ID NO: 4006299 - DNA, 23 bp, Homo sapiens
atactctttctgtatatactttt

SEQ ID NO: 4006300 - DNA, 14 bp, Homo sapiens
atactgaaggaaaa

SEQ ID NO: 4006301 - DNA, 15 bp, Homo sapiens
atactgaatataaaa

SEQ ID NO: 4006302 - DNA, 22 bp, Homo sapiens
atactgagggaccaactgggcc

SEQ ID NO: 4006303 - DNA, 16 bp, Homo sapiens
atactgcaagaaaatg

SEQ ID NO: 4006304 - DNA, 23 bp, Homo sapiens
atactgcatgtaagccaagtcat

SEQ ID NO: 4006305 - DNA, 15 bp, Homo sapiens
atactgctactgtaa

SEQ ID NO: 4006306 - DNA, 16 bp, Homo sapiens
atactgctactgtaat

SEQ ID NO: 4006307 - DNA, 19 bp, Homo sapiens
atactgctactgtaatttt

SEQ ID NO: 4006308 - DNA, 20 bp, Homo sapiens
atactgctactgtaatttta

SEQ ID NO: 4006309 - DNA, 22 bp, Homo sapiens
atactgctactgtaattttata

SEQ ID NO: 4006310 - DNA, 22 bp, Homo sapiens
atactgcttgaccgtactctca

SEQ ID NO: 4006311 - DNA, 14 bp, Homo sapiens
atactggaagtttt

SEQ ID NO: 4006312 - DNA, 16 bp, Homo sapiens
atactggaagttttgc

SEQ ID NO: 4006313 - DNA, 17 bp, Homo sapiens
atactggaataatttgt

SEQ ID NO: 4006314 - DNA, 19 bp, Homo sapiens
atactggaataatttgtaa

SEQ ID NO: 4006315 - DNA, 21 bp, Homo sapiens
atactggaataatttgtaaat

SEQ ID NO: 4006316 - DNA, 16 bp, Homo sapiens
atactgtacttaataa

SEQ ID NO: 4006317 - DNA, 17 bp, Homo sapiens
atactgtacttaataaa

SEQ ID NO: 4006318 - DNA, 14 bp, Homo sapiens
atactgtgaagtta

SEQ ID NO: 4006319 - DNA, 16 bp, Homo sapiens
atactgtgcagaataa

SEQ ID NO: 4006320 - DNA, 20 bp, Homo sapiens
atactgtgcagaataatgga

SEQ ID NO: 4006321 - DNA, 21 bp, Homo sapiens
atactgtgcagaataatggaa

SEQ ID NO: 4006322 - DNA, 22 bp, Homo sapiens
atacttagcaaagttttacctg

SEQ ID NO: 4006323 - DNA, 17 bp, Homo sapiens
atacttatatttcccta

SEQ ID NO: 4006324 - DNA, 17 bp, Homo sapiens
atacttcaaaaataatg

SEQ ID NO: 4006325 - DNA, 17 bp, Homo sapiens
atacttgaagggccaga

SEQ ID NO: 4006326 - DNA, 18 bp, Homo sapiens
atacttgaagggccagag

SEQ ID NO: 4006327 - DNA, 12 bp, Homo sapiens
atacttggattt

SEQ ID NO: 4006328 - DNA, 17 bp, Homo sapiens
atacttggatttagttt

SEQ ID NO: 4006329 - DNA, 22 bp, Homo sapiens
atacttggatttagtttcagta

SEQ ID NO: 4006330 - DNA, 13 bp, Homo sapiens
atactttatttct

SEQ ID NO: 4006331 - DNA, 14 bp, Homo sapiens
atactttatttctg

SEQ ID NO: 4006332 - DNA, 15 bp, Homo sapiens
atactttgcttcata

SEQ ID NO: 4006333 - DNA, 20 bp, Homo sapiens
atacttttactctgcctaca

SEQ ID NO: 4006334 - DNA, 23 bp, Homo sapiens
atagaaactgtctagcacttcct

SEQ ID NO: 4006335 - DNA, 14 bp, Homo sapiens
atagaaataaattc

SEQ ID NO: 4006336 - DNA, 16 bp, Homo sapiens
atagaaattttgtaag

SEQ ID NO: 4006337 - DNA, 21 bp, Homo sapiens
atagaactcagttttaactag

SEQ ID NO: 4006338 - DNA, 12 bp, Homo sapiens
atagaataaaag

SEQ ID NO: 4006339 - DNA, 19 bp, Homo sapiens
atagaatataattatcgga

SEQ ID NO: 4006340 - DNA, 23 bp, Homo sapiens
atagaatgtggccacttatttca

SEQ ID NO: 4006341 - DNA, 13 bp, Homo sapiens
atagaccaaagca

SEQ ID NO: 4006342 - DNA, 14 bp, Homo sapiens
atagagactgtaga

SEQ ID NO: 4006343 - DNA, 15 bp, Homo sapiens
atagagattgtacat

SEQ ID NO: 4006344 - DNA, 16 bp, Homo sapiens
atagagcttttaaaaa

SEQ ID NO: 4006345 - DNA, 19 bp, Homo sapiens
atagaggctagcttctgct

SEQ ID NO: 4006346 - DNA, 20 bp, Homo sapiens
atagaggctagcttctgctt

SEQ ID NO: 4006347 - DNA, 18 bp, Homo sapiens
atagaggcttctccgcca

SEQ ID NO: 4006348 - DNA, 22 bp, Homo sapiens
atagaggcttctccgccagcct

SEQ ID NO: 4006349 - DNA, 14 bp, Homo sapiens
atagagtatatgca

SEQ ID NO: 4006350 - DNA, 21 bp, Homo sapiens
atagataccctacgctgtcca

SEQ ID NO: 4006351 - DNA, 20 bp, Homo sapiens
atagataggcccctggggct

SEQ ID NO: 4006352 - DNA, 13 bp, Homo sapiens
atagatattttca

SEQ ID NO: 4006353 - DNA, 16 bp, Homo sapiens
atagatgcaagatatt

SEQ ID NO: 4006354 - DNA, 15 bp, Homo sapiens
atagatgctggccca

SEQ ID NO: 4006355 - DNA, 13 bp, Homo sapiens
atagatgggtctg

SEQ ID NO: 4006356 - DNA, 21 bp, Homo sapiens
atagattagaaaaattcctaa

SEQ ID NO: 4006357 - DNA, 14 bp, Homo sapiens
atagcaaatgacat

SEQ ID NO: 4006358 - DNA, 15 bp, Homo sapiens
atagcaacaggaaaa

SEQ ID NO: 4006359 - DNA, 22 bp, Homo sapiens
atagcagattttaattttgaat

SEQ ID NO: 4006360 - DNA, 13 bp, Homo sapiens
atagcattaacta

SEQ ID NO: 4006361 - DNA, 21 bp, Homo sapiens
atagccacatttggaatactt

SEQ ID NO: 4006362 - DNA, 23 bp, Homo sapiens
atagccacatttggaatactttt

SEQ ID NO: 4006363 - DNA, 20 bp, Homo sapiens
atagccatcgactcctgcct

SEQ ID NO: 4006364 - DNA, 22 bp, Homo sapiens
atagccatcgactcctgcctga

SEQ ID NO: 4006365 - DNA, 14 bp, Homo sapiens
atagcccaggtcct

SEQ ID NO: 4006366 - DNA, 21 bp, Homo sapiens
atagcgctgtttttgttgtgt

SEQ ID NO: 4006367 - DNA, 13 bp, Homo sapiens
atagctaagtaca

SEQ ID NO: 4006368 - DNA, 17 bp, Homo sapiens
atagctatatccatgta

SEQ ID NO: 4006369 - DNA, 23 bp, Homo sapiens
atagctatatccatgtactgtag

SEQ ID NO: 4006370 - DNA, 13 bp, Homo sapiens
atagctcagttta

SEQ ID NO: 4006371 - DNA, 20 bp, Homo sapiens
atagctccttggagcaggca

SEQ ID NO: 4006372 - DNA, 23 bp, Homo sapiens
atagcttaactaatttgaatgtg

SEQ ID NO: 4006373 - DNA, 16 bp, Homo sapiens
atagcttattattgaa

SEQ ID NO: 4006374 - DNA, 15 bp, Homo sapiens
ataggaaactgaagc

SEQ ID NO: 4006375 - DNA, 18 bp, Homo sapiens
ataggaatgtgaaagcac

SEQ ID NO: 4006376 - DNA, 12 bp, Homo sapiens
ataggagcctgc

SEQ ID NO: 4006377 - DNA, 14 bp, Homo sapiens
ataggcagaatgga

SEQ ID NO: 4006378 - DNA, 23 bp, Homo sapiens
ataggccagggcatgtgtatgtg

SEQ ID NO: 4006379 - DNA, 21 bp, Homo sapiens
ataggcccaaggtcccctcca

SEQ ID NO: 4006380 - DNA, 22 bp, Homo sapiens
ataggcccaaggtcccctccac

SEQ ID NO: 4006381 - DNA, 15 bp, Homo sapiens
ataggcctgtccctt

SEQ ID NO: 4006382 - DNA, 19 bp, Homo sapiens
ataggcctgtcccttgcct

SEQ ID NO: 4006383 - DNA, 21 bp, Homo sapiens
ataggcctgtcccttgcctct

SEQ ID NO: 4006384 - DNA, 22 bp, Homo sapiens
ataggcctgtcccttgcctctg

SEQ ID NO: 4006385 - DNA, 12 bp, Homo sapiens
ataggctctgca

SEQ ID NO: 4006386 - DNA, 21 bp, Homo sapiens
ataggctggagaagctcaccc

SEQ ID NO: 4006387 - DNA, 16 bp, Homo sapiens
atagggtctcttcagg

SEQ ID NO: 4006388 - DNA, 14 bp, Homo sapiens
ataggtaatcaatg

SEQ ID NO: 4006389 - DNA, 21 bp, Homo sapiens
atatcttttatgtttgaatat

SEQ ID NO: 4006390 - DNA, 16 bp, Homo sapiens
atatcttttggttatt

SEQ ID NO: 4006391 - DNA, 15 bp, Homo sapiens
atatgaaaactatac

SEQ ID NO: 4006392 - DNA, 16 bp, Homo sapiens
atatgaaaatacaact

SEQ ID NO: 4006393 - DNA, 16 bp, Homo sapiens
atatgaaattccagca

SEQ ID NO: 4006394 - DNA, 15 bp, Homo sapiens
atatgaagacataaa

SEQ ID NO: 4006395 - DNA, 16 bp, Homo sapiens
atatgaagacataaac

SEQ ID NO: 4006396 - DNA, 22 bp, Homo sapiens
atatgaatacagggcatgcatt

SEQ ID NO: 4006397 - DNA, 21 bp, Homo sapiens
atatgaatttaaatataattc

SEQ ID NO: 4006398 - DNA, 15 bp, Homo sapiens
atatgaccagaagcc

SEQ ID NO: 4006399 - DNA, 23 bp, Homo sapiens
atatgacggaagaacatagaact

SEQ ID NO: 4006400 - DNA, 15 bp, Homo sapiens
atatgagtacaaatg

SEQ ID NO: 4006401 - DNA, 20 bp, Homo sapiens
atatgagtgtggaagccgga

SEQ ID NO: 4006402 - DNA, 23 bp, Homo sapiens
atatgagtgtggaagccggaggg

SEQ ID NO: 4006403 - DNA, 14 bp, Homo sapiens
atatgatctgtttt

SEQ ID NO: 4006404 - DNA, 14 bp, Homo sapiens
atatgattgtttct

SEQ ID NO: 4006405 - DNA, 16 bp, Homo sapiens
atatgattttatttga

SEQ ID NO: 4006406 - DNA, 14 bp, Homo sapiens
atatgcaacattgt

SEQ ID NO: 4006407 - DNA, 15 bp, Homo sapiens
atatgcacaatagca

SEQ ID NO: 4006408 - DNA, 16 bp, Homo sapiens
atatgcactatgtata

SEQ ID NO: 4006409 - DNA, 17 bp, Homo sapiens
atatgctaatttgggga

SEQ ID NO: 4006410 - DNA, 16 bp, Homo sapiens
atatgcttaaaataag

SEQ ID NO: 4006411 - DNA, 18 bp, Homo sapiens
atatgcttaaaataagca

SEQ ID NO: 4006412 - DNA, 16 bp, Homo sapiens
atatggaaccttccct

SEQ ID NO: 4006413 - DNA, 20 bp, Homo sapiens
atatggaaccttccctccaa

SEQ ID NO: 4006414 - DNA, 19 bp, Homo sapiens
atatggaacttacattgtt

SEQ ID NO: 4006415 - DNA, 16 bp, Homo sapiens
atatggacaagaggta

SEQ ID NO: 4006416 - DNA, 22 bp, Homo sapiens
atatggagtgagtcacctgctc

SEQ ID NO: 4006417 - DNA, 18 bp, Homo sapiens
atatggatgattcagaaa

SEQ ID NO: 4006418 - DNA, 23 bp, Homo sapiens
atatggattttctattgttactc

SEQ ID NO: 4006419 - DNA, 17 bp, Homo sapiens
atatggcagaagacacc

SEQ ID NO: 4006420 - DNA, 16 bp, Homo sapiens
atatggcccagccttg

SEQ ID NO: 4006421 - DNA, 15 bp, Homo sapiens
atatggctataaata

SEQ ID NO: 4006422 - DNA, 20 bp, Homo sapiens
atatgggtgggattttgcaa

SEQ ID NO: 4006423 - DNA, 22 bp, Homo sapiens
atatgggttgcatttggtcaag

SEQ ID NO: 4006424 - DNA, 15 bp, Homo sapiens
atatggtttggtttt

SEQ ID NO: 4006425 - DNA, 14 bp, Homo sapiens
atatgtaagggaaa

SEQ ID NO: 4006426 - DNA, 18 bp, Homo sapiens
atatgtagtataaagaaa

SEQ ID NO: 4006427 - DNA, 22 bp, Homo sapiens
atatgtatatcattctacagaa

SEQ ID NO: 4006428 - DNA, 21 bp, Homo sapiens
atatgtatatgacatttaaat

SEQ ID NO: 4006429 - DNA, 18 bp, Homo sapiens
atatgtatatttttttaa

SEQ ID NO: 4006430 - DNA, 23 bp, Homo sapiens
atatgtatatttttttaatttaa

SEQ ID NO: 4006431 - DNA, 16 bp, Homo sapiens
atatgtattttcctaa

SEQ ID NO: 4006432 - DNA, 14 bp, Homo sapiens
atatgtcaagccat

SEQ ID NO: 4006433 - DNA, 20 bp, Homo sapiens
atatgtgagtgccttttgca

SEQ ID NO: 4006434 - DNA, 21 bp, Homo sapiens
atatgtgtgcctatttgtgtg

SEQ ID NO: 4006435 - DNA, 14 bp, Homo sapiens
atatgttgaatact

SEQ ID NO: 4006436 - DNA, 17 bp, Homo sapiens
atatgttgaatactttt

SEQ ID NO: 4006437 - DNA, 18 bp, Homo sapiens
atatgttgaatacttttt

SEQ ID NO: 4006438 - DNA, 18 bp, Homo sapiens
atatgttgctataataaa

SEQ ID NO: 4006439 - DNA, 21 bp, Homo sapiens
atatgtttaaaataaaatgaa

SEQ ID NO: 4006440 - DNA, 14 bp, Homo sapiens
atatgttttttaga

SEQ ID NO: 4006441 - DNA, 17 bp, Homo sapiens
atatgttttttagatca

SEQ ID NO: 4006442 - DNA, 17 bp, Homo sapiens
atattaaatacagacac

SEQ ID NO: 4006443 - DNA, 19 bp, Homo sapiens
atattaaatacagacacta

SEQ ID NO: 4006444 - DNA, 12 bp, Homo sapiens
atattaaatctg

SEQ ID NO: 4006445 - DNA, 17 bp, Homo sapiens
atattaagaaagactat

SEQ ID NO: 4006446 - DNA, 12 bp, Homo sapiens
atattaagcact

SEQ ID NO: 4006447 - DNA, 13 bp, Homo sapiens
atattaagcactt

SEQ ID NO: 4006448 - DNA, 20 bp, Homo sapiens
atattaagcactttaagctc

SEQ ID NO: 4006449 - DNA, 12 bp, Homo sapiens
atattaatgtac

SEQ ID NO: 4006450 - DNA, 18 bp, Homo sapiens
atattaatgtacttgttt

SEQ ID NO: 4006451 - DNA, 23 bp, Homo sapiens
atattaattagcaggttgggcta

SEQ ID NO: 4006452 - DNA, 14 bp, Homo sapiens
atattacctggatt

SEQ ID NO: 4006453 - DNA, 18 bp, Homo sapiens
atattactgttgcattta

SEQ ID NO: 4006454 - DNA, 18 bp, Homo sapiens
atattatcataagaattt

SEQ ID NO: 4006455 - DNA, 18 bp, Homo sapiens
atattatgcctgaatgac

SEQ ID NO: 4006456 - DNA, 13 bp, Homo sapiens
atattattagaaa

SEQ ID NO: 4006457 - DNA, 19 bp, Homo sapiens
atattattagaaattagaa

SEQ ID NO: 4006458 - DNA, 23 bp, Homo sapiens
atattattgtaagttgtacaaat

SEQ ID NO: 4006459 - DNA, 19 bp, Homo sapiens
atattccatgaatgtatca

SEQ ID NO: 4006460 - DNA, 13 bp, Homo sapiens
atattcctccaaa

SEQ ID NO: 4006461 - DNA, 17 bp, Homo sapiens
atattcttttgtttcca

SEQ ID NO: 4006462 - DNA, 12 bp, Homo sapiens
atattgaacttt

SEQ ID NO: 4006463 - DNA, 16 bp, Homo sapiens
atattgaagacaattt

SEQ ID NO: 4006464 - DNA, 19 bp, Homo sapiens
atattgacactgtccctct

SEQ ID NO: 4006465 - DNA, 15 bp, Homo sapiens
atattgacatttgta

SEQ ID NO: 4006466 - DNA, 21 bp, Homo sapiens
atattgagaatcccttaaaat

SEQ ID NO: 4006467 - DNA, 18 bp, Homo sapiens
atattgaggctttgtgtt

SEQ ID NO: 4006468 - DNA, 17 bp, Homo sapiens
atattgagtcaaatggt

SEQ ID NO: 4006469 - DNA, 13 bp, Homo sapiens
atattgatgaaaa

SEQ ID NO: 4006470 - DNA, 14 bp, Homo sapiens
atattgatgaaaag

SEQ ID NO: 4006471 - DNA, 15 bp, Homo sapiens
atattgatgataaca

SEQ ID NO: 4006472 - DNA, 16 bp, Homo sapiens
atattgattgtccttt

SEQ ID NO: 4006473 - DNA, 17 bp, Homo sapiens
atattgcacaattataa

SEQ ID NO: 4006474 - DNA, 15 bp, Homo sapiens
atattgctttttcta

SEQ ID NO: 4006475 - DNA, 22 bp, Homo sapiens
atattgctttttctaatgtggt

SEQ ID NO: 4006476 - DNA, 22 bp, Homo sapiens
atattggtgcgtttttacagtt

SEQ ID NO: 4006477 - DNA, 17 bp, Homo sapiens
atattgtacataaaaga

SEQ ID NO: 4006478 - DNA, 20 bp, Homo sapiens
atattgtattgctgctgtgc

SEQ ID NO: 4006479 - DNA, 13 bp, Homo sapiens
atattgtgattct

SEQ ID NO: 4006480 - DNA, 21 bp, Homo sapiens
atattgtgtttgtgtatttac

SEQ ID NO: 4006481 - DNA, 20 bp, Homo sapiens
atattgttcaaacaatatca

SEQ ID NO: 4006482 - DNA, 22 bp, Homo sapiens
atattgttcaaacaatatcata

SEQ ID NO: 4006483 - DNA, 13 bp, Homo sapiens
atattgttgacaa

SEQ ID NO: 4006484 - DNA, 15 bp, Homo sapiens
atattgttgacaact

SEQ ID NO: 4006485 - DNA, 21 bp, Homo sapiens
atattgttgacaactgtgact

SEQ ID NO: 4006486 - DNA, 22 bp, Homo sapiens
atattgttgtataatttcgaga

SEQ ID NO: 4006487 - DNA, 14 bp, Homo sapiens
atattgtttaaaat

SEQ ID NO: 4006488 - DNA, 15 bp, Homo sapiens
atattgtttaaaatt

SEQ ID NO: 4006489 - DNA, 17 bp, Homo sapiens
atattgtttaaaattca

SEQ ID NO: 4006490 - DNA, 19 bp, Homo sapiens
atattgtttaaaattcagt

SEQ ID NO: 4006491 - DNA, 13 bp, Homo sapiens
atattgttttcag

SEQ ID NO: 4006492 - DNA, 18 bp, Homo sapiens
atattgttttctgtaaat

SEQ ID NO: 4006493 - DNA, 21 bp, Homo sapiens
atatttaaacatggttacaat

SEQ ID NO: 4006494 - DNA, 14 bp, Homo sapiens
atatttaagaaaag

SEQ ID NO: 4006495 - DNA, 23 bp, Homo sapiens
atatttaagaaaatacaataaac

SEQ ID NO: 4006496 - DNA, 20 bp, Homo sapiens
atatttacaataaatgaaga

SEQ ID NO: 4006497 - DNA, 18 bp, Homo sapiens
atatttacattctagttc

SEQ ID NO: 4006498 - DNA, 14 bp, Homo sapiens
atatttataaaact

SEQ ID NO: 4006499 - DNA, 11 bp, Homo sapiens
atatttataac

SEQ ID NO: 4006500 - DNA, 13 bp, Homo sapiens
atatttataactc

SEQ ID NO: 4006501 - DNA, 17 bp, Homo sapiens
atatttataactcatca

SEQ ID NO: 4006502 - DNA, 22 bp, Homo sapiens
atatttataactcatcataaaa

SEQ ID NO: 4006503 - DNA, 18 bp, Homo sapiens
atatttatgtctatttaa

SEQ ID NO: 4006504 - DNA, 16 bp, Homo sapiens
atatttattaaataaa

SEQ ID NO: 4006505 - DNA, 20 bp, Homo sapiens
atatttattaaataaaatca

SEQ ID NO: 4006506 - DNA, 14 bp, Homo sapiens
atatttattacctc

SEQ ID NO: 4006507 - DNA, 23 bp, Homo sapiens
atatttattattttcacctgttt

SEQ ID NO: 4006508 - DNA, 11 bp, Homo sapiens
atatttattgt

SEQ ID NO: 4006509 - DNA, 13 bp, Homo sapiens
atatttattgtta

SEQ ID NO: 4006510 - DNA, 19 bp, Homo sapiens
atatttattgttagaaaat

SEQ ID NO: 4006511 - DNA, 13 bp, Homo sapiens
atatttatttaaa

SEQ ID NO: 4006512 - DNA, 22 bp, Homo sapiens
atatttattttcttttgaattg

SEQ ID NO: 4006513 - DNA, 18 bp, Homo sapiens
atatttatttttttaagc

SEQ ID NO: 4006514 - DNA, 15 bp, Homo sapiens
atatttcacttttgt

SEQ ID NO: 4006515 - DNA, 20 bp, Homo sapiens
atatttcacttttgttctgc

SEQ ID NO: 4006516 - DNA, 23 bp, Homo sapiens
atatttcagatatcaaaattcta

SEQ ID NO: 4006517 - DNA, 18 bp, Homo sapiens
atatttccatatggattt

SEQ ID NO: 4006518 - DNA, 15 bp, Homo sapiens
atatttccatttctt

SEQ ID NO: 4006519 - DNA, 16 bp, Homo sapiens
atatttccatttcttc

SEQ ID NO: 4006520 - DNA, 15 bp, Homo sapiens
atatttcctgacttg

SEQ ID NO: 4006521 - DNA, 22 bp, Homo sapiens
atatttcctgacttgagtgttc

SEQ ID NO: 4006522 - DNA, 15 bp, Homo sapiens
atatttcctttatgt

SEQ ID NO: 4006523 - DNA, 19 bp, Homo sapiens
atatttcctttatgtgaat

SEQ ID NO: 4006524 - DNA, 15 bp, Homo sapiens
atatttcgaaagctg

SEQ ID NO: 4006525 - DNA, 15 bp, Homo sapiens
atatttgaaaaaaac

SEQ ID NO: 4006526 - DNA, 12 bp, Homo sapiens
atatttgaatga

SEQ ID NO: 4006527 - DNA, 16 bp, Homo sapiens
atatttgaatgaaaac

SEQ ID NO: 4006528 - DNA, 12 bp, Homo sapiens
atatttgtatcg

SEQ ID NO: 4006529 - DNA, 21 bp, Homo sapiens
atatttgtcatgctgggattt

SEQ ID NO: 4006530 - DNA, 19 bp, Homo sapiens
atattttaatgcagttgct

SEQ ID NO: 4006531 - DNA, 20 bp, Homo sapiens
atattttatgtgagagaaag

SEQ ID NO: 4006532 - DNA, 17 bp, Homo sapiens
atattttcaaattgtat

SEQ ID NO: 4006533 - DNA, 13 bp, Homo sapiens
atattttcaacta

SEQ ID NO: 4006534 - DNA, 17 bp, Homo sapiens
atattttcacaatgtca

SEQ ID NO: 4006535 - DNA, 12 bp, Homo sapiens
atattttctcta

SEQ ID NO: 4006536 - DNA, 16 bp, Homo sapiens
atattttgagaaactg

SEQ ID NO: 4006537 - DNA, 17 bp, Homo sapiens
atattttggaaactgct

SEQ ID NO: 4006538 - DNA, 19 bp, Homo sapiens
atatttttaaaaaatgaaa

SEQ ID NO: 4006539 - DNA, 15 bp, Homo sapiens
atatttttaaagatc

SEQ ID NO: 4006540 - DNA, 13 bp, Homo sapiens
atatttttagata

SEQ ID NO: 4006541 - DNA, 17 bp, Homo sapiens
atatttttataataaac

SEQ ID NO: 4006542 - DNA, 20 bp, Homo sapiens
atatttttatatttccttta

SEQ ID NO: 4006543 - DNA, 12 bp, Homo sapiens
atatttttgtac

SEQ ID NO: 4006544 - DNA, 13 bp, Homo sapiens
atatttttgtact

SEQ ID NO: 4006545 - DNA, 18 bp, Homo sapiens
atattttttcagaaatat

SEQ ID NO: 4006546 - DNA, 13 bp, Homo sapiens
atattttttgcaa

SEQ ID NO: 4006547 - DNA, 21 bp, Homo sapiens
atatttttttaaaatgttaaa

SEQ ID NO: 4006548 - DNA, 17 bp, Homo sapiens
atatttttttaatttaa

SEQ ID NO: 4006549 - DNA, 20 bp, Homo sapiens
atcaaaaggttaataaagta

SEQ ID NO: 4006550 - DNA, 21 bp, Homo sapiens
atcaaaatcactatctttctg

SEQ ID NO: 4006551 - DNA, 14 bp, Homo sapiens
atcaaaatgtagct

SEQ ID NO: 4006552 - DNA, 20 bp, Homo sapiens
atcaaaccctagccttgctt

SEQ ID NO: 4006553 - DNA, 16 bp, Homo sapiens
atcaaagtagcaaatg

SEQ ID NO: 4006554 - DNA, 20 bp, Homo sapiens
atcaaagtcaaaaatagcaa

SEQ ID NO: 4006555 - DNA, 22 bp, Homo sapiens
atcaaatactttaaaggaaaaa

SEQ ID NO: 4006556 - DNA, 23 bp, Homo sapiens
atcaaccaccatggatttttaca

SEQ ID NO: 4006557 - DNA, 13 bp, Homo sapiens
atcaactctaata

SEQ ID NO: 4006558 - DNA, 14 bp, Homo sapiens
atcaactttaatca

SEQ ID NO: 4006559 - DNA, 19 bp, Homo sapiens
atcaagagctgccctcctt

SEQ ID NO: 4006560 - DNA, 14 bp, Homo sapiens
atcaagattttagg

SEQ ID NO: 4006561 - DNA, 17 bp, Homo sapiens
atcaagcaggaattatg

SEQ ID NO: 4006562 - DNA, 18 bp, Homo sapiens
atcaagcaggaattatgt

SEQ ID NO: 4006563 - DNA, 19 bp, Homo sapiens
atcaagcaggaattatgtc

SEQ ID NO: 4006564 - DNA, 21 bp, Homo sapiens
atcaagccatgtataaatgtg

SEQ ID NO: 4006565 - DNA, 19 bp, Homo sapiens
atcaagcctttatggctgc

SEQ ID NO: 4006566 - DNA, 20 bp, Homo sapiens
atcaagtatttgggaagtga

SEQ ID NO: 4006567 - DNA, 13 bp, Homo sapiens
atcaagtattttg

SEQ ID NO: 4006568 - DNA, 17 bp, Homo sapiens
atcaagtcaatcatttc

SEQ ID NO: 4006569 - DNA, 17 bp, Homo sapiens
atcaagtcctttgtgaa

SEQ ID NO: 4006570 - DNA, 19 bp, Homo sapiens
atcaagtcctttgtgaata

SEQ ID NO: 4006571 - DNA, 22 bp, Homo sapiens
atcaagttgtaacttatattga

SEQ ID NO: 4006572 - DNA, 23 bp, Homo sapiens
atcaagttgtaacttatattgaa

SEQ ID NO: 4006573 - DNA, 10 bp, Homo sapiens
atcaataaat

SEQ ID NO: 4006574 - DNA, 18 bp, Homo sapiens
atcaataacagccgctcc

SEQ ID NO: 4006575 - DNA, 17 bp, Homo sapiens
atcaatacagacaaggt

SEQ ID NO: 4006576 - DNA, 19 bp, Homo sapiens
atcaatcaaataagtattt

SEQ ID NO: 4006577 - DNA, 22 bp, Homo sapiens
atcaatgcaagagtgattgcag

SEQ ID NO: 4006578 - DNA, 22 bp, Homo sapiens
atcaatgttcacgcaacttgaa

SEQ ID NO: 4006579 - DNA, 23 bp, Homo sapiens
atcaatgttcacgcaacttgaaa

SEQ ID NO: 4006580 - DNA, 13 bp, Homo sapiens
atcaattaaatgt

SEQ ID NO: 4006581 - DNA, 15 bp, Homo sapiens
atcaattaaatgtag

SEQ ID NO: 4006582 - DNA, 23 bp, Homo sapiens
atcaattccctctctcagcacag

SEQ ID NO: 4006583 - DNA, 16 bp, Homo sapiens
atcaattggaaatcaa

SEQ ID NO: 4006584 - DNA, 22 bp, Homo sapiens
atcaattggaaatcaatcctgt

SEQ ID NO: 4006585 - DNA, 20 bp, Homo sapiens
atcaattggcagtgactttg

SEQ ID NO: 4006586 - DNA, 19 bp, Homo sapiens
atcaattttcattaaactt

SEQ ID NO: 4006587 - DNA, 14 bp, Homo sapiens
atcacaatacagat

SEQ ID NO: 4006588 - DNA, 11 bp, Homo sapiens
atcacacacac

SEQ ID NO: 4006589 - DNA, 14 bp, Homo sapiens
atcacagcagcctc

SEQ ID NO: 4006590 - DNA, 20 bp, Homo sapiens
atcacagggttgggcccaga

SEQ ID NO: 4006591 - DNA, 13 bp, Homo sapiens
atcacagtattat

SEQ ID NO: 4006592 - DNA, 19 bp, Homo sapiens
atcacagtattatctgtgt

SEQ ID NO: 4006593 - DNA, 22 bp, Homo sapiens
atcacagtattatctgtgttaa

SEQ ID NO: 4006594 - DNA, 17 bp, Homo sapiens
atcacatctcacctccg

SEQ ID NO: 4006595 - DNA, 14 bp, Homo sapiens
atcattgttgcctc

SEQ ID NO: 4006596 - DNA, 15 bp, Homo sapiens
atcatttattggatg

SEQ ID NO: 4006597 - DNA, 18 bp, Homo sapiens
atcatttctattaaatga

SEQ ID NO: 4006598 - DNA, 21 bp, Homo sapiens
atcatttctattaaatgagca

SEQ ID NO: 4006599 - DNA, 14 bp, Homo sapiens
atcattttaattat

SEQ ID NO: 4006600 - DNA, 13 bp, Homo sapiens
atcattttccccc

SEQ ID NO: 4006601 - DNA, 14 bp, Homo sapiens
atcattttcccccc

SEQ ID NO: 4006602 - DNA, 22 bp, Homo sapiens
atccaaaagaagcccccagcta

SEQ ID NO: 4006603 - DNA, 19 bp, Homo sapiens
atccaaaatattttttgca

SEQ ID NO: 4006604 - DNA, 17 bp, Homo sapiens
atccaaaatgtgtattt

SEQ ID NO: 4006605 - DNA, 23 bp, Homo sapiens
atccaaaatgtgtatttcttata

SEQ ID NO: 4006606 - DNA, 22 bp, Homo sapiens
atccaaagaacttgatttgcat

SEQ ID NO: 4006607 - DNA, 15 bp, Homo sapiens
atccaaagcagacag

SEQ ID NO: 4006608 - DNA, 18 bp, Homo sapiens
atccaacaagaagaaata

SEQ ID NO: 4006609 - DNA, 16 bp, Homo sapiens
atccaagatcaattcc

SEQ ID NO: 4006610 - DNA, 22 bp, Homo sapiens
atccaagggttgagagccagtg

SEQ ID NO: 4006611 - DNA, 24 bp, Homo sapiens
atccaatattttctttaatgcttt

SEQ ID NO: 4006612 - DNA, 20 bp, Homo sapiens
atccaatcctcactgggtgg

SEQ ID NO: 4006613 - DNA, 20 bp, Homo sapiens
atccaattgatgtatatgtt

SEQ ID NO: 4006614 - DNA, 19 bp, Homo sapiens
atccacacacgcaggaact

SEQ ID NO: 4006615 - DNA, 20 bp, Homo sapiens
atccacccgggggagcccag

SEQ ID NO: 4006616 - DNA, 23 bp, Homo sapiens
atccacccgggggagcccagtga

SEQ ID NO: 4006617 - DNA, 18 bp, Homo sapiens
atccacctgtctcagcct

SEQ ID NO: 4006618 - DNA, 21 bp, Homo sapiens
atccacctgtctcagcctccc

SEQ ID NO: 4006619 - DNA, 13 bp, Homo sapiens
atccaccttggct

SEQ ID NO: 4006620 - DNA, 20 bp, Homo sapiens
atccaccttggctctgccag

SEQ ID NO: 4006621 - DNA, 18 bp, Homo sapiens
atccactctaccctccca

SEQ ID NO: 4006622 - DNA, 19 bp, Homo sapiens
atccactctaccctcccac

SEQ ID NO: 4006623 - DNA, 23 bp, Homo sapiens
atccactctaccctcccaccccc

SEQ ID NO: 4006624 - DNA, 10 bp, Homo sapiens
atccagaaac

SEQ ID NO: 4006625 - DNA, 16 bp, Homo sapiens
atccagacatcatgaa

SEQ ID NO: 4006626 - DNA, 18 bp, Homo sapiens
atccagacatcatgaatt

SEQ ID NO: 4006627 - DNA, 22 bp, Homo sapiens
atccagacatcatgaattttac

SEQ ID NO: 4006628 - DNA, 15 bp, Homo sapiens
atccagacctggctc

SEQ ID NO: 4006629 - DNA, 22 bp, Homo sapiens
atccagagagcttaaattgtca

SEQ ID NO: 4006630 - DNA, 22 bp, Homo sapiens
atccagagtttagaggaaaaaa

SEQ ID NO: 4006631 - DNA, 23 bp, Homo sapiens
atccagcagtgttgctcagctcc

SEQ ID NO: 4006632 - DNA, 19 bp, Homo sapiens
atccagccggaggccagag

SEQ ID NO: 4006633 - DNA, 12 bp, Homo sapiens
atccagcctggg

SEQ ID NO: 4006634 - DNA, 17 bp, Homo sapiens
atccagcctggggtctg

SEQ ID NO: 4006635 - DNA, 15 bp, Homo sapiens
atccagctccctaga

SEQ ID NO: 4006636 - DNA, 15 bp, Homo sapiens
atccaggactctgtc

SEQ ID NO: 4006637 - DNA, 19 bp, Homo sapiens
atccaggcagatccaggac

SEQ ID NO: 4006638 - DNA, 13 bp, Homo sapiens
atccagggacaga

SEQ ID NO: 4006639 - DNA, 16 bp, Homo sapiens
atccagggacagaggc

SEQ ID NO: 4006640 - DNA, 21 bp, Homo sapiens
atccagggacagaggccccag

SEQ ID NO: 4006641 - DNA, 20 bp, Homo sapiens
atccagtattgctgatttta

SEQ ID NO: 4006642 - DNA, 20 bp, Homo sapiens
atccagtttgttctccgggt

SEQ ID NO: 4006643 - DNA, 20 bp, Homo sapiens
atccatattgagtcaaatgg

SEQ ID NO: 4006644 - DNA, 15 bp, Homo sapiens
atccatcagctccct

SEQ ID NO: 4006645 - DNA, 14 bp, Homo sapiens
atccatccatctcc

SEQ ID NO: 4006646 - DNA, 16 bp, Homo sapiens
atccatccatctccag

SEQ ID NO: 4006647 - DNA, 18 bp, Homo sapiens
atccatgtactgtagttt

SEQ ID NO: 4006648 - DNA, 18 bp, Homo sapiens
atccatgttagtttttac

SEQ ID NO: 4006649 - DNA, 18 bp, Homo sapiens
atccatttcccctccttc

SEQ ID NO: 4006650 - DNA, 19 bp, Homo sapiens
atccatttcccctccttcc

SEQ ID NO: 4006651 - DNA, 17 bp, Homo sapiens
atccatttgcctttctg

SEQ ID NO: 4006652 - DNA, 23 bp, Homo sapiens
atccatttgcctttctgggagca

SEQ ID NO: 4006653 - DNA, 15 bp, Homo sapiens
atcccaaagttgttg

SEQ ID NO: 4006654 - DNA, 19 bp, Homo sapiens
atcccaacctctttttcct

SEQ ID NO: 4006655 - DNA, 12 bp, Homo sapiens
atcccacacagg

SEQ ID NO: 4006656 - DNA, 14 bp, Homo sapiens
atcccacaccctgg

SEQ ID NO: 4006657 - DNA, 18 bp, Homo sapiens
atcccaccccatcctcca

SEQ ID NO: 4006658 - DNA, 20 bp, Homo sapiens
atcccaccccatcctccagg

SEQ ID NO: 4006659 - DNA, 17 bp, Homo sapiens
atcccacgcactccatg

SEQ ID NO: 4006660 - DNA, 14 bp, Homo sapiens
atcccagcactttg

SEQ ID NO: 4006661 - DNA, 15 bp, Homo sapiens
atcccagcagcccaa

SEQ ID NO: 4006662 - DNA, 13 bp, Homo sapiens
atcccagcctggg

SEQ ID NO: 4006663 - DNA, 15 bp, Homo sapiens
atcccagcctgtggt

SEQ ID NO: 4006664 - DNA, 18 bp, Homo sapiens
atcccagctacttgggaa

SEQ ID NO: 4006665 - DNA, 19 bp, Homo sapiens
atcccaggcttcaccctga

SEQ ID NO: 4006666 - DNA, 16 bp, Homo sapiens
atcccagggctggctc

SEQ ID NO: 4006667 - DNA, 19 bp, Homo sapiens
atcccatccatcagctccc

SEQ ID NO: 4006668 - DNA, 16 bp, Homo sapiens
atccccaagcccacca

SEQ ID NO: 4006669 - DNA, 19 bp, Homo sapiens
atccccacagctggctctg

SEQ ID NO: 4006670 - DNA, 15 bp, Homo sapiens
atccccactgtccta

SEQ ID NO: 4006671 - DNA, 13 bp, Homo sapiens
atccccagggcag

SEQ ID NO: 4006672 - DNA, 21 bp, Homo sapiens
atccccaggggtcccagccac

SEQ ID NO: 4006673 - DNA, 17 bp, Homo sapiens
atccccatcctccagag

SEQ ID NO: 4006674 - DNA, 19 bp, Homo sapiens
atccccatctccctgcctg

SEQ ID NO: 4006675 - DNA, 19 bp, Homo sapiens
atccccgttcctgacatca

SEQ ID NO: 4006676 - DNA, 13 bp, Homo sapiens
atcccctcaggac

SEQ ID NO: 4006677 - DNA, 20 bp, Homo sapiens
atcccctctgtctacaaata

SEQ ID NO: 4006678 - DNA, 19 bp, Homo sapiens
atcccctgcggtcaggctg

SEQ ID NO: 4006679 - DNA, 16 bp, Homo sapiens
atcccgtgttctcctt

SEQ ID NO: 4006680 - DNA, 13 bp, Homo sapiens
atccctacatgta

SEQ ID NO: 4006681 - DNA, 14 bp, Homo sapiens
atccctacccccta

SEQ ID NO: 4006682 - DNA, 21 bp, Homo sapiens
atccctaccccctaagagcca

SEQ ID NO: 4006683 - DNA, 20 bp, Homo sapiens
atccctagtccccctgtttt

SEQ ID NO: 4006684 - DNA, 21 bp, Homo sapiens
atccctcacacatccagacat

SEQ ID NO: 4006685 - DNA, 13 bp, Homo sapiens
atccctcacctgt

SEQ ID NO: 4006686 - DNA, 15 bp, Homo sapiens
atccctccccagttc

SEQ ID NO: 4006687 - DNA, 18 bp, Homo sapiens
atccctcccccccatgca

SEQ ID NO: 4006688 - DNA, 22 bp, Homo sapiens
atccctcgggaagcagccagct

SEQ ID NO: 4006689 - DNA, 15 bp, Homo sapiens
atccctctcttcccc

SEQ ID NO: 4006690 - DNA, 23 bp, Homo sapiens
atccctctcttccccttccctta

SEQ ID NO: 4006691 - DNA, 20 bp, Homo sapiens
atccctgaatcccccttgcc

SEQ ID NO: 4006692 - DNA, 18 bp, Homo sapiens
atccctgactggccaaac

SEQ ID NO: 4006693 - DNA, 12 bp, Homo sapiens
atccctgccaca

SEQ ID NO: 4006694 - DNA, 16 bp, Homo sapiens
atccctgcggcctcca

SEQ ID NO: 4006695 - DNA, 19 bp, Homo sapiens
atccctgcggcctccacac

SEQ ID NO: 4006696 - DNA, 17 bp, Homo sapiens
atccctgggcattgctt

SEQ ID NO: 4006697 - DNA, 16 bp, Homo sapiens
atcgttattataaatg

SEQ ID NO: 4006698 - DNA, 19 bp, Homo sapiens
atcgttattataaatgtta

SEQ ID NO: 4006699 - DNA, 22 bp, Homo sapiens
atcgttattataaatgttagtt

SEQ ID NO: 4006700 - DNA, 19 bp, Homo sapiens
atctaaaaatagacttaaa

SEQ ID NO: 4006701 - DNA, 20 bp, Homo sapiens
atctaaaacaaaatctgaac

SEQ ID NO: 4006702 - DNA, 19 bp, Homo sapiens
atctaaaagaaatgtctat

SEQ ID NO: 4006703 - DNA, 20 bp, Homo sapiens
atctaaagtgtgttgttgct

SEQ ID NO: 4006704 - DNA, 13 bp, Homo sapiens
atctaaatctatt

SEQ ID NO: 4006705 - DNA, 15 bp, Homo sapiens
atctaaatctattta

SEQ ID NO: 4006706 - DNA, 18 bp, Homo sapiens
atctaaatctatttatta

SEQ ID NO: 4006707 - DNA, 20 bp, Homo sapiens
atctaaatctatttattaat

SEQ ID NO: 4006708 - DNA, 17 bp, Homo sapiens
atctaagcctttccata

SEQ ID NO: 4006709 - DNA, 18 bp, Homo sapiens
atctaaggatgtcacagg

SEQ ID NO: 4006710 - DNA, 17 bp, Homo sapiens
atctaagtgatataaat

SEQ ID NO: 4006711 - DNA, 19 bp, Homo sapiens
atctaatatatatgaataa

SEQ ID NO: 4006712 - DNA, 20 bp, Homo sapiens
atctaatatatatgaataaa

SEQ ID NO: 4006713 - DNA, 14 bp, Homo sapiens
atctaatctaaaag

SEQ ID NO: 4006714 - DNA, 15 bp, Homo sapiens
atctacacagcctgg

SEQ ID NO: 4006715 - DNA, 19 bp, Homo sapiens
atctactaattccacacct

SEQ ID NO: 4006716 - DNA, 19 bp, Homo sapiens
atctagccagcccctcttc

SEQ ID NO: 4006717 - DNA, 22 bp, Homo sapiens
atctaggtggagttgaaagagt

SEQ ID NO: 4006718 - DNA, 12 bp, Homo sapiens
atctataaagaa

SEQ ID NO: 4006719 - DNA, 13 bp, Homo sapiens
atctataaagaag

SEQ ID NO: 4006720 - DNA, 16 bp, Homo sapiens
atctataaagaagaac

SEQ ID NO: 4006721 - DNA, 16 bp, Homo sapiens
atctatagaaagctat

SEQ ID NO: 4006722 - DNA, 17 bp, Homo sapiens
atctatcgagtttgcaa

SEQ ID NO: 4006723 - DNA, 15 bp, Homo sapiens
atctatgatataacc

SEQ ID NO: 4006724 - DNA, 14 bp, Homo sapiens
atctatgcagcatg

SEQ ID NO: 4006725 - DNA, 23 bp, Homo sapiens
atctatgcagcatggggttttta

SEQ ID NO: 4006726 - DNA, 15 bp, Homo sapiens
atctattaaagtgac

SEQ ID NO: 4006727 - DNA, 18 bp, Homo sapiens
atctattaatatatgtat

SEQ ID NO: 4006728 - DNA, 16 bp, Homo sapiens
atctattgggttcatt

SEQ ID NO: 4006729 - DNA, 21 bp, Homo sapiens
atctcaaataactaaaaggta

SEQ ID NO: 4006730 - DNA, 18 bp, Homo sapiens
atctcaatgaagccagct

SEQ ID NO: 4006731 - DNA, 14 bp, Homo sapiens
atctcaccccatcc

SEQ ID NO: 4006732 - DNA, 22 bp, Homo sapiens
atctcaccccatcccacaccct

SEQ ID NO: 4006733 - DNA, 23 bp, Homo sapiens
atctcaccccatcccacaccctg

SEQ ID NO: 4006734 - DNA, 16 bp, Homo sapiens
atctcagaaagtgcct

SEQ ID NO: 4006735 - DNA, 17 bp, Homo sapiens
atctcagaaagtgcctg

SEQ ID NO: 4006736 - DNA, 20 bp, Homo sapiens
atctcagaattccttttcta

SEQ ID NO: 4006737 - DNA, 20 bp, Homo sapiens
atctcagatcagtgtaccat

SEQ ID NO: 4006738 - DNA, 11 bp, Homo sapiens
atctcagccca

SEQ ID NO: 4006739 - DNA, 12 bp, Homo sapiens
atctcagcctcc

SEQ ID NO: 4006740 - DNA, 20 bp, Homo sapiens
atctcagcctcctgagcctg

SEQ ID NO: 4006741 - DNA, 21 bp, Homo sapiens
atctcagcctcctgagcctgt

SEQ ID NO: 4006742 - DNA, 19 bp, Homo sapiens
atctcaggacacttccgta

SEQ ID NO: 4006743 - DNA, 21 bp, Homo sapiens
atctcaggagatggagggctt

SEQ ID NO: 4006744 - DNA, 17 bp, Homo sapiens
atctcaggggccagagg

SEQ ID NO: 4006745 - DNA, 15 bp, Homo sapiens
atctcagtcatgcat

SEQ ID NO: 4006746 - DNA, 20 bp, Homo sapiens
atctcagtcatgcataaata

SEQ ID NO: 4006747 - DNA, 22 bp, Homo sapiens
atctcagtcatgcataaatatg

SEQ ID NO: 4006748 - DNA, 18 bp, Homo sapiens
atctcatgaggggagagg

SEQ ID NO: 4006749 - DNA, 23 bp, Homo sapiens
atctcatgcccctggctgggacg

SEQ ID NO: 4006750 - DNA, 16 bp, Homo sapiens
atctcattgcttacaa

SEQ ID NO: 4006751 - DNA, 19 bp, Homo sapiens
atctcatttaatttgttat

SEQ ID NO: 4006752 - DNA, 20 bp, Homo sapiens
atctccaggattgaagagca

SEQ ID NO: 4006753 - DNA, 21 bp, Homo sapiens
atctccagggagcaagacaga

SEQ ID NO: 4006754 - DNA, 23 bp, Homo sapiens
atctccagggagcaagacagaga

SEQ ID NO: 4006755 - DNA, 14 bp, Homo sapiens
atctccatttcaaa

SEQ ID NO: 4006756 - DNA, 18 bp, Homo sapiens
atctcccacctagcagca

SEQ ID NO: 4006757 - DNA, 19 bp, Homo sapiens
atctcccacctagcagcac

SEQ ID NO: 4006758 - DNA, 18 bp, Homo sapiens
atctcccattttggaatt

SEQ ID NO: 4006759 - DNA, 19 bp, Homo sapiens
atctcccattttggaattt

SEQ ID NO: 4006760 - DNA, 14 bp, Homo sapiens
atctccctgcctgg

SEQ ID NO: 4006761 - DNA, 15 bp, Homo sapiens
atctccctgcctggc

SEQ ID NO: 4006762 - DNA, 21 bp, Homo sapiens
atctccgttccatctgggctt

SEQ ID NO: 4006763 - DNA, 14 bp, Homo sapiens
atctcctgctcacc

SEQ ID NO: 4006764 - DNA, 17 bp, Homo sapiens
atctcctgctcaccacc

SEQ ID NO: 4006765 - DNA, 20 bp, Homo sapiens
atctcctgctcaccacctgc

SEQ ID NO: 4006766 - DNA, 19 bp, Homo sapiens
atctcctgtgcatgggtga

SEQ ID NO: 4006767 - DNA, 16 bp, Homo sapiens
atctccttcccacccc

SEQ ID NO: 4006768 - DNA, 22 bp, Homo sapiens
atctccttcccacccctacaca

SEQ ID NO: 4006769 - DNA, 14 bp, Homo sapiens
atctcgttcccaaa

SEQ ID NO: 4006770 - DNA, 19 bp, Homo sapiens
atctctactaccacaagga

SEQ ID NO: 4006771 - DNA, 20 bp, Homo sapiens
atctctactaccacaaggaa

SEQ ID NO: 4006772 - DNA, 19 bp, Homo sapiens
atctctatcgattgtgtag

SEQ ID NO: 4006773 - DNA, 13 bp, Homo sapiens
atctctatttaat

SEQ ID NO: 4006774 - DNA, 16 bp, Homo sapiens
atctctatttaatatt

SEQ ID NO: 4006775 - DNA, 19 bp, Homo sapiens
atctctatttaatatttat

SEQ ID NO: 4006776 - DNA, 14 bp, Homo sapiens
atctctcaaaactt

SEQ ID NO: 4006777 - DNA, 15 bp, Homo sapiens
atctctcaaatctgt

SEQ ID NO: 4006778 - DNA, 16 bp, Homo sapiens
atctctcaaatctgtt

SEQ ID NO: 4006779 - DNA, 19 bp, Homo sapiens
atctctcaaatctgttatc

SEQ ID NO: 4006780 - DNA, 20 bp, Homo sapiens
atctctccacggtagcactt

SEQ ID NO: 4006781 - DNA, 11 bp, Homo sapiens
atctctccctc

SEQ ID NO: 4006782 - DNA, 12 bp, Homo sapiens
atctctcctggc

SEQ ID NO: 4006783 - DNA, 19 bp, Homo sapiens
atctctctgcagctgccgg

SEQ ID NO: 4006784 - DNA, 13 bp, Homo sapiens
atctctctggggc

SEQ ID NO: 4006785 - DNA, 16 bp, Homo sapiens
atctctctggggccct

SEQ ID NO: 4006786 - DNA, 20 bp, Homo sapiens
atctctctggggccctgggc

SEQ ID NO: 4006787 - DNA, 23 bp, Homo sapiens
atctctctggggccctgggcctc

SEQ ID NO: 4006788 - DNA, 22 bp, Homo sapiens
atctctgaaggagttacaggga

SEQ ID NO: 4006789 - DNA, 16 bp, Homo sapiens
atctctgaatgcccca

SEQ ID NO: 4006790 - DNA, 16 bp, Homo sapiens
atctcttattttacaa

SEQ ID NO: 4006791 - DNA, 20 bp, Homo sapiens
atctcttcattattctctgc

SEQ ID NO: 4006792 - DNA, 14 bp, Homo sapiens
atctcttccccaga

SEQ ID NO: 4006793 - DNA, 17 bp, Homo sapiens
atctcttccccagagag

SEQ ID NO: 4006794 - DNA, 18 bp, Homo sapiens
atctcttccccagagagg

SEQ ID NO: 4006795 - DNA, 14 bp, Homo sapiens
atctcttctgcaag

SEQ ID NO: 4006796 - DNA, 23 bp, Homo sapiens
atctcttctgcaagcctcatgcc

SEQ ID NO: 4006797 - DNA, 14 bp, Homo sapiens
atctcttctggtgt

SEQ ID NO: 4006798 - DNA, 16 bp, Homo sapiens
atctcttctggtgttg

SEQ ID NO: 4006799 - DNA, 19 bp, Homo sapiens
atgaatcaatgaaaaatgt

SEQ ID NO: 4006800 - DNA, 21 bp, Homo sapiens
atgaatctcgttcccaaagaa

SEQ ID NO: 4006801 - DNA, 14 bp, Homo sapiens
atgaatctgctcac

SEQ ID NO: 4006802 - DNA, 16 bp, Homo sapiens
atgaatgtatcaggaa

SEQ ID NO: 4006803 - DNA, 15 bp, Homo sapiens
atgaatgtatttatt

SEQ ID NO: 4006804 - DNA, 17 bp, Homo sapiens
atgaatgtatttatttg

SEQ ID NO: 4006805 - DNA, 17 bp, Homo sapiens
atgaattcaagaaagga

SEQ ID NO: 4006806 - DNA, 11 bp, Homo sapiens
atgaatttaaa

SEQ ID NO: 4006807 - DNA, 14 bp, Homo sapiens
atgaatttaaatat

SEQ ID NO: 4006808 - DNA, 16 bp, Homo sapiens
atgaatttaaatataa

SEQ ID NO: 4006809 - DNA, 22 bp, Homo sapiens
atgaattttccacgcagttctt

SEQ ID NO: 4006810 - DNA, 14 bp, Homo sapiens
atgacacccaccct

SEQ ID NO: 4006811 - DNA, 23 bp, Homo sapiens
atgacacccaccctgtgccatca

SEQ ID NO: 4006812 - DNA, 13 bp, Homo sapiens
atgacaccctggc

SEQ ID NO: 4006813 - DNA, 15 bp, Homo sapiens
atgacagaggctgca

SEQ ID NO: 4006814 - DNA, 15 bp, Homo sapiens
atgacagatatattt

SEQ ID NO: 4006815 - DNA, 20 bp, Homo sapiens
atgacagatatatttaagcc

SEQ ID NO: 4006816 - DNA, 21 bp, Homo sapiens
atgacagatatatttaagcct

SEQ ID NO: 4006817 - DNA, 12 bp, Homo sapiens
atgacagggcag

SEQ ID NO: 4006818 - DNA, 16 bp, Homo sapiens
atgacagggcagagca

SEQ ID NO: 4006819 - DNA, 16 bp, Homo sapiens
atgacatctcaggggc

SEQ ID NO: 4006820 - DNA, 19 bp, Homo sapiens
atgacattaaatgcaataa

SEQ ID NO: 4006821 - DNA, 14 bp, Homo sapiens
atgacattccctgc

SEQ ID NO: 4006822 - DNA, 21 bp, Homo sapiens
atgacattttttttaactact

SEQ ID NO: 4006823 - DNA, 23 bp, Homo sapiens
atgaccaatattatactaagaaa

SEQ ID NO: 4006824 - DNA, 17 bp, Homo sapiens
atgaccagggatgctgg

SEQ ID NO: 4006825 - DNA, 18 bp, Homo sapiens
atgacctcttcctttagg

SEQ ID NO: 4006826 - DNA, 19 bp, Homo sapiens
atgacctgtgaccagcact

SEQ ID NO: 4006827 - DNA, 16 bp, Homo sapiens
atgacggaagaacata

SEQ ID NO: 4006828 - DNA, 11 bp, Homo sapiens
atgactaaaga

SEQ ID NO: 4006829 - DNA, 23 bp, Homo sapiens
atgactaaagagagaatgtagat

SEQ ID NO: 4006830 - DNA, 23 bp, Homo sapiens
atgactacttagcatcctaagaa

SEQ ID NO: 4006831 - DNA, 14 bp, Homo sapiens
atgactcagaatat

SEQ ID NO: 4006832 - DNA, 16 bp, Homo sapiens
atgactgaaagcactg

SEQ ID NO: 4006833 - DNA, 13 bp, Homo sapiens
atgactgaatggg

SEQ ID NO: 4006834 - DNA, 23 bp, Homo sapiens
atgactgcacccagctccagggg

SEQ ID NO: 4006835 - DNA, 21 bp, Homo sapiens
atgactgctccccagccctgg

SEQ ID NO: 4006836 - DNA, 18 bp, Homo sapiens
atgactgtgaccaccttc

SEQ ID NO: 4006837 - DNA, 14 bp, Homo sapiens
atgacttatttctg

SEQ ID NO: 4006838 - DNA, 19 bp, Homo sapiens
atgacttatttctgctctg

SEQ ID NO: 4006839 - DNA, 22 bp, Homo sapiens
atgacttatttctgctctggaa

SEQ ID NO: 4006840 - DNA, 16 bp, Homo sapiens
atgacttccctgctcc

SEQ ID NO: 4006841 - DNA, 18 bp, Homo sapiens
atgagaattttacttcca

SEQ ID NO: 4006842 - DNA, 20 bp, Homo sapiens
atgagacagggtcttgctct

SEQ ID NO: 4006843 - DNA, 17 bp, Homo sapiens
atgagactctagggtcc

SEQ ID NO: 4006844 - DNA, 22 bp, Homo sapiens
atgagagcccagaggtaacaga

SEQ ID NO: 4006845 - DNA, 13 bp, Homo sapiens
atgagagtcactt

SEQ ID NO: 4006846 - DNA, 19 bp, Homo sapiens
atgagatcccgcctcttct

SEQ ID NO: 4006847 - DNA, 23 bp, Homo sapiens
atgagatctaagcctttccataa

SEQ ID NO: 4006848 - DNA, 18 bp, Homo sapiens
atgagcaaggacattgcc

SEQ ID NO: 4006849 - DNA, 21 bp, Homo sapiens
atgagcaaggacattgcccca

SEQ ID NO: 4006850 - DNA, 13 bp, Homo sapiens
atgagcacctcca

SEQ ID NO: 4006851 - DNA, 14 bp, Homo sapiens
atgagcacctccat

SEQ ID NO: 4006852 - DNA, 20 bp, Homo sapiens
atgagccatcactagaagaa

SEQ ID NO: 4006853 - DNA, 11 bp, Homo sapiens
atgagcccaga

SEQ ID NO: 4006854 - DNA, 17 bp, Homo sapiens
atgagcccagagaacag

SEQ ID NO: 4006855 - DNA, 18 bp, Homo sapiens
atgagcccagagaacagc

SEQ ID NO: 4006856 - DNA, 23 bp, Homo sapiens
atgagccgctgtgagcccctggt

SEQ ID NO: 4006857 - DNA, 10 bp, Homo sapiens
atgagcctgc

SEQ ID NO: 4006858 - DNA, 14 bp, Homo sapiens
atgagcctgctgga

SEQ ID NO: 4006859 - DNA, 22 bp, Homo sapiens
atgagctcgcatttgtcaatga

SEQ ID NO: 4006860 - DNA, 14 bp, Homo sapiens
atgaggaggggagc

SEQ ID NO: 4006861 - DNA, 23 bp, Homo sapiens
atgaggaggggagcgtctgggaa

SEQ ID NO: 4006862 - DNA, 15 bp, Homo sapiens
atgaggaggggaggg

SEQ ID NO: 4006863 - DNA, 12 bp, Homo sapiens
atgaggagggtg

SEQ ID NO: 4006864 - DNA, 22 bp, Homo sapiens
atgaggagggtgggggagggag

SEQ ID NO: 4006865 - DNA, 20 bp, Homo sapiens
atgaggccatctcaggagat

SEQ ID NO: 4006866 - DNA, 14 bp, Homo sapiens
atgagggacagggt

SEQ ID NO: 4006867 - DNA, 14 bp, Homo sapiens
atgagggactggaa

SEQ ID NO: 4006868 - DNA, 19 bp, Homo sapiens
atgaggggacattttggtg

SEQ ID NO: 4006869 - DNA, 23 bp, Homo sapiens
atgagggtgtgagaagtgccttc

SEQ ID NO: 4006870 - DNA, 14 bp, Homo sapiens
atgaggtcccaggc

SEQ ID NO: 4006871 - DNA, 17 bp, Homo sapiens
atgaggtcccaggcaga

SEQ ID NO: 4006872 - DNA, 15 bp, Homo sapiens
atgaggtctgtttaa

SEQ ID NO: 4006873 - DNA, 13 bp, Homo sapiens
atgaggtgggagg

SEQ ID NO: 4006874 - DNA, 14 bp, Homo sapiens
atgaggtgggaggt

SEQ ID NO: 4006875 - DNA, 21 bp, Homo sapiens
atgaggttctgagaccagtgt

SEQ ID NO: 4006876 - DNA, 14 bp, Homo sapiens
atgagtacaaatgc

SEQ ID NO: 4006877 - DNA, 23 bp, Homo sapiens
atgagtatttggtccaaaaaaag

SEQ ID NO: 4006878 - DNA, 16 bp, Homo sapiens
atgagtcaatgtgcag

SEQ ID NO: 4006879 - DNA, 22 bp, Homo sapiens
atgagtcactatgggatgagaa

SEQ ID NO: 4006880 - DNA, 15 bp, Homo sapiens
atgagtgaataaatg

SEQ ID NO: 4006881 - DNA, 20 bp, Homo sapiens
atgagttgtgaaatttaatg

SEQ ID NO: 4006882 - DNA, 21 bp, Homo sapiens
atgataaaataaataatttta

SEQ ID NO: 4006883 - DNA, 14 bp, Homo sapiens
atgataaagagaca

SEQ ID NO: 4006884 - DNA, 20 bp, Homo sapiens
atgataaagagacagtgata

SEQ ID NO: 4006885 - DNA, 17 bp, Homo sapiens
atgataagtaaatgcta

SEQ ID NO: 4006886 - DNA, 13 bp, Homo sapiens
atgatacaatgaa

SEQ ID NO: 4006887 - DNA, 17 bp, Homo sapiens
atgatacaatgaacact

SEQ ID NO: 4006888 - DNA, 15 bp, Homo sapiens
atgatacatccaaag

SEQ ID NO: 4006889 - DNA, 22 bp, Homo sapiens
atgataccctgaatttggcctg

SEQ ID NO: 4006890 - DNA, 22 bp, Homo sapiens
atgatatgtaaacataattctt

SEQ ID NO: 4006891 - DNA, 15 bp, Homo sapiens
atgatattgtttaaa

SEQ ID NO: 4006892 - DNA, 12 bp, Homo sapiens
atgatatttctt

SEQ ID NO: 4006893 - DNA, 21 bp, Homo sapiens
atgatcagcatctgtgatggg

SEQ ID NO: 4006894 - DNA, 13 bp, Homo sapiens
atgatccctgtgt

SEQ ID NO: 4006895 - DNA, 16 bp, Homo sapiens
atgatctactcagaaa

SEQ ID NO: 4006896 - DNA, 18 bp, Homo sapiens
atgatctactcagaaatt

SEQ ID NO: 4006897 - DNA, 23 bp, Homo sapiens
atgatctctccacggtagcactt

SEQ ID NO: 4006898 - DNA, 15 bp, Homo sapiens
atgatctctctagct

SEQ ID NO: 4006899 - DNA, 14 bp, Homo sapiens
atgatctctctgaa

SEQ ID NO: 4006900 - DNA, 17 bp, Homo sapiens
atgatctcttctggtgt

SEQ ID NO: 4006901 - DNA, 23 bp, Homo sapiens
atgatcttgagtataagaaatgc

SEQ ID NO: 4006902 - DNA, 18 bp, Homo sapiens
atgatgaaaaggttgcct

SEQ ID NO: 4006903 - DNA, 12 bp, Homo sapiens
atgatgaatgag

SEQ ID NO: 4006904 - DNA, 15 bp, Homo sapiens
atgatgctgtgacaa

SEQ ID NO: 4006905 - DNA, 16 bp, Homo sapiens
atgatgggaaaatatt

SEQ ID NO: 4006906 - DNA, 21 bp, Homo sapiens
atgatgggaaaatatttcctg

SEQ ID NO: 4006907 - DNA, 17 bp, Homo sapiens
atgatggttttaaactt

SEQ ID NO: 4006908 - DNA, 12 bp, Homo sapiens
atgatgtatatt

SEQ ID NO: 4006909 - DNA, 15 bp, Homo sapiens
atgatgtccagaaga

SEQ ID NO: 4006910 - DNA, 19 bp, Homo sapiens
atgatgtgtacccaaacgt

SEQ ID NO: 4006911 - DNA, 15 bp, Homo sapiens
atgatgttttcaggt

SEQ ID NO: 4006912 - DNA, 16 bp, Homo sapiens
atgattaaacacctga

SEQ ID NO: 4006913 - DNA, 18 bp, Homo sapiens
atgattaaacacctgaca

SEQ ID NO: 4006914 - DNA, 14 bp, Homo sapiens
atgattagcaagtt

SEQ ID NO: 4006915 - DNA, 22 bp, Homo sapiens
atgattccttgatggagatatt

SEQ ID NO: 4006916 - DNA, 15 bp, Homo sapiens
atgattggattattc

SEQ ID NO: 4006917 - DNA, 21 bp, Homo sapiens
atgattggattattcatttaa

SEQ ID NO: 4006918 - DNA, 13 bp, Homo sapiens
atgattgtataag

SEQ ID NO: 4006919 - DNA, 20 bp, Homo sapiens
atgatttataaacagacaat

SEQ ID NO: 4006920 - DNA, 15 bp, Homo sapiens
atgatttccttcaat

SEQ ID NO: 4006921 - DNA, 20 bp, Homo sapiens
atgatttccttcaatgtgca

SEQ ID NO: 4006922 - DNA, 13 bp, Homo sapiens
atgatttggggga

SEQ ID NO: 4006923 - DNA, 15 bp, Homo sapiens
atgatttgttttgaa

SEQ ID NO: 4006924 - DNA, 17 bp, Homo sapiens
atgattttaattttata

SEQ ID NO: 4006925 - DNA, 18 bp, Homo sapiens
atgattttatttgacaaa

SEQ ID NO: 4006926 - DNA, 18 bp, Homo sapiens
atgattttcatttcatga

SEQ ID NO: 4006927 - DNA, 12 bp, Homo sapiens
atgcaaaaagaa

SEQ ID NO: 4006928 - DNA, 17 bp, Homo sapiens
atgcaaaatatgtttaa

SEQ ID NO: 4006929 - DNA, 12 bp, Homo sapiens
atgcaaaatgga

SEQ ID NO: 4006930 - DNA, 13 bp, Homo sapiens
atgcaaaatggaa

SEQ ID NO: 4006931 - DNA, 15 bp, Homo sapiens
atgcaacaaatgaat

SEQ ID NO: 4006932 - DNA, 23 bp, Homo sapiens
atgcaacaaatgaattttccacg

SEQ ID NO: 4006933 - DNA, 21 bp, Homo sapiens
atgcaagagtgattgcagctt

SEQ ID NO: 4006934 - DNA, 18 bp, Homo sapiens
atgcaaggaaggaaagaa

SEQ ID NO: 4006935 - DNA, 20 bp, Homo sapiens
atgcaaggtatttctccagt

SEQ ID NO: 4006936 - DNA, 12 bp, Homo sapiens
atgcaataattt

SEQ ID NO: 4006937 - DNA, 14 bp, Homo sapiens
atgcaataatttta

SEQ ID NO: 4006938 - DNA, 16 bp, Homo sapiens
atgcaatcagacaagt

SEQ ID NO: 4006939 - DNA, 15 bp, Homo sapiens
atgcaatccttccct

SEQ ID NO: 4006940 - DNA, 21 bp, Homo sapiens
atgcaattaggtttttcctta

SEQ ID NO: 4006941 - DNA, 16 bp, Homo sapiens
atgcacaagaatggat

SEQ ID NO: 4006942 - DNA, 19 bp, Homo sapiens
atgcacagttgccacattt

SEQ ID NO: 4006943 - DNA, 23 bp, Homo sapiens
atgcactgaaaacttagccagag

SEQ ID NO: 4006944 - DNA, 19 bp, Homo sapiens
atgcactgtgaaggaccct

SEQ ID NO: 4006945 - DNA, 20 bp, Homo sapiens
atgcactgtgaaggaccctt

SEQ ID NO: 4006946 - DNA, 14 bp, Homo sapiens
atgcagagagccat

SEQ ID NO: 4006947 - DNA, 21 bp, Homo sapiens
atgcagagagccattttgtga

SEQ ID NO: 4006948 - DNA, 17 bp, Homo sapiens
atgcagcatggggtttt

SEQ ID NO: 4006949 - DNA, 14 bp, Homo sapiens
atgcagctcttcct

SEQ ID NO: 4006950 - DNA, 16 bp, Homo sapiens
atgcagctcttcctgg

SEQ ID NO: 4006951 - DNA, 15 bp, Homo sapiens
atgcaggacaggagg

SEQ ID NO: 4006952 - DNA, 12 bp, Homo sapiens
atgcaggccctt

SEQ ID NO: 4006953 - DNA, 20 bp, Homo sapiens
atgcagggaatgcaatcctt

SEQ ID NO: 4006954 - DNA, 21 bp, Homo sapiens
atgcaggttggaaggggcctt

SEQ ID NO: 4006955 - DNA, 11 bp, Homo sapiens
atgcagtcctg

SEQ ID NO: 4006956 - DNA, 19 bp, Homo sapiens
atgcagtgatatggcagaa

SEQ ID NO: 4006957 - DNA, 21 bp, Homo sapiens
atgcataaaagggtcaaacct

SEQ ID NO: 4006958 - DNA, 23 bp, Homo sapiens
atgcataaaagggtcaaacctgt

SEQ ID NO: 4006959 - DNA, 14 bp, Homo sapiens
atgcataaatatgc

SEQ ID NO: 4006960 - DNA, 15 bp, Homo sapiens
atgcataaatatgca

SEQ ID NO: 4006961 - DNA, 22 bp, Homo sapiens
atgcatatgtcactagaatgga

SEQ ID NO: 4006962 - DNA, 14 bp, Homo sapiens
atgcatctagatta

SEQ ID NO: 4006963 - DNA, 18 bp, Homo sapiens
atgcatggtgccccagga

SEQ ID NO: 4006964 - DNA, 20 bp, Homo sapiens
atgcatggtgccccaggacc

SEQ ID NO: 4006965 - DNA, 17 bp, Homo sapiens
atgcattcttctctgtt

SEQ ID NO: 4006966 - DNA, 19 bp, Homo sapiens
atgcattcttctctgttgt

SEQ ID NO: 4006967 - DNA, 16 bp, Homo sapiens
atgcattgttggctat

SEQ ID NO: 4006968 - DNA, 17 bp, Homo sapiens
atgcattgttggctatt

SEQ ID NO: 4006969 - DNA, 19 bp, Homo sapiens
atgcattgttggctatttg

SEQ ID NO: 4006970 - DNA, 15 bp, Homo sapiens
atgcatttggaatta

SEQ ID NO: 4006971 - DNA, 12 bp, Homo sapiens
atgcattttgca

SEQ ID NO: 4006972 - DNA, 22 bp, Homo sapiens
atgccaaagctagggtggccct

SEQ ID NO: 4006973 - DNA, 22 bp, Homo sapiens
atgccaagaaaagggctgacat

SEQ ID NO: 4006974 - DNA, 17 bp, Homo sapiens
atgccaatattaaatct

SEQ ID NO: 4006975 - DNA, 16 bp, Homo sapiens
atgccacaaggacttc

SEQ ID NO: 4006976 - DNA, 15 bp, Homo sapiens
atgccacacagagtg

SEQ ID NO: 4006977 - DNA, 16 bp, Homo sapiens
atgccacacagagtgg

SEQ ID NO: 4006978 - DNA, 13 bp, Homo sapiens
atgccaccctcac

SEQ ID NO: 4006979 - DNA, 14 bp, Homo sapiens
atgccaccctcaca

SEQ ID NO: 4006980 - DNA, 22 bp, Homo sapiens
atgccaccctcacacacacagc

SEQ ID NO: 4006981 - DNA, 21 bp, Homo sapiens
atgccacctggcaaaggaccc

SEQ ID NO: 4006982 - DNA, 20 bp, Homo sapiens
atgccacgtggtcactgtgc

SEQ ID NO: 4006983 - DNA, 21 bp, Homo sapiens
atgccacgttccacagttgcc

SEQ ID NO: 4006984 - DNA, 18 bp, Homo sapiens
atgccactgcctgcacct

SEQ ID NO: 4006985 - DNA, 12 bp, Homo sapiens
atgccacttcct

SEQ ID NO: 4006986 - DNA, 12 bp, Homo sapiens
atgccagctgtg

SEQ ID NO: 4006987 - DNA, 15 bp, Homo sapiens
atgccagctgtgtcc

SEQ ID NO: 4006988 - DNA, 13 bp, Homo sapiens
atgccagcttctc

SEQ ID NO: 4006989 - DNA, 15 bp, Homo sapiens
atgccagcttctctc

SEQ ID NO: 4006990 - DNA, 16 bp, Homo sapiens
atgccagcttctctct

SEQ ID NO: 4006991 - DNA, 17 bp, Homo sapiens
atgccagcttctctctc

SEQ ID NO: 4006992 - DNA, 19 bp, Homo sapiens
atgccagcttctctctcca

SEQ ID NO: 4006993 - DNA, 12 bp, Homo sapiens
atgccaggacac

SEQ ID NO: 4006994 - DNA, 23 bp, Homo sapiens
atgccagtaacgcgtcttcctga

SEQ ID NO: 4006995 - DNA, 20 bp, Homo sapiens
atgccatttcagtggcttcc

SEQ ID NO: 4006996 - DNA, 15 bp, Homo sapiens
atgcccaccccctgc

SEQ ID NO: 4006997 - DNA, 18 bp, Homo sapiens
atgcccaccccctgccct

SEQ ID NO: 4006998 - DNA, 19 bp, Homo sapiens
atgcccacctgcccatcac

SEQ ID NO: 4006999 - DNA, 15 bp, Homo sapiens
atgcccagtgagact

SEQ ID NO: 4007000 - DNA, 13 bp, Homo sapiens
atgccccaaggac

SEQ ID NO: 4007001 - DNA, 14 bp, Homo sapiens
atgccccaaggaca

SEQ ID NO: 4007002 - DNA, 23 bp, Homo sapiens
atgccccattccttgcgcctcag

SEQ ID NO: 4007003 - DNA, 16 bp, Homo sapiens
atgcccctggctggga

SEQ ID NO: 4007004 - DNA, 20 bp, Homo sapiens
atgcccctgtactccagcct

SEQ ID NO: 4007005 - DNA, 13 bp, Homo sapiens
atggaaacaatgt

SEQ ID NO: 4007006 - DNA, 15 bp, Homo sapiens
atggaaactggactc

SEQ ID NO: 4007007 - DNA, 13 bp, Homo sapiens
atggaaccttccc

SEQ ID NO: 4007008 - DNA, 18 bp, Homo sapiens
atggaaccttccctccaa

SEQ ID NO: 4007009 - DNA, 21 bp, Homo sapiens
atggaaccttccctccaaatt

SEQ ID NO: 4007010 - DNA, 17 bp, Homo sapiens
atggaagtaaagcctca

SEQ ID NO: 4007011 - DNA, 21 bp, Homo sapiens
atggaatatttataggccagg

SEQ ID NO: 4007012 - DNA, 18 bp, Homo sapiens
atggaatggacatcctgt

SEQ ID NO: 4007013 - DNA, 21 bp, Homo sapiens
atggaatgtgcccctggccca

SEQ ID NO: 4007014 - DNA, 15 bp, Homo sapiens
atggacaacttattt

SEQ ID NO: 4007015 - DNA, 20 bp, Homo sapiens
atggacaagaggtacagggt

SEQ ID NO: 4007016 - DNA, 18 bp, Homo sapiens
atggacactaatgcagcc

SEQ ID NO: 4007017 - DNA, 11 bp, Homo sapiens
atggacactcc

SEQ ID NO: 4007018 - DNA, 18 bp, Homo sapiens
atggacagcattgccagt

SEQ ID NO: 4007019 - DNA, 22 bp, Homo sapiens
atggacatcctgtataagcact

SEQ ID NO: 4007020 - DNA, 23 bp, Homo sapiens
atggacatcctgtataagcactg

SEQ ID NO: 4007021 - DNA, 13 bp, Homo sapiens
atggacatggtgg

SEQ ID NO: 4007022 - DNA, 18 bp, Homo sapiens
atggaccaacctgctctg

SEQ ID NO: 4007023 - DNA, 12 bp, Homo sapiens
atggacctaaca

SEQ ID NO: 4007024 - DNA, 13 bp, Homo sapiens
atggacctaacat

SEQ ID NO: 4007025 - DNA, 15 bp, Homo sapiens
atggaccttctagaa

SEQ ID NO: 4007026 - DNA, 17 bp, Homo sapiens
atggactgttgccacca

SEQ ID NO: 4007027 - DNA, 23 bp, Homo sapiens
atggagccagctccctctattta

SEQ ID NO: 4007028 - DNA, 15 bp, Homo sapiens
atggagcccccagat

SEQ ID NO: 4007029 - DNA, 23 bp, Homo sapiens
atggagcccccagatagagctgg

SEQ ID NO: 4007030 - DNA, 17 bp, Homo sapiens
atggagccccctctgcc

SEQ ID NO: 4007031 - DNA, 13 bp, Homo sapiens
atggagctgtcat

SEQ ID NO: 4007032 - DNA, 14 bp, Homo sapiens
atggagctgtcatc

SEQ ID NO: 4007033 - DNA, 18 bp, Homo sapiens
atggagggcttggcccag

SEQ ID NO: 4007034 - DNA, 14 bp, Homo sapiens
atggaggggaattc

SEQ ID NO: 4007035 - DNA, 15 bp, Homo sapiens
atggaggttctcaga

SEQ ID NO: 4007036 - DNA, 17 bp, Homo sapiens
atggaggttctcagagc

SEQ ID NO: 4007037 - DNA, 22 bp, Homo sapiens
atggaggttctcagagccaagt

SEQ ID NO: 4007038 - DNA, 21 bp, Homo sapiens
atggagtagaggtactagaat

SEQ ID NO: 4007039 - DNA, 22 bp, Homo sapiens
atggagtgacggtcccacactg

SEQ ID NO: 4007040 - DNA, 18 bp, Homo sapiens
atggagtgagtcacctgc

SEQ ID NO: 4007041 - DNA, 19 bp, Homo sapiens
atggagtgagtcacctgct

SEQ ID NO: 4007042 - DNA, 21 bp, Homo sapiens
atggagtgtgtattgttccca

SEQ ID NO: 4007043 - DNA, 20 bp, Homo sapiens
atggataaaataatgctgca

SEQ ID NO: 4007044 - DNA, 21 bp, Homo sapiens
atggataaaataatgctgcaa

SEQ ID NO: 4007045 - DNA, 19 bp, Homo sapiens
atggatactacatctttaa

SEQ ID NO: 4007046 - DNA, 16 bp, Homo sapiens
atggatcacaagatgg

SEQ ID NO: 4007047 - DNA, 20 bp, Homo sapiens
atggatgaatctcccactcc

SEQ ID NO: 4007048 - DNA, 14 bp, Homo sapiens
atggatggcttcta

SEQ ID NO: 4007049 - DNA, 12 bp, Homo sapiens
atggatgtgctt

SEQ ID NO: 4007050 - DNA, 20 bp, Homo sapiens
atggattaaatttaattctt

SEQ ID NO: 4007051 - DNA, 14 bp, Homo sapiens
atggattctcagat

SEQ ID NO: 4007052 - DNA, 17 bp, Homo sapiens
atggattctcagatatt

SEQ ID NO: 4007053 - DNA, 19 bp, Homo sapiens
atggattctcagatattta

SEQ ID NO: 4007054 - DNA, 22 bp, Homo sapiens
atggattctcagatatttatat

SEQ ID NO: 4007055 - DNA, 22 bp, Homo sapiens
atggattggattatttaataac

SEQ ID NO: 4007056 - DNA, 23 bp, Homo sapiens
atggatttcgtttttcttggggt

SEQ ID NO: 4007057 - DNA, 20 bp, Homo sapiens
atggatttgaagtttgccaa

SEQ ID NO: 4007058 - DNA, 14 bp, Homo sapiens
atggatttgcctgt

SEQ ID NO: 4007059 - DNA, 21 bp, Homo sapiens
atggatttttacaagatccat

SEQ ID NO: 4007060 - DNA, 15 bp, Homo sapiens
atggcaacagatctg

SEQ ID NO: 4007061 - DNA, 16 bp, Homo sapiens
atggcaatgttttgct

SEQ ID NO: 4007062 - DNA, 13 bp, Homo sapiens
atggcagaagaca

SEQ ID NO: 4007063 - DNA, 20 bp, Homo sapiens
atggcagaagacaccagagc

SEQ ID NO: 4007064 - DNA, 19 bp, Homo sapiens
atggcagaggaatatcaat

SEQ ID NO: 4007065 - DNA, 15 bp, Homo sapiens
atggcagctagtgcc

SEQ ID NO: 4007066 - DNA, 22 bp, Homo sapiens
atggcagctgtttctcatgaag

SEQ ID NO: 4007067 - DNA, 18 bp, Homo sapiens
atggcagtgttcctattt

SEQ ID NO: 4007068 - DNA, 13 bp, Homo sapiens
atggcccagcctt

SEQ ID NO: 4007069 - DNA, 16 bp, Homo sapiens
atggcccccaggggca

SEQ ID NO: 4007070 - DNA, 19 bp, Homo sapiens
atggcccccaggggcagga

SEQ ID NO: 4007071 - DNA, 23 bp, Homo sapiens
atggcccccaggggcaggactga

SEQ ID NO: 4007072 - DNA, 21 bp, Homo sapiens
atggccccgcaaggcctccag

SEQ ID NO: 4007073 - DNA, 18 bp, Homo sapiens
atggcccctctgacctgc

SEQ ID NO: 4007074 - DNA, 17 bp, Homo sapiens
atggcctcagctgcctc

SEQ ID NO: 4007075 - DNA, 22 bp, Homo sapiens
atggcctcttactaatgtaaaa

SEQ ID NO: 4007076 - DNA, 19 bp, Homo sapiens
atggcctggagggactttt

SEQ ID NO: 4007077 - DNA, 18 bp, Homo sapiens
atggccttaatttccttt

SEQ ID NO: 4007078 - DNA, 13 bp, Homo sapiens
atggcctttcctt

SEQ ID NO: 4007079 - DNA, 23 bp, Homo sapiens
atggcctttccttccctctctga

SEQ ID NO: 4007080 - DNA, 14 bp, Homo sapiens
atggcctttctaat

SEQ ID NO: 4007081 - DNA, 18 bp, Homo sapiens
atggctaatgtactgcat

SEQ ID NO: 4007082 - DNA, 14 bp, Homo sapiens
atggctataaatat

SEQ ID NO: 4007083 - DNA, 21 bp, Homo sapiens
atggctataaatatataaaaa

SEQ ID NO: 4007084 - DNA, 17 bp, Homo sapiens
atggctatttttgaagc

SEQ ID NO: 4007085 - DNA, 19 bp, Homo sapiens
atggctatttttgaagcaa

SEQ ID NO: 4007086 - DNA, 19 bp, Homo sapiens
atggctcagagcttgaaga

SEQ ID NO: 4007087 - DNA, 23 bp, Homo sapiens
atggctctgcacccctctgccct

SEQ ID NO: 4007088 - DNA, 13 bp, Homo sapiens
atggctgcccagg

SEQ ID NO: 4007089 - DNA, 16 bp, Homo sapiens
atggctgcccaggaga

SEQ ID NO: 4007090 - DNA, 20 bp, Homo sapiens
atggcttattttttaaaata

SEQ ID NO: 4007091 - DNA, 14 bp, Homo sapiens
atggcttctaacaa

SEQ ID NO: 4007092 - DNA, 18 bp, Homo sapiens
atggctttgataattgtt

SEQ ID NO: 4007093 - DNA, 14 bp, Homo sapiens
atgggaaaatattt

SEQ ID NO: 4007094 - DNA, 19 bp, Homo sapiens
atgggaatagggagacagg

SEQ ID NO: 4007095 - DNA, 15 bp, Homo sapiens
atgggaatttgtcag

SEQ ID NO: 4007096 - DNA, 18 bp, Homo sapiens
atgggagacccttgacac

SEQ ID NO: 4007097 - DNA, 11 bp, Homo sapiens
atgggagccag

SEQ ID NO: 4007098 - DNA, 19 bp, Homo sapiens
atgggagccagctgctttt

SEQ ID NO: 4007099 - DNA, 20 bp, Homo sapiens
atgggagccagctgcttttt

SEQ ID NO: 4007100 - DNA, 22 bp, Homo sapiens
atgggagctcctctcctggagg

SEQ ID NO: 4007101 - DNA, 20 bp, Homo sapiens
atgggagggggcttgaagcc

SEQ ID NO: 4007102 - DNA, 19 bp, Homo sapiens
atgggagtgggcacctcag

SEQ ID NO: 4007103 - DNA, 21 bp, Homo sapiens
atgggatatgtggtgtatatc

SEQ ID NO: 4007104 - DNA, 23 bp, Homo sapiens
atgggattcagtgcttcttaaag

SEQ ID NO: 4007105 - DNA, 13 bp, Homo sapiens
atgggcagcccaa

SEQ ID NO: 4007106 - DNA, 20 bp, Homo sapiens
atgggccacggctgagcctt

SEQ ID NO: 4007107 - DNA, 16 bp, Homo sapiens
atgtatatgtgttcat

SEQ ID NO: 4007108 - DNA, 21 bp, Homo sapiens
atgtatatttttttaatttaa

SEQ ID NO: 4007109 - DNA, 21 bp, Homo sapiens
atgtatcaggaaatatatatg

SEQ ID NO: 4007110 - DNA, 20 bp, Homo sapiens
atgtatcagtgtcctttcca

SEQ ID NO: 4007111 - DNA, 21 bp, Homo sapiens
atgtatcagtgtcctttccag

SEQ ID NO: 4007112 - DNA, 15 bp, Homo sapiens
atgtatctgagcagg

SEQ ID NO: 4007113 - DNA, 20 bp, Homo sapiens
atgtatggaatacagtgtta

SEQ ID NO: 4007114 - DNA, 21 bp, Homo sapiens
atgtatgggtagggtaaatca

SEQ ID NO: 4007115 - DNA, 15 bp, Homo sapiens
atgtatgtgcactgt

SEQ ID NO: 4007116 - DNA, 16 bp, Homo sapiens
atgtatgtgcactgtc

SEQ ID NO: 4007117 - DNA, 17 bp, Homo sapiens
atgtatgtgcactgtca

SEQ ID NO: 4007118 - DNA, 15 bp, Homo sapiens
atgtatgtgtaagta

SEQ ID NO: 4007119 - DNA, 17 bp, Homo sapiens
atgtatgtttacatatc

SEQ ID NO: 4007120 - DNA, 20 bp, Homo sapiens
atgtattattctgcagcatg

SEQ ID NO: 4007121 - DNA, 16 bp, Homo sapiens
atgtattatttataat

SEQ ID NO: 4007122 - DNA, 14 bp, Homo sapiens
atgtattcaaatac

SEQ ID NO: 4007123 - DNA, 16 bp, Homo sapiens
atgtattcatccagag

SEQ ID NO: 4007124 - DNA, 18 bp, Homo sapiens
atgtattcatccagagtt

SEQ ID NO: 4007125 - DNA, 17 bp, Homo sapiens
atgtattgcacattgta

SEQ ID NO: 4007126 - DNA, 22 bp, Homo sapiens
atgtattgcacattgtaaaaag

SEQ ID NO: 4007127 - DNA, 12 bp, Homo sapiens
atgtatttaatt

SEQ ID NO: 4007128 - DNA, 17 bp, Homo sapiens
atgtatttataaatata

SEQ ID NO: 4007129 - DNA, 13 bp, Homo sapiens
atgtattttccta

SEQ ID NO: 4007130 - DNA, 16 bp, Homo sapiens
atgtattttgaagaat

SEQ ID NO: 4007131 - DNA, 17 bp, Homo sapiens
atgtattttgaagaata

SEQ ID NO: 4007132 - DNA, 17 bp, Homo sapiens
atgtcaacttctggctc

SEQ ID NO: 4007133 - DNA, 14 bp, Homo sapiens
atgtcacaacctct

SEQ ID NO: 4007134 - DNA, 12 bp, Homo sapiens
atgtcacagggc

SEQ ID NO: 4007135 - DNA, 16 bp, Homo sapiens
atgtcagatttctggt

SEQ ID NO: 4007136 - DNA, 23 bp, Homo sapiens
atgtcagccgagccgggcctggg

SEQ ID NO: 4007137 - DNA, 15 bp, Homo sapiens
atgtcaggaacagaa

SEQ ID NO: 4007138 - DNA, 13 bp, Homo sapiens
atgtcagtatttc

SEQ ID NO: 4007139 - DNA, 16 bp, Homo sapiens
atgtcagtatttcaac

SEQ ID NO: 4007140 - DNA, 16 bp, Homo sapiens
atgtcagtatttcagt

SEQ ID NO: 4007141 - DNA, 17 bp, Homo sapiens
atgtcagtgtttgggaa

SEQ ID NO: 4007142 - DNA, 14 bp, Homo sapiens
atgtcatgtctgct

SEQ ID NO: 4007143 - DNA, 16 bp, Homo sapiens
atgtcatgtctgcttg

SEQ ID NO: 4007144 - DNA, 18 bp, Homo sapiens
atgtccaaagaggctgcc

SEQ ID NO: 4007145 - DNA, 20 bp, Homo sapiens
atgtccaaagaggctgcccc

SEQ ID NO: 4007146 - DNA, 17 bp, Homo sapiens
atgtccaagttcttcac

SEQ ID NO: 4007147 - DNA, 22 bp, Homo sapiens
atgtccaagttcttcacctcta

SEQ ID NO: 4007148 - DNA, 21 bp, Homo sapiens
atgtccctgggccagggtctg

SEQ ID NO: 4007149 - DNA, 16 bp, Homo sapiens
atgtccctttcttggc

SEQ ID NO: 4007150 - DNA, 16 bp, Homo sapiens
atgtcctaaggacaca

SEQ ID NO: 4007151 - DNA, 17 bp, Homo sapiens
atgtcctaaggacacac

SEQ ID NO: 4007152 - DNA, 19 bp, Homo sapiens
atgtcctaaggacacacta

SEQ ID NO: 4007153 - DNA, 21 bp, Homo sapiens
atgtcctaaggacacactaat

SEQ ID NO: 4007154 - DNA, 16 bp, Homo sapiens
atgtcctccagaagcc

SEQ ID NO: 4007155 - DNA, 16 bp, Homo sapiens
atgtcctgctggcttc

SEQ ID NO: 4007156 - DNA, 15 bp, Homo sapiens
atgtcgatgcacagt

SEQ ID NO: 4007157 - DNA, 19 bp, Homo sapiens
atgtctaaatgctgaaaaa

SEQ ID NO: 4007158 - DNA, 20 bp, Homo sapiens
atgtctatcaactttaatca

SEQ ID NO: 4007159 - DNA, 14 bp, Homo sapiens
atgtctattattat

SEQ ID NO: 4007160 - DNA, 16 bp, Homo sapiens
atgtctattattatga

SEQ ID NO: 4007161 - DNA, 20 bp, Homo sapiens
atgtctattattatgaagaa

SEQ ID NO: 4007162 - DNA, 14 bp, Homo sapiens
atgtctcactgttc

SEQ ID NO: 4007163 - DNA, 15 bp, Homo sapiens
atgtctctaaagcac

SEQ ID NO: 4007164 - DNA, 15 bp, Homo sapiens
atgtctgagtgaacc

SEQ ID NO: 4007165 - DNA, 22 bp, Homo sapiens
atgtctgagtgaacctgtataa

SEQ ID NO: 4007166 - DNA, 15 bp, Homo sapiens
atgtctgccatgttg

SEQ ID NO: 4007167 - DNA, 14 bp, Homo sapiens
atgtctgcctggag

SEQ ID NO: 4007168 - DNA, 17 bp, Homo sapiens
atgtctgcctggagtgc

SEQ ID NO: 4007169 - DNA, 22 bp, Homo sapiens
atgtctgcctggagtgctgtgc

SEQ ID NO: 4007170 - DNA, 20 bp, Homo sapiens
atgtctgctgagttggcctg

SEQ ID NO: 4007171 - DNA, 13 bp, Homo sapiens
atgtctgttacca

SEQ ID NO: 4007172 - DNA, 20 bp, Homo sapiens
atgtctgttaccatgtcact

SEQ ID NO: 4007173 - DNA, 23 bp, Homo sapiens
atgtctgttaccatgtcactgtg

SEQ ID NO: 4007174 - DNA, 13 bp, Homo sapiens
atgtcttccctgg

SEQ ID NO: 4007175 - DNA, 14 bp, Homo sapiens
atgtcttccctggg

SEQ ID NO: 4007176 - DNA, 15 bp, Homo sapiens
atgtctttgtaagtc

SEQ ID NO: 4007177 - DNA, 17 bp, Homo sapiens
atgtcttttatatttgt

SEQ ID NO: 4007178 - DNA, 20 bp, Homo sapiens
atgtcttttatatttgtatc

SEQ ID NO: 4007179 - DNA, 21 bp, Homo sapiens
atgtcttttatatttgtatcg

SEQ ID NO: 4007180 - DNA, 22 bp, Homo sapiens
atgtcttttatatttgtatcga

SEQ ID NO: 4007181 - DNA, 16 bp, Homo sapiens
atgtcttttcttggca

SEQ ID NO: 4007182 - DNA, 12 bp, Homo sapiens
atgtgaaaaaaa

SEQ ID NO: 4007183 - DNA, 13 bp, Homo sapiens
atgtgaaaagtat

SEQ ID NO: 4007184 - DNA, 14 bp, Homo sapiens
atgtgaaaagtatc

SEQ ID NO: 4007185 - DNA, 22 bp, Homo sapiens
atgtgaaaccttttttaagatt

SEQ ID NO: 4007186 - DNA, 17 bp, Homo sapiens
atgtgaaatgctttctg

SEQ ID NO: 4007187 - DNA, 13 bp, Homo sapiens
atgtgaacccggg

SEQ ID NO: 4007188 - DNA, 18 bp, Homo sapiens
atgtgaagataatttgca

SEQ ID NO: 4007189 - DNA, 20 bp, Homo sapiens
atgtgaagataatttgcata

SEQ ID NO: 4007190 - DNA, 22 bp, Homo sapiens
atgtgaagccaattcagacagg

SEQ ID NO: 4007191 - DNA, 14 bp, Homo sapiens
atgtgaattattga

SEQ ID NO: 4007192 - DNA, 21 bp, Homo sapiens
atgtgaattattgacactgaa

SEQ ID NO: 4007193 - DNA, 18 bp, Homo sapiens
atgtgaattgcctgcaga

SEQ ID NO: 4007194 - DNA, 10 bp, Homo sapiens
atgtgaattt

SEQ ID NO: 4007195 - DNA, 11 bp, Homo sapiens
atgtgaatttt

SEQ ID NO: 4007196 - DNA, 19 bp, Homo sapiens
atgtgaatttttaagctgc

SEQ ID NO: 4007197 - DNA, 15 bp, Homo sapiens
atgtgacattaacaa

SEQ ID NO: 4007198 - DNA, 13 bp, Homo sapiens
atgtgacatttat

SEQ ID NO: 4007199 - DNA, 19 bp, Homo sapiens
atgtgacatttatatattg

SEQ ID NO: 4007200 - DNA, 14 bp, Homo sapiens
atgtgacatttctc

SEQ ID NO: 4007201 - DNA, 19 bp, Homo sapiens
atgtgaccactctgtcttg

SEQ ID NO: 4007202 - DNA, 20 bp, Homo sapiens
atgtgacccagatcctcaca

SEQ ID NO: 4007203 - DNA, 21 bp, Homo sapiens
atgtgactttttttggtataa

SEQ ID NO: 4007204 - DNA, 21 bp, Homo sapiens
atgtgagccaccgctgccagc

SEQ ID NO: 4007205 - DNA, 22 bp, Homo sapiens
atgtgagccaccgctgccagca

SEQ ID NO: 4007206 - DNA, 17 bp, Homo sapiens
atgtgagccaccgtgcc

SEQ ID NO: 4007207 - DNA, 22 bp, Homo sapiens
atgtgagccaccgtgcctggcc

SEQ ID NO: 4007208 - DNA, 16 bp, Homo sapiens
atgtgagctgctgcca

SEQ ID NO: 4007209 - DNA, 16 bp, Homo sapiens
atgtgaggaggaaaag

SEQ ID NO: 4007210 - DNA, 12 bp, Homo sapiens
atgttggggggg

SEQ ID NO: 4007211 - DNA, 15 bp, Homo sapiens
atgttgtgatgtatt

SEQ ID NO: 4007212 - DNA, 15 bp, Homo sapiens
atgttgttatttaaa

SEQ ID NO: 4007213 - DNA, 17 bp, Homo sapiens
atgttgttatttaaaga

SEQ ID NO: 4007214 - DNA, 20 bp, Homo sapiens
atgttgttcaaatgcatttt

SEQ ID NO: 4007215 - DNA, 15 bp, Homo sapiens
atgtttaaaataaaa

SEQ ID NO: 4007216 - DNA, 17 bp, Homo sapiens
atgtttaaaataaaatg

SEQ ID NO: 4007217 - DNA, 18 bp, Homo sapiens
atgtttaaaataaaatga

SEQ ID NO: 4007218 - DNA, 14 bp, Homo sapiens
atgtttaaagtaat

SEQ ID NO: 4007219 - DNA, 21 bp, Homo sapiens
atgtttaaagtaattgttcca

SEQ ID NO: 4007220 - DNA, 13 bp, Homo sapiens
atgtttaaatcat

SEQ ID NO: 4007221 - DNA, 15 bp, Homo sapiens
atgtttaaatcatgt

SEQ ID NO: 4007222 - DNA, 16 bp, Homo sapiens
atgtttaaatcatgta

SEQ ID NO: 4007223 - DNA, 16 bp, Homo sapiens
atgtttacactctttg

SEQ ID NO: 4007224 - DNA, 22 bp, Homo sapiens
atgtttacactctttgtaagag

SEQ ID NO: 4007225 - DNA, 22 bp, Homo sapiens
atgtttatatactgggttcttg

SEQ ID NO: 4007226 - DNA, 20 bp, Homo sapiens
atgtttatatctgcaaaaaa

SEQ ID NO: 4007227 - DNA, 13 bp, Homo sapiens
atgtttatttata

SEQ ID NO: 4007228 - DNA, 21 bp, Homo sapiens
atgtttatttattctgcattt

SEQ ID NO: 4007229 - DNA, 16 bp, Homo sapiens
atgtttcaactgtgct

SEQ ID NO: 4007230 - DNA, 15 bp, Homo sapiens
atgtttccagacttc

SEQ ID NO: 4007231 - DNA, 13 bp, Homo sapiens
atgtttccagcag

SEQ ID NO: 4007232 - DNA, 20 bp, Homo sapiens
atgtttctgcatagcgaaat

SEQ ID NO: 4007233 - DNA, 21 bp, Homo sapiens
atgtttctgggtcctgaagaa

SEQ ID NO: 4007234 - DNA, 12 bp, Homo sapiens
atgtttgaaatg

SEQ ID NO: 4007235 - DNA, 21 bp, Homo sapiens
atgtttgaatatggacaagag

SEQ ID NO: 4007236 - DNA, 16 bp, Homo sapiens
atgtttgcacttgtga

SEQ ID NO: 4007237 - DNA, 18 bp, Homo sapiens
atgtttgcctcataatag

SEQ ID NO: 4007238 - DNA, 16 bp, Homo sapiens
atgtttgctattgaca

SEQ ID NO: 4007239 - DNA, 15 bp, Homo sapiens
atgtttgtggcctca

SEQ ID NO: 4007240 - DNA, 17 bp, Homo sapiens
atgtttgttaaaaataa

SEQ ID NO: 4007241 - DNA, 16 bp, Homo sapiens
atgttttactgtgaaa

SEQ ID NO: 4007242 - DNA, 15 bp, Homo sapiens
atgttttatttatca

SEQ ID NO: 4007243 - DNA, 18 bp, Homo sapiens
atgttttctgaaaatata

SEQ ID NO: 4007244 - DNA, 19 bp, Homo sapiens
atgttttgtatatacagtt

SEQ ID NO: 4007245 - DNA, 23 bp, Homo sapiens
atgttttgtatatacagttattt

SEQ ID NO: 4007246 - DNA, 21 bp, Homo sapiens
atgttttgtcccatttccttg

SEQ ID NO: 4007247 - DNA, 23 bp, Homo sapiens
atgttttgtcccatttccttgga

SEQ ID NO: 4007248 - DNA, 16 bp, Homo sapiens
atgttttgtgcatttg

SEQ ID NO: 4007249 - DNA, 19 bp, Homo sapiens
atgttttgtttctgaaaat

SEQ ID NO: 4007250 - DNA, 17 bp, Homo sapiens
atgtttttccctcccca

SEQ ID NO: 4007251 - DNA, 18 bp, Homo sapiens
atgttttttgccacagct

SEQ ID NO: 4007252 - DNA, 14 bp, Homo sapiens
attaaaaaaaaaga

SEQ ID NO: 4007253 - DNA, 15 bp, Homo sapiens
attaaaaagttaatc

SEQ ID NO: 4007254 - DNA, 16 bp, Homo sapiens
attaaaacacagcttt

SEQ ID NO: 4007255 - DNA, 23 bp, Homo sapiens
attaaaacacattatgtatctta

SEQ ID NO: 4007256 - DNA, 20 bp, Homo sapiens
attaaaactaggtaatgttt

SEQ ID NO: 4007257 - DNA, 19 bp, Homo sapiens
attaaaactatttagtgtt

SEQ ID NO: 4007258 - DNA, 14 bp, Homo sapiens
attaaaacttctta

SEQ ID NO: 4007259 - DNA, 16 bp, Homo sapiens
attaaaaggaaagtca

SEQ ID NO: 4007260 - DNA, 16 bp, Homo sapiens
attaaaatttatctta

SEQ ID NO: 4007261 - DNA, 15 bp, Homo sapiens
attaaacacctgaca

SEQ ID NO: 4007262 - DNA, 12 bp, Homo sapiens
attaaacagatg

SEQ ID NO: 4007263 - DNA, 23 bp, Homo sapiens
attaaactcttcacaaaatctgt

SEQ ID NO: 4007264 - DNA, 17 bp, Homo sapiens
attaaacttgaagcagt

SEQ ID NO: 4007265 - DNA, 16 bp, Homo sapiens
attaaagcctttagta

SEQ ID NO: 4007266 - DNA, 17 bp, Homo sapiens
attaaagtctattcaaa

SEQ ID NO: 4007267 - DNA, 15 bp, Homo sapiens
attaaagtgactttc

SEQ ID NO: 4007268 - DNA, 14 bp, Homo sapiens
attaaataaaatca

SEQ ID NO: 4007269 - DNA, 20 bp, Homo sapiens
attaaatacagacactaagt

SEQ ID NO: 4007270 - DNA, 14 bp, Homo sapiens
attaaattcacaaa

SEQ ID NO: 4007271 - DNA, 15 bp, Homo sapiens
attaaatttaattag

SEQ ID NO: 4007272 - DNA, 18 bp, Homo sapiens
attaaatttaattcttca

SEQ ID NO: 4007273 - DNA, 20 bp, Homo sapiens
attaaattttgagttctaca

SEQ ID NO: 4007274 - DNA, 20 bp, Homo sapiens
attaacaaattatgttacat

SEQ ID NO: 4007275 - DNA, 15 bp, Homo sapiens
attaacacaaaggaa

SEQ ID NO: 4007276 - DNA, 21 bp, Homo sapiens
attaacagttttccatgaaaa

SEQ ID NO: 4007277 - DNA, 17 bp, Homo sapiens
attaaccatttaataaa

SEQ ID NO: 4007278 - DNA, 13 bp, Homo sapiens
attaacctctgca

SEQ ID NO: 4007279 - DNA, 14 bp, Homo sapiens
attaactacattta

SEQ ID NO: 4007280 - DNA, 21 bp, Homo sapiens
attaactacatttatgagtaa

SEQ ID NO: 4007281 - DNA, 14 bp, Homo sapiens
attaactgaaacat

SEQ ID NO: 4007282 - DNA, 17 bp, Homo sapiens
attaacttatttagaga

SEQ ID NO: 4007283 - DNA, 21 bp, Homo sapiens
attaagaatatgtttccttgt

SEQ ID NO: 4007284 - DNA, 15 bp, Homo sapiens
attaagatacaaatt

SEQ ID NO: 4007285 - DNA, 20 bp, Homo sapiens
attaagatggattctcagat

SEQ ID NO: 4007286 - DNA, 15 bp, Homo sapiens
attaagattttacaa

SEQ ID NO: 4007287 - DNA, 17 bp, Homo sapiens
attaagggcattttacc

SEQ ID NO: 4007288 - DNA, 18 bp, Homo sapiens
attaagtagaacaaaaaa

SEQ ID NO: 4007289 - DNA, 16 bp, Homo sapiens
attaagtcatgtgtga

SEQ ID NO: 4007290 - DNA, 13 bp, Homo sapiens
attaagttatctt

SEQ ID NO: 4007291 - DNA, 19 bp, Homo sapiens
attaataaaaaatggaaag

SEQ ID NO: 4007292 - DNA, 12 bp, Homo sapiens
attaataatctt

SEQ ID NO: 4007293 - DNA, 13 bp, Homo sapiens
attaataatctta

SEQ ID NO: 4007294 - DNA, 16 bp, Homo sapiens
attaataatcttatta

SEQ ID NO: 4007295 - DNA, 20 bp, Homo sapiens
attaatatatgtattattta

SEQ ID NO: 4007296 - DNA, 15 bp, Homo sapiens
attaatatgaaaact

SEQ ID NO: 4007297 - DNA, 23 bp, Homo sapiens
attaatatttgtgaaagaagaca

SEQ ID NO: 4007298 - DNA, 11 bp, Homo sapiens
attaatcaaaa

SEQ ID NO: 4007299 - DNA, 23 bp, Homo sapiens
attaatctttctttacctgagac

SEQ ID NO: 4007300 - DNA, 15 bp, Homo sapiens
attaatgacttactt

SEQ ID NO: 4007301 - DNA, 18 bp, Homo sapiens
attaatgcgatttcttcc

SEQ ID NO: 4007302 - DNA, 15 bp, Homo sapiens
attaatgtgtattaa

SEQ ID NO: 4007303 - DNA, 12 bp, Homo sapiens
attaatgttaat

SEQ ID NO: 4007304 - DNA, 12 bp, Homo sapiens
attaattcttca

SEQ ID NO: 4007305 - DNA, 20 bp, Homo sapiens
attaattgttttgcactttt

SEQ ID NO: 4007306 - DNA, 13 bp, Homo sapiens
attaatttgaaac

SEQ ID NO: 4007307 - DNA, 10 bp, Homo sapiens
attacaaata

SEQ ID NO: 4007308 - DNA, 17 bp, Homo sapiens
attacaactctatttaa

SEQ ID NO: 4007309 - DNA, 12 bp, Homo sapiens
attacagagagg

SEQ ID NO: 4007310 - DNA, 22 bp, Homo sapiens
attacagagaggagaaacacat

SEQ ID NO: 4007311 - DNA, 21 bp, Homo sapiens
attacagatgggcaaattaag

SEQ ID NO: 4007312 - DNA, 22 bp, Homo sapiens
attacaggcacctgccaccatg

SEQ ID NO: 4007313 - DNA, 17 bp, Homo sapiens
attattttaaaatattt

SEQ ID NO: 4007314 - DNA, 14 bp, Homo sapiens
attattttcttcat

SEQ ID NO: 4007315 - DNA, 12 bp, Homo sapiens
attattttgggg

SEQ ID NO: 4007316 - DNA, 14 bp, Homo sapiens
attattttggggtc

SEQ ID NO: 4007317 - DNA, 16 bp, Homo sapiens
attattttggggtctc

SEQ ID NO: 4007318 - DNA, 19 bp, Homo sapiens
attattttggtacttttat

SEQ ID NO: 4007319 - DNA, 19 bp, Homo sapiens
attatttttccactttgtt

SEQ ID NO: 4007320 - DNA, 20 bp, Homo sapiens
attatttttgtgtttctaaa

SEQ ID NO: 4007321 - DNA, 14 bp, Homo sapiens
attcaaaagattaa

SEQ ID NO: 4007322 - DNA, 22 bp, Homo sapiens
attcaaccactgtaaaatgaaa

SEQ ID NO: 4007323 - DNA, 15 bp, Homo sapiens
attcaagaaaataaa

SEQ ID NO: 4007324 - DNA, 19 bp, Homo sapiens
attcaatattgacatttgt

SEQ ID NO: 4007325 - DNA, 23 bp, Homo sapiens
attcaatgtttatgcaaggaagg

SEQ ID NO: 4007326 - DNA, 14 bp, Homo sapiens
attcacaatagaaa

SEQ ID NO: 4007327 - DNA, 20 bp, Homo sapiens
attcacacatgcctatatta

SEQ ID NO: 4007328 - DNA, 19 bp, Homo sapiens
attcacactttttatttaa

SEQ ID NO: 4007329 - DNA, 22 bp, Homo sapiens
attcaccccctttcctggacac

SEQ ID NO: 4007330 - DNA, 19 bp, Homo sapiens
attcacctgccccaactct

SEQ ID NO: 4007331 - DNA, 17 bp, Homo sapiens
attcactcaagcactga

SEQ ID NO: 4007332 - DNA, 21 bp, Homo sapiens
attcactgtataaactttttt

SEQ ID NO: 4007333 - DNA, 19 bp, Homo sapiens
attcagaaaatgttctgtt

SEQ ID NO: 4007334 - DNA, 13 bp, Homo sapiens
attcagacaagca

SEQ ID NO: 4007335 - DNA, 13 bp, Homo sapiens
attcagagtcctt

SEQ ID NO: 4007336 - DNA, 18 bp, Homo sapiens
attcagatatatttttca

SEQ ID NO: 4007337 - DNA, 19 bp, Homo sapiens
attcagatcactgaattta

SEQ ID NO: 4007338 - DNA, 22 bp, Homo sapiens
attcagattgtcttgcaacttc

SEQ ID NO: 4007339 - DNA, 21 bp, Homo sapiens
attcagcactgatttcacaac

SEQ ID NO: 4007340 - DNA, 23 bp, Homo sapiens
attcagcagactttctctgtgta

SEQ ID NO: 4007341 - DNA, 14 bp, Homo sapiens
attcagcctgtttg

SEQ ID NO: 4007342 - DNA, 21 bp, Homo sapiens
attcaggaatgtgtggcctgc

SEQ ID NO: 4007343 - DNA, 21 bp, Homo sapiens
attcaggacttaacggctcca

SEQ ID NO: 4007344 - DNA, 22 bp, Homo sapiens
attcaggacttaacggctccag

SEQ ID NO: 4007345 - DNA, 16 bp, Homo sapiens
attcaggccagcccag

SEQ ID NO: 4007346 - DNA, 17 bp, Homo sapiens
attcaggccagcccagc

SEQ ID NO: 4007347 - DNA, 11 bp, Homo sapiens
attcaggctgc

SEQ ID NO: 4007348 - DNA, 13 bp, Homo sapiens
attcaggctgctt

SEQ ID NO: 4007349 - DNA, 17 bp, Homo sapiens
attcaggggctgggggt

SEQ ID NO: 4007350 - DNA, 12 bp, Homo sapiens
attcagtaaaca

SEQ ID NO: 4007351 - DNA, 19 bp, Homo sapiens
attcagtaataactctacc

SEQ ID NO: 4007352 - DNA, 15 bp, Homo sapiens
attcagtgagggtct

SEQ ID NO: 4007353 - DNA, 19 bp, Homo sapiens
attcagtgattactgtcaa

SEQ ID NO: 4007354 - DNA, 14 bp, Homo sapiens
attcagtgcttctt

SEQ ID NO: 4007355 - DNA, 19 bp, Homo sapiens
attcagtggcgagaaataa

SEQ ID NO: 4007356 - DNA, 23 bp, Homo sapiens
attcagttcccaccatctgatta

SEQ ID NO: 4007357 - DNA, 14 bp, Homo sapiens
attcagtttcataa

SEQ ID NO: 4007358 - DNA, 15 bp, Homo sapiens
attcataaaaactgc

SEQ ID NO: 4007359 - DNA, 19 bp, Homo sapiens
attcataattaaaatttat

SEQ ID NO: 4007360 - DNA, 22 bp, Homo sapiens
attcataattaaaatttatctt

SEQ ID NO: 4007361 - DNA, 24 bp, Homo sapiens
attcataattaaaatttatcttaa

SEQ ID NO: 4007362 - DNA, 17 bp, Homo sapiens
attcatagtaacttctt

SEQ ID NO: 4007363 - DNA, 18 bp, Homo sapiens
attcatagtaacttctta

SEQ ID NO: 4007364 - DNA, 18 bp, Homo sapiens
attcatatttacttctta

SEQ ID NO: 4007365 - DNA, 19 bp, Homo sapiens
attcatatttacttcttat

SEQ ID NO: 4007366 - DNA, 23 bp, Homo sapiens
attcatcaatatccctcttgtaa

SEQ ID NO: 4007367 - DNA, 14 bp, Homo sapiens
attcatccagagtt

SEQ ID NO: 4007368 - DNA, 22 bp, Homo sapiens
attcatgcctttcatagtttat

SEQ ID NO: 4007369 - DNA, 15 bp, Homo sapiens
attcatgtattttgt

SEQ ID NO: 4007370 - DNA, 18 bp, Homo sapiens
attcattctgcattgcta

SEQ ID NO: 4007371 - DNA, 13 bp, Homo sapiens
attcattgtctct

SEQ ID NO: 4007372 - DNA, 16 bp, Homo sapiens
attcatttaaaatgat

SEQ ID NO: 4007373 - DNA, 12 bp, Homo sapiens
attcattttcct

SEQ ID NO: 4007374 - DNA, 13 bp, Homo sapiens
attcattttcctg

SEQ ID NO: 4007375 - DNA, 15 bp, Homo sapiens
attcattttcctgtt

SEQ ID NO: 4007376 - DNA, 20 bp, Homo sapiens
attccaaagagtagaattgc

SEQ ID NO: 4007377 - DNA, 20 bp, Homo sapiens
attccaaatgtcttttagaa

SEQ ID NO: 4007378 - DNA, 16 bp, Homo sapiens
attccactacacctgg

SEQ ID NO: 4007379 - DNA, 18 bp, Homo sapiens
attccactacacctggct

SEQ ID NO: 4007380 - DNA, 18 bp, Homo sapiens
attccactgcgttgtcca

SEQ ID NO: 4007381 - DNA, 12 bp, Homo sapiens
attccagaatat

SEQ ID NO: 4007382 - DNA, 16 bp, Homo sapiens
attccagaatatctgg

SEQ ID NO: 4007383 - DNA, 15 bp, Homo sapiens
attccagaatgctgt

SEQ ID NO: 4007384 - DNA, 19 bp, Homo sapiens
attccagaatgctgtacat

SEQ ID NO: 4007385 - DNA, 20 bp, Homo sapiens
attccagaatgctgtacatc

SEQ ID NO: 4007386 - DNA, 17 bp, Homo sapiens
attccagagctgccagt

SEQ ID NO: 4007387 - DNA, 17 bp, Homo sapiens
attccagcaataagaaa

SEQ ID NO: 4007388 - DNA, 21 bp, Homo sapiens
attccagcaataagaaatgaa

SEQ ID NO: 4007389 - DNA, 20 bp, Homo sapiens
attccagtgctagaaaattt

SEQ ID NO: 4007390 - DNA, 15 bp, Homo sapiens
attccatcaataaat

SEQ ID NO: 4007391 - DNA, 17 bp, Homo sapiens
attccatcaataaatgc

SEQ ID NO: 4007392 - DNA, 15 bp, Homo sapiens
attccatccataaat

SEQ ID NO: 4007393 - DNA, 20 bp, Homo sapiens
attccattatcttatgaata

SEQ ID NO: 4007394 - DNA, 20 bp, Homo sapiens
attccattgcctagctcttt

SEQ ID NO: 4007395 - DNA, 14 bp, Homo sapiens
attcccaccaaggt

SEQ ID NO: 4007396 - DNA, 15 bp, Homo sapiens
attcccatctttact

SEQ ID NO: 4007397 - DNA, 21 bp, Homo sapiens
attcccccaccagctgcagcc

SEQ ID NO: 4007398 - DNA, 21 bp, Homo sapiens
attccctatcttttagtttta

SEQ ID NO: 4007399 - DNA, 22 bp, Homo sapiens
attccctatcttttagttttag

SEQ ID NO: 4007400 - DNA, 18 bp, Homo sapiens
attccctctcctgcccag

SEQ ID NO: 4007401 - DNA, 18 bp, Homo sapiens
attccgttgtctgtggat

SEQ ID NO: 4007402 - DNA, 19 bp, Homo sapiens
attcctaaggtaatcctat

SEQ ID NO: 4007403 - DNA, 16 bp, Homo sapiens
attcctacagcactac

SEQ ID NO: 4007404 - DNA, 20 bp, Homo sapiens
attcctagtggatgactgtt

SEQ ID NO: 4007405 - DNA, 11 bp, Homo sapiens
attcctccctc

SEQ ID NO: 4007406 - DNA, 12 bp, Homo sapiens
attcctctggga

SEQ ID NO: 4007407 - DNA, 14 bp, Homo sapiens
attcctctgtccta

SEQ ID NO: 4007408 - DNA, 16 bp, Homo sapiens
attcctgaagaaccag

SEQ ID NO: 4007409 - DNA, 22 bp, Homo sapiens
attccttctctgaacacaggca

SEQ ID NO: 4007410 - DNA, 14 bp, Homo sapiens
attccttctttgat

SEQ ID NO: 4007411 - DNA, 21 bp, Homo sapiens
attccttgcgcctcagccctc

SEQ ID NO: 4007412 - DNA, 12 bp, Homo sapiens
attccttgtgaa

SEQ ID NO: 4007413 - DNA, 21 bp, Homo sapiens
attcgctgtaccctttaagat

SEQ ID NO: 4007414 - DNA, 14 bp, Homo sapiens
attcgtgagctggg

SEQ ID NO: 4007415 - DNA, 13 bp, Homo sapiens
attgaatcagtat

SEQ ID NO: 4007416 - DNA, 15 bp, Homo sapiens
attgaatgcgcttta

SEQ ID NO: 4007417 - DNA, 15 bp, Homo sapiens
attgacaagaactga

SEQ ID NO: 4007418 - DNA, 20 bp, Homo sapiens
attgacacacagcactctct

SEQ ID NO: 4007419 - DNA, 22 bp, Homo sapiens
attgacacacagcactctctaa

SEQ ID NO: 4007420 - DNA, 22 bp, Homo sapiens
attgacaccagaaagccctctt

SEQ ID NO: 4007421 - DNA, 18 bp, Homo sapiens
attgacactgaacttaat

SEQ ID NO: 4007422 - DNA, 18 bp, Homo sapiens
attgacactgtccctctt

SEQ ID NO: 4007423 - DNA, 22 bp, Homo sapiens
attgacactgtccctctttggc

SEQ ID NO: 4007424 - DNA, 18 bp, Homo sapiens
attgacaggattattgga

SEQ ID NO: 4007425 - DNA, 17 bp, Homo sapiens
attgacatttgtagttg

SEQ ID NO: 4007426 - DNA, 15 bp, Homo sapiens
attgaccaagaactg

SEQ ID NO: 4007427 - DNA, 18 bp, Homo sapiens
attgaccaagaactgcat

SEQ ID NO: 4007428 - DNA, 14 bp, Homo sapiens
attgaccatctgct

SEQ ID NO: 4007429 - DNA, 21 bp, Homo sapiens
attgaccgacagctttccagt

SEQ ID NO: 4007430 - DNA, 16 bp, Homo sapiens
attgacctctcagggc

SEQ ID NO: 4007431 - DNA, 19 bp, Homo sapiens
attgacctctcagggcctg

SEQ ID NO: 4007432 - DNA, 17 bp, Homo sapiens
attgacctgctccgctg

SEQ ID NO: 4007433 - DNA, 21 bp, Homo sapiens
attgacctgctccgctgctcc

SEQ ID NO: 4007434 - DNA, 22 bp, Homo sapiens
attgactattttcgttcattac

SEQ ID NO: 4007435 - DNA, 12 bp, Homo sapiens
attgactcttgc

SEQ ID NO: 4007436 - DNA, 14 bp, Homo sapiens
attgactgatgatt

SEQ ID NO: 4007437 - DNA, 14 bp, Homo sapiens
attgacttgtatat

SEQ ID NO: 4007438 - DNA, 15 bp, Homo sapiens
attgactttcagtaa

SEQ ID NO: 4007439 - DNA, 21 bp, Homo sapiens
attgagaattttaaattataa

SEQ ID NO: 4007440 - DNA, 12 bp, Homo sapiens
attgagatttct

SEQ ID NO: 4007441 - DNA, 15 bp, Homo sapiens
attgagctgatataa

SEQ ID NO: 4007442 - DNA, 19 bp, Homo sapiens
attgagctgatataaattc

SEQ ID NO: 4007443 - DNA, 16 bp, Homo sapiens
attgaggagctgcact

SEQ ID NO: 4007444 - DNA, 18 bp, Homo sapiens
attgaggagctgcactga

SEQ ID NO: 4007445 - DNA, 12 bp, Homo sapiens
attgaggcctgc

SEQ ID NO: 4007446 - DNA, 19 bp, Homo sapiens
attgaggctttgtgttgta

SEQ ID NO: 4007447 - DNA, 22 bp, Homo sapiens
attgaggggattaatatgaaaa

SEQ ID NO: 4007448 - DNA, 15 bp, Homo sapiens
attgaggggccctgg

SEQ ID NO: 4007449 - DNA, 19 bp, Homo sapiens
attgagtaatggtgtagaa

SEQ ID NO: 4007450 - DNA, 15 bp, Homo sapiens
attgagtcaaatggt

SEQ ID NO: 4007451 - DNA, 18 bp, Homo sapiens
attgataatgctttcaca

SEQ ID NO: 4007452 - DNA, 18 bp, Homo sapiens
attgatagagtgttatca

SEQ ID NO: 4007453 - DNA, 15 bp, Homo sapiens
attgatcaaattcat

SEQ ID NO: 4007454 - DNA, 17 bp, Homo sapiens
attgatcaaattcattt

SEQ ID NO: 4007455 - DNA, 12 bp, Homo sapiens
attgatgtgttt

SEQ ID NO: 4007456 - DNA, 19 bp, Homo sapiens
attgatgtgtttatttata

SEQ ID NO: 4007457 - DNA, 14 bp, Homo sapiens
attgatgtttcctt

SEQ ID NO: 4007458 - DNA, 20 bp, Homo sapiens
attgatttgcattgaacaca

SEQ ID NO: 4007459 - DNA, 19 bp, Homo sapiens
attgcaaatcttgaaatta

SEQ ID NO: 4007460 - DNA, 19 bp, Homo sapiens
attgcacgtggcctcttga

SEQ ID NO: 4007461 - DNA, 20 bp, Homo sapiens
attgcagctttatgttcatt

SEQ ID NO: 4007462 - DNA, 13 bp, Homo sapiens
attgcataaagca

SEQ ID NO: 4007463 - DNA, 19 bp, Homo sapiens
attgcatgccgggtgcagc

SEQ ID NO: 4007464 - DNA, 23 bp, Homo sapiens
attgcatgccgggtgcagcatct

SEQ ID NO: 4007465 - DNA, 17 bp, Homo sapiens
attgcattctattgcct

SEQ ID NO: 4007466 - DNA, 18 bp, Homo sapiens
attgcattctattgcctt

SEQ ID NO: 4007467 - DNA, 11 bp, Homo sapiens
attgcattgac

SEQ ID NO: 4007468 - DNA, 15 bp, Homo sapiens
attgccaccaggaga

SEQ ID NO: 4007469 - DNA, 21 bp, Homo sapiens
attgccaccaggagaaccact

SEQ ID NO: 4007470 - DNA, 16 bp, Homo sapiens
attgccccaagatagg

SEQ ID NO: 4007471 - DNA, 14 bp, Homo sapiens
attgcccctggctt

SEQ ID NO: 4007472 - DNA, 19 bp, Homo sapiens
attgcccctggctttgcct

SEQ ID NO: 4007473 - DNA, 15 bp, Homo sapiens
attgcctgcagagag

SEQ ID NO: 4007474 - DNA, 17 bp, Homo sapiens
attgcctgcagagagaa

SEQ ID NO: 4007475 - DNA, 22 bp, Homo sapiens
attgcctgtgtatggaaaaacc

SEQ ID NO: 4007476 - DNA, 17 bp, Homo sapiens
attgccttctttgaaga

SEQ ID NO: 4007477 - DNA, 18 bp, Homo sapiens
attgccttctttgaagaa

SEQ ID NO: 4007478 - DNA, 20 bp, Homo sapiens
attgccttctttgaagaagg

SEQ ID NO: 4007479 - DNA, 21 bp, Homo sapiens
attgccttctttgaagaaggt

SEQ ID NO: 4007480 - DNA, 13 bp, Homo sapiens
attgcgctgctac

SEQ ID NO: 4007481 - DNA, 18 bp, Homo sapiens
attgcggccccaggaggg

SEQ ID NO: 4007482 - DNA, 16 bp, Homo sapiens
attgctaatttagaga

SEQ ID NO: 4007483 - DNA, 16 bp, Homo sapiens
attgctagataaaagc

SEQ ID NO: 4007484 - DNA, 13 bp, Homo sapiens
attgctagtattt

SEQ ID NO: 4007485 - DNA, 17 bp, Homo sapiens
attgctagtatttgaat

SEQ ID NO: 4007486 - DNA, 18 bp, Homo sapiens
attgctagtatttgaatt

SEQ ID NO: 4007487 - DNA, 23 bp, Homo sapiens
attgctcaagttcattgatgacc

SEQ ID NO: 4007488 - DNA, 19 bp, Homo sapiens
attgctccctaagactgtg

SEQ ID NO: 4007489 - DNA, 16 bp, Homo sapiens
attgctgaaaatggta

SEQ ID NO: 4007490 - DNA, 18 bp, Homo sapiens
attgctgaaaatggtatt

SEQ ID NO: 4007491 - DNA, 23 bp, Homo sapiens
attgctgagagaaatatggaact

SEQ ID NO: 4007492 - DNA, 21 bp, Homo sapiens
attgctgctgtgcgtggaaaa

SEQ ID NO: 4007493 - DNA, 20 bp, Homo sapiens
attgctgttatgtctgttta

SEQ ID NO: 4007494 - DNA, 23 bp, Homo sapiens
attgctgttatgtctgtttaaga

SEQ ID NO: 4007495 - DNA, 13 bp, Homo sapiens
attgcttacattt

SEQ ID NO: 4007496 - DNA, 16 bp, Homo sapiens
attgcttacattttta

SEQ ID NO: 4007497 - DNA, 22 bp, Homo sapiens
attgcttacatttttacaataa

SEQ ID NO: 4007498 - DNA, 10 bp, Homo sapiens
attgcttctt

SEQ ID NO: 4007499 - DNA, 17 bp, Homo sapiens
attgcttgagcccagga

SEQ ID NO: 4007500 - DNA, 18 bp, Homo sapiens
attgcttgagcccaggag

SEQ ID NO: 4007501 - DNA, 14 bp, Homo sapiens
attgctttccactg

SEQ ID NO: 4007502 - DNA, 11 bp, Homo sapiens
attgctttctg

SEQ ID NO: 4007503 - DNA, 18 bp, Homo sapiens
attgcttttattttgaaa

SEQ ID NO: 4007504 - DNA, 15 bp, Homo sapiens
attgctttttctaat

SEQ ID NO: 4007505 - DNA, 22 bp, Homo sapiens
attggaaatgtcatctaaccat

SEQ ID NO: 4007506 - DNA, 16 bp, Homo sapiens
attggaacagaatgtt

SEQ ID NO: 4007507 - DNA, 14 bp, Homo sapiens
attggaatctgata

SEQ ID NO: 4007508 - DNA, 12 bp, Homo sapiens
attggaattaac

SEQ ID NO: 4007509 - DNA, 16 bp, Homo sapiens
attggaattaacctgg

SEQ ID NO: 4007510 - DNA, 21 bp, Homo sapiens
attggacagttgtctagagat

SEQ ID NO: 4007511 - DNA, 18 bp, Homo sapiens
attggagagtaaaaactg

SEQ ID NO: 4007512 - DNA, 23 bp, Homo sapiens
attggaggtgagatcacagcctc

SEQ ID NO: 4007513 - DNA, 18 bp, Homo sapiens
attggattattcatttaa

SEQ ID NO: 4007514 - DNA, 22 bp, Homo sapiens
attggattattcatttaaaatg

SEQ ID NO: 4007515 - DNA, 20 bp, Homo sapiens
attggattatttaataacat

SEQ ID NO: 4007516 - DNA, 13 bp, Homo sapiens
attggcaaaacta

SEQ ID NO: 4007517 - DNA, 15 bp, Homo sapiens
attggcaccatgtgc

SEQ ID NO: 4007518 - DNA, 22 bp, Homo sapiens
atttaaatataattctgtaaat

SEQ ID NO: 4007519 - DNA, 15 bp, Homo sapiens
atttaaatttaaaga

SEQ ID NO: 4007520 - DNA, 17 bp, Homo sapiens
atttaacaaactaaaaa

SEQ ID NO: 4007521 - DNA, 19 bp, Homo sapiens
atttaacaaactaaaaata

SEQ ID NO: 4007522 - DNA, 22 bp, Homo sapiens
atttaacagctgaattatctat

SEQ ID NO: 4007523 - DNA, 16 bp, Homo sapiens
atttaacattatttat

SEQ ID NO: 4007524 - DNA, 15 bp, Homo sapiens
atttaagaaaagcac

SEQ ID NO: 4007525 - DNA, 17 bp, Homo sapiens
atttaagaaaatacaat

SEQ ID NO: 4007526 - DNA, 20 bp, Homo sapiens
atttaagaaaatacaataaa

SEQ ID NO: 4007527 - DNA, 15 bp, Homo sapiens
atttaagacactgaa

SEQ ID NO: 4007528 - DNA, 22 bp, Homo sapiens
atttaagccttataaaccaatc

SEQ ID NO: 4007529 - DNA, 18 bp, Homo sapiens
atttaagcttatgtcaga

SEQ ID NO: 4007530 - DNA, 19 bp, Homo sapiens
atttaagtgcgtgtgtaga

SEQ ID NO: 4007531 - DNA, 22 bp, Homo sapiens
atttaagtgcgtgtgtagagtt

SEQ ID NO: 4007532 - DNA, 20 bp, Homo sapiens
atttaagtggggcaaaacct

SEQ ID NO: 4007533 - DNA, 19 bp, Homo sapiens
atttaagttcatattccat

SEQ ID NO: 4007534 - DNA, 19 bp, Homo sapiens
atttaataaaataattcta

SEQ ID NO: 4007535 - DNA, 12 bp, Homo sapiens
atttaataacat

SEQ ID NO: 4007536 - DNA, 13 bp, Homo sapiens
atttaatacagca

SEQ ID NO: 4007537 - DNA, 13 bp, Homo sapiens
atttaatatttat

SEQ ID NO: 4007538 - DNA, 18 bp, Homo sapiens
atttaatcttttttatgt

SEQ ID NO: 4007539 - DNA, 16 bp, Homo sapiens
atttaatgaaagactg

SEQ ID NO: 4007540 - DNA, 20 bp, Homo sapiens
atttaatgaaagactgtaca

SEQ ID NO: 4007541 - DNA, 22 bp, Homo sapiens
atttaatgataagtaaatgcta

SEQ ID NO: 4007542 - DNA, 23 bp, Homo sapiens
atttaatggaagtgtatttattt

SEQ ID NO: 4007543 - DNA, 21 bp, Homo sapiens
atttaatggcagctagtgcct

SEQ ID NO: 4007544 - DNA, 20 bp, Homo sapiens
atttaatggtttttatttct

SEQ ID NO: 4007545 - DNA, 15 bp, Homo sapiens
atttaattaaatgta

SEQ ID NO: 4007546 - DNA, 15 bp, Homo sapiens
atttaattattaact

SEQ ID NO: 4007547 - DNA, 23 bp, Homo sapiens
atttaattcctctttttagggct

SEQ ID NO: 4007548 - DNA, 13 bp, Homo sapiens
atttaatttccag

SEQ ID NO: 4007549 - DNA, 14 bp, Homo sapiens
atttaatttgttat

SEQ ID NO: 4007550 - DNA, 17 bp, Homo sapiens
atttaatttgttataag

SEQ ID NO: 4007551 - DNA, 15 bp, Homo sapiens
atttaccacagcagc

SEQ ID NO: 4007552 - DNA, 18 bp, Homo sapiens
atttaccatcatctctga

SEQ ID NO: 4007553 - DNA, 18 bp, Homo sapiens
atttaccgttgcttgaaa

SEQ ID NO: 4007554 - DNA, 21 bp, Homo sapiens
atttaccgttgcttgaaatta

SEQ ID NO: 4007555 - DNA, 15 bp, Homo sapiens
atttacctctaaatt

SEQ ID NO: 4007556 - DNA, 17 bp, Homo sapiens
atttacctctaaatttc

SEQ ID NO: 4007557 - DNA, 15 bp, Homo sapiens
atttacgctttgatt

SEQ ID NO: 4007558 - DNA, 16 bp, Homo sapiens
atttactaaacatatg

SEQ ID NO: 4007559 - DNA, 19 bp, Homo sapiens
atttactaaacatatgatt

SEQ ID NO: 4007560 - DNA, 13 bp, Homo sapiens
atttactgagctt

SEQ ID NO: 4007561 - DNA, 18 bp, Homo sapiens
atttacttctaatcttaa

SEQ ID NO: 4007562 - DNA, 14 bp, Homo sapiens
atttacttcttata

SEQ ID NO: 4007563 - DNA, 15 bp, Homo sapiens
atttacttttaataa

SEQ ID NO: 4007564 - DNA, 23 bp, Homo sapiens
atttagacaacctgaaatttatt

SEQ ID NO: 4007565 - DNA, 23 bp, Homo sapiens
atttagagatgaattaaatttaa

SEQ ID NO: 4007566 - DNA, 22 bp, Homo sapiens
atttagagatgctgtaacttaa

SEQ ID NO: 4007567 - DNA, 14 bp, Homo sapiens
atttagctgtaaac

SEQ ID NO: 4007568 - DNA, 15 bp, Homo sapiens
atttagcttctttcc

SEQ ID NO: 4007569 - DNA, 14 bp, Homo sapiens
atttaggagaagcc

SEQ ID NO: 4007570 - DNA, 17 bp, Homo sapiens
atttaggagaagccagg

SEQ ID NO: 4007571 - DNA, 21 bp, Homo sapiens
atttaggagtgtgtgacattc

SEQ ID NO: 4007572 - DNA, 22 bp, Homo sapiens
atttagggagaaatgttgttca

SEQ ID NO: 4007573 - DNA, 20 bp, Homo sapiens
atttagggtactaaatttaa

SEQ ID NO: 4007574 - DNA, 19 bp, Homo sapiens
atttagtgatcttagcata

SEQ ID NO: 4007575 - DNA, 15 bp, Homo sapiens
atttataaaacttct

SEQ ID NO: 4007576 - DNA, 17 bp, Homo sapiens
atttataaacagacaat

SEQ ID NO: 4007577 - DNA, 14 bp, Homo sapiens
atttataaatatat

SEQ ID NO: 4007578 - DNA, 15 bp, Homo sapiens
atttataaatgctat

SEQ ID NO: 4007579 - DNA, 18 bp, Homo sapiens
atttataactcatcataa

SEQ ID NO: 4007580 - DNA, 22 bp, Homo sapiens
atttataactcatcataaaata

SEQ ID NO: 4007581 - DNA, 18 bp, Homo sapiens
atttatacaaattagaaa

SEQ ID NO: 4007582 - DNA, 15 bp, Homo sapiens
atttatacaagattg

SEQ ID NO: 4007583 - DNA, 17 bp, Homo sapiens
atttataggccagggca

SEQ ID NO: 4007584 - DNA, 22 bp, Homo sapiens
atttataggccagggcatgtgt

SEQ ID NO: 4007585 - DNA, 13 bp, Homo sapiens
atttatatatgaa

SEQ ID NO: 4007586 - DNA, 14 bp, Homo sapiens
atttatatatgaaa

SEQ ID NO: 4007587 - DNA, 15 bp, Homo sapiens
atttatatatgaaaa

SEQ ID NO: 4007588 - DNA, 16 bp, Homo sapiens
atttatatatgaaaac

SEQ ID NO: 4007589 - DNA, 14 bp, Homo sapiens
atttatatattgaa

SEQ ID NO: 4007590 - DNA, 18 bp, Homo sapiens
atttatatatttataact

SEQ ID NO: 4007591 - DNA, 19 bp, Homo sapiens
atttatatatttataactc

SEQ ID NO: 4007592 - DNA, 15 bp, Homo sapiens
atttatatgtacatg

SEQ ID NO: 4007593 - DNA, 17 bp, Homo sapiens
atttatatgtacatgag

SEQ ID NO: 4007594 - DNA, 12 bp, Homo sapiens
atttatcaaaat

SEQ ID NO: 4007595 - DNA, 20 bp, Homo sapiens
atttatcaaagcatagatgt

SEQ ID NO: 4007596 - DNA, 22 bp, Homo sapiens
atttatcaaagcatagatgttt

SEQ ID NO: 4007597 - DNA, 14 bp, Homo sapiens
atttatcagtgaca

SEQ ID NO: 4007598 - DNA, 23 bp, Homo sapiens
atttatcagtgacagagttcact

SEQ ID NO: 4007599 - DNA, 17 bp, Homo sapiens
atttatccaaaatgtgt

SEQ ID NO: 4007600 - DNA, 19 bp, Homo sapiens
atttatccaaaatgtgtat

SEQ ID NO: 4007601 - DNA, 21 bp, Homo sapiens
atttatccacaggaaagtgtt

SEQ ID NO: 4007602 - DNA, 20 bp, Homo sapiens
atttatctgggattatggtt

SEQ ID NO: 4007603 - DNA, 20 bp, Homo sapiens
atttatctgtgtttttgaaa

SEQ ID NO: 4007604 - DNA, 14 bp, Homo sapiens
atttatcttaagtt

SEQ ID NO: 4007605 - DNA, 19 bp, Homo sapiens
atttatcttgtctctgggc

SEQ ID NO: 4007606 - DNA, 13 bp, Homo sapiens
atttatgaaaaga

SEQ ID NO: 4007607 - DNA, 13 bp, Homo sapiens
atttatgaagttt

SEQ ID NO: 4007608 - DNA, 23 bp, Homo sapiens
atttatgaataaagaatgccatt

SEQ ID NO: 4007609 - DNA, 20 bp, Homo sapiens
atttatgagtaactattatt

SEQ ID NO: 4007610 - DNA, 18 bp, Homo sapiens
atttatgagtttttgata

SEQ ID NO: 4007611 - DNA, 15 bp, Homo sapiens
atttatgcactgtgg

SEQ ID NO: 4007612 - DNA, 20 bp, Homo sapiens
atttatgcctctgtatttaa

SEQ ID NO: 4007613 - DNA, 21 bp, Homo sapiens
atttatgccttgatgatttaa

SEQ ID NO: 4007614 - DNA, 18 bp, Homo sapiens
atttatggtcaacactta

SEQ ID NO: 4007615 - DNA, 21 bp, Homo sapiens
atttatgtagatgtgcatttt

SEQ ID NO: 4007616 - DNA, 18 bp, Homo sapiens
atttatgtgaaatgcttt

SEQ ID NO: 4007617 - DNA, 15 bp, Homo sapiens
atttatgtgtatatg

SEQ ID NO: 4007618 - DNA, 13 bp, Homo sapiens
atttatgtgtgag

SEQ ID NO: 4007619 - DNA, 14 bp, Homo sapiens
atttatgttaaaag

SEQ ID NO: 4007620 - DNA, 14 bp, Homo sapiens
atttcttccttgtt

SEQ ID NO: 4007621 - DNA, 19 bp, Homo sapiens
atttcttctctttagtata

SEQ ID NO: 4007622 - DNA, 19 bp, Homo sapiens
atttcttggtaagaagccg

SEQ ID NO: 4007623 - DNA, 20 bp, Homo sapiens
atttcttggtaagaagccgg

SEQ ID NO: 4007624 - DNA, 16 bp, Homo sapiens
atttcttggtattatt

SEQ ID NO: 4007625 - DNA, 18 bp, Homo sapiens
atttctttaaaagaatga

SEQ ID NO: 4007626 - DNA, 21 bp, Homo sapiens
atttctttgatctggacagaa

SEQ ID NO: 4007627 - DNA, 23 bp, Homo sapiens
atttctttgttatcaaacttcag

SEQ ID NO: 4007628 - DNA, 22 bp, Homo sapiens
atttgaaaaaaacttcattctc

SEQ ID NO: 4007629 - DNA, 21 bp, Homo sapiens
atttgaaatactaaaagcaaa

SEQ ID NO: 4007630 - DNA, 22 bp, Homo sapiens
atttgaaatactaaaagcaaat

SEQ ID NO: 4007631 - DNA, 11 bp, Homo sapiens
atttgaaattt

SEQ ID NO: 4007632 - DNA, 15 bp, Homo sapiens
atttgaaatttagct

SEQ ID NO: 4007633 - DNA, 13 bp, Homo sapiens
atttgaacactgg

SEQ ID NO: 4007634 - DNA, 17 bp, Homo sapiens
atttgaagtgtacctgt

SEQ ID NO: 4007635 - DNA, 14 bp, Homo sapiens
atttgaatgaaaaa

SEQ ID NO: 4007636 - DNA, 15 bp, Homo sapiens
atttgaatgaaaaat

SEQ ID NO: 4007637 - DNA, 16 bp, Homo sapiens
atttgaatgaaaaatt

SEQ ID NO: 4007638 - DNA, 15 bp, Homo sapiens
atttgaattaaaact

SEQ ID NO: 4007639 - DNA, 21 bp, Homo sapiens
atttgaattaaaacttcttaa

SEQ ID NO: 4007640 - DNA, 14 bp, Homo sapiens
atttgactgaagat

SEQ ID NO: 4007641 - DNA, 13 bp, Homo sapiens
atttgacttgaat

SEQ ID NO: 4007642 - DNA, 21 bp, Homo sapiens
atttgacttgcatgaagagaa

SEQ ID NO: 4007643 - DNA, 19 bp, Homo sapiens
atttgagaaaataaagcta

SEQ ID NO: 4007644 - DNA, 14 bp, Homo sapiens
atttgagagaagcc

SEQ ID NO: 4007645 - DNA, 22 bp, Homo sapiens
atttgaggtcaagtaagaagac

SEQ ID NO: 4007646 - DNA, 13 bp, Homo sapiens
atttgatacataa

SEQ ID NO: 4007647 - DNA, 14 bp, Homo sapiens
atttgatacataat

SEQ ID NO: 4007648 - DNA, 15 bp, Homo sapiens
atttgatacataata

SEQ ID NO: 4007649 - DNA, 15 bp, Homo sapiens
atttgatattatcta

SEQ ID NO: 4007650 - DNA, 15 bp, Homo sapiens
atttgatatttgcat

SEQ ID NO: 4007651 - DNA, 17 bp, Homo sapiens
atttgatcgttccagtt

SEQ ID NO: 4007652 - DNA, 14 bp, Homo sapiens
atttgatgctaaat

SEQ ID NO: 4007653 - DNA, 19 bp, Homo sapiens
atttgatgctggagaggtt

SEQ ID NO: 4007654 - DNA, 15 bp, Homo sapiens
atttgatgtgacttt

SEQ ID NO: 4007655 - DNA, 16 bp, Homo sapiens
atttgattaacaaata

SEQ ID NO: 4007656 - DNA, 17 bp, Homo sapiens
atttgattcattttcct

SEQ ID NO: 4007657 - DNA, 18 bp, Homo sapiens
atttgattcattttcctg

SEQ ID NO: 4007658 - DNA, 20 bp, Homo sapiens
atttgattcgccctcctccc

SEQ ID NO: 4007659 - DNA, 16 bp, Homo sapiens
atttgattgatttgaa

SEQ ID NO: 4007660 - DNA, 22 bp, Homo sapiens
atttgatttttctaaccttgaa

SEQ ID NO: 4007661 - DNA, 22 bp, Homo sapiens
atttgcatattctattgtatta

SEQ ID NO: 4007662 - DNA, 16 bp, Homo sapiens
atttgcatattttgag

SEQ ID NO: 4007663 - DNA, 20 bp, Homo sapiens
atttgcatattttgagaaac

SEQ ID NO: 4007664 - DNA, 19 bp, Homo sapiens
atttgccatgggcttcact

SEQ ID NO: 4007665 - DNA, 19 bp, Homo sapiens
atttgccttctactcccct

SEQ ID NO: 4007666 - DNA, 15 bp, Homo sapiens
atttgccttgctgga

SEQ ID NO: 4007667 - DNA, 20 bp, Homo sapiens
atttgcctttctgggagcag

SEQ ID NO: 4007668 - DNA, 23 bp, Homo sapiens
atttgctaatcaaagccagggtc

SEQ ID NO: 4007669 - DNA, 21 bp, Homo sapiens
atttgctagcagtaaaagatg

SEQ ID NO: 4007670 - DNA, 14 bp, Homo sapiens
atttgctgccccag

SEQ ID NO: 4007671 - DNA, 16 bp, Homo sapiens
atttgctgccccagct

SEQ ID NO: 4007672 - DNA, 13 bp, Homo sapiens
atttgctggggaa

SEQ ID NO: 4007673 - DNA, 12 bp, Homo sapiens
atttgcttcatt

SEQ ID NO: 4007674 - DNA, 17 bp, Homo sapiens
atttggaaccttgtttt

SEQ ID NO: 4007675 - DNA, 13 bp, Homo sapiens
atttggaatactt

SEQ ID NO: 4007676 - DNA, 19 bp, Homo sapiens
atttggagggaagctcttg

SEQ ID NO: 4007677 - DNA, 23 bp, Homo sapiens
atttggagggaagctcttggagc

SEQ ID NO: 4007678 - DNA, 16 bp, Homo sapiens
atttggcctgcactaa

SEQ ID NO: 4007679 - DNA, 19 bp, Homo sapiens
atttggcttgacaaaggca

SEQ ID NO: 4007680 - DNA, 17 bp, Homo sapiens
atttgggagggaaaagg

SEQ ID NO: 4007681 - DNA, 19 bp, Homo sapiens
atttgggcctgctccagac

SEQ ID NO: 4007682 - DNA, 22 bp, Homo sapiens
atttgggcctgctccagacctg

SEQ ID NO: 4007683 - DNA, 23 bp, Homo sapiens
atttgggggaggctttgggagca

SEQ ID NO: 4007684 - DNA, 21 bp, Homo sapiens
atttggtaaattagtatttat

SEQ ID NO: 4007685 - DNA, 19 bp, Homo sapiens
atttggtccaaaaaaagga

SEQ ID NO: 4007686 - DNA, 21 bp, Homo sapiens
atttggtccaaaaaaaggaaa

SEQ ID NO: 4007687 - DNA, 21 bp, Homo sapiens
atttggttcattaattctata

SEQ ID NO: 4007688 - DNA, 23 bp, Homo sapiens
atttgtaaaaacagcattgcttt

SEQ ID NO: 4007689 - DNA, 20 bp, Homo sapiens
atttgtaacctcagctctgg

SEQ ID NO: 4007690 - DNA, 14 bp, Homo sapiens
atttgtaataaagt

SEQ ID NO: 4007691 - DNA, 15 bp, Homo sapiens
atttgtaattgctta

SEQ ID NO: 4007692 - DNA, 19 bp, Homo sapiens
atttgtacagaattttgga

SEQ ID NO: 4007693 - DNA, 15 bp, Homo sapiens
atttgtagcactgag

SEQ ID NO: 4007694 - DNA, 23 bp, Homo sapiens
atttgtaggaaggtctcattctt

SEQ ID NO: 4007695 - DNA, 11 bp, Homo sapiens
atttgtcccag

SEQ ID NO: 4007696 - DNA, 15 bp, Homo sapiens
atttgtgagattcct

SEQ ID NO: 4007697 - DNA, 19 bp, Homo sapiens
atttgtgtttttctttttc

SEQ ID NO: 4007698 - DNA, 21 bp, Homo sapiens
atttgttaaaattatcaatat

SEQ ID NO: 4007699 - DNA, 14 bp, Homo sapiens
atttgttataatga

SEQ ID NO: 4007700 - DNA, 21 bp, Homo sapiens
atttgttcctgcttccgagat

SEQ ID NO: 4007701 - DNA, 13 bp, Homo sapiens
atttgttcctgga

SEQ ID NO: 4007702 - DNA, 20 bp, Homo sapiens
atttgttcctggagttttga

SEQ ID NO: 4007703 - DNA, 14 bp, Homo sapiens
atttgttgaaatta

SEQ ID NO: 4007704 - DNA, 16 bp, Homo sapiens
atttgttgaaattatg

SEQ ID NO: 4007705 - DNA, 17 bp, Homo sapiens
atttgtttaaagaataa

SEQ ID NO: 4007706 - DNA, 22 bp, Homo sapiens
atttgtttaaagaataaagtcc

SEQ ID NO: 4007707 - DNA, 17 bp, Homo sapiens
atttgttttgaattttg

SEQ ID NO: 4007708 - DNA, 18 bp, Homo sapiens
atttgttttgaattttgt

SEQ ID NO: 4007709 - DNA, 16 bp, Homo sapiens
atttgtttttcattca

SEQ ID NO: 4007710 - DNA, 18 bp, Homo sapiens
attttaaaaaagccttcc

SEQ ID NO: 4007711 - DNA, 14 bp, Homo sapiens
attttaaaaagtct

SEQ ID NO: 4007712 - DNA, 22 bp, Homo sapiens
attttaaaaatacagatagata

SEQ ID NO: 4007713 - DNA, 18 bp, Homo sapiens
attttaaaatatttaaac

SEQ ID NO: 4007714 - DNA, 16 bp, Homo sapiens
attttaacaaaagcaa

SEQ ID NO: 4007715 - DNA, 22 bp, Homo sapiens
attttaacaataactactgtgt

SEQ ID NO: 4007716 - DNA, 17 bp, Homo sapiens
attttaactttatcaca

SEQ ID NO: 4007717 - DNA, 15 bp, Homo sapiens
attttaagaagacat

SEQ ID NO: 4007718 - DNA, 21 bp, Homo sapiens
attttaagtttgcagatttat

SEQ ID NO: 4007719 - DNA, 21 bp, Homo sapiens
attttaatacaggacttttaa

SEQ ID NO: 4007720 - DNA, 13 bp, Homo sapiens
attttaatagaaa

SEQ ID NO: 4007721 - DNA, 15 bp, Homo sapiens
attttaatagaaata

SEQ ID NO: 4007722 - DNA, 23 bp, Homo sapiens
atttttaaaaagaaatctggtct

SEQ ID NO: 4007723 - DNA, 17 bp, Homo sapiens
atttttaaaatatttat

SEQ ID NO: 4007724 - DNA, 12 bp, Homo sapiens
atttttaaagat

SEQ ID NO: 4007725 - DNA, 13 bp, Homo sapiens
atttttaaagatc

SEQ ID NO: 4007726 - DNA, 17 bp, Homo sapiens
atttttaaagtatatat

SEQ ID NO: 4007727 - DNA, 17 bp, Homo sapiens
atttttaagaacttcat

SEQ ID NO: 4007728 - DNA, 13 bp, Homo sapiens
atttttaatttgg

SEQ ID NO: 4007729 - DNA, 16 bp, Homo sapiens
atttttaattttcaca

SEQ ID NO: 4007730 - DNA, 17 bp, Homo sapiens
atttttaccctaatgtc

SEQ ID NO: 4007731 - DNA, 19 bp, Homo sapiens
atttttaccctaatgtctt

SEQ ID NO: 4007732 - DNA, 16 bp, Homo sapiens
atttttacctaaagac

SEQ ID NO: 4007733 - DNA, 21 bp, Homo sapiens
atttttaggaagttttctgta

SEQ ID NO: 4007734 - DNA, 16 bp, Homo sapiens
atttttatcatgaatt

SEQ ID NO: 4007735 - DNA, 16 bp, Homo sapiens
atttttattaaattat

SEQ ID NO: 4007736 - DNA, 13 bp, Homo sapiens
atttttatttatg

SEQ ID NO: 4007737 - DNA, 17 bp, Homo sapiens
atttttatttcttccta

SEQ ID NO: 4007738 - DNA, 21 bp, Homo sapiens
atttttcaataaagcatttat

SEQ ID NO: 4007739 - DNA, 14 bp, Homo sapiens
atttttcaatatat

SEQ ID NO: 4007740 - DNA, 18 bp, Homo sapiens
atttttcaatatattgaa

SEQ ID NO: 4007741 - DNA, 20 bp, Homo sapiens
atttttcaatatattgaact

SEQ ID NO: 4007742 - DNA, 15 bp, Homo sapiens
atttttccaaaataa

SEQ ID NO: 4007743 - DNA, 17 bp, Homo sapiens
atttttccgtttgcttt

SEQ ID NO: 4007744 - DNA, 10 bp, Homo sapiens
atttttccta

SEQ ID NO: 4007745 - DNA, 12 bp, Homo sapiens
atttttctaaaa

SEQ ID NO: 4007746 - DNA, 15 bp, Homo sapiens
atttttctcccaaga

SEQ ID NO: 4007747 - DNA, 19 bp, Homo sapiens
atttttctcccaagaaacc

SEQ ID NO: 4007748 - DNA, 21 bp, Homo sapiens
atttttctcccaagaaacctg

SEQ ID NO: 4007749 - DNA, 20 bp, Homo sapiens
atttttcttttattcttctt

SEQ ID NO: 4007750 - DNA, 22 bp, Homo sapiens
atttttcttttattcttctttc

SEQ ID NO: 4007751 - DNA, 17 bp, Homo sapiens
atttttcttttcttgat

SEQ ID NO: 4007752 - DNA, 20 bp, Homo sapiens
atttttgactgtagccacag

SEQ ID NO: 4007753 - DNA, 18 bp, Homo sapiens
atttttggggaaaaaagc

SEQ ID NO: 4007754 - DNA, 19 bp, Homo sapiens
atttttggggaaaaaagca

SEQ ID NO: 4007755 - DNA, 22 bp, Homo sapiens
atttttggtgggtgaaaggaat

SEQ ID NO: 4007756 - DNA, 19 bp, Homo sapiens
atttttggttgtcaatatt

SEQ ID NO: 4007757 - DNA, 12 bp, Homo sapiens
atttttgtaatg

SEQ ID NO: 4007758 - DNA, 12 bp, Homo sapiens
atttttgtaatt

SEQ ID NO: 4007759 - DNA, 12 bp, Homo sapiens
atttttgtacat

SEQ ID NO: 4007760 - DNA, 15 bp, Homo sapiens
atttttgtagtagcg

SEQ ID NO: 4007761 - DNA, 17 bp, Homo sapiens
atttttgtatgttatga

SEQ ID NO: 4007762 - DNA, 23 bp, Homo sapiens
atttttgtcttatatatatttct

SEQ ID NO: 4007763 - DNA, 13 bp, Homo sapiens
attttttaaaata

SEQ ID NO: 4007764 - DNA, 20 bp, Homo sapiens
attttttaaagttactttgt

SEQ ID NO: 4007765 - DNA, 16 bp, Homo sapiens
attttttaagtattta

SEQ ID NO: 4007766 - DNA, 15 bp, Homo sapiens
attttttaattatta

SEQ ID NO: 4007767 - DNA, 14 bp, Homo sapiens
attttttattgcta

SEQ ID NO: 4007768 - DNA, 14 bp, Homo sapiens
attttttcagttgt

SEQ ID NO: 4007769 - DNA, 20 bp, Homo sapiens
attttttgctataatcatta

SEQ ID NO: 4007770 - DNA, 22 bp, Homo sapiens
attttttgggcagcaatttaaa

SEQ ID NO: 4007771 - DNA, 18 bp, Homo sapiens
atttttttaaaatgttaa

SEQ ID NO: 4007772 - DNA, 16 bp, Homo sapiens
atttttttattactga

SEQ ID NO: 4007773 - DNA, 16 bp, Homo sapiens
atttttttattcagca

SEQ ID NO: 4007774 - DNA, 19 bp, Homo sapiens
atttttttcccaattgaga

SEQ ID NO: 4007775 - DNA, 13 bp, Homo sapiens
atttttttgtaat

SEQ ID NO: 4007776 - DNA, 19 bp, Homo sapiens
atttttttgtaataagcaa

SEQ ID NO: 4007777 - DNA, 18 bp, Homo sapiens
atttttttgtaattgctt

SEQ ID NO: 4007778 - DNA, 19 bp, Homo sapiens
atttttttgtcattaaaat

SEQ ID NO: 4007779 - DNA, 13 bp, Homo sapiens
atttttttgtctt

SEQ ID NO: 4007780 - DNA, 15 bp, Homo sapiens
atttttttgtgtatg

SEQ ID NO: 4007781 - DNA, 14 bp, Homo sapiens
attttttttatatt

SEQ ID NO: 4007782 - DNA, 18 bp, Homo sapiens
attttttttgtattctta

SEQ ID NO: 4007783 - DNA, 16 bp, Homo sapiens
attttttttttaaatc

SEQ ID NO: 4007784 - DNA, 21 bp, Homo sapiens
attttttttttcctcttcaga

SEQ ID NO: 4007785 - DNA, 22 bp, Homo sapiens
caaaaaaaaaaaaaagcatcta

SEQ ID NO: 4007786 - DNA, 19 bp, Homo sapiens
caaaaaaaaaaaaatgcac

SEQ ID NO: 4007787 - DNA, 16 bp, Homo sapiens
caaaaaaaaagtttta

SEQ ID NO: 4007788 - DNA, 21 bp, Homo sapiens
caaaaaaaatttagccgggcg

SEQ ID NO: 4007789 - DNA, 16 bp, Homo sapiens
caaaaaaacactagtt

SEQ ID NO: 4007790 - DNA, 20 bp, Homo sapiens
caaaaaaaggaaaaataatc

SEQ ID NO: 4007791 - DNA, 16 bp, Homo sapiens
caaaaaaatccagaaa

SEQ ID NO: 4007792 - DNA, 18 bp, Homo sapiens
caaaaaaatttaaaatta

SEQ ID NO: 4007793 - DNA, 15 bp, Homo sapiens
caaaaaactacttct

SEQ ID NO: 4007794 - DNA, 12 bp, Homo sapiens
caaaaaatgagc

SEQ ID NO: 4007795 - DNA, 16 bp, Homo sapiens
caaaaaattagccggg

SEQ ID NO: 4007796 - DNA, 22 bp, Homo sapiens
caaaaacatgtatgtgcatttc

SEQ ID NO: 4007797 - DNA, 20 bp, Homo sapiens
caaaaacatgtttctgcctt

SEQ ID NO: 4007798 - DNA, 16 bp, Homo sapiens
caaaaactacacatat

SEQ ID NO: 4007799 - DNA, 21 bp, Homo sapiens
caaaaaggagccttttgctct

SEQ ID NO: 4007800 - DNA, 20 bp, Homo sapiens
caaaaagggaaactattgtc

SEQ ID NO: 4007801 - DNA, 13 bp, Homo sapiens
caaaaaggttgct

SEQ ID NO: 4007802 - DNA, 15 bp, Homo sapiens
caaaaagtttccata

SEQ ID NO: 4007803 - DNA, 23 bp, Homo sapiens
caaaaatataaaatatgaagaca

SEQ ID NO: 4007804 - DNA, 22 bp, Homo sapiens
caaaaatatttataaaacttct

SEQ ID NO: 4007805 - DNA, 19 bp, Homo sapiens
caaaaatcccaccttccca

SEQ ID NO: 4007806 - DNA, 20 bp, Homo sapiens
caaaaattagccgggcgtgg

SEQ ID NO: 4007807 - DNA, 15 bp, Homo sapiens
caaaaattagctggg

SEQ ID NO: 4007808 - DNA, 17 bp, Homo sapiens
caaaaattatctatagc

SEQ ID NO: 4007809 - DNA, 18 bp, Homo sapiens
caaaacaaaaattaggta

SEQ ID NO: 4007810 - DNA, 23 bp, Homo sapiens
caaaacaaaaattaggtattttg

SEQ ID NO: 4007811 - DNA, 17 bp, Homo sapiens
caaaaccaggcctctgc

SEQ ID NO: 4007812 - DNA, 13 bp, Homo sapiens
caaaacccagacc

SEQ ID NO: 4007813 - DNA, 15 bp, Homo sapiens
caaaacccagggcaa

SEQ ID NO: 4007814 - DNA, 16 bp, Homo sapiens
caaaacccatgcattt

SEQ ID NO: 4007815 - DNA, 18 bp, Homo sapiens
caaaacctgatgttaaaa

SEQ ID NO: 4007816 - DNA, 19 bp, Homo sapiens
caaaacgcatggagtgtgt

SEQ ID NO: 4007817 - DNA, 14 bp, Homo sapiens
caaaacgtcttatt

SEQ ID NO: 4007818 - DNA, 13 bp, Homo sapiens
caaaacttctctt

SEQ ID NO: 4007819 - DNA, 23 bp, Homo sapiens
caaaactttaggccctgccccag

SEQ ID NO: 4007820 - DNA, 12 bp, Homo sapiens
caaaagaaaaac

SEQ ID NO: 4007821 - DNA, 19 bp, Homo sapiens
caaaagaacaagaatttct

SEQ ID NO: 4007822 - DNA, 18 bp, Homo sapiens
caaaagaagcccccagct

SEQ ID NO: 4007823 - DNA, 19 bp, Homo sapiens
caaaagaagcccccagcta

SEQ ID NO: 4007824 - DNA, 21 bp, Homo sapiens
caaaagatgtatccttccaat

SEQ ID NO: 4007825 - DNA, 13 bp, Homo sapiens
caaagcagccacg

SEQ ID NO: 4007826 - DNA, 15 bp, Homo sapiens
caaagcagtggagcc

SEQ ID NO: 4007827 - DNA, 14 bp, Homo sapiens
caaagcagttgaat

SEQ ID NO: 4007828 - DNA, 21 bp, Homo sapiens
caaagccacaaggctggccag

SEQ ID NO: 4007829 - DNA, 23 bp, Homo sapiens
caaagccacctctgtcatttgtt

SEQ ID NO: 4007830 - DNA, 23 bp, Homo sapiens
caaagccagggtctctccctcag

SEQ ID NO: 4007831 - DNA, 16 bp, Homo sapiens
caaagccagtgaaatg

SEQ ID NO: 4007832 - DNA, 22 bp, Homo sapiens
caaagcgggacgccgcaggtgt

SEQ ID NO: 4007833 - DNA, 13 bp, Homo sapiens
caaagcgggggga

SEQ ID NO: 4007834 - DNA, 15 bp, Homo sapiens
caaagcgtttcttta

SEQ ID NO: 4007835 - DNA, 20 bp, Homo sapiens
caaagctcaaataaaaataa

SEQ ID NO: 4007836 - DNA, 16 bp, Homo sapiens
caaagctgttcttcct

SEQ ID NO: 4007837 - DNA, 19 bp, Homo sapiens
caaagcttctatcccagga

SEQ ID NO: 4007838 - DNA, 17 bp, Homo sapiens
caaaggaggctggcagg

SEQ ID NO: 4007839 - DNA, 22 bp, Homo sapiens
caaaggatagtgcgatgtttca

SEQ ID NO: 4007840 - DNA, 17 bp, Homo sapiens
caaaggatgtgatatat

SEQ ID NO: 4007841 - DNA, 13 bp, Homo sapiens
caaaggcccccta

SEQ ID NO: 4007842 - DNA, 23 bp, Homo sapiens
caaaggcgcagtgcttctctaca

SEQ ID NO: 4007843 - DNA, 15 bp, Homo sapiens
caaaggctggtggca

SEQ ID NO: 4007844 - DNA, 14 bp, Homo sapiens
caaagggctgaaag

SEQ ID NO: 4007845 - DNA, 18 bp, Homo sapiens
caaaggggacagctgtgt

SEQ ID NO: 4007846 - DNA, 20 bp, Homo sapiens
caaagggtgaagctatttat

SEQ ID NO: 4007847 - DNA, 23 bp, Homo sapiens
caaagggtgaagctatttatctg

SEQ ID NO: 4007848 - DNA, 14 bp, Homo sapiens
caaaggtataattt

SEQ ID NO: 4007849 - DNA, 16 bp, Homo sapiens
caaagtaaatacaaga

SEQ ID NO: 4007850 - DNA, 20 bp, Homo sapiens
caaagtaaatacaagactgt

SEQ ID NO: 4007851 - DNA, 21 bp, Homo sapiens
caaagtagaagtcttagatgt

SEQ ID NO: 4007852 - DNA, 14 bp, Homo sapiens
caaagtcctttttt

SEQ ID NO: 4007853 - DNA, 21 bp, Homo sapiens
caaagtgagaaaatgcctcaa

SEQ ID NO: 4007854 - DNA, 21 bp, Homo sapiens
caaagtgatagaaaagtgtgg

SEQ ID NO: 4007855 - DNA, 23 bp, Homo sapiens
caaagtgttgtgttcctggctga

SEQ ID NO: 4007856 - DNA, 17 bp, Homo sapiens
caaagttaattcaccta

SEQ ID NO: 4007857 - DNA, 21 bp, Homo sapiens
caaagttttgaaaagctatta

SEQ ID NO: 4007858 - DNA, 16 bp, Homo sapiens
caaataaaaatattgt

SEQ ID NO: 4007859 - DNA, 17 bp, Homo sapiens
caaatacaaagtaaata

SEQ ID NO: 4007860 - DNA, 19 bp, Homo sapiens
caaatacaaagtaaataca

SEQ ID NO: 4007861 - DNA, 14 bp, Homo sapiens
caaatactcttagg

SEQ ID NO: 4007862 - DNA, 12 bp, Homo sapiens
caaatactttaa

SEQ ID NO: 4007863 - DNA, 19 bp, Homo sapiens
caaatactttaaaggaaaa

SEQ ID NO: 4007864 - DNA, 15 bp, Homo sapiens
caaataggcagaatg

SEQ ID NO: 4007865 - DNA, 13 bp, Homo sapiens
caaatataaacat

SEQ ID NO: 4007866 - DNA, 15 bp, Homo sapiens
caaatataagacatt

SEQ ID NO: 4007867 - DNA, 19 bp, Homo sapiens
caaatataagacatttgtt

SEQ ID NO: 4007868 - DNA, 23 bp, Homo sapiens
caaatataagacatttgtttgct

SEQ ID NO: 4007869 - DNA, 17 bp, Homo sapiens
caaatatgtattttcct

SEQ ID NO: 4007870 - DNA, 14 bp, Homo sapiens
caaatatgtcctgg

SEQ ID NO: 4007871 - DNA, 17 bp, Homo sapiens
caaatatgtcctggggt

SEQ ID NO: 4007872 - DNA, 18 bp, Homo sapiens
caaatattcactggcccc

SEQ ID NO: 4007873 - DNA, 18 bp, Homo sapiens
caaatattgttgacaact

SEQ ID NO: 4007874 - DNA, 19 bp, Homo sapiens
caaatatttctagacactt

SEQ ID NO: 4007875 - DNA, 14 bp, Homo sapiens
caaatcaatacact

SEQ ID NO: 4007876 - DNA, 17 bp, Homo sapiens
caaatcaatacactagt

SEQ ID NO: 4007877 - DNA, 17 bp, Homo sapiens
caaatcaatctgtaaaa

SEQ ID NO: 4007878 - DNA, 20 bp, Homo sapiens
caaatcaatctgtaaaacta

SEQ ID NO: 4007879 - DNA, 19 bp, Homo sapiens
caaatccttccaaaaatta

SEQ ID NO: 4007880 - DNA, 16 bp, Homo sapiens
caaatctattcagaca

SEQ ID NO: 4007881 - DNA, 20 bp, Homo sapiens
caaatctattcagacaagca

SEQ ID NO: 4007882 - DNA, 20 bp, Homo sapiens
caaatctcttgcttgtcatt

SEQ ID NO: 4007883 - DNA, 20 bp, Homo sapiens
caaatctgggtatctttcca

SEQ ID NO: 4007884 - DNA, 11 bp, Homo sapiens
caaatctggtc

SEQ ID NO: 4007885 - DNA, 20 bp, Homo sapiens
caaatctggtccatatttac

SEQ ID NO: 4007886 - DNA, 21 bp, Homo sapiens
caaatctggtccatatttaca

SEQ ID NO: 4007887 - DNA, 16 bp, Homo sapiens
caaatctgtataaatg

SEQ ID NO: 4007888 - DNA, 20 bp, Homo sapiens
caaatctgtataaatgtcta

SEQ ID NO: 4007889 - DNA, 18 bp, Homo sapiens
caaatctgtcagcatctg

SEQ ID NO: 4007890 - DNA, 13 bp, Homo sapiens
caaatcttgaaat

SEQ ID NO: 4007891 - DNA, 21 bp, Homo sapiens
caaatcttggcaatattcctt

SEQ ID NO: 4007892 - DNA, 14 bp, Homo sapiens
caaatcttgggtgg

SEQ ID NO: 4007893 - DNA, 12 bp, Homo sapiens
caaatgagccat

SEQ ID NO: 4007894 - DNA, 18 bp, Homo sapiens
caaatgcatggtgcagtt

SEQ ID NO: 4007895 - DNA, 14 bp, Homo sapiens
caaatgcattctat

SEQ ID NO: 4007896 - DNA, 18 bp, Homo sapiens
caaatgccttaaaatgga

SEQ ID NO: 4007897 - DNA, 22 bp, Homo sapiens
caaatggaaagtaactcatttg

SEQ ID NO: 4007898 - DNA, 19 bp, Homo sapiens
caaatggattcctgtttca

SEQ ID NO: 4007899 - DNA, 18 bp, Homo sapiens
caaatggcgtctggaagt

SEQ ID NO: 4007900 - DNA, 21 bp, Homo sapiens
caaatggcgtctggaagtcca

SEQ ID NO: 4007901 - DNA, 17 bp, Homo sapiens
caaatgggagctgagca

SEQ ID NO: 4007902 - DNA, 18 bp, Homo sapiens
caaatggggccagatcca

SEQ ID NO: 4007903 - DNA, 13 bp, Homo sapiens
caaatggtaggca

SEQ ID NO: 4007904 - DNA, 18 bp, Homo sapiens
caaatgtcctccagaagc

SEQ ID NO: 4007905 - DNA, 15 bp, Homo sapiens
caaattaataatctt

SEQ ID NO: 4007906 - DNA, 16 bp, Homo sapiens
caaattaataatctta

SEQ ID NO: 4007907 - DNA, 13 bp, Homo sapiens
caaattaatttta

SEQ ID NO: 4007908 - DNA, 16 bp, Homo sapiens
caaattcatattctgt

SEQ ID NO: 4007909 - DNA, 19 bp, Homo sapiens
caaattggactttcaaaat

SEQ ID NO: 4007910 - DNA, 22 bp, Homo sapiens
caaattgtatctagtgcagctg

SEQ ID NO: 4007911 - DNA, 13 bp, Homo sapiens
caaatttatcaaa

SEQ ID NO: 4007912 - DNA, 14 bp, Homo sapiens
caaatttgattgat

SEQ ID NO: 4007913 - DNA, 17 bp, Homo sapiens
caaatttgattgatttg

SEQ ID NO: 4007914 - DNA, 19 bp, Homo sapiens
caaattttgagttgccaca

SEQ ID NO: 4007915 - DNA, 15 bp, Homo sapiens
caaattttttgactt

SEQ ID NO: 4007916 - DNA, 17 bp, Homo sapiens
caacaaaaagcttcccc

SEQ ID NO: 4007917 - DNA, 12 bp, Homo sapiens
caacaaagaaat

SEQ ID NO: 4007918 - DNA, 14 bp, Homo sapiens
caacaaagaacact

SEQ ID NO: 4007919 - DNA, 14 bp, Homo sapiens
caacaaatgaattt

SEQ ID NO: 4007920 - DNA, 15 bp, Homo sapiens
caacaacaattggta

SEQ ID NO: 4007921 - DNA, 14 bp, Homo sapiens
caacaagaagaaat

SEQ ID NO: 4007922 - DNA, 15 bp, Homo sapiens
caacaagaagaaata

SEQ ID NO: 4007923 - DNA, 20 bp, Homo sapiens
caacaagaagaaatatgaaa

SEQ ID NO: 4007924 - DNA, 21 bp, Homo sapiens
caacaagaatgcattccctga

SEQ ID NO: 4007925 - DNA, 20 bp, Homo sapiens
caacaaggtggtgtgatctt

SEQ ID NO: 4007926 - DNA, 14 bp, Homo sapiens
caacaattggtaaa

SEQ ID NO: 4007927 - DNA, 15 bp, Homo sapiens
caacaattggtaaaa

SEQ ID NO: 4007928 - DNA, 18 bp, Homo sapiens
caacaattggtaaaactc

SEQ ID NO: 4007929 - DNA, 19 bp, Homo sapiens
caacaattggtaaaactca

SEQ ID NO: 4007930 - DNA, 20 bp, Homo sapiens
caacaatttagaaggaaaac

SEQ ID NO: 4007931 - DNA, 14 bp, Homo sapiens
caacacagaggcag

SEQ ID NO: 4007932 - DNA, 15 bp, Homo sapiens
caacaccaagcacag

SEQ ID NO: 4007933 - DNA, 20 bp, Homo sapiens
caacaccacagacacacaca

SEQ ID NO: 4007934 - DNA, 19 bp, Homo sapiens
caacacgcacctgcctcag

SEQ ID NO: 4007935 - DNA, 13 bp, Homo sapiens
caacactggtgtg

SEQ ID NO: 4007936 - DNA, 18 bp, Homo sapiens
caacactggtgtgacctg

SEQ ID NO: 4007937 - DNA, 15 bp, Homo sapiens
caacagaactaaatg

SEQ ID NO: 4007938 - DNA, 23 bp, Homo sapiens
caacagaagtcatgaagcccaag

SEQ ID NO: 4007939 - DNA, 13 bp, Homo sapiens
caacagatctgga

SEQ ID NO: 4007940 - DNA, 14 bp, Homo sapiens
caacagatctggaa

SEQ ID NO: 4007941 - DNA, 17 bp, Homo sapiens
caacagccaagtgtgac

SEQ ID NO: 4007942 - DNA, 17 bp, Homo sapiens
caacaggacagagttca

SEQ ID NO: 4007943 - DNA, 18 bp, Homo sapiens
caacaggacagagttcac

SEQ ID NO: 4007944 - DNA, 22 bp, Homo sapiens
caacaggacagagttcacagga

SEQ ID NO: 4007945 - DNA, 14 bp, Homo sapiens
caacatatatttat

SEQ ID NO: 4007946 - DNA, 15 bp, Homo sapiens
caacatcaatgttca

SEQ ID NO: 4007947 - DNA, 21 bp, Homo sapiens
caacatctttgcgaaaagata

SEQ ID NO: 4007948 - DNA, 13 bp, Homo sapiens
caacatcttttta

SEQ ID NO: 4007949 - DNA, 20 bp, Homo sapiens
caacattaaggaatttgatg

SEQ ID NO: 4007950 - DNA, 17 bp, Homo sapiens
caacattgcttgtgcca

SEQ ID NO: 4007951 - DNA, 23 bp, Homo sapiens
caacatttacagtccttcaaaat

SEQ ID NO: 4007952 - DNA, 20 bp, Homo sapiens
caaccaatttacactgccat

SEQ ID NO: 4007953 - DNA, 20 bp, Homo sapiens
caaccacacttgtcggctcc

SEQ ID NO: 4007954 - DNA, 16 bp, Homo sapiens
caaccacgtggagaaa

SEQ ID NO: 4007955 - DNA, 12 bp, Homo sapiens
caaccagagccc

SEQ ID NO: 4007956 - DNA, 22 bp, Homo sapiens
caaccagctaagaaaagatttt

SEQ ID NO: 4007957 - DNA, 23 bp, Homo sapiens
caaccatgagaccactgttatca

SEQ ID NO: 4007958 - DNA, 15 bp, Homo sapiens
caacccaaggactga

SEQ ID NO: 4007959 - DNA, 19 bp, Homo sapiens
caacccaaggactgaggga

SEQ ID NO: 4007960 - DNA, 19 bp, Homo sapiens
caacccagtgggtctggga

SEQ ID NO: 4007961 - DNA, 18 bp, Homo sapiens
caacccattcactacagg

SEQ ID NO: 4007962 - DNA, 13 bp, Homo sapiens
caaccccaggctg

SEQ ID NO: 4007963 - DNA, 11 bp, Homo sapiens
caacccccacc

SEQ ID NO: 4007964 - DNA, 14 bp, Homo sapiens
caacccccagctcc

SEQ ID NO: 4007965 - DNA, 18 bp, Homo sapiens
caaccctcagagccaccc

SEQ ID NO: 4007966 - DNA, 21 bp, Homo sapiens
caaccctcagagccaccccta

SEQ ID NO: 4007967 - DNA, 20 bp, Homo sapiens
caaccctggggaaggagcca

SEQ ID NO: 4007968 - DNA, 21 bp, Homo sapiens
caaccctggggaaggagccag

SEQ ID NO: 4007969 - DNA, 19 bp, Homo sapiens
caacccttaccccttagcc

SEQ ID NO: 4007970 - DNA, 22 bp, Homo sapiens
caacccttaccccttagcctcc

SEQ ID NO: 4007971 - DNA, 21 bp, Homo sapiens
caaccggtggatcctcaaaca

SEQ ID NO: 4007972 - DNA, 19 bp, Homo sapiens
caacctagaatgtcagatt

SEQ ID NO: 4007973 - DNA, 15 bp, Homo sapiens
caacctcaccttcct

SEQ ID NO: 4007974 - DNA, 16 bp, Homo sapiens
caacctcaccttcctg

SEQ ID NO: 4007975 - DNA, 19 bp, Homo sapiens
caacctcaccttcctgtgg

SEQ ID NO: 4007976 - DNA, 13 bp, Homo sapiens
caacctcagaggc

SEQ ID NO: 4007977 - DNA, 20 bp, Homo sapiens
caacctcagaggcagcttca

SEQ ID NO: 4007978 - DNA, 16 bp, Homo sapiens
caacctcgctgagggc

SEQ ID NO: 4007979 - DNA, 15 bp, Homo sapiens
caacctctgcctccc

SEQ ID NO: 4007980 - DNA, 20 bp, Homo sapiens
caacctctgcctcccaggtt

SEQ ID NO: 4007981 - DNA, 17 bp, Homo sapiens
caacctcttctggctca

SEQ ID NO: 4007982 - DNA, 13 bp, Homo sapiens
caacctcttggcc

SEQ ID NO: 4007983 - DNA, 16 bp, Homo sapiens
caacctgaaatttatt

SEQ ID NO: 4007984 - DNA, 17 bp, Homo sapiens
caacctgctctgtcccc

SEQ ID NO: 4007985 - DNA, 22 bp, Homo sapiens
caacctggtggcaccagatgca

SEQ ID NO: 4007986 - DNA, 12 bp, Homo sapiens
caacctttaaaa

SEQ ID NO: 4007987 - DNA, 17 bp, Homo sapiens
caacgagccttttcacc

SEQ ID NO: 4007988 - DNA, 12 bp, Homo sapiens
caacgcagccct

SEQ ID NO: 4007989 - DNA, 17 bp, Homo sapiens
caacgcccctccaaacc

SEQ ID NO: 4007990 - DNA, 20 bp, Homo sapiens
caacggccctgcagccagct

SEQ ID NO: 4007991 - DNA, 15 bp, Homo sapiens
caactatttttccaa

SEQ ID NO: 4007992 - DNA, 19 bp, Homo sapiens
caactccaggaaagagcag

SEQ ID NO: 4007993 - DNA, 24 bp, Homo sapiens
caactctcccctgacctgtgagcc

SEQ ID NO: 4007994 - DNA, 12 bp, Homo sapiens
caactctctcct

SEQ ID NO: 4007995 - DNA, 16 bp, Homo sapiens
caactctgagcccata

SEQ ID NO: 4007996 - DNA, 16 bp, Homo sapiens
caactcttgattatcc

SEQ ID NO: 4007997 - DNA, 13 bp, Homo sapiens
caactctttgtta

SEQ ID NO: 4007998 - DNA, 13 bp, Homo sapiens
caactgaagacaa

SEQ ID NO: 4007999 - DNA, 18 bp, Homo sapiens
caactgaggttcttggga

SEQ ID NO: 4008000 - DNA, 12 bp, Homo sapiens
caactgattgca

SEQ ID NO: 4008001 - DNA, 15 bp, Homo sapiens
caactgccaggctgc

SEQ ID NO: 4008002 - DNA, 18 bp, Homo sapiens
caactgccaggctgcctc

SEQ ID NO: 4008003 - DNA, 11 bp, Homo sapiens
caactgctttg

SEQ ID NO: 4008004 - DNA, 19 bp, Homo sapiens
caactggccctatttagat

SEQ ID NO: 4008005 - DNA, 23 bp, Homo sapiens
caactggccctatttagatgata

SEQ ID NO: 4008006 - DNA, 15 bp, Homo sapiens
caactgtcttcctca

SEQ ID NO: 4008007 - DNA, 16 bp, Homo sapiens
caacttatttaaaaat

SEQ ID NO: 4008008 - DNA, 17 bp, Homo sapiens
caacttatttaaaaata

SEQ ID NO: 4008009 - DNA, 15 bp, Homo sapiens
caacttctcttgctt

SEQ ID NO: 4008010 - DNA, 16 bp, Homo sapiens
caacttgattttttca

SEQ ID NO: 4008011 - DNA, 16 bp, Homo sapiens
caacttgggttcttct

SEQ ID NO: 4008012 - DNA, 16 bp, Homo sapiens
caacttgtaaatacac

SEQ ID NO: 4008013 - DNA, 22 bp, Homo sapiens
caacttgtaaatacaccacctc

SEQ ID NO: 4008014 - DNA, 19 bp, Homo sapiens
caacttgtacttgtttcat

SEQ ID NO: 4008015 - DNA, 17 bp, Homo sapiens
caacttgtctttttctg

SEQ ID NO: 4008016 - DNA, 20 bp, Homo sapiens
caacttttgtgtaatgaaaa

SEQ ID NO: 4008017 - DNA, 21 bp, Homo sapiens
caacttttgtgtaatgaaaat

SEQ ID NO: 4008018 - DNA, 12 bp, Homo sapiens
caagaaacagcc

SEQ ID NO: 4008019 - DNA, 19 bp, Homo sapiens
caagaaacagccagcaaga

SEQ ID NO: 4008020 - DNA, 20 bp, Homo sapiens
caagaaagatgaagcttgga

SEQ ID NO: 4008021 - DNA, 19 bp, Homo sapiens
caagaaagcttcttcagag

SEQ ID NO: 4008022 - DNA, 20 bp, Homo sapiens
caagaaataaaaggaagcca

SEQ ID NO: 4008023 - DNA, 14 bp, Homo sapiens
caagaaatccctgt

SEQ ID NO: 4008024 - DNA, 15 bp, Homo sapiens
caagaaatccctgtt

SEQ ID NO: 4008025 - DNA, 13 bp, Homo sapiens
caagaactgcatg

SEQ ID NO: 4008026 - DNA, 18 bp, Homo sapiens
caagaactgcatggacct

SEQ ID NO: 4008027 - DNA, 23 bp, Homo sapiens
caagaactgcatggacctaacat

SEQ ID NO: 4008028 - DNA, 13 bp, Homo sapiens
caagaagaaaaag

SEQ ID NO: 4008029 - DNA, 12 bp, Homo sapiens
caagaagaaata

SEQ ID NO: 4008030 - DNA, 12 bp, Homo sapiens
caagaagacatg

SEQ ID NO: 4008031 - DNA, 18 bp, Homo sapiens
caaggacattgccccaag

SEQ ID NO: 4008032 - DNA, 14 bp, Homo sapiens
caaggaccaggact

SEQ ID NO: 4008033 - DNA, 15 bp, Homo sapiens
caaggaccaggactc

SEQ ID NO: 4008034 - DNA, 21 bp, Homo sapiens
caaggactacgttaagggaag

SEQ ID NO: 4008035 - DNA, 23 bp, Homo sapiens
caaggactcccggagcctgtgca

SEQ ID NO: 4008036 - DNA, 15 bp, Homo sapiens
caaggactgagggac

SEQ ID NO: 4008037 - DNA, 22 bp, Homo sapiens
caaggactgagggactctgaag

SEQ ID NO: 4008038 - DNA, 18 bp, Homo sapiens
caaggacttgaaagcatc

SEQ ID NO: 4008039 - DNA, 21 bp, Homo sapiens
caaggagaatatgataaaaca

SEQ ID NO: 4008040 - DNA, 22 bp, Homo sapiens
caaggagaccaagtcctggcta

SEQ ID NO: 4008041 - DNA, 18 bp, Homo sapiens
caaggagcaaacactgaa

SEQ ID NO: 4008042 - DNA, 21 bp, Homo sapiens
caaggagcaaacactgaaata

SEQ ID NO: 4008043 - DNA, 15 bp, Homo sapiens
caaggagcacaagcc

SEQ ID NO: 4008044 - DNA, 15 bp, Homo sapiens
caaggaggtagagag

SEQ ID NO: 4008045 - DNA, 20 bp, Homo sapiens
caaggatagatgctggccca

SEQ ID NO: 4008046 - DNA, 22 bp, Homo sapiens
caaggatagatgctggcccagg

SEQ ID NO: 4008047 - DNA, 18 bp, Homo sapiens
caaggatcggactctgcc

SEQ ID NO: 4008048 - DNA, 18 bp, Homo sapiens
caaggcaggttggatggg

SEQ ID NO: 4008049 - DNA, 18 bp, Homo sapiens
caaggccagagtggcctg

SEQ ID NO: 4008050 - DNA, 21 bp, Homo sapiens
caaggccagagtggcctggcc

SEQ ID NO: 4008051 - DNA, 22 bp, Homo sapiens
caaggccagagtggcctggcca

SEQ ID NO: 4008052 - DNA, 17 bp, Homo sapiens
caaggccagtccccatt

SEQ ID NO: 4008053 - DNA, 13 bp, Homo sapiens
caaggccctgctg

SEQ ID NO: 4008054 - DNA, 17 bp, Homo sapiens
caaggccctgctgccca

SEQ ID NO: 4008055 - DNA, 24 bp, Homo sapiens
caaggccgagcgttcccagcaggg

SEQ ID NO: 4008056 - DNA, 22 bp, Homo sapiens
caaggctgggtaatgtgaaggc

SEQ ID NO: 4008057 - DNA, 14 bp, Homo sapiens
caagggaaaggggt

SEQ ID NO: 4008058 - DNA, 20 bp, Homo sapiens
caagggagaaaagagaaacc

SEQ ID NO: 4008059 - DNA, 20 bp, Homo sapiens
caagggccatgctgaaggga

SEQ ID NO: 4008060 - DNA, 21 bp, Homo sapiens
caagggccatgctgaagggac

SEQ ID NO: 4008061 - DNA, 18 bp, Homo sapiens
caaggggcccaaattctt

SEQ ID NO: 4008062 - DNA, 14 bp, Homo sapiens
caagggggacacat

SEQ ID NO: 4008063 - DNA, 15 bp, Homo sapiens
caagggggactgtct

SEQ ID NO: 4008064 - DNA, 23 bp, Homo sapiens
caagggtcattatgggttaggca

SEQ ID NO: 4008065 - DNA, 16 bp, Homo sapiens
caagggttgagagcca

SEQ ID NO: 4008066 - DNA, 23 bp, Homo sapiens
caaggtccactccctgctccacg

SEQ ID NO: 4008067 - DNA, 20 bp, Homo sapiens
caaggtcctctgtcagtcac

SEQ ID NO: 4008068 - DNA, 10 bp, Homo sapiens
caaggtcctg

SEQ ID NO: 4008069 - DNA, 16 bp, Homo sapiens
caaggtcttcagccat

SEQ ID NO: 4008070 - DNA, 21 bp, Homo sapiens
caaggtggcagatgtcttccc

SEQ ID NO: 4008071 - DNA, 21 bp, Homo sapiens
caaggtggcctttgtgctgcg

SEQ ID NO: 4008072 - DNA, 20 bp, Homo sapiens
caaggtggggattgcccctg

SEQ ID NO: 4008073 - DNA, 15 bp, Homo sapiens
caaggttccctctga

SEQ ID NO: 4008074 - DNA, 16 bp, Homo sapiens
caaggttccctctgag

SEQ ID NO: 4008075 - DNA, 19 bp, Homo sapiens
caaggttccctctgagaat

SEQ ID NO: 4008076 - DNA, 17 bp, Homo sapiens
caaggttggagcccagg

SEQ ID NO: 4008077 - DNA, 19 bp, Homo sapiens
caaggttggcaccccagct

SEQ ID NO: 4008078 - DNA, 10 bp, Homo sapiens
caagtaaaaa

SEQ ID NO: 4008079 - DNA, 13 bp, Homo sapiens
caagtaaacattc

SEQ ID NO: 4008080 - DNA, 14 bp, Homo sapiens
caagtaagaagaca

SEQ ID NO: 4008081 - DNA, 16 bp, Homo sapiens
caagtaagaagacatg

SEQ ID NO: 4008082 - DNA, 22 bp, Homo sapiens
caagtaagaagacatgaaccaa

SEQ ID NO: 4008083 - DNA, 20 bp, Homo sapiens
caagtacagcggctcccctc

SEQ ID NO: 4008084 - DNA, 13 bp, Homo sapiens
caagtagataaat

SEQ ID NO: 4008085 - DNA, 15 bp, Homo sapiens
caagtagctttccac

SEQ ID NO: 4008086 - DNA, 17 bp, Homo sapiens
caagtatcttctatttt

SEQ ID NO: 4008087 - DNA, 19 bp, Homo sapiens
caagtatttgggaagtgaa

SEQ ID NO: 4008088 - DNA, 14 bp, Homo sapiens
caagtcaaattaat

SEQ ID NO: 4008089 - DNA, 16 bp, Homo sapiens
caagtcaaattaataa

SEQ ID NO: 4008090 - DNA, 13 bp, Homo sapiens
caagtcacacagc

SEQ ID NO: 4008091 - DNA, 18 bp, Homo sapiens
caagtcacatgcgtaaac

SEQ ID NO: 4008092 - DNA, 20 bp, Homo sapiens
caagtcataggttaatattt

SEQ ID NO: 4008093 - DNA, 15 bp, Homo sapiens
caagtccaataagac

SEQ ID NO: 4008094 - DNA, 18 bp, Homo sapiens
caagtccaataagacact

SEQ ID NO: 4008095 - DNA, 19 bp, Homo sapiens
caagtccgcagaagccctg

SEQ ID NO: 4008096 - DNA, 18 bp, Homo sapiens
caagtcctgactgggctg

SEQ ID NO: 4008097 - DNA, 19 bp, Homo sapiens
caagtcctgactgggctgg

SEQ ID NO: 4008098 - DNA, 17 bp, Homo sapiens
caagtcctggctacatc

SEQ ID NO: 4008099 - DNA, 23 bp, Homo sapiens
caagtctcagtggcttcatctgt

SEQ ID NO: 4008100 - DNA, 14 bp, Homo sapiens
caagtctctctgtg

SEQ ID NO: 4008101 - DNA, 15 bp, Homo sapiens
caagtctctctgtga

SEQ ID NO: 4008102 - DNA, 19 bp, Homo sapiens
caagtctctgctggcccag

SEQ ID NO: 4008103 - DNA, 22 bp, Homo sapiens
caagtctctgctggcccagcca

SEQ ID NO: 4008104 - DNA, 23 bp, Homo sapiens
caagtctctgctggcccagccaa

SEQ ID NO: 4008105 - DNA, 23 bp, Homo sapiens
caagtcttaacaaaccaacatct

SEQ ID NO: 4008106 - DNA, 23 bp, Homo sapiens
caagtcttgggtctgaatttatt

SEQ ID NO: 4008107 - DNA, 21 bp, Homo sapiens
caagtgaaataacaaaatgga

SEQ ID NO: 4008108 - DNA, 19 bp, Homo sapiens
caagtgaggtgtgtcacaa

SEQ ID NO: 4008109 - DNA, 20 bp, Homo sapiens
caagtgcactttctaatgtt

SEQ ID NO: 4008110 - DNA, 15 bp, Homo sapiens
caagtgccccctcac

SEQ ID NO: 4008111 - DNA, 16 bp, Homo sapiens
caagtgccccctcacc

SEQ ID NO: 4008112 - DNA, 17 bp, Homo sapiens
caagtgccccctcacct

SEQ ID NO: 4008113 - DNA, 18 bp, Homo sapiens
caagtgccttttgctgcg

SEQ ID NO: 4008114 - DNA, 20 bp, Homo sapiens
caagtgccttttgctgcgca

SEQ ID NO: 4008115 - DNA, 20 bp, Homo sapiens
caagtgctgaacagtggagg

SEQ ID NO: 4008116 - DNA, 23 bp, Homo sapiens
caagtggaccttaggccttcctc

SEQ ID NO: 4008117 - DNA, 16 bp, Homo sapiens
caagtggactcagggc

SEQ ID NO: 4008118 - DNA, 18 bp, Homo sapiens
caagtggactcagggcag

SEQ ID NO: 4008119 - DNA, 23 bp, Homo sapiens
caagtggactcagggcagcgcca

SEQ ID NO: 4008120 - DNA, 21 bp, Homo sapiens
caagtggagcctgacagccag

SEQ ID NO: 4008121 - DNA, 23 bp, Homo sapiens
caagtggatgggaatttgtcagc

SEQ ID NO: 4008122 - DNA, 16 bp, Homo sapiens
caagtggtatgaccag

SEQ ID NO: 4008123 - DNA, 18 bp, Homo sapiens
caagtggtgtttattgca

SEQ ID NO: 4008124 - DNA, 23 bp, Homo sapiens
caagtgtggtagggacttaaaaa

SEQ ID NO: 4008125 - DNA, 15 bp, Homo sapiens
caagtgttttggaaa

SEQ ID NO: 4008126 - DNA, 14 bp, Homo sapiens
caagttaaataaat

SEQ ID NO: 4008127 - DNA, 15 bp, Homo sapiens
caagttaacaaggaa

SEQ ID NO: 4008128 - DNA, 18 bp, Homo sapiens
caagttaagagaaacttt

SEQ ID NO: 4008129 - DNA, 16 bp, Homo sapiens
caagttagggtctatg

SEQ ID NO: 4008130 - DNA, 20 bp, Homo sapiens
caagttataaatcaatgtca

SEQ ID NO: 4008131 - DNA, 21 bp, Homo sapiens
caagttatattagtgaagatg

SEQ ID NO: 4008132 - DNA, 19 bp, Homo sapiens
caatggctaattcccagag

SEQ ID NO: 4008133 - DNA, 22 bp, Homo sapiens
caatgggactggagtcagatga

SEQ ID NO: 4008134 - DNA, 21 bp, Homo sapiens
caatgggagctgaggccacac

SEQ ID NO: 4008135 - DNA, 23 bp, Homo sapiens
caatgggagctgaggccacactc

SEQ ID NO: 4008136 - DNA, 19 bp, Homo sapiens
caatgggcactgggatgag

SEQ ID NO: 4008137 - DNA, 14 bp, Homo sapiens
caatgtcagtattt

SEQ ID NO: 4008138 - DNA, 15 bp, Homo sapiens
caatgtgaactttat

SEQ ID NO: 4008139 - DNA, 13 bp, Homo sapiens
caatgtgaccagg

SEQ ID NO: 4008140 - DNA, 13 bp, Homo sapiens
caatgtgcataat

SEQ ID NO: 4008141 - DNA, 22 bp, Homo sapiens
caatgtgcataatgataaaata

SEQ ID NO: 4008142 - DNA, 21 bp, Homo sapiens
caatgtggagtctccctctga

SEQ ID NO: 4008143 - DNA, 22 bp, Homo sapiens
caatgtgtgccgagcccttgcc

SEQ ID NO: 4008144 - DNA, 11 bp, Homo sapiens
caatgttaagg

SEQ ID NO: 4008145 - DNA, 14 bp, Homo sapiens
caatgttaaggaaa

SEQ ID NO: 4008146 - DNA, 16 bp, Homo sapiens
caatgttaaggaaact

SEQ ID NO: 4008147 - DNA, 18 bp, Homo sapiens
caatgttaaggaaactct

SEQ ID NO: 4008148 - DNA, 14 bp, Homo sapiens
caatgttttcttca

SEQ ID NO: 4008149 - DNA, 20 bp, Homo sapiens
caattaaaggtcctgccctc

SEQ ID NO: 4008150 - DNA, 12 bp, Homo sapiens
caattaaatgta

SEQ ID NO: 4008151 - DNA, 15 bp, Homo sapiens
caattaataaaaaat

SEQ ID NO: 4008152 - DNA, 17 bp, Homo sapiens
caattactttagaaaat

SEQ ID NO: 4008153 - DNA, 16 bp, Homo sapiens
caattaggattttgat

SEQ ID NO: 4008154 - DNA, 14 bp, Homo sapiens
caattagtttcctt

SEQ ID NO: 4008155 - DNA, 14 bp, Homo sapiens
caattattggcaaa

SEQ ID NO: 4008156 - DNA, 17 bp, Homo sapiens
caattattgttacacat

SEQ ID NO: 4008157 - DNA, 23 bp, Homo sapiens
caattattgttacacattaagta

SEQ ID NO: 4008158 - DNA, 13 bp, Homo sapiens
caattcctctggg

SEQ ID NO: 4008159 - DNA, 18 bp, Homo sapiens
caattgaagtaaactttt

SEQ ID NO: 4008160 - DNA, 21 bp, Homo sapiens
caattgaattaaattaggaat

SEQ ID NO: 4008161 - DNA, 16 bp, Homo sapiens
caattgtcacttttta

SEQ ID NO: 4008162 - DNA, 14 bp, Homo sapiens
caattgtgctgcca

SEQ ID NO: 4008163 - DNA, 11 bp, Homo sapiens
caatttaaatg

SEQ ID NO: 4008164 - DNA, 13 bp, Homo sapiens
caatttaaatgtt

SEQ ID NO: 4008165 - DNA, 13 bp, Homo sapiens
caatttccctcag

SEQ ID NO: 4008166 - DNA, 21 bp, Homo sapiens
caatttcggattttttccaaa

SEQ ID NO: 4008167 - DNA, 14 bp, Homo sapiens
caatttgatacata

SEQ ID NO: 4008168 - DNA, 15 bp, Homo sapiens
caatttgatacataa

SEQ ID NO: 4008169 - DNA, 16 bp, Homo sapiens
caatttgatacataat

SEQ ID NO: 4008170 - DNA, 23 bp, Homo sapiens
caatttgtaaaaacagcattgct

SEQ ID NO: 4008171 - DNA, 21 bp, Homo sapiens
caattttatccctcacctgta

SEQ ID NO: 4008172 - DNA, 23 bp, Homo sapiens
caattttatgtttttatttatga

SEQ ID NO: 4008173 - DNA, 19 bp, Homo sapiens
caatttttgtctcagaagt

SEQ ID NO: 4008174 - DNA, 21 bp, Homo sapiens
caattttttttttcctcttca

SEQ ID NO: 4008175 - DNA, 16 bp, Homo sapiens
cacaaaacccagacct

SEQ ID NO: 4008176 - DNA, 16 bp, Homo sapiens
cacaaaatgtctcagt

SEQ ID NO: 4008177 - DNA, 13 bp, Homo sapiens
cacaaacacacac

SEQ ID NO: 4008178 - DNA, 13 bp, Homo sapiens
cacaaactgtaaa

SEQ ID NO: 4008179 - DNA, 21 bp, Homo sapiens
cacaaagagttctggaaaaga

SEQ ID NO: 4008180 - DNA, 15 bp, Homo sapiens
cacaaagcagatcct

SEQ ID NO: 4008181 - DNA, 14 bp, Homo sapiens
cacaaatgatgttt

SEQ ID NO: 4008182 - DNA, 15 bp, Homo sapiens
cacaacatttgcaga

SEQ ID NO: 4008183 - DNA, 14 bp, Homo sapiens
cacaacccccagct

SEQ ID NO: 4008184 - DNA, 17 bp, Homo sapiens
cacaacccccagctccc

SEQ ID NO: 4008185 - DNA, 17 bp, Homo sapiens
cacaaccctgttttata

SEQ ID NO: 4008186 - DNA, 18 bp, Homo sapiens
cacaacctctctgatctt

SEQ ID NO: 4008187 - DNA, 14 bp, Homo sapiens
cacaactatttttc

SEQ ID NO: 4008188 - DNA, 13 bp, Homo sapiens
cacaagaatggat

SEQ ID NO: 4008189 - DNA, 22 bp, Homo sapiens
cacaagcaaaaaaaaaaaaaag

SEQ ID NO: 4008190 - DNA, 23 bp, Homo sapiens
cacaagcagagtgcacagctgtc

SEQ ID NO: 4008191 - DNA, 12 bp, Homo sapiens
cacaagctggaa

SEQ ID NO: 4008192 - DNA, 16 bp, Homo sapiens
cacaagctggaagcac

SEQ ID NO: 4008193 - DNA, 12 bp, Homo sapiens
cacaaggacttc

SEQ ID NO: 4008194 - DNA, 14 bp, Homo sapiens
cacaaggacttcct

SEQ ID NO: 4008195 - DNA, 21 bp, Homo sapiens
cacaaggatagatgctggccc

SEQ ID NO: 4008196 - DNA, 18 bp, Homo sapiens
cacaaggctccaagacct

SEQ ID NO: 4008197 - DNA, 15 bp, Homo sapiens
cacaaggctggccag

SEQ ID NO: 4008198 - DNA, 23 bp, Homo sapiens
cacaaggtccactccctgctcca

SEQ ID NO: 4008199 - DNA, 13 bp, Homo sapiens
cacaagtaaacat

SEQ ID NO: 4008200 - DNA, 21 bp, Homo sapiens
cacaagtcctggatgttgtgt

SEQ ID NO: 4008201 - DNA, 14 bp, Homo sapiens
cacaagtcttccag

SEQ ID NO: 4008202 - DNA, 19 bp, Homo sapiens
cacaataacactaaaattt

SEQ ID NO: 4008203 - DNA, 21 bp, Homo sapiens
cacaataacactaaaatttta

SEQ ID NO: 4008204 - DNA, 13 bp, Homo sapiens
cacaataagcaaa

SEQ ID NO: 4008205 - DNA, 19 bp, Homo sapiens
cacaatacagataacatta

SEQ ID NO: 4008206 - DNA, 12 bp, Homo sapiens
cacaatatgaat

SEQ ID NO: 4008207 - DNA, 14 bp, Homo sapiens
cacaatatgtatgc

SEQ ID NO: 4008208 - DNA, 14 bp, Homo sapiens
cacaatccctgggg

SEQ ID NO: 4008209 - DNA, 20 bp, Homo sapiens
cacaatcctaacacattatc

SEQ ID NO: 4008210 - DNA, 23 bp, Homo sapiens
cacaatcctaacacattatcggg

SEQ ID NO: 4008211 - DNA, 23 bp, Homo sapiens
cacaatgagattgaatttcactg

SEQ ID NO: 4008212 - DNA, 18 bp, Homo sapiens
cacaatgcagttctgagc

SEQ ID NO: 4008213 - DNA, 17 bp, Homo sapiens
cacaattattggcaaag

SEQ ID NO: 4008214 - DNA, 18 bp, Homo sapiens
cacaattattggcaaagt

SEQ ID NO: 4008215 - DNA, 18 bp, Homo sapiens
cacacaaaggtataattt

SEQ ID NO: 4008216 - DNA, 19 bp, Homo sapiens
cacacaaggatagatgctg

SEQ ID NO: 4008217 - DNA, 13 bp, Homo sapiens
cacacacaaacct

SEQ ID NO: 4008218 - DNA, 13 bp, Homo sapiens
cacacacacaaaa

SEQ ID NO: 4008219 - DNA, 13 bp, Homo sapiens
cacacacacacaa

SEQ ID NO: 4008220 - DNA, 15 bp, Homo sapiens
cacacacacacacag

SEQ ID NO: 4008221 - DNA, 12 bp, Homo sapiens
cacacacacact

SEQ ID NO: 4008222 - DNA, 12 bp, Homo sapiens
cacacacacagg

SEQ ID NO: 4008223 - DNA, 13 bp, Homo sapiens
cacacacacaggt

SEQ ID NO: 4008224 - DNA, 14 bp, Homo sapiens
cacacacacgcacg

SEQ ID NO: 4008225 - DNA, 15 bp, Homo sapiens
cacacaccctgaggt

SEQ ID NO: 4008226 - DNA, 13 bp, Homo sapiens
cacacacctccga

SEQ ID NO: 4008227 - DNA, 23 bp, Homo sapiens
cacacacctccgagacagtccag

SEQ ID NO: 4008228 - DNA, 15 bp, Homo sapiens
cacacacgcacgcac

SEQ ID NO: 4008229 - DNA, 17 bp, Homo sapiens
cacacacgcacgcacac

SEQ ID NO: 4008230 - DNA, 15 bp, Homo sapiens
cacacactccctgct

SEQ ID NO: 4008231 - DNA, 14 bp, Homo sapiens
cacacactgatgct

SEQ ID NO: 4008232 - DNA, 16 bp, Homo sapiens
cacacagatacacaca

SEQ ID NO: 4008233 - DNA, 12 bp, Homo sapiens
cacacagcagcc

SEQ ID NO: 4008234 - DNA, 13 bp, Homo sapiens
cacacagcagccc

SEQ ID NO: 4008235 - DNA, 20 bp, Homo sapiens
cacacagcagccccccagca

SEQ ID NO: 4008236 - DNA, 16 bp, Homo sapiens
cacagctcccttctgt

SEQ ID NO: 4008237 - DNA, 21 bp, Homo sapiens
cacagctccttttccagagca

SEQ ID NO: 4008238 - DNA, 16 bp, Homo sapiens
cacagctcttcacacc

SEQ ID NO: 4008239 - DNA, 16 bp, Homo sapiens
cacagctgagcactta

SEQ ID NO: 4008240 - DNA, 13 bp, Homo sapiens
cacagctgcccta

SEQ ID NO: 4008241 - DNA, 15 bp, Homo sapiens
cacagctgccctagc

SEQ ID NO: 4008242 - DNA, 18 bp, Homo sapiens
cacagctgctgttctcag

SEQ ID NO: 4008243 - DNA, 14 bp, Homo sapiens
cacagctgctttct

SEQ ID NO: 4008244 - DNA, 20 bp, Homo sapiens
cacagctgctttctgttgtc

SEQ ID NO: 4008245 - DNA, 13 bp, Homo sapiens
cacagctggatct

SEQ ID NO: 4008246 - DNA, 13 bp, Homo sapiens
cacagctggctct

SEQ ID NO: 4008247 - DNA, 17 bp, Homo sapiens
cacagctgttcttctgt

SEQ ID NO: 4008248 - DNA, 22 bp, Homo sapiens
cacagctgttcttctgttctgc

SEQ ID NO: 4008249 - DNA, 15 bp, Homo sapiens
cacagcttagatttc

SEQ ID NO: 4008250 - DNA, 19 bp, Homo sapiens
cacagcttagatttcatag

SEQ ID NO: 4008251 - DNA, 23 bp, Homo sapiens
cacaggaaggaggggagagacag

SEQ ID NO: 4008252 - DNA, 23 bp, Homo sapiens
cacaggacaggaaagtggcacct

SEQ ID NO: 4008253 - DNA, 22 bp, Homo sapiens
cacaggacatgcggtagccagc

SEQ ID NO: 4008254 - DNA, 15 bp, Homo sapiens
cacaggaggccagtg

SEQ ID NO: 4008255 - DNA, 20 bp, Homo sapiens
cacaggagtgtcctcttccc

SEQ ID NO: 4008256 - DNA, 24 bp, Homo sapiens
cacaggatcctattctcaccagga

SEQ ID NO: 4008257 - DNA, 16 bp, Homo sapiens
cacaggatgctggcct

SEQ ID NO: 4008258 - DNA, 17 bp, Homo sapiens
cacaggcacgggtccct

SEQ ID NO: 4008259 - DNA, 16 bp, Homo sapiens
cacaggcagctttcta

SEQ ID NO: 4008260 - DNA, 17 bp, Homo sapiens
cacaggccctggagaag

SEQ ID NO: 4008261 - DNA, 14 bp, Homo sapiens
cacaggccctggct

SEQ ID NO: 4008262 - DNA, 15 bp, Homo sapiens
cacaggcccttcctc

SEQ ID NO: 4008263 - DNA, 23 bp, Homo sapiens
cacaggcccttcctctccactgc

SEQ ID NO: 4008264 - DNA, 13 bp, Homo sapiens
cacagggcaccag

SEQ ID NO: 4008265 - DNA, 20 bp, Homo sapiens
cacagggcaccagaggccga

SEQ ID NO: 4008266 - DNA, 17 bp, Homo sapiens
cacaggggacacccaga

SEQ ID NO: 4008267 - DNA, 20 bp, Homo sapiens
cacagggggattctgagcag

SEQ ID NO: 4008268 - DNA, 21 bp, Homo sapiens
cacagggggattctgagcagt

SEQ ID NO: 4008269 - DNA, 15 bp, Homo sapiens
cacagggtctgctct

SEQ ID NO: 4008270 - DNA, 17 bp, Homo sapiens
cacagggtctgctcttt

SEQ ID NO: 4008271 - DNA, 23 bp, Homo sapiens
cacagggtctgctctttctctgc

SEQ ID NO: 4008272 - DNA, 14 bp, Homo sapiens
cacagggttgggcc

SEQ ID NO: 4008273 - DNA, 16 bp, Homo sapiens
cacagggttgggccca

SEQ ID NO: 4008274 - DNA, 18 bp, Homo sapiens
cacagggttgggcccaga

SEQ ID NO: 4008275 - DNA, 22 bp, Homo sapiens
cacagggttgggcccagatctg

SEQ ID NO: 4008276 - DNA, 23 bp, Homo sapiens
cacagggttgggcccagatctgg

SEQ ID NO: 4008277 - DNA, 17 bp, Homo sapiens
cacaggtggggactggg

SEQ ID NO: 4008278 - DNA, 20 bp, Homo sapiens
cacaggtggggactgggcac

SEQ ID NO: 4008279 - DNA, 20 bp, Homo sapiens
cacagtacagcatgtgcctt

SEQ ID NO: 4008280 - DNA, 16 bp, Homo sapiens
cacagtcaaaataatt

SEQ ID NO: 4008281 - DNA, 18 bp, Homo sapiens
cacagtcagcatgcttcc

SEQ ID NO: 4008282 - DNA, 15 bp, Homo sapiens
cacagtccagaccca

SEQ ID NO: 4008283 - DNA, 17 bp, Homo sapiens
cacagtgataccagttc

SEQ ID NO: 4008284 - DNA, 18 bp, Homo sapiens
cacagtgcatctcagccc

SEQ ID NO: 4008285 - DNA, 19 bp, Homo sapiens
cacagtgcatctcagccca

SEQ ID NO: 4008286 - DNA, 19 bp, Homo sapiens
cacagtggactcagcagtg

SEQ ID NO: 4008287 - DNA, 20 bp, Homo sapiens
cacagtgtaatccaggggtg

SEQ ID NO: 4008288 - DNA, 21 bp, Homo sapiens
cacagtgtaatccaggggtgt

SEQ ID NO: 4008289 - DNA, 14 bp, Homo sapiens
cacagtgttgccca

SEQ ID NO: 4008290 - DNA, 21 bp, Homo sapiens
cacagttctttgggccagaca

SEQ ID NO: 4008291 - DNA, 18 bp, Homo sapiens
cacagttgaagggagggg

SEQ ID NO: 4008292 - DNA, 22 bp, Homo sapiens
cacagttgccaccacctctgtg

SEQ ID NO: 4008293 - DNA, 22 bp, Homo sapiens
cacataaacaattcatgccttt

SEQ ID NO: 4008294 - DNA, 22 bp, Homo sapiens
cacataaggacgtgtgtaaata

SEQ ID NO: 4008295 - DNA, 15 bp, Homo sapiens
cacatacattaaaac

SEQ ID NO: 4008296 - DNA, 16 bp, Homo sapiens
cacatactgtgttcca

SEQ ID NO: 4008297 - DNA, 15 bp, Homo sapiens
cacatagactgtgcg

SEQ ID NO: 4008298 - DNA, 21 bp, Homo sapiens
cacatagtgatggttcccctg

SEQ ID NO: 4008299 - DNA, 10 bp, Homo sapiens
cacatcagat

SEQ ID NO: 4008300 - DNA, 21 bp, Homo sapiens
cacatccacacacgcaggaac

SEQ ID NO: 4008301 - DNA, 18 bp, Homo sapiens
cacatccacagtctcccc

SEQ ID NO: 4008302 - DNA, 12 bp, Homo sapiens
cacatccatccc

SEQ ID NO: 4008303 - DNA, 16 bp, Homo sapiens
cacatccatccctcca

SEQ ID NO: 4008304 - DNA, 21 bp, Homo sapiens
cacatcccaccccatcctcca

SEQ ID NO: 4008305 - DNA, 22 bp, Homo sapiens
cacatcccaggcttcaccctga

SEQ ID NO: 4008306 - DNA, 18 bp, Homo sapiens
cacatcgcacactggggc

SEQ ID NO: 4008307 - DNA, 15 bp, Homo sapiens
cacatctttatctgt

SEQ ID NO: 4008308 - DNA, 22 bp, Homo sapiens
cacatctttatctgttcttgct

SEQ ID NO: 4008309 - DNA, 13 bp, Homo sapiens
cacatgaaagttt

SEQ ID NO: 4008310 - DNA, 15 bp, Homo sapiens
cacatgaatgcagtc

SEQ ID NO: 4008311 - DNA, 23 bp, Homo sapiens
cacatgacctgatcactagcctg

SEQ ID NO: 4008312 - DNA, 22 bp, Homo sapiens
cacatgaggccatctcaggaga

SEQ ID NO: 4008313 - DNA, 23 bp, Homo sapiens
cacatgaggccatctcaggagat

SEQ ID NO: 4008314 - DNA, 16 bp, Homo sapiens
cacatgattgtataag

SEQ ID NO: 4008315 - DNA, 16 bp, Homo sapiens
cacatgccacctggca

SEQ ID NO: 4008316 - DNA, 12 bp, Homo sapiens
cacatgccactg

SEQ ID NO: 4008317 - DNA, 16 bp, Homo sapiens
cacatgccactgcctg

SEQ ID NO: 4008318 - DNA, 16 bp, Homo sapiens
cacatgcctatattat

SEQ ID NO: 4008319 - DNA, 21 bp, Homo sapiens
cacatgctaggatgcggaaat

SEQ ID NO: 4008320 - DNA, 22 bp, Homo sapiens
cacatggagccccctctgccgg

SEQ ID NO: 4008321 - DNA, 19 bp, Homo sapiens
cacattaaaaaatgaaata

SEQ ID NO: 4008322 - DNA, 22 bp, Homo sapiens
cacattaaaaaatgaaatattt

SEQ ID NO: 4008323 - DNA, 22 bp, Homo sapiens
cacattaagtaatcaataaaga

SEQ ID NO: 4008324 - DNA, 20 bp, Homo sapiens
cacattagattttattttac

SEQ ID NO: 4008325 - DNA, 17 bp, Homo sapiens
cacattatcgggagcag

SEQ ID NO: 4008326 - DNA, 23 bp, Homo sapiens
cacattatcgggagcagtgtctt

SEQ ID NO: 4008327 - DNA, 14 bp, Homo sapiens
cacattatgtatct

SEQ ID NO: 4008328 - DNA, 13 bp, Homo sapiens
cacattatttcta

SEQ ID NO: 4008329 - DNA, 15 bp, Homo sapiens
cacattatttgcatg

SEQ ID NO: 4008330 - DNA, 17 bp, Homo sapiens
cacattcaggaagatga

SEQ ID NO: 4008331 - DNA, 23 bp, Homo sapiens
cacattcccccaccagctgcagc

SEQ ID NO: 4008332 - DNA, 20 bp, Homo sapiens
cacattcgacataccccact

SEQ ID NO: 4008333 - DNA, 22 bp, Homo sapiens
cacattgaccgcaactcacaca

SEQ ID NO: 4008334 - DNA, 18 bp, Homo sapiens
cacattgcattctattgc

SEQ ID NO: 4008335 - DNA, 19 bp, Homo sapiens
cacattgcattctattgcc

SEQ ID NO: 4008336 - DNA, 17 bp, Homo sapiens
cacatttcactgtctgt

SEQ ID NO: 4008337 - DNA, 12 bp, Homo sapiens
cacatttctgat

SEQ ID NO: 4008338 - DNA, 17 bp, Homo sapiens
caccccttatccaggac

SEQ ID NO: 4008339 - DNA, 18 bp, Homo sapiens
caccccttctctcctccc

SEQ ID NO: 4008340 - DNA, 14 bp, Homo sapiens
cacccgaaatgcca

SEQ ID NO: 4008341 - DNA, 18 bp, Homo sapiens
cacccgaaatgccacgtg

SEQ ID NO: 4008342 - DNA, 12 bp, Homo sapiens
cacccgacctgg

SEQ ID NO: 4008343 - DNA, 14 bp, Homo sapiens
cacccgactcctca

SEQ ID NO: 4008344 - DNA, 15 bp, Homo sapiens
cacccgactcctcaa

SEQ ID NO: 4008345 - DNA, 12 bp, Homo sapiens
cacccggcctct

SEQ ID NO: 4008346 - DNA, 13 bp, Homo sapiens
cacccggcctctt

SEQ ID NO: 4008347 - DNA, 19 bp, Homo sapiens
cacccgggggagcccagtg

SEQ ID NO: 4008348 - DNA, 19 bp, Homo sapiens
cacccgttctgctggcctg

SEQ ID NO: 4008349 - DNA, 17 bp, Homo sapiens
caccctagtcccttccc

SEQ ID NO: 4008350 - DNA, 20 bp, Homo sapiens
caccctagtcccttcccctc

SEQ ID NO: 4008351 - DNA, 14 bp, Homo sapiens
caccctcacacaca

SEQ ID NO: 4008352 - DNA, 17 bp, Homo sapiens
caccctcacacacacag

SEQ ID NO: 4008353 - DNA, 14 bp, Homo sapiens
caccctcagggagc

SEQ ID NO: 4008354 - DNA, 17 bp, Homo sapiens
caccctccacctcttca

SEQ ID NO: 4008355 - DNA, 16 bp, Homo sapiens
caccctccccttccca

SEQ ID NO: 4008356 - DNA, 20 bp, Homo sapiens
caccctccccttcccagggc

SEQ ID NO: 4008357 - DNA, 15 bp, Homo sapiens
caccctccctgactg

SEQ ID NO: 4008358 - DNA, 19 bp, Homo sapiens
caccctccctgactggcct

SEQ ID NO: 4008359 - DNA, 15 bp, Homo sapiens
caccctcctcctctt

SEQ ID NO: 4008360 - DNA, 12 bp, Homo sapiens
caccctcctgcc

SEQ ID NO: 4008361 - DNA, 17 bp, Homo sapiens
caccctcctgccccaca

SEQ ID NO: 4008362 - DNA, 14 bp, Homo sapiens
caccctccttccca

SEQ ID NO: 4008363 - DNA, 22 bp, Homo sapiens
caccctgatttaggagaagcca

SEQ ID NO: 4008364 - DNA, 19 bp, Homo sapiens
caccctgccccaccccacc

SEQ ID NO: 4008365 - DNA, 22 bp, Homo sapiens
caccctgccccaccccacctcc

SEQ ID NO: 4008366 - DNA, 12 bp, Homo sapiens
caccctgcctta

SEQ ID NO: 4008367 - DNA, 17 bp, Homo sapiens
caccctgcgcctccaga

SEQ ID NO: 4008368 - DNA, 21 bp, Homo sapiens
caccctggccgagtccaagct

SEQ ID NO: 4008369 - DNA, 21 bp, Homo sapiens
caccctggcctgaactgagga

SEQ ID NO: 4008370 - DNA, 17 bp, Homo sapiens
caccctgggagacagac

SEQ ID NO: 4008371 - DNA, 12 bp, Homo sapiens
caccctgggagc

SEQ ID NO: 4008372 - DNA, 14 bp, Homo sapiens
caccctggggcctg

SEQ ID NO: 4008373 - DNA, 15 bp, Homo sapiens
caccctggggcctgg

SEQ ID NO: 4008374 - DNA, 19 bp, Homo sapiens
caccctggggcctggacct

SEQ ID NO: 4008375 - DNA, 22 bp, Homo sapiens
caccctggggcctggacctgcc

SEQ ID NO: 4008376 - DNA, 15 bp, Homo sapiens
caccctggtgggcca

SEQ ID NO: 4008377 - DNA, 22 bp, Homo sapiens
caccctgtacctcatcccatga

SEQ ID NO: 4008378 - DNA, 21 bp, Homo sapiens
caccctgtactgttctgtgtc

SEQ ID NO: 4008379 - DNA, 17 bp, Homo sapiens
caccctgtctaaaaaac

SEQ ID NO: 4008380 - DNA, 15 bp, Homo sapiens
caccctgtgcagaag

SEQ ID NO: 4008381 - DNA, 15 bp, Homo sapiens
caccctgtgccatca

SEQ ID NO: 4008382 - DNA, 15 bp, Homo sapiens
caccctgtggccctg

SEQ ID NO: 4008383 - DNA, 19 bp, Homo sapiens
cacccttggacaagacaaa

SEQ ID NO: 4008384 - DNA, 12 bp, Homo sapiens
cacccttggcct

SEQ ID NO: 4008385 - DNA, 13 bp, Homo sapiens
cacccttggcctg

SEQ ID NO: 4008386 - DNA, 15 bp, Homo sapiens
cacccttggcctgtc

SEQ ID NO: 4008387 - DNA, 18 bp, Homo sapiens
cacccttggcctgtctca

SEQ ID NO: 4008388 - DNA, 13 bp, Homo sapiens
cacccttgttcca

SEQ ID NO: 4008389 - DNA, 22 bp, Homo sapiens
caccgaagtggactggcccctg

SEQ ID NO: 4008390 - DNA, 23 bp, Homo sapiens
caccgaagtggactggcccctgg

SEQ ID NO: 4008391 - DNA, 18 bp, Homo sapiens
caccgaccaactgcccta

SEQ ID NO: 4008392 - DNA, 19 bp, Homo sapiens
caccgacgcgtctcctgtt

SEQ ID NO: 4008393 - DNA, 14 bp, Homo sapiens
caccgatggagccc

SEQ ID NO: 4008394 - DNA, 16 bp, Homo sapiens
caccgccacgtcccag

SEQ ID NO: 4008395 - DNA, 19 bp, Homo sapiens
caccgccacgtcccagcat

SEQ ID NO: 4008396 - DNA, 12 bp, Homo sapiens
caccgctggccc

SEQ ID NO: 4008397 - DNA, 18 bp, Homo sapiens
caccggccgatggagaca

SEQ ID NO: 4008398 - DNA, 18 bp, Homo sapiens
caccgggacagacctgga

SEQ ID NO: 4008399 - DNA, 17 bp, Homo sapiens
caccgggagcctccccc

SEQ ID NO: 4008400 - DNA, 19 bp, Homo sapiens
caccgggagcctccccctc

SEQ ID NO: 4008401 - DNA, 20 bp, Homo sapiens
caccgggcatgtctgcctgg

SEQ ID NO: 4008402 - DNA, 21 bp, Homo sapiens
caccgggcatgtctgcctgga

SEQ ID NO: 4008403 - DNA, 16 bp, Homo sapiens
caccggtcagtgcctt

SEQ ID NO: 4008404 - DNA, 18 bp, Homo sapiens
caccggtcagtgcctttt

SEQ ID NO: 4008405 - DNA, 23 bp, Homo sapiens
caccgtcatggcttaatgtttat

SEQ ID NO: 4008406 - DNA, 15 bp, Homo sapiens
caccgtgaaccagag

SEQ ID NO: 4008407 - DNA, 16 bp, Homo sapiens
caccgtgaaccagagg

SEQ ID NO: 4008408 - DNA, 13 bp, Homo sapiens
caccgtgcctggc

SEQ ID NO: 4008409 - DNA, 16 bp, Homo sapiens
caccgtgcctggccag

SEQ ID NO: 4008410 - DNA, 23 bp, Homo sapiens
caccgtgtcaagctgctctgagc

SEQ ID NO: 4008411 - DNA, 20 bp, Homo sapiens
cacctaaaggtgtatttaaa

SEQ ID NO: 4008412 - DNA, 20 bp, Homo sapiens
cacctaatccaggcagatcc

SEQ ID NO: 4008413 - DNA, 21 bp, Homo sapiens
cacctaatccaggcagatcca

SEQ ID NO: 4008414 - DNA, 12 bp, Homo sapiens
cacctactgagt

SEQ ID NO: 4008415 - DNA, 13 bp, Homo sapiens
cacctatgttatt

SEQ ID NO: 4008416 - DNA, 22 bp, Homo sapiens
cacctatgttattttgtgtaca

SEQ ID NO: 4008417 - DNA, 13 bp, Homo sapiens
cacctatttccat

SEQ ID NO: 4008418 - DNA, 15 bp, Homo sapiens
cacctcaagaccccc

SEQ ID NO: 4008419 - DNA, 21 bp, Homo sapiens
cacctcaccaaggatcggact

SEQ ID NO: 4008420 - DNA, 16 bp, Homo sapiens
cacctcacccggcctc

SEQ ID NO: 4008421 - DNA, 12 bp, Homo sapiens
cacctcagggca

SEQ ID NO: 4008422 - DNA, 17 bp, Homo sapiens
cacctcagttcccttgg

SEQ ID NO: 4008423 - DNA, 21 bp, Homo sapiens
cacctcatgcccaccccctgc

SEQ ID NO: 4008424 - DNA, 12 bp, Homo sapiens
cacctccaccca

SEQ ID NO: 4008425 - DNA, 14 bp, Homo sapiens
cacctccacccagc

SEQ ID NO: 4008426 - DNA, 15 bp, Homo sapiens
cacctccacccagcc

SEQ ID NO: 4008427 - DNA, 17 bp, Homo sapiens
cacctccacccagcccc

SEQ ID NO: 4008428 - DNA, 18 bp, Homo sapiens
cacctccacccagcccct

SEQ ID NO: 4008429 - DNA, 14 bp, Homo sapiens
cacctccaggcctg

SEQ ID NO: 4008430 - DNA, 21 bp, Homo sapiens
cacctccattaaagtctgaat

SEQ ID NO: 4008431 - DNA, 12 bp, Homo sapiens
cacctccccaca

SEQ ID NO: 4008432 - DNA, 10 bp, Homo sapiens
cacctccctc

SEQ ID NO: 4008433 - DNA, 14 bp, Homo sapiens
cacctccctgaccc

SEQ ID NO: 4008434 - DNA, 15 bp, Homo sapiens
cacctctccaggtgc

SEQ ID NO: 4008435 - DNA, 19 bp, Homo sapiens
cacctctccaggtgctcat

SEQ ID NO: 4008436 - DNA, 23 bp, Homo sapiens
cacctctccctcaacaagggaga

SEQ ID NO: 4008437 - DNA, 13 bp, Homo sapiens
cacctctctcaga

SEQ ID NO: 4008438 - DNA, 13 bp, Homo sapiens
cacctctggactg

SEQ ID NO: 4008439 - DNA, 19 bp, Homo sapiens
cacctctgtcatttgttgt

SEQ ID NO: 4008440 - DNA, 20 bp, Homo sapiens
cacctctgtggcattgaaat

SEQ ID NO: 4008441 - DNA, 18 bp, Homo sapiens
cactaccccacaccagcc

SEQ ID NO: 4008442 - DNA, 20 bp, Homo sapiens
cactaccccatatacacctg

SEQ ID NO: 4008443 - DNA, 13 bp, Homo sapiens
cactactgcagca

SEQ ID NO: 4008444 - DNA, 14 bp, Homo sapiens
cactactgggtgtc

SEQ ID NO: 4008445 - DNA, 15 bp, Homo sapiens
cactactgggtgtca

SEQ ID NO: 4008446 - DNA, 21 bp, Homo sapiens
cactactgggtgtcatttcat

SEQ ID NO: 4008447 - DNA, 12 bp, Homo sapiens
cactagaaaact

SEQ ID NO: 4008448 - DNA, 15 bp, Homo sapiens
cactagaagaaaagc

SEQ ID NO: 4008449 - DNA, 19 bp, Homo sapiens
cactagaagaaaagcccat

SEQ ID NO: 4008450 - DNA, 18 bp, Homo sapiens
cactagaatggataaaat

SEQ ID NO: 4008451 - DNA, 19 bp, Homo sapiens
cactagaatggataaaata

SEQ ID NO: 4008452 - DNA, 17 bp, Homo sapiens
cactagcctctccagga

SEQ ID NO: 4008453 - DNA, 20 bp, Homo sapiens
cactaggaatcccagaggtg

SEQ ID NO: 4008454 - DNA, 13 bp, Homo sapiens
cactagtgccaat

SEQ ID NO: 4008455 - DNA, 23 bp, Homo sapiens
cactagtgtcaggcccccagtgg

SEQ ID NO: 4008456 - DNA, 19 bp, Homo sapiens
cactataaatggtgttttt

SEQ ID NO: 4008457 - DNA, 15 bp, Homo sapiens
cactatcttcttcaa

SEQ ID NO: 4008458 - DNA, 17 bp, Homo sapiens
cactatctttctgataa

SEQ ID NO: 4008459 - DNA, 19 bp, Homo sapiens
cactatctttctgataaca

SEQ ID NO: 4008460 - DNA, 21 bp, Homo sapiens
cactatgaagatgtttcaaaa

SEQ ID NO: 4008461 - DNA, 17 bp, Homo sapiens
cactatgaagctacctc

SEQ ID NO: 4008462 - DNA, 20 bp, Homo sapiens
cactatggtatgctggccag

SEQ ID NO: 4008463 - DNA, 19 bp, Homo sapiens
cactcaaattaatctttct

SEQ ID NO: 4008464 - DNA, 18 bp, Homo sapiens
cactcaactctgagccca

SEQ ID NO: 4008465 - DNA, 13 bp, Homo sapiens
cactcaccccctt

SEQ ID NO: 4008466 - DNA, 15 bp, Homo sapiens
cactcagcacaaggc

SEQ ID NO: 4008467 - DNA, 21 bp, Homo sapiens
cactcaggaggctgaggcagg

SEQ ID NO: 4008468 - DNA, 15 bp, Homo sapiens
cactcaggattggga

SEQ ID NO: 4008469 - DNA, 12 bp, Homo sapiens
cactcaggcctg

SEQ ID NO: 4008470 - DNA, 15 bp, Homo sapiens
cactcaggcctgtgc

SEQ ID NO: 4008471 - DNA, 16 bp, Homo sapiens
cactcaggcctgtgcc

SEQ ID NO: 4008472 - DNA, 18 bp, Homo sapiens
cactcaggcctgtgccca

SEQ ID NO: 4008473 - DNA, 14 bp, Homo sapiens
cactcagtgagcct

SEQ ID NO: 4008474 - DNA, 16 bp, Homo sapiens
cactcagtttatgctg

SEQ ID NO: 4008475 - DNA, 19 bp, Homo sapiens
cactcattgctgagcctct

SEQ ID NO: 4008476 - DNA, 21 bp, Homo sapiens
cactcattgctgagcctctgc

SEQ ID NO: 4008477 - DNA, 16 bp, Homo sapiens
cactccagacccctgg

SEQ ID NO: 4008478 - DNA, 17 bp, Homo sapiens
cactccagacccctggc

SEQ ID NO: 4008479 - DNA, 13 bp, Homo sapiens
cactccagcctgg

SEQ ID NO: 4008480 - DNA, 15 bp, Homo sapiens
cactccagcctgggg

SEQ ID NO: 4008481 - DNA, 13 bp, Homo sapiens
cactccagtgcca

SEQ ID NO: 4008482 - DNA, 13 bp, Homo sapiens
cactccatctcct

SEQ ID NO: 4008483 - DNA, 19 bp, Homo sapiens
cactcccaaggttggagcc

SEQ ID NO: 4008484 - DNA, 16 bp, Homo sapiens
cactcccacctcaccc

SEQ ID NO: 4008485 - DNA, 13 bp, Homo sapiens
cactccccaagga

SEQ ID NO: 4008486 - DNA, 14 bp, Homo sapiens
cactccccaaggaa

SEQ ID NO: 4008487 - DNA, 19 bp, Homo sapiens
cactccccagggagctctg

SEQ ID NO: 4008488 - DNA, 16 bp, Homo sapiens
cactccccatgccacg

SEQ ID NO: 4008489 - DNA, 18 bp, Homo sapiens
cactccccgaagtctttt

SEQ ID NO: 4008490 - DNA, 20 bp, Homo sapiens
cactccccgccttagagcct

SEQ ID NO: 4008491 - DNA, 21 bp, Homo sapiens
cactcccgcctcagggccagg

SEQ ID NO: 4008492 - DNA, 16 bp, Homo sapiens
cactcccgttttcggt

SEQ ID NO: 4008493 - DNA, 20 bp, Homo sapiens
cactccctgctccacgaagc

SEQ ID NO: 4008494 - DNA, 16 bp, Homo sapiens
cactccctgcttgcag

SEQ ID NO: 4008495 - DNA, 17 bp, Homo sapiens
cactccctgcttgcagg

SEQ ID NO: 4008496 - DNA, 11 bp, Homo sapiens
cactccctggg

SEQ ID NO: 4008497 - DNA, 19 bp, Homo sapiens
cactcctagagaacgcagc

SEQ ID NO: 4008498 - DNA, 22 bp, Homo sapiens
cactcctagagaacgcagccct

SEQ ID NO: 4008499 - DNA, 14 bp, Homo sapiens
cactcctaggagag

SEQ ID NO: 4008500 - DNA, 17 bp, Homo sapiens
cactcctaggagagcca

SEQ ID NO: 4008501 - DNA, 18 bp, Homo sapiens
cactcctaggagagccaa

SEQ ID NO: 4008502 - DNA, 22 bp, Homo sapiens
cactcctaggagagccaacctc

SEQ ID NO: 4008503 - DNA, 16 bp, Homo sapiens
cactcctgctctgctc

SEQ ID NO: 4008504 - DNA, 19 bp, Homo sapiens
cactcctggggcctcttgg

SEQ ID NO: 4008505 - DNA, 21 bp, Homo sapiens
cactcgacccagaatggagcc

SEQ ID NO: 4008506 - DNA, 20 bp, Homo sapiens
cactcgccatctcctgggcc

SEQ ID NO: 4008507 - DNA, 22 bp, Homo sapiens
cactcgggaggctgagacagga

SEQ ID NO: 4008508 - DNA, 16 bp, Homo sapiens
cactctaaaaaacatt

SEQ ID NO: 4008509 - DNA, 12 bp, Homo sapiens
cactctaaactg

SEQ ID NO: 4008510 - DNA, 14 bp, Homo sapiens
cactctaaactgca

SEQ ID NO: 4008511 - DNA, 17 bp, Homo sapiens
cactctaccaaataatt

SEQ ID NO: 4008512 - DNA, 13 bp, Homo sapiens
cactctctgaaga

SEQ ID NO: 4008513 - DNA, 14 bp, Homo sapiens
cactctctggaagc

SEQ ID NO: 4008514 - DNA, 18 bp, Homo sapiens
cactctgtcagccagccg

SEQ ID NO: 4008515 - DNA, 16 bp, Homo sapiens
cactcttaagcttccg

SEQ ID NO: 4008516 - DNA, 14 bp, Homo sapiens
cactcttgtttctc

SEQ ID NO: 4008517 - DNA, 21 bp, Homo sapiens
cactcttgtttctcccgtgct

SEQ ID NO: 4008518 - DNA, 23 bp, Homo sapiens
cactcttttgctttattccagaa

SEQ ID NO: 4008519 - DNA, 11 bp, Homo sapiens
cactgaaaaat

SEQ ID NO: 4008520 - DNA, 17 bp, Homo sapiens
cactgaaaacttagcca

SEQ ID NO: 4008521 - DNA, 18 bp, Homo sapiens
cactgaaaatagtgttcc

SEQ ID NO: 4008522 - DNA, 13 bp, Homo sapiens
cactgaaagtttt

SEQ ID NO: 4008523 - DNA, 21 bp, Homo sapiens
cactgaaagttttgtaaaaga

SEQ ID NO: 4008524 - DNA, 14 bp, Homo sapiens
cactgaaggacctg

SEQ ID NO: 4008525 - DNA, 15 bp, Homo sapiens
cactgaatttataaa

SEQ ID NO: 4008526 - DNA, 13 bp, Homo sapiens
cactgaccagaac

SEQ ID NO: 4008527 - DNA, 14 bp, Homo sapiens
cactgaccagaact

SEQ ID NO: 4008528 - DNA, 23 bp, Homo sapiens
cactgaccatccactctaccctc

SEQ ID NO: 4008529 - DNA, 19 bp, Homo sapiens
cactgagaagattgtgaat

SEQ ID NO: 4008530 - DNA, 14 bp, Homo sapiens
cactgagagggcaa

SEQ ID NO: 4008531 - DNA, 21 bp, Homo sapiens
cactgagctcacatgggactg

SEQ ID NO: 4008532 - DNA, 16 bp, Homo sapiens
cactgagctccccaga

SEQ ID NO: 4008533 - DNA, 19 bp, Homo sapiens
cactgagctccccagatct

SEQ ID NO: 4008534 - DNA, 13 bp, Homo sapiens
cactgaggcagcc

SEQ ID NO: 4008535 - DNA, 16 bp, Homo sapiens
cactgaggcagccttg

SEQ ID NO: 4008536 - DNA, 13 bp, Homo sapiens
cactgagggccac

SEQ ID NO: 4008537 - DNA, 21 bp, Homo sapiens
cactgagggtggcactcaact

SEQ ID NO: 4008538 - DNA, 18 bp, Homo sapiens
cactgagtaccaggggct

SEQ ID NO: 4008539 - DNA, 15 bp, Homo sapiens
cactgatcacccaat

SEQ ID NO: 4008540 - DNA, 12 bp, Homo sapiens
cactgatgctgc

SEQ ID NO: 4008541 - DNA, 17 bp, Homo sapiens
cactgatgctgttctct

SEQ ID NO: 4008542 - DNA, 22 bp, Homo sapiens
cactgcacagtgcatctcagcc

SEQ ID NO: 4008543 - DNA, 17 bp, Homo sapiens
cactgcagacttgtcca

SEQ ID NO: 4008544 - DNA, 23 bp, Homo sapiens
cactttagggctgtaaaatgcat

SEQ ID NO: 4008545 - DNA, 22 bp, Homo sapiens
cactttataagtcattgtatgt

SEQ ID NO: 4008546 - DNA, 13 bp, Homo sapiens
cactttccacttc

SEQ ID NO: 4008547 - DNA, 22 bp, Homo sapiens
cactttccacttcttcctttct

SEQ ID NO: 4008548 - DNA, 17 bp, Homo sapiens
cactttctaatgtttct

SEQ ID NO: 4008549 - DNA, 18 bp, Homo sapiens
cactttctaatgtttctg

SEQ ID NO: 4008550 - DNA, 18 bp, Homo sapiens
cactttgaagtctataaa

SEQ ID NO: 4008551 - DNA, 17 bp, Homo sapiens
cactttgcaactccctg

SEQ ID NO: 4008552 - DNA, 23 bp, Homo sapiens
cactttgcatatgagccgtgaac

SEQ ID NO: 4008553 - DNA, 21 bp, Homo sapiens
cactttgctctcaattaaagt

SEQ ID NO: 4008554 - DNA, 13 bp, Homo sapiens
cactttgctctgg

SEQ ID NO: 4008555 - DNA, 14 bp, Homo sapiens
cactttgggaggcc

SEQ ID NO: 4008556 - DNA, 20 bp, Homo sapiens
cactttgtcgcccaggctgg

SEQ ID NO: 4008557 - DNA, 19 bp, Homo sapiens
cactttttcgtgtggatct

SEQ ID NO: 4008558 - DNA, 21 bp, Homo sapiens
cactttttctttacaaacaaa

SEQ ID NO: 4008559 - DNA, 20 bp, Homo sapiens
cagaaaaaaagagtgaaaaa

SEQ ID NO: 4008560 - DNA, 21 bp, Homo sapiens
cagaaaaaaagagtgaaaaag

SEQ ID NO: 4008561 - DNA, 11 bp, Homo sapiens
cagaaaaaagg

SEQ ID NO: 4008562 - DNA, 21 bp, Homo sapiens
cagaaaaataacttcaagcaa

SEQ ID NO: 4008563 - DNA, 14 bp, Homo sapiens
cagaaaaatatata

SEQ ID NO: 4008564 - DNA, 15 bp, Homo sapiens
cagaaaactttaaaa

SEQ ID NO: 4008565 - DNA, 19 bp, Homo sapiens
cagaaaagcataacaccaa

SEQ ID NO: 4008566 - DNA, 20 bp, Homo sapiens
cagaaaagcataacaccaat

SEQ ID NO: 4008567 - DNA, 16 bp, Homo sapiens
cagaaaagtgcctgag

SEQ ID NO: 4008568 - DNA, 17 bp, Homo sapiens
cagaaaagtgcctgagc

SEQ ID NO: 4008569 - DNA, 14 bp, Homo sapiens
cagaaaatgttgag

SEQ ID NO: 4008570 - DNA, 18 bp, Homo sapiens
cagaaaatgttgagaatc

SEQ ID NO: 4008571 - DNA, 17 bp, Homo sapiens
cagaaacacccacaggc

SEQ ID NO: 4008572 - DNA, 15 bp, Homo sapiens
cagaaacagccattg

SEQ ID NO: 4008573 - DNA, 17 bp, Homo sapiens
cagaaacgccacatccc

SEQ ID NO: 4008574 - DNA, 14 bp, Homo sapiens
cagaaactcctgtt

SEQ ID NO: 4008575 - DNA, 19 bp, Homo sapiens
cagaaactggattaaaaca

SEQ ID NO: 4008576 - DNA, 16 bp, Homo sapiens
cagaaaggttctgccc

SEQ ID NO: 4008577 - DNA, 21 bp, Homo sapiens
cagaaaggttctgcccgggaa

SEQ ID NO: 4008578 - DNA, 15 bp, Homo sapiens
cagaaagtgcctgac

SEQ ID NO: 4008579 - DNA, 23 bp, Homo sapiens
cagaaagtgcctgacacactaac

SEQ ID NO: 4008580 - DNA, 14 bp, Homo sapiens
cagaaatacaattt

SEQ ID NO: 4008581 - DNA, 14 bp, Homo sapiens
cagaaatcagagga

SEQ ID NO: 4008582 - DNA, 16 bp, Homo sapiens
cagaaatcagaggaga

SEQ ID NO: 4008583 - DNA, 18 bp, Homo sapiens
cagaaatcagaggagaga

SEQ ID NO: 4008584 - DNA, 14 bp, Homo sapiens
cagaaatgctgctg

SEQ ID NO: 4008585 - DNA, 17 bp, Homo sapiens
cagaaatgctgctggcc

SEQ ID NO: 4008586 - DNA, 11 bp, Homo sapiens
cagaaattgga

SEQ ID NO: 4008587 - DNA, 21 bp, Homo sapiens
cagaacaaggttccctctgag

SEQ ID NO: 4008588 - DNA, 19 bp, Homo sapiens
cagaacacggctcacgctt

SEQ ID NO: 4008589 - DNA, 12 bp, Homo sapiens
cagaacagcaga

SEQ ID NO: 4008590 - DNA, 18 bp, Homo sapiens
cagaacatcgatatgtat

SEQ ID NO: 4008591 - DNA, 22 bp, Homo sapiens
cagaacccatcggtaggcaaag

SEQ ID NO: 4008592 - DNA, 14 bp, Homo sapiens
cagaacctcagcat

SEQ ID NO: 4008593 - DNA, 14 bp, Homo sapiens
cagaacctcttccc

SEQ ID NO: 4008594 - DNA, 14 bp, Homo sapiens
cagaacctgagcta

SEQ ID NO: 4008595 - DNA, 22 bp, Homo sapiens
cagaacctgagctattttcctc

SEQ ID NO: 4008596 - DNA, 22 bp, Homo sapiens
cagaactcaaatggggccagat

SEQ ID NO: 4008597 - DNA, 18 bp, Homo sapiens
cagaactcactggggcct

SEQ ID NO: 4008598 - DNA, 21 bp, Homo sapiens
cagaactcattctatccccaa

SEQ ID NO: 4008599 - DNA, 18 bp, Homo sapiens
cagaactctgcctgccct

SEQ ID NO: 4008600 - DNA, 22 bp, Homo sapiens
cagaactctgcctgccctttgt

SEQ ID NO: 4008601 - DNA, 13 bp, Homo sapiens
cagaactctgtgt

SEQ ID NO: 4008602 - DNA, 22 bp, Homo sapiens
cagaactcttcctccaaggaca

SEQ ID NO: 4008603 - DNA, 12 bp, Homo sapiens
cagaactgcccc

SEQ ID NO: 4008604 - DNA, 16 bp, Homo sapiens
cagaactgcccccact

SEQ ID NO: 4008605 - DNA, 20 bp, Homo sapiens
cagaacttcagaaagacttg

SEQ ID NO: 4008606 - DNA, 14 bp, Homo sapiens
cagaacttccctga

SEQ ID NO: 4008607 - DNA, 15 bp, Homo sapiens
cagaacttccctgat

SEQ ID NO: 4008608 - DNA, 19 bp, Homo sapiens
cagaacttgaagcctgctc

SEQ ID NO: 4008609 - DNA, 22 bp, Homo sapiens
cagaacttgaagcctgctcctt

SEQ ID NO: 4008610 - DNA, 16 bp, Homo sapiens
cagaacttgaagggtt

SEQ ID NO: 4008611 - DNA, 17 bp, Homo sapiens
cagaacttgaagggtta

SEQ ID NO: 4008612 - DNA, 14 bp, Homo sapiens
cagaacttgctgct

SEQ ID NO: 4008613 - DNA, 11 bp, Homo sapiens
cagaagaaaga

SEQ ID NO: 4008614 - DNA, 18 bp, Homo sapiens
cagaagaagagaagctgc

SEQ ID NO: 4008615 - DNA, 18 bp, Homo sapiens
cagaagaatattcaggac

SEQ ID NO: 4008616 - DNA, 20 bp, Homo sapiens
cagaagaatattcaggactt

SEQ ID NO: 4008617 - DNA, 16 bp, Homo sapiens
cagaagacaccagagc

SEQ ID NO: 4008618 - DNA, 21 bp, Homo sapiens
cagaagacaccagagcagatg

SEQ ID NO: 4008619 - DNA, 16 bp, Homo sapiens
cagaagacccctgact

SEQ ID NO: 4008620 - DNA, 15 bp, Homo sapiens
cagaagataacttga

SEQ ID NO: 4008621 - DNA, 16 bp, Homo sapiens
cagaagatgccagctt

SEQ ID NO: 4008622 - DNA, 18 bp, Homo sapiens
cagaagcaagccagacct

SEQ ID NO: 4008623 - DNA, 20 bp, Homo sapiens
cagaagcacagaatattttt

SEQ ID NO: 4008624 - DNA, 19 bp, Homo sapiens
cagaagccacccaaagcag

SEQ ID NO: 4008625 - DNA, 22 bp, Homo sapiens
cagaagcctccaagcctgcctc

SEQ ID NO: 4008626 - DNA, 19 bp, Homo sapiens
cagaagcctctggctagag

SEQ ID NO: 4008627 - DNA, 17 bp, Homo sapiens
cagaagcctggactctg

SEQ ID NO: 4008628 - DNA, 21 bp, Homo sapiens
cagaagccttggaaccagccc

SEQ ID NO: 4008629 - DNA, 22 bp, Homo sapiens
cagaagctcttactctttccta

SEQ ID NO: 4008630 - DNA, 18 bp, Homo sapiens
cagaaggaatctgtgcag

SEQ ID NO: 4008631 - DNA, 12 bp, Homo sapiens
cagaaggctcct

SEQ ID NO: 4008632 - DNA, 11 bp, Homo sapiens
cagaagggaat

SEQ ID NO: 4008633 - DNA, 21 bp, Homo sapiens
cagaagggagctggctccagc

SEQ ID NO: 4008634 - DNA, 17 bp, Homo sapiens
cagaagtcatgaagccc

SEQ ID NO: 4008635 - DNA, 16 bp, Homo sapiens
cagaagtccagagtct

SEQ ID NO: 4008636 - DNA, 15 bp, Homo sapiens
cagaagtggagctgg

SEQ ID NO: 4008637 - DNA, 22 bp, Homo sapiens
cagaataaagttctgagtgttt

SEQ ID NO: 4008638 - DNA, 22 bp, Homo sapiens
cagaataaattaatattgtatt

SEQ ID NO: 4008639 - DNA, 16 bp, Homo sapiens
cagaataatggaaaca

SEQ ID NO: 4008640 - DNA, 15 bp, Homo sapiens
cagaataatgttcta

SEQ ID NO: 4008641 - DNA, 22 bp, Homo sapiens
cagaatagccacatttggaata

SEQ ID NO: 4008642 - DNA, 21 bp, Homo sapiens
cagaatatttttatatttcct

SEQ ID NO: 4008643 - DNA, 19 bp, Homo sapiens
cagaatcagaatcatggag

SEQ ID NO: 4008644 - DNA, 21 bp, Homo sapiens
cagaatcagaatcatggagaa

SEQ ID NO: 4008645 - DNA, 20 bp, Homo sapiens
cagaatcatggagaaaatgg

SEQ ID NO: 4008646 - DNA, 15 bp, Homo sapiens
cagagacatacttga

SEQ ID NO: 4008647 - DNA, 19 bp, Homo sapiens
cagagacatacttgaaggg

SEQ ID NO: 4008648 - DNA, 21 bp, Homo sapiens
cagagacatacttgaagggcc

SEQ ID NO: 4008649 - DNA, 20 bp, Homo sapiens
cagagacccaacagcagtga

SEQ ID NO: 4008650 - DNA, 15 bp, Homo sapiens
cagagacgcaggaat

SEQ ID NO: 4008651 - DNA, 17 bp, Homo sapiens
cagagacgcccagcccc

SEQ ID NO: 4008652 - DNA, 12 bp, Homo sapiens
cagagagaagcc

SEQ ID NO: 4008653 - DNA, 20 bp, Homo sapiens
cagagagatcttcccataat

SEQ ID NO: 4008654 - DNA, 19 bp, Homo sapiens
cagagagcagctccctttc

SEQ ID NO: 4008655 - DNA, 17 bp, Homo sapiens
cagagaggagaaacaca

SEQ ID NO: 4008656 - DNA, 18 bp, Homo sapiens
cagagaggagaaacacat

SEQ ID NO: 4008657 - DNA, 18 bp, Homo sapiens
cagagaggcactcagtga

SEQ ID NO: 4008658 - DNA, 20 bp, Homo sapiens
cagagaggcactcagtgagc

SEQ ID NO: 4008659 - DNA, 21 bp, Homo sapiens
cagagagggatgggttcctgc

SEQ ID NO: 4008660 - DNA, 20 bp, Homo sapiens
cagagataaaccaataaatc

SEQ ID NO: 4008661 - DNA, 16 bp, Homo sapiens
cagagcaacgaccagg

SEQ ID NO: 4008662 - DNA, 20 bp, Homo sapiens
cagagcaagactctgtctca

SEQ ID NO: 4008663 - DNA, 20 bp, Homo sapiens
cagagcaagatcctgtcttt

SEQ ID NO: 4008664 - DNA, 23 bp, Homo sapiens
cagagcacctttgcacaggatgc

SEQ ID NO: 4008665 - DNA, 14 bp, Homo sapiens
cagagcagatgcag

SEQ ID NO: 4008666 - DNA, 21 bp, Homo sapiens
cagagcaggaaggacaggaag

SEQ ID NO: 4008667 - DNA, 19 bp, Homo sapiens
cagagcagttgagaggaca

SEQ ID NO: 4008668 - DNA, 14 bp, Homo sapiens
cagagcatctggct

SEQ ID NO: 4008669 - DNA, 20 bp, Homo sapiens
cagagcattacgtgagccag

SEQ ID NO: 4008670 - DNA, 14 bp, Homo sapiens
cagagccaagcctt

SEQ ID NO: 4008671 - DNA, 14 bp, Homo sapiens
cagagccacctgga

SEQ ID NO: 4008672 - DNA, 14 bp, Homo sapiens
cagagcccagaccc

SEQ ID NO: 4008673 - DNA, 11 bp, Homo sapiens
cagagcccagc

SEQ ID NO: 4008674 - DNA, 16 bp, Homo sapiens
cagagccccaagcagg

SEQ ID NO: 4008675 - DNA, 18 bp, Homo sapiens
cagagcccccaggaagcc

SEQ ID NO: 4008676 - DNA, 16 bp, Homo sapiens
cagagcccctacagca

SEQ ID NO: 4008677 - DNA, 21 bp, Homo sapiens
cagagcccctacagcattgtt

SEQ ID NO: 4008678 - DNA, 18 bp, Homo sapiens
cagagcccctcctccagc

SEQ ID NO: 4008679 - DNA, 22 bp, Homo sapiens
cagagcccctcctccagcccct

SEQ ID NO: 4008680 - DNA, 17 bp, Homo sapiens
cagagccctggctgggt

SEQ ID NO: 4008681 - DNA, 13 bp, Homo sapiens
cagagcctgcccc

SEQ ID NO: 4008682 - DNA, 19 bp, Homo sapiens
cagagcctgccccagcgct

SEQ ID NO: 4008683 - DNA, 14 bp, Homo sapiens
cagagcctggcccc

SEQ ID NO: 4008684 - DNA, 18 bp, Homo sapiens
cagagccttctcagaagc

SEQ ID NO: 4008685 - DNA, 19 bp, Homo sapiens
cagagccttctcagaagca

SEQ ID NO: 4008686 - DNA, 16 bp, Homo sapiens
cagagcgacagagcag

SEQ ID NO: 4008687 - DNA, 17 bp, Homo sapiens
cagagcggaggctgtgt

SEQ ID NO: 4008688 - DNA, 19 bp, Homo sapiens
cagagcggaggctgtgtgc

SEQ ID NO: 4008689 - DNA, 19 bp, Homo sapiens
cagagcgtccttccccctg

SEQ ID NO: 4008690 - DNA, 23 bp, Homo sapiens
cagagcgtccttccccctgtaga

SEQ ID NO: 4008691 - DNA, 22 bp, Homo sapiens
cagagctaagggtgggtgctca

SEQ ID NO: 4008692 - DNA, 13 bp, Homo sapiens
cagagctgccagt

SEQ ID NO: 4008693 - DNA, 16 bp, Homo sapiens
cagagctgcttccccg

SEQ ID NO: 4008694 - DNA, 18 bp, Homo sapiens
cagagctggagcccccag

SEQ ID NO: 4008695 - DNA, 14 bp, Homo sapiens
cagagctgggaggc

SEQ ID NO: 4008696 - DNA, 23 bp, Homo sapiens
cagagctgggaggcatggccctg

SEQ ID NO: 4008697 - DNA, 15 bp, Homo sapiens
cagagctgtggagga

SEQ ID NO: 4008698 - DNA, 14 bp, Homo sapiens
cagaggaaatctgt

SEQ ID NO: 4008699 - DNA, 16 bp, Homo sapiens
cagaggaacccccacc

SEQ ID NO: 4008700 - DNA, 19 bp, Homo sapiens
cagaggaacccccaccaga

SEQ ID NO: 4008701 - DNA, 16 bp, Homo sapiens
cagaggagagacggtg

SEQ ID NO: 4008702 - DNA, 17 bp, Homo sapiens
cagaggagcaaggttta

SEQ ID NO: 4008703 - DNA, 15 bp, Homo sapiens
cagaggagcttttct

SEQ ID NO: 4008704 - DNA, 18 bp, Homo sapiens
cagaggaggcgaggaggc

SEQ ID NO: 4008705 - DNA, 22 bp, Homo sapiens
cagaggagtgattgaaccagct

SEQ ID NO: 4008706 - DNA, 23 bp, Homo sapiens
cagaggagtgattgaaccagctc

SEQ ID NO: 4008707 - DNA, 14 bp, Homo sapiens
cagaggccatggca

SEQ ID NO: 4008708 - DNA, 13 bp, Homo sapiens
cagaggccccagc

SEQ ID NO: 4008709 - DNA, 16 bp, Homo sapiens
cagaggccccagcctc

SEQ ID NO: 4008710 - DNA, 19 bp, Homo sapiens
cagaggccgaaggtgcctc

SEQ ID NO: 4008711 - DNA, 21 bp, Homo sapiens
cagaggcctgctgccagtgca

SEQ ID NO: 4008712 - DNA, 23 bp, Homo sapiens
cagaggcctgctgccagtgcagc

SEQ ID NO: 4008713 - DNA, 17 bp, Homo sapiens
cagaggcgcactgtgac

SEQ ID NO: 4008714 - DNA, 21 bp, Homo sapiens
cagaggctgcacccctgggcc

SEQ ID NO: 4008715 - DNA, 14 bp, Homo sapiens
cagaggctgggagt

SEQ ID NO: 4008716 - DNA, 16 bp, Homo sapiens
cagagggagcaggccg

SEQ ID NO: 4008717 - DNA, 15 bp, Homo sapiens
cagagggcagtggcc

SEQ ID NO: 4008718 - DNA, 11 bp, Homo sapiens
cagagggctgg

SEQ ID NO: 4008719 - DNA, 12 bp, Homo sapiens
cagagggctgga

SEQ ID NO: 4008720 - DNA, 14 bp, Homo sapiens
cagagggctggagg

SEQ ID NO: 4008721 - DNA, 19 bp, Homo sapiens
cagagggctggaggcccag

SEQ ID NO: 4008722 - DNA, 22 bp, Homo sapiens
cagagggggagtagccaagctg

SEQ ID NO: 4008723 - DNA, 20 bp, Homo sapiens
cagaggggtaggcagagcct

SEQ ID NO: 4008724 - DNA, 21 bp, Homo sapiens
cagaggggtaggcagagcctt

SEQ ID NO: 4008725 - DNA, 18 bp, Homo sapiens
cagaggtaaaagtgtgag

SEQ ID NO: 4008726 - DNA, 21 bp, Homo sapiens
cagaggtaaaagtgtgagcag

SEQ ID NO: 4008727 - DNA, 14 bp, Homo sapiens
cagaggtaacagaa

SEQ ID NO: 4008728 - DNA, 19 bp, Homo sapiens
cagaggtaacagaacagct

SEQ ID NO: 4008729 - DNA, 18 bp, Homo sapiens
cagaggtcaggaagcagg

SEQ ID NO: 4008730 - DNA, 14 bp, Homo sapiens
cagaggtgcttcac

SEQ ID NO: 4008731 - DNA, 14 bp, Homo sapiens
cagaggtggccaga

SEQ ID NO: 4008732 - DNA, 14 bp, Homo sapiens
cagaggtgtacact

SEQ ID NO: 4008733 - DNA, 17 bp, Homo sapiens
cagaggttgcagtgtgg

SEQ ID NO: 4008734 - DNA, 17 bp, Homo sapiens
cagagtacgtcctgcct

SEQ ID NO: 4008735 - DNA, 18 bp, Homo sapiens
cagagtacgtcctgcctg

SEQ ID NO: 4008736 - DNA, 20 bp, Homo sapiens
cagagtacgtcctgcctggc

SEQ ID NO: 4008737 - DNA, 21 bp, Homo sapiens
cagagtcaccttttctgtggc

SEQ ID NO: 4008738 - DNA, 20 bp, Homo sapiens
cagagtctagcgtagtgcag

SEQ ID NO: 4008739 - DNA, 18 bp, Homo sapiens
cagagtctgggcctctga

SEQ ID NO: 4008740 - DNA, 24 bp, Homo sapiens
cagagtctgggcctctgactctga

SEQ ID NO: 4008741 - DNA, 15 bp, Homo sapiens
cagagtgaagaatct

SEQ ID NO: 4008742 - DNA, 11 bp, Homo sapiens
cagagtgagcc

SEQ ID NO: 4008743 - DNA, 13 bp, Homo sapiens
cagagtgctggca

SEQ ID NO: 4008744 - DNA, 17 bp, Homo sapiens
cagagtgctggcactta

SEQ ID NO: 4008745 - DNA, 13 bp, Homo sapiens
cagagtggcccac

SEQ ID NO: 4008746 - DNA, 18 bp, Homo sapiens
cagagtggcctccctgct

SEQ ID NO: 4008747 - DNA, 12 bp, Homo sapiens
cagagtggcctg

SEQ ID NO: 4008748 - DNA, 16 bp, Homo sapiens
cagagtggcctggcca

SEQ ID NO: 4008749 - DNA, 15 bp, Homo sapiens
ggaattgatttgcat

SEQ ID NO: 4008750 - DNA, 17 bp, Homo sapiens
ggaattgatttgcattg

SEQ ID NO: 4008751 - DNA, 21 bp, Homo sapiens
ggaattggtggcagattttac

SEQ ID NO: 4008752 - DNA, 18 bp, Homo sapiens
ggaatttaaaattaagta

SEQ ID NO: 4008753 - DNA, 15 bp, Homo sapiens
ggaatttcccaggac

SEQ ID NO: 4008754 - DNA, 18 bp, Homo sapiens
ggaatttgtaacctcagc

SEQ ID NO: 4008755 - DNA, 15 bp, Homo sapiens
ggacaacttatttaa

SEQ ID NO: 4008756 - DNA, 17 bp, Homo sapiens
ggacaacttatttaaaa

SEQ ID NO: 4008757 - DNA, 13 bp, Homo sapiens
ggacaagcagagg

SEQ ID NO: 4008758 - DNA, 20 bp, Homo sapiens
ggacaagccaacttgtaaat

SEQ ID NO: 4008759 - DNA, 21 bp, Homo sapiens
ggacaagccaacttgtaaata

SEQ ID NO: 4008760 - DNA, 18 bp, Homo sapiens
ggacaaggtgcaggcagg

SEQ ID NO: 4008761 - DNA, 21 bp, Homo sapiens
ggacaatcatgaaatatgcat

SEQ ID NO: 4008762 - DNA, 15 bp, Homo sapiens
ggacaattgttttaa

SEQ ID NO: 4008763 - DNA, 21 bp, Homo sapiens
ggacacacaaggtgcaaatca

SEQ ID NO: 4008764 - DNA, 22 bp, Homo sapiens
ggacacaccccacaccccagcc

SEQ ID NO: 4008765 - DNA, 22 bp, Homo sapiens
ggacacattggaatgccttgga

SEQ ID NO: 4008766 - DNA, 21 bp, Homo sapiens
ggacacccctacacacaccca

SEQ ID NO: 4008767 - DNA, 14 bp, Homo sapiens
ggacacccctgctc

SEQ ID NO: 4008768 - DNA, 20 bp, Homo sapiens
ggacaccccttatccaggac

SEQ ID NO: 4008769 - DNA, 18 bp, Homo sapiens
ggacactccagtgccagc

SEQ ID NO: 4008770 - DNA, 14 bp, Homo sapiens
ggacactcctagag

SEQ ID NO: 4008771 - DNA, 16 bp, Homo sapiens
ggacacttaatactac

SEQ ID NO: 4008772 - DNA, 20 bp, Homo sapiens
ggacagaggagcaaggttta

SEQ ID NO: 4008773 - DNA, 15 bp, Homo sapiens
ggacagaggccccag

SEQ ID NO: 4008774 - DNA, 14 bp, Homo sapiens
ggacagaggcctgc

SEQ ID NO: 4008775 - DNA, 17 bp, Homo sapiens
ggacagaggcctgcccg

SEQ ID NO: 4008776 - DNA, 15 bp, Homo sapiens
ggacagcagaagcct

SEQ ID NO: 4008777 - DNA, 18 bp, Homo sapiens
ggacagcatcccttccca

SEQ ID NO: 4008778 - DNA, 14 bp, Homo sapiens
ggacagcccagagc

SEQ ID NO: 4008779 - DNA, 17 bp, Homo sapiens
ggacagcccagagcctg

SEQ ID NO: 4008780 - DNA, 21 bp, Homo sapiens
ggacagcccagagcctggctg

SEQ ID NO: 4008781 - DNA, 16 bp, Homo sapiens
ggacagccccaccctg

SEQ ID NO: 4008782 - DNA, 17 bp, Homo sapiens
ggacagctgataaattt

SEQ ID NO: 4008783 - DNA, 16 bp, Homo sapiens
ggacaggagtcagtgt

SEQ ID NO: 4008784 - DNA, 12 bp, Homo sapiens
ggacaggcccag

SEQ ID NO: 4008785 - DNA, 13 bp, Homo sapiens
ggacaggcccagc

SEQ ID NO: 4008786 - DNA, 13 bp, Homo sapiens
ggacaggctggct

SEQ ID NO: 4008787 - DNA, 14 bp, Homo sapiens
ggacagggaggcca

SEQ ID NO: 4008788 - DNA, 19 bp, Homo sapiens
ggacatgcggtagccagca

SEQ ID NO: 4008789 - DNA, 16 bp, Homo sapiens
ggacatgctcacctct

SEQ ID NO: 4008790 - DNA, 18 bp, Homo sapiens
ggacattgccccaagata

SEQ ID NO: 4008791 - DNA, 19 bp, Homo sapiens
ggacatttgaacatgttta

SEQ ID NO: 4008792 - DNA, 15 bp, Homo sapiens
ggaccaacctgctct

SEQ ID NO: 4008793 - DNA, 15 bp, Homo sapiens
ggaccacatgccact

SEQ ID NO: 4008794 - DNA, 18 bp, Homo sapiens
ggaccaccctccctgact

SEQ ID NO: 4008795 - DNA, 22 bp, Homo sapiens
ggaccaccctccctgactggcc

SEQ ID NO: 4008796 - DNA, 19 bp, Homo sapiens
ggaccagaagccaaagact

SEQ ID NO: 4008797 - DNA, 15 bp, Homo sapiens
ggaccagagccagat

SEQ ID NO: 4008798 - DNA, 18 bp, Homo sapiens
ggaccagagccagatgca

SEQ ID NO: 4008799 - DNA, 13 bp, Homo sapiens
ggaccagctcagg

SEQ ID NO: 4008800 - DNA, 16 bp, Homo sapiens
ggaccagctcaggaca

SEQ ID NO: 4008801 - DNA, 11 bp, Homo sapiens
ggaccaggact

SEQ ID NO: 4008802 - DNA, 20 bp, Homo sapiens
ggaccagtggtttccagtca

SEQ ID NO: 4008803 - DNA, 23 bp, Homo sapiens
ggaccatgccagattctgcctct

SEQ ID NO: 4008804 - DNA, 21 bp, Homo sapiens
ggaccatgtgtcacttgtgct

SEQ ID NO: 4008805 - DNA, 18 bp, Homo sapiens
ggacccaaaacacaggaa

SEQ ID NO: 4008806 - DNA, 19 bp, Homo sapiens
ggacccaaaacacaggaag

SEQ ID NO: 4008807 - DNA, 22 bp, Homo sapiens
ggacccccgaggggagggcagg

SEQ ID NO: 4008808 - DNA, 20 bp, Homo sapiens
ggacccctgctcccagcctg

SEQ ID NO: 4008809 - DNA, 16 bp, Homo sapiens
ggaccctgtgacatgg

SEQ ID NO: 4008810 - DNA, 22 bp, Homo sapiens
ggaccctgtgacatggtgcctg

SEQ ID NO: 4008811 - DNA, 18 bp, Homo sapiens
ggaccctttttgttatga

SEQ ID NO: 4008812 - DNA, 14 bp, Homo sapiens
ggaccgtccagggg

SEQ ID NO: 4008813 - DNA, 22 bp, Homo sapiens
ggacctaacattcgatctcatt

SEQ ID NO: 4008814 - DNA, 21 bp, Homo sapiens
ggacctatgtcctaaggacac

SEQ ID NO: 4008815 - DNA, 22 bp, Homo sapiens
ggacctgcctcctgcctgcccc

SEQ ID NO: 4008816 - DNA, 11 bp, Homo sapiens
ggacctgggaa

SEQ ID NO: 4008817 - DNA, 21 bp, Homo sapiens
ggaccttaggccttcctctct

SEQ ID NO: 4008818 - DNA, 21 bp, Homo sapiens
ggacctttaacttttttttct

SEQ ID NO: 4008819 - DNA, 23 bp, Homo sapiens
ggacctttaacttttttttctct

SEQ ID NO: 4008820 - DNA, 13 bp, Homo sapiens
ggaccttttaaag

SEQ ID NO: 4008821 - DNA, 17 bp, Homo sapiens
ggacgcctgcaggagag

SEQ ID NO: 4008822 - DNA, 15 bp, Homo sapiens
ggacggctcctcaga

SEQ ID NO: 4008823 - DNA, 13 bp, Homo sapiens
ggacgtcctccaa

SEQ ID NO: 4008824 - DNA, 18 bp, Homo sapiens
ggacgtggctcagccagc

SEQ ID NO: 4008825 - DNA, 19 bp, Homo sapiens
ggactaagcctacctgctc

SEQ ID NO: 4008826 - DNA, 21 bp, Homo sapiens
ggactacgttaagggaaggaa

SEQ ID NO: 4008827 - DNA, 15 bp, Homo sapiens
ggactatagcccagg

SEQ ID NO: 4008828 - DNA, 15 bp, Homo sapiens
ggactcagccctgag

SEQ ID NO: 4008829 - DNA, 15 bp, Homo sapiens
ggactcagggcagcg

SEQ ID NO: 4008830 - DNA, 15 bp, Homo sapiens
ggactcattgtagaa

SEQ ID NO: 4008831 - DNA, 14 bp, Homo sapiens
ggactccaggccca

SEQ ID NO: 4008832 - DNA, 11 bp, Homo sapiens
ggactccatct

SEQ ID NO: 4008833 - DNA, 17 bp, Homo sapiens
ggactccccaggccagg

SEQ ID NO: 4008834 - DNA, 19 bp, Homo sapiens
ggactccccaggccaggcc

SEQ ID NO: 4008835 - DNA, 16 bp, Homo sapiens
ggactcccggagcctg

SEQ ID NO: 4008836 - DNA, 15 bp, Homo sapiens
ggactcccgggccac

SEQ ID NO: 4008837 - DNA, 18 bp, Homo sapiens
ggactcccgggccacgcc

SEQ ID NO: 4008838 - DNA, 20 bp, Homo sapiens
ggactcccgggccacgcccc

SEQ ID NO: 4008839 - DNA, 11 bp, Homo sapiens
ggactctcagg

SEQ ID NO: 4008840 - DNA, 18 bp, Homo sapiens
ggactctgccccacgctg

SEQ ID NO: 4008841 - DNA, 14 bp, Homo sapiens
ggactctgcccctg

SEQ ID NO: 4008842 - DNA, 16 bp, Homo sapiens
ggactcttctcggctc

SEQ ID NO: 4008843 - DNA, 14 bp, Homo sapiens
ggactggaaccagg

SEQ ID NO: 4008844 - DNA, 18 bp, Homo sapiens
ggactggaaccagggaga

SEQ ID NO: 4008845 - DNA, 21 bp, Homo sapiens
ggactggaggcccctggagcc

SEQ ID NO: 4008846 - DNA, 19 bp, Homo sapiens
ggactggaggtgggcatgc

SEQ ID NO: 4008847 - DNA, 17 bp, Homo sapiens
ggactggcccctgggtc

SEQ ID NO: 4008848 - DNA, 19 bp, Homo sapiens
ggactgggaggagggggag

SEQ ID NO: 4008849 - DNA, 23 bp, Homo sapiens
ggactggggatgtgggagggagc

SEQ ID NO: 4008850 - DNA, 17 bp, Homo sapiens
ggactggtgccctcctc

SEQ ID NO: 4008851 - DNA, 21 bp, Homo sapiens
ggactggtgccctcctcactc

SEQ ID NO: 4008852 - DNA, 22 bp, Homo sapiens
ggcaaagtttaaatgtatttta

SEQ ID NO: 4008853 - DNA, 24 bp, Homo sapiens
ggcaaagtttaaatgtattttaca

SEQ ID NO: 4008854 - DNA, 16 bp, Homo sapiens
ggcaaattaacttgag

SEQ ID NO: 4008855 - DNA, 14 bp, Homo sapiens
ggcaacacagaggc

SEQ ID NO: 4008856 - DNA, 14 bp, Homo sapiens
ggcaacagatctgg

SEQ ID NO: 4008857 - DNA, 19 bp, Homo sapiens
ggcaacagatctggaacct

SEQ ID NO: 4008858 - DNA, 17 bp, Homo sapiens
ggcaacgaagaaaaaaa

SEQ ID NO: 4008859 - DNA, 15 bp, Homo sapiens
ggcaacttttaaagc

SEQ ID NO: 4008860 - DNA, 14 bp, Homo sapiens
ggcaagaaaaggac

SEQ ID NO: 4008861 - DNA, 24 bp, Homo sapiens
ggcaagacagaaaagtgcctgagc

SEQ ID NO: 4008862 - DNA, 17 bp, Homo sapiens
ggcaagactgcaaactt

SEQ ID NO: 4008863 - DNA, 15 bp, Homo sapiens
ggcaagcaggacctg

SEQ ID NO: 4008864 - DNA, 13 bp, Homo sapiens
ggcaagccacagg

SEQ ID NO: 4008865 - DNA, 16 bp, Homo sapiens
ggcaagccacaggaag

SEQ ID NO: 4008866 - DNA, 18 bp, Homo sapiens
ggcaagccacaggaagga

SEQ ID NO: 4008867 - DNA, 23 bp, Homo sapiens
ggcaaggacgcttcacaggacag

SEQ ID NO: 4008868 - DNA, 17 bp, Homo sapiens
ggcaagggttaaggcct

SEQ ID NO: 4008869 - DNA, 14 bp, Homo sapiens
ggcaatattaacct

SEQ ID NO: 4008870 - DNA, 23 bp, Homo sapiens
ggcacaagtcctggatgttgtgt

SEQ ID NO: 4008871 - DNA, 14 bp, Homo sapiens
ggcacacagctact

SEQ ID NO: 4008872 - DNA, 22 bp, Homo sapiens
ggcacagacacgctcgcgggca

SEQ ID NO: 4008873 - DNA, 20 bp, Homo sapiens
ggcacagcggagtctgtcct

SEQ ID NO: 4008874 - DNA, 15 bp, Homo sapiens
ggcacaggccccctt

SEQ ID NO: 4008875 - DNA, 14 bp, Homo sapiens
ggcacagggcacca

SEQ ID NO: 4008876 - DNA, 23 bp, Homo sapiens
ggcacagggcccgcagtgctggg

SEQ ID NO: 4008877 - DNA, 12 bp, Homo sapiens
ggcacagggtct

SEQ ID NO: 4008878 - DNA, 18 bp, Homo sapiens
ggcacagggtctgctctt

SEQ ID NO: 4008879 - DNA, 19 bp, Homo sapiens
ggcacagggtctgctcttt

SEQ ID NO: 4008880 - DNA, 17 bp, Homo sapiens
ggcacaggtcgggcgca

SEQ ID NO: 4008881 - DNA, 22 bp, Homo sapiens
ggcaccactgcactccagcctg

SEQ ID NO: 4008882 - DNA, 16 bp, Homo sapiens
ggcaccagacacccag

SEQ ID NO: 4008883 - DNA, 17 bp, Homo sapiens
ggcaccagacacccagg

SEQ ID NO: 4008884 - DNA, 19 bp, Homo sapiens
ggcaccagacacccaggac

SEQ ID NO: 4008885 - DNA, 13 bp, Homo sapiens
ggcaccagccagc

SEQ ID NO: 4008886 - DNA, 21 bp, Homo sapiens
ggcaccagggcattcgggcca

SEQ ID NO: 4008887 - DNA, 19 bp, Homo sapiens
ggcacccaaatcacatctc

SEQ ID NO: 4008888 - DNA, 21 bp, Homo sapiens
ggcacccaccgtggaggagga

SEQ ID NO: 4008889 - DNA, 18 bp, Homo sapiens
ggcaccccctggagagaa

SEQ ID NO: 4008890 - DNA, 21 bp, Homo sapiens
ggcaccctcagggagcctccc

SEQ ID NO: 4008891 - DNA, 15 bp, Homo sapiens
ggcacctaatccagg

SEQ ID NO: 4008892 - DNA, 18 bp, Homo sapiens
ggcacctgcacactccat

SEQ ID NO: 4008893 - DNA, 21 bp, Homo sapiens
ggcacctgtctgctccagctc

SEQ ID NO: 4008894 - DNA, 21 bp, Homo sapiens
ggcacgcttgcgtatgtctgt

SEQ ID NO: 4008895 - DNA, 21 bp, Homo sapiens
ggcacgtcgcccgctgagctg

SEQ ID NO: 4008896 - DNA, 23 bp, Homo sapiens
ggcactaacgttgagcccctgga

SEQ ID NO: 4008897 - DNA, 17 bp, Homo sapiens
ggcactcagtgagcctc

SEQ ID NO: 4008898 - DNA, 19 bp, Homo sapiens
ggcactcagtgagcctcct

SEQ ID NO: 4008899 - DNA, 21 bp, Homo sapiens
ggcactgcccttttcaggaag

SEQ ID NO: 4008900 - DNA, 21 bp, Homo sapiens
ggcactgccttctcctctctg

SEQ ID NO: 4008901 - DNA, 13 bp, Homo sapiens
ggcactgggctgt

SEQ ID NO: 4008902 - DNA, 15 bp, Homo sapiens
ggcactggtggcccg

SEQ ID NO: 4008903 - DNA, 13 bp, Homo sapiens
ggcacttctgcct

SEQ ID NO: 4008904 - DNA, 15 bp, Homo sapiens
ggcacttctgcctga

SEQ ID NO: 4008905 - DNA, 22 bp, Homo sapiens
ggcagaaaggttctgcccggga

SEQ ID NO: 4008906 - DNA, 14 bp, Homo sapiens
ggcagaaagtggcc

SEQ ID NO: 4008907 - DNA, 15 bp, Homo sapiens
ggcagaagacaccag

SEQ ID NO: 4008908 - DNA, 16 bp, Homo sapiens
ggcagaagacaccaga

SEQ ID NO: 4008909 - DNA, 17 bp, Homo sapiens
ggcagaagacaccagag

SEQ ID NO: 4008910 - DNA, 18 bp, Homo sapiens
ggcagaagacaccagagc

SEQ ID NO: 4008911 - DNA, 19 bp, Homo sapiens
ggcagaagacaccagagca

SEQ ID NO: 4008912 - DNA, 20 bp, Homo sapiens
ggcagaagacaccagagcag

SEQ ID NO: 4008913 - DNA, 21 bp, Homo sapiens
ggcagaagacaccagagcaga

SEQ ID NO: 4008914 - DNA, 22 bp, Homo sapiens
ggcagaagacaccagagcagat

SEQ ID NO: 4008915 - DNA, 19 bp, Homo sapiens
ggcagaataatctttgggt

SEQ ID NO: 4008916 - DNA, 16 bp, Homo sapiens
ggcagacgccggggac

SEQ ID NO: 4008917 - DNA, 15 bp, Homo sapiens
ggcagactacacagg

SEQ ID NO: 4008918 - DNA, 17 bp, Homo sapiens
ggcagactacacaggat

SEQ ID NO: 4008919 - DNA, 14 bp, Homo sapiens
ggcagagaaagaag

SEQ ID NO: 4008920 - DNA, 21 bp, Homo sapiens
ggcagagaaagaagagacagg

SEQ ID NO: 4008921 - DNA, 14 bp, Homo sapiens
ggcagagaatcata

SEQ ID NO: 4008922 - DNA, 11 bp, Homo sapiens
ggcagagagag

SEQ ID NO: 4008923 - DNA, 18 bp, Homo sapiens
ggcagaggaacccccacc

SEQ ID NO: 4008924 - DNA, 20 bp, Homo sapiens
ggcagaggaccaggctgtag

SEQ ID NO: 4008925 - DNA, 13 bp, Homo sapiens
ggcagagggctgg

SEQ ID NO: 4008926 - DNA, 14 bp, Homo sapiens
ggcagatccaggac

SEQ ID NO: 4008927 - DNA, 16 bp, Homo sapiens
ggcagatccaggacta

SEQ ID NO: 4008928 - DNA, 21 bp, Homo sapiens
ggcagatgcagctcttcctgg

SEQ ID NO: 4008929 - DNA, 13 bp, Homo sapiens
ggcagatggagcc

SEQ ID NO: 4008930 - DNA, 16 bp, Homo sapiens
ggcagatggagcccat

SEQ ID NO: 4008931 - DNA, 13 bp, Homo sapiens
ggcagattgaaaa

SEQ ID NO: 4008932 - DNA, 14 bp, Homo sapiens
ggcagcaccctccc

SEQ ID NO: 4008933 - DNA, 23 bp, Homo sapiens
ggcagcaggggtaggggtaggga

SEQ ID NO: 4008934 - DNA, 19 bp, Homo sapiens
ggcagccaaacccatgagg

SEQ ID NO: 4008935 - DNA, 20 bp, Homo sapiens
ggcagccaaacccatgaggc

SEQ ID NO: 4008936 - DNA, 12 bp, Homo sapiens
ggcagccagcag

SEQ ID NO: 4008937 - DNA, 13 bp, Homo sapiens
ggcagcccactgc

SEQ ID NO: 4008938 - DNA, 15 bp, Homo sapiens
ggcagcccactgcac

SEQ ID NO: 4008939 - DNA, 16 bp, Homo sapiens
ggcagcccactgcacc

SEQ ID NO: 4008940 - DNA, 16 bp, Homo sapiens
ggcagccccagagaga

SEQ ID NO: 4008941 - DNA, 21 bp, Homo sapiens
ggcagcctcccatccagggcc

SEQ ID NO: 4008942 - DNA, 19 bp, Homo sapiens
ggcagcctgccttgcccac

SEQ ID NO: 4008943 - DNA, 22 bp, Homo sapiens
ggcagcctggatccctgccctt

SEQ ID NO: 4008944 - DNA, 18 bp, Homo sapiens
ggcagcgccaagtgcgtg

SEQ ID NO: 4008945 - DNA, 20 bp, Homo sapiens
ggcagcgccaagtgcgtgcc

SEQ ID NO: 4008946 - DNA, 22 bp, Homo sapiens
ggcagcgccaggctgaccacag

SEQ ID NO: 4008947 - DNA, 12 bp, Homo sapiens
ggcagcgggcca

SEQ ID NO: 4008948 - DNA, 13 bp, Homo sapiens
ggcagcgggccag

SEQ ID NO: 4008949 - DNA, 14 bp, Homo sapiens
ggcagcgggccagg

SEQ ID NO: 4008950 - DNA, 17 bp, Homo sapiens
ggcagcgggccaggccc

SEQ ID NO: 4008951 - DNA, 14 bp, Homo sapiens
ggcagctagtgcct

SEQ ID NO: 4008952 - DNA, 17 bp, Homo sapiens
ggcagctagtgccttta

SEQ ID NO: 4008953 - DNA, 16 bp, Homo sapiens
ggcagctcacccctgg

SEQ ID NO: 4008954 - DNA, 15 bp, Homo sapiens
ggccctaggcccctc

SEQ ID NO: 4008955 - DNA, 18 bp, Homo sapiens
ggccctaggcccctccta

SEQ ID NO: 4008956 - DNA, 22 bp, Homo sapiens
ggccctcatctatgaggaaagg

SEQ ID NO: 4008957 - DNA, 19 bp, Homo sapiens
ggccctccctgttccccag

SEQ ID NO: 4008958 - DNA, 21 bp, Homo sapiens
ggccctccctgttccccagag

SEQ ID NO: 4008959 - DNA, 22 bp, Homo sapiens
ggccctccgaccacttccaggg

SEQ ID NO: 4008960 - DNA, 14 bp, Homo sapiens
ggccctcctgtgct

SEQ ID NO: 4008961 - DNA, 20 bp, Homo sapiens
ggccctcctgtgctggggga

SEQ ID NO: 4008962 - DNA, 23 bp, Homo sapiens
ggccctcgacactcaccatgaag

SEQ ID NO: 4008963 - DNA, 15 bp, Homo sapiens
ggccctctttccctg

SEQ ID NO: 4008964 - DNA, 17 bp, Homo sapiens
ggccctctttccctgcg

SEQ ID NO: 4008965 - DNA, 22 bp, Homo sapiens
ggccctgactcctctggctttc

SEQ ID NO: 4008966 - DNA, 11 bp, Homo sapiens
ggccctgaggc

SEQ ID NO: 4008967 - DNA, 12 bp, Homo sapiens
ggccctgcagct

SEQ ID NO: 4008968 - DNA, 16 bp, Homo sapiens
ggccctgcctcctggg

SEQ ID NO: 4008969 - DNA, 13 bp, Homo sapiens
ggccctgcctgct

SEQ ID NO: 4008970 - DNA, 17 bp, Homo sapiens
ggccctgctcctgcagc

SEQ ID NO: 4008971 - DNA, 20 bp, Homo sapiens
ggccctgctgagtcatctgt

SEQ ID NO: 4008972 - DNA, 12 bp, Homo sapiens
ggccctggaggg

SEQ ID NO: 4008973 - DNA, 11 bp, Homo sapiens
ggccctggcca

SEQ ID NO: 4008974 - DNA, 12 bp, Homo sapiens
ggccctggccag

SEQ ID NO: 4008975 - DNA, 15 bp, Homo sapiens
ggccctggccaggac

SEQ ID NO: 4008976 - DNA, 22 bp, Homo sapiens
ggccctggctcccacaggccct

SEQ ID NO: 4008977 - DNA, 19 bp, Homo sapiens
ggccctggctgagggcagc

SEQ ID NO: 4008978 - DNA, 18 bp, Homo sapiens
ggccctgggctcggaggc

SEQ ID NO: 4008979 - DNA, 22 bp, Homo sapiens
ggccctgggctgggtgctggga

SEQ ID NO: 4008980 - DNA, 12 bp, Homo sapiens
ggccctgtccca

SEQ ID NO: 4008981 - DNA, 16 bp, Homo sapiens
ggcccttagagacccc

SEQ ID NO: 4008982 - DNA, 17 bp, Homo sapiens
ggcccttcctctccact

SEQ ID NO: 4008983 - DNA, 19 bp, Homo sapiens
ggcccttcctctccactgc

SEQ ID NO: 4008984 - DNA, 20 bp, Homo sapiens
ggccctttgaagcctcagct

SEQ ID NO: 4008985 - DNA, 16 bp, Homo sapiens
ggccgaaggtgcctca

SEQ ID NO: 4008986 - DNA, 18 bp, Homo sapiens
ggccgaaggtgcctcaga

SEQ ID NO: 4008987 - DNA, 17 bp, Homo sapiens
ggccgacccactgaccc

SEQ ID NO: 4008988 - DNA, 23 bp, Homo sapiens
ggccgagctggtttcctgcccag

SEQ ID NO: 4008989 - DNA, 18 bp, Homo sapiens
ggccgaggcccagcgggc

SEQ ID NO: 4008990 - DNA, 21 bp, Homo sapiens
ggccgaggcccagcgggcaga

SEQ ID NO: 4008991 - DNA, 18 bp, Homo sapiens
ggccgagggtcctggctc

SEQ ID NO: 4008992 - DNA, 16 bp, Homo sapiens
ggccgagtccaagctg

SEQ ID NO: 4008993 - DNA, 12 bp, Homo sapiens
ggccgccccctg

SEQ ID NO: 4008994 - DNA, 16 bp, Homo sapiens
ggccgccccctgcccc

SEQ ID NO: 4008995 - DNA, 18 bp, Homo sapiens
ggccgccccctgcccccc

SEQ ID NO: 4008996 - DNA, 19 bp, Homo sapiens
ggccgccccctgcccccca

SEQ ID NO: 4008997 - DNA, 16 bp, Homo sapiens
ggccggcctggcaccg

SEQ ID NO: 4008998 - DNA, 12 bp, Homo sapiens
ggccgggcagag

SEQ ID NO: 4008999 - DNA, 19 bp, Homo sapiens
ggccgggcaggtcctgccc

SEQ ID NO: 4009000 - DNA, 20 bp, Homo sapiens
ggccgggcttgggccctgca

SEQ ID NO: 4009001 - DNA, 18 bp, Homo sapiens
ggccgggggaggtgggtg

SEQ ID NO: 4009002 - DNA, 15 bp, Homo sapiens
ggccgtctcctccct

SEQ ID NO: 4009003 - DNA, 13 bp, Homo sapiens
ggccgtgcccagg

SEQ ID NO: 4009004 - DNA, 14 bp, Homo sapiens
ggccgtgccttgtt

SEQ ID NO: 4009005 - DNA, 17 bp, Homo sapiens
ggccgtggtccagctct

SEQ ID NO: 4009006 - DNA, 14 bp, Homo sapiens
ggcctaaaatcttg

SEQ ID NO: 4009007 - DNA, 14 bp, Homo sapiens
ggcctaagacatgt

SEQ ID NO: 4009008 - DNA, 19 bp, Homo sapiens
ggcctagcgatctctcctg

SEQ ID NO: 4009009 - DNA, 21 bp, Homo sapiens
ggcctagcgatctctcctggc

SEQ ID NO: 4009010 - DNA, 20 bp, Homo sapiens
ggcctcaaaggcccgctcta

SEQ ID NO: 4009011 - DNA, 20 bp, Homo sapiens
ggcctcaagaacaaacactg

SEQ ID NO: 4009012 - DNA, 18 bp, Homo sapiens
ggcctcacccacccctgc

SEQ ID NO: 4009013 - DNA, 10 bp, Homo sapiens
ggcctcagaa

SEQ ID NO: 4009014 - DNA, 10 bp, Homo sapiens
ggcctcagcc

SEQ ID NO: 4009015 - DNA, 12 bp, Homo sapiens
ggcctcagccct

SEQ ID NO: 4009016 - DNA, 16 bp, Homo sapiens
ggcctcagctgcctca

SEQ ID NO: 4009017 - DNA, 16 bp, Homo sapiens
ggcctcaggtgctgtc

SEQ ID NO: 4009018 - DNA, 15 bp, Homo sapiens
ggcctccagaactca

SEQ ID NO: 4009019 - DNA, 12 bp, Homo sapiens
ggcctcccaaag

SEQ ID NO: 4009020 - DNA, 18 bp, Homo sapiens
ggcctcccaaagtgctga

SEQ ID NO: 4009021 - DNA, 13 bp, Homo sapiens
ggcctccctcagg

SEQ ID NO: 4009022 - DNA, 23 bp, Homo sapiens
ggcctccctcaggctctgtggag

SEQ ID NO: 4009023 - DNA, 15 bp, Homo sapiens
ggcctccctccttgg

SEQ ID NO: 4009024 - DNA, 16 bp, Homo sapiens
ggcctccctccttggg

SEQ ID NO: 4009025 - DNA, 12 bp, Homo sapiens
ggcctccctgcc

SEQ ID NO: 4009026 - DNA, 12 bp, Homo sapiens
ggcctccctgct

SEQ ID NO: 4009027 - DNA, 13 bp, Homo sapiens
ggcctccctgctg

SEQ ID NO: 4009028 - DNA, 22 bp, Homo sapiens
ggcctccctgctgtgccatgct

SEQ ID NO: 4009029 - DNA, 22 bp, Homo sapiens
ggcctcgggacacctgccctgc

SEQ ID NO: 4009030 - DNA, 23 bp, Homo sapiens
ggcctcgggacacctgccctgcc

SEQ ID NO: 4009031 - DNA, 20 bp, Homo sapiens
ggcctcgtgccatgatctgt

SEQ ID NO: 4009032 - DNA, 12 bp, Homo sapiens
ggcctctccagt

SEQ ID NO: 4009033 - DNA, 15 bp, Homo sapiens
ggcctctctgcccca

SEQ ID NO: 4009034 - DNA, 17 bp, Homo sapiens
ggcctctgactctgagt

SEQ ID NO: 4009035 - DNA, 22 bp, Homo sapiens
ggcctctgctgccgcccttcct

SEQ ID NO: 4009036 - DNA, 22 bp, Homo sapiens
ggcctcttcgcctttcccaccc

SEQ ID NO: 4009037 - DNA, 16 bp, Homo sapiens
ggcctgaactgaggag

SEQ ID NO: 4009038 - DNA, 15 bp, Homo sapiens
ggcctgaagccagct

SEQ ID NO: 4009039 - DNA, 18 bp, Homo sapiens
ggcctgaagccagctgcc

SEQ ID NO: 4009040 - DNA, 19 bp, Homo sapiens
ggcctgaagccagctgccc

SEQ ID NO: 4009041 - DNA, 20 bp, Homo sapiens
ggcctgaagccagctgccct

SEQ ID NO: 4009042 - DNA, 17 bp, Homo sapiens
ggcctgaatcatgagcc

SEQ ID NO: 4009043 - DNA, 19 bp, Homo sapiens
ggcctgaatcatgagcctg

SEQ ID NO: 4009044 - DNA, 21 bp, Homo sapiens
ggcctgaatcatgagcctgct

SEQ ID NO: 4009045 - DNA, 23 bp, Homo sapiens
ggcctgaatcatgagcctgctgg

SEQ ID NO: 4009046 - DNA, 22 bp, Homo sapiens
ggcctgaatccaaaagaaaaac

SEQ ID NO: 4009047 - DNA, 21 bp, Homo sapiens
ggcctgacaccccctccccgc

SEQ ID NO: 4009048 - DNA, 14 bp, Homo sapiens
ggcctgactgctca

SEQ ID NO: 4009049 - DNA, 15 bp, Homo sapiens
ggcctgactgctcag

SEQ ID NO: 4009050 - DNA, 21 bp, Homo sapiens
ggcctgagagaattggctcaa

SEQ ID NO: 4009051 - DNA, 18 bp, Homo sapiens
ggcctgagaggggaagcg

SEQ ID NO: 4009052 - DNA, 15 bp, Homo sapiens
ggcctgagagtcagc

SEQ ID NO: 4009053 - DNA, 18 bp, Homo sapiens
ggcctgagagtcagctct

SEQ ID NO: 4009054 - DNA, 21 bp, Homo sapiens
ggcctgagagtcagctctctg

SEQ ID NO: 4009055 - DNA, 15 bp, Homo sapiens
ggcctgatcagacca

SEQ ID NO: 4009056 - DNA, 19 bp, Homo sapiens
ggcctgcagcaggagtggt

SEQ ID NO: 4009057 - DNA, 14 bp, Homo sapiens
gggagacactggcc

SEQ ID NO: 4009058 - DNA, 14 bp, Homo sapiens
gggagacagggtag

SEQ ID NO: 4009059 - DNA, 16 bp, Homo sapiens
gggagagacaggcagc

SEQ ID NO: 4009060 - DNA, 20 bp, Homo sapiens
gggagagacaggcagcccag

SEQ ID NO: 4009061 - DNA, 12 bp, Homo sapiens
gggagagacctc

SEQ ID NO: 4009062 - DNA, 13 bp, Homo sapiens
gggagagcctgct

SEQ ID NO: 4009063 - DNA, 16 bp, Homo sapiens
gggagagcctgctggc

SEQ ID NO: 4009064 - DNA, 22 bp, Homo sapiens
gggagagctgagccagttgtcc

SEQ ID NO: 4009065 - DNA, 21 bp, Homo sapiens
gggagaggatttttttctgag

SEQ ID NO: 4009066 - DNA, 12 bp, Homo sapiens
gggagcacccag

SEQ ID NO: 4009067 - DNA, 14 bp, Homo sapiens
gggagcactggagt

SEQ ID NO: 4009068 - DNA, 11 bp, Homo sapiens
gggagcagaaa

SEQ ID NO: 4009069 - DNA, 12 bp, Homo sapiens
gggagcagcccc

SEQ ID NO: 4009070 - DNA, 19 bp, Homo sapiens
gggagcagtgtcttccata

SEQ ID NO: 4009071 - DNA, 20 bp, Homo sapiens
gggagcagtgtcttccataa

SEQ ID NO: 4009072 - DNA, 21 bp, Homo sapiens
gggagcatttaatggcagcta

SEQ ID NO: 4009073 - DNA, 14 bp, Homo sapiens
gggagccagctgct

SEQ ID NO: 4009074 - DNA, 13 bp, Homo sapiens
gggagccccaggg

SEQ ID NO: 4009075 - DNA, 14 bp, Homo sapiens
gggagccccagggt

SEQ ID NO: 4009076 - DNA, 16 bp, Homo sapiens
gggagccccagggtct

SEQ ID NO: 4009077 - DNA, 21 bp, Homo sapiens
gggagccccagggtcttccct

SEQ ID NO: 4009078 - DNA, 19 bp, Homo sapiens
gggagccccttctgctcag

SEQ ID NO: 4009079 - DNA, 20 bp, Homo sapiens
gggagccggtaactgtcctg

SEQ ID NO: 4009080 - DNA, 18 bp, Homo sapiens
gggagcctcccctccctg

SEQ ID NO: 4009081 - DNA, 22 bp, Homo sapiens
gggagcctttggttctggccag

SEQ ID NO: 4009082 - DNA, 13 bp, Homo sapiens
gggagcggaggtt

SEQ ID NO: 4009083 - DNA, 16 bp, Homo sapiens
gggagcgtctgggaac

SEQ ID NO: 4009084 - DNA, 16 bp, Homo sapiens
gggagctctggggaca

SEQ ID NO: 4009085 - DNA, 17 bp, Homo sapiens
gggagctctggggacag

SEQ ID NO: 4009086 - DNA, 12 bp, Homo sapiens
gggagctgaggc

SEQ ID NO: 4009087 - DNA, 22 bp, Homo sapiens
gggagctggctccagcctggaa

SEQ ID NO: 4009088 - DNA, 12 bp, Homo sapiens
gggaggacaggc

SEQ ID NO: 4009089 - DNA, 19 bp, Homo sapiens
gggaggacctgaccctact

SEQ ID NO: 4009090 - DNA, 13 bp, Homo sapiens
gggaggagggaga

SEQ ID NO: 4009091 - DNA, 17 bp, Homo sapiens
gggaggagggagaggga

SEQ ID NO: 4009092 - DNA, 18 bp, Homo sapiens
gggaggcaagtgtggggg

SEQ ID NO: 4009093 - DNA, 11 bp, Homo sapiens
gggaggcagcc

SEQ ID NO: 4009094 - DNA, 13 bp, Homo sapiens
gggaggcagccgg

SEQ ID NO: 4009095 - DNA, 12 bp, Homo sapiens
gggaggcagcct

SEQ ID NO: 4009096 - DNA, 16 bp, Homo sapiens
gggaggcatggccctg

SEQ ID NO: 4009097 - DNA, 15 bp, Homo sapiens
gggaggccccttctc

SEQ ID NO: 4009098 - DNA, 15 bp, Homo sapiens
gggaggccgaggcgg

SEQ ID NO: 4009099 - DNA, 18 bp, Homo sapiens
gggaggcggagagtacag

SEQ ID NO: 4009100 - DNA, 15 bp, Homo sapiens
gggaggctgagacag

SEQ ID NO: 4009101 - DNA, 12 bp, Homo sapiens
gggaggctgggc

SEQ ID NO: 4009102 - DNA, 13 bp, Homo sapiens
gggagggaaaagg

SEQ ID NO: 4009103 - DNA, 22 bp, Homo sapiens
gggagggatgaagggcgagtga

SEQ ID NO: 4009104 - DNA, 11 bp, Homo sapiens
gggagggcagg

SEQ ID NO: 4009105 - DNA, 16 bp, Homo sapiens
gggagggcaggatggc

SEQ ID NO: 4009106 - DNA, 12 bp, Homo sapiens
gggaggggaagt

SEQ ID NO: 4009107 - DNA, 12 bp, Homo sapiens
gggaggggaggc

SEQ ID NO: 4009108 - DNA, 23 bp, Homo sapiens
gggaggggcggcaggagggaggt

SEQ ID NO: 4009109 - DNA, 21 bp, Homo sapiens
gggagggggttacaaactgca

SEQ ID NO: 4009110 - DNA, 16 bp, Homo sapiens
gggaggtccaagcaga

SEQ ID NO: 4009111 - DNA, 23 bp, Homo sapiens
gggaggtggaagaagggagaaga

SEQ ID NO: 4009112 - DNA, 13 bp, Homo sapiens
gggagtacctgct

SEQ ID NO: 4009113 - DNA, 20 bp, Homo sapiens
gggagtccagggtttctctg

SEQ ID NO: 4009114 - DNA, 23 bp, Homo sapiens
gggagtgactcaagaagtgaaga

SEQ ID NO: 4009115 - DNA, 16 bp, Homo sapiens
gggagtgggcacctca

SEQ ID NO: 4009116 - DNA, 21 bp, Homo sapiens
gggagtggttaggcagcaagc

SEQ ID NO: 4009117 - DNA, 15 bp, Homo sapiens
gggataaaatgacta

SEQ ID NO: 4009118 - DNA, 19 bp, Homo sapiens
gggatacagatctcagggc

SEQ ID NO: 4009119 - DNA, 20 bp, Homo sapiens
gggatagtgttctgctcctg

SEQ ID NO: 4009120 - DNA, 23 bp, Homo sapiens
gggatagtgttctgctcctgctt

SEQ ID NO: 4009121 - DNA, 16 bp, Homo sapiens
gggatataggagagga

SEQ ID NO: 4009122 - DNA, 18 bp, Homo sapiens
gggatatcacttccatga

SEQ ID NO: 4009123 - DNA, 13 bp, Homo sapiens
gggatcacaaggt

SEQ ID NO: 4009124 - DNA, 20 bp, Homo sapiens
gggatgccactcctccctcc

SEQ ID NO: 4009125 - DNA, 13 bp, Homo sapiens
gggatgctgctcc

SEQ ID NO: 4009126 - DNA, 14 bp, Homo sapiens
gggatgctgggctg

SEQ ID NO: 4009127 - DNA, 15 bp, Homo sapiens
gggatgctgggctgg

SEQ ID NO: 4009128 - DNA, 15 bp, Homo sapiens
gggatggaaaaggaa

SEQ ID NO: 4009129 - DNA, 16 bp, Homo sapiens
gggatgggacagggag

SEQ ID NO: 4009130 - DNA, 18 bp, Homo sapiens
gggatgggacagggaggc

SEQ ID NO: 4009131 - DNA, 20 bp, Homo sapiens
gggatgggacagggaggcca

SEQ ID NO: 4009132 - DNA, 22 bp, Homo sapiens
gggatggggcctccctccttgg

SEQ ID NO: 4009133 - DNA, 14 bp, Homo sapiens
gggatggtccagga

SEQ ID NO: 4009134 - DNA, 15 bp, Homo sapiens
gggatggtccaggat

SEQ ID NO: 4009135 - DNA, 17 bp, Homo sapiens
gggatgtcagcagacac

SEQ ID NO: 4009136 - DNA, 14 bp, Homo sapiens
gggattcaggctgc

SEQ ID NO: 4009137 - DNA, 21 bp, Homo sapiens
gggattctactttaagcacta

SEQ ID NO: 4009138 - DNA, 22 bp, Homo sapiens
gggattgcccctggctttgcct

SEQ ID NO: 4009139 - DNA, 17 bp, Homo sapiens
gggcaaacctagccgga

SEQ ID NO: 4009140 - DNA, 14 bp, Homo sapiens
gggcaacgaagaaa

SEQ ID NO: 4009141 - DNA, 20 bp, Homo sapiens
gggcaagggttaaggcctga

SEQ ID NO: 4009142 - DNA, 22 bp, Homo sapiens
gggcacacgcacaaacacacac

SEQ ID NO: 4009143 - DNA, 19 bp, Homo sapiens
gggcacactacagagcagc

SEQ ID NO: 4009144 - DNA, 12 bp, Homo sapiens
gggcacagggca

SEQ ID NO: 4009145 - DNA, 16 bp, Homo sapiens
gggcacagggcaccag

SEQ ID NO: 4009146 - DNA, 22 bp, Homo sapiens
gggcacagggcaccagaggccg

SEQ ID NO: 4009147 - DNA, 19 bp, Homo sapiens
gggcacagtggactcagca

SEQ ID NO: 4009148 - DNA, 12 bp, Homo sapiens
gggcaccagagg

SEQ ID NO: 4009149 - DNA, 15 bp, Homo sapiens
gggcaccagaggccg

SEQ ID NO: 4009150 - DNA, 16 bp, Homo sapiens
gggcaccagaggccga

SEQ ID NO: 4009151 - DNA, 20 bp, Homo sapiens
gggcacggtcacacggccac

SEQ ID NO: 4009152 - DNA, 21 bp, Homo sapiens
gggcacggtcacacggccacc

SEQ ID NO: 4009153 - DNA, 13 bp, Homo sapiens
gggcactggccca

SEQ ID NO: 4009154 - DNA, 16 bp, Homo sapiens
gggcagaagggagaag

SEQ ID NO: 4009155 - DNA, 14 bp, Homo sapiens
gggcagactgtgaa

SEQ ID NO: 4009156 - DNA, 13 bp, Homo sapiens
gggcagagggctg

SEQ ID NO: 4009157 - DNA, 14 bp, Homo sapiens
gggcagcaccctcc

SEQ ID NO: 4009158 - DNA, 15 bp, Homo sapiens
gggcagcaccctccc

SEQ ID NO: 4009159 - DNA, 13 bp, Homo sapiens
gggcagcaggggt

SEQ ID NO: 4009160 - DNA, 13 bp, Homo sapiens
gggcagccaggct

SEQ ID NO: 4009161 - DNA, 21 bp, Homo sapiens
ggggccgggcgcggtggctca

SEQ ID NO: 4009162 - DNA, 15 bp, Homo sapiens
ggggcctgagagaat

SEQ ID NO: 4009163 - DNA, 14 bp, Homo sapiens
ggggcctggacctg

SEQ ID NO: 4009164 - DNA, 11 bp, Homo sapiens
ggggcctggca

SEQ ID NO: 4009165 - DNA, 16 bp, Homo sapiens
ggggcctgggacttcc

SEQ ID NO: 4009166 - DNA, 23 bp, Homo sapiens
ggggccttagggcactgggctgt

SEQ ID NO: 4009167 - DNA, 13 bp, Homo sapiens
ggggcgaggcagg

SEQ ID NO: 4009168 - DNA, 18 bp, Homo sapiens
ggggcgatgctccctcag

SEQ ID NO: 4009169 - DNA, 18 bp, Homo sapiens
ggggctcagatggactgg

SEQ ID NO: 4009170 - DNA, 21 bp, Homo sapiens
ggggctcctttctccagccag

SEQ ID NO: 4009171 - DNA, 20 bp, Homo sapiens
ggggctctcagctcagcgcc

SEQ ID NO: 4009172 - DNA, 14 bp, Homo sapiens
ggggctgaggggca

SEQ ID NO: 4009173 - DNA, 12 bp, Homo sapiens
ggggctggccat

SEQ ID NO: 4009174 - DNA, 12 bp, Homo sapiens
ggggctggggga

SEQ ID NO: 4009175 - DNA, 18 bp, Homo sapiens
ggggctggggggcacccc

SEQ ID NO: 4009176 - DNA, 19 bp, Homo sapiens
gggggaaaaaaaaaaaaga

SEQ ID NO: 4009177 - DNA, 17 bp, Homo sapiens
gggggaacgatgtgtct

SEQ ID NO: 4009178 - DNA, 18 bp, Homo sapiens
gggggaacgatgtgtctg

SEQ ID NO: 4009179 - DNA, 12 bp, Homo sapiens
gggggaatgagc

SEQ ID NO: 4009180 - DNA, 13 bp, Homo sapiens
gggggacactcca

SEQ ID NO: 4009181 - DNA, 15 bp, Homo sapiens
gggggacagagaagg

SEQ ID NO: 4009182 - DNA, 21 bp, Homo sapiens
gggggaccctgcctcagctga

SEQ ID NO: 4009183 - DNA, 20 bp, Homo sapiens
gggggactctgagcgggagg

SEQ ID NO: 4009184 - DNA, 21 bp, Homo sapiens
gggggactctgagcgggaggc

SEQ ID NO: 4009185 - DNA, 22 bp, Homo sapiens
gggggagccggtaactgtcctg

SEQ ID NO: 4009186 - DNA, 14 bp, Homo sapiens
gggggagggggagg

SEQ ID NO: 4009187 - DNA, 22 bp, Homo sapiens
gggggatagaggggctgcaggg

SEQ ID NO: 4009188 - DNA, 15 bp, Homo sapiens
gggggatgggccagg

SEQ ID NO: 4009189 - DNA, 22 bp, Homo sapiens
gggggattctgagcagtgcctc

SEQ ID NO: 4009190 - DNA, 14 bp, Homo sapiens
gggggccgggcagg

SEQ ID NO: 4009191 - DNA, 12 bp, Homo sapiens
gggggctggggg

SEQ ID NO: 4009192 - DNA, 13 bp, Homo sapiens
gggggtggaggct

SEQ ID NO: 4009193 - DNA, 17 bp, Homo sapiens
gggggtttcacctgggc

SEQ ID NO: 4009194 - DNA, 17 bp, Homo sapiens
ggggtaggcagagcctt

SEQ ID NO: 4009195 - DNA, 14 bp, Homo sapiens
ggggtatgaagagc

SEQ ID NO: 4009196 - DNA, 22 bp, Homo sapiens
ggggtatttaccacagcagctg

SEQ ID NO: 4009197 - DNA, 18 bp, Homo sapiens
ggggtccacccagcaaag

SEQ ID NO: 4009198 - DNA, 13 bp, Homo sapiens
ggggtctcatgtc

SEQ ID NO: 4009199 - DNA, 21 bp, Homo sapiens
ggggtctccctggctccctcc

SEQ ID NO: 4009200 - DNA, 21 bp, Homo sapiens
ggggtctggagttgatctgga

SEQ ID NO: 4009201 - DNA, 12 bp, Homo sapiens
ggggtctttgtg

SEQ ID NO: 4009202 - DNA, 18 bp, Homo sapiens
ggggtgacggccctcatc

SEQ ID NO: 4009203 - DNA, 13 bp, Homo sapiens
ggggtgaggacca

SEQ ID NO: 4009204 - DNA, 15 bp, Homo sapiens
ggggtgcattctggc

SEQ ID NO: 4009205 - DNA, 11 bp, Homo sapiens
ggggtgctgcc

SEQ ID NO: 4009206 - DNA, 22 bp, Homo sapiens
ggggtgtaacttcctgctgcac

SEQ ID NO: 4009207 - DNA, 16 bp, Homo sapiens
ggggtgttcttcttgg

SEQ ID NO: 4009208 - DNA, 18 bp, Homo sapiens
ggggttaagtctcctgtc

SEQ ID NO: 4009209 - DNA, 17 bp, Homo sapiens
ggggttacaaactgcaa

SEQ ID NO: 4009210 - DNA, 14 bp, Homo sapiens
ggggttcaggcccg

SEQ ID NO: 4009211 - DNA, 16 bp, Homo sapiens
ggggttggcagcccac

SEQ ID NO: 4009212 - DNA, 17 bp, Homo sapiens
ggggttggggtgacagt

SEQ ID NO: 4009213 - DNA, 14 bp, Homo sapiens
ggggttggtgggag

SEQ ID NO: 4009214 - DNA, 17 bp, Homo sapiens
ggggttgtgaggcctgg

SEQ ID NO: 4009215 - DNA, 11 bp, Homo sapiens
ggggtttttct

SEQ ID NO: 4009216 - DNA, 14 bp, Homo sapiens
gggtagggagcctc

SEQ ID NO: 4009217 - DNA, 12 bp, Homo sapiens
gggtagtgagca

SEQ ID NO: 4009218 - DNA, 20 bp, Homo sapiens
gggtatccaagttggactgg

SEQ ID NO: 4009219 - DNA, 21 bp, Homo sapiens
gggtatgaagagcttgctttg

SEQ ID NO: 4009220 - DNA, 15 bp, Homo sapiens
gggtatgctcaggtc

SEQ ID NO: 4009221 - DNA, 10 bp, Homo sapiens
gggtattttt

SEQ ID NO: 4009222 - DNA, 21 bp, Homo sapiens
gggtcaaagacagaatggtgg

SEQ ID NO: 4009223 - DNA, 14 bp, Homo sapiens
gggtcagaagagag

SEQ ID NO: 4009224 - DNA, 18 bp, Homo sapiens
gggtcaggccgggcagag

SEQ ID NO: 4009225 - DNA, 21 bp, Homo sapiens
gggtcagtctggtgggaggac

SEQ ID NO: 4009226 - DNA, 20 bp, Homo sapiens
gggtcattgacctctcaggg

SEQ ID NO: 4009227 - DNA, 23 bp, Homo sapiens
gggtcattgacctctcagggcct

SEQ ID NO: 4009228 - DNA, 16 bp, Homo sapiens
gggtcccctccaggag

SEQ ID NO: 4009229 - DNA, 13 bp, Homo sapiens
gggtccctccacc

SEQ ID NO: 4009230 - DNA, 13 bp, Homo sapiens
gggtcctcttctg

SEQ ID NO: 4009231 - DNA, 19 bp, Homo sapiens
gggtcctcttctgggcctg

SEQ ID NO: 4009232 - DNA, 18 bp, Homo sapiens
gggtcctggctcctgagg

SEQ ID NO: 4009233 - DNA, 13 bp, Homo sapiens
gggtcctgggctg

SEQ ID NO: 4009234 - DNA, 14 bp, Homo sapiens
gggtcctgggctgg

SEQ ID NO: 4009235 - DNA, 15 bp, Homo sapiens
gggtccttctccaca

SEQ ID NO: 4009236 - DNA, 23 bp, Homo sapiens
gggtcggaacccaagcttagaac

SEQ ID NO: 4009237 - DNA, 15 bp, Homo sapiens
gggtcggccctgccc

SEQ ID NO: 4009238 - DNA, 16 bp, Homo sapiens
gggtcggccctgccca

SEQ ID NO: 4009239 - DNA, 15 bp, Homo sapiens
gggtctccctggagt

SEQ ID NO: 4009240 - DNA, 13 bp, Homo sapiens
gggtctccctggc

SEQ ID NO: 4009241 - DNA, 14 bp, Homo sapiens
gggtctccctggct

SEQ ID NO: 4009242 - DNA, 17 bp, Homo sapiens
gggtctcgctgtcactg

SEQ ID NO: 4009243 - DNA, 20 bp, Homo sapiens
gggtctgccaccatcctgct

SEQ ID NO: 4009244 - DNA, 22 bp, Homo sapiens
gggtctggcagcctcccatcca

SEQ ID NO: 4009245 - DNA, 11 bp, Homo sapiens
gggtcttccta

SEQ ID NO: 4009246 - DNA, 20 bp, Homo sapiens
gggtcttgctctgtccccca

SEQ ID NO: 4009247 - DNA, 14 bp, Homo sapiens
gggtctttcttggg

SEQ ID NO: 4009248 - DNA, 22 bp, Homo sapiens
gggtctttgtggtagcttatct

SEQ ID NO: 4009249 - DNA, 14 bp, Homo sapiens
gggtgaaggcctgg

SEQ ID NO: 4009250 - DNA, 13 bp, Homo sapiens
gggtgacagtcat

SEQ ID NO: 4009251 - DNA, 18 bp, Homo sapiens
gggtgacagtcatcatca

SEQ ID NO: 4009252 - DNA, 20 bp, Homo sapiens
gggtgacagtcatcatcagg

SEQ ID NO: 4009253 - DNA, 22 bp, Homo sapiens
gggtgacagtcatcatcagggc

SEQ ID NO: 4009254 - DNA, 23 bp, Homo sapiens
gggtgactttgtctctcctggct

SEQ ID NO: 4009255 - DNA, 11 bp, Homo sapiens
gggtgagccag

SEQ ID NO: 4009256 - DNA, 14 bp, Homo sapiens
gggtgaggagctgg

SEQ ID NO: 4009257 - DNA, 16 bp, Homo sapiens
gggtgatttcagagag

SEQ ID NO: 4009258 - DNA, 17 bp, Homo sapiens
gggtgcagcatctggaa

SEQ ID NO: 4009259 - DNA, 23 bp, Homo sapiens
gggtgcagtatcatgccctgtgc

SEQ ID NO: 4009260 - DNA, 20 bp, Homo sapiens
gggtgcatttgagagaagcc

SEQ ID NO: 4009261 - DNA, 20 bp, Homo sapiens
gggtgcctcccacacttgct

SEQ ID NO: 4009262 - DNA, 15 bp, Homo sapiens
gggtgctgccctgtg

SEQ ID NO: 4009263 - DNA, 17 bp, Homo sapiens
gggtgctgccctgtgta

SEQ ID NO: 4009264 - DNA, 13 bp, Homo sapiens
ggtgcaaggaaaa

SEQ ID NO: 4009265 - DNA, 19 bp, Homo sapiens
ggtgcagacaatcttctgt

SEQ ID NO: 4009266 - DNA, 15 bp, Homo sapiens
ggtgcagacagaagt

SEQ ID NO: 4009267 - DNA, 13 bp, Homo sapiens
ggtgcaggtgggc

SEQ ID NO: 4009268 - DNA, 15 bp, Homo sapiens
ggtgcaggtgggcac

SEQ ID NO: 4009269 - DNA, 20 bp, Homo sapiens
ggtgcagttgacagcaggtg

SEQ ID NO: 4009270 - DNA, 19 bp, Homo sapiens
ggtgcatttgagagaagcc

SEQ ID NO: 4009271 - DNA, 17 bp, Homo sapiens
ggtgccaaaaccaggcc

SEQ ID NO: 4009272 - DNA, 15 bp, Homo sapiens
ggtgccaactggtgt

SEQ ID NO: 4009273 - DNA, 13 bp, Homo sapiens
ggtgccagggccc

SEQ ID NO: 4009274 - DNA, 18 bp, Homo sapiens
ggtgccagggcccacccc

SEQ ID NO: 4009275 - DNA, 22 bp, Homo sapiens
ggtgccagggcccaccccagcc

SEQ ID NO: 4009276 - DNA, 23 bp, Homo sapiens
ggtgccagggcccaccccagcct

SEQ ID NO: 4009277 - DNA, 19 bp, Homo sapiens
ggtgcccagaacttccctg

SEQ ID NO: 4009278 - DNA, 21 bp, Homo sapiens
ggtgccccacagctacctgag

SEQ ID NO: 4009279 - DNA, 23 bp, Homo sapiens
ggtgccccacagctacctgagac

SEQ ID NO: 4009280 - DNA, 16 bp, Homo sapiens
ggtgccccaggaccag

SEQ ID NO: 4009281 - DNA, 20 bp, Homo sapiens
ggtgccccaggaccagctca

SEQ ID NO: 4009282 - DNA, 22 bp, Homo sapiens
ggtgccccccacccctggaaga

SEQ ID NO: 4009283 - DNA, 13 bp, Homo sapiens
ggtgcctcagact

SEQ ID NO: 4009284 - DNA, 21 bp, Homo sapiens
ggtgcctcccacacttgctgg

SEQ ID NO: 4009285 - DNA, 19 bp, Homo sapiens
ggtgcctgagaggcaggca

SEQ ID NO: 4009286 - DNA, 14 bp, Homo sapiens
ggtgcctgaggtct

SEQ ID NO: 4009287 - DNA, 22 bp, Homo sapiens
ggtgcctgccaccttcaagttc

SEQ ID NO: 4009288 - DNA, 23 bp, Homo sapiens
ggtgcggatggacactaatgcag

SEQ ID NO: 4009289 - DNA, 24 bp, Homo sapiens
ggtgctagtgggccctctctctgg

SEQ ID NO: 4009290 - DNA, 22 bp, Homo sapiens
ggtgctcattgtaaccatttct

SEQ ID NO: 4009291 - DNA, 15 bp, Homo sapiens
ggtgctgacggccag

SEQ ID NO: 4009292 - DNA, 17 bp, Homo sapiens
ggtgctgacggccaggg

SEQ ID NO: 4009293 - DNA, 15 bp, Homo sapiens
ggtgctgcaggagtg

SEQ ID NO: 4009294 - DNA, 21 bp, Homo sapiens
ggtgctgcaggagtgtcctgc

SEQ ID NO: 4009295 - DNA, 12 bp, Homo sapiens
ggtgctgccctg

SEQ ID NO: 4009296 - DNA, 13 bp, Homo sapiens
ggtgctgccctgt

SEQ ID NO: 4009297 - DNA, 16 bp, Homo sapiens
ggtgctggatattttc

SEQ ID NO: 4009298 - DNA, 12 bp, Homo sapiens
ggtgctggttta

SEQ ID NO: 4009299 - DNA, 14 bp, Homo sapiens
ggtgctgtgaggga

SEQ ID NO: 4009300 - DNA, 17 bp, Homo sapiens
ggtgcttacacatctca

SEQ ID NO: 4009301 - DNA, 19 bp, Homo sapiens
ggtgcttattctcaaagca

SEQ ID NO: 4009302 - DNA, 19 bp, Homo sapiens
ggtgcttttatagaggcta

SEQ ID NO: 4009303 - DNA, 21 bp, Homo sapiens
ggtggaaaggtgtgagactgg

SEQ ID NO: 4009304 - DNA, 19 bp, Homo sapiens
ggtggaagaagggagaaga

SEQ ID NO: 4009305 - DNA, 15 bp, Homo sapiens
ggtggaaggcagaca

SEQ ID NO: 4009306 - DNA, 17 bp, Homo sapiens
ggtggactgcgctggac

SEQ ID NO: 4009307 - DNA, 17 bp, Homo sapiens
ggtggagggcacagccc

SEQ ID NO: 4009308 - DNA, 18 bp, Homo sapiens
ggtggagggcacagccct

SEQ ID NO: 4009309 - DNA, 22 bp, Homo sapiens
ggtggatcacgaggtcaggaga

SEQ ID NO: 4009310 - DNA, 12 bp, Homo sapiens
ggtggcaagtgc

SEQ ID NO: 4009311 - DNA, 23 bp, Homo sapiens
ggtggcacaggagtgtcctcttc

SEQ ID NO: 4009312 - DNA, 17 bp, Homo sapiens
ggtggcacaggccccct

SEQ ID NO: 4009313 - DNA, 17 bp, Homo sapiens
ggtggcagatgtcttcc

SEQ ID NO: 4009314 - DNA, 14 bp, Homo sapiens
ggtggcaggaccag

SEQ ID NO: 4009315 - DNA, 15 bp, Homo sapiens
ggtggcaggaccagg

SEQ ID NO: 4009316 - DNA, 18 bp, Homo sapiens
ggtggcaggaccaggact

SEQ ID NO: 4009317 - DNA, 22 bp, Homo sapiens
ggtggcaggcacacagcagccc

SEQ ID NO: 4009318 - DNA, 13 bp, Homo sapiens
ggtggccacagca

SEQ ID NO: 4009319 - DNA, 14 bp, Homo sapiens
ggtggccatccctg

SEQ ID NO: 4009320 - DNA, 16 bp, Homo sapiens
ggtggccatccctggg

SEQ ID NO: 4009321 - DNA, 19 bp, Homo sapiens
ggtggcccgacagcctggc

SEQ ID NO: 4009322 - DNA, 11 bp, Homo sapiens
ggtggcctcag

SEQ ID NO: 4009323 - DNA, 22 bp, Homo sapiens
ggtggcctcgggacacctgccc

SEQ ID NO: 4009324 - DNA, 16 bp, Homo sapiens
ggtggctgccccggcc

SEQ ID NO: 4009325 - DNA, 18 bp, Homo sapiens
ggtggctgccccggcctc

SEQ ID NO: 4009326 - DNA, 11 bp, Homo sapiens
ggtggctgggc

SEQ ID NO: 4009327 - DNA, 13 bp, Homo sapiens
ggtggctgggcag

SEQ ID NO: 4009328 - DNA, 22 bp, Homo sapiens
ggtgggaaatggtatgagctga

SEQ ID NO: 4009329 - DNA, 21 bp, Homo sapiens
ggtgggaaccatgaagacagg

SEQ ID NO: 4009330 - DNA, 16 bp, Homo sapiens
ggtgggctctgtgcag

SEQ ID NO: 4009331 - DNA, 22 bp, Homo sapiens
ggtgggcttcctgcccttccct

SEQ ID NO: 4009332 - DNA, 15 bp, Homo sapiens
ggtggggcgaggcag

SEQ ID NO: 4009333 - DNA, 20 bp, Homo sapiens
ggtggggggatcacaaggtc

SEQ ID NO: 4009334 - DNA, 15 bp, Homo sapiens
ggtgggggggcagag

SEQ ID NO: 4009335 - DNA, 13 bp, Homo sapiens
ggtgggtgctcag

SEQ ID NO: 4009336 - DNA, 15 bp, Homo sapiens
ggtgggtgctgccct

SEQ ID NO: 4009337 - DNA, 19 bp, Homo sapiens
ggtgggttctttggaagga

SEQ ID NO: 4009338 - DNA, 16 bp, Homo sapiens
ggtggtaccctctgga

SEQ ID NO: 4009339 - DNA, 18 bp, Homo sapiens
ggtggtctgaatgttctg

SEQ ID NO: 4009340 - DNA, 19 bp, Homo sapiens
ggtggtctgaatgttctga

SEQ ID NO: 4009341 - DNA, 14 bp, Homo sapiens
ggtggtggatctgt

SEQ ID NO: 4009342 - DNA, 14 bp, Homo sapiens
ggtggtggcctggt

SEQ ID NO: 4009343 - DNA, 15 bp, Homo sapiens
ggtgtaaagctggcc

SEQ ID NO: 4009344 - DNA, 16 bp, Homo sapiens
ggtgtaaagctggccc

SEQ ID NO: 4009345 - DNA, 22 bp, Homo sapiens
ggtgtaaagctggccctgcctc

SEQ ID NO: 4009346 - DNA, 15 bp, Homo sapiens
ggtgtaacttcctgc

SEQ ID NO: 4009347 - DNA, 17 bp, Homo sapiens
ggtgtaacttcctgctg

SEQ ID NO: 4009348 - DNA, 15 bp, Homo sapiens
ggtgtaataagacat

SEQ ID NO: 4009349 - DNA, 22 bp, Homo sapiens
ggtgtagaacactaattcataa

SEQ ID NO: 4009350 - DNA, 15 bp, Homo sapiens
ggtgtatataatttt

SEQ ID NO: 4009351 - DNA, 14 bp, Homo sapiens
ggtgtcatttcatt

SEQ ID NO: 4009352 - DNA, 18 bp, Homo sapiens
ggtgtcatttcattccat

SEQ ID NO: 4009353 - DNA, 15 bp, Homo sapiens
ggtgtcctgcctgtc

SEQ ID NO: 4009354 - DNA, 13 bp, Homo sapiens
ggtgtctggcctg

SEQ ID NO: 4009355 - DNA, 15 bp, Homo sapiens
ggtgtctttctcttt

SEQ ID NO: 4009356 - DNA, 18 bp, Homo sapiens
ggtgtgaacctacctgcc

SEQ ID NO: 4009357 - DNA, 15 bp, Homo sapiens
ggtgtgacctgaggg

SEQ ID NO: 4009358 - DNA, 21 bp, Homo sapiens
ggtgtgagaagtgccttctcc

SEQ ID NO: 4009359 - DNA, 22 bp, Homo sapiens
ggtgtgagggcagtgcaaggag

SEQ ID NO: 4009360 - DNA, 14 bp, Homo sapiens
ggtgtgcctggcct

SEQ ID NO: 4009361 - DNA, 22 bp, Homo sapiens
ggtgtggggacacagcagtgag

SEQ ID NO: 4009362 - DNA, 20 bp, Homo sapiens
ggtgtgggtggaagggctgg

SEQ ID NO: 4009363 - DNA, 18 bp, Homo sapiens
ggtgtgtggagatgcaga

SEQ ID NO: 4009364 - DNA, 22 bp, Homo sapiens
ggtgttctttcctgccctgtcc

SEQ ID NO: 4009365 - DNA, 21 bp, Homo sapiens
ggtgttgccaaatatgtcctg

SEQ ID NO: 4009366 - DNA, 12 bp, Homo sapiens
ggtgtttattgc

SEQ ID NO: 4009367 - DNA, 14 bp, Homo sapiens
gtacagaatttcca

SEQ ID NO: 4009368 - DNA, 15 bp, Homo sapiens
gtacagaattttgga

SEQ ID NO: 4009369 - DNA, 16 bp, Homo sapiens
gtacagggttatctgc

SEQ ID NO: 4009370 - DNA, 16 bp, Homo sapiens
gtacataaaagaattt

SEQ ID NO: 4009371 - DNA, 22 bp, Homo sapiens
gtacataatgcttaatttctaa

SEQ ID NO: 4009372 - DNA, 23 bp, Homo sapiens
gtacatataaatgaatctggtgt

SEQ ID NO: 4009373 - DNA, 16 bp, Homo sapiens
gtacatatgtgctgga

SEQ ID NO: 4009374 - DNA, 17 bp, Homo sapiens
gtacatatttattttct

SEQ ID NO: 4009375 - DNA, 19 bp, Homo sapiens
gtacatatttattttcttt

SEQ ID NO: 4009376 - DNA, 18 bp, Homo sapiens
gtacatctattttggatt

SEQ ID NO: 4009377 - DNA, 18 bp, Homo sapiens
gtacatctgcaatatgaa

SEQ ID NO: 4009378 - DNA, 22 bp, Homo sapiens
gtacatttatgatttaataaaa

SEQ ID NO: 4009379 - DNA, 18 bp, Homo sapiens
gtacatttatttattact

SEQ ID NO: 4009380 - DNA, 21 bp, Homo sapiens
gtacatttatttattactgtc

SEQ ID NO: 4009381 - DNA, 22 bp, Homo sapiens
gtacatttatttattactgtcc

SEQ ID NO: 4009382 - DNA, 15 bp, Homo sapiens
gtacatttggagaca

SEQ ID NO: 4009383 - DNA, 15 bp, Homo sapiens
gtaccaaatctgaca

SEQ ID NO: 4009384 - DNA, 14 bp, Homo sapiens
gtaccaatcatttt

SEQ ID NO: 4009385 - DNA, 15 bp, Homo sapiens
gtaccacagacacaa

SEQ ID NO: 4009386 - DNA, 22 bp, Homo sapiens
gtaccacagacacaatatgtat

SEQ ID NO: 4009387 - DNA, 21 bp, Homo sapiens
gtaccagcgctctaaaagcac

SEQ ID NO: 4009388 - DNA, 22 bp, Homo sapiens
gtaccagcgctctaaaagcacc

SEQ ID NO: 4009389 - DNA, 18 bp, Homo sapiens
gtaccaggggctgggctc

SEQ ID NO: 4009390 - DNA, 22 bp, Homo sapiens
gtaccaggggctgggctccctg

SEQ ID NO: 4009391 - DNA, 21 bp, Homo sapiens
gtaccagttctttaagaagat

SEQ ID NO: 4009392 - DNA, 20 bp, Homo sapiens
gtaccatagtaccatttata

SEQ ID NO: 4009393 - DNA, 21 bp, Homo sapiens
gtaccatttatacaaattaga

SEQ ID NO: 4009394 - DNA, 16 bp, Homo sapiens
gtacccagatgcctac

SEQ ID NO: 4009395 - DNA, 17 bp, Homo sapiens
gtacccatctagtactt

SEQ ID NO: 4009396 - DNA, 18 bp, Homo sapiens
gtaccctctcagctccag

SEQ ID NO: 4009397 - DNA, 15 bp, Homo sapiens
gtaccctctggaggg

SEQ ID NO: 4009398 - DNA, 13 bp, Homo sapiens
gtaccctttaaga

SEQ ID NO: 4009399 - DNA, 20 bp, Homo sapiens
gtaccctttaagatatccat

SEQ ID NO: 4009400 - DNA, 16 bp, Homo sapiens
gtacctcaagccccat

SEQ ID NO: 4009401 - DNA, 18 bp, Homo sapiens
gtacctcctctcagtgtt

SEQ ID NO: 4009402 - DNA, 22 bp, Homo sapiens
gtacctctcaagctagtgtttc

SEQ ID NO: 4009403 - DNA, 12 bp, Homo sapiens
gtacctggtgga

SEQ ID NO: 4009404 - DNA, 13 bp, Homo sapiens
gtacctttgtcac

SEQ ID NO: 4009405 - DNA, 21 bp, Homo sapiens
gtacgttattgttgacttatt

SEQ ID NO: 4009406 - DNA, 23 bp, Homo sapiens
gtactaaggaatctttctgcttt

SEQ ID NO: 4009407 - DNA, 19 bp, Homo sapiens
gtactagatgcatcactgg

SEQ ID NO: 4009408 - DNA, 21 bp, Homo sapiens
gtactagatgcatcactgggt

SEQ ID NO: 4009409 - DNA, 16 bp, Homo sapiens
gtactagttacacatc

SEQ ID NO: 4009410 - DNA, 13 bp, Homo sapiens
gtactagttttag

SEQ ID NO: 4009411 - DNA, 15 bp, Homo sapiens
gtactatgtatcaat

SEQ ID NO: 4009412 - DNA, 21 bp, Homo sapiens
gtactatttagatataacact

SEQ ID NO: 4009413 - DNA, 16 bp, Homo sapiens
gtactcactgaagcct

SEQ ID NO: 4009414 - DNA, 22 bp, Homo sapiens
gtactgaatttttttgtaataa

SEQ ID NO: 4009415 - DNA, 18 bp, Homo sapiens
gtactgactttgcttgct

SEQ ID NO: 4009416 - DNA, 19 bp, Homo sapiens
gtactgccccccatgagga

SEQ ID NO: 4009417 - DNA, 21 bp, Homo sapiens
gtactgccccccatgaggaag

SEQ ID NO: 4009418 - DNA, 23 bp, Homo sapiens
gtactgtatggaaacactgattt

SEQ ID NO: 4009419 - DNA, 17 bp, Homo sapiens
gtactgttctgtgtctt

SEQ ID NO: 4009420 - DNA, 19 bp, Homo sapiens
gtacttaaatgaaagcatg

SEQ ID NO: 4009421 - DNA, 13 bp, Homo sapiens
gtacttcccgggc

SEQ ID NO: 4009422 - DNA, 15 bp, Homo sapiens
gtacttcctttctcc

SEQ ID NO: 4009423 - DNA, 21 bp, Homo sapiens
gtacttggagtattggggtct

SEQ ID NO: 4009424 - DNA, 20 bp, Homo sapiens
gtacttgtgaaacacagctg

SEQ ID NO: 4009425 - DNA, 15 bp, Homo sapiens
gtacttgtgtttgct

SEQ ID NO: 4009426 - DNA, 17 bp, Homo sapiens
gtacttgtgtttgctta

SEQ ID NO: 4009427 - DNA, 19 bp, Homo sapiens
gtacttgtttcatctggtt

SEQ ID NO: 4009428 - DNA, 16 bp, Homo sapiens
gtacttgtttctctgt

SEQ ID NO: 4009429 - DNA, 18 bp, Homo sapiens
gtactttctaagagaaag

SEQ ID NO: 4009430 - DNA, 22 bp, Homo sapiens
gtagaaatgcaagggggacaca

SEQ ID NO: 4009431 - DNA, 17 bp, Homo sapiens
gtagaacactaattcat

SEQ ID NO: 4009432 - DNA, 16 bp, Homo sapiens
gtagaacgccagggac

SEQ ID NO: 4009433 - DNA, 18 bp, Homo sapiens
gtagaacgtaaccacgga

SEQ ID NO: 4009434 - DNA, 16 bp, Homo sapiens
gtagaactgtctgtga

SEQ ID NO: 4009435 - DNA, 13 bp, Homo sapiens
gtagactagtgcc

SEQ ID NO: 4009436 - DNA, 18 bp, Homo sapiens
gtagactggcctgaacca

SEQ ID NO: 4009437 - DNA, 15 bp, Homo sapiens
gtagactgtgccaga

SEQ ID NO: 4009438 - DNA, 17 bp, Homo sapiens
gtagagaggggactggg

SEQ ID NO: 4009439 - DNA, 15 bp, Homo sapiens
gtagagtcatctcca

SEQ ID NO: 4009440 - DNA, 23 bp, Homo sapiens
gtagagtcatctccatcagctgt

SEQ ID NO: 4009441 - DNA, 20 bp, Homo sapiens
gtagagtgtagactgtggct

SEQ ID NO: 4009442 - DNA, 15 bp, Homo sapiens
gtagataaatatttg

SEQ ID NO: 4009443 - DNA, 17 bp, Homo sapiens
gtagatgcagaaaaaga

SEQ ID NO: 4009444 - DNA, 17 bp, Homo sapiens
gtagatgggagggaggc

SEQ ID NO: 4009445 - DNA, 18 bp, Homo sapiens
gtagattttaaagacaaa

SEQ ID NO: 4009446 - DNA, 20 bp, Homo sapiens
gtagcaagttctagagaaga

SEQ ID NO: 4009447 - DNA, 21 bp, Homo sapiens
gtagcaagttctagagaagag

SEQ ID NO: 4009448 - DNA, 19 bp, Homo sapiens
gtagcataaataaaactga

SEQ ID NO: 4009449 - DNA, 21 bp, Homo sapiens
gtagccagcacacagggcagt

SEQ ID NO: 4009450 - DNA, 13 bp, Homo sapiens
gtagccatctgca

SEQ ID NO: 4009451 - DNA, 17 bp, Homo sapiens
gtagcccatccttccct

SEQ ID NO: 4009452 - DNA, 15 bp, Homo sapiens
gtagccccctcttcc

SEQ ID NO: 4009453 - DNA, 19 bp, Homo sapiens
gtagccccctcttccctgg

SEQ ID NO: 4009454 - DNA, 18 bp, Homo sapiens
gtagcctttttgtataaa

SEQ ID NO: 4009455 - DNA, 18 bp, Homo sapiens
gtagcgttttttaaatgt

SEQ ID NO: 4009456 - DNA, 18 bp, Homo sapiens
gtagctgggatgacaggc

SEQ ID NO: 4009457 - DNA, 15 bp, Homo sapiens
gtagcttaagaaaaa

SEQ ID NO: 4009458 - DNA, 14 bp, Homo sapiens
gtagcttgctccct

SEQ ID NO: 4009459 - DNA, 19 bp, Homo sapiens
gtagcttgctccctgtgtc

SEQ ID NO: 4009460 - DNA, 11 bp, Homo sapiens
gtagctttgca

SEQ ID NO: 4009461 - DNA, 14 bp, Homo sapiens
gtaggaaagggcgc

SEQ ID NO: 4009462 - DNA, 22 bp, Homo sapiens
gtaggaaccgtggtatgtctgc

SEQ ID NO: 4009463 - DNA, 21 bp, Homo sapiens
gtaggaatgtacatgaagcaa

SEQ ID NO: 4009464 - DNA, 20 bp, Homo sapiens
gtaggacaaggtgcaggcag

SEQ ID NO: 4009465 - DNA, 13 bp, Homo sapiens
gtaggcagagcct

SEQ ID NO: 4009466 - DNA, 15 bp, Homo sapiens
gtaggcagagccttt

SEQ ID NO: 4009467 - DNA, 13 bp, Homo sapiens
gtaggctggggcg

SEQ ID NO: 4009468 - DNA, 16 bp, Homo sapiens
gtagggaggcagcctc

SEQ ID NO: 4009469 - DNA, 13 bp, Homo sapiens
gtcagagtgttgt

SEQ ID NO: 4009470 - DNA, 12 bp, Homo sapiens
gtcagatgagca

SEQ ID NO: 4009471 - DNA, 15 bp, Homo sapiens
gtcagatgagcaagg

SEQ ID NO: 4009472 - DNA, 18 bp, Homo sapiens
gtcagatgggaagacatg

SEQ ID NO: 4009473 - DNA, 21 bp, Homo sapiens
gtcagatttctggttgatttg

SEQ ID NO: 4009474 - DNA, 16 bp, Homo sapiens
gtcagcagacacacat

SEQ ID NO: 4009475 - DNA, 16 bp, Homo sapiens
gtcagcatctggctgt

SEQ ID NO: 4009476 - DNA, 18 bp, Homo sapiens
gtcagcatctggctgtct

SEQ ID NO: 4009477 - DNA, 16 bp, Homo sapiens
gtcagcatgcttccca

SEQ ID NO: 4009478 - DNA, 22 bp, Homo sapiens
gtcagcatgcttcccagaggga

SEQ ID NO: 4009479 - DNA, 18 bp, Homo sapiens
gtcagccagccgccctgg

SEQ ID NO: 4009480 - DNA, 21 bp, Homo sapiens
gtcagccagccgccctgggct

SEQ ID NO: 4009481 - DNA, 15 bp, Homo sapiens
gtcagccaggagctg

SEQ ID NO: 4009482 - DNA, 11 bp, Homo sapiens
gtcagccaggg

SEQ ID NO: 4009483 - DNA, 17 bp, Homo sapiens
gtcagctactaatgatg

SEQ ID NO: 4009484 - DNA, 13 bp, Homo sapiens
gtcagctctctgc

SEQ ID NO: 4009485 - DNA, 16 bp, Homo sapiens
gtcagctctctgccct

SEQ ID NO: 4009486 - DNA, 17 bp, Homo sapiens
gtcagctctctgccctg

SEQ ID NO: 4009487 - DNA, 18 bp, Homo sapiens
gtcagcttttgttgttta

SEQ ID NO: 4009488 - DNA, 17 bp, Homo sapiens
gtcaggaacagaaggat

SEQ ID NO: 4009489 - DNA, 22 bp, Homo sapiens
gtcaggaacagtggctgggtgg

SEQ ID NO: 4009490 - DNA, 19 bp, Homo sapiens
gtcaggacggctcctcaga

SEQ ID NO: 4009491 - DNA, 21 bp, Homo sapiens
gtcaggagttgtttctgaccc

SEQ ID NO: 4009492 - DNA, 18 bp, Homo sapiens
gtcaggcccccagtggga

SEQ ID NO: 4009493 - DNA, 17 bp, Homo sapiens
gtcaggccctgactcct

SEQ ID NO: 4009494 - DNA, 21 bp, Homo sapiens
gtcaggccctgactcctctgg

SEQ ID NO: 4009495 - DNA, 17 bp, Homo sapiens
gtcaggccgggcagagc

SEQ ID NO: 4009496 - DNA, 19 bp, Homo sapiens
gtcaggccgggcagagcac

SEQ ID NO: 4009497 - DNA, 22 bp, Homo sapiens
gtcaggccgggcagagcacagc

SEQ ID NO: 4009498 - DNA, 23 bp, Homo sapiens
gtcaggcctgtgtgtgaaaggaa

SEQ ID NO: 4009499 - DNA, 21 bp, Homo sapiens
gtcaggcggggtgctgtggtg

SEQ ID NO: 4009500 - DNA, 14 bp, Homo sapiens
gtcaggctctctgg

SEQ ID NO: 4009501 - DNA, 16 bp, Homo sapiens
gtcaggctctctgggc

SEQ ID NO: 4009502 - DNA, 19 bp, Homo sapiens
gtcaggctgggcagcccca

SEQ ID NO: 4009503 - DNA, 17 bp, Homo sapiens
gtcagggacttggacag

SEQ ID NO: 4009504 - DNA, 18 bp, Homo sapiens
gtcagggacttggacagg

SEQ ID NO: 4009505 - DNA, 13 bp, Homo sapiens
gtcagggagtgct

SEQ ID NO: 4009506 - DNA, 14 bp, Homo sapiens
gtcaggggggagaa

SEQ ID NO: 4009507 - DNA, 22 bp, Homo sapiens
gtcagggttggtgtgctgaggt

SEQ ID NO: 4009508 - DNA, 12 bp, Homo sapiens
gtcaggtgctca

SEQ ID NO: 4009509 - DNA, 19 bp, Homo sapiens
gtcaggttatactcctcct

SEQ ID NO: 4009510 - DNA, 13 bp, Homo sapiens
gtcaggttgacag

SEQ ID NO: 4009511 - DNA, 18 bp, Homo sapiens
gtcaggttgacaggaggt

SEQ ID NO: 4009512 - DNA, 23 bp, Homo sapiens
gtcagtcgcctttcagcaggcag

SEQ ID NO: 4009513 - DNA, 21 bp, Homo sapiens
gtcagtcttcacttgcactgg

SEQ ID NO: 4009514 - DNA, 14 bp, Homo sapiens
gtcagtgttgagat

SEQ ID NO: 4009515 - DNA, 15 bp, Homo sapiens
gtcagttcttggtgc

SEQ ID NO: 4009516 - DNA, 18 bp, Homo sapiens
gtcataactaaataaagc

SEQ ID NO: 4009517 - DNA, 14 bp, Homo sapiens
gtcatcatcagggc

SEQ ID NO: 4009518 - DNA, 17 bp, Homo sapiens
gtcatcatcagggcctg

SEQ ID NO: 4009519 - DNA, 23 bp, Homo sapiens
gtcatcatcagggcctggggcct

SEQ ID NO: 4009520 - DNA, 15 bp, Homo sapiens
gtcatccaacaagaa

SEQ ID NO: 4009521 - DNA, 21 bp, Homo sapiens
gtcatccaacaagaagaaata

SEQ ID NO: 4009522 - DNA, 19 bp, Homo sapiens
gtcatcggaggctgggccc

SEQ ID NO: 4009523 - DNA, 22 bp, Homo sapiens
gtcatctaaccattaagtcatg

SEQ ID NO: 4009524 - DNA, 15 bp, Homo sapiens
gtcatctacttaata

SEQ ID NO: 4009525 - DNA, 14 bp, Homo sapiens
gtcatctctctggg

SEQ ID NO: 4009526 - DNA, 23 bp, Homo sapiens
gtcatctctctggggccctgggc

SEQ ID NO: 4009527 - DNA, 14 bp, Homo sapiens
gtcatgaagcccaa

SEQ ID NO: 4009528 - DNA, 19 bp, Homo sapiens
gtcatgatgctctttccca

SEQ ID NO: 4009529 - DNA, 14 bp, Homo sapiens
gtcatgcaaagatt

SEQ ID NO: 4009530 - DNA, 13 bp, Homo sapiens
gtcatgcataaat

SEQ ID NO: 4009531 - DNA, 19 bp, Homo sapiens
gtcatgctcccctgtgcca

SEQ ID NO: 4009532 - DNA, 21 bp, Homo sapiens
gtcatggagaatctgctgcat

SEQ ID NO: 4009533 - DNA, 20 bp, Homo sapiens
gtcatggggatcaattttca

SEQ ID NO: 4009534 - DNA, 14 bp, Homo sapiens
gtcatgtctgcttg

SEQ ID NO: 4009535 - DNA, 11 bp, Homo sapiens
gtcatgtgacc

SEQ ID NO: 4009536 - DNA, 15 bp, Homo sapiens
gtcatgtttgcaggg

SEQ ID NO: 4009537 - DNA, 12 bp, Homo sapiens
gtcattaaaggt

SEQ ID NO: 4009538 - DNA, 16 bp, Homo sapiens
gtcattagactcctcc

SEQ ID NO: 4009539 - DNA, 21 bp, Homo sapiens
gtcattattttgggaagaaaa

SEQ ID NO: 4009540 - DNA, 18 bp, Homo sapiens
gtcattctaggatgtgga

SEQ ID NO: 4009541 - DNA, 14 bp, Homo sapiens
gtcattcttcccta

SEQ ID NO: 4009542 - DNA, 13 bp, Homo sapiens
gtcattgacctct

SEQ ID NO: 4009543 - DNA, 19 bp, Homo sapiens
gtcattgacctctcagggc

SEQ ID NO: 4009544 - DNA, 21 bp, Homo sapiens
gtcattgacctctcagggcct

SEQ ID NO: 4009545 - DNA, 15 bp, Homo sapiens
gtcattgactcttgc

SEQ ID NO: 4009546 - DNA, 21 bp, Homo sapiens
gtcattgactcttgcgtgtca

SEQ ID NO: 4009547 - DNA, 15 bp, Homo sapiens
gtcattgcttcttct

SEQ ID NO: 4009548 - DNA, 16 bp, Homo sapiens
gtcattgcttcttctg

SEQ ID NO: 4009549 - DNA, 15 bp, Homo sapiens
gtcatttaaatgtgt

SEQ ID NO: 4009550 - DNA, 16 bp, Homo sapiens
gtcatttactaaacat

SEQ ID NO: 4009551 - DNA, 15 bp, Homo sapiens
gtcatttcattccat

SEQ ID NO: 4009552 - DNA, 16 bp, Homo sapiens
gtcatttcattccatt

SEQ ID NO: 4009553 - DNA, 22 bp, Homo sapiens
gtcatttgctgagcatgtactg

SEQ ID NO: 4009554 - DNA, 20 bp, Homo sapiens
gtccaaaaaaaggaaaaata

SEQ ID NO: 4009555 - DNA, 20 bp, Homo sapiens
gtccaaggggtcccctccag

SEQ ID NO: 4009556 - DNA, 23 bp, Homo sapiens
gtccaaggtggcagatgtcttcc

SEQ ID NO: 4009557 - DNA, 22 bp, Homo sapiens
gtccaagttcttcacctctatc

SEQ ID NO: 4009558 - DNA, 12 bp, Homo sapiens
gtccaataagac

SEQ ID NO: 4009559 - DNA, 11 bp, Homo sapiens
gtccacccagc

SEQ ID NO: 4009560 - DNA, 19 bp, Homo sapiens
gtccaccccccacacacac

SEQ ID NO: 4009561 - DNA, 21 bp, Homo sapiens
gtccaccccccacacacacta

SEQ ID NO: 4009562 - DNA, 13 bp, Homo sapiens
gtccactccctgc

SEQ ID NO: 4009563 - DNA, 20 bp, Homo sapiens
gtccactgtcactgtttctc

SEQ ID NO: 4009564 - DNA, 21 bp, Homo sapiens
gtccagaagaatattcaggac

SEQ ID NO: 4009565 - DNA, 16 bp, Homo sapiens
gtccagagctgcttcc

SEQ ID NO: 4009566 - DNA, 22 bp, Homo sapiens
gtccagattattggctgctttg

SEQ ID NO: 4009567 - DNA, 22 bp, Homo sapiens
gtccagccgccattgccaccag

SEQ ID NO: 4009568 - DNA, 13 bp, Homo sapiens
gtccagctggggc

SEQ ID NO: 4009569 - DNA, 13 bp, Homo sapiens
gtccagggaagag

SEQ ID NO: 4009570 - DNA, 13 bp, Homo sapiens
gtccagggaagct

SEQ ID NO: 4009571 - DNA, 14 bp, Homo sapiens
gtccagggcctgac

SEQ ID NO: 4009572 - DNA, 15 bp, Homo sapiens
gtcctgcctgtctgc

SEQ ID NO: 4009573 - DNA, 17 bp, Homo sapiens
gtcctgctggcttccag

SEQ ID NO: 4009574 - DNA, 21 bp, Homo sapiens
gtcctggaagcgcgagggcct

SEQ ID NO: 4009575 - DNA, 16 bp, Homo sapiens
gtcctggaatttggac

SEQ ID NO: 4009576 - DNA, 21 bp, Homo sapiens
gtcctggccagatggcccgga

SEQ ID NO: 4009577 - DNA, 20 bp, Homo sapiens
gtcctggctacatcccagcc

SEQ ID NO: 4009578 - DNA, 17 bp, Homo sapiens
gtcctggctcctgaggg

SEQ ID NO: 4009579 - DNA, 13 bp, Homo sapiens
gtcctgggcctgc

SEQ ID NO: 4009580 - DNA, 15 bp, Homo sapiens
gtcctgggcctgccc

SEQ ID NO: 4009581 - DNA, 13 bp, Homo sapiens
gtcctgtactgta

SEQ ID NO: 4009582 - DNA, 19 bp, Homo sapiens
gtccttaacccacctctcc

SEQ ID NO: 4009583 - DNA, 23 bp, Homo sapiens
gtccttaacccacctctcctgcc

SEQ ID NO: 4009584 - DNA, 15 bp, Homo sapiens
gtccttagaacattt

SEQ ID NO: 4009585 - DNA, 13 bp, Homo sapiens
gtccttcaaaggc

SEQ ID NO: 4009586 - DNA, 14 bp, Homo sapiens
gtccttctaatgaa

SEQ ID NO: 4009587 - DNA, 21 bp, Homo sapiens
gtccttctaatgaagacaatg

SEQ ID NO: 4009588 - DNA, 18 bp, Homo sapiens
gtccttgcacccctcact

SEQ ID NO: 4009589 - DNA, 23 bp, Homo sapiens
gtccttggactgttttgaaaagt

SEQ ID NO: 4009590 - DNA, 12 bp, Homo sapiens
gtccttttggtt

SEQ ID NO: 4009591 - DNA, 21 bp, Homo sapiens
gtcgaatgggtaaaggagcat

SEQ ID NO: 4009592 - DNA, 14 bp, Homo sapiens
gtcgccccaggccc

SEQ ID NO: 4009593 - DNA, 22 bp, Homo sapiens
gtcgccccaggccctccctgac

SEQ ID NO: 4009594 - DNA, 14 bp, Homo sapiens
gtcgcctgcctgca

SEQ ID NO: 4009595 - DNA, 18 bp, Homo sapiens
gtcgcctgcctgcagcag

SEQ ID NO: 4009596 - DNA, 22 bp, Homo sapiens
gtcggctccagtccccagaact

SEQ ID NO: 4009597 - DNA, 14 bp, Homo sapiens
gtcgggcaccagcc

SEQ ID NO: 4009598 - DNA, 15 bp, Homo sapiens
gtcgggcagccagca

SEQ ID NO: 4009599 - DNA, 14 bp, Homo sapiens
gtcgggggctgagg

SEQ ID NO: 4009600 - DNA, 12 bp, Homo sapiens
gtctaaaaacac

SEQ ID NO: 4009601 - DNA, 17 bp, Homo sapiens
gtctaaacaaaattgca

SEQ ID NO: 4009602 - DNA, 21 bp, Homo sapiens
gtctaaacaatgctgatttgg

SEQ ID NO: 4009603 - DNA, 15 bp, Homo sapiens
gtctaaatgctgaaa

SEQ ID NO: 4009604 - DNA, 13 bp, Homo sapiens
gtctaaatttgaa

SEQ ID NO: 4009605 - DNA, 13 bp, Homo sapiens
gtctaacccccag

SEQ ID NO: 4009606 - DNA, 15 bp, Homo sapiens
gtctaacccccagct

SEQ ID NO: 4009607 - DNA, 17 bp, Homo sapiens
gtctaacccccagctgg

SEQ ID NO: 4009608 - DNA, 23 bp, Homo sapiens
gtctaactttagaagtgcatttc

SEQ ID NO: 4009609 - DNA, 21 bp, Homo sapiens
gtctaagatagtaacaatgaa

SEQ ID NO: 4009610 - DNA, 22 bp, Homo sapiens
gtctaattgcatctcaaaatta

SEQ ID NO: 4009611 - DNA, 21 bp, Homo sapiens
gtctaccaccgaatccctagt

SEQ ID NO: 4009612 - DNA, 12 bp, Homo sapiens
gtctagaatgtg

SEQ ID NO: 4009613 - DNA, 18 bp, Homo sapiens
gtctaggtctcctcaggg

SEQ ID NO: 4009614 - DNA, 23 bp, Homo sapiens
gtctagttgccaaatctggctcc

SEQ ID NO: 4009615 - DNA, 16 bp, Homo sapiens
gtctatttttgtctta

SEQ ID NO: 4009616 - DNA, 13 bp, Homo sapiens
gtctattttttta

SEQ ID NO: 4009617 - DNA, 16 bp, Homo sapiens
gtctcaaaaatacaaa

SEQ ID NO: 4009618 - DNA, 18 bp, Homo sapiens
gtctcaacgcctccccct

SEQ ID NO: 4009619 - DNA, 17 bp, Homo sapiens
gtctcaagagggcactg

SEQ ID NO: 4009620 - DNA, 20 bp, Homo sapiens
gtctcaagagggcactggtg

SEQ ID NO: 4009621 - DNA, 19 bp, Homo sapiens
gtctcaagggctagcatcc

SEQ ID NO: 4009622 - DNA, 15 bp, Homo sapiens
gtctcactgttctgc

SEQ ID NO: 4009623 - DNA, 17 bp, Homo sapiens
gtctcagaaactcccct

SEQ ID NO: 4009624 - DNA, 23 bp, Homo sapiens
gtctcagaaactcccctgggggt

SEQ ID NO: 4009625 - DNA, 18 bp, Homo sapiens
gtctcagtttgtgtgtct

SEQ ID NO: 4009626 - DNA, 21 bp, Homo sapiens
gtctcagtttgtgtgtcttaa

SEQ ID NO: 4009627 - DNA, 16 bp, Homo sapiens
gtctcatccccagggg

SEQ ID NO: 4009628 - DNA, 17 bp, Homo sapiens
gtctcatgtcctgctgg

SEQ ID NO: 4009629 - DNA, 20 bp, Homo sapiens
gtctcatgtcctgctggctt

SEQ ID NO: 4009630 - DNA, 19 bp, Homo sapiens
gtctcattccgttgtctgt

SEQ ID NO: 4009631 - DNA, 23 bp, Homo sapiens
gtctccactaaatgagctcctgc

SEQ ID NO: 4009632 - DNA, 13 bp, Homo sapiens
gtctccagctgcc

SEQ ID NO: 4009633 - DNA, 19 bp, Homo sapiens
gtctccagctgcctgggcc

SEQ ID NO: 4009634 - DNA, 23 bp, Homo sapiens
gtctccatgaagagcttgtgtcc

SEQ ID NO: 4009635 - DNA, 13 bp, Homo sapiens
gtctccatgtttg

SEQ ID NO: 4009636 - DNA, 19 bp, Homo sapiens
gtctccccaattctcccct

SEQ ID NO: 4009637 - DNA, 23 bp, Homo sapiens
gtctccctcgacagcgcccctgc

SEQ ID NO: 4009638 - DNA, 12 bp, Homo sapiens
gtctccctctga

SEQ ID NO: 4009639 - DNA, 18 bp, Homo sapiens
gtctccctttcccttctt

SEQ ID NO: 4009640 - DNA, 22 bp, Homo sapiens
gtctcctcagggtggggggtga

SEQ ID NO: 4009641 - DNA, 20 bp, Homo sapiens
gtctcctctatcctgggctt

SEQ ID NO: 4009642 - DNA, 23 bp, Homo sapiens
gtctcctgtcttatggtccagaa

SEQ ID NO: 4009643 - DNA, 16 bp, Homo sapiens
gtctcctttgcactga

SEQ ID NO: 4009644 - DNA, 15 bp, Homo sapiens
gtctcgatctcctga

SEQ ID NO: 4009645 - DNA, 14 bp, Homo sapiens
gtctcgctgtcact

SEQ ID NO: 4009646 - DNA, 18 bp, Homo sapiens
gtctcgctgtcactggct

SEQ ID NO: 4009647 - DNA, 23 bp, Homo sapiens
gtctcggaacctgtgagctgcac

SEQ ID NO: 4009648 - DNA, 21 bp, Homo sapiens
gtctcggatgacaccctggcc

SEQ ID NO: 4009649 - DNA, 12 bp, Homo sapiens
gtctctagagca

SEQ ID NO: 4009650 - DNA, 16 bp, Homo sapiens
gtctctctgtgaatac

SEQ ID NO: 4009651 - DNA, 23 bp, Homo sapiens
gtctctgctcgccctcctttctg

SEQ ID NO: 4009652 - DNA, 15 bp, Homo sapiens
gtctcttctccactg

SEQ ID NO: 4009653 - DNA, 13 bp, Homo sapiens
gtctcttctcctt

SEQ ID NO: 4009654 - DNA, 14 bp, Homo sapiens
gtctcttctcctta

SEQ ID NO: 4009655 - DNA, 23 bp, Homo sapiens
gtctcttgagggagcttagccaa

SEQ ID NO: 4009656 - DNA, 16 bp, Homo sapiens
gtctcttgtattaaac

SEQ ID NO: 4009657 - DNA, 17 bp, Homo sapiens
gtctctttaagggcatg

SEQ ID NO: 4009658 - DNA, 11 bp, Homo sapiens
gtctcttttgt

SEQ ID NO: 4009659 - DNA, 17 bp, Homo sapiens
gtctcttttgtaaatta

SEQ ID NO: 4009660 - DNA, 18 bp, Homo sapiens
gtctcttttgtaaattaa

SEQ ID NO: 4009661 - DNA, 19 bp, Homo sapiens
gtctcttttgtaaattaaa

SEQ ID NO: 4009662 - DNA, 11 bp, Homo sapiens
gtctgaaatgg

SEQ ID NO: 4009663 - DNA, 19 bp, Homo sapiens
gtctgaagtcactgcacag

SEQ ID NO: 4009664 - DNA, 20 bp, Homo sapiens
gtctgaatgttctgacatta

SEQ ID NO: 4009665 - DNA, 13 bp, Homo sapiens
gtctgaatttatt

SEQ ID NO: 4009666 - DNA, 17 bp, Homo sapiens
gtctgactctccactcc

SEQ ID NO: 4009667 - DNA, 16 bp, Homo sapiens
gtctgagcatgatggg

SEQ ID NO: 4009668 - DNA, 20 bp, Homo sapiens
gtctgattggctcacccaag

SEQ ID NO: 4009669 - DNA, 22 bp, Homo sapiens
gtctgatttcaggatactctgt

SEQ ID NO: 4009670 - DNA, 22 bp, Homo sapiens
gtctgattttctcactgaactc

SEQ ID NO: 4009671 - DNA, 13 bp, Homo sapiens
gtctgcacccagg

SEQ ID NO: 4009672 - DNA, 15 bp, Homo sapiens
gtctgcacccagggg

SEQ ID NO: 4009673 - DNA, 18 bp, Homo sapiens
gtctgccaccatcctgct

SEQ ID NO: 4009674 - DNA, 22 bp, Homo sapiens
gtgattccactacacctggctg

SEQ ID NO: 4009675 - DNA, 20 bp, Homo sapiens
gtgattgacacacagcactc

SEQ ID NO: 4009676 - DNA, 15 bp, Homo sapiens
gtgattgcacagaat

SEQ ID NO: 4009677 - DNA, 18 bp, Homo sapiens
gtgattgcagctttatgt

SEQ ID NO: 4009678 - DNA, 13 bp, Homo sapiens
gtgattgctgcca

SEQ ID NO: 4009679 - DNA, 19 bp, Homo sapiens
gtgattgtggaatggagat

SEQ ID NO: 4009680 - DNA, 19 bp, Homo sapiens
gtgatttcagagagggcag

SEQ ID NO: 4009681 - DNA, 22 bp, Homo sapiens
gtgcaacaaggtcctctgtcag

SEQ ID NO: 4009682 - DNA, 23 bp, Homo sapiens
gtgcaacccttaccccttagcct

SEQ ID NO: 4009683 - DNA, 19 bp, Homo sapiens
gtgcaagcgacgacagatg

SEQ ID NO: 4009684 - DNA, 22 bp, Homo sapiens
gtgcaaggactcccggagcctg

SEQ ID NO: 4009685 - DNA, 19 bp, Homo sapiens
gtgcaataaatctgaccca

SEQ ID NO: 4009686 - DNA, 21 bp, Homo sapiens
gtgcaataaatctgacccagt

SEQ ID NO: 4009687 - DNA, 23 bp, Homo sapiens
gtgcaataaatctgacccagtgc

SEQ ID NO: 4009688 - DNA, 14 bp, Homo sapiens
gtgcaatagaaata

SEQ ID NO: 4009689 - DNA, 22 bp, Homo sapiens
gtgcaattgtaggggtgtgtgt

SEQ ID NO: 4009690 - DNA, 11 bp, Homo sapiens
gtgcacagctg

SEQ ID NO: 4009691 - DNA, 14 bp, Homo sapiens
gtgcacagctgtcc

SEQ ID NO: 4009692 - DNA, 13 bp, Homo sapiens
gtgcacatttctt

SEQ ID NO: 4009693 - DNA, 16 bp, Homo sapiens
gtgcacgtggagagct

SEQ ID NO: 4009694 - DNA, 21 bp, Homo sapiens
gtgcacgtggagagctggtgc

SEQ ID NO: 4009695 - DNA, 13 bp, Homo sapiens
gtgcactctgcta

SEQ ID NO: 4009696 - DNA, 20 bp, Homo sapiens
gtgcactgcccatggacagg

SEQ ID NO: 4009697 - DNA, 13 bp, Homo sapiens
gtgcactgtcact

SEQ ID NO: 4009698 - DNA, 15 bp, Homo sapiens
gtgcactgtcacttt

SEQ ID NO: 4009699 - DNA, 19 bp, Homo sapiens
gtgcactttctaatgtttc

SEQ ID NO: 4009700 - DNA, 18 bp, Homo sapiens
gtgcagacaatcttctgt

SEQ ID NO: 4009701 - DNA, 23 bp, Homo sapiens
gtgcagacaggccatgtgagcca

SEQ ID NO: 4009702 - DNA, 23 bp, Homo sapiens
gtgcagagccttctcagaagcac

SEQ ID NO: 4009703 - DNA, 17 bp, Homo sapiens
gtgcagcacgtctcaga

SEQ ID NO: 4009704 - DNA, 16 bp, Homo sapiens
gtgcagctgattttaa

SEQ ID NO: 4009705 - DNA, 11 bp, Homo sapiens
gtgcaggcagg

SEQ ID NO: 4009706 - DNA, 18 bp, Homo sapiens
gtgcaggcaggctggcct

SEQ ID NO: 4009707 - DNA, 13 bp, Homo sapiens
gtgcagggctggt

SEQ ID NO: 4009708 - DNA, 23 bp, Homo sapiens
gtgcaggtgggcactggagcatg

SEQ ID NO: 4009709 - DNA, 14 bp, Homo sapiens
gtgcagtcactgga

SEQ ID NO: 4009710 - DNA, 22 bp, Homo sapiens
gtgcagttcccccaacctcaga

SEQ ID NO: 4009711 - DNA, 18 bp, Homo sapiens
gtgcatcccccctgctca

SEQ ID NO: 4009712 - DNA, 21 bp, Homo sapiens
gtgcatcccccctgctcagca

SEQ ID NO: 4009713 - DNA, 22 bp, Homo sapiens
gtgcatctcctcccgcccttcc

SEQ ID NO: 4009714 - DNA, 17 bp, Homo sapiens
gtgcatgcatgccctct

SEQ ID NO: 4009715 - DNA, 16 bp, Homo sapiens
gtgcattacagagagg

SEQ ID NO: 4009716 - DNA, 19 bp, Homo sapiens
gtgcatttgagagaagcca

SEQ ID NO: 4009717 - DNA, 15 bp, Homo sapiens
gtgccaaatgctctc

SEQ ID NO: 4009718 - DNA, 15 bp, Homo sapiens
gtgccaactcctcac

SEQ ID NO: 4009719 - DNA, 14 bp, Homo sapiens
gtgccaactgccag

SEQ ID NO: 4009720 - DNA, 18 bp, Homo sapiens
gtgccacccaccagggcg

SEQ ID NO: 4009721 - DNA, 19 bp, Homo sapiens
gtgccactgcccgagctgg

SEQ ID NO: 4009722 - DNA, 20 bp, Homo sapiens
gtgccactgcccgagctggt

SEQ ID NO: 4009723 - DNA, 21 bp, Homo sapiens
gtgccactgcccgagctggtg

SEQ ID NO: 4009724 - DNA, 23 bp, Homo sapiens
gtgccactgcccgagctggtgca

SEQ ID NO: 4009725 - DNA, 15 bp, Homo sapiens
gtgccaggagcaatg

SEQ ID NO: 4009726 - DNA, 22 bp, Homo sapiens
gtgccaggagcaatgggactgg

SEQ ID NO: 4009727 - DNA, 15 bp, Homo sapiens
gtgccagggtgggtg

SEQ ID NO: 4009728 - DNA, 15 bp, Homo sapiens
gtgccatgctgggcc

SEQ ID NO: 4009729 - DNA, 21 bp, Homo sapiens
gtgccattccactccactcag

SEQ ID NO: 4009730 - DNA, 20 bp, Homo sapiens
gtgcccaagaatagatgctg

SEQ ID NO: 4009731 - DNA, 23 bp, Homo sapiens
gtgcccaagaatagatgctgact

SEQ ID NO: 4009732 - DNA, 13 bp, Homo sapiens
gtgcccacaggcc

SEQ ID NO: 4009733 - DNA, 19 bp, Homo sapiens
gtgcccagaacttccctga

SEQ ID NO: 4009734 - DNA, 18 bp, Homo sapiens
gtgcccagcccggacctt

SEQ ID NO: 4009735 - DNA, 19 bp, Homo sapiens
gtgccccaggaccagctca

SEQ ID NO: 4009736 - DNA, 21 bp, Homo sapiens
gtgccccaggaccagctcagg

SEQ ID NO: 4009737 - DNA, 13 bp, Homo sapiens
gtgccccagggag

SEQ ID NO: 4009738 - DNA, 18 bp, Homo sapiens
gtgccccagggagtccag

SEQ ID NO: 4009739 - DNA, 21 bp, Homo sapiens
gtgccccagggagtccagggt

SEQ ID NO: 4009740 - DNA, 18 bp, Homo sapiens
gtgccccatgcctgtcca

SEQ ID NO: 4009741 - DNA, 15 bp, Homo sapiens
gtgcccccactgacc

SEQ ID NO: 4009742 - DNA, 14 bp, Homo sapiens
gtgccccctcacct

SEQ ID NO: 4009743 - DNA, 12 bp, Homo sapiens
gtgcccctggcc

SEQ ID NO: 4009744 - DNA, 16 bp, Homo sapiens
gtgccctgctttgcaa

SEQ ID NO: 4009745 - DNA, 23 bp, Homo sapiens
gtgccgtagggagtacctgctgc

SEQ ID NO: 4009746 - DNA, 15 bp, Homo sapiens
gtgccgtgtgagtgt

SEQ ID NO: 4009747 - DNA, 20 bp, Homo sapiens
gtgccgtgtgagtgtgacag

SEQ ID NO: 4009748 - DNA, 22 bp, Homo sapiens
gtgcctccttccacctccctcc

SEQ ID NO: 4009749 - DNA, 14 bp, Homo sapiens
gtgcctctgggact

SEQ ID NO: 4009750 - DNA, 21 bp, Homo sapiens
gtgcctgacacactaaccaag

SEQ ID NO: 4009751 - DNA, 15 bp, Homo sapiens
gtgcctgagaggcag

SEQ ID NO: 4009752 - DNA, 16 bp, Homo sapiens
gtgcctgagaggcagg

SEQ ID NO: 4009753 - DNA, 12 bp, Homo sapiens
gtgcctgagctg

SEQ ID NO: 4009754 - DNA, 21 bp, Homo sapiens
gtgcctgcactgagagggcaa

SEQ ID NO: 4009755 - DNA, 22 bp, Homo sapiens
gtgcctggacatttgccttgct

SEQ ID NO: 4009756 - DNA, 14 bp, Homo sapiens
gtgcctggccccag

SEQ ID NO: 4009757 - DNA, 14 bp, Homo sapiens
gtgcctggcctctg

SEQ ID NO: 4009758 - DNA, 22 bp, Homo sapiens
gtgccttccataattatgacag

SEQ ID NO: 4009759 - DNA, 18 bp, Homo sapiens
gtgcctttctacaactga

SEQ ID NO: 4009760 - DNA, 17 bp, Homo sapiens
gtgcctttctttgcctc

SEQ ID NO: 4009761 - DNA, 18 bp, Homo sapiens
gtgcctttctttgcctct

SEQ ID NO: 4009762 - DNA, 23 bp, Homo sapiens
gtgccttttgcagaagagggtgt

SEQ ID NO: 4009763 - DNA, 17 bp, Homo sapiens
gtgcgggctgaggccag

SEQ ID NO: 4009764 - DNA, 15 bp, Homo sapiens
gtgcggtggctcacg

SEQ ID NO: 4009765 - DNA, 15 bp, Homo sapiens
gtgcgtgtgtagagt

SEQ ID NO: 4009766 - DNA, 17 bp, Homo sapiens
gtgcgtgtgtagagtta

SEQ ID NO: 4009767 - DNA, 16 bp, Homo sapiens
gtgctaaattttcagt

SEQ ID NO: 4009768 - DNA, 21 bp, Homo sapiens
gtgctattttgtttgttttgt

SEQ ID NO: 4009769 - DNA, 18 bp, Homo sapiens
gtgctcaatggagaatat

SEQ ID NO: 4009770 - DNA, 19 bp, Homo sapiens
gtgctcagaataaggcagg

SEQ ID NO: 4009771 - DNA, 16 bp, Homo sapiens
gtgctcattgtaacca

SEQ ID NO: 4009772 - DNA, 21 bp, Homo sapiens
gtgctcctcttgattcctggt

SEQ ID NO: 4009773 - DNA, 14 bp, Homo sapiens
gtgctcgccctgcg

SEQ ID NO: 4009774 - DNA, 12 bp, Homo sapiens
gtgctctgcctc

SEQ ID NO: 4009775 - DNA, 13 bp, Homo sapiens
gtgctctgcctca

SEQ ID NO: 4009776 - DNA, 15 bp, Homo sapiens
gtgtcacttgtgctt

SEQ ID NO: 4009777 - DNA, 15 bp, Homo sapiens
gtgtcagagtgttgt

SEQ ID NO: 4009778 - DNA, 14 bp, Homo sapiens
gtgtcagctgaggc

SEQ ID NO: 4009779 - DNA, 22 bp, Homo sapiens
gtgtcaggcccccagtgggacc

SEQ ID NO: 4009780 - DNA, 16 bp, Homo sapiens
gtgtcatcagaagata

SEQ ID NO: 4009781 - DNA, 20 bp, Homo sapiens
gtgtcccctccactgtcaca

SEQ ID NO: 4009782 - DNA, 15 bp, Homo sapiens
gtgtcctccaagtgc

SEQ ID NO: 4009783 - DNA, 20 bp, Homo sapiens
gtgtcctgaaacgctccttt

SEQ ID NO: 4009784 - DNA, 16 bp, Homo sapiens
gtgtcctgcctgtctg

SEQ ID NO: 4009785 - DNA, 17 bp, Homo sapiens
gtgtcctgcctgtctgc

SEQ ID NO: 4009786 - DNA, 20 bp, Homo sapiens
gtgtcctgcctgtctgcccc

SEQ ID NO: 4009787 - DNA, 12 bp, Homo sapiens
gtgtccttccct

SEQ ID NO: 4009788 - DNA, 15 bp, Homo sapiens
gtgtccttccctgca

SEQ ID NO: 4009789 - DNA, 15 bp, Homo sapiens
gtgtccttcgggggc

SEQ ID NO: 4009790 - DNA, 14 bp, Homo sapiens
gtgtctaaaaacac

SEQ ID NO: 4009791 - DNA, 17 bp, Homo sapiens
gtgtctaaaaacaccaa

SEQ ID NO: 4009792 - DNA, 23 bp, Homo sapiens
gtgtctcagggtgcagaggtcag

SEQ ID NO: 4009793 - DNA, 13 bp, Homo sapiens
gtgtctgccccct

SEQ ID NO: 4009794 - DNA, 14 bp, Homo sapiens
gtgtctggcctgag

SEQ ID NO: 4009795 - DNA, 15 bp, Homo sapiens
gtgtctggcctgagg

SEQ ID NO: 4009796 - DNA, 16 bp, Homo sapiens
gtgtctggcctgaggt

SEQ ID NO: 4009797 - DNA, 14 bp, Homo sapiens
gtgtctgtatttat

SEQ ID NO: 4009798 - DNA, 12 bp, Homo sapiens
gtgtctgttgct

SEQ ID NO: 4009799 - DNA, 15 bp, Homo sapiens
gtgtctgttgcttgt

SEQ ID NO: 4009800 - DNA, 15 bp, Homo sapiens
gtgtctttctctttt

SEQ ID NO: 4009801 - DNA, 21 bp, Homo sapiens
gtgtgaaaggaagctccactg

SEQ ID NO: 4009802 - DNA, 18 bp, Homo sapiens
gtgtgaacctacctgcct

SEQ ID NO: 4009803 - DNA, 18 bp, Homo sapiens
gtgtgaactgctttcaag

SEQ ID NO: 4009804 - DNA, 14 bp, Homo sapiens
gtgtgaatgaacac

SEQ ID NO: 4009805 - DNA, 15 bp, Homo sapiens
gtgtgaatgtgggca

SEQ ID NO: 4009806 - DNA, 19 bp, Homo sapiens
gtgtgaatgtgggcactgg

SEQ ID NO: 4009807 - DNA, 14 bp, Homo sapiens
gtgtgacagggcca

SEQ ID NO: 4009808 - DNA, 18 bp, Homo sapiens
gtgtgacagggccagtgg

SEQ ID NO: 4009809 - DNA, 16 bp, Homo sapiens
gtgtgagaagtgcctt

SEQ ID NO: 4009810 - DNA, 12 bp, Homo sapiens
gtgtgagactgg

SEQ ID NO: 4009811 - DNA, 17 bp, Homo sapiens
gtgtgagctcttccctt

SEQ ID NO: 4009812 - DNA, 13 bp, Homo sapiens
gtgtgaggcagga

SEQ ID NO: 4009813 - DNA, 22 bp, Homo sapiens
gtgtgatcttaatatatttgaa

SEQ ID NO: 4009814 - DNA, 14 bp, Homo sapiens
gtgtgcactccagc

SEQ ID NO: 4009815 - DNA, 21 bp, Homo sapiens
gtgtggaagttattaacttta

SEQ ID NO: 4009816 - DNA, 16 bp, Homo sapiens
gtgtggacccccaccc

SEQ ID NO: 4009817 - DNA, 15 bp, Homo sapiens
gtgtggactgtgatg

SEQ ID NO: 4009818 - DNA, 16 bp, Homo sapiens
gtgtggagaccctgcc

SEQ ID NO: 4009819 - DNA, 13 bp, Homo sapiens
gtgtggcctcagc

SEQ ID NO: 4009820 - DNA, 15 bp, Homo sapiens
gtgtggcctcagccc

SEQ ID NO: 4009821 - DNA, 14 bp, Homo sapiens
gtgtggctccttcc

SEQ ID NO: 4009822 - DNA, 20 bp, Homo sapiens
gtgtggctgaggaggcctcc

SEQ ID NO: 4009823 - DNA, 11 bp, Homo sapiens
gtgtggctttc

SEQ ID NO: 4009824 - DNA, 17 bp, Homo sapiens
gtgtggggggctggggg

SEQ ID NO: 4009825 - DNA, 18 bp, Homo sapiens
gtgtgggtggaagggctg

SEQ ID NO: 4009826 - DNA, 14 bp, Homo sapiens
gtgtgggtgtcctg

SEQ ID NO: 4009827 - DNA, 15 bp, Homo sapiens
gtgtggtccatgccc

SEQ ID NO: 4009828 - DNA, 16 bp, Homo sapiens
gtgtggtgaggggctt

SEQ ID NO: 4009829 - DNA, 13 bp, Homo sapiens
gtgtggtggcctc

SEQ ID NO: 4009830 - DNA, 16 bp, Homo sapiens
gtgtggtggcctcagc

SEQ ID NO: 4009831 - DNA, 23 bp, Homo sapiens
gtgtggtgggttctttggaagga

SEQ ID NO: 4009832 - DNA, 19 bp, Homo sapiens
gtgtgtaaatatgtacatt

SEQ ID NO: 4009833 - DNA, 21 bp, Homo sapiens
gtgtgtatgactaaagagaga

SEQ ID NO: 4009834 - DNA, 15 bp, Homo sapiens
gtgtgtattgttccc

SEQ ID NO: 4009835 - DNA, 14 bp, Homo sapiens
gtgtgtcttaatta

SEQ ID NO: 4009836 - DNA, 14 bp, Homo sapiens
gtgtgtgaaaggaa

SEQ ID NO: 4009837 - DNA, 14 bp, Homo sapiens
gtgtgtgtggaccc

SEQ ID NO: 4009838 - DNA, 10 bp, Homo sapiens
gtgtgtgtgt

SEQ ID NO: 4009839 - DNA, 12 bp, Homo sapiens
gtgtgtgtgtat

SEQ ID NO: 4009840 - DNA, 12 bp, Homo sapiens
gtgtgtgtgtgt

SEQ ID NO: 4009841 - DNA, 14 bp, Homo sapiens
gtgtgtgtgtgtgt

SEQ ID NO: 4009842 - DNA, 17 bp, Homo sapiens
gtgtgttttcataataa

SEQ ID NO: 4009843 - DNA, 18 bp, Homo sapiens
gtgtgttttcataataaa

SEQ ID NO: 4009844 - DNA, 14 bp, Homo sapiens
gtgttactttttgt

SEQ ID NO: 4009845 - DNA, 21 bp, Homo sapiens
gtgttatttggaaccttgttt

SEQ ID NO: 4009846 - DNA, 13 bp, Homo sapiens
gtgttatttttca

SEQ ID NO: 4009847 - DNA, 23 bp, Homo sapiens
gtgttcagtgttagcagtgggtc

SEQ ID NO: 4009848 - DNA, 19 bp, Homo sapiens
gtgttccccatctgggtcc

SEQ ID NO: 4009849 - DNA, 15 bp, Homo sapiens
gtgttcctggcaata

SEQ ID NO: 4009850 - DNA, 19 bp, Homo sapiens
gtgttcctggcagtttaaa

SEQ ID NO: 4009851 - DNA, 14 bp, Homo sapiens
gtgttcctggctga

SEQ ID NO: 4009852 - DNA, 16 bp, Homo sapiens
gtgttctccttttcct

SEQ ID NO: 4009853 - DNA, 16 bp, Homo sapiens
gtgttctgattagaaa

SEQ ID NO: 4009854 - DNA, 23 bp, Homo sapiens
gtgttctgctccataccttttct

SEQ ID NO: 4009855 - DNA, 21 bp, Homo sapiens
gtgttctgctcctgcttttct

SEQ ID NO: 4009856 - DNA, 22 bp, Homo sapiens
gtgttctgctcctgcttttctg

SEQ ID NO: 4009857 - DNA, 23 bp, Homo sapiens
gtgttctgctcctgcttttctgt

SEQ ID NO: 4009858 - DNA, 17 bp, Homo sapiens
gtgttgccaaatatgtc

SEQ ID NO: 4009859 - DNA, 19 bp, Homo sapiens
gtgttgccaaatatgtcct

SEQ ID NO: 4009860 - DNA, 20 bp, Homo sapiens
gtgttgcccaggctggtctc

SEQ ID NO: 4009861 - DNA, 14 bp, Homo sapiens
gtgttgctcagctc

SEQ ID NO: 4009862 - DNA, 18 bp, Homo sapiens
gtgttgtaattcttcagt

SEQ ID NO: 4009863 - DNA, 17 bp, Homo sapiens
gtgttgtcttcagcagt

SEQ ID NO: 4009864 - DNA, 19 bp, Homo sapiens
gtgtttattcatccagcag

SEQ ID NO: 4009865 - DNA, 13 bp, Homo sapiens
gtgtttatttata

SEQ ID NO: 4009866 - DNA, 18 bp, Homo sapiens
gtgtttccacagcctgca

SEQ ID NO: 4009867 - DNA, 18 bp, Homo sapiens
gtgtttccatattttata

SEQ ID NO: 4009868 - DNA, 14 bp, Homo sapiens
gtgtttccatctca

SEQ ID NO: 4009869 - DNA, 12 bp, Homo sapiens
gtgtttcccata

SEQ ID NO: 4009870 - DNA, 15 bp, Homo sapiens
gtgtttcccataatt

SEQ ID NO: 4009871 - DNA, 20 bp, Homo sapiens
gtgtttgctgccttgctcct

SEQ ID NO: 4009872 - DNA, 11 bp, Homo sapiens
gtgtttgcttg

SEQ ID NO: 4009873 - DNA, 20 bp, Homo sapiens
gtgtttggtttacatttaaa

SEQ ID NO: 4009874 - DNA, 12 bp, Homo sapiens
gtgtttgtctct

SEQ ID NO: 4009875 - DNA, 15 bp, Homo sapiens
gtgtttgtctcttct

SEQ ID NO: 4009876 - DNA, 14 bp, Homo sapiens
gtgttttaatttaa

SEQ ID NO: 4009877 - DNA, 20 bp, Homo sapiens
gtgttttgtggggctccccg

SEQ ID NO: 4009878 - DNA, 15 bp, Homo sapiens
gtgtttttgaaatat

SEQ ID NO: 4009879 - DNA, 14 bp, Homo sapiens
gtgtttttgggaag

SEQ ID NO: 4009880 - DNA, 16 bp, Homo sapiens
gttggactctcaggga

SEQ ID NO: 4009881 - DNA, 23 bp, Homo sapiens
gttggacttttcgttaacattga

SEQ ID NO: 4009882 - DNA, 13 bp, Homo sapiens
gttggatcttcaa

SEQ ID NO: 4009883 - DNA, 23 bp, Homo sapiens
gttggatggatgggtggatggcc

SEQ ID NO: 4009884 - DNA, 15 bp, Homo sapiens
gttggatgggagtgg

SEQ ID NO: 4009885 - DNA, 21 bp, Homo sapiens
gttggatttataaatgctatt

SEQ ID NO: 4009886 - DNA, 17 bp, Homo sapiens
gttggcaacaggacaga

SEQ ID NO: 4009887 - DNA, 19 bp, Homo sapiens
gttggcacctgcacactcc

SEQ ID NO: 4009888 - DNA, 15 bp, Homo sapiens
gttggcagacagccg

SEQ ID NO: 4009889 - DNA, 23 bp, Homo sapiens
gttggcagatgcagctcttcctg

SEQ ID NO: 4009890 - DNA, 13 bp, Homo sapiens
gttggcctgcact

SEQ ID NO: 4009891 - DNA, 20 bp, Homo sapiens
gttggctttgcccacccctc

SEQ ID NO: 4009892 - DNA, 22 bp, Homo sapiens
gttgggagccctttggagaacg

SEQ ID NO: 4009893 - DNA, 13 bp, Homo sapiens
gttgggagctgat

SEQ ID NO: 4009894 - DNA, 13 bp, Homo sapiens
gttgggcccagat

SEQ ID NO: 4009895 - DNA, 16 bp, Homo sapiens
gttgggcccagatctg

SEQ ID NO: 4009896 - DNA, 17 bp, Homo sapiens
gttgggcccagatctgg

SEQ ID NO: 4009897 - DNA, 15 bp, Homo sapiens
gttggggcccttaac

SEQ ID NO: 4009898 - DNA, 22 bp, Homo sapiens
gttggggggactctgagcggga

SEQ ID NO: 4009899 - DNA, 20 bp, Homo sapiens
gttgggggggaccctgcctc

SEQ ID NO: 4009900 - DNA, 16 bp, Homo sapiens
gttggggtctggcagc

SEQ ID NO: 4009901 - DNA, 12 bp, Homo sapiens
gttggtcagagg

SEQ ID NO: 4009902 - DNA, 14 bp, Homo sapiens
gttggtccagagcg

SEQ ID NO: 4009903 - DNA, 15 bp, Homo sapiens
gttggttgtgtcttt

SEQ ID NO: 4009904 - DNA, 16 bp, Homo sapiens
gttgtaaaccaagtga

SEQ ID NO: 4009905 - DNA, 18 bp, Homo sapiens
gttgtaaataatttattt

SEQ ID NO: 4009906 - DNA, 14 bp, Homo sapiens
gttgtaacctgctg

SEQ ID NO: 4009907 - DNA, 22 bp, Homo sapiens
gttgtaacttatattgaagaca

SEQ ID NO: 4009908 - DNA, 23 bp, Homo sapiens
gttgtacatttatgatttaataa

SEQ ID NO: 4009909 - DNA, 14 bp, Homo sapiens
gttgtataatttcg

SEQ ID NO: 4009910 - DNA, 21 bp, Homo sapiens
gttgtattcttctgtatttct

SEQ ID NO: 4009911 - DNA, 15 bp, Homo sapiens
gttgtcaatattaaa

SEQ ID NO: 4009912 - DNA, 19 bp, Homo sapiens
gttgtcaatattaaataca

SEQ ID NO: 4009913 - DNA, 18 bp, Homo sapiens
gttgtctctagagcaggg

SEQ ID NO: 4009914 - DNA, 20 bp, Homo sapiens
gttgtgatcttgcattcatt

SEQ ID NO: 4009915 - DNA, 21 bp, Homo sapiens
gttgtgatgtcttttcttggc

SEQ ID NO: 4009916 - DNA, 16 bp, Homo sapiens
gttgtgttcctggctg

SEQ ID NO: 4009917 - DNA, 14 bp, Homo sapiens
gttgttgtggaagc

SEQ ID NO: 4009918 - DNA, 15 bp, Homo sapiens
gttgtttctgaccca

SEQ ID NO: 4009919 - DNA, 13 bp, Homo sapiens
gttgtttctttct

SEQ ID NO: 4009920 - DNA, 20 bp, Homo sapiens
gttgtttgtaaataagagat

SEQ ID NO: 4009921 - DNA, 19 bp, Homo sapiens
gttgttttttgaaaacatg

SEQ ID NO: 4009922 - DNA, 13 bp, Homo sapiens
gtttaaaaagtaa

SEQ ID NO: 4009923 - DNA, 14 bp, Homo sapiens
gtttaaaaagtaag

SEQ ID NO: 4009924 - DNA, 17 bp, Homo sapiens
gtttaaaacagtattta

SEQ ID NO: 4009925 - DNA, 10 bp, Homo sapiens
gtttaaaatt

SEQ ID NO: 4009926 - DNA, 21 bp, Homo sapiens
gtttaaactgattcataataa

SEQ ID NO: 4009927 - DNA, 15 bp, Homo sapiens
gtttaaagagaggtt

SEQ ID NO: 4009928 - DNA, 14 bp, Homo sapiens
gtttaaagctttta

SEQ ID NO: 4009929 - DNA, 19 bp, Homo sapiens
gtttaaagcttttattcgt

SEQ ID NO: 4009930 - DNA, 12 bp, Homo sapiens
gtttaaatgtat

SEQ ID NO: 4009931 - DNA, 21 bp, Homo sapiens
gtttaagaaaagtattttgaa

SEQ ID NO: 4009932 - DNA, 21 bp, Homo sapiens
gtttaagtgactgatggctaa

SEQ ID NO: 4009933 - DNA, 15 bp, Homo sapiens
gtttaatattgagaa

SEQ ID NO: 4009934 - DNA, 15 bp, Homo sapiens
gtttaatatttaaac

SEQ ID NO: 4009935 - DNA, 21 bp, Homo sapiens
gtttacaacttgattttttca

SEQ ID NO: 4009936 - DNA, 22 bp, Homo sapiens
gtttacaacttgattttttcaa

SEQ ID NO: 4009937 - DNA, 14 bp, Homo sapiens
gtttacaggccctg

SEQ ID NO: 4009938 - DNA, 19 bp, Homo sapiens
gtttacaggccctgctcct

SEQ ID NO: 4009939 - DNA, 21 bp, Homo sapiens
gtttacatgtgtagcctatgt

SEQ ID NO: 4009940 - DNA, 21 bp, Homo sapiens
gtttacatttaaagcattgct

SEQ ID NO: 4009941 - DNA, 11 bp, Homo sapiens
gtttacatttt

SEQ ID NO: 4009942 - DNA, 22 bp, Homo sapiens
gtttacatttttatttatgaag

SEQ ID NO: 4009943 - DNA, 13 bp, Homo sapiens
gtttaccatttgt

SEQ ID NO: 4009944 - DNA, 16 bp, Homo sapiens
gtttaccatttgtaat

SEQ ID NO: 4009945 - DNA, 14 bp, Homo sapiens
gtttagaagctgag

SEQ ID NO: 4009946 - DNA, 19 bp, Homo sapiens
gtttagcagaactcattct

SEQ ID NO: 4009947 - DNA, 23 bp, Homo sapiens
gtttagcagcagcctttaatgca

SEQ ID NO: 4009948 - DNA, 23 bp, Homo sapiens
gtttaggctatttgtaaatctgc

SEQ ID NO: 4009949 - DNA, 23 bp, Homo sapiens
gtttatagagaatgatgataaca

SEQ ID NO: 4009950 - DNA, 21 bp, Homo sapiens
gtttatattttttcagttgtt

SEQ ID NO: 4009951 - DNA, 15 bp, Homo sapiens
gtttatcagatacat

SEQ ID NO: 4009952 - DNA, 17 bp, Homo sapiens
gtttatgatatttcttg

SEQ ID NO: 4009953 - DNA, 17 bp, Homo sapiens
gtttatgcaaggaagga

SEQ ID NO: 4009954 - DNA, 23 bp, Homo sapiens
gtttatggccacatttaatatct

SEQ ID NO: 4009955 - DNA, 23 bp, Homo sapiens
gtttatggcctcagctgcctcac

SEQ ID NO: 4009956 - DNA, 21 bp, Homo sapiens
gtttatgttcttatagaataa

SEQ ID NO: 4009957 - DNA, 22 bp, Homo sapiens
gtttatgttcttatagaataaa

SEQ ID NO: 4009958 - DNA, 17 bp, Homo sapiens
gtttattaatgcctctc

SEQ ID NO: 4009959 - DNA, 22 bp, Homo sapiens
gtttattcagtaaacaacttgt

SEQ ID NO: 4009960 - DNA, 20 bp, Homo sapiens
gtttattcttccagaatgct

SEQ ID NO: 4009961 - DNA, 17 bp, Homo sapiens
gtttatttattctgcat

SEQ ID NO: 4009962 - DNA, 19 bp, Homo sapiens
gtttatttctgtttctcat

SEQ ID NO: 4009963 - DNA, 15 bp, Homo sapiens
gtttatttttgtaat

SEQ ID NO: 4009964 - DNA, 17 bp, Homo sapiens
gtttatttttgtaatgt

SEQ ID NO: 4009965 - DNA, 22 bp, Homo sapiens
gtttcacaggtcaataaactta

SEQ ID NO: 4009966 - DNA, 22 bp, Homo sapiens
gtttcagctaagggaagacatt

SEQ ID NO: 4009967 - DNA, 10 bp, Homo sapiens
gtttcaggtg

SEQ ID NO: 4009968 - DNA, 14 bp, Homo sapiens
gtttcatatctggt

SEQ ID NO: 4009969 - DNA, 14 bp, Homo sapiens
gtttcatccttccc

SEQ ID NO: 4009970 - DNA, 12 bp, Homo sapiens
gtttcatctggt

SEQ ID NO: 4009971 - DNA, 13 bp, Homo sapiens
gtttcatctggtt

SEQ ID NO: 4009972 - DNA, 14 bp, Homo sapiens
gtttcatctggttt

SEQ ID NO: 4009973 - DNA, 15 bp, Homo sapiens
gtttcattctcctgc

SEQ ID NO: 4009974 - DNA, 19 bp, Homo sapiens
gtttcatttagtcatgtga

SEQ ID NO: 4009975 - DNA, 13 bp, Homo sapiens
gtttccatttact

SEQ ID NO: 4009976 - DNA, 13 bp, Homo sapiens
gtttcccataatt

SEQ ID NO: 4009977 - DNA, 20 bp, Homo sapiens
gtttcccataattttcttca

SEQ ID NO: 4009978 - DNA, 16 bp, Homo sapiens
gtttcccctctggctt

SEQ ID NO: 4009979 - DNA, 18 bp, Homo sapiens
gtttcccctctggcttga

SEQ ID NO: 4009980 - DNA, 22 bp, Homo sapiens
gtttcctgaaacaacttggaaa

SEQ ID NO: 4009981 - DNA, 14 bp, Homo sapiens
gtttctcaaatctt

SEQ ID NO: 4009982 - DNA, 14 bp, Homo sapiens
taaaagagataata

SEQ ID NO: 4009983 - DNA, 23 bp, Homo sapiens
taaaagataacaagatctttcag

SEQ ID NO: 4009984 - DNA, 18 bp, Homo sapiens
taaaagcaaatctacaga

SEQ ID NO: 4009985 - DNA, 20 bp, Homo sapiens
taaaagcagcatctgctaat

SEQ ID NO: 4009986 - DNA, 16 bp, Homo sapiens
taaaaggaaaagcaaa

SEQ ID NO: 4009987 - DNA, 15 bp, Homo sapiens
taaaaggaaagaaaa

SEQ ID NO: 4009988 - DNA, 21 bp, Homo sapiens
taaaaggaaagaaaacatctt

SEQ ID NO: 4009989 - DNA, 21 bp, Homo sapiens
taaaaggaaatctcaccccat

SEQ ID NO: 4009990 - DNA, 19 bp, Homo sapiens
taaaaggaagccaaagagt

SEQ ID NO: 4009991 - DNA, 17 bp, Homo sapiens
taaaagggcaaatctgc

SEQ ID NO: 4009992 - DNA, 19 bp, Homo sapiens
taaaagggggtccgtggaa

SEQ ID NO: 4009993 - DNA, 21 bp, Homo sapiens
taaaagggggtccgtggaaga

SEQ ID NO: 4009994 - DNA, 21 bp, Homo sapiens
taaaaggtatgcaatcaaatc

SEQ ID NO: 4009995 - DNA, 12 bp, Homo sapiens
taaaagtaaaca

SEQ ID NO: 4009996 - DNA, 14 bp, Homo sapiens
taaaagtaaacatt

SEQ ID NO: 4009997 - DNA, 19 bp, Homo sapiens
taaaagtagaagcatgttt

SEQ ID NO: 4009998 - DNA, 18 bp, Homo sapiens
taaaagtgaatgaaagat

SEQ ID NO: 4009999 - DNA, 14 bp, Homo sapiens
taaaagtgtgagca

SEQ ID NO: 4010000 - DNA, 21 bp, Homo sapiens
taaaataaaatgaaaattgta

SEQ ID NO: 4010001 - DNA, 14 bp, Homo sapiens
taaaataaacagtt

SEQ ID NO: 4010002 - DNA, 16 bp, Homo sapiens
taaaataaacagttgt

SEQ ID NO: 4010003 - DNA, 15 bp, Homo sapiens
taaaataattctaaa

SEQ ID NO: 4010004 - DNA, 14 bp, Homo sapiens
taaaatacatttaa

SEQ ID NO: 4010005 - DNA, 18 bp, Homo sapiens
taaaatacatttaaaact

SEQ ID NO: 4010006 - DNA, 14 bp, Homo sapiens
taaaatacttttac

SEQ ID NO: 4010007 - DNA, 21 bp, Homo sapiens
taaaatacttttactctgcct

SEQ ID NO: 4010008 - DNA, 20 bp, Homo sapiens
taaaatatgaagacataaac

SEQ ID NO: 4010009 - DNA, 14 bp, Homo sapiens
taaaatatggctat

SEQ ID NO: 4010010 - DNA, 12 bp, Homo sapiens
taaaatatttat

SEQ ID NO: 4010011 - DNA, 15 bp, Homo sapiens
taaaatatttatctg

SEQ ID NO: 4010012 - DNA, 18 bp, Homo sapiens
taaaatatttgaatgaaa

SEQ ID NO: 4010013 - DNA, 19 bp, Homo sapiens
taaaatatttgaatgaaaa

SEQ ID NO: 4010014 - DNA, 20 bp, Homo sapiens
taaaatatttgaatgaaaac

SEQ ID NO: 4010015 - DNA, 17 bp, Homo sapiens
taaaatctattctgtgt

SEQ ID NO: 4010016 - DNA, 13 bp, Homo sapiens
taaaatcttggaa

SEQ ID NO: 4010017 - DNA, 14 bp, Homo sapiens
taaaatgaaattac

SEQ ID NO: 4010018 - DNA, 20 bp, Homo sapiens
taaaatgactacttagcatc

SEQ ID NO: 4010019 - DNA, 15 bp, Homo sapiens
taaaatgattttatc

SEQ ID NO: 4010020 - DNA, 18 bp, Homo sapiens
taaaatgattttatctgt

SEQ ID NO: 4010021 - DNA, 12 bp, Homo sapiens
taaaatggaatt

SEQ ID NO: 4010022 - DNA, 13 bp, Homo sapiens
taaaatggaattg

SEQ ID NO: 4010023 - DNA, 15 bp, Homo sapiens
taaaatggaattgaa

SEQ ID NO: 4010024 - DNA, 16 bp, Homo sapiens
taaaatggtttgtcct

SEQ ID NO: 4010025 - DNA, 21 bp, Homo sapiens
taaaatgtcagtgtttgggaa

SEQ ID NO: 4010026 - DNA, 13 bp, Homo sapiens
taaaatgtgaagt

SEQ ID NO: 4010027 - DNA, 14 bp, Homo sapiens
taaaatgttaaaac

SEQ ID NO: 4010028 - DNA, 13 bp, Homo sapiens
taaaattacaact

SEQ ID NO: 4010029 - DNA, 17 bp, Homo sapiens
taaaattacaactaagt

SEQ ID NO: 4010030 - DNA, 18 bp, Homo sapiens
taaaattatatagctgct

SEQ ID NO: 4010031 - DNA, 22 bp, Homo sapiens
taaaattatcaatatctaatat

SEQ ID NO: 4010032 - DNA, 14 bp, Homo sapiens
taaaattcatttct

SEQ ID NO: 4010033 - DNA, 18 bp, Homo sapiens
taaaattccattatctta

SEQ ID NO: 4010034 - DNA, 23 bp, Homo sapiens
taaaattgctatgttactatttt

SEQ ID NO: 4010035 - DNA, 23 bp, Homo sapiens
taaaattggaaatgtcatctaac

SEQ ID NO: 4010036 - DNA, 18 bp, Homo sapiens
taaaattgtaacctgcat

SEQ ID NO: 4010037 - DNA, 17 bp, Homo sapiens
taaaatttaagtatctt

SEQ ID NO: 4010038 - DNA, 14 bp, Homo sapiens
taaaatttatctta

SEQ ID NO: 4010039 - DNA, 16 bp, Homo sapiens
taaaatttatcttaag

SEQ ID NO: 4010040 - DNA, 16 bp, Homo sapiens
taaacaaaattgcaat

SEQ ID NO: 4010041 - DNA, 17 bp, Homo sapiens
taaacaaaattgcaatt

SEQ ID NO: 4010042 - DNA, 18 bp, Homo sapiens
taaacaaagtgactgttt

SEQ ID NO: 4010043 - DNA, 14 bp, Homo sapiens
taaacaaagttact

SEQ ID NO: 4010044 - DNA, 19 bp, Homo sapiens
taaacaaattcatattctg

SEQ ID NO: 4010045 - DNA, 19 bp, Homo sapiens
taaacaacttgtacttgtt

SEQ ID NO: 4010046 - DNA, 22 bp, Homo sapiens
taaacaacttgtacttgtttca

SEQ ID NO: 4010047 - DNA, 21 bp, Homo sapiens
taaacaatgctgatttggtga

SEQ ID NO: 4010048 - DNA, 16 bp, Homo sapiens
taaacaattcaagtga

SEQ ID NO: 4010049 - DNA, 17 bp, Homo sapiens
taaacaattcatgcctt

SEQ ID NO: 4010050 - DNA, 12 bp, Homo sapiens
taaacacacaga

SEQ ID NO: 4010051 - DNA, 18 bp, Homo sapiens
taaacacacagatacaca

SEQ ID NO: 4010052 - DNA, 18 bp, Homo sapiens
taaacacagtcaaaataa

SEQ ID NO: 4010053 - DNA, 15 bp, Homo sapiens
taaacacattgaatg

SEQ ID NO: 4010054 - DNA, 15 bp, Homo sapiens
taaacacctgacaca

SEQ ID NO: 4010055 - DNA, 16 bp, Homo sapiens
taaacacctgacacat

SEQ ID NO: 4010056 - DNA, 13 bp, Homo sapiens
taaacagacaata

SEQ ID NO: 4010057 - DNA, 21 bp, Homo sapiens
taaacagatataaatggctgg

SEQ ID NO: 4010058 - DNA, 17 bp, Homo sapiens
taaacagatgatgagaa

SEQ ID NO: 4010059 - DNA, 15 bp, Homo sapiens
taaacagatttttac

SEQ ID NO: 4010060 - DNA, 19 bp, Homo sapiens
taaacagatttttacaaat

SEQ ID NO: 4010061 - DNA, 17 bp, Homo sapiens
taaacagcagtgttccc

SEQ ID NO: 4010062 - DNA, 14 bp, Homo sapiens
taaacataagctaa

SEQ ID NO: 4010063 - DNA, 23 bp, Homo sapiens
taaacataagtgtacgattctta

SEQ ID NO: 4010064 - DNA, 18 bp, Homo sapiens
taaacataagttgcattt

SEQ ID NO: 4010065 - DNA, 23 bp, Homo sapiens
taaacataataaatcacacattc

SEQ ID NO: 4010066 - DNA, 17 bp, Homo sapiens
taaacatatacagaaaa

SEQ ID NO: 4010067 - DNA, 19 bp, Homo sapiens
taaacatatacagaaaaat

SEQ ID NO: 4010068 - DNA, 18 bp, Homo sapiens
taaacatatgatttcact

SEQ ID NO: 4010069 - DNA, 15 bp, Homo sapiens
taaacatcacacaca

SEQ ID NO: 4010070 - DNA, 16 bp, Homo sapiens
taaacatcacacacac

SEQ ID NO: 4010071 - DNA, 15 bp, Homo sapiens
taaacatcagtttct

SEQ ID NO: 4010072 - DNA, 20 bp, Homo sapiens
taaacatccaatattttctt

SEQ ID NO: 4010073 - DNA, 20 bp, Homo sapiens
taaacattgacgattccttc

SEQ ID NO: 4010074 - DNA, 14 bp, Homo sapiens
taaacatttgttcc

SEQ ID NO: 4010075 - DNA, 21 bp, Homo sapiens
taaacatttgttcctggagtt

SEQ ID NO: 4010076 - DNA, 20 bp, Homo sapiens
taaaccaacctttaaaattg

SEQ ID NO: 4010077 - DNA, 17 bp, Homo sapiens
taaaccaaggactgagc

SEQ ID NO: 4010078 - DNA, 21 bp, Homo sapiens
taaaccaggtttagacagtat

SEQ ID NO: 4010079 - DNA, 11 bp, Homo sapiens
taaacctacct

SEQ ID NO: 4010080 - DNA, 19 bp, Homo sapiens
taaacctcaaaatgtctaa

SEQ ID NO: 4010081 - DNA, 19 bp, Homo sapiens
taaacctgtttttttttca

SEQ ID NO: 4010082 - DNA, 21 bp, Homo sapiens
taaacggtgcccatcctgcca

SEQ ID NO: 4010083 - DNA, 22 bp, Homo sapiens
taaacgtgatgatcagctgttt

SEQ ID NO: 4010084 - DNA, 16 bp, Homo sapiens
taaactaaataatgaa

SEQ ID NO: 4010085 - DNA, 23 bp, Homo sapiens
taacaggctcaatattcctgaat

SEQ ID NO: 4010086 - DNA, 14 bp, Homo sapiens
taacaggtattttg

SEQ ID NO: 4010087 - DNA, 14 bp, Homo sapiens
taacagtcatttaa

SEQ ID NO: 4010088 - DNA, 15 bp, Homo sapiens
taacagtcatttaaa

SEQ ID NO: 4010089 - DNA, 18 bp, Homo sapiens
taacagttcatgtttgct

SEQ ID NO: 4010090 - DNA, 13 bp, Homo sapiens
taacagttttcca

SEQ ID NO: 4010091 - DNA, 15 bp, Homo sapiens
taacagttttccatg

SEQ ID NO: 4010092 - DNA, 21 bp, Homo sapiens
taacagttttccatgaaaacg

SEQ ID NO: 4010093 - DNA, 15 bp, Homo sapiens
taacatgtatcccaa

SEQ ID NO: 4010094 - DNA, 13 bp, Homo sapiens
taacattacctta

SEQ ID NO: 4010095 - DNA, 17 bp, Homo sapiens
taacattaccttactgt

SEQ ID NO: 4010096 - DNA, 14 bp, Homo sapiens
taacattatttata

SEQ ID NO: 4010097 - DNA, 15 bp, Homo sapiens
taacattcagttccc

SEQ ID NO: 4010098 - DNA, 16 bp, Homo sapiens
taacattcgatctcat

SEQ ID NO: 4010099 - DNA, 23 bp, Homo sapiens
taacattgaccaagaactgcatg

SEQ ID NO: 4010100 - DNA, 16 bp, Homo sapiens
taacatttgctgtttt

SEQ ID NO: 4010101 - DNA, 17 bp, Homo sapiens
taacatttgctgtttta

SEQ ID NO: 4010102 - DNA, 14 bp, Homo sapiens
taaccaacaatata

SEQ ID NO: 4010103 - DNA, 16 bp, Homo sapiens
taaccaacaatataaa

SEQ ID NO: 4010104 - DNA, 20 bp, Homo sapiens
taaccaagctgagtttccta

SEQ ID NO: 4010105 - DNA, 14 bp, Homo sapiens
taaccaagtttatt

SEQ ID NO: 4010106 - DNA, 21 bp, Homo sapiens
taaccacagctccttttccag

SEQ ID NO: 4010107 - DNA, 13 bp, Homo sapiens
taaccacggaaaa

SEQ ID NO: 4010108 - DNA, 18 bp, Homo sapiens
taaccatttaataaagaa

SEQ ID NO: 4010109 - DNA, 19 bp, Homo sapiens
taaccatttaataaagaaa

SEQ ID NO: 4010110 - DNA, 20 bp, Homo sapiens
taaccatttctcactagtgt

SEQ ID NO: 4010111 - DNA, 21 bp, Homo sapiens
taacccacctctcctgccctg

SEQ ID NO: 4010112 - DNA, 19 bp, Homo sapiens
taacccaggcctgtctgac

SEQ ID NO: 4010113 - DNA, 13 bp, Homo sapiens
taaccccagcctg

SEQ ID NO: 4010114 - DNA, 22 bp, Homo sapiens
taaccccctctgctctgtcctc

SEQ ID NO: 4010115 - DNA, 17 bp, Homo sapiens
taaccctaggaatttag

SEQ ID NO: 4010116 - DNA, 18 bp, Homo sapiens
taacccttcatcttcctg

SEQ ID NO: 4010117 - DNA, 21 bp, Homo sapiens
taacccttcatcttcctgtgt

SEQ ID NO: 4010118 - DNA, 20 bp, Homo sapiens
taaccctttggtttttttct

SEQ ID NO: 4010119 - DNA, 19 bp, Homo sapiens
taaccgcacatgcacacac

SEQ ID NO: 4010120 - DNA, 18 bp, Homo sapiens
taacctagaagtattttt

SEQ ID NO: 4010121 - DNA, 23 bp, Homo sapiens
taacctatttttttctctattct

SEQ ID NO: 4010122 - DNA, 17 bp, Homo sapiens
taacctcagctctggga

SEQ ID NO: 4010123 - DNA, 20 bp, Homo sapiens
taacctcagtgtcatttatg

SEQ ID NO: 4010124 - DNA, 17 bp, Homo sapiens
taacctcttttctgcat

SEQ ID NO: 4010125 - DNA, 22 bp, Homo sapiens
taacctgactggttaacagcag

SEQ ID NO: 4010126 - DNA, 16 bp, Homo sapiens
taacctgcaaaatctg

SEQ ID NO: 4010127 - DNA, 15 bp, Homo sapiens
taaccttgaatgctg

SEQ ID NO: 4010128 - DNA, 19 bp, Homo sapiens
taaccttgaatgctgccag

SEQ ID NO: 4010129 - DNA, 22 bp, Homo sapiens
taaccttgaatgctgccagtgt

SEQ ID NO: 4010130 - DNA, 14 bp, Homo sapiens
taacgacttcaggg

SEQ ID NO: 4010131 - DNA, 23 bp, Homo sapiens
taacgcaataaacgcattatcag

SEQ ID NO: 4010132 - DNA, 22 bp, Homo sapiens
taacgcgtatctaggctttggt

SEQ ID NO: 4010133 - DNA, 15 bp, Homo sapiens
taacggctccaggat

SEQ ID NO: 4010134 - DNA, 17 bp, Homo sapiens
taacgggaggctgggca

SEQ ID NO: 4010135 - DNA, 18 bp, Homo sapiens
taacgggaggctgggcac

SEQ ID NO: 4010136 - DNA, 22 bp, Homo sapiens
taacgtgtgctgtgtttgctcc

SEQ ID NO: 4010137 - DNA, 20 bp, Homo sapiens
taacgtttttcctttaaaaa

SEQ ID NO: 4010138 - DNA, 22 bp, Homo sapiens
taactaatctattgggttcatt

SEQ ID NO: 4010139 - DNA, 22 bp, Homo sapiens
taactactatattgattgtcct

SEQ ID NO: 4010140 - DNA, 12 bp, Homo sapiens
taactactgtgt

SEQ ID NO: 4010141 - DNA, 17 bp, Homo sapiens
taactactgtgttcctg

SEQ ID NO: 4010142 - DNA, 18 bp, Homo sapiens
taactagaatttattcaa

SEQ ID NO: 4010143 - DNA, 21 bp, Homo sapiens
taactagcataagtggttttc

SEQ ID NO: 4010144 - DNA, 19 bp, Homo sapiens
taactaggctcagagatgt

SEQ ID NO: 4010145 - DNA, 13 bp, Homo sapiens
taactagtggctc

SEQ ID NO: 4010146 - DNA, 23 bp, Homo sapiens
taactatgacagatatatttaag

SEQ ID NO: 4010147 - DNA, 15 bp, Homo sapiens
taactatgtttaaag

SEQ ID NO: 4010148 - DNA, 16 bp, Homo sapiens
taactattgcatttat

SEQ ID NO: 4010149 - DNA, 21 bp, Homo sapiens
taactattgcatttatatgta

SEQ ID NO: 4010150 - DNA, 23 bp, Homo sapiens
taactattgcatttatatgtacc

SEQ ID NO: 4010151 - DNA, 16 bp, Homo sapiens
taactgaaaatgtaaa

SEQ ID NO: 4010152 - DNA, 18 bp, Homo sapiens
taactgaaaatgtaaatt

SEQ ID NO: 4010153 - DNA, 16 bp, Homo sapiens
taactgaaataaaaaa

SEQ ID NO: 4010154 - DNA, 20 bp, Homo sapiens
taactgagtagctctcctga

SEQ ID NO: 4010155 - DNA, 23 bp, Homo sapiens
taactgagtagctctcctgactt

SEQ ID NO: 4010156 - DNA, 16 bp, Homo sapiens
taactgcatttttaga

SEQ ID NO: 4010157 - DNA, 22 bp, Homo sapiens
taactgtagtgtagtcaggtgc

SEQ ID NO: 4010158 - DNA, 15 bp, Homo sapiens
taactgtcctgtcct

SEQ ID NO: 4010159 - DNA, 17 bp, Homo sapiens
taactgtgctgaatgct

SEQ ID NO: 4010160 - DNA, 14 bp, Homo sapiens
taactgtgtatgta

SEQ ID NO: 4010161 - DNA, 15 bp, Homo sapiens
taactgtgtatgtac

SEQ ID NO: 4010162 - DNA, 16 bp, Homo sapiens
taacttaatagtattt

SEQ ID NO: 4010163 - DNA, 16 bp, Homo sapiens
taacttatattgaaga

SEQ ID NO: 4010164 - DNA, 15 bp, Homo sapiens
taacttattagaaac

SEQ ID NO: 4010165 - DNA, 21 bp, Homo sapiens
taacttatttatgttaaaaga

SEQ ID NO: 4010166 - DNA, 18 bp, Homo sapiens
taacttcacattaaaaaa

SEQ ID NO: 4010167 - DNA, 18 bp, Homo sapiens
taactttaaggatttgaa

SEQ ID NO: 4010168 - DNA, 16 bp, Homo sapiens
taactttaatgttttt

SEQ ID NO: 4010169 - DNA, 14 bp, Homo sapiens
taactttacagaaa

SEQ ID NO: 4010170 - DNA, 16 bp, Homo sapiens
taactttactctgtgt

SEQ ID NO: 4010171 - DNA, 21 bp, Homo sapiens
taactttactctgtgtttaaa

SEQ ID NO: 4010172 - DNA, 22 bp, Homo sapiens
taactttagaagtgcatttctg

SEQ ID NO: 4010173 - DNA, 21 bp, Homo sapiens
taactttatcacattatttgc

SEQ ID NO: 4010174 - DNA, 13 bp, Homo sapiens
taactttcagaag

SEQ ID NO: 4010175 - DNA, 20 bp, Homo sapiens
taagaaaaaataacacacat

SEQ ID NO: 4010176 - DNA, 18 bp, Homo sapiens
taagaaaagagatatttt

SEQ ID NO: 4010177 - DNA, 14 bp, Homo sapiens
taagaaaagatttt

SEQ ID NO: 4010178 - DNA, 18 bp, Homo sapiens
taagaaaagcacttttgt

SEQ ID NO: 4010179 - DNA, 20 bp, Homo sapiens
taagaaaagcacttttgtta

SEQ ID NO: 4010180 - DNA, 15 bp, Homo sapiens
taagaaaagtatttt

SEQ ID NO: 4010181 - DNA, 18 bp, Homo sapiens
taagaaaatacaataaac

SEQ ID NO: 4010182 - DNA, 19 bp, Homo sapiens
taagaaaatacaataaact

SEQ ID NO: 4010183 - DNA, 12 bp, Homo sapiens
taagaaacagag

SEQ ID NO: 4010184 - DNA, 16 bp, Homo sapiens
taagaaacagagcagt

SEQ ID NO: 4010185 - DNA, 19 bp, Homo sapiens
taagaaaccttgctctcct

SEQ ID NO: 4010186 - DNA, 15 bp, Homo sapiens
taagaaagtgaagca

SEQ ID NO: 4010187 - DNA, 22 bp, Homo sapiens
taattgtgtaaaaaatggaaaa

SEQ ID NO: 4010188 - DNA, 12 bp, Homo sapiens
taattgttccag

SEQ ID NO: 4010189 - DNA, 14 bp, Homo sapiens
taattgttgaaatt

SEQ ID NO: 4010190 - DNA, 18 bp, Homo sapiens
taattgttgaaattttgc

SEQ ID NO: 4010191 - DNA, 19 bp, Homo sapiens
taattgttgtttctttcta

SEQ ID NO: 4010192 - DNA, 16 bp, Homo sapiens
taattgttttgcactt

SEQ ID NO: 4010193 - DNA, 18 bp, Homo sapiens
taattgttttgcactttt

SEQ ID NO: 4010194 - DNA, 17 bp, Homo sapiens
taatttaaacacctcct

SEQ ID NO: 4010195 - DNA, 20 bp, Homo sapiens
taatttaaacatttgttcct

SEQ ID NO: 4010196 - DNA, 14 bp, Homo sapiens
taatttaaagagac

SEQ ID NO: 4010197 - DNA, 21 bp, Homo sapiens
taatttaagagctaaccagtt

SEQ ID NO: 4010198 - DNA, 19 bp, Homo sapiens
taatttacaaaaatataaa

SEQ ID NO: 4010199 - DNA, 21 bp, Homo sapiens
taatttacaaaaatataaaat

SEQ ID NO: 4010200 - DNA, 13 bp, Homo sapiens
taatttagaaact

SEQ ID NO: 4010201 - DNA, 22 bp, Homo sapiens
taatttagagataggaaactga

SEQ ID NO: 4010202 - DNA, 21 bp, Homo sapiens
taatttagggtactaaattta

SEQ ID NO: 4010203 - DNA, 23 bp, Homo sapiens
taatttagggtactaaatttaaa

SEQ ID NO: 4010204 - DNA, 16 bp, Homo sapiens
taatttagtgatctta

SEQ ID NO: 4010205 - DNA, 20 bp, Homo sapiens
taatttatctaaattaaagc

SEQ ID NO: 4010206 - DNA, 23 bp, Homo sapiens
taatttatcttgtctctgggctt

SEQ ID NO: 4010207 - DNA, 20 bp, Homo sapiens
taatttatgagtttttgata

SEQ ID NO: 4010208 - DNA, 22 bp, Homo sapiens
taatttatttcaataaatcttt

SEQ ID NO: 4010209 - DNA, 19 bp, Homo sapiens
taatttatttccactaaaa

SEQ ID NO: 4010210 - DNA, 17 bp, Homo sapiens
taatttcaaaaatataa

SEQ ID NO: 4010211 - DNA, 11 bp, Homo sapiens
taatttccttt

SEQ ID NO: 4010212 - DNA, 17 bp, Homo sapiens
taatttcctttttgaca

SEQ ID NO: 4010213 - DNA, 17 bp, Homo sapiens
taatttcgagatttgta

SEQ ID NO: 4010214 - DNA, 22 bp, Homo sapiens
taatttctaaagataatattac

SEQ ID NO: 4010215 - DNA, 21 bp, Homo sapiens
taatttctactctgtcttaaa

SEQ ID NO: 4010216 - DNA, 13 bp, Homo sapiens
taatttgaagatt

SEQ ID NO: 4010217 - DNA, 15 bp, Homo sapiens
taatttgacttgaat

SEQ ID NO: 4010218 - DNA, 17 bp, Homo sapiens
taatttgatgaaagctg

SEQ ID NO: 4010219 - DNA, 24 bp, Homo sapiens
taatttgatgaaagctgattactg

SEQ ID NO: 4010220 - DNA, 14 bp, Homo sapiens
taatttgatgttta

SEQ ID NO: 4010221 - DNA, 17 bp, Homo sapiens
taatttgattaacaaat

SEQ ID NO: 4010222 - DNA, 12 bp, Homo sapiens
taatttgcatta

SEQ ID NO: 4010223 - DNA, 20 bp, Homo sapiens
taatttgcattaaattcaca

SEQ ID NO: 4010224 - DNA, 14 bp, Homo sapiens
taatttgtaaatga

SEQ ID NO: 4010225 - DNA, 19 bp, Homo sapiens
taattttaaataatttcta

SEQ ID NO: 4010226 - DNA, 13 bp, Homo sapiens
taattttaagaaa

SEQ ID NO: 4010227 - DNA, 15 bp, Homo sapiens
taattttacacatta

SEQ ID NO: 4010228 - DNA, 19 bp, Homo sapiens
taattttatattcagtgaa

SEQ ID NO: 4010229 - DNA, 18 bp, Homo sapiens
taattttatgaatgtctt

SEQ ID NO: 4010230 - DNA, 12 bp, Homo sapiens
taattttctcaa

SEQ ID NO: 4010231 - DNA, 13 bp, Homo sapiens
taattttctcaaa

SEQ ID NO: 4010232 - DNA, 15 bp, Homo sapiens
taattttgaataaat

SEQ ID NO: 4010233 - DNA, 12 bp, Homo sapiens
taattttgcaaa

SEQ ID NO: 4010234 - DNA, 13 bp, Homo sapiens
taattttgcaaat

SEQ ID NO: 4010235 - DNA, 16 bp, Homo sapiens
taatttttatatttaa

SEQ ID NO: 4010236 - DNA, 16 bp, Homo sapiens
taatttttatttcttc

SEQ ID NO: 4010237 - DNA, 17 bp, Homo sapiens
taatttttatttcttcc

SEQ ID NO: 4010238 - DNA, 13 bp, Homo sapiens
taatttttccttc

SEQ ID NO: 4010239 - DNA, 12 bp, Homo sapiens
taatttttgggg

SEQ ID NO: 4010240 - DNA, 22 bp, Homo sapiens
taatttttggggaaaaaagcac

SEQ ID NO: 4010241 - DNA, 23 bp, Homo sapiens
taatttttggggaaaaaagcaca

SEQ ID NO: 4010242 - DNA, 20 bp, Homo sapiens
taattttttttaaaatagaa

SEQ ID NO: 4010243 - DNA, 18 bp, Homo sapiens
taatttttttttcataga

SEQ ID NO: 4010244 - DNA, 19 bp, Homo sapiens
tacaaaagagcagcatttt

SEQ ID NO: 4010245 - DNA, 13 bp, Homo sapiens
tacaaaagatgta

SEQ ID NO: 4010246 - DNA, 13 bp, Homo sapiens
tacaaaataaaaa

SEQ ID NO: 4010247 - DNA, 20 bp, Homo sapiens
tacaaaatacaatcctgttt

SEQ ID NO: 4010248 - DNA, 19 bp, Homo sapiens
tacaaaatttgaaatttag

SEQ ID NO: 4010249 - DNA, 14 bp, Homo sapiens
tacaaactgcaata

SEQ ID NO: 4010250 - DNA, 17 bp, Homo sapiens
tacaaatataagatttt

SEQ ID NO: 4010251 - DNA, 16 bp, Homo sapiens
tacaaatcaagtattt

SEQ ID NO: 4010252 - DNA, 13 bp, Homo sapiens
tacaaatctgtat

SEQ ID NO: 4010253 - DNA, 15 bp, Homo sapiens
tacaaatctgtataa

SEQ ID NO: 4010254 - DNA, 18 bp, Homo sapiens
tacaaatctgtataaatg

SEQ ID NO: 4010255 - DNA, 22 bp, Homo sapiens
tacaaatctgtataaatgtcta

SEQ ID NO: 4010256 - DNA, 22 bp, Homo sapiens
tacaaatgtattttgaagaata

SEQ ID NO: 4010257 - DNA, 23 bp, Homo sapiens
tacaaatgtattttgaagaatat

SEQ ID NO: 4010258 - DNA, 13 bp, Homo sapiens
tacaaattagaaa

SEQ ID NO: 4010259 - DNA, 15 bp, Homo sapiens
tacaaattagaaaat

SEQ ID NO: 4010260 - DNA, 12 bp, Homo sapiens
tacaaccagagc

SEQ ID NO: 4010261 - DNA, 14 bp, Homo sapiens
tacaaccagagccc

SEQ ID NO: 4010262 - DNA, 18 bp, Homo sapiens
tacaaccatccctgccac

SEQ ID NO: 4010263 - DNA, 18 bp, Homo sapiens
tacaacttaaataataaa

SEQ ID NO: 4010264 - DNA, 19 bp, Homo sapiens
tacaagagcagcctgtggc

SEQ ID NO: 4010265 - DNA, 22 bp, Homo sapiens
tacaagagtggagagaagctct

SEQ ID NO: 4010266 - DNA, 23 bp, Homo sapiens
tacaagagtggagagaagctctt

SEQ ID NO: 4010267 - DNA, 18 bp, Homo sapiens
tacaagatattgatgata

SEQ ID NO: 4010268 - DNA, 12 bp, Homo sapiens
tacaagatccat

SEQ ID NO: 4010269 - DNA, 19 bp, Homo sapiens
tacaagatccatttgcctt

SEQ ID NO: 4010270 - DNA, 21 bp, Homo sapiens
tacaagatccatttgcctttc

SEQ ID NO: 4010271 - DNA, 23 bp, Homo sapiens
tacaagatccatttgcctttctg

SEQ ID NO: 4010272 - DNA, 24 bp, Homo sapiens
tacaagatgaaggagaggcaacat

SEQ ID NO: 4010273 - DNA, 14 bp, Homo sapiens
tacaagattgtaag

SEQ ID NO: 4010274 - DNA, 16 bp, Homo sapiens
tacaagttgttattgt

SEQ ID NO: 4010275 - DNA, 20 bp, Homo sapiens
tacaagttgttattgttgaa

SEQ ID NO: 4010276 - DNA, 16 bp, Homo sapiens
tacaagtttcagacag

SEQ ID NO: 4010277 - DNA, 11 bp, Homo sapiens
tacaataaact

SEQ ID NO: 4010278 - DNA, 15 bp, Homo sapiens
tacaataaataatct

SEQ ID NO: 4010279 - DNA, 16 bp, Homo sapiens
tacaataaataatctg

SEQ ID NO: 4010280 - DNA, 15 bp, Homo sapiens
tacaatcctgtttat

SEQ ID NO: 4010281 - DNA, 23 bp, Homo sapiens
tacaatcctgtttataatctgaa

SEQ ID NO: 4010282 - DNA, 21 bp, Homo sapiens
tacaatgaacacttataagtg

SEQ ID NO: 4010283 - DNA, 14 bp, Homo sapiens
tacaatgtgaactt

SEQ ID NO: 4010284 - DNA, 20 bp, Homo sapiens
tacaatgtgaactttattaa

SEQ ID NO: 4010285 - DNA, 22 bp, Homo sapiens
tacaattaaaaaaaaagatctg

SEQ ID NO: 4010286 - DNA, 22 bp, Homo sapiens
tacaattaatagtttgtctatt

SEQ ID NO: 4010287 - DNA, 14 bp, Homo sapiens
tacacaagtaaaca

SEQ ID NO: 4010288 - DNA, 15 bp, Homo sapiens
tacacaagtaaacat

SEQ ID NO: 4010289 - DNA, 16 bp, Homo sapiens
tacacaagtaaacatt

SEQ ID NO: 4010290 - DNA, 13 bp, Homo sapiens
taccctcccaccc

SEQ ID NO: 4010291 - DNA, 15 bp, Homo sapiens
taccctctcagctcc

SEQ ID NO: 4010292 - DNA, 20 bp, Homo sapiens
taccctctcagctccaggtg

SEQ ID NO: 4010293 - DNA, 15 bp, Homo sapiens
taccctgctccctgc

SEQ ID NO: 4010294 - DNA, 18 bp, Homo sapiens
taccctggccgccccctg

SEQ ID NO: 4010295 - DNA, 16 bp, Homo sapiens
tacccttccctgcact

SEQ ID NO: 4010296 - DNA, 20 bp, Homo sapiens
tacccttggctcaatcctct

SEQ ID NO: 4010297 - DNA, 16 bp, Homo sapiens
taccctttggggagca

SEQ ID NO: 4010298 - DNA, 16 bp, Homo sapiens
tacccttttccccctt

SEQ ID NO: 4010299 - DNA, 17 bp, Homo sapiens
tacccttttcccccttc

SEQ ID NO: 4010300 - DNA, 19 bp, Homo sapiens
taccctttttctccagctg

SEQ ID NO: 4010301 - DNA, 15 bp, Homo sapiens
taccgccctgggctg

SEQ ID NO: 4010302 - DNA, 16 bp, Homo sapiens
taccgccctgggctgg

SEQ ID NO: 4010303 - DNA, 19 bp, Homo sapiens
tacctaaaaggaaatctca

SEQ ID NO: 4010304 - DNA, 22 bp, Homo sapiens
tacctaaaaggaaatctcaccc

SEQ ID NO: 4010305 - DNA, 23 bp, Homo sapiens
tacctaaagacgtctctttttgg

SEQ ID NO: 4010306 - DNA, 17 bp, Homo sapiens
tacctaccacagtgtct

SEQ ID NO: 4010307 - DNA, 18 bp, Homo sapiens
tacctaccacagtgtctg

SEQ ID NO: 4010308 - DNA, 15 bp, Homo sapiens
tacctactgagtagg

SEQ ID NO: 4010309 - DNA, 21 bp, Homo sapiens
tacctactgtgtgccaggggc

SEQ ID NO: 4010310 - DNA, 14 bp, Homo sapiens
tacctcaaactatc

SEQ ID NO: 4010311 - DNA, 15 bp, Homo sapiens
tacctcaggcaggaa

SEQ ID NO: 4010312 - DNA, 22 bp, Homo sapiens
tacctccaacagaactaaatgt

SEQ ID NO: 4010313 - DNA, 23 bp, Homo sapiens
tacctccaacagaactaaatgtt

SEQ ID NO: 4010314 - DNA, 15 bp, Homo sapiens
tacctccaagcaagt

SEQ ID NO: 4010315 - DNA, 21 bp, Homo sapiens
tacctccatccatccttccaa

SEQ ID NO: 4010316 - DNA, 14 bp, Homo sapiens
tacctcccacactc

SEQ ID NO: 4010317 - DNA, 15 bp, Homo sapiens
tacctcccacactcc

SEQ ID NO: 4010318 - DNA, 21 bp, Homo sapiens
tacctccctccccgtctcatt

SEQ ID NO: 4010319 - DNA, 15 bp, Homo sapiens
tacctcctctcagtg

SEQ ID NO: 4010320 - DNA, 18 bp, Homo sapiens
tacctctctgtcccttgc

SEQ ID NO: 4010321 - DNA, 21 bp, Homo sapiens
tacctctcttatagaatattt

SEQ ID NO: 4010322 - DNA, 13 bp, Homo sapiens
tacctctgtgcca

SEQ ID NO: 4010323 - DNA, 17 bp, Homo sapiens
tacctctgtgccagggc

SEQ ID NO: 4010324 - DNA, 13 bp, Homo sapiens
tacctgacctaaa

SEQ ID NO: 4010325 - DNA, 17 bp, Homo sapiens
tacctgacctcttgctg

SEQ ID NO: 4010326 - DNA, 20 bp, Homo sapiens
tacctgacctcttgctgtct

SEQ ID NO: 4010327 - DNA, 12 bp, Homo sapiens
tacctgagacca

SEQ ID NO: 4010328 - DNA, 13 bp, Homo sapiens
tacctgaggccag

SEQ ID NO: 4010329 - DNA, 23 bp, Homo sapiens
tacctgatggaagtaaagcctca

SEQ ID NO: 4010330 - DNA, 20 bp, Homo sapiens
tacctgcacgttcataacca

SEQ ID NO: 4010331 - DNA, 18 bp, Homo sapiens
tacctgcaggctgagcca

SEQ ID NO: 4010332 - DNA, 13 bp, Homo sapiens
tacctgccctgga

SEQ ID NO: 4010333 - DNA, 16 bp, Homo sapiens
tacctgccctggaaca

SEQ ID NO: 4010334 - DNA, 14 bp, Homo sapiens
tacctgctctccaa

SEQ ID NO: 4010335 - DNA, 23 bp, Homo sapiens
tacctgctctccaagtctcagtg

SEQ ID NO: 4010336 - DNA, 18 bp, Homo sapiens
tacctgctgccccagctg

SEQ ID NO: 4010337 - DNA, 17 bp, Homo sapiens
tacctggcttttacttt

SEQ ID NO: 4010338 - DNA, 18 bp, Homo sapiens
tacctgggtttccagggc

SEQ ID NO: 4010339 - DNA, 20 bp, Homo sapiens
tacctgtatacagtgcagag

SEQ ID NO: 4010340 - DNA, 20 bp, Homo sapiens
tacctgtatacgtttcaaaa

SEQ ID NO: 4010341 - DNA, 17 bp, Homo sapiens
tacctgtcacattgcat

SEQ ID NO: 4010342 - DNA, 18 bp, Homo sapiens
tacctgtcacattgcatt

SEQ ID NO: 4010343 - DNA, 19 bp, Homo sapiens
tacctgtcacattgcattc

SEQ ID NO: 4010344 - DNA, 21 bp, Homo sapiens
tacctgtcacattgcattcta

SEQ ID NO: 4010345 - DNA, 14 bp, Homo sapiens
tacctgtgtatata

SEQ ID NO: 4010346 - DNA, 21 bp, Homo sapiens
tacctgtgtggtactctgaaa

SEQ ID NO: 4010347 - DNA, 22 bp, Homo sapiens
tacctgttttgtggtcagctgt

SEQ ID NO: 4010348 - DNA, 12 bp, Homo sapiens
taccttactgtg

SEQ ID NO: 4010349 - DNA, 18 bp, Homo sapiens
taccttatcactgcatta

SEQ ID NO: 4010350 - DNA, 13 bp, Homo sapiens
taccttcatttca

SEQ ID NO: 4010351 - DNA, 14 bp, Homo sapiens
taccttcatttcag

SEQ ID NO: 4010352 - DNA, 18 bp, Homo sapiens
taccttcctgtccctgag

SEQ ID NO: 4010353 - DNA, 20 bp, Homo sapiens
taccttcctgtccctgaggt

SEQ ID NO: 4010354 - DNA, 15 bp, Homo sapiens
taccttgaggtcttt

SEQ ID NO: 4010355 - DNA, 16 bp, Homo sapiens
tacctttatggtttct

SEQ ID NO: 4010356 - DNA, 16 bp, Homo sapiens
taccttttatgtagca

SEQ ID NO: 4010357 - DNA, 18 bp, Homo sapiens
taccttttctcttttctt

SEQ ID NO: 4010358 - DNA, 20 bp, Homo sapiens
taccttttctcttttctttc

SEQ ID NO: 4010359 - DNA, 21 bp, Homo sapiens
taccttttgaggagccccagc

SEQ ID NO: 4010360 - DNA, 17 bp, Homo sapiens
tacgactttattttctg

SEQ ID NO: 4010361 - DNA, 21 bp, Homo sapiens
tacgagcacctccagcctgaa

SEQ ID NO: 4010362 - DNA, 17 bp, Homo sapiens
tacgtcctgcctggcac

SEQ ID NO: 4010363 - DNA, 16 bp, Homo sapiens
tacgttattgttgact

SEQ ID NO: 4010364 - DNA, 18 bp, Homo sapiens
tacgttcctattgtcatt

SEQ ID NO: 4010365 - DNA, 14 bp, Homo sapiens
tactaaaaatgcaa

SEQ ID NO: 4010366 - DNA, 16 bp, Homo sapiens
tactaaaagcaaatct

SEQ ID NO: 4010367 - DNA, 22 bp, Homo sapiens
tactaaaagcaaatctacagat

SEQ ID NO: 4010368 - DNA, 15 bp, Homo sapiens
tactaaatttaaatt

SEQ ID NO: 4010369 - DNA, 22 bp, Homo sapiens
tactaagctttgccagctgctg

SEQ ID NO: 4010370 - DNA, 13 bp, Homo sapiens
tactaatgatgtt

SEQ ID NO: 4010371 - DNA, 15 bp, Homo sapiens
tactaatgatgtttt

SEQ ID NO: 4010372 - DNA, 16 bp, Homo sapiens
tactaatgtaaaatga

SEQ ID NO: 4010373 - DNA, 17 bp, Homo sapiens
tactaccacaaggaaaa

SEQ ID NO: 4010374 - DNA, 16 bp, Homo sapiens
tactaccttgaaaata

SEQ ID NO: 4010375 - DNA, 17 bp, Homo sapiens
tactactcctgtaggaa

SEQ ID NO: 4010376 - DNA, 15 bp, Homo sapiens
tactactgaaacaga

SEQ ID NO: 4010377 - DNA, 20 bp, Homo sapiens
tactactgaaacagatttca

SEQ ID NO: 4010378 - DNA, 14 bp, Homo sapiens
tactactttaagtg

SEQ ID NO: 4010379 - DNA, 14 bp, Homo sapiens
tactagaatgctta

SEQ ID NO: 4010380 - DNA, 20 bp, Homo sapiens
tactagatgcatcactgggt

SEQ ID NO: 4010381 - DNA, 14 bp, Homo sapiens
tactagatgtcttt

SEQ ID NO: 4010382 - DNA, 13 bp, Homo sapiens
tactaggtaactt

SEQ ID NO: 4010383 - DNA, 14 bp, Homo sapiens
tactagttacacat

SEQ ID NO: 4010384 - DNA, 19 bp, Homo sapiens
tactagttttagttttctc

SEQ ID NO: 4010385 - DNA, 14 bp, Homo sapiens
tactataacatatg

SEQ ID NO: 4010386 - DNA, 14 bp, Homo sapiens
tactatatttgtga

SEQ ID NO: 4010387 - DNA, 12 bp, Homo sapiens
tactatgtatca

SEQ ID NO: 4010388 - DNA, 20 bp, Homo sapiens
tactattaagcagtaaaaac

SEQ ID NO: 4010389 - DNA, 14 bp, Homo sapiens
tactattgcctcat

SEQ ID NO: 4010390 - DNA, 21 bp, Homo sapiens
tactatttaaagcctcctcat

SEQ ID NO: 4010391 - DNA, 17 bp, Homo sapiens
tactcacacttcagctg

SEQ ID NO: 4010392 - DNA, 21 bp, Homo sapiens
tactcacagtctctttaatct

SEQ ID NO: 4010393 - DNA, 20 bp, Homo sapiens
tagaggcatgggcttgctgt

SEQ ID NO: 4010394 - DNA, 14 bp, Homo sapiens
tagaggcttctccg

SEQ ID NO: 4010395 - DNA, 21 bp, Homo sapiens
tagaggcttctccgccagcct

SEQ ID NO: 4010396 - DNA, 21 bp, Homo sapiens
tagaggttgcagcatgagact

SEQ ID NO: 4010397 - DNA, 19 bp, Homo sapiens
tagagtagaagatttgatg

SEQ ID NO: 4010398 - DNA, 14 bp, Homo sapiens
tagagtatatgcac

SEQ ID NO: 4010399 - DNA, 15 bp, Homo sapiens
tagagttaagaagct

SEQ ID NO: 4010400 - DNA, 23 bp, Homo sapiens
tagagttaagaagctgttgtaca

SEQ ID NO: 4010401 - DNA, 12 bp, Homo sapiens
tagagttcggtc

SEQ ID NO: 4010402 - DNA, 16 bp, Homo sapiens
tagagttgctgagagg

SEQ ID NO: 4010403 - DNA, 13 bp, Homo sapiens
tagagtttctgtt

SEQ ID NO: 4010404 - DNA, 15 bp, Homo sapiens
tagagtttctgtttg

SEQ ID NO: 4010405 - DNA, 15 bp, Homo sapiens
tagataaaaagatgg

SEQ ID NO: 4010406 - DNA, 22 bp, Homo sapiens
tagatagctgcatgtggctttt

SEQ ID NO: 4010407 - DNA, 17 bp, Homo sapiens
tagataggcccctgggg

SEQ ID NO: 4010408 - DNA, 19 bp, Homo sapiens
tagataggcccctggggct

SEQ ID NO: 4010409 - DNA, 15 bp, Homo sapiens
tagatatatgctctg

SEQ ID NO: 4010410 - DNA, 19 bp, Homo sapiens
tagatatatgctctgcatg

SEQ ID NO: 4010411 - DNA, 22 bp, Homo sapiens
tagatatcctctccccctcctc

SEQ ID NO: 4010412 - DNA, 16 bp, Homo sapiens
tagatgaagttttaca

SEQ ID NO: 4010413 - DNA, 18 bp, Homo sapiens
tagatgcagaaaaagaaa

SEQ ID NO: 4010414 - DNA, 14 bp, Homo sapiens
tagatgctgactgt

SEQ ID NO: 4010415 - DNA, 16 bp, Homo sapiens
tagatgctggcccagg

SEQ ID NO: 4010416 - DNA, 21 bp, Homo sapiens
tagatgctggcccagggccca

SEQ ID NO: 4010417 - DNA, 21 bp, Homo sapiens
tagatgggagggaggctcagg

SEQ ID NO: 4010418 - DNA, 18 bp, Homo sapiens
tagatgggggaactgtga

SEQ ID NO: 4010419 - DNA, 16 bp, Homo sapiens
tagatgggtctggctg

SEQ ID NO: 4010420 - DNA, 20 bp, Homo sapiens
tagatgggtctggctgagct

SEQ ID NO: 4010421 - DNA, 21 bp, Homo sapiens
tagatgtccctttcttggcca

SEQ ID NO: 4010422 - DNA, 15 bp, Homo sapiens
tagatgtgagaaaac

SEQ ID NO: 4010423 - DNA, 12 bp, Homo sapiens
tagatgtgatta

SEQ ID NO: 4010424 - DNA, 22 bp, Homo sapiens
tagatgtgcatttttgtgaaat

SEQ ID NO: 4010425 - DNA, 13 bp, Homo sapiens
tagatgtttcaca

SEQ ID NO: 4010426 - DNA, 13 bp, Homo sapiens
tagattaaatata

SEQ ID NO: 4010427 - DNA, 18 bp, Homo sapiens
tagattaaatatagatta

SEQ ID NO: 4010428 - DNA, 22 bp, Homo sapiens
tagattaaatatagattagaaa

SEQ ID NO: 4010429 - DNA, 17 bp, Homo sapiens
tagattaggtagacttt

SEQ ID NO: 4010430 - DNA, 12 bp, Homo sapiens
tagattgcagaa

SEQ ID NO: 4010431 - DNA, 20 bp, Homo sapiens
tagatttcatagttcagaat

SEQ ID NO: 4010432 - DNA, 14 bp, Homo sapiens
tagattttcatgtt

SEQ ID NO: 4010433 - DNA, 19 bp, Homo sapiens
tagcaacaacaattggtaa

SEQ ID NO: 4010434 - DNA, 13 bp, Homo sapiens
tagcaacttttgt

SEQ ID NO: 4010435 - DNA, 17 bp, Homo sapiens
tagcaacttttgtgtaa

SEQ ID NO: 4010436 - DNA, 20 bp, Homo sapiens
tagcaagggacaattgtatc

SEQ ID NO: 4010437 - DNA, 12 bp, Homo sapiens
tagcacagctcc

SEQ ID NO: 4010438 - DNA, 13 bp, Homo sapiens
tagcacagctccc

SEQ ID NO: 4010439 - DNA, 17 bp, Homo sapiens
tagcaccttcagggctg

SEQ ID NO: 4010440 - DNA, 19 bp, Homo sapiens
tagcactcattttctataa

SEQ ID NO: 4010441 - DNA, 16 bp, Homo sapiens
tagcactgagctcaca

SEQ ID NO: 4010442 - DNA, 11 bp, Homo sapiens
tagcactgagg

SEQ ID NO: 4010443 - DNA, 20 bp, Homo sapiens
tagcacttccttgccagtct

SEQ ID NO: 4010444 - DNA, 15 bp, Homo sapiens
tagcagaaagaagag

SEQ ID NO: 4010445 - DNA, 17 bp, Homo sapiens
tagcagacagaaactgg

SEQ ID NO: 4010446 - DNA, 19 bp, Homo sapiens
tagcagacagaaactggat

SEQ ID NO: 4010447 - DNA, 19 bp, Homo sapiens
tagcagacaggccccgtga

SEQ ID NO: 4010448 - DNA, 14 bp, Homo sapiens
tagcagcacctcct

SEQ ID NO: 4010449 - DNA, 12 bp, Homo sapiens
tagcaggctgtt

SEQ ID NO: 4010450 - DNA, 15 bp, Homo sapiens
tagcataaataaaac

SEQ ID NO: 4010451 - DNA, 16 bp, Homo sapiens
tagcataaataaaact

SEQ ID NO: 4010452 - DNA, 19 bp, Homo sapiens
tagcataaataaaactgaa

SEQ ID NO: 4010453 - DNA, 21 bp, Homo sapiens
tagcatacatttataatgttt

SEQ ID NO: 4010454 - DNA, 19 bp, Homo sapiens
tagcatagcttattattga

SEQ ID NO: 4010455 - DNA, 22 bp, Homo sapiens
tagcatatatgtgtccatttcc

SEQ ID NO: 4010456 - DNA, 15 bp, Homo sapiens
tagcatcatcctgca

SEQ ID NO: 4010457 - DNA, 16 bp, Homo sapiens
tagcatcctaagaaat

SEQ ID NO: 4010458 - DNA, 20 bp, Homo sapiens
tagcatcctaagaaatatgt

SEQ ID NO: 4010459 - DNA, 22 bp, Homo sapiens
tagcatcctaagaaatatgtga

SEQ ID NO: 4010460 - DNA, 21 bp, Homo sapiens
tagccaacggccccagcttct

SEQ ID NO: 4010461 - DNA, 16 bp, Homo sapiens
tagccacatttggaat

SEQ ID NO: 4010462 - DNA, 20 bp, Homo sapiens
tagccacatttggaatactt

SEQ ID NO: 4010463 - DNA, 14 bp, Homo sapiens
tagccaccagtgtc

SEQ ID NO: 4010464 - DNA, 19 bp, Homo sapiens
tagccagcacacagggcag

SEQ ID NO: 4010465 - DNA, 20 bp, Homo sapiens
tagccaggatcatggtgtaa

SEQ ID NO: 4010466 - DNA, 22 bp, Homo sapiens
tagccaggatcatggtgtaata

SEQ ID NO: 4010467 - DNA, 16 bp, Homo sapiens
tagccagtgctccagg

SEQ ID NO: 4010468 - DNA, 14 bp, Homo sapiens
tagcccagactctg

SEQ ID NO: 4010469 - DNA, 17 bp, Homo sapiens
tagcccagactctgagc

SEQ ID NO: 4010470 - DNA, 19 bp, Homo sapiens
tagcccagcactgtgaaga

SEQ ID NO: 4010471 - DNA, 15 bp, Homo sapiens
tagccccctcttccc

SEQ ID NO: 4010472 - DNA, 15 bp, Homo sapiens
tagccccggcccccc

SEQ ID NO: 4010473 - DNA, 13 bp, Homo sapiens
tagccctccccct

SEQ ID NO: 4010474 - DNA, 16 bp, Homo sapiens
tagccctccccctcaa

SEQ ID NO: 4010475 - DNA, 18 bp, Homo sapiens
tagccctccccctcaacc

SEQ ID NO: 4010476 - DNA, 18 bp, Homo sapiens
tagcccttccctgagtgc

SEQ ID NO: 4010477 - DNA, 17 bp, Homo sapiens
tagccggaaggccgagg

SEQ ID NO: 4010478 - DNA, 23 bp, Homo sapiens
tagccggaaggccgaggtcccat

SEQ ID NO: 4010479 - DNA, 15 bp, Homo sapiens
tagccgggctctgca

SEQ ID NO: 4010480 - DNA, 21 bp, Homo sapiens
tagccgggctctgcacccacg

SEQ ID NO: 4010481 - DNA, 12 bp, Homo sapiens
tagcctccctga

SEQ ID NO: 4010482 - DNA, 18 bp, Homo sapiens
tagcctgtgcctctggga

SEQ ID NO: 4010483 - DNA, 13 bp, Homo sapiens
tagccttgcttgt

SEQ ID NO: 4010484 - DNA, 14 bp, Homo sapiens
tagccttgcttgtt

SEQ ID NO: 4010485 - DNA, 20 bp, Homo sapiens
tagcggaaaagttgtcttaa

SEQ ID NO: 4010486 - DNA, 14 bp, Homo sapiens
tagcggagcccagc

SEQ ID NO: 4010487 - DNA, 21 bp, Homo sapiens
tagcggcaaacctttccccct

SEQ ID NO: 4010488 - DNA, 16 bp, Homo sapiens
tagctaatttatttcc

SEQ ID NO: 4010489 - DNA, 20 bp, Homo sapiens
tagctaatttatttccccag

SEQ ID NO: 4010490 - DNA, 20 bp, Homo sapiens
tagctacaggaagcacccca

SEQ ID NO: 4010491 - DNA, 15 bp, Homo sapiens
tagctatatccatgt

SEQ ID NO: 4010492 - DNA, 21 bp, Homo sapiens
tagctatatccatgtactgta

SEQ ID NO: 4010493 - DNA, 11 bp, Homo sapiens
tagctcagttt

SEQ ID NO: 4010494 - DNA, 21 bp, Homo sapiens
tagctcctgccacatggagcc

SEQ ID NO: 4010495 - DNA, 11 bp, Homo sapiens
tagctctccca

SEQ ID NO: 4010496 - DNA, 22 bp, Homo sapiens
tataaagaacaaggtagttttt

SEQ ID NO: 4010497 - DNA, 23 bp, Homo sapiens
tataaagaaggttggtgaatttc

SEQ ID NO: 4010498 - DNA, 17 bp, Homo sapiens
tataaagagaagacgaa

SEQ ID NO: 4010499 - DNA, 21 bp, Homo sapiens
tataaagcgatatacagatga

SEQ ID NO: 4010500 - DNA, 17 bp, Homo sapiens
tataaatacaaatctgt

SEQ ID NO: 4010501 - DNA, 22 bp, Homo sapiens
tataaatacaaatctgtataaa

SEQ ID NO: 4010502 - DNA, 19 bp, Homo sapiens
tataaataggagaggatga

SEQ ID NO: 4010503 - DNA, 20 bp, Homo sapiens
tataaatcaatgtcacttaa

SEQ ID NO: 4010504 - DNA, 18 bp, Homo sapiens
tataaatcatattgatga

SEQ ID NO: 4010505 - DNA, 21 bp, Homo sapiens
tataaatcatattgatgaaaa

SEQ ID NO: 4010506 - DNA, 22 bp, Homo sapiens
tataaatcatattgatgaaaag

SEQ ID NO: 4010507 - DNA, 20 bp, Homo sapiens
tataaatgaaatttgcaaaa

SEQ ID NO: 4010508 - DNA, 17 bp, Homo sapiens
tataaatgttagttcta

SEQ ID NO: 4010509 - DNA, 22 bp, Homo sapiens
tataacacttaggactagaaga

SEQ ID NO: 4010510 - DNA, 15 bp, Homo sapiens
tataaccatatgata

SEQ ID NO: 4010511 - DNA, 15 bp, Homo sapiens
tataaccatgagaat

SEQ ID NO: 4010512 - DNA, 12 bp, Homo sapiens
tataaccccacc

SEQ ID NO: 4010513 - DNA, 13 bp, Homo sapiens
tataaccccacct

SEQ ID NO: 4010514 - DNA, 15 bp, Homo sapiens
tataaccccagctcc

SEQ ID NO: 4010515 - DNA, 20 bp, Homo sapiens
tataactcatcataaaataa

SEQ ID NO: 4010516 - DNA, 22 bp, Homo sapiens
tataacttaaaaatgtaaatat

SEQ ID NO: 4010517 - DNA, 16 bp, Homo sapiens
tataagagcatgaaat

SEQ ID NO: 4010518 - DNA, 18 bp, Homo sapiens
tataagcattgaaattat

SEQ ID NO: 4010519 - DNA, 23 bp, Homo sapiens
tataaggaaagcaataaatgaat

SEQ ID NO: 4010520 - DNA, 14 bp, Homo sapiens
tataagtgaagtga

SEQ ID NO: 4010521 - DNA, 13 bp, Homo sapiens
tataagtgtacat

SEQ ID NO: 4010522 - DNA, 14 bp, Homo sapiens
tataagtgtacata

SEQ ID NO: 4010523 - DNA, 18 bp, Homo sapiens
tataagtgtacatatgtg

SEQ ID NO: 4010524 - DNA, 20 bp, Homo sapiens
tataagttatttttgtacat

SEQ ID NO: 4010525 - DNA, 22 bp, Homo sapiens
tataagttatttttgtacatgt

SEQ ID NO: 4010526 - DNA, 17 bp, Homo sapiens
tataagttcacaaaatg

SEQ ID NO: 4010527 - DNA, 13 bp, Homo sapiens
tataataaaagga

SEQ ID NO: 4010528 - DNA, 12 bp, Homo sapiens
tataataaacat

SEQ ID NO: 4010529 - DNA, 22 bp, Homo sapiens
tataataaaggactgtaatctt

SEQ ID NO: 4010530 - DNA, 17 bp, Homo sapiens
tataatagcaacttttg

SEQ ID NO: 4010531 - DNA, 17 bp, Homo sapiens
tataatatactatattt

SEQ ID NO: 4010532 - DNA, 14 bp, Homo sapiens
tataatatggaacc

SEQ ID NO: 4010533 - DNA, 18 bp, Homo sapiens
tataatcaatgaatttgt

SEQ ID NO: 4010534 - DNA, 16 bp, Homo sapiens
tataatcaccagggcc

SEQ ID NO: 4010535 - DNA, 18 bp, Homo sapiens
tataatcccagcactttg

SEQ ID NO: 4010536 - DNA, 15 bp, Homo sapiens
tataatctgaagata

SEQ ID NO: 4010537 - DNA, 20 bp, Homo sapiens
tataatcttccatacttctt

SEQ ID NO: 4010538 - DNA, 18 bp, Homo sapiens
tataatgaatgaaacatt

SEQ ID NO: 4010539 - DNA, 18 bp, Homo sapiens
tataatgttgttatttaa

SEQ ID NO: 4010540 - DNA, 13 bp, Homo sapiens
tataatgtttaaa

SEQ ID NO: 4010541 - DNA, 19 bp, Homo sapiens
tataatgtttaaatcatgt

SEQ ID NO: 4010542 - DNA, 13 bp, Homo sapiens
tataattccctat

SEQ ID NO: 4010543 - DNA, 21 bp, Homo sapiens
tataattcctatatcctgtga

SEQ ID NO: 4010544 - DNA, 13 bp, Homo sapiens
tataattctgtaa

SEQ ID NO: 4010545 - DNA, 14 bp, Homo sapiens
tataattctgtaaa

SEQ ID NO: 4010546 - DNA, 15 bp, Homo sapiens
tataattctgtaaat

SEQ ID NO: 4010547 - DNA, 19 bp, Homo sapiens
tataatttatttccactaa

SEQ ID NO: 4010548 - DNA, 16 bp, Homo sapiens
tataatttcgagattt

SEQ ID NO: 4010549 - DNA, 21 bp, Homo sapiens
tataatttcgagatttgtagg

SEQ ID NO: 4010550 - DNA, 19 bp, Homo sapiens
tataatttttaaagtatat

SEQ ID NO: 4010551 - DNA, 20 bp, Homo sapiens
tataatttttttatgttttg

SEQ ID NO: 4010552 - DNA, 18 bp, Homo sapiens
tataatttttttcaatat

SEQ ID NO: 4010553 - DNA, 16 bp, Homo sapiens
tatacaaattagaaaa

SEQ ID NO: 4010554 - DNA, 16 bp, Homo sapiens
tatacaacaaaggcaa

SEQ ID NO: 4010555 - DNA, 15 bp, Homo sapiens
tatacagatgaaaat

SEQ ID NO: 4010556 - DNA, 19 bp, Homo sapiens
tatacagatgaaaatttga

SEQ ID NO: 4010557 - DNA, 12 bp, Homo sapiens
tatacagtgcct

SEQ ID NO: 4010558 - DNA, 16 bp, Homo sapiens
tatacagtgccttgct

SEQ ID NO: 4010559 - DNA, 14 bp, Homo sapiens
tatacagttatttt

SEQ ID NO: 4010560 - DNA, 15 bp, Homo sapiens
tatacagttattttg

SEQ ID NO: 4010561 - DNA, 19 bp, Homo sapiens
tatacagttattttggata

SEQ ID NO: 4010562 - DNA, 21 bp, Homo sapiens
tatacatatctttattaatca

SEQ ID NO: 4010563 - DNA, 15 bp, Homo sapiens
tatacatgaaaattt

SEQ ID NO: 4010564 - DNA, 16 bp, Homo sapiens
tatacattctttatct

SEQ ID NO: 4010565 - DNA, 17 bp, Homo sapiens
tatacattctttatctt

SEQ ID NO: 4010566 - DNA, 14 bp, Homo sapiens
tatacatttgataa

SEQ ID NO: 4010567 - DNA, 24 bp, Homo sapiens
tatacccccaggaaactagctttt

SEQ ID NO: 4010568 - DNA, 14 bp, Homo sapiens
tatacctggctttt

SEQ ID NO: 4010569 - DNA, 20 bp, Homo sapiens
tatacctggcttttacttta

SEQ ID NO: 4010570 - DNA, 13 bp, Homo sapiens
tatacctgttgct

SEQ ID NO: 4010571 - DNA, 18 bp, Homo sapiens
tatactccagtgtacata

SEQ ID NO: 4010572 - DNA, 16 bp, Homo sapiens
tatactgaagtctttt

SEQ ID NO: 4010573 - DNA, 17 bp, Homo sapiens
tatactgattatgtctt

SEQ ID NO: 4010574 - DNA, 16 bp, Homo sapiens
tatactgggttcttgt

SEQ ID NO: 4010575 - DNA, 18 bp, Homo sapiens
tatactgggttcttgttt

SEQ ID NO: 4010576 - DNA, 19 bp, Homo sapiens
tatacttgtggttttcaaa

SEQ ID NO: 4010577 - DNA, 11 bp, Homo sapiens
tatactttttt

SEQ ID NO: 4010578 - DNA, 21 bp, Homo sapiens
tatacttttttcttatttaac

SEQ ID NO: 4010579 - DNA, 24 bp, Homo sapiens
tatagaaagctatataagacaaga

SEQ ID NO: 4010580 - DNA, 20 bp, Homo sapiens
tatagaataaaagctgtgga

SEQ ID NO: 4010581 - DNA, 15 bp, Homo sapiens
tatagaatatttatt

SEQ ID NO: 4010582 - DNA, 22 bp, Homo sapiens
tatagacaacgatgaatttctt

SEQ ID NO: 4010583 - DNA, 22 bp, Homo sapiens
tatagaccaaagcaaagaaaat

SEQ ID NO: 4010584 - DNA, 21 bp, Homo sapiens
tatagaggaccctaacacagt

SEQ ID NO: 4010585 - DNA, 23 bp, Homo sapiens
tatagcaatccatgttagttttt

SEQ ID NO: 4010586 - DNA, 15 bp, Homo sapiens
tatagcactgagctc

SEQ ID NO: 4010587 - DNA, 21 bp, Homo sapiens
tatagccacatccctttgaaa

SEQ ID NO: 4010588 - DNA, 14 bp, Homo sapiens
tatagccatgattt

SEQ ID NO: 4010589 - DNA, 13 bp, Homo sapiens
tatagcccaggtc

SEQ ID NO: 4010590 - DNA, 22 bp, Homo sapiens
tatagctacaggaagcacccca

SEQ ID NO: 4010591 - DNA, 19 bp, Homo sapiens
tataggaacatatgaaaat

SEQ ID NO: 4010592 - DNA, 19 bp, Homo sapiens
tataggccagggcatgtgt

SEQ ID NO: 4010593 - DNA, 21 bp, Homo sapiens
tataggcctgtcccttgcctc

SEQ ID NO: 4010594 - DNA, 22 bp, Homo sapiens
tataggcctgtcccttgcctct

SEQ ID NO: 4010595 - DNA, 20 bp, Homo sapiens
tataggtttttctcatgtat

SEQ ID NO: 4010596 - DNA, 13 bp, Homo sapiens
tatagtacatgat

SEQ ID NO: 4010597 - DNA, 13 bp, Homo sapiens
tatagtagatttt

SEQ ID NO: 4010598 - DNA, 23 bp, Homo sapiens
tatccaaaatgtgtatttcttat

SEQ ID NO: 4010599 - DNA, 19 bp, Homo sapiens
tatccaaaccaaataaaaa

SEQ ID NO: 4010600 - DNA, 20 bp, Homo sapiens
tatccaaagaacttgatttg

SEQ ID NO: 4010601 - DNA, 14 bp, Homo sapiens
tatccaatctgtga

SEQ ID NO: 4010602 - DNA, 21 bp, Homo sapiens
tatccacaattattggcaaag

SEQ ID NO: 4010603 - DNA, 17 bp, Homo sapiens
tatccacgagagcgcag

SEQ ID NO: 4010604 - DNA, 14 bp, Homo sapiens
tatccagttactgc

SEQ ID NO: 4010605 - DNA, 15 bp, Homo sapiens
tatccatgtactgta

SEQ ID NO: 4010606 - DNA, 23 bp, Homo sapiens
tatcccagctttaaaaagaaaaa

SEQ ID NO: 4010607 - DNA, 17 bp, Homo sapiens
tatccccatctccctgc

SEQ ID NO: 4010608 - DNA, 21 bp, Homo sapiens
tatccccatctccctgcctgg

SEQ ID NO: 4010609 - DNA, 22 bp, Homo sapiens
tatccccatctccctgcctggc

SEQ ID NO: 4010610 - DNA, 17 bp, Homo sapiens
tatccctctcttcccct

SEQ ID NO: 4010611 - DNA, 14 bp, Homo sapiens
tatccctcttgtaa

SEQ ID NO: 4010612 - DNA, 19 bp, Homo sapiens
tatccctcttgtaagtcat

SEQ ID NO: 4010613 - DNA, 20 bp, Homo sapiens
tatcctagtcattcttccct

SEQ ID NO: 4010614 - DNA, 20 bp, Homo sapiens
tatcctctccccctcctcca

SEQ ID NO: 4010615 - DNA, 10 bp, Homo sapiens
tatcctgccc

SEQ ID NO: 4010616 - DNA, 17 bp, Homo sapiens
tatcctgcgaccttgca

SEQ ID NO: 4010617 - DNA, 23 bp, Homo sapiens
tatcctgggcttttgttttgctt

SEQ ID NO: 4010618 - DNA, 13 bp, Homo sapiens
tatcctgtgactg

SEQ ID NO: 4010619 - DNA, 14 bp, Homo sapiens
tatcctgtgactgt

SEQ ID NO: 4010620 - DNA, 15 bp, Homo sapiens
tatccttctggctgt

SEQ ID NO: 4010621 - DNA, 14 bp, Homo sapiens
tatcgaaataacaa

SEQ ID NO: 4010622 - DNA, 16 bp, Homo sapiens
tatcgaaataacaatg

SEQ ID NO: 4010623 - DNA, 19 bp, Homo sapiens
tatcgaaataacaatgtta

SEQ ID NO: 4010624 - DNA, 19 bp, Homo sapiens
tatcgccctggcaggcagg

SEQ ID NO: 4010625 - DNA, 14 bp, Homo sapiens
tatcgggagcagtg

SEQ ID NO: 4010626 - DNA, 15 bp, Homo sapiens
tatcgggagcagtgt

SEQ ID NO: 4010627 - DNA, 12 bp, Homo sapiens
tatctaaagttt

SEQ ID NO: 4010628 - DNA, 17 bp, Homo sapiens
tatctaatatatatgaa

SEQ ID NO: 4010629 - DNA, 21 bp, Homo sapiens
tatctaatatatatgaataaa

SEQ ID NO: 4010630 - DNA, 20 bp, Homo sapiens
tatctagcaatcacaacact

SEQ ID NO: 4010631 - DNA, 13 bp, Homo sapiens
tatctagctgcat

SEQ ID NO: 4010632 - DNA, 18 bp, Homo sapiens
tatctagctgcatatctt

SEQ ID NO: 4010633 - DNA, 14 bp, Homo sapiens
tatctagtgcagct

SEQ ID NO: 4010634 - DNA, 20 bp, Homo sapiens
tatctagtgcagctgatttt

SEQ ID NO: 4010635 - DNA, 14 bp, Homo sapiens
tatctattaaagtg

SEQ ID NO: 4010636 - DNA, 12 bp, Homo sapiens
tatctattaata

SEQ ID NO: 4010637 - DNA, 14 bp, Homo sapiens
tatctcatcaacaa

SEQ ID NO: 4010638 - DNA, 22 bp, Homo sapiens
tatctcatttaatttgttataa

SEQ ID NO: 4010639 - DNA, 13 bp, Homo sapiens
tatctccttccca

SEQ ID NO: 4010640 - DNA, 15 bp, Homo sapiens
tatctccttcccacc

SEQ ID NO: 4010641 - DNA, 20 bp, Homo sapiens
tatctctatttaatatttat

SEQ ID NO: 4010642 - DNA, 12 bp, Homo sapiens
tatctctctgtg

SEQ ID NO: 4010643 - DNA, 12 bp, Homo sapiens
tatctctgtgtt

SEQ ID NO: 4010644 - DNA, 14 bp, Homo sapiens
tatctgaaaactgg

SEQ ID NO: 4010645 - DNA, 20 bp, Homo sapiens
tatctgaaaatgtatgtgta

SEQ ID NO: 4010646 - DNA, 16 bp, Homo sapiens
tatctgattttgtgca

SEQ ID NO: 4010647 - DNA, 22 bp, Homo sapiens
tatctgattttgtgcaaaagct

SEQ ID NO: 4010648 - DNA, 20 bp, Homo sapiens
tatctgcactctaaactgca

SEQ ID NO: 4010649 - DNA, 21 bp, Homo sapiens
tatctgcactctaaactgcaa

SEQ ID NO: 4010650 - DNA, 15 bp, Homo sapiens
tatctgcattatcta

SEQ ID NO: 4010651 - DNA, 18 bp, Homo sapiens
tatctggcctaaaatctt

SEQ ID NO: 4010652 - DNA, 15 bp, Homo sapiens
tatctgtcatctctc

SEQ ID NO: 4010653 - DNA, 17 bp, Homo sapiens
tatctgtccgtggaaaa

SEQ ID NO: 4010654 - DNA, 19 bp, Homo sapiens
tatctgtgaaatgctggca

SEQ ID NO: 4010655 - DNA, 18 bp, Homo sapiens
tatctgtgcgtgaaacac

SEQ ID NO: 4010656 - DNA, 17 bp, Homo sapiens
tatctgtgtttttgaaa

SEQ ID NO: 4010657 - DNA, 18 bp, Homo sapiens
tatcttaagttctatgaa

SEQ ID NO: 4010658 - DNA, 21 bp, Homo sapiens
tatcttcaaactttcactttg

SEQ ID NO: 4010659 - DNA, 17 bp, Homo sapiens
tatcttcttcaaataca

SEQ ID NO: 4010660 - DNA, 20 bp, Homo sapiens
tatcttcttcaaatacaaag

SEQ ID NO: 4010661 - DNA, 16 bp, Homo sapiens
tatcttgtatggtttg

SEQ ID NO: 4010662 - DNA, 15 bp, Homo sapiens
tatcttgtctctggg

SEQ ID NO: 4010663 - DNA, 13 bp, Homo sapiens
tatcttgtgaagt

SEQ ID NO: 4010664 - DNA, 15 bp, Homo sapiens
tatcttgtgaagttg

SEQ ID NO: 4010665 - DNA, 15 bp, Homo sapiens
tatctttattaatca

SEQ ID NO: 4010666 - DNA, 18 bp, Homo sapiens
tatctttgtgataattta

SEQ ID NO: 4010667 - DNA, 14 bp, Homo sapiens
tatcttttatgttt

SEQ ID NO: 4010668 - DNA, 18 bp, Homo sapiens
tatctttttacctttcat

SEQ ID NO: 4010669 - DNA, 19 bp, Homo sapiens
tatgaaaaaaatggcatca

SEQ ID NO: 4010670 - DNA, 19 bp, Homo sapiens
tatgaaaaattggggagga

SEQ ID NO: 4010671 - DNA, 15 bp, Homo sapiens
tatgaaaacttatga

SEQ ID NO: 4010672 - DNA, 14 bp, Homo sapiens
tatgaaagaatata

SEQ ID NO: 4010673 - DNA, 19 bp, Homo sapiens
tatgaaagaatatatttat

SEQ ID NO: 4010674 - DNA, 23 bp, Homo sapiens
tatgaaagaatatatttatttaa

SEQ ID NO: 4010675 - DNA, 19 bp, Homo sapiens
tatgaaagcaacaaagaaa

SEQ ID NO: 4010676 - DNA, 16 bp, Homo sapiens
tatgaaattccagcaa

SEQ ID NO: 4010677 - DNA, 23 bp, Homo sapiens
tatgaaattccagcaataagaaa

SEQ ID NO: 4010678 - DNA, 15 bp, Homo sapiens
tatgaaatttcactt

SEQ ID NO: 4010679 - DNA, 18 bp, Homo sapiens
tatgaagaattgccaatc

SEQ ID NO: 4010680 - DNA, 23 bp, Homo sapiens
tatgaagaattgccaatcttgtt

SEQ ID NO: 4010681 - DNA, 14 bp, Homo sapiens
tatgaagacataaa

SEQ ID NO: 4010682 - DNA, 19 bp, Homo sapiens
tatgaagataagtgtattt

SEQ ID NO: 4010683 - DNA, 13 bp, Homo sapiens
tatgaagtgcgtg

SEQ ID NO: 4010684 - DNA, 19 bp, Homo sapiens
tatgaagtgcgtgaatgta

SEQ ID NO: 4010685 - DNA, 12 bp, Homo sapiens
tatgaatacagg

SEQ ID NO: 4010686 - DNA, 23 bp, Homo sapiens
tatgaatcagtgggcaggataaa

SEQ ID NO: 4010687 - DNA, 13 bp, Homo sapiens
tatgaattcaaga

SEQ ID NO: 4010688 - DNA, 19 bp, Homo sapiens
tatgaatttaaatataatt

SEQ ID NO: 4010689 - DNA, 16 bp, Homo sapiens
tatgacagatatattt

SEQ ID NO: 4010690 - DNA, 21 bp, Homo sapiens
tatgacagatatatttaagcc

SEQ ID NO: 4010691 - DNA, 12 bp, Homo sapiens
tatgacatttaa

SEQ ID NO: 4010692 - DNA, 13 bp, Homo sapiens
tatgaccagaagc

SEQ ID NO: 4010693 - DNA, 15 bp, Homo sapiens
tatgaccagaagcct

SEQ ID NO: 4010694 - DNA, 17 bp, Homo sapiens
tatgaccagaagccttg

SEQ ID NO: 4010695 - DNA, 18 bp, Homo sapiens
tatgaccagaagccttgg

SEQ ID NO: 4010696 - DNA, 16 bp, Homo sapiens
tatgacggaagaacat

SEQ ID NO: 4010697 - DNA, 15 bp, Homo sapiens
tatgactaaagagag

SEQ ID NO: 4010698 - DNA, 16 bp, Homo sapiens
tatgactaaagagaga

SEQ ID NO: 4010699 - DNA, 20 bp, Homo sapiens
tatgactaaagagagaatgt

SEQ ID NO: 4010700 - DNA, 22 bp, Homo sapiens
tatgactgctccccagccctgg

SEQ ID NO: 4010701 - DNA, 21 bp, Homo sapiens
tatttatctgtagtaaactat

SEQ ID NO: 4010702 - DNA, 12 bp, Homo sapiens
tatttatgaagt

SEQ ID NO: 4010703 - DNA, 22 bp, Homo sapiens
tatttatgaagtttaaaacagt

SEQ ID NO: 4010704 - DNA, 19 bp, Homo sapiens
tatttatgcactgtgggat

SEQ ID NO: 4010705 - DNA, 22 bp, Homo sapiens
tatttatgccttgatgatttaa

SEQ ID NO: 4010706 - DNA, 19 bp, Homo sapiens
tatttatggatgcaacacg

SEQ ID NO: 4010707 - DNA, 17 bp, Homo sapiens
tatttattaaataaaat

SEQ ID NO: 4010708 - DNA, 13 bp, Homo sapiens
tatttattaacag

SEQ ID NO: 4010709 - DNA, 19 bp, Homo sapiens
tatttattaatatttaaca

SEQ ID NO: 4010710 - DNA, 13 bp, Homo sapiens
tatttattacctc

SEQ ID NO: 4010711 - DNA, 13 bp, Homo sapiens
tatttattactgt

SEQ ID NO: 4010712 - DNA, 10 bp, Homo sapiens
tatttattgt

SEQ ID NO: 4010713 - DNA, 16 bp, Homo sapiens
tatttattgttagaaa

SEQ ID NO: 4010714 - DNA, 13 bp, Homo sapiens
tatttatttaatt

SEQ ID NO: 4010715 - DNA, 11 bp, Homo sapiens
tatttatttac

SEQ ID NO: 4010716 - DNA, 13 bp, Homo sapiens
tatttatttactg

SEQ ID NO: 4010717 - DNA, 17 bp, Homo sapiens
tatttatttactgagct

SEQ ID NO: 4010718 - DNA, 12 bp, Homo sapiens
tatttatttcta

SEQ ID NO: 4010719 - DNA, 14 bp, Homo sapiens
tatttatttctagt

SEQ ID NO: 4010720 - DNA, 13 bp, Homo sapiens
tatttattttctt

SEQ ID NO: 4010721 - DNA, 21 bp, Homo sapiens
tatttattttcttttgaattg

SEQ ID NO: 4010722 - DNA, 21 bp, Homo sapiens
tatttcaataaatctttcaaa

SEQ ID NO: 4010723 - DNA, 21 bp, Homo sapiens
tatttcactatcttcttcaaa

SEQ ID NO: 4010724 - DNA, 19 bp, Homo sapiens
tatttcagatatcaaaatt

SEQ ID NO: 4010725 - DNA, 21 bp, Homo sapiens
tatttcagtgtagttaattta

SEQ ID NO: 4010726 - DNA, 22 bp, Homo sapiens
tatttcagtgtagttaatttat

SEQ ID NO: 4010727 - DNA, 23 bp, Homo sapiens
tatttcagtgtagttaatttatc

SEQ ID NO: 4010728 - DNA, 18 bp, Homo sapiens
tatttcagtgttacctgt

SEQ ID NO: 4010729 - DNA, 23 bp, Homo sapiens
tatttcagttattgtccctggct

SEQ ID NO: 4010730 - DNA, 12 bp, Homo sapiens
tatttcatgtgg

SEQ ID NO: 4010731 - DNA, 17 bp, Homo sapiens
tatttcatgtggctgta

SEQ ID NO: 4010732 - DNA, 22 bp, Homo sapiens
tatttcattcgggccccacctg

SEQ ID NO: 4010733 - DNA, 15 bp, Homo sapiens
tatttccactaaaaa

SEQ ID NO: 4010734 - DNA, 19 bp, Homo sapiens
tatttcccctcttctgcta

SEQ ID NO: 4010735 - DNA, 15 bp, Homo sapiens
tatttccctaaaata

SEQ ID NO: 4010736 - DNA, 18 bp, Homo sapiens
tatttccctctcattttg

SEQ ID NO: 4010737 - DNA, 13 bp, Homo sapiens
tatttcctccctc

SEQ ID NO: 4010738 - DNA, 11 bp, Homo sapiens
tatttcctgac

SEQ ID NO: 4010739 - DNA, 13 bp, Homo sapiens
tatttcctgactt

SEQ ID NO: 4010740 - DNA, 15 bp, Homo sapiens
tatttcctgacttga

SEQ ID NO: 4010741 - DNA, 16 bp, Homo sapiens
tatttcctgacttgag

SEQ ID NO: 4010742 - DNA, 22 bp, Homo sapiens
tatttccttggattttcctgaa

SEQ ID NO: 4010743 - DNA, 16 bp, Homo sapiens
tatttcctttatgtga

SEQ ID NO: 4010744 - DNA, 15 bp, Homo sapiens
tatttcgaaagctgc

SEQ ID NO: 4010745 - DNA, 20 bp, Homo sapiens
tatttctaatccttttcctt

SEQ ID NO: 4010746 - DNA, 17 bp, Homo sapiens
tatttctagtccaaaat

SEQ ID NO: 4010747 - DNA, 11 bp, Homo sapiens
tatttctcctt

SEQ ID NO: 4010748 - DNA, 15 bp, Homo sapiens
tatttctccttttgt

SEQ ID NO: 4010749 - DNA, 19 bp, Homo sapiens
tatttctcgggtgcatttg

SEQ ID NO: 4010750 - DNA, 17 bp, Homo sapiens
tatttctgtttctcata

SEQ ID NO: 4010751 - DNA, 13 bp, Homo sapiens
tatttcttccctg

SEQ ID NO: 4010752 - DNA, 13 bp, Homo sapiens
tatttcttgtttg

SEQ ID NO: 4010753 - DNA, 23 bp, Homo sapiens
tatttctttttaattattttaaa

SEQ ID NO: 4010754 - DNA, 16 bp, Homo sapiens
tatttgaaaaaaactt

SEQ ID NO: 4010755 - DNA, 20 bp, Homo sapiens
tatttgaaaacatgtttatt

SEQ ID NO: 4010756 - DNA, 18 bp, Homo sapiens
tatttgaaaattttactt

SEQ ID NO: 4010757 - DNA, 17 bp, Homo sapiens
tatttgaaatactaaaa

SEQ ID NO: 4010758 - DNA, 19 bp, Homo sapiens
tatttgaaatactaaaagc

SEQ ID NO: 4010759 - DNA, 22 bp, Homo sapiens
tatttgaaatactaaaagcaaa

SEQ ID NO: 4010760 - DNA, 12 bp, Homo sapiens
tatttgaatgaa

SEQ ID NO: 4010761 - DNA, 17 bp, Homo sapiens
tatttgaatgaaaacat

SEQ ID NO: 4010762 - DNA, 15 bp, Homo sapiens
tatttgaattaaaac

SEQ ID NO: 4010763 - DNA, 21 bp, Homo sapiens
tatttgaattaaaacttctta

SEQ ID NO: 4010764 - DNA, 19 bp, Homo sapiens
tatttgaattttaaatcta

SEQ ID NO: 4010765 - DNA, 21 bp, Homo sapiens
tatttgaattttaaatctaaa

SEQ ID NO: 4010766 - DNA, 22 bp, Homo sapiens
tatttgacttgcatgaagagaa

SEQ ID NO: 4010767 - DNA, 18 bp, Homo sapiens
tatttgagagttctaaat

SEQ ID NO: 4010768 - DNA, 16 bp, Homo sapiens
tatttgcatgttacct

SEQ ID NO: 4010769 - DNA, 15 bp, Homo sapiens
tatttgcattgagga

SEQ ID NO: 4010770 - DNA, 16 bp, Homo sapiens
tatttgccatgggctt

SEQ ID NO: 4010771 - DNA, 17 bp, Homo sapiens
tatttgccatgggcttc

SEQ ID NO: 4010772 - DNA, 19 bp, Homo sapiens
tatttgccttctactcccc

SEQ ID NO: 4010773 - DNA, 15 bp, Homo sapiens
tatttgctgttaact

SEQ ID NO: 4010774 - DNA, 15 bp, Homo sapiens
tatttgggaagtgaa

SEQ ID NO: 4010775 - DNA, 12 bp, Homo sapiens
tatttgtgaata

SEQ ID NO: 4010776 - DNA, 19 bp, Homo sapiens
tatttgtgttttaatttaa

SEQ ID NO: 4010777 - DNA, 21 bp, Homo sapiens
tatttgtgttttaatttaaac

SEQ ID NO: 4010778 - DNA, 22 bp, Homo sapiens
tatttgttgttttctgggggaa

SEQ ID NO: 4010779 - DNA, 21 bp, Homo sapiens
tatttgtttttattgtaaaac

SEQ ID NO: 4010780 - DNA, 19 bp, Homo sapiens
tattttaagcactcttaaa

SEQ ID NO: 4010781 - DNA, 22 bp, Homo sapiens
tattttaatacaggacttttaa

SEQ ID NO: 4010782 - DNA, 13 bp, Homo sapiens
tattttaatagaa

SEQ ID NO: 4010783 - DNA, 23 bp, Homo sapiens
tattttaatcctgtaccaaatct

SEQ ID NO: 4010784 - DNA, 13 bp, Homo sapiens
tattttaatgtaa

SEQ ID NO: 4010785 - DNA, 19 bp, Homo sapiens
tattttaatttatgagttt

SEQ ID NO: 4010786 - DNA, 17 bp, Homo sapiens
tattttatttatttaat

SEQ ID NO: 4010787 - DNA, 21 bp, Homo sapiens
tattttcaacgcagccctgct

SEQ ID NO: 4010788 - DNA, 12 bp, Homo sapiens
tattttcacaat

SEQ ID NO: 4010789 - DNA, 18 bp, Homo sapiens
tattttcccccttttctg

SEQ ID NO: 4010790 - DNA, 19 bp, Homo sapiens
tattttcccctatcattta

SEQ ID NO: 4010791 - DNA, 21 bp, Homo sapiens
tattttcttacccaatttccc

SEQ ID NO: 4010792 - DNA, 14 bp, Homo sapiens
tattttctttaatg

SEQ ID NO: 4010793 - DNA, 14 bp, Homo sapiens
tattttctttgaaa

SEQ ID NO: 4010794 - DNA, 14 bp, Homo sapiens
tattttgaaaagct

SEQ ID NO: 4010795 - DNA, 14 bp, Homo sapiens
tattttgaagaata

SEQ ID NO: 4010796 - DNA, 15 bp, Homo sapiens
tattttgaagtttac

SEQ ID NO: 4010797 - DNA, 17 bp, Homo sapiens
tattttgaagtttacat

SEQ ID NO: 4010798 - DNA, 18 bp, Homo sapiens
tattttgaagtttacatt

SEQ ID NO: 4010799 - DNA, 16 bp, Homo sapiens
tattttgaatgtgaag

SEQ ID NO: 4010800 - DNA, 21 bp, Homo sapiens
tattttgagaaactgctgcag

SEQ ID NO: 4010801 - DNA, 23 bp, Homo sapiens
tattttggaaactgctaaattct

SEQ ID NO: 4010802 - DNA, 12 bp, Homo sapiens
tattttggatat

SEQ ID NO: 4010803 - DNA, 17 bp, Homo sapiens
tattttggtacttttat

SEQ ID NO: 4010804 - DNA, 19 bp, Homo sapiens
tcactagaatggataaaat

SEQ ID NO: 4010805 - DNA, 23 bp, Homo sapiens
tcactagtgccaatgatgtgacc

SEQ ID NO: 4010806 - DNA, 17 bp, Homo sapiens
tcactagtgtcaggccc

SEQ ID NO: 4010807 - DNA, 15 bp, Homo sapiens
tcactatcttcttca

SEQ ID NO: 4010808 - DNA, 19 bp, Homo sapiens
tcactatgacactgagcaa

SEQ ID NO: 4010809 - DNA, 17 bp, Homo sapiens
tcactatggtatgctgg

SEQ ID NO: 4010810 - DNA, 21 bp, Homo sapiens
tcactatggtatgctggccag

SEQ ID NO: 4010811 - DNA, 14 bp, Homo sapiens
tcactcaagcactg

SEQ ID NO: 4010812 - DNA, 18 bp, Homo sapiens
tcactcagaagtccagag

SEQ ID NO: 4010813 - DNA, 14 bp, Homo sapiens
tcactcagagcagt

SEQ ID NO: 4010814 - DNA, 22 bp, Homo sapiens
tcactcattgctgagcctctgc

SEQ ID NO: 4010815 - DNA, 13 bp, Homo sapiens
tcactccacagag

SEQ ID NO: 4010816 - DNA, 23 bp, Homo sapiens
tcactcccacctgcatctggggc

SEQ ID NO: 4010817 - DNA, 14 bp, Homo sapiens
tcactccccaggga

SEQ ID NO: 4010818 - DNA, 17 bp, Homo sapiens
tcactccctctgccttc

SEQ ID NO: 4010819 - DNA, 15 bp, Homo sapiens
tcactcctacctggt

SEQ ID NO: 4010820 - DNA, 22 bp, Homo sapiens
tcactcctaggagagccaacct

SEQ ID NO: 4010821 - DNA, 12 bp, Homo sapiens
tcactcctgggg

SEQ ID NO: 4010822 - DNA, 20 bp, Homo sapiens
tcactcctgttacttaccta

SEQ ID NO: 4010823 - DNA, 14 bp, Homo sapiens
tcactctctattgt

SEQ ID NO: 4010824 - DNA, 23 bp, Homo sapiens
tcactctctattgtcatggggat

SEQ ID NO: 4010825 - DNA, 15 bp, Homo sapiens
tcactctctgaagat

SEQ ID NO: 4010826 - DNA, 14 bp, Homo sapiens
tcactgaactccac

SEQ ID NO: 4010827 - DNA, 16 bp, Homo sapiens
tcactgaactccaccg

SEQ ID NO: 4010828 - DNA, 14 bp, Homo sapiens
tcactgaatttata

SEQ ID NO: 4010829 - DNA, 20 bp, Homo sapiens
tcactgagctccccagatct

SEQ ID NO: 4010830 - DNA, 21 bp, Homo sapiens
tcactgagctccccagatctc

SEQ ID NO: 4010831 - DNA, 22 bp, Homo sapiens
tcactgagctccccagatctcc

SEQ ID NO: 4010832 - DNA, 18 bp, Homo sapiens
tcactgcaacctccgcct

SEQ ID NO: 4010833 - DNA, 21 bp, Homo sapiens
tcactgcaacctctgcctccc

SEQ ID NO: 4010834 - DNA, 18 bp, Homo sapiens
tcactgcaattttgtgta

SEQ ID NO: 4010835 - DNA, 22 bp, Homo sapiens
tcactgcacagtgcatctcagc

SEQ ID NO: 4010836 - DNA, 17 bp, Homo sapiens
tcactgcattattctct

SEQ ID NO: 4010837 - DNA, 16 bp, Homo sapiens
tcactgccaggccagc

SEQ ID NO: 4010838 - DNA, 23 bp, Homo sapiens
tcactgccaggccagcctccgag

SEQ ID NO: 4010839 - DNA, 13 bp, Homo sapiens
tcactgcctcccc

SEQ ID NO: 4010840 - DNA, 15 bp, Homo sapiens
tcactgctggctgcc

SEQ ID NO: 4010841 - DNA, 17 bp, Homo sapiens
tcactgctggctgcctt

SEQ ID NO: 4010842 - DNA, 18 bp, Homo sapiens
tcactgctggctgcctta

SEQ ID NO: 4010843 - DNA, 17 bp, Homo sapiens
tcactggaaaggggaga

SEQ ID NO: 4010844 - DNA, 19 bp, Homo sapiens
tcactggagttacattaat

SEQ ID NO: 4010845 - DNA, 16 bp, Homo sapiens
tcactggcaatgaaaa

SEQ ID NO: 4010846 - DNA, 19 bp, Homo sapiens
tcactggctggcctgagca

SEQ ID NO: 4010847 - DNA, 16 bp, Homo sapiens
tcactggctggctcct

SEQ ID NO: 4010848 - DNA, 17 bp, Homo sapiens
tcactggggcctacagc

SEQ ID NO: 4010849 - DNA, 14 bp, Homo sapiens
tcactgggtgttga

SEQ ID NO: 4010850 - DNA, 22 bp, Homo sapiens
tcactgggtgttgatcttacaa

SEQ ID NO: 4010851 - DNA, 19 bp, Homo sapiens
tcactgtataaataggaga

SEQ ID NO: 4010852 - DNA, 23 bp, Homo sapiens
tcactgtataaataggagaggat

SEQ ID NO: 4010853 - DNA, 15 bp, Homo sapiens
tcactgtatagacat

SEQ ID NO: 4010854 - DNA, 15 bp, Homo sapiens
tcactgtgtacataa

SEQ ID NO: 4010855 - DNA, 17 bp, Homo sapiens
tcactgtgtacataatg

SEQ ID NO: 4010856 - DNA, 19 bp, Homo sapiens
tcactgttccctctgctcc

SEQ ID NO: 4010857 - DNA, 20 bp, Homo sapiens
tcactgttccctctgctcct

SEQ ID NO: 4010858 - DNA, 12 bp, Homo sapiens
tcactgttctgc

SEQ ID NO: 4010859 - DNA, 17 bp, Homo sapiens
tcacttacctagattta

SEQ ID NO: 4010860 - DNA, 20 bp, Homo sapiens
tcacttagaacctttctgtg

SEQ ID NO: 4010861 - DNA, 19 bp, Homo sapiens
tcacttatcccaagagaat

SEQ ID NO: 4010862 - DNA, 19 bp, Homo sapiens
tcacttcaggagaaactgc

SEQ ID NO: 4010863 - DNA, 13 bp, Homo sapiens
tcacttctttccc

SEQ ID NO: 4010864 - DNA, 22 bp, Homo sapiens
tcacttctttcccttcctccat

SEQ ID NO: 4010865 - DNA, 13 bp, Homo sapiens
tcacttgaatgtg

SEQ ID NO: 4010866 - DNA, 22 bp, Homo sapiens
tcacttgaggtcaggagttcct

SEQ ID NO: 4010867 - DNA, 20 bp, Homo sapiens
tcacttgatgtgccatttta

SEQ ID NO: 4010868 - DNA, 17 bp, Homo sapiens
tcacttgtgcagtgttg

SEQ ID NO: 4010869 - DNA, 18 bp, Homo sapiens
tcacttgtgctttgctct

SEQ ID NO: 4010870 - DNA, 19 bp, Homo sapiens
tcacttgtgctttgctctt

SEQ ID NO: 4010871 - DNA, 20 bp, Homo sapiens
tcacttgtgctttgctcttg

SEQ ID NO: 4010872 - DNA, 15 bp, Homo sapiens
tcactttatttcatt

SEQ ID NO: 4010873 - DNA, 17 bp, Homo sapiens
tcactttcacatagatg

SEQ ID NO: 4010874 - DNA, 15 bp, Homo sapiens
tcactttgctctggg

SEQ ID NO: 4010875 - DNA, 13 bp, Homo sapiens
tcactttgtctaa

SEQ ID NO: 4010876 - DNA, 19 bp, Homo sapiens
tcacttttgttctgcttta

SEQ ID NO: 4010877 - DNA, 20 bp, Homo sapiens
tcacttttgttctgctttat

SEQ ID NO: 4010878 - DNA, 23 bp, Homo sapiens
tcagaaaaaaggttctttgtgta

SEQ ID NO: 4010879 - DNA, 17 bp, Homo sapiens
tcagaaaatattatgtg

SEQ ID NO: 4010880 - DNA, 13 bp, Homo sapiens
tcagaaaccagtt

SEQ ID NO: 4010881 - DNA, 22 bp, Homo sapiens
tcagaaaccagttatgtgaatg

SEQ ID NO: 4010882 - DNA, 16 bp, Homo sapiens
tcagaaactagaaatg

SEQ ID NO: 4010883 - DNA, 15 bp, Homo sapiens
tcagaaactcccctg

SEQ ID NO: 4010884 - DNA, 15 bp, Homo sapiens
tcagaaacttgtgaa

SEQ ID NO: 4010885 - DNA, 18 bp, Homo sapiens
tcagaaacttgtgaagtg

SEQ ID NO: 4010886 - DNA, 13 bp, Homo sapiens
tcagaaagacttg

SEQ ID NO: 4010887 - DNA, 20 bp, Homo sapiens
tcagaaagtcaccaggactt

SEQ ID NO: 4010888 - DNA, 15 bp, Homo sapiens
tcagaaagtgcctga

SEQ ID NO: 4010889 - DNA, 23 bp, Homo sapiens
tcagaaagtgcctgacacactaa

SEQ ID NO: 4010890 - DNA, 16 bp, Homo sapiens
tcagaaattggaacag

SEQ ID NO: 4010891 - DNA, 19 bp, Homo sapiens
tcagaaatttttatcagtt

SEQ ID NO: 4010892 - DNA, 17 bp, Homo sapiens
tcagaacctcttcccca

SEQ ID NO: 4010893 - DNA, 18 bp, Homo sapiens
tcagaacctcttccccag

SEQ ID NO: 4010894 - DNA, 21 bp, Homo sapiens
tcagaactcaaatggggccag

SEQ ID NO: 4010895 - DNA, 22 bp, Homo sapiens
tcagaactcaaatggggccaga

SEQ ID NO: 4010896 - DNA, 14 bp, Homo sapiens
tcagaactgtgcca

SEQ ID NO: 4010897 - DNA, 13 bp, Homo sapiens
tcagaacttgctg

SEQ ID NO: 4010898 - DNA, 16 bp, Homo sapiens
tcagaacttgctgctg

SEQ ID NO: 4010899 - DNA, 17 bp, Homo sapiens
tcagaacttgctgctgt

SEQ ID NO: 4010900 - DNA, 14 bp, Homo sapiens
tcagaagcaaacaa

SEQ ID NO: 4010901 - DNA, 16 bp, Homo sapiens
tcagaagcaagccaga

SEQ ID NO: 4010902 - DNA, 15 bp, Homo sapiens
tcagaagcctccaag

SEQ ID NO: 4010903 - DNA, 14 bp, Homo sapiens
tcagaatattgtct

SEQ ID NO: 4010904 - DNA, 16 bp, Homo sapiens
tcagaatcatggagaa

SEQ ID NO: 4010905 - DNA, 18 bp, Homo sapiens
tcagaatctcaaataact

SEQ ID NO: 4010906 - DNA, 17 bp, Homo sapiens
tcattgtaatgttactg

SEQ ID NO: 4010907 - DNA, 13 bp, Homo sapiens
tcattgtccctct

SEQ ID NO: 4010908 - DNA, 16 bp, Homo sapiens
tcattgtccctcttca

SEQ ID NO: 4010909 - DNA, 20 bp, Homo sapiens
tcattgtccctcttcactcc

SEQ ID NO: 4010910 - DNA, 21 bp, Homo sapiens
tcattgtccctcttcactccc

SEQ ID NO: 4010911 - DNA, 15 bp, Homo sapiens
tcattgttatttata

SEQ ID NO: 4010912 - DNA, 22 bp, Homo sapiens
tcattgttatttatacaagatt

SEQ ID NO: 4010913 - DNA, 22 bp, Homo sapiens
tcattgttctcctcgtccatca

SEQ ID NO: 4010914 - DNA, 14 bp, Homo sapiens
tcatttaaaatgat

SEQ ID NO: 4010915 - DNA, 16 bp, Homo sapiens
tcatttaaaatgatta

SEQ ID NO: 4010916 - DNA, 16 bp, Homo sapiens
tcatttactaaacata

SEQ ID NO: 4010917 - DNA, 16 bp, Homo sapiens
tcatttagaacttgca

SEQ ID NO: 4010918 - DNA, 23 bp, Homo sapiens
tcatttagcatgttgttgaaagg

SEQ ID NO: 4010919 - DNA, 18 bp, Homo sapiens
tcatttattgtttatgta

SEQ ID NO: 4010920 - DNA, 22 bp, Homo sapiens
tcatttattgtttatgtaaatg

SEQ ID NO: 4010921 - DNA, 16 bp, Homo sapiens
tcatttattttaagca

SEQ ID NO: 4010922 - DNA, 20 bp, Homo sapiens
tcatttcagtatcatctcca

SEQ ID NO: 4010923 - DNA, 13 bp, Homo sapiens
tcatttcattcca

SEQ ID NO: 4010924 - DNA, 14 bp, Homo sapiens
tcatttcattccat

SEQ ID NO: 4010925 - DNA, 15 bp, Homo sapiens
tcatttctactgtga

SEQ ID NO: 4010926 - DNA, 24 bp, Homo sapiens
tcatttctcactgtgtacataatg

SEQ ID NO: 4010927 - DNA, 18 bp, Homo sapiens
tcatttctcataattttg

SEQ ID NO: 4010928 - DNA, 21 bp, Homo sapiens
tcatttgcccttaaggacaaa

SEQ ID NO: 4010929 - DNA, 16 bp, Homo sapiens
tcattttacagtatct

SEQ ID NO: 4010930 - DNA, 14 bp, Homo sapiens
tcattttacagtga

SEQ ID NO: 4010931 - DNA, 21 bp, Homo sapiens
tcattttcctgttcagtgaga

SEQ ID NO: 4010932 - DNA, 16 bp, Homo sapiens
tcattttgcattcaaa

SEQ ID NO: 4010933 - DNA, 17 bp, Homo sapiens
tcattttgcattcaaat

SEQ ID NO: 4010934 - DNA, 14 bp, Homo sapiens
tcattttggagctt

SEQ ID NO: 4010935 - DNA, 21 bp, Homo sapiens
tcattttgttgcttttgtgaa

SEQ ID NO: 4010936 - DNA, 13 bp, Homo sapiens
tccaaaaaaagga

SEQ ID NO: 4010937 - DNA, 18 bp, Homo sapiens
tccaaaaaaaggaaaaat

SEQ ID NO: 4010938 - DNA, 20 bp, Homo sapiens
tccaaaaaaaggaaaaataa

SEQ ID NO: 4010939 - DNA, 23 bp, Homo sapiens
tccaaaaaaaggaaaaataatca

SEQ ID NO: 4010940 - DNA, 19 bp, Homo sapiens
tccaaaaagattttcagaa

SEQ ID NO: 4010941 - DNA, 22 bp, Homo sapiens
tccaaaaagattttcagaaaat

SEQ ID NO: 4010942 - DNA, 15 bp, Homo sapiens
tccaaaataatttta

SEQ ID NO: 4010943 - DNA, 12 bp, Homo sapiens
tccaaaattctt

SEQ ID NO: 4010944 - DNA, 23 bp, Homo sapiens
tccaaaatttgaaatattaaaat

SEQ ID NO: 4010945 - DNA, 22 bp, Homo sapiens
tccaaacatgaggttctctcta

SEQ ID NO: 4010946 - DNA, 22 bp, Homo sapiens
tccaaacttggatttttgactc

SEQ ID NO: 4010947 - DNA, 15 bp, Homo sapiens
tccaaagaacttgat

SEQ ID NO: 4010948 - DNA, 15 bp, Homo sapiens
tccaaagaggctgcc

SEQ ID NO: 4010949 - DNA, 15 bp, Homo sapiens
tccaaagcagagagc

SEQ ID NO: 4010950 - DNA, 14 bp, Homo sapiens
tccaaagccagtga

SEQ ID NO: 4010951 - DNA, 13 bp, Homo sapiens
tccaaagctttat

SEQ ID NO: 4010952 - DNA, 19 bp, Homo sapiens
tccaaaggaggctggcagg

SEQ ID NO: 4010953 - DNA, 14 bp, Homo sapiens
tccaaaggccccct

SEQ ID NO: 4010954 - DNA, 22 bp, Homo sapiens
tccaaatataagacatttgttt

SEQ ID NO: 4010955 - DNA, 20 bp, Homo sapiens
tccaaatggcgtctggaagt

SEQ ID NO: 4010956 - DNA, 17 bp, Homo sapiens
tccaaatgtcctccaga

SEQ ID NO: 4010957 - DNA, 22 bp, Homo sapiens
tccaaatgtcctccagaagcct

SEQ ID NO: 4010958 - DNA, 18 bp, Homo sapiens
tccaaattcagtttcata

SEQ ID NO: 4010959 - DNA, 15 bp, Homo sapiens
tccaacaagaagaaa

SEQ ID NO: 4010960 - DNA, 16 bp, Homo sapiens
tccaacaagaagaaat

SEQ ID NO: 4010961 - DNA, 21 bp, Homo sapiens
tccaacaagaagaaatatgaa

SEQ ID NO: 4010962 - DNA, 15 bp, Homo sapiens
tccaacaagaatgca

SEQ ID NO: 4010963 - DNA, 15 bp, Homo sapiens
tccaacacaaggctc

SEQ ID NO: 4010964 - DNA, 21 bp, Homo sapiens
tccaacaccaagcacagcagc

SEQ ID NO: 4010965 - DNA, 23 bp, Homo sapiens
tccaacaccaagcacagcagcct

SEQ ID NO: 4010966 - DNA, 21 bp, Homo sapiens
tccaacaccacagacacacac

SEQ ID NO: 4010967 - DNA, 17 bp, Homo sapiens
tccaacagaactaaatg

SEQ ID NO: 4010968 - DNA, 23 bp, Homo sapiens
tccaaccaggagctgatggcagc

SEQ ID NO: 4010969 - DNA, 15 bp, Homo sapiens
tccaacccggggacc

SEQ ID NO: 4010970 - DNA, 21 bp, Homo sapiens
tccaacctgcaaagatctgtc

SEQ ID NO: 4010971 - DNA, 13 bp, Homo sapiens
tccaaccttccca

SEQ ID NO: 4010972 - DNA, 14 bp, Homo sapiens
tccaaccttcccaa

SEQ ID NO: 4010973 - DNA, 18 bp, Homo sapiens
tccaactcgaatctgtgt

SEQ ID NO: 4010974 - DNA, 20 bp, Homo sapiens
tccaacttatgtttttaaat

SEQ ID NO: 4010975 - DNA, 15 bp, Homo sapiens
tccaagacattgtca

SEQ ID NO: 4010976 - DNA, 20 bp, Homo sapiens
tccaagatcaattccctctc

SEQ ID NO: 4010977 - DNA, 19 bp, Homo sapiens
tccaagcaagtagctttcc

SEQ ID NO: 4010978 - DNA, 14 bp, Homo sapiens
tccaagcacagagc

SEQ ID NO: 4010979 - DNA, 23 bp, Homo sapiens
tccaagcagcctgagcaactctt

SEQ ID NO: 4010980 - DNA, 14 bp, Homo sapiens
tccaagcctgcctc

SEQ ID NO: 4010981 - DNA, 17 bp, Homo sapiens
tccaagctgagagtcta

SEQ ID NO: 4010982 - DNA, 22 bp, Homo sapiens
tccaagctgggagattcaaggg

SEQ ID NO: 4010983 - DNA, 14 bp, Homo sapiens
tccaaggagaccaa

SEQ ID NO: 4010984 - DNA, 16 bp, Homo sapiens
tccaaggatcctctcc

SEQ ID NO: 4010985 - DNA, 17 bp, Homo sapiens
tccaaggatcctctcca

SEQ ID NO: 4010986 - DNA, 12 bp, Homo sapiens
tccaaggccagt

SEQ ID NO: 4010987 - DNA, 18 bp, Homo sapiens
tccaagggtactaaggaa

SEQ ID NO: 4010988 - DNA, 21 bp, Homo sapiens
tccaagggttgagagccagtg

SEQ ID NO: 4010989 - DNA, 22 bp, Homo sapiens
tccaagggttgagagccagtgg

SEQ ID NO: 4010990 - DNA, 14 bp, Homo sapiens
tccaaggtggcaga

SEQ ID NO: 4010991 - DNA, 23 bp, Homo sapiens
tccaagtcactgcaaaaccaggt

SEQ ID NO: 4010992 - DNA, 16 bp, Homo sapiens
tccaagtctctctgtg

SEQ ID NO: 4010993 - DNA, 17 bp, Homo sapiens
tccaagtctctctgtga

SEQ ID NO: 4010994 - DNA, 18 bp, Homo sapiens
tccaagtctctctgtgaa

SEQ ID NO: 4010995 - DNA, 18 bp, Homo sapiens
tccaagtgccccctcacc

SEQ ID NO: 4010996 - DNA, 18 bp, Homo sapiens
tccaagttcttcacctct

SEQ ID NO: 4010997 - DNA, 16 bp, Homo sapiens
tccaagttggactggg

SEQ ID NO: 4010998 - DNA, 21 bp, Homo sapiens
tccaataaaaacattttgaag

SEQ ID NO: 4010999 - DNA, 14 bp, Homo sapiens
tccaatcctcactg

SEQ ID NO: 4011000 - DNA, 18 bp, Homo sapiens
tccaatcctcactgggtg

SEQ ID NO: 4011001 - DNA, 22 bp, Homo sapiens
tccaatctgtgatgacattccc

SEQ ID NO: 4011002 - DNA, 13 bp, Homo sapiens
tccaatcttgctt

SEQ ID NO: 4011003 - DNA, 14 bp, Homo sapiens
tccaatcttgcttt

SEQ ID NO: 4011004 - DNA, 22 bp, Homo sapiens
tccaatgcacagttgccacatt

SEQ ID NO: 4011005 - DNA, 19 bp, Homo sapiens
tccaatgtctgctgaggag

SEQ ID NO: 4011006 - DNA, 16 bp, Homo sapiens
tccaattagtttcctt

SEQ ID NO: 4011007 - DNA, 15 bp, Homo sapiens
tccaattctccttta

SEQ ID NO: 4011008 - DNA, 16 bp, Homo sapiens
tcccctgttaaacagt

SEQ ID NO: 4011009 - DNA, 12 bp, Homo sapiens
tccccttcccag

SEQ ID NO: 4011010 - DNA, 18 bp, Homo sapiens
tccccttcccgtgacctg

SEQ ID NO: 4011011 - DNA, 11 bp, Homo sapiens
tccccttccct

SEQ ID NO: 4011012 - DNA, 23 bp, Homo sapiens
tccccttgatttaaacacacaga

SEQ ID NO: 4011013 - DNA, 21 bp, Homo sapiens
tccccttgtttgtcccttcta

SEQ ID NO: 4011014 - DNA, 13 bp, Homo sapiens
tcccgaggtcagc

SEQ ID NO: 4011015 - DNA, 18 bp, Homo sapiens
tcccgaggtcagccaggc

SEQ ID NO: 4011016 - DNA, 22 bp, Homo sapiens
tcccgcacatggtgtggggggc

SEQ ID NO: 4011017 - DNA, 13 bp, Homo sapiens
tcccgcaccaggc

SEQ ID NO: 4011018 - DNA, 18 bp, Homo sapiens
tcccgcaccaggccgggc

SEQ ID NO: 4011019 - DNA, 21 bp, Homo sapiens
tcccgccccttcccactcacc

SEQ ID NO: 4011020 - DNA, 12 bp, Homo sapiens
tcccgcggtgcc

SEQ ID NO: 4011021 - DNA, 13 bp, Homo sapiens
tcccgctcccagg

SEQ ID NO: 4011022 - DNA, 18 bp, Homo sapiens
tcccggaggttgggtggg

SEQ ID NO: 4011023 - DNA, 20 bp, Homo sapiens
tcccgggccacgccccagcc

SEQ ID NO: 4011024 - DNA, 15 bp, Homo sapiens
tcccgggccagggct

SEQ ID NO: 4011025 - DNA, 16 bp, Homo sapiens
tcccgggccagggctg

SEQ ID NO: 4011026 - DNA, 16 bp, Homo sapiens
tcccggtaccttccat

SEQ ID NO: 4011027 - DNA, 21 bp, Homo sapiens
tcccggttcagacccctgcct

SEQ ID NO: 4011028 - DNA, 20 bp, Homo sapiens
tcccgtacctcttcccatga

SEQ ID NO: 4011029 - DNA, 19 bp, Homo sapiens
tccctaaaatacatttaaa

SEQ ID NO: 4011030 - DNA, 22 bp, Homo sapiens
tccctaagcatgtgtcccagga

SEQ ID NO: 4011031 - DNA, 21 bp, Homo sapiens
tccctaccccagggccctggc

SEQ ID NO: 4011032 - DNA, 19 bp, Homo sapiens
tccctaccgagtctcttct

SEQ ID NO: 4011033 - DNA, 17 bp, Homo sapiens
tccctacctcaggcagg

SEQ ID NO: 4011034 - DNA, 18 bp, Homo sapiens
tccctagagggttcctgt

SEQ ID NO: 4011035 - DNA, 23 bp, Homo sapiens
tccctatctattaaagtgacttt

SEQ ID NO: 4011036 - DNA, 23 bp, Homo sapiens
tccctatctccttcccaccccta

SEQ ID NO: 4011037 - DNA, 14 bp, Homo sapiens
tccctcacctgtag

SEQ ID NO: 4011038 - DNA, 18 bp, Homo sapiens
tccctcactgaaggacct

SEQ ID NO: 4011039 - DNA, 14 bp, Homo sapiens
tccctcagcctcag

SEQ ID NO: 4011040 - DNA, 16 bp, Homo sapiens
tccctcagcctcagag

SEQ ID NO: 4011041 - DNA, 17 bp, Homo sapiens
tccctcagcctcagagg

SEQ ID NO: 4011042 - DNA, 18 bp, Homo sapiens
tccctcaggctctgtgga

SEQ ID NO: 4011043 - DNA, 22 bp, Homo sapiens
tccctcaggttctattttctta

SEQ ID NO: 4011044 - DNA, 13 bp, Homo sapiens
tccctccacccca

SEQ ID NO: 4011045 - DNA, 20 bp, Homo sapiens
tccctccacctcaagacccc

SEQ ID NO: 4011046 - DNA, 21 bp, Homo sapiens
tccctccagtattgccccctc

SEQ ID NO: 4011047 - DNA, 23 bp, Homo sapiens
tccctcccacactcgccatctcc

SEQ ID NO: 4011048 - DNA, 13 bp, Homo sapiens
tccctccccagaa

SEQ ID NO: 4011049 - DNA, 12 bp, Homo sapiens
tccctccccctt

SEQ ID NO: 4011050 - DNA, 12 bp, Homo sapiens
tccctccctgct

SEQ ID NO: 4011051 - DNA, 15 bp, Homo sapiens
tccctccgccttctc

SEQ ID NO: 4011052 - DNA, 18 bp, Homo sapiens
tccctccgggtcttccta

SEQ ID NO: 4011053 - DNA, 14 bp, Homo sapiens
tccctcctcacctc

SEQ ID NO: 4011054 - DNA, 16 bp, Homo sapiens
tccctcctcacctctg

SEQ ID NO: 4011055 - DNA, 21 bp, Homo sapiens
tccctcgacagcgcccctgct

SEQ ID NO: 4011056 - DNA, 19 bp, Homo sapiens
tccctcgctgcacaaatac

SEQ ID NO: 4011057 - DNA, 22 bp, Homo sapiens
tccctcgctgcacaaatactcc

SEQ ID NO: 4011058 - DNA, 20 bp, Homo sapiens
tccctcggagttcttcttga

SEQ ID NO: 4011059 - DNA, 22 bp, Homo sapiens
tccctcggggaccgttcagtgt

SEQ ID NO: 4011060 - DNA, 16 bp, Homo sapiens
tccctcgtctttccca

SEQ ID NO: 4011061 - DNA, 19 bp, Homo sapiens
tccctctatttatgtttgc

SEQ ID NO: 4011062 - DNA, 16 bp, Homo sapiens
tccctctcagaggcct

SEQ ID NO: 4011063 - DNA, 14 bp, Homo sapiens
tccctctcatctca

SEQ ID NO: 4011064 - DNA, 17 bp, Homo sapiens
tccctctcatctcaggt

SEQ ID NO: 4011065 - DNA, 21 bp, Homo sapiens
tccctctctcccatttcagga

SEQ ID NO: 4011066 - DNA, 18 bp, Homo sapiens
tccctctctcttctgctc

SEQ ID NO: 4011067 - DNA, 19 bp, Homo sapiens
tccctctctcttctgctcc

SEQ ID NO: 4011068 - DNA, 20 bp, Homo sapiens
tccctctctcttctgctcca

SEQ ID NO: 4011069 - DNA, 23 bp, Homo sapiens
tccctctctcttctgctccaccc

SEQ ID NO: 4011070 - DNA, 13 bp, Homo sapiens
tccctctgctcag

SEQ ID NO: 4011071 - DNA, 12 bp, Homo sapiens
tccctcttcact

SEQ ID NO: 4011072 - DNA, 13 bp, Homo sapiens
tccctcttgtaag

SEQ ID NO: 4011073 - DNA, 17 bp, Homo sapiens
tccctgaaaatgttttt

SEQ ID NO: 4011074 - DNA, 16 bp, Homo sapiens
tccctgacctccctct

SEQ ID NO: 4011075 - DNA, 19 bp, Homo sapiens
tccctgactccctgtgggg

SEQ ID NO: 4011076 - DNA, 14 bp, Homo sapiens
tccctgactggcct

SEQ ID NO: 4011077 - DNA, 15 bp, Homo sapiens
tccctgactggcctg

SEQ ID NO: 4011078 - DNA, 15 bp, Homo sapiens
tccctgacttgcttt

SEQ ID NO: 4011079 - DNA, 16 bp, Homo sapiens
tccctgacttgcttta

SEQ ID NO: 4011080 - DNA, 20 bp, Homo sapiens
tccctgagagtgtctctgat

SEQ ID NO: 4011081 - DNA, 17 bp, Homo sapiens
tccctgattgacctgct

SEQ ID NO: 4011082 - DNA, 23 bp, Homo sapiens
tccctgattgacctgctccgctg

SEQ ID NO: 4011083 - DNA, 23 bp, Homo sapiens
tccctgcactaaagccagcctga

SEQ ID NO: 4011084 - DNA, 17 bp, Homo sapiens
tccctgcatttctgagt

SEQ ID NO: 4011085 - DNA, 12 bp, Homo sapiens
tccctgccacat

SEQ ID NO: 4011086 - DNA, 22 bp, Homo sapiens
tccctgccacatacaggtgctc

SEQ ID NO: 4011087 - DNA, 12 bp, Homo sapiens
tccctgcctggc

SEQ ID NO: 4011088 - DNA, 20 bp, Homo sapiens
tccctgccttaggcctacct

SEQ ID NO: 4011089 - DNA, 22 bp, Homo sapiens
tccctgcggcctccacacctga

SEQ ID NO: 4011090 - DNA, 23 bp, Homo sapiens
tccctgctgtcattgcttcttct

SEQ ID NO: 4011091 - DNA, 20 bp, Homo sapiens
tccctgctgtgccatgctgg

SEQ ID NO: 4011092 - DNA, 21 bp, Homo sapiens
tccctgctgtgccatgctggg

SEQ ID NO: 4011093 - DNA, 22 bp, Homo sapiens
tccctgctgtgccatgctgggc

SEQ ID NO: 4011094 - DNA, 12 bp, Homo sapiens
tccctgcttcca

SEQ ID NO: 4011095 - DNA, 21 bp, Homo sapiens
tccctgcttgcaggaggccaa

SEQ ID NO: 4011096 - DNA, 23 bp, Homo sapiens
tccctgcttgcaggaggccaaac

SEQ ID NO: 4011097 - DNA, 16 bp, Homo sapiens
tccctggagcaggagc

SEQ ID NO: 4011098 - DNA, 17 bp, Homo sapiens
tccctggagcaggagcc

SEQ ID NO: 4011099 - DNA, 19 bp, Homo sapiens
tccctggagcaggagcccc

SEQ ID NO: 4011100 - DNA, 21 bp, Homo sapiens
tccctggagcctccactgcct

SEQ ID NO: 4011101 - DNA, 10 bp, Homo sapiens
tccctggagt

SEQ ID NO: 4011102 - DNA, 16 bp, Homo sapiens
tccctggctctcagaa

SEQ ID NO: 4011103 - DNA, 12 bp, Homo sapiens
tccctggcttcc

SEQ ID NO: 4011104 - DNA, 15 bp, Homo sapiens
tccctggcttcctta

SEQ ID NO: 4011105 - DNA, 17 bp, Homo sapiens
tccctggcttccttact

SEQ ID NO: 4011106 - DNA, 19 bp, Homo sapiens
tccctgggacacagaccca

SEQ ID NO: 4011107 - DNA, 19 bp, Homo sapiens
tccctgggaggaaatttga

SEQ ID NO: 4011108 - DNA, 16 bp, Homo sapiens
tccctgggcagaaagt

SEQ ID NO: 4011109 - DNA, 16 bp, Homo sapiens
tccctgggccagggtc

SEQ ID NO: 4011110 - DNA, 10 bp, Homo sapiens
tcctggccag

SEQ ID NO: 4011111 - DNA, 22 bp, Homo sapiens
tcctggcctatccgctgccagc

SEQ ID NO: 4011112 - DNA, 17 bp, Homo sapiens
tcctggcctgagagtca

SEQ ID NO: 4011113 - DNA, 17 bp, Homo sapiens
tcctggctacatcccag

SEQ ID NO: 4011114 - DNA, 13 bp, Homo sapiens
tcctggctcctga

SEQ ID NO: 4011115 - DNA, 24 bp, Homo sapiens
tcctggctgatgatccagaacagt

SEQ ID NO: 4011116 - DNA, 12 bp, Homo sapiens
tcctggctgcgg

SEQ ID NO: 4011117 - DNA, 11 bp, Homo sapiens
tcctggctggg

SEQ ID NO: 4011118 - DNA, 13 bp, Homo sapiens
tcctggctgggcc

SEQ ID NO: 4011119 - DNA, 18 bp, Homo sapiens
tcctggctgggccatcct

SEQ ID NO: 4011120 - DNA, 23 bp, Homo sapiens
tcctgggagcccccaccacaaac

SEQ ID NO: 4011121 - DNA, 21 bp, Homo sapiens
tcctgggcatgggtccagggc

SEQ ID NO: 4011122 - DNA, 13 bp, Homo sapiens
tcctgggcctgcc

SEQ ID NO: 4011123 - DNA, 12 bp, Homo sapiens
tcctgggctcag

SEQ ID NO: 4011124 - DNA, 15 bp, Homo sapiens
tcctggggcctcttg

SEQ ID NO: 4011125 - DNA, 13 bp, Homo sapiens
tcctgggggtggc

SEQ ID NO: 4011126 - DNA, 15 bp, Homo sapiens
tcctgggggtggcag

SEQ ID NO: 4011127 - DNA, 18 bp, Homo sapiens
tcctgggggtggcaggca

SEQ ID NO: 4011128 - DNA, 19 bp, Homo sapiens
tcctgggggtggcaggcac

SEQ ID NO: 4011129 - DNA, 17 bp, Homo sapiens
tcctggtcttgagatgt

SEQ ID NO: 4011130 - DNA, 20 bp, Homo sapiens
tcctggtcttgagatgtctt

SEQ ID NO: 4011131 - DNA, 22 bp, Homo sapiens
tcctggttccttcctatgccca

SEQ ID NO: 4011132 - DNA, 23 bp, Homo sapiens
tcctggttccttcctatgcccag

SEQ ID NO: 4011133 - DNA, 15 bp, Homo sapiens
tcctggtttgactca

SEQ ID NO: 4011134 - DNA, 22 bp, Homo sapiens
tcctggttttgtacactgctgt

SEQ ID NO: 4011135 - DNA, 20 bp, Homo sapiens
tcctgtaaatggtgtacata

SEQ ID NO: 4011136 - DNA, 16 bp, Homo sapiens
tcctgtaccaaatctg

SEQ ID NO: 4011137 - DNA, 14 bp, Homo sapiens
tcctgtccagctcc

SEQ ID NO: 4011138 - DNA, 15 bp, Homo sapiens
tcctgtccctgaggt

SEQ ID NO: 4011139 - DNA, 18 bp, Homo sapiens
tcctgtcccttttccctt

SEQ ID NO: 4011140 - DNA, 11 bp, Homo sapiens
tcctgtcctcc

SEQ ID NO: 4011141 - DNA, 21 bp, Homo sapiens
tcctgtcctcccatcccctgg

SEQ ID NO: 4011142 - DNA, 13 bp, Homo sapiens
tcctgtcctgctc

SEQ ID NO: 4011143 - DNA, 19 bp, Homo sapiens
tcctgtctttaaggaaaaa

SEQ ID NO: 4011144 - DNA, 20 bp, Homo sapiens
tcctgtgcatgggtgaaggg

SEQ ID NO: 4011145 - DNA, 15 bp, Homo sapiens
tcctgtgcctggccc

SEQ ID NO: 4011146 - DNA, 12 bp, Homo sapiens
tcctgtgctggg

SEQ ID NO: 4011147 - DNA, 17 bp, Homo sapiens
tcctgtggcctgccagt

SEQ ID NO: 4011148 - DNA, 19 bp, Homo sapiens
tcctgtggcctgccagtca

SEQ ID NO: 4011149 - DNA, 17 bp, Homo sapiens
tcctgtggctttgtttt

SEQ ID NO: 4011150 - DNA, 21 bp, Homo sapiens
tcctgtggctttgttttctta

SEQ ID NO: 4011151 - DNA, 13 bp, Homo sapiens
tcctgtggggaaa

SEQ ID NO: 4011152 - DNA, 22 bp, Homo sapiens
tcctgttaggtattagaaagtg

SEQ ID NO: 4011153 - DNA, 21 bp, Homo sapiens
tcctgttgttgttaatgaaaa

SEQ ID NO: 4011154 - DNA, 22 bp, Homo sapiens
tcctgtttataatctgaagata

SEQ ID NO: 4011155 - DNA, 16 bp, Homo sapiens
tcctgtttttctgggt

SEQ ID NO: 4011156 - DNA, 14 bp, Homo sapiens
tccttaaactgtgt

SEQ ID NO: 4011157 - DNA, 16 bp, Homo sapiens
tccttaaactgtgtgg

SEQ ID NO: 4011158 - DNA, 16 bp, Homo sapiens
tccttaagaacacaaa

SEQ ID NO: 4011159 - DNA, 22 bp, Homo sapiens
tccttaccagagacgcccagcc

SEQ ID NO: 4011160 - DNA, 14 bp, Homo sapiens
tccttacctcttcc

SEQ ID NO: 4011161 - DNA, 16 bp, Homo sapiens
tccttagaaaagccat

SEQ ID NO: 4011162 - DNA, 16 bp, Homo sapiens
tccttagttggctgga

SEQ ID NO: 4011163 - DNA, 14 bp, Homo sapiens
tccttatccctctc

SEQ ID NO: 4011164 - DNA, 17 bp, Homo sapiens
tccttatccctctcttc

SEQ ID NO: 4011165 - DNA, 18 bp, Homo sapiens
tccttatccctctcttcc

SEQ ID NO: 4011166 - DNA, 16 bp, Homo sapiens
tccttatgtcctgtca

SEQ ID NO: 4011167 - DNA, 14 bp, Homo sapiens
tccttatttgcctt

SEQ ID NO: 4011168 - DNA, 16 bp, Homo sapiens
tccttatttgccttct

SEQ ID NO: 4011169 - DNA, 21 bp, Homo sapiens
tccttatttgccttctactcc

SEQ ID NO: 4011170 - DNA, 20 bp, Homo sapiens
tccttcaaaatccttccaaa

SEQ ID NO: 4011171 - DNA, 20 bp, Homo sapiens
tccttcaccagagcccatgc

SEQ ID NO: 4011172 - DNA, 13 bp, Homo sapiens
tccttcagacacc

SEQ ID NO: 4011173 - DNA, 23 bp, Homo sapiens
tccttcagacaccctcaacctct

SEQ ID NO: 4011174 - DNA, 14 bp, Homo sapiens
tccttcattcatag

SEQ ID NO: 4011175 - DNA, 18 bp, Homo sapiens
tccttcatttccaccagg

SEQ ID NO: 4011176 - DNA, 19 bp, Homo sapiens
tccttcatttccaccaggc

SEQ ID NO: 4011177 - DNA, 18 bp, Homo sapiens
tccttccaaaaattatta

SEQ ID NO: 4011178 - DNA, 19 bp, Homo sapiens
tccttccaaaaattattat

SEQ ID NO: 4011179 - DNA, 14 bp, Homo sapiens
tccttccacctccc

SEQ ID NO: 4011180 - DNA, 17 bp, Homo sapiens
tccttccacctccctcc

SEQ ID NO: 4011181 - DNA, 13 bp, Homo sapiens
tccttccagccca

SEQ ID NO: 4011182 - DNA, 21 bp, Homo sapiens
tccttccagtgtccttagaac

SEQ ID NO: 4011183 - DNA, 17 bp, Homo sapiens
tccttcccacccctaca

SEQ ID NO: 4011184 - DNA, 19 bp, Homo sapiens
tccttcccactcttctcat

SEQ ID NO: 4011185 - DNA, 18 bp, Homo sapiens
tccttcccatttctctac

SEQ ID NO: 4011186 - DNA, 12 bp, Homo sapiens
tccttccccagg

SEQ ID NO: 4011187 - DNA, 22 bp, Homo sapiens
tccttccccctgtagactagtg

SEQ ID NO: 4011188 - DNA, 17 bp, Homo sapiens
tccttcccctttcccca

SEQ ID NO: 4011189 - DNA, 16 bp, Homo sapiens
tccttccctcaccccc

SEQ ID NO: 4011190 - DNA, 20 bp, Homo sapiens
tccttccctcacccccagca

SEQ ID NO: 4011191 - DNA, 21 bp, Homo sapiens
tccttccctcatgcccgccag

SEQ ID NO: 4011192 - DNA, 17 bp, Homo sapiens
tccttcccttgctacca

SEQ ID NO: 4011193 - DNA, 16 bp, Homo sapiens
tccttcccttttctgt

SEQ ID NO: 4011194 - DNA, 21 bp, Homo sapiens
tccttccgccaatctggccct

SEQ ID NO: 4011195 - DNA, 22 bp, Homo sapiens
tccttcctagttcatcccttct

SEQ ID NO: 4011196 - DNA, 21 bp, Homo sapiens
tccttcgtgaacatcccctcc

SEQ ID NO: 4011197 - DNA, 20 bp, Homo sapiens
tccttctctgaacacaggca

SEQ ID NO: 4011198 - DNA, 17 bp, Homo sapiens
tccttctgaccacagca

SEQ ID NO: 4011199 - DNA, 22 bp, Homo sapiens
tccttctggctgtagataaata

SEQ ID NO: 4011200 - DNA, 20 bp, Homo sapiens
tccttctgtgaaagtacatt

SEQ ID NO: 4011201 - DNA, 20 bp, Homo sapiens
tccttctttgataatgttaa

SEQ ID NO: 4011202 - DNA, 19 bp, Homo sapiens
tccttctttgccctttact

SEQ ID NO: 4011203 - DNA, 16 bp, Homo sapiens
tccttgagtgctcttg

SEQ ID NO: 4011204 - DNA, 21 bp, Homo sapiens
tccttgcaaggttaagcaagg

SEQ ID NO: 4011205 - DNA, 15 bp, Homo sapiens
tccttgcacccctca

SEQ ID NO: 4011206 - DNA, 20 bp, Homo sapiens
tccttgcacccctcactctg

SEQ ID NO: 4011207 - DNA, 21 bp, Homo sapiens
tccttgcacccctcactctgg

SEQ ID NO: 4011208 - DNA, 21 bp, Homo sapiens
tccttgcaggtgggggttgct

SEQ ID NO: 4011209 - DNA, 17 bp, Homo sapiens
tccttgcgcctcagccc

SEQ ID NO: 4011210 - DNA, 20 bp, Homo sapiens
tccttggctttatgcacatt

SEQ ID NO: 4011211 - DNA, 20 bp, Homo sapiens
tccttgtcccgtctggacct

SEQ ID NO: 4011212 - DNA, 23 bp, Homo sapiens
tctattaaatagttatataattc

SEQ ID NO: 4011213 - DNA, 16 bp, Homo sapiens
tctattaatatatgta

SEQ ID NO: 4011214 - DNA, 21 bp, Homo sapiens
tctattaatatatgtattatt

SEQ ID NO: 4011215 - DNA, 22 bp, Homo sapiens
tctattaatatatgtattattt

SEQ ID NO: 4011216 - DNA, 17 bp, Homo sapiens
tctattacattttcagt

SEQ ID NO: 4011217 - DNA, 17 bp, Homo sapiens
tctattatggaaaactg

SEQ ID NO: 4011218 - DNA, 23 bp, Homo sapiens
tctattattatgaagaattgcca

SEQ ID NO: 4011219 - DNA, 14 bp, Homo sapiens
tctattctctgcaa

SEQ ID NO: 4011220 - DNA, 16 bp, Homo sapiens
tctattctctgcaatt

SEQ ID NO: 4011221 - DNA, 18 bp, Homo sapiens
tctattctgtcagtgtta

SEQ ID NO: 4011222 - DNA, 18 bp, Homo sapiens
tctattgccttctttgaa

SEQ ID NO: 4011223 - DNA, 19 bp, Homo sapiens
tctattgccttctttgaag

SEQ ID NO: 4011224 - DNA, 17 bp, Homo sapiens
tctattgggttcattat

SEQ ID NO: 4011225 - DNA, 23 bp, Homo sapiens
tctattgtcatggggatcaattt

SEQ ID NO: 4011226 - DNA, 12 bp, Homo sapiens
tctattgttact

SEQ ID NO: 4011227 - DNA, 16 bp, Homo sapiens
tctattgttactctgg

SEQ ID NO: 4011228 - DNA, 15 bp, Homo sapiens
tctatttatgtttgc

SEQ ID NO: 4011229 - DNA, 18 bp, Homo sapiens
tctatttccccctttctt

SEQ ID NO: 4011230 - DNA, 21 bp, Homo sapiens
tctatttccccctttcttcct

SEQ ID NO: 4011231 - DNA, 22 bp, Homo sapiens
tctatttccccctttcttcctc

SEQ ID NO: 4011232 - DNA, 15 bp, Homo sapiens
tctattttaaaataa

SEQ ID NO: 4011233 - DNA, 16 bp, Homo sapiens
tctattttactttgta

SEQ ID NO: 4011234 - DNA, 14 bp, Homo sapiens
tctattttagaata

SEQ ID NO: 4011235 - DNA, 14 bp, Homo sapiens
tctattttcttaaa

SEQ ID NO: 4011236 - DNA, 18 bp, Homo sapiens
tctattttcttaaaccaa

SEQ ID NO: 4011237 - DNA, 15 bp, Homo sapiens
tctattttgtgatga

SEQ ID NO: 4011238 - DNA, 22 bp, Homo sapiens
tctcaaaaaaaaaaaaatgcac

SEQ ID NO: 4011239 - DNA, 23 bp, Homo sapiens
tctcaaaaatacaaaataaaaac

SEQ ID NO: 4011240 - DNA, 21 bp, Homo sapiens
tctcaaaagcatttatcattc

SEQ ID NO: 4011241 - DNA, 23 bp, Homo sapiens
tctcaaaagcatttatcattctt

SEQ ID NO: 4011242 - DNA, 16 bp, Homo sapiens
tctcaaaagtctattt

SEQ ID NO: 4011243 - DNA, 17 bp, Homo sapiens
tctcaaaagtctatttt

SEQ ID NO: 4011244 - DNA, 17 bp, Homo sapiens
tctcaaactaaaagaca

SEQ ID NO: 4011245 - DNA, 17 bp, Homo sapiens
tctcaaataactaaaag

SEQ ID NO: 4011246 - DNA, 21 bp, Homo sapiens
tctcaaatttggattgctaat

SEQ ID NO: 4011247 - DNA, 12 bp, Homo sapiens
tctcaagacttt

SEQ ID NO: 4011248 - DNA, 22 bp, Homo sapiens
tctcaagactttagcttttcct

SEQ ID NO: 4011249 - DNA, 23 bp, Homo sapiens
tctcaagaggcagagttctgtga

SEQ ID NO: 4011250 - DNA, 18 bp, Homo sapiens
tctcaagagggcactggt

SEQ ID NO: 4011251 - DNA, 19 bp, Homo sapiens
tctcaagagggcactggtg

SEQ ID NO: 4011252 - DNA, 19 bp, Homo sapiens
tctcaagctagtgtttcta

SEQ ID NO: 4011253 - DNA, 20 bp, Homo sapiens
tctcaagctagtgtttctag

SEQ ID NO: 4011254 - DNA, 20 bp, Homo sapiens
tctcaaggtgggccttgcta

SEQ ID NO: 4011255 - DNA, 16 bp, Homo sapiens
tctcaatgaagccagc

SEQ ID NO: 4011256 - DNA, 17 bp, Homo sapiens
tctcaatgaagccagct

SEQ ID NO: 4011257 - DNA, 12 bp, Homo sapiens
tctcacagtgtg

SEQ ID NO: 4011258 - DNA, 15 bp, Homo sapiens
tctcacccataaaca

SEQ ID NO: 4011259 - DNA, 19 bp, Homo sapiens
tctcacctaaaaaaagaga

SEQ ID NO: 4011260 - DNA, 19 bp, Homo sapiens
tctcactagtgtcaggccc

SEQ ID NO: 4011261 - DNA, 22 bp, Homo sapiens
tctcactgaactccaccgacca

SEQ ID NO: 4011262 - DNA, 14 bp, Homo sapiens
tctcactgcagtct

SEQ ID NO: 4011263 - DNA, 17 bp, Homo sapiens
tctcactgtgtacataa

SEQ ID NO: 4011264 - DNA, 14 bp, Homo sapiens
tctcactgttccct

SEQ ID NO: 4011265 - DNA, 17 bp, Homo sapiens
tctcactgttccctctg

SEQ ID NO: 4011266 - DNA, 22 bp, Homo sapiens
tctcactgttccctctgctcct

SEQ ID NO: 4011267 - DNA, 14 bp, Homo sapiens
tctcactgttctgc

SEQ ID NO: 4011268 - DNA, 17 bp, Homo sapiens
tctcactgttctgcaaa

SEQ ID NO: 4011269 - DNA, 22 bp, Homo sapiens
tctcagaaactcccctgggggt

SEQ ID NO: 4011270 - DNA, 19 bp, Homo sapiens
tctcagaaagtgcctgaca

SEQ ID NO: 4011271 - DNA, 19 bp, Homo sapiens
tctcagaaggtattccttt

SEQ ID NO: 4011272 - DNA, 21 bp, Homo sapiens
tctcagaatctcaaataacta

SEQ ID NO: 4011273 - DNA, 15 bp, Homo sapiens
tctcagagccaagtc

SEQ ID NO: 4011274 - DNA, 20 bp, Homo sapiens
tctcagatatttatattttt

SEQ ID NO: 4011275 - DNA, 14 bp, Homo sapiens
tctcagcacagcct

SEQ ID NO: 4011276 - DNA, 17 bp, Homo sapiens
tctcagcctcctgagcc

SEQ ID NO: 4011277 - DNA, 16 bp, Homo sapiens
tctcagctccaggtgg

SEQ ID NO: 4011278 - DNA, 21 bp, Homo sapiens
tctcagctccaggtggctctg

SEQ ID NO: 4011279 - DNA, 12 bp, Homo sapiens
tctcaggaagag

SEQ ID NO: 4011280 - DNA, 14 bp, Homo sapiens
tctcaggagcacag

SEQ ID NO: 4011281 - DNA, 16 bp, Homo sapiens
tctcaggagcacaggc

SEQ ID NO: 4011282 - DNA, 18 bp, Homo sapiens
tctcaggagcacaggcag

SEQ ID NO: 4011283 - DNA, 23 bp, Homo sapiens
tctcaggatatccttatcagagc

SEQ ID NO: 4011284 - DNA, 15 bp, Homo sapiens
tctcagggcctggca

SEQ ID NO: 4011285 - DNA, 16 bp, Homo sapiens
tctcagggcctggcag

SEQ ID NO: 4011286 - DNA, 14 bp, Homo sapiens
tctcagggctcggg

SEQ ID NO: 4011287 - DNA, 20 bp, Homo sapiens
tctcaggggccagaggaact

SEQ ID NO: 4011288 - DNA, 20 bp, Homo sapiens
tctcagtcatgcataaatat

SEQ ID NO: 4011289 - DNA, 20 bp, Homo sapiens
tctcagtggcttcatctgtc

SEQ ID NO: 4011290 - DNA, 15 bp, Homo sapiens
tctcagtgtgtgtgt

SEQ ID NO: 4011291 - DNA, 22 bp, Homo sapiens
tctcagtgtgtgtgtgtggtcc

SEQ ID NO: 4011292 - DNA, 23 bp, Homo sapiens
tctcagtgtgtgtgtgtggtcca

SEQ ID NO: 4011293 - DNA, 18 bp, Homo sapiens
tctcagtgttgagccttt

SEQ ID NO: 4011294 - DNA, 21 bp, Homo sapiens
tctcagttaaaatgtgaggaa

SEQ ID NO: 4011295 - DNA, 17 bp, Homo sapiens
tctcagtttgtgtgtct

SEQ ID NO: 4011296 - DNA, 18 bp, Homo sapiens
tctcagtttgtgtgtctt

SEQ ID NO: 4011297 - DNA, 13 bp, Homo sapiens
tctcatagcatta

SEQ ID NO: 4011298 - DNA, 22 bp, Homo sapiens
tctcataggaaaagtacattta

SEQ ID NO: 4011299 - DNA, 21 bp, Homo sapiens
tctcatcagtgtcctcttgct

SEQ ID NO: 4011300 - DNA, 19 bp, Homo sapiens
tctcatcccacgcactcca

SEQ ID NO: 4011301 - DNA, 22 bp, Homo sapiens
tctcatccccaggggtcccagc

SEQ ID NO: 4011302 - DNA, 18 bp, Homo sapiens
tctcatcctcctggaacc

SEQ ID NO: 4011303 - DNA, 18 bp, Homo sapiens
tctcatgcccctggctgg

SEQ ID NO: 4011304 - DNA, 21 bp, Homo sapiens
tctcatgcccctggctgggac

SEQ ID NO: 4011305 - DNA, 19 bp, Homo sapiens
tctcatgctgcccctgcct

SEQ ID NO: 4011306 - DNA, 13 bp, Homo sapiens
tctcatgtatctt

SEQ ID NO: 4011307 - DNA, 16 bp, Homo sapiens
tctcatgtcctgctgg

SEQ ID NO: 4011308 - DNA, 14 bp, Homo sapiens
tctcattccgttgt

SEQ ID NO: 4011309 - DNA, 13 bp, Homo sapiens
tctcattcttgtt

SEQ ID NO: 4011310 - DNA, 16 bp, Homo sapiens
tctcatttaatttgtt

SEQ ID NO: 4011311 - DNA, 18 bp, Homo sapiens
tctcatttaatttgttat

SEQ ID NO: 4011312 - DNA, 19 bp, Homo sapiens
tctccaaggatcctctcca

SEQ ID NO: 4011313 - DNA, 14 bp, Homo sapiens
tctccaagtacttt

SEQ ID NO: 4011314 - DNA, 14 bp, Homo sapiens
tctggcctgaggtc

SEQ ID NO: 4011315 - DNA, 21 bp, Homo sapiens
tctggcctgaggtcaatggtg

SEQ ID NO: 4011316 - DNA, 21 bp, Homo sapiens
tctggctagaggccagcccca

SEQ ID NO: 4011317 - DNA, 22 bp, Homo sapiens
tctggctagaggccagccccac

SEQ ID NO: 4011318 - DNA, 23 bp, Homo sapiens
tctggctcagggtcaaagacaga

SEQ ID NO: 4011319 - DNA, 18 bp, Homo sapiens
tctggctgaacactggca

SEQ ID NO: 4011320 - DNA, 15 bp, Homo sapiens
tctggctgagctgaa

SEQ ID NO: 4011321 - DNA, 20 bp, Homo sapiens
ccagaggtgggatcctccct

SEQ ID NO: 4011322 - DNA, 22 bp, Homo sapiens
ccagaggtgggatcctccctca

SEQ ID NO: 4011323 - DNA, 23 bp, Homo sapiens
ccagagtctagcgtagtgcagca

SEQ ID NO: 4011324 - DNA, 13 bp, Homo sapiens
ccagagtggcctg

SEQ ID NO: 4011325 - DNA, 18 bp, Homo sapiens
ccagagtggcctggccag

SEQ ID NO: 4011326 - DNA, 22 bp, Homo sapiens
ccagagtggcctggccaggagc

SEQ ID NO: 4011327 - DNA, 14 bp, Homo sapiens
ccagatagagctgg

SEQ ID NO: 4011328 - DNA, 15 bp, Homo sapiens
ccagatagagctggg

SEQ ID NO: 4011329 - DNA, 22 bp, Homo sapiens
ccagatagagctgggtggcctg

SEQ ID NO: 4011330 - DNA, 15 bp, Homo sapiens
ccagatcagccagaa

SEQ ID NO: 4011331 - DNA, 16 bp, Homo sapiens
ccagatcagccagaag

SEQ ID NO: 4011332 - DNA, 14 bp, Homo sapiens
ccagatccagcctg

SEQ ID NO: 4011333 - DNA, 15 bp, Homo sapiens
ccagatccagcctgg

SEQ ID NO: 4011334 - DNA, 14 bp, Homo sapiens
ccagatcctcacaa

SEQ ID NO: 4011335 - DNA, 15 bp, Homo sapiens
ccagatcctcttggt

SEQ ID NO: 4011336 - DNA, 13 bp, Homo sapiens
ccagatctggtcc

SEQ ID NO: 4011337 - DNA, 19 bp, Homo sapiens
ccagatgaggctggccaag

SEQ ID NO: 4011338 - DNA, 20 bp, Homo sapiens
ccagatgcaggacaggaggc

SEQ ID NO: 4011339 - DNA, 22 bp, Homo sapiens
ccagatgccctttggaaagcca

SEQ ID NO: 4011340 - DNA, 23 bp, Homo sapiens
ccagatgcctacaaccatccctg

SEQ ID NO: 4011341 - DNA, 22 bp, Homo sapiens
ccagatggctggaaggggtcca

SEQ ID NO: 4011342 - DNA, 23 bp, Homo sapiens
ccagatgtgtcccccccaggcct

SEQ ID NO: 4011343 - DNA, 15 bp, Homo sapiens
ccagattcccctgtg

SEQ ID NO: 4011344 - DNA, 17 bp, Homo sapiens
ccagattcccctgtgtc

SEQ ID NO: 4011345 - DNA, 18 bp, Homo sapiens
ccagattctgcctctctg

SEQ ID NO: 4011346 - DNA, 23 bp, Homo sapiens
ccagattctgcctctctggaaag

SEQ ID NO: 4011347 - DNA, 18 bp, Homo sapiens
ccagattttgctgtatat

SEQ ID NO: 4011348 - DNA, 18 bp, Homo sapiens
ccagatttttcggaggcc

SEQ ID NO: 4011349 - DNA, 22 bp, Homo sapiens
ccagcaaaagagctattgccaa

SEQ ID NO: 4011350 - DNA, 15 bp, Homo sapiens
ccagcaacacaagct

SEQ ID NO: 4011351 - DNA, 18 bp, Homo sapiens
ccagcaacttgtcttttt

SEQ ID NO: 4011352 - DNA, 23 bp, Homo sapiens
ccagcaaggcaggttggatggga

SEQ ID NO: 4011353 - DNA, 13 bp, Homo sapiens
ccagcaataagaa

SEQ ID NO: 4011354 - DNA, 20 bp, Homo sapiens
ccagcaataagaaatgaaca

SEQ ID NO: 4011355 - DNA, 21 bp, Homo sapiens
ccagcaataagaaatgaacaa

SEQ ID NO: 4011356 - DNA, 22 bp, Homo sapiens
ccagcaataagaaatgaacaaa

SEQ ID NO: 4011357 - DNA, 22 bp, Homo sapiens
ccagcaatgacatctcaggggc

SEQ ID NO: 4011358 - DNA, 17 bp, Homo sapiens
ccagcaatgatgtccag

SEQ ID NO: 4011359 - DNA, 15 bp, Homo sapiens
ccagcacactattta

SEQ ID NO: 4011360 - DNA, 21 bp, Homo sapiens
ccagcacagagcgtccttccc

SEQ ID NO: 4011361 - DNA, 13 bp, Homo sapiens
ccagcaccaccct

SEQ ID NO: 4011362 - DNA, 16 bp, Homo sapiens
ccagcaccctctcctg

SEQ ID NO: 4011363 - DNA, 18 bp, Homo sapiens
ccagcaccctctcctggg

SEQ ID NO: 4011364 - DNA, 20 bp, Homo sapiens
ccagcactaaggccgtgtct

SEQ ID NO: 4011365 - DNA, 19 bp, Homo sapiens
ccccaccttgccaagcttt

SEQ ID NO: 4011366 - DNA, 17 bp, Homo sapiens
ccccacgagggtcagga

SEQ ID NO: 4011367 - DNA, 21 bp, Homo sapiens
ccccacggagacagaggaaag

SEQ ID NO: 4011368 - DNA, 22 bp, Homo sapiens
ccccacggggcctcgggacctc

SEQ ID NO: 4011369 - DNA, 23 bp, Homo sapiens
ccccactactgcagcacctccag

SEQ ID NO: 4011370 - DNA, 13 bp, Homo sapiens
ccccactcacccc

SEQ ID NO: 4011371 - DNA, 15 bp, Homo sapiens
ccccactcaccccct

SEQ ID NO: 4011372 - DNA, 22 bp, Homo sapiens
ccccactcccccgtttctcctt

SEQ ID NO: 4011373 - DNA, 21 bp, Homo sapiens
ccccactctaggggtcaggct

SEQ ID NO: 4011374 - DNA, 12 bp, Homo sapiens
ccccactctccc

SEQ ID NO: 4011375 - DNA, 18 bp, Homo sapiens
ccccactctccccacact

SEQ ID NO: 4011376 - DNA, 21 bp, Homo sapiens
ccccactgacagcctcccacc

SEQ ID NO: 4011377 - DNA, 14 bp, Homo sapiens
ccccactgaccaga

SEQ ID NO: 4011378 - DNA, 15 bp, Homo sapiens
ccccactgatgctgt

SEQ ID NO: 4011379 - DNA, 23 bp, Homo sapiens
ccccactgccaagtggggatggg

SEQ ID NO: 4011380 - DNA, 19 bp, Homo sapiens
ccccactgggccagccctg

SEQ ID NO: 4011381 - DNA, 21 bp, Homo sapiens
ccccactgtccccctacccac

SEQ ID NO: 4011382 - DNA, 17 bp, Homo sapiens
ccccagaccccagggca

SEQ ID NO: 4011383 - DNA, 19 bp, Homo sapiens
ccccagacccttcttgcct

SEQ ID NO: 4011384 - DNA, 21 bp, Homo sapiens
ccccagagctgtttatggcct

SEQ ID NO: 4011385 - DNA, 23 bp, Homo sapiens
ccccagagctgtttatggcctca

SEQ ID NO: 4011386 - DNA, 17 bp, Homo sapiens
ccccagatagagctggg

SEQ ID NO: 4011387 - DNA, 23 bp, Homo sapiens
ccccagatagagctgggtggcct

SEQ ID NO: 4011388 - DNA, 19 bp, Homo sapiens
ccccagcaacgcccctcca

SEQ ID NO: 4011389 - DNA, 20 bp, Homo sapiens
ccccagcaacgcccctccaa

SEQ ID NO: 4011390 - DNA, 17 bp, Homo sapiens
ccccagcaagcgggagc

SEQ ID NO: 4011391 - DNA, 14 bp, Homo sapiens
ccccagcagaggca

SEQ ID NO: 4011392 - DNA, 20 bp, Homo sapiens
ccccagcagaggcaggctgg

SEQ ID NO: 4011393 - DNA, 17 bp, Homo sapiens
ccccagcagccctcaac

SEQ ID NO: 4011394 - DNA, 16 bp, Homo sapiens
ccccagcatcactccc

SEQ ID NO: 4011395 - DNA, 22 bp, Homo sapiens
ccccagcccctcccccatctcc

SEQ ID NO: 4011396 - DNA, 23 bp, Homo sapiens
ccccagcccctcccccatctccc

SEQ ID NO: 4011397 - DNA, 21 bp, Homo sapiens
ccccagccccttctcccagca

SEQ ID NO: 4011398 - DNA, 15 bp, Homo sapiens
ccccagccctgtcct

SEQ ID NO: 4011399 - DNA, 15 bp, Homo sapiens
ccccagcctcgcctg

SEQ ID NO: 4011400 - DNA, 15 bp, Homo sapiens
ccccagcctctggca

SEQ ID NO: 4011401 - DNA, 17 bp, Homo sapiens
ccccagcctgacctgag

SEQ ID NO: 4011402 - DNA, 15 bp, Homo sapiens
ccccaggaccagctc

SEQ ID NO: 4011403 - DNA, 15 bp, Homo sapiens
ccccaggacctggct

SEQ ID NO: 4011404 - DNA, 20 bp, Homo sapiens
ccccaggacctggctgccat

SEQ ID NO: 4011405 - DNA, 21 bp, Homo sapiens
ccccaggacctggctgccata

SEQ ID NO: 4011406 - DNA, 15 bp, Homo sapiens
ccccaggagctcagg

SEQ ID NO: 4011407 - DNA, 16 bp, Homo sapiens
ccccaggagctcaggt

SEQ ID NO: 4011408 - DNA, 12 bp, Homo sapiens
ccccaggccagg

SEQ ID NO: 4011409 - DNA, 14 bp, Homo sapiens
ccccaggccctccc

SEQ ID NO: 4011410 - DNA, 13 bp, Homo sapiens
ccccaggccttgt

SEQ ID NO: 4011411 - DNA, 19 bp, Homo sapiens
ccccaggctggacatgctg

SEQ ID NO: 4011412 - DNA, 14 bp, Homo sapiens
ccccaggctgttct

SEQ ID NO: 4011413 - DNA, 18 bp, Homo sapiens
ccccaggctgttctccag

SEQ ID NO: 4011414 - DNA, 11 bp, Homo sapiens
ccccagggagt

SEQ ID NO: 4011415 - DNA, 14 bp, Homo sapiens
ccccagggcagggt

SEQ ID NO: 4011416 - DNA, 23 bp, Homo sapiens
ccccagggcagggtgggcagcct

SEQ ID NO: 4011417 - DNA, 19 bp, Homo sapiens
ccccagggccctggccagc

SEQ ID NO: 4011418 - DNA, 15 bp, Homo sapiens
ccccagggcctccag

SEQ ID NO: 4011419 - DNA, 16 bp, Homo sapiens
ccccagggcctccagg

SEQ ID NO: 4011420 - DNA, 19 bp, Homo sapiens
ccccagtccccacccctgc

SEQ ID NO: 4011421 - DNA, 20 bp, Homo sapiens
ccccagtgggaccacatgcc

SEQ ID NO: 4011422 - DNA, 13 bp, Homo sapiens
ccccatccccacc

SEQ ID NO: 4011423 - DNA, 14 bp, Homo sapiens
ccccatccccacca

SEQ ID NO: 4011424 - DNA, 12 bp, Homo sapiens
ccccatccctcg

SEQ ID NO: 4011425 - DNA, 14 bp, Homo sapiens
ccccatccctcggg

SEQ ID NO: 4011426 - DNA, 13 bp, Homo sapiens
ccccatccctggg

SEQ ID NO: 4011427 - DNA, 18 bp, Homo sapiens
ccccatcctcatccctga

SEQ ID NO: 4011428 - DNA, 19 bp, Homo sapiens
ccccatcctcatccctgac

SEQ ID NO: 4011429 - DNA, 18 bp, Homo sapiens
ccccatctccctgcctgg

SEQ ID NO: 4011430 - DNA, 13 bp, Homo sapiens
ccccatctctcat

SEQ ID NO: 4011431 - DNA, 12 bp, Homo sapiens
ccccatctctcc

SEQ ID NO: 4011432 - DNA, 16 bp, Homo sapiens
ccccatctctccctcc

SEQ ID NO: 4011433 - DNA, 14 bp, Homo sapiens
ccccatctgggtcc

SEQ ID NO: 4011434 - DNA, 21 bp, Homo sapiens
ccccatctgtccagctggggc

SEQ ID NO: 4011435 - DNA, 15 bp, Homo sapiens
ccccatgaggaagga

SEQ ID NO: 4011436 - DNA, 19 bp, Homo sapiens
ccccatgcactgtgaagga

SEQ ID NO: 4011437 - DNA, 13 bp, Homo sapiens
ccccatgcagtct

SEQ ID NO: 4011438 - DNA, 13 bp, Homo sapiens
ccccatgccaaag

SEQ ID NO: 4011439 - DNA, 16 bp, Homo sapiens
ccccatgccacgttcc

SEQ ID NO: 4011440 - DNA, 21 bp, Homo sapiens
ccccatgcctgtccagcctgg

SEQ ID NO: 4011441 - DNA, 23 bp, Homo sapiens
ccccatgcctgtccagcctgggc

SEQ ID NO: 4011442 - DNA, 14 bp, Homo sapiens
ccccatgggctcct

SEQ ID NO: 4011443 - DNA, 16 bp, Homo sapiens
ccccatgggctcctgc

SEQ ID NO: 4011444 - DNA, 17 bp, Homo sapiens
ccccatgggctcctgcc

SEQ ID NO: 4011445 - DNA, 20 bp, Homo sapiens
ccccatgggctcctgcccct

SEQ ID NO: 4011446 - DNA, 18 bp, Homo sapiens
ccccatgtgtcctggttc

SEQ ID NO: 4011447 - DNA, 21 bp, Homo sapiens
ccccattcctgatcccatggc

SEQ ID NO: 4011448 - DNA, 20 bp, Homo sapiens
ccccattccttgcgcctcag

SEQ ID NO: 4011449 - DNA, 16 bp, Homo sapiens
ccccatttcccatctg

SEQ ID NO: 4011450 - DNA, 14 bp, Homo sapiens
ccccatttcccgca

SEQ ID NO: 4011451 - DNA, 16 bp, Homo sapiens
ccccatttcctcacac

SEQ ID NO: 4011452 - DNA, 17 bp, Homo sapiens
ccccatttctgcctcgc

SEQ ID NO: 4011453 - DNA, 15 bp, Homo sapiens
ccccatttgtcccag

SEQ ID NO: 4011454 - DNA, 15 bp, Homo sapiens
cccccaaaggcatcc

SEQ ID NO: 4011455 - DNA, 14 bp, Homo sapiens
cccccaccagacat

SEQ ID NO: 4011456 - DNA, 13 bp, Homo sapiens
cccccacccacct

SEQ ID NO: 4011457 - DNA, 20 bp, Homo sapiens
cccccaccccggggaccctg

SEQ ID NO: 4011458 - DNA, 23 bp, Homo sapiens
cccccagcactaaggccgtgtct

SEQ ID NO: 4011459 - DNA, 15 bp, Homo sapiens
cccccagcagaggca

SEQ ID NO: 4011460 - DNA, 22 bp, Homo sapiens
cccccagcagaggcaggctggg

SEQ ID NO: 4011461 - DNA, 13 bp, Homo sapiens
cccccagctaaga

SEQ ID NO: 4011462 - DNA, 15 bp, Homo sapiens
cccccagctgggtct

SEQ ID NO: 4011463 - DNA, 20 bp, Homo sapiens
cccccaggctggagtgcagt

SEQ ID NO: 4011464 - DNA, 18 bp, Homo sapiens
cccccagggcctccaggg

SEQ ID NO: 4011465 - DNA, 20 bp, Homo sapiens
cccccagggcctccagggcc

SEQ ID NO: 4011466 - DNA, 14 bp, Homo sapiens
cccccagtacctcc

SEQ ID NO: 4011467 - DNA, 15 bp, Homo sapiens
cccccagtacctcca

SEQ ID NO: 4011468 - DNA, 17 bp, Homo sapiens
cccttccttttccctgc

SEQ ID NO: 4011469 - DNA, 18 bp, Homo sapiens
cccttccttttccctgct

SEQ ID NO: 4011470 - DNA, 21 bp, Homo sapiens
cccttccttttccctgcttcc

SEQ ID NO: 4011471 - DNA, 15 bp, Homo sapiens
cccttctcccagcac

SEQ ID NO: 4011472 - DNA, 21 bp, Homo sapiens
cccttctctccctgccagagg

SEQ ID NO: 4011473 - DNA, 16 bp, Homo sapiens
cccttctctgctccac

SEQ ID NO: 4011474 - DNA, 15 bp, Homo sapiens
cccttctcttagtta

SEQ ID NO: 4011475 - DNA, 17 bp, Homo sapiens
cccttctcttccaggca

SEQ ID NO: 4011476 - DNA, 14 bp, Homo sapiens
cccttctgctcagc

SEQ ID NO: 4011477 - DNA, 20 bp, Homo sapiens
cccttcttgcctgctgggct

SEQ ID NO: 4011478 - DNA, 21 bp, Homo sapiens
cccttcttgcctgctgggctc

SEQ ID NO: 4011479 - DNA, 21 bp, Homo sapiens
cccttgaactgttctggcctc

SEQ ID NO: 4011480 - DNA, 23 bp, Homo sapiens
cccttgacgtcaagtctccttcc

SEQ ID NO: 4011481 - DNA, 22 bp, Homo sapiens
cccttgagaaaccttattgtac

SEQ ID NO: 4011482 - DNA, 16 bp, Homo sapiens
cccttgcagctagttt

SEQ ID NO: 4011483 - DNA, 14 bp, Homo sapiens
cccttgcaggggtc

SEQ ID NO: 4011484 - DNA, 22 bp, Homo sapiens
cccttgcaggggtcccccctca

SEQ ID NO: 4011485 - DNA, 19 bp, Homo sapiens
cccttgcagttcagcacca

SEQ ID NO: 4011486 - DNA, 13 bp, Homo sapiens
cccttgccacccc

SEQ ID NO: 4011487 - DNA, 19 bp, Homo sapiens
cccttgcccatgctgggct

SEQ ID NO: 4011488 - DNA, 16 bp, Homo sapiens
cccttgccctagatag

SEQ ID NO: 4011489 - DNA, 13 bp, Homo sapiens
cccttgcctcccc

SEQ ID NO: 4011490 - DNA, 23 bp, Homo sapiens
cccttgcctccccatttcccatc

SEQ ID NO: 4011491 - DNA, 12 bp, Homo sapiens
cccttgcctctg

SEQ ID NO: 4011492 - DNA, 20 bp, Homo sapiens
cccttgcctttcgaggcctg

SEQ ID NO: 4011493 - DNA, 18 bp, Homo sapiens
cccttgctgaacacacac

SEQ ID NO: 4011494 - DNA, 21 bp, Homo sapiens
cccttgctgtatgctgatcat

SEQ ID NO: 4011495 - DNA, 22 bp, Homo sapiens
cccttgctttcctgggcctttg

SEQ ID NO: 4011496 - DNA, 15 bp, Homo sapiens
cccttggctcaatcc

SEQ ID NO: 4011497 - DNA, 19 bp, Homo sapiens
cccttggctggatcaggga

SEQ ID NO: 4011498 - DNA, 23 bp, Homo sapiens
cccttggctgtgaggcccctgga

SEQ ID NO: 4011499 - DNA, 17 bp, Homo sapiens
cccttgggacagccaga

SEQ ID NO: 4011500 - DNA, 15 bp, Homo sapiens
cccttgggcagttct

SEQ ID NO: 4011501 - DNA, 15 bp, Homo sapiens
cccttgggctggaag

SEQ ID NO: 4011502 - DNA, 16 bp, Homo sapiens
cccttgggttctgata

SEQ ID NO: 4011503 - DNA, 17 bp, Homo sapiens
cccttgtacagtgtctg

SEQ ID NO: 4011504 - DNA, 17 bp, Homo sapiens
cccttgtgagagcccat

SEQ ID NO: 4011505 - DNA, 12 bp, Homo sapiens
ccctttactcgt

SEQ ID NO: 4011506 - DNA, 12 bp, Homo sapiens
ccctttcaggcc

SEQ ID NO: 4011507 - DNA, 16 bp, Homo sapiens
ccctttcaggcctaca

SEQ ID NO: 4011508 - DNA, 22 bp, Homo sapiens
ccctttccccagcatcactccc

SEQ ID NO: 4011509 - DNA, 20 bp, Homo sapiens
ccctttcctaggcccaggcc

SEQ ID NO: 4011510 - DNA, 12 bp, Homo sapiens
ccctttcctgtc

SEQ ID NO: 4011511 - DNA, 14 bp, Homo sapiens
ccctttcctgtccc

SEQ ID NO: 4011512 - DNA, 13 bp, Homo sapiens
ccctttcttcctc

SEQ ID NO: 4011513 - DNA, 21 bp, Homo sapiens
ccctttcttctcccccatcct

SEQ ID NO: 4011514 - DNA, 16 bp, Homo sapiens
ccctttcttggccagt

SEQ ID NO: 4011515 - DNA, 17 bp, Homo sapiens
ccctttcttggccagtt

SEQ ID NO: 4011516 - DNA, 14 bp, Homo sapiens
ccctttgctgtgag

SEQ ID NO: 4011517 - DNA, 21 bp, Homo sapiens
ccctttgtcctcctgctgcca

SEQ ID NO: 4011518 - DNA, 22 bp, Homo sapiens
ccctttgtcctcctgctgccag

SEQ ID NO: 4011519 - DNA, 16 bp, Homo sapiens
cccttttcagctgagc

SEQ ID NO: 4011520 - DNA, 9 bp, Homo sapiens
cccttttcc

SEQ ID NO: 4011521 - DNA, 13 bp, Homo sapiens
cccttttctgttc

SEQ ID NO: 4011522 - DNA, 22 bp, Homo sapiens
cccttttctttttcccttgaac

SEQ ID NO: 4011523 - DNA, 21 bp, Homo sapiens
ccctttttttcctttttctga

SEQ ID NO: 4011524 - DNA, 18 bp, Homo sapiens
ccgaatcccctccctgtc

SEQ ID NO: 4011525 - DNA, 13 bp, Homo sapiens
ccgacaagcacag

SEQ ID NO: 4011526 - DNA, 14 bp, Homo sapiens
ccgacagcctggca

SEQ ID NO: 4011527 - DNA, 15 bp, Homo sapiens
ccgaccaactgccct

SEQ ID NO: 4011528 - DNA, 23 bp, Homo sapiens
ccgacctggctgcccctcacctt

SEQ ID NO: 4011529 - DNA, 24 bp, Homo sapiens
ccgacgccgtcccaccagcttcac

SEQ ID NO: 4011530 - DNA, 16 bp, Homo sapiens
ccgacgcgtctcctgt

SEQ ID NO: 4011531 - DNA, 23 bp, Homo sapiens
ccgacggtgggcatttgtgaggc

SEQ ID NO: 4011532 - DNA, 17 bp, Homo sapiens
ccgactagacacacaaa

SEQ ID NO: 4011533 - DNA, 19 bp, Homo sapiens
ccgactctggccctggccc

SEQ ID NO: 4011534 - DNA, 18 bp, Homo sapiens
ccgacttgtgcacaggca

SEQ ID NO: 4011535 - DNA, 20 bp, Homo sapiens
ccgacttgtgcacaggcaga

SEQ ID NO: 4011536 - DNA, 21 bp, Homo sapiens
ccgagcaaagatcaaaataaa

SEQ ID NO: 4011537 - DNA, 23 bp, Homo sapiens
ccgagcaaagatcaaaataaaaa

SEQ ID NO: 4011538 - DNA, 16 bp, Homo sapiens
ccgagccgggcctggg

SEQ ID NO: 4011539 - DNA, 17 bp, Homo sapiens
ccgagctccagagcaac

SEQ ID NO: 4011540 - DNA, 14 bp, Homo sapiens
ccgagctcttggcc

SEQ ID NO: 4011541 - DNA, 18 bp, Homo sapiens
ccgagctcttggcctttg

SEQ ID NO: 4011542 - DNA, 23 bp, Homo sapiens
ccgagctcttggcctttgcattt

SEQ ID NO: 4011543 - DNA, 13 bp, Homo sapiens
ccgagctggagcg

SEQ ID NO: 4011544 - DNA, 15 bp, Homo sapiens
ccgaggaggtgcctg

SEQ ID NO: 4011545 - DNA, 15 bp, Homo sapiens
ccgaggcccagcggg

SEQ ID NO: 4011546 - DNA, 18 bp, Homo sapiens
ccgaggggagggcaggat

SEQ ID NO: 4011547 - DNA, 21 bp, Homo sapiens
ccgagggtcctggctcctgag

SEQ ID NO: 4011548 - DNA, 12 bp, Homo sapiens
ccgaggtcccat

SEQ ID NO: 4011549 - DNA, 16 bp, Homo sapiens
ccgagtgaacctacct

SEQ ID NO: 4011550 - DNA, 22 bp, Homo sapiens
ccgagtgtgtttcatccttccc

SEQ ID NO: 4011551 - DNA, 23 bp, Homo sapiens
ccgagtgtgtttcatccttccca

SEQ ID NO: 4011552 - DNA, 13 bp, Homo sapiens
ccgataatgcatg

SEQ ID NO: 4011553 - DNA, 19 bp, Homo sapiens
ccgataatgcatgaagcaa

SEQ ID NO: 4011554 - DNA, 12 bp, Homo sapiens
ccgatggagccc

SEQ ID NO: 4011555 - DNA, 14 bp, Homo sapiens
ccgcaactcacaca

SEQ ID NO: 4011556 - DNA, 20 bp, Homo sapiens
ccgcaccccggcctcagggc

SEQ ID NO: 4011557 - DNA, 14 bp, Homo sapiens
ccgcactcacccat

SEQ ID NO: 4011558 - DNA, 22 bp, Homo sapiens
ccgcactttccacttcttcctt

SEQ ID NO: 4011559 - DNA, 16 bp, Homo sapiens
ccgcagacgggcacag

SEQ ID NO: 4011560 - DNA, 21 bp, Homo sapiens
ccgcaggtgtttggcacccaa

SEQ ID NO: 4011561 - DNA, 21 bp, Homo sapiens
ccgcagtgctgggaccagagc

SEQ ID NO: 4011562 - DNA, 11 bp, Homo sapiens
ccgcagtgttt

SEQ ID NO: 4011563 - DNA, 14 bp, Homo sapiens
ccgcatcacctcac

SEQ ID NO: 4011564 - DNA, 16 bp, Homo sapiens
ccgccaatctggccct

SEQ ID NO: 4011565 - DNA, 23 bp, Homo sapiens
ccgccacctatctcgtgggagag

SEQ ID NO: 4011566 - DNA, 15 bp, Homo sapiens
ccgccacctcagggc

SEQ ID NO: 4011567 - DNA, 21 bp, Homo sapiens
ccgccacgtcccagcatccct

SEQ ID NO: 4011568 - DNA, 16 bp, Homo sapiens
ccgccactcctgaacc

SEQ ID NO: 4011569 - DNA, 12 bp, Homo sapiens
ccgccagcctcc

SEQ ID NO: 4011570 - DNA, 13 bp, Homo sapiens
cctcaccttcctg

SEQ ID NO: 4011571 - DNA, 21 bp, Homo sapiens
cctcaccttggcaccagacac

SEQ ID NO: 4011572 - DNA, 18 bp, Homo sapiens
cctcaccttgggctgggg

SEQ ID NO: 4011573 - DNA, 22 bp, Homo sapiens
cctcactatggtatgctggcca

SEQ ID NO: 4011574 - DNA, 14 bp, Homo sapiens
cctcactccccagg

SEQ ID NO: 4011575 - DNA, 16 bp, Homo sapiens
cctcactccccaggga

SEQ ID NO: 4011576 - DNA, 12 bp, Homo sapiens
cctcactcctgt

SEQ ID NO: 4011577 - DNA, 13 bp, Homo sapiens
cctcactcctgtt

SEQ ID NO: 4011578 - DNA, 18 bp, Homo sapiens
cctcagacgttgcctgag

SEQ ID NO: 4011579 - DNA, 19 bp, Homo sapiens
cctcagacgttgcctgaga

SEQ ID NO: 4011580 - DNA, 20 bp, Homo sapiens
cctcagacgttgcctgagaa

SEQ ID NO: 4011581 - DNA, 22 bp, Homo sapiens
cctcagacttaccaggaagcag

SEQ ID NO: 4011582 - DNA, 17 bp, Homo sapiens
cctcagagcgccaggaa

SEQ ID NO: 4011583 - DNA, 22 bp, Homo sapiens
cctcagagcgccaggaagccag

SEQ ID NO: 4011584 - DNA, 23 bp, Homo sapiens
cctcagagcgccaggaagccaga

SEQ ID NO: 4011585 - DNA, 17 bp, Homo sapiens
cctcagaggagctctac

SEQ ID NO: 4011586 - DNA, 11 bp, Homo sapiens
cctcagaggca

SEQ ID NO: 4011587 - DNA, 16 bp, Homo sapiens
cctcagaggcagcttc

SEQ ID NO: 4011588 - DNA, 14 bp, Homo sapiens
cctcagcaagccct

SEQ ID NO: 4011589 - DNA, 12 bp, Homo sapiens
cctcagcctcag

SEQ ID NO: 4011590 - DNA, 16 bp, Homo sapiens
cctcagcctcagagga

SEQ ID NO: 4011591 - DNA, 11 bp, Homo sapiens
cctcagcctgg

SEQ ID NO: 4011592 - DNA, 12 bp, Homo sapiens
cctcagcctggc

SEQ ID NO: 4011593 - DNA, 13 bp, Homo sapiens
cctcagcctggcc

SEQ ID NO: 4011594 - DNA, 12 bp, Homo sapiens
cctcagccttaa

SEQ ID NO: 4011595 - DNA, 18 bp, Homo sapiens
cctcagccttgccagaga

SEQ ID NO: 4011596 - DNA, 14 bp, Homo sapiens
cctcagctctctgg

SEQ ID NO: 4011597 - DNA, 16 bp, Homo sapiens
cctcagctctctggga

SEQ ID NO: 4011598 - DNA, 14 bp, Homo sapiens
cctcagctgaatgc

SEQ ID NO: 4011599 - DNA, 14 bp, Homo sapiens
cctcagctgacccg

SEQ ID NO: 4011600 - DNA, 20 bp, Homo sapiens
cctcagctgacccggcctct

SEQ ID NO: 4011601 - DNA, 14 bp, Homo sapiens
cctcagctgcctca

SEQ ID NO: 4011602 - DNA, 16 bp, Homo sapiens
cctcagctgcctcact

SEQ ID NO: 4011603 - DNA, 18 bp, Homo sapiens
cctcagctgcctcctgcg

SEQ ID NO: 4011604 - DNA, 21 bp, Homo sapiens
cctcagctggttactcagggt

SEQ ID NO: 4011605 - DNA, 21 bp, Homo sapiens
cctcagcttcttcacaggcac

SEQ ID NO: 4011606 - DNA, 15 bp, Homo sapiens
cctcaggcacacagc

SEQ ID NO: 4011607 - DNA, 20 bp, Homo sapiens
cctcagggccaggcccaggc

SEQ ID NO: 4011608 - DNA, 14 bp, Homo sapiens
cctcagggcgctca

SEQ ID NO: 4011609 - DNA, 18 bp, Homo sapiens
cctcagggctcccagggg

SEQ ID NO: 4011610 - DNA, 17 bp, Homo sapiens
cctcagggctgtcccag

SEQ ID NO: 4011611 - DNA, 21 bp, Homo sapiens
cctcagggctgtcccagcccc

SEQ ID NO: 4011612 - DNA, 22 bp, Homo sapiens
cctcagggctgtcccagccccg

SEQ ID NO: 4011613 - DNA, 14 bp, Homo sapiens
cctcagggtggggg

SEQ ID NO: 4011614 - DNA, 19 bp, Homo sapiens
cctcagggtggggggtgac

SEQ ID NO: 4011615 - DNA, 16 bp, Homo sapiens
cctcaggtgctgtcca

SEQ ID NO: 4011616 - DNA, 18 bp, Homo sapiens
cctcaggtgctgtccatg

SEQ ID NO: 4011617 - DNA, 19 bp, Homo sapiens
cctcaggttctattttctt

SEQ ID NO: 4011618 - DNA, 16 bp, Homo sapiens
cctcagtccatttata

SEQ ID NO: 4011619 - DNA, 18 bp, Homo sapiens
cctcagtccatttatata

SEQ ID NO: 4011620 - DNA, 23 bp, Homo sapiens
cctcagtgtcatttatgaaaaga

SEQ ID NO: 4011621 - DNA, 15 bp, Homo sapiens
cctcagttcaacctg

SEQ ID NO: 4011622 - DNA, 23 bp, Homo sapiens
cctcagttcaacctggtggcacc

SEQ ID NO: 4011623 - DNA, 19 bp, Homo sapiens
cctcagttcccttggcctc

SEQ ID NO: 4011624 - DNA, 20 bp, Homo sapiens
cctcagttcccttggcctca

SEQ ID NO: 4011625 - DNA, 13 bp, Homo sapiens
cctcatatttaaa

SEQ ID NO: 4011626 - DNA, 13 bp, Homo sapiens
cctcatcccatga

SEQ ID NO: 4011627 - DNA, 20 bp, Homo sapiens
cctcatctctctgcccaacc

SEQ ID NO: 4011628 - DNA, 21 bp, Homo sapiens
cctcatgccaaccctgggcta

SEQ ID NO: 4011629 - DNA, 15 bp, Homo sapiens
cctcatggcccccag

SEQ ID NO: 4011630 - DNA, 22 bp, Homo sapiens
cctcatggcccctctgacctgc

SEQ ID NO: 4011631 - DNA, 14 bp, Homo sapiens
cctcatgggaagca

SEQ ID NO: 4011632 - DNA, 15 bp, Homo sapiens
cctcatgggtcctag

SEQ ID NO: 4011633 - DNA, 15 bp, Homo sapiens
cctcattccctcgtc

SEQ ID NO: 4011634 - DNA, 21 bp, Homo sapiens
cctcattccctcgtctttccc

SEQ ID NO: 4011635 - DNA, 19 bp, Homo sapiens
cctcattgacaagaactga

SEQ ID NO: 4011636 - DNA, 16 bp, Homo sapiens
cctccaaaggccccct

SEQ ID NO: 4011637 - DNA, 22 bp, Homo sapiens
cctccaaatctcttgcttgtca

SEQ ID NO: 4011638 - DNA, 14 bp, Homo sapiens
cctccaagcaagta

SEQ ID NO: 4011639 - DNA, 18 bp, Homo sapiens
cctccaagcacagagcct

SEQ ID NO: 4011640 - DNA, 16 bp, Homo sapiens
cctccaagcctgcctc

SEQ ID NO: 4011641 - DNA, 19 bp, Homo sapiens
cctccaagtgccccctcac

SEQ ID NO: 4011642 - DNA, 15 bp, Homo sapiens
cctccacatcccagc

SEQ ID NO: 4011643 - DNA, 21 bp, Homo sapiens
cctccacatcccagcagccca

SEQ ID NO: 4011644 - DNA, 12 bp, Homo sapiens
cctccacccagc

SEQ ID NO: 4011645 - DNA, 14 bp, Homo sapiens
cctccacccagccc

SEQ ID NO: 4011646 - DNA, 14 bp, Homo sapiens
cctccacctcttca

SEQ ID NO: 4011647 - DNA, 14 bp, Homo sapiens
cctccaccttccat

SEQ ID NO: 4011648 - DNA, 21 bp, Homo sapiens
cctccaccttccattttcccc

SEQ ID NO: 4011649 - DNA, 13 bp, Homo sapiens
cctccacgcctcc

SEQ ID NO: 4011650 - DNA, 20 bp, Homo sapiens
cctccacgcctcctggccag

SEQ ID NO: 4011651 - DNA, 21 bp, Homo sapiens
cctccacgcctcctggccaga

SEQ ID NO: 4011652 - DNA, 21 bp, Homo sapiens
cctccactcagctgtcctgca

SEQ ID NO: 4011653 - DNA, 18 bp, Homo sapiens
cctccactcccacctcac

SEQ ID NO: 4011654 - DNA, 17 bp, Homo sapiens
cctccagaactcttcct

SEQ ID NO: 4011655 - DNA, 18 bp, Homo sapiens
cctccagaactcttcctc

SEQ ID NO: 4011656 - DNA, 18 bp, Homo sapiens
cctccagaagcctctggc

SEQ ID NO: 4011657 - DNA, 19 bp, Homo sapiens
cctccagaagcctctggct

SEQ ID NO: 4011658 - DNA, 22 bp, Homo sapiens
cctccagaagcctctggctaga

SEQ ID NO: 4011659 - DNA, 19 bp, Homo sapiens
cctccagagaaacccaggg

SEQ ID NO: 4011660 - DNA, 20 bp, Homo sapiens
cctccagagaaacccaggga

SEQ ID NO: 4011661 - DNA, 22 bp, Homo sapiens
cctccagaggtcctccgtaggg

SEQ ID NO: 4011662 - DNA, 21 bp, Homo sapiens
cctccagcctccctgtctcca

SEQ ID NO: 4011663 - DNA, 14 bp, Homo sapiens
cctccagctgcacc

SEQ ID NO: 4011664 - DNA, 15 bp, Homo sapiens
cctccagctgcacca

SEQ ID NO: 4011665 - DNA, 18 bp, Homo sapiens
cctccagctgcaccagag

SEQ ID NO: 4011666 - DNA, 19 bp, Homo sapiens
cctccagctgcaccagagc

SEQ ID NO: 4011667 - DNA, 23 bp, Homo sapiens
cctccaggagcttcttgtttcct

SEQ ID NO: 4011668 - DNA, 13 bp, Homo sapiens
cctccaggcctgc

SEQ ID NO: 4011669 - DNA, 18 bp, Homo sapiens
cctccagggaaggtggcc

SEQ ID NO: 4011670 - DNA, 16 bp, Homo sapiens
cctccagggcccccca

SEQ ID NO: 4011671 - DNA, 16 bp, Homo sapiens
cctccagtaccttgct

SEQ ID NO: 4011672 - DNA, 17 bp, Homo sapiens
cctccagtaccttgctt

SEQ ID NO: 4011673 - DNA, 20 bp, Homo sapiens
cctgccccgcccccagtccc

SEQ ID NO: 4011674 - DNA, 14 bp, Homo sapiens
cctgcccctccctt

SEQ ID NO: 4011675 - DNA, 16 bp, Homo sapiens
cctgcccctcccttca

SEQ ID NO: 4011676 - DNA, 16 bp, Homo sapiens
cctgccccttccttta

SEQ ID NO: 4011677 - DNA, 18 bp, Homo sapiens
cctgcccctttcaggcct

SEQ ID NO: 4011678 - DNA, 20 bp, Homo sapiens
cctgcccctttcaggcctac

SEQ ID NO: 4011679 - DNA, 21 bp, Homo sapiens
cctgcccctttcaggcctaca

SEQ ID NO: 4011680 - DNA, 20 bp, Homo sapiens
cctgcccggatggagcgggg

SEQ ID NO: 4011681 - DNA, 18 bp, Homo sapiens
cctgcccgtgccctggtg

SEQ ID NO: 4011682 - DNA, 14 bp, Homo sapiens
cctgccctcaggga

SEQ ID NO: 4011683 - DNA, 12 bp, Homo sapiens
cctgccctggtc

SEQ ID NO: 4011684 - DNA, 14 bp, Homo sapiens
cctgccctgtccaa

SEQ ID NO: 4011685 - DNA, 16 bp, Homo sapiens
cctgccctgtccctgt

SEQ ID NO: 4011686 - DNA, 14 bp, Homo sapiens
cctgcccttccctc

SEQ ID NO: 4011687 - DNA, 19 bp, Homo sapiens
cctgccgggctgagggcct

SEQ ID NO: 4011688 - DNA, 21 bp, Homo sapiens
cctgccgggctgagggcctgc

SEQ ID NO: 4011689 - DNA, 23 bp, Homo sapiens
cctgccgggctgagggcctgctg

SEQ ID NO: 4011690 - DNA, 13 bp, Homo sapiens
cctgcctcagcct

SEQ ID NO: 4011691 - DNA, 12 bp, Homo sapiens
cctgcctcagga

SEQ ID NO: 4011692 - DNA, 13 bp, Homo sapiens
cctgcctgagggc

SEQ ID NO: 4011693 - DNA, 13 bp, Homo sapiens
cctgcctgcagca

SEQ ID NO: 4011694 - DNA, 14 bp, Homo sapiens
cctgcctgccctgt

SEQ ID NO: 4011695 - DNA, 13 bp, Homo sapiens
cctgcctggagcg

SEQ ID NO: 4011696 - DNA, 13 bp, Homo sapiens
cctgcctggcact

SEQ ID NO: 4011697 - DNA, 11 bp, Homo sapiens
cctgcctggcc

SEQ ID NO: 4011698 - DNA, 12 bp, Homo sapiens
cctgcctggccc

SEQ ID NO: 4011699 - DNA, 13 bp, Homo sapiens
cctgcctggcccc

SEQ ID NO: 4011700 - DNA, 15 bp, Homo sapiens
cctgcctgtctgccc

SEQ ID NO: 4011701 - DNA, 14 bp, Homo sapiens
cctgccttcatgga

SEQ ID NO: 4011702 - DNA, 17 bp, Homo sapiens
cctgccttggagagggc

SEQ ID NO: 4011703 - DNA, 11 bp, Homo sapiens
cctgccttggc

SEQ ID NO: 4011704 - DNA, 21 bp, Homo sapiens
cctgccttgggccttgctgct

SEQ ID NO: 4011705 - DNA, 13 bp, Homo sapiens
cctgcgagacgca

SEQ ID NO: 4011706 - DNA, 21 bp, Homo sapiens
cctgcgagacgcacacagctg

SEQ ID NO: 4011707 - DNA, 16 bp, Homo sapiens
cctgcgccagtcctgc

SEQ ID NO: 4011708 - DNA, 13 bp, Homo sapiens
cctgcgcctccag

SEQ ID NO: 4011709 - DNA, 14 bp, Homo sapiens
cctgcgcctccaga

SEQ ID NO: 4011710 - DNA, 13 bp, Homo sapiens
cctgcgcctgctg

SEQ ID NO: 4011711 - DNA, 15 bp, Homo sapiens
cctgcgggagtagtt

SEQ ID NO: 4011712 - DNA, 12 bp, Homo sapiens
cctgcgggctgc

SEQ ID NO: 4011713 - DNA, 24 bp, Homo sapiens
cctgcgggtgaacaaagcagccac

SEQ ID NO: 4011714 - DNA, 14 bp, Homo sapiens
cctgcggtcaggct

SEQ ID NO: 4011715 - DNA, 15 bp, Homo sapiens
cctgcgtcctcctca

SEQ ID NO: 4011716 - DNA, 17 bp, Homo sapiens
cctgcgttggtccagag

SEQ ID NO: 4011717 - DNA, 20 bp, Homo sapiens
cctgctacaacttcagcagt

SEQ ID NO: 4011718 - DNA, 23 bp, Homo sapiens
cctgctcaactctacccctgctc

SEQ ID NO: 4011719 - DNA, 15 bp, Homo sapiens
cctgctcaccacctg

SEQ ID NO: 4011720 - DNA, 18 bp, Homo sapiens
cctgctcaccacctgcct

SEQ ID NO: 4011721 - DNA, 20 bp, Homo sapiens
cctgctcaccacctgcctct

SEQ ID NO: 4011722 - DNA, 20 bp, Homo sapiens
cctgctcagcaattcagacc

SEQ ID NO: 4011723 - DNA, 23 bp, Homo sapiens
cctgctcagcaattcagacccct

SEQ ID NO: 4011724 - DNA, 21 bp, Homo sapiens
cctgctcagcagtgagagcag

SEQ ID NO: 4011725 - DNA, 17 bp, Homo sapiens
cctgctccaccagcagc

SEQ ID NO: 4011726 - DNA, 18 bp, Homo sapiens
cctgctccaccagcagca

SEQ ID NO: 4011727 - DNA, 11 bp, Homo sapiens
cctgctccaga

SEQ ID NO: 4011728 - DNA, 18 bp, Homo sapiens
cctgctccagaagatgcc

SEQ ID NO: 4011729 - DNA, 12 bp, Homo sapiens
cctgctccagac

SEQ ID NO: 4011730 - DNA, 15 bp, Homo sapiens
cctgctccagacctg

SEQ ID NO: 4011731 - DNA, 22 bp, Homo sapiens
cctgctccagacctgatcctgg

SEQ ID NO: 4011732 - DNA, 13 bp, Homo sapiens
cctgctccctgct

SEQ ID NO: 4011733 - DNA, 14 bp, Homo sapiens
cctgctccgctgct

SEQ ID NO: 4011734 - DNA, 17 bp, Homo sapiens
cctgctccgctgctcct

SEQ ID NO: 4011735 - DNA, 22 bp, Homo sapiens
cctgctccgctgctccttggct

SEQ ID NO: 4011736 - DNA, 20 bp, Homo sapiens
cctgctcctcctgccctgtc

SEQ ID NO: 4011737 - DNA, 16 bp, Homo sapiens
cctgctcctgcagcat

SEQ ID NO: 4011738 - DNA, 17 bp, Homo sapiens
cctgctcctgcagcatg

SEQ ID NO: 4011739 - DNA, 16 bp, Homo sapiens
cctgctccttcccttg

SEQ ID NO: 4011740 - DNA, 18 bp, Homo sapiens
cctgctccttcccttgct

SEQ ID NO: 4011741 - DNA, 18 bp, Homo sapiens
cctgctctacccatgagc

SEQ ID NO: 4011742 - DNA, 23 bp, Homo sapiens
cctgctctacccatgagcctgcc

SEQ ID NO: 4011743 - DNA, 22 bp, Homo sapiens
cctgctctagtgggacagccca

SEQ ID NO: 4011744 - DNA, 12 bp, Homo sapiens
cctgctctgctg

SEQ ID NO: 4011745 - DNA, 13 bp, Homo sapiens
cctgctctgctga

SEQ ID NO: 4011746 - DNA, 18 bp, Homo sapiens
cctgctgagagcccccac

SEQ ID NO: 4011747 - DNA, 12 bp, Homo sapiens
cctgctgcaccc

SEQ ID NO: 4011748 - DNA, 22 bp, Homo sapiens
cctgctgcaccctgcgcctcca

SEQ ID NO: 4011749 - DNA, 23 bp, Homo sapiens
cctgctgcaccctgcgcctccag

SEQ ID NO: 4011750 - DNA, 10 bp, Homo sapiens
cctgctgcat

SEQ ID NO: 4011751 - DNA, 21 bp, Homo sapiens
cctgctgccagtaccagcccc

SEQ ID NO: 4011752 - DNA, 15 bp, Homo sapiens
cctgctgccagtgca

SEQ ID NO: 4011753 - DNA, 21 bp, Homo sapiens
cctgctgccagtgcagccact

SEQ ID NO: 4011754 - DNA, 15 bp, Homo sapiens
cctgctgcccaggct

SEQ ID NO: 4011755 - DNA, 17 bp, Homo sapiens
cctgctgcccaggctgt

SEQ ID NO: 4011756 - DNA, 20 bp, Homo sapiens
cctgctgcggaggagctgcc

SEQ ID NO: 4011757 - DNA, 20 bp, Homo sapiens
cctgctgctgtgtttttgct

SEQ ID NO: 4011758 - DNA, 15 bp, Homo sapiens
cctgctggaggcctc

SEQ ID NO: 4011759 - DNA, 16 bp, Homo sapiens
cctgctggaggcctca

SEQ ID NO: 4011760 - DNA, 22 bp, Homo sapiens
cctgctggaggcctcaggtgct

SEQ ID NO: 4011761 - DNA, 12 bp, Homo sapiens
cctgctggctct

SEQ ID NO: 4011762 - DNA, 13 bp, Homo sapiens
cctgctggcttcc

SEQ ID NO: 4011763 - DNA, 21 bp, Homo sapiens
cctgctggcttccagcttcag

SEQ ID NO: 4011764 - DNA, 22 bp, Homo sapiens
cctgctggcttccagcttcagg

SEQ ID NO: 4011765 - DNA, 20 bp, Homo sapiens
cctgctgggctccccccagt

SEQ ID NO: 4011766 - DNA, 18 bp, Homo sapiens
cctgctggtcacagcctc

SEQ ID NO: 4011767 - DNA, 22 bp, Homo sapiens
cctgctgtcattgcttcttctg

SEQ ID NO: 4011768 - DNA, 20 bp, Homo sapiens
cctgctgtgattccactaca

SEQ ID NO: 4011769 - DNA, 21 bp, Homo sapiens
cctgctgtgccatgctgggcc

SEQ ID NO: 4011770 - DNA, 21 bp, Homo sapiens
cctgcttagctgccttgagct

SEQ ID NO: 4011771 - DNA, 17 bp, Homo sapiens
cctgcttctctgcccag

SEQ ID NO: 4011772 - DNA, 14 bp, Homo sapiens
cctgcttctgaact

SEQ ID NO: 4011773 - DNA, 15 bp, Homo sapiens
cctgcttctgaactc

SEQ ID NO: 4011774 - DNA, 15 bp, Homo sapiens
cctgcttgcaggagg

SEQ ID NO: 4011775 - DNA, 14 bp, Homo sapiens
cctgcttggcccgg

SEQ ID NO: 4011776 - DNA, 13 bp, Homo sapiens
ccttctcccagca

SEQ ID NO: 4011777 - DNA, 16 bp, Homo sapiens
ccttctcctctctggg

SEQ ID NO: 4011778 - DNA, 22 bp, Homo sapiens
ccttctccttcccatttctcta

SEQ ID NO: 4011779 - DNA, 17 bp, Homo sapiens
ccttctccttccccagg

SEQ ID NO: 4011780 - DNA, 19 bp, Homo sapiens
ccttctccttccccaggat

SEQ ID NO: 4011781 - DNA, 15 bp, Homo sapiens
ccttctctccctgcc

SEQ ID NO: 4011782 - DNA, 15 bp, Homo sapiens
ccttctctcctcccc

SEQ ID NO: 4011783 - DNA, 13 bp, Homo sapiens
ccttctctgaaca

SEQ ID NO: 4011784 - DNA, 15 bp, Homo sapiens
ccttctctgaacaca

SEQ ID NO: 4011785 - DNA, 21 bp, Homo sapiens
ccttctctgaacacaggcagc

SEQ ID NO: 4011786 - DNA, 14 bp, Homo sapiens
ccttctctgctcca

SEQ ID NO: 4011787 - DNA, 16 bp, Homo sapiens
ccttctctgctccacc

SEQ ID NO: 4011788 - DNA, 13 bp, Homo sapiens
ccttctctgggtc

SEQ ID NO: 4011789 - DNA, 23 bp, Homo sapiens
ccttctctgggtctgattttctc

SEQ ID NO: 4011790 - DNA, 12 bp, Homo sapiens
ccttctcttcca

SEQ ID NO: 4011791 - DNA, 22 bp, Homo sapiens
ccttctgatgtctctaaagcac

SEQ ID NO: 4011792 - DNA, 17 bp, Homo sapiens
ccttctgcctttgatgt

SEQ ID NO: 4011793 - DNA, 14 bp, Homo sapiens
ccttctgtccccag

SEQ ID NO: 4011794 - DNA, 14 bp, Homo sapiens
ccttctgtggctca

SEQ ID NO: 4011795 - DNA, 15 bp, Homo sapiens
ccttcttcacccagc

SEQ ID NO: 4011796 - DNA, 23 bp, Homo sapiens
ccttcttcacccagctaatctgt

SEQ ID NO: 4011797 - DNA, 23 bp, Homo sapiens
ccttcttcccaatagcaaggctg

SEQ ID NO: 4011798 - DNA, 16 bp, Homo sapiens
ccttcttgcctgctgg

SEQ ID NO: 4011799 - DNA, 19 bp, Homo sapiens
ccttcttgggccccagacc

SEQ ID NO: 4011800 - DNA, 21 bp, Homo sapiens
ccttctttgataatgttaaat

SEQ ID NO: 4011801 - DNA, 13 bp, Homo sapiens
ccttctttgtaat

SEQ ID NO: 4011802 - DNA, 21 bp, Homo sapiens
ccttgaaaataagaatagaaa

SEQ ID NO: 4011803 - DNA, 13 bp, Homo sapiens
ccttgaaaggaag

SEQ ID NO: 4011804 - DNA, 18 bp, Homo sapiens
ccttgaacctgtgagtaa

SEQ ID NO: 4011805 - DNA, 21 bp, Homo sapiens
ccttgaacctgtgagtaaata

SEQ ID NO: 4011806 - DNA, 18 bp, Homo sapiens
ccttgaactgttctggcc

SEQ ID NO: 4011807 - DNA, 17 bp, Homo sapiens
ccttgaatgctgccagt

SEQ ID NO: 4011808 - DNA, 11 bp, Homo sapiens
ccttgagacca

SEQ ID NO: 4011809 - DNA, 21 bp, Homo sapiens
ccttgagagtatcaggtctcc

SEQ ID NO: 4011810 - DNA, 22 bp, Homo sapiens
ccttgagccctggctgttctgt

SEQ ID NO: 4011811 - DNA, 18 bp, Homo sapiens
ccttgaggggagccagga

SEQ ID NO: 4011812 - DNA, 12 bp, Homo sapiens
ccttgaggtctt

SEQ ID NO: 4011813 - DNA, 15 bp, Homo sapiens
ccttgagtaaaaagg

SEQ ID NO: 4011814 - DNA, 14 bp, Homo sapiens
ccttgagtggggtt

SEQ ID NO: 4011815 - DNA, 15 bp, Homo sapiens
ccttgatgatttaat

SEQ ID NO: 4011816 - DNA, 19 bp, Homo sapiens
ccttgatttaaacacacag

SEQ ID NO: 4011817 - DNA, 17 bp, Homo sapiens
ccttgcaacttcatgtc

SEQ ID NO: 4011818 - DNA, 14 bp, Homo sapiens
ccttgcacccctca

SEQ ID NO: 4011819 - DNA, 15 bp, Homo sapiens
ccttgcagccacatg

SEQ ID NO: 4011820 - DNA, 18 bp, Homo sapiens
ccttgcagccacatggcc

SEQ ID NO: 4011821 - DNA, 20 bp, Homo sapiens
ccttgcagttcagcaccacc

SEQ ID NO: 4011822 - DNA, 13 bp, Homo sapiens
ccttgccacccca

SEQ ID NO: 4011823 - DNA, 13 bp, Homo sapiens
ccttgccagagat

SEQ ID NO: 4011824 - DNA, 20 bp, Homo sapiens
ccttgcccactcctgctctg

SEQ ID NO: 4011825 - DNA, 22 bp, Homo sapiens
ccttgcccactcctgctctgct

SEQ ID NO: 4011826 - DNA, 19 bp, Homo sapiens
ccttgccccccgccctcat

SEQ ID NO: 4011827 - DNA, 15 bp, Homo sapiens
ccttgcctcaatgcc

SEQ ID NO: 4011828 - DNA, 16 bp, Homo sapiens
ccttgcctcaatgcca

SEQ ID NO: 4011829 - DNA, 20 bp, Homo sapiens
ccttgcctcaatgccagtaa

SEQ ID NO: 4011830 - DNA, 14 bp, Homo sapiens
ccttgcctccccat

SEQ ID NO: 4011831 - DNA, 12 bp, Homo sapiens
ccttgcctctgc

SEQ ID NO: 4011832 - DNA, 20 bp, Homo sapiens
ccttgcctttcgaggcctga

SEQ ID NO: 4011833 - DNA, 15 bp, Homo sapiens
ccttgcgcctcagcc

SEQ ID NO: 4011834 - DNA, 20 bp, Homo sapiens
ccttgcgcctcagccctcag

SEQ ID NO: 4011835 - DNA, 18 bp, Homo sapiens
ccttgctaccacggcctc

SEQ ID NO: 4011836 - DNA, 12 bp, Homo sapiens
ccttgctacctc

SEQ ID NO: 4011837 - DNA, 16 bp, Homo sapiens
ccttgctcctagcaga

SEQ ID NO: 4011838 - DNA, 18 bp, Homo sapiens
ccttgctcctagcagaca

SEQ ID NO: 4011839 - DNA, 18 bp, Homo sapiens
ccttgctcgctgtaaaat

SEQ ID NO: 4011840 - DNA, 15 bp, Homo sapiens
ccttgctctcagctg

SEQ ID NO: 4011841 - DNA, 17 bp, Homo sapiens
ccttgctctcctcatct

SEQ ID NO: 4011842 - DNA, 20 bp, Homo sapiens
ccttgctgtatgctgatcat

SEQ ID NO: 4011843 - DNA, 21 bp, Homo sapiens
ccttgctgtatgctgatcatc

SEQ ID NO: 4011844 - DNA, 16 bp, Homo sapiens
ccttgctttcctgggc

SEQ ID NO: 4011845 - DNA, 18 bp, Homo sapiens
ccttgctttcctgggcct

SEQ ID NO: 4011846 - DNA, 21 bp, Homo sapiens
ccttgctttgttttaataaac

SEQ ID NO: 4011847 - DNA, 22 bp, Homo sapiens
ccttggaaatagaaagaagcca

SEQ ID NO: 4011848 - DNA, 22 bp, Homo sapiens
ccttggaaccagccccatcaga

SEQ ID NO: 4011849 - DNA, 12 bp, Homo sapiens
ccttggaggcca

SEQ ID NO: 4011850 - DNA, 19 bp, Homo sapiens
ccttggcaggtcctggcca

SEQ ID NO: 4011851 - DNA, 14 bp, Homo sapiens
ccttggcctcagaa

SEQ ID NO: 4011852 - DNA, 22 bp, Homo sapiens
ccttggcctgtctcatccccag

SEQ ID NO: 4011853 - DNA, 18 bp, Homo sapiens
ccttggctcaatcctcta

SEQ ID NO: 4011854 - DNA, 12 bp, Homo sapiens
ccttggctcaga

SEQ ID NO: 4011855 - DNA, 23 bp, Homo sapiens
ccttggctctgccagtggatccc

SEQ ID NO: 4011856 - DNA, 21 bp, Homo sapiens
ccttggctgtgaggcccctgg

SEQ ID NO: 4011857 - DNA, 20 bp, Homo sapiens
ccttgggacagccagagctg

SEQ ID NO: 4011858 - DNA, 22 bp, Homo sapiens
ccttgggatggggagtcccaaa

SEQ ID NO: 4011859 - DNA, 20 bp, Homo sapiens
ccttgggcctgggcctctgc

SEQ ID NO: 4011860 - DNA, 15 bp, Homo sapiens
ccttgggctctgctg

SEQ ID NO: 4011861 - DNA, 16 bp, Homo sapiens
ccttgggctctgctga

SEQ ID NO: 4011862 - DNA, 15 bp, Homo sapiens
ccttgggctgctcct

SEQ ID NO: 4011863 - DNA, 22 bp, Homo sapiens
ccttggggaaccccgagctggg

SEQ ID NO: 4011864 - DNA, 22 bp, Homo sapiens
ccttggggtcaggttgacagga

SEQ ID NO: 4011865 - DNA, 13 bp, Homo sapiens
ccttgggtcattg

SEQ ID NO: 4011866 - DNA, 19 bp, Homo sapiens
ccttgggtcattgacctct

SEQ ID NO: 4011867 - DNA, 21 bp, Homo sapiens
ccttgggtgagtggcctgcta

SEQ ID NO: 4011868 - DNA, 21 bp, Homo sapiens
ccttgggttccaaccaggcag

SEQ ID NO: 4011869 - DNA, 21 bp, Homo sapiens
ccttggtctttgtatcttcca

SEQ ID NO: 4011870 - DNA, 21 bp, Homo sapiens
ccttggtgccaccaaaagtgc

SEQ ID NO: 4011871 - DNA, 22 bp, Homo sapiens
ccttgtacagtgtctgtgccat

SEQ ID NO: 4011872 - DNA, 19 bp, Homo sapiens
ccttgtctcctactcctga

SEQ ID NO: 4011873 - DNA, 15 bp, Homo sapiens
ccttgtgtgatttta

SEQ ID NO: 4011874 - DNA, 13 bp, Homo sapiens
ccttgttccagtt

SEQ ID NO: 4011875 - DNA, 20 bp, Homo sapiens
ccttgtttgagtttttcctc

SEQ ID NO: 4011876 - DNA, 23 bp, Homo sapiens
ccttgtttgagtttttcctccca

SEQ ID NO: 4011877 - DNA, 21 bp, Homo sapiens
cctttaaagatgaactctgaa

SEQ ID NO: 4011878 - DNA, 14 bp, Homo sapiens
cgctgccagccttg

SEQ ID NO: 4011879 - DNA, 16 bp, Homo sapiens
cgctgccgctgcacca

SEQ ID NO: 4011880 - DNA, 18 bp, Homo sapiens
cgctgccgctgcaccacg

SEQ ID NO: 4011881 - DNA, 15 bp, Homo sapiens
cgctgccgctgccgc

SEQ ID NO: 4011882 - DNA, 18 bp, Homo sapiens
cgctgccgctgccgctgc

SEQ ID NO: 4011883 - DNA, 15 bp, Homo sapiens
cgctgctccttggct

SEQ ID NO: 4011884 - DNA, 13 bp, Homo sapiens
cgctgcttccagg

SEQ ID NO: 4011885 - DNA, 20 bp, Homo sapiens
cgctgctttgcgctggtgga

SEQ ID NO: 4011886 - DNA, 23 bp, Homo sapiens
cgctggactattgtgccaactgc

SEQ ID NO: 4011887 - DNA, 20 bp, Homo sapiens
cgctggccgggggaggtggg

SEQ ID NO: 4011888 - DNA, 22 bp, Homo sapiens
cgctggtcccctccctctgtct

SEQ ID NO: 4011889 - DNA, 16 bp, Homo sapiens
cgctggtggaccacag

SEQ ID NO: 4011890 - DNA, 14 bp, Homo sapiens
cgctgtcactggct

SEQ ID NO: 4011891 - DNA, 19 bp, Homo sapiens
cgctgtgagcccctggtcc

SEQ ID NO: 4011892 - DNA, 21 bp, Homo sapiens
cgctgtttttgttgtgtgtgc

SEQ ID NO: 4011893 - DNA, 14 bp, Homo sapiens
cgcttctgcctgca

SEQ ID NO: 4011894 - DNA, 15 bp, Homo sapiens
cgcttctgccttttc

SEQ ID NO: 4011895 - DNA, 20 bp, Homo sapiens
cgcttctgtgtatctctttc

SEQ ID NO: 4011896 - DNA, 17 bp, Homo sapiens
cgctttctaaagttacc

SEQ ID NO: 4011897 - DNA, 14 bp, Homo sapiens
cgctttctcagtgt

SEQ ID NO: 4011898 - DNA, 16 bp, Homo sapiens
cgctttgattcatagt

SEQ ID NO: 4011899 - DNA, 21 bp, Homo sapiens
cgctttgctgctaccgccctg

SEQ ID NO: 4011900 - DNA, 12 bp, Homo sapiens
cgctttgtcaca

SEQ ID NO: 4011901 - DNA, 17 bp, Homo sapiens
cgcttttgttctcgcaa

SEQ ID NO: 4011902 - DNA, 15 bp, Homo sapiens
cggaaccacagggcc

SEQ ID NO: 4011903 - DNA, 16 bp, Homo sapiens
cggaaccacagggcca

SEQ ID NO: 4011904 - DNA, 21 bp, Homo sapiens
cggaaccacagggccagaggg

SEQ ID NO: 4011905 - DNA, 17 bp, Homo sapiens
cggaacccaagcttaga

SEQ ID NO: 4011906 - DNA, 18 bp, Homo sapiens
cggaacctgtgagctgca

SEQ ID NO: 4011907 - DNA, 19 bp, Homo sapiens
cggaacctgtgagctgcac

SEQ ID NO: 4011908 - DNA, 14 bp, Homo sapiens
cggaagcagtgcct

SEQ ID NO: 4011909 - DNA, 20 bp, Homo sapiens
cggaagcagtgccttccata

SEQ ID NO: 4011910 - DNA, 23 bp, Homo sapiens
cggaagcagtgccttccataatt

SEQ ID NO: 4011911 - DNA, 17 bp, Homo sapiens
cggaaggggttcctcaa

SEQ ID NO: 4011912 - DNA, 17 bp, Homo sapiens
cggaaggtttttaaaca

SEQ ID NO: 4011913 - DNA, 16 bp, Homo sapiens
cggacactcctagaga

SEQ ID NO: 4011914 - DNA, 21 bp, Homo sapiens
cggaccttggcagcccaggcc

SEQ ID NO: 4011915 - DNA, 15 bp, Homo sapiens
cggactggtgccctc

SEQ ID NO: 4011916 - DNA, 16 bp, Homo sapiens
cggactggtgccctcc

SEQ ID NO: 4011917 - DNA, 15 bp, Homo sapiens
cggagacagtgatct

SEQ ID NO: 4011918 - DNA, 17 bp, Homo sapiens
cggagagcagcagcacc

SEQ ID NO: 4011919 - DNA, 13 bp, Homo sapiens
cggagaggacagt

SEQ ID NO: 4011920 - DNA, 17 bp, Homo sapiens
cggagaggctgtctggg

SEQ ID NO: 4011921 - DNA, 19 bp, Homo sapiens
cggagaggctgtctggggc

SEQ ID NO: 4011922 - DNA, 21 bp, Homo sapiens
cggagaggctgtctggggcct

SEQ ID NO: 4011923 - DNA, 19 bp, Homo sapiens
cggagagtacagtgagcca

SEQ ID NO: 4011924 - DNA, 15 bp, Homo sapiens
cggagcccagcctgg

SEQ ID NO: 4011925 - DNA, 12 bp, Homo sapiens
cggagccccagg

SEQ ID NO: 4011926 - DNA, 22 bp, Homo sapiens
cggagcccttggcccctcggac

SEQ ID NO: 4011927 - DNA, 13 bp, Homo sapiens
cggaggaccaggg

SEQ ID NO: 4011928 - DNA, 15 bp, Homo sapiens
cggaggaccagggct

SEQ ID NO: 4011929 - DNA, 21 bp, Homo sapiens
cggaggagaccagctcagagg

SEQ ID NO: 4011930 - DNA, 13 bp, Homo sapiens
cggaggaggctgc

SEQ ID NO: 4011931 - DNA, 17 bp, Homo sapiens
cggaggccccactgatg

SEQ ID NO: 4011932 - DNA, 14 bp, Homo sapiens
cggaggctgggccc

SEQ ID NO: 4011933 - DNA, 19 bp, Homo sapiens
cggaggctgggcccctggg

SEQ ID NO: 4011934 - DNA, 20 bp, Homo sapiens
cggaggctgggcccctggga

SEQ ID NO: 4011935 - DNA, 14 bp, Homo sapiens
cggaggctgtgctc

SEQ ID NO: 4011936 - DNA, 15 bp, Homo sapiens
cggaggggcctggca

SEQ ID NO: 4011937 - DNA, 18 bp, Homo sapiens
cggaggggcctggcagcc

SEQ ID NO: 4011938 - DNA, 19 bp, Homo sapiens
cggagtcagccaggagctg

SEQ ID NO: 4011939 - DNA, 14 bp, Homo sapiens
cggatcagctgagc

SEQ ID NO: 4011940 - DNA, 13 bp, Homo sapiens
cggatgctgcttc

SEQ ID NO: 4011941 - DNA, 16 bp, Homo sapiens
cggatggatggaaggt

SEQ ID NO: 4011942 - DNA, 13 bp, Homo sapiens
cggattttttcca

SEQ ID NO: 4011943 - DNA, 13 bp, Homo sapiens
cggcaagccacag

SEQ ID NO: 4011944 - DNA, 14 bp, Homo sapiens
cggcaagccacagg

SEQ ID NO: 4011945 - DNA, 22 bp, Homo sapiens
cggcagaaaggaaaacctgaag

SEQ ID NO: 4011946 - DNA, 19 bp, Homo sapiens
cggcaggctcactgccagg

SEQ ID NO: 4011947 - DNA, 22 bp, Homo sapiens
cggcaggctcactgccaggcca

SEQ ID NO: 4011948 - DNA, 18 bp, Homo sapiens
cggcatgtttccagcaga

SEQ ID NO: 4011949 - DNA, 19 bp, Homo sapiens
cggccacgcactgggccac

SEQ ID NO: 4011950 - DNA, 22 bp, Homo sapiens
cggccacgcactgggccacgga

SEQ ID NO: 4011951 - DNA, 20 bp, Homo sapiens
cggccagccccggccctggg

SEQ ID NO: 4011952 - DNA, 18 bp, Homo sapiens
cggccagcgggcacaggg

SEQ ID NO: 4011953 - DNA, 17 bp, Homo sapiens
cggccagcgtcccaggg

SEQ ID NO: 4011954 - DNA, 18 bp, Homo sapiens
cggccagcgtcccagggt

SEQ ID NO: 4011955 - DNA, 13 bp, Homo sapiens
cggccaggcacag

SEQ ID NO: 4011956 - DNA, 14 bp, Homo sapiens
cggccaggcacagg

SEQ ID NO: 4011957 - DNA, 16 bp, Homo sapiens
cggccagggagaagct

SEQ ID NO: 4011958 - DNA, 16 bp, Homo sapiens
cggccccaggagggga

SEQ ID NO: 4011959 - DNA, 17 bp, Homo sapiens
cggccccaggaggggaa

SEQ ID NO: 4011960 - DNA, 21 bp, Homo sapiens
cggccccccgcgctcgcccag

SEQ ID NO: 4011961 - DNA, 22 bp, Homo sapiens
cggcccctgcatccccttggct

SEQ ID NO: 4011962 - DNA, 21 bp, Homo sapiens
cggcccggccagcgggcacag

SEQ ID NO: 4011963 - DNA, 18 bp, Homo sapiens
cggccctcatctatgagg

SEQ ID NO: 4011964 - DNA, 13 bp, Homo sapiens
cggccctgcccaa

SEQ ID NO: 4011965 - DNA, 15 bp, Homo sapiens
cggccgagctggttt

SEQ ID NO: 4011966 - DNA, 23 bp, Homo sapiens
cggccggccagcccctggcccca

SEQ ID NO: 4011967 - DNA, 15 bp, Homo sapiens
cggccggcctggcac

SEQ ID NO: 4011968 - DNA, 12 bp, Homo sapiens
cggcctcagggc

SEQ ID NO: 4011969 - DNA, 13 bp, Homo sapiens
cggcctcagggcg

SEQ ID NO: 4011970 - DNA, 16 bp, Homo sapiens
cggcctccacacctga

SEQ ID NO: 4011971 - DNA, 18 bp, Homo sapiens
cggcctgctcccagcagc

SEQ ID NO: 4011972 - DNA, 20 bp, Homo sapiens
cggcctggatgccagctgtg

SEQ ID NO: 4011973 - DNA, 17 bp, Homo sapiens
cggcctggctgcagctg

SEQ ID NO: 4011974 - DNA, 19 bp, Homo sapiens
cggccttcaactgaaaaga

SEQ ID NO: 4011975 - DNA, 15 bp, Homo sapiens
cggcgatttttgtat

SEQ ID NO: 4011976 - DNA, 15 bp, Homo sapiens
cggcgcccccagtgt

SEQ ID NO: 4011977 - DNA, 18 bp, Homo sapiens
cggcgcccctgccacctc

SEQ ID NO: 4011978 - DNA, 14 bp, Homo sapiens
cggcggccaggcac

SEQ ID NO: 4011979 - DNA, 17 bp, Homo sapiens
cggctcaggctctgctg

SEQ ID NO: 4011980 - DNA, 20 bp, Homo sapiens
cggctccagtccccagaact

SEQ ID NO: 4011981 - DNA, 17 bp, Homo sapiens
ctacatcttcttcccag

SEQ ID NO: 4011982 - DNA, 18 bp, Homo sapiens
ctacatgactgggcctcc

SEQ ID NO: 4011983 - DNA, 13 bp, Homo sapiens
ctacatgagaaca

SEQ ID NO: 4011984 - DNA, 14 bp, Homo sapiens
ctacatgagaacaa

SEQ ID NO: 4011985 - DNA, 23 bp, Homo sapiens
ctacatgcagcccatgcccacct

SEQ ID NO: 4011986 - DNA, 13 bp, Homo sapiens
ctacatgtattgc

SEQ ID NO: 4011987 - DNA, 18 bp, Homo sapiens
ctacatgtattgcacatt

SEQ ID NO: 4011988 - DNA, 18 bp, Homo sapiens
ctacatttgagggcccag

SEQ ID NO: 4011989 - DNA, 13 bp, Homo sapiens
ctaccacaaggaa

SEQ ID NO: 4011990 - DNA, 13 bp, Homo sapiens
ctaccacagtgtc

SEQ ID NO: 4011991 - DNA, 15 bp, Homo sapiens
ctaccagagctctat

SEQ ID NO: 4011992 - DNA, 15 bp, Homo sapiens
ctaccaggcaaattc

SEQ ID NO: 4011993 - DNA, 16 bp, Homo sapiens
ctaccatcagggacag

SEQ ID NO: 4011994 - DNA, 18 bp, Homo sapiens
ctaccatcagggacagga

SEQ ID NO: 4011995 - DNA, 16 bp, Homo sapiens
ctaccatcatccggtt

SEQ ID NO: 4011996 - DNA, 13 bp, Homo sapiens
ctacccaaccact

SEQ ID NO: 4011997 - DNA, 16 bp, Homo sapiens
ctacccaaccactcaa

SEQ ID NO: 4011998 - DNA, 20 bp, Homo sapiens
ctacccacacctctgccaga

SEQ ID NO: 4011999 - DNA, 17 bp, Homo sapiens
ctacccaccgatggagc

SEQ ID NO: 4012000 - DNA, 22 bp, Homo sapiens
ctacccacttctaaatagcaat

SEQ ID NO: 4012001 - DNA, 17 bp, Homo sapiens
ctaccccacaccagcct

SEQ ID NO: 4012002 - DNA, 19 bp, Homo sapiens
ctaccccacaccagccttg

SEQ ID NO: 4012003 - DNA, 20 bp, Homo sapiens
ctaccccagggccctggcca

SEQ ID NO: 4012004 - DNA, 21 bp, Homo sapiens
ctaccccagggccctggccag

SEQ ID NO: 4012005 - DNA, 20 bp, Homo sapiens
ctaccccatatacacctgga

SEQ ID NO: 4012006 - DNA, 14 bp, Homo sapiens
ctacccccttttca

SEQ ID NO: 4012007 - DNA, 21 bp, Homo sapiens
ctacccccttttcagctgagc

SEQ ID NO: 4012008 - DNA, 24 bp, Homo sapiens
ctacccccttttcagctgagccct

SEQ ID NO: 4012009 - DNA, 24 bp, Homo sapiens
ctacccctcccggccctgcctgct

SEQ ID NO: 4012010 - DNA, 12 bp, Homo sapiens
ctaccctcccac

SEQ ID NO: 4012011 - DNA, 14 bp, Homo sapiens
ctaccctcccaccc

SEQ ID NO: 4012012 - DNA, 16 bp, Homo sapiens
ctaccctcccaccccc

SEQ ID NO: 4012013 - DNA, 23 bp, Homo sapiens
ctaccctgctccctgctttggct

SEQ ID NO: 4012014 - DNA, 17 bp, Homo sapiens
ctaccgagtctcttctc

SEQ ID NO: 4012015 - DNA, 21 bp, Homo sapiens
ctaccgagtctcttctccact

SEQ ID NO: 4012016 - DNA, 20 bp, Homo sapiens
ctaccgccctgggctggact

SEQ ID NO: 4012017 - DNA, 21 bp, Homo sapiens
ctaccgccctgggctggactg

SEQ ID NO: 4012018 - DNA, 13 bp, Homo sapiens
ctacctcagcctc

SEQ ID NO: 4012019 - DNA, 17 bp, Homo sapiens
ctacctcaggcagctca

SEQ ID NO: 4012020 - DNA, 20 bp, Homo sapiens
ctacctcaggcaggaagggc

SEQ ID NO: 4012021 - DNA, 23 bp, Homo sapiens
ctacctccctccccgtctcattc

SEQ ID NO: 4012022 - DNA, 16 bp, Homo sapiens
ctacctcccttgcctt

SEQ ID NO: 4012023 - DNA, 16 bp, Homo sapiens
ctacctcctctcctga

SEQ ID NO: 4012024 - DNA, 13 bp, Homo sapiens
ctacctctctgtc

SEQ ID NO: 4012025 - DNA, 20 bp, Homo sapiens
ctacctgattggtgcaaccc

SEQ ID NO: 4012026 - DNA, 14 bp, Homo sapiens
ctacctgccctgga

SEQ ID NO: 4012027 - DNA, 18 bp, Homo sapiens
ctacctgccctggaacat

SEQ ID NO: 4012028 - DNA, 12 bp, Homo sapiens
ctacctgctctc

SEQ ID NO: 4012029 - DNA, 18 bp, Homo sapiens
ctacctgtgtggtactct

SEQ ID NO: 4012030 - DNA, 13 bp, Homo sapiens
ctaccttcctgtc

SEQ ID NO: 4012031 - DNA, 13 bp, Homo sapiens
ctacgaatcttcc

SEQ ID NO: 4012032 - DNA, 23 bp, Homo sapiens
ctacgagtaattgcatttgcttt

SEQ ID NO: 4012033 - DNA, 16 bp, Homo sapiens
ctacgttaagggaagg

SEQ ID NO: 4012034 - DNA, 19 bp, Homo sapiens
ctacgttcctattgtcatt

SEQ ID NO: 4012035 - DNA, 14 bp, Homo sapiens
ctactaaaaatgca

SEQ ID NO: 4012036 - DNA, 17 bp, Homo sapiens
ctactaattccacacct

SEQ ID NO: 4012037 - DNA, 16 bp, Homo sapiens
ctactaccacaaggaa

SEQ ID NO: 4012038 - DNA, 22 bp, Homo sapiens
ctactagagtctgaacagctgt

SEQ ID NO: 4012039 - DNA, 15 bp, Homo sapiens
ctactataaagagaa

SEQ ID NO: 4012040 - DNA, 13 bp, Homo sapiens
ctactatgtgctg

SEQ ID NO: 4012041 - DNA, 16 bp, Homo sapiens
ctactatgtgctgggt

SEQ ID NO: 4012042 - DNA, 14 bp, Homo sapiens
ctactattggccct

SEQ ID NO: 4012043 - DNA, 12 bp, Homo sapiens
ctactattttct

SEQ ID NO: 4012044 - DNA, 15 bp, Homo sapiens
ctactcacagtctct

SEQ ID NO: 4012045 - DNA, 18 bp, Homo sapiens
ctactcacagtctcttta

SEQ ID NO: 4012046 - DNA, 11 bp, Homo sapiens
ctactcctgac

SEQ ID NO: 4012047 - DNA, 13 bp, Homo sapiens
ctactcctgactc

SEQ ID NO: 4012048 - DNA, 14 bp, Homo sapiens
ctactcctgcctca

SEQ ID NO: 4012049 - DNA, 23 bp, Homo sapiens
ctactctccccacgagggctggc

SEQ ID NO: 4012050 - DNA, 21 bp, Homo sapiens
ctactctggaatgtttttccc

SEQ ID NO: 4012051 - DNA, 14 bp, Homo sapiens
ctactctttgattt

SEQ ID NO: 4012052 - DNA, 12 bp, Homo sapiens
ctactgaaacag

SEQ ID NO: 4012053 - DNA, 18 bp, Homo sapiens
ctactgaaacagatttca

SEQ ID NO: 4012054 - DNA, 22 bp, Homo sapiens
ctactgaaacagatttcatacc

SEQ ID NO: 4012055 - DNA, 18 bp, Homo sapiens
ctactgacaacattataa

SEQ ID NO: 4012056 - DNA, 14 bp, Homo sapiens
ctactgacatgtgg

SEQ ID NO: 4012057 - DNA, 20 bp, Homo sapiens
ctactgacatgtggggccag

SEQ ID NO: 4012058 - DNA, 19 bp, Homo sapiens
ctactgcactccagcctgg

SEQ ID NO: 4012059 - DNA, 19 bp, Homo sapiens
ctactgcagcacctccagg

SEQ ID NO: 4012060 - DNA, 11 bp, Homo sapiens
ctactgctgtg

SEQ ID NO: 4012061 - DNA, 14 bp, Homo sapiens
ctactgggagactg

SEQ ID NO: 4012062 - DNA, 14 bp, Homo sapiens
ctactgggtgtcat

SEQ ID NO: 4012063 - DNA, 23 bp, Homo sapiens
ctactgggtgtcatttcattcca

SEQ ID NO: 4012064 - DNA, 17 bp, Homo sapiens
ctactgtaattttatat

SEQ ID NO: 4012065 - DNA, 19 bp, Homo sapiens
ctactgtaattttatatga

SEQ ID NO: 4012066 - DNA, 13 bp, Homo sapiens
ctactgtgttcct

SEQ ID NO: 4012067 - DNA, 15 bp, Homo sapiens
ctacttaattccttt

SEQ ID NO: 4012068 - DNA, 19 bp, Homo sapiens
ctacttagcatcctaagaa

SEQ ID NO: 4012069 - DNA, 20 bp, Homo sapiens
ctacttagcatcctaagaaa

SEQ ID NO: 4012070 - DNA, 22 bp, Homo sapiens
ctacttagcatcctaagaaata

SEQ ID NO: 4012071 - DNA, 16 bp, Homo sapiens
ctacttcatagctcct

SEQ ID NO: 4012072 - DNA, 13 bp, Homo sapiens
ctacttgggaggc

SEQ ID NO: 4012073 - DNA, 16 bp, Homo sapiens
ctacttgggaggctga

SEQ ID NO: 4012074 - DNA, 21 bp, Homo sapiens
ctacttttagttgactcacag

SEQ ID NO: 4012075 - DNA, 20 bp, Homo sapiens
ctagaaattgacacaagtgg

SEQ ID NO: 4012076 - DNA, 17 bp, Homo sapiens
ctagaaccacttcctgc

SEQ ID NO: 4012077 - DNA, 22 bp, Homo sapiens
ctagaagattttgaaattttta

SEQ ID NO: 4012078 - DNA, 11 bp, Homo sapiens
ctagaagcaca

SEQ ID NO: 4012079 - DNA, 12 bp, Homo sapiens
ctagaagcacat

SEQ ID NO: 4012080 - DNA, 12 bp, Homo sapiens
ctagaagccaag

SEQ ID NO: 4012081 - DNA, 21 bp, Homo sapiens
ctagaagtatttttgtctctt

SEQ ID NO: 4012082 - DNA, 19 bp, Homo sapiens
ctagaagtttcccttcctc

SEQ ID NO: 4012083 - DNA, 22 bp, Homo sapiens
ctagaagtttcccttcctccat

SEQ ID NO: 4012084 - DNA, 23 bp, Homo sapiens
ctcaagcaatccacctgccttgg

SEQ ID NO: 4012085 - DNA, 20 bp, Homo sapiens
ctcaagcaatcctcctgcct

SEQ ID NO: 4012086 - DNA, 14 bp, Homo sapiens
ctcaagccccagca

SEQ ID NO: 4012087 - DNA, 16 bp, Homo sapiens
ctcaagccccagcagc

SEQ ID NO: 4012088 - DNA, 19 bp, Homo sapiens
ctcaagccccagcagccct

SEQ ID NO: 4012089 - DNA, 14 bp, Homo sapiens
ctcaagctgcgttt

SEQ ID NO: 4012090 - DNA, 18 bp, Homo sapiens
ctcaaggacttgaaagca

SEQ ID NO: 4012091 - DNA, 20 bp, Homo sapiens
ctcaaggacttgaaagcatc

SEQ ID NO: 4012092 - DNA, 22 bp, Homo sapiens
ctcaaggactttgcagccggca

SEQ ID NO: 4012093 - DNA, 15 bp, Homo sapiens
ctcaataaattgcaa

SEQ ID NO: 4012094 - DNA, 16 bp, Homo sapiens
ctcaatagatctccag

SEQ ID NO: 4012095 - DNA, 16 bp, Homo sapiens
ctcaatcccacatacg

SEQ ID NO: 4012096 - DNA, 19 bp, Homo sapiens
ctcaatcctaatttctcct

SEQ ID NO: 4012097 - DNA, 20 bp, Homo sapiens
ctcaatcctaatttctcctc

SEQ ID NO: 4012098 - DNA, 22 bp, Homo sapiens
ctcaatcctaatttctcctccc

SEQ ID NO: 4012099 - DNA, 23 bp, Homo sapiens
ctcaatcctaatttctcctccct

SEQ ID NO: 4012100 - DNA, 14 bp, Homo sapiens
ctcaatcctctaag

SEQ ID NO: 4012101 - DNA, 15 bp, Homo sapiens
ctcaatgtgaccagg

SEQ ID NO: 4012102 - DNA, 16 bp, Homo sapiens
ctcaatgtgaccaggg

SEQ ID NO: 4012103 - DNA, 18 bp, Homo sapiens
ctcaatgtgaccaggggt

SEQ ID NO: 4012104 - DNA, 13 bp, Homo sapiens
ctcaattatttgc

SEQ ID NO: 4012105 - DNA, 23 bp, Homo sapiens
ctcaattttatccctcacctgta

SEQ ID NO: 4012106 - DNA, 16 bp, Homo sapiens
ctcaatttttgtctca

SEQ ID NO: 4012107 - DNA, 18 bp, Homo sapiens
ctcacaaaatcactttaa

SEQ ID NO: 4012108 - DNA, 16 bp, Homo sapiens
ctcacaaagtgctggg

SEQ ID NO: 4012109 - DNA, 23 bp, Homo sapiens
ctcacaacttagtgtaatatacc

SEQ ID NO: 4012110 - DNA, 13 bp, Homo sapiens
ctcacacacacag

SEQ ID NO: 4012111 - DNA, 12 bp, Homo sapiens
ctcacacccctg

SEQ ID NO: 4012112 - DNA, 13 bp, Homo sapiens
ctcacacccctgt

SEQ ID NO: 4012113 - DNA, 18 bp, Homo sapiens
ctcacactggtctgctgt

SEQ ID NO: 4012114 - DNA, 22 bp, Homo sapiens
ctcacagtgtggggcagccgtc

SEQ ID NO: 4012115 - DNA, 21 bp, Homo sapiens
ctcacattcgacataccccac

SEQ ID NO: 4012116 - DNA, 15 bp, Homo sapiens
ctcaccagccctgca

SEQ ID NO: 4012117 - DNA, 23 bp, Homo sapiens
ctcaccagtgtcccctccactgt

SEQ ID NO: 4012118 - DNA, 14 bp, Homo sapiens
ctcaccatgtaaaa

SEQ ID NO: 4012119 - DNA, 20 bp, Homo sapiens
ctcacccatcccacccctcc

SEQ ID NO: 4012120 - DNA, 22 bp, Homo sapiens
ctcaccccatcccacaccctgg

SEQ ID NO: 4012121 - DNA, 13 bp, Homo sapiens
ctcacccctgggc

SEQ ID NO: 4012122 - DNA, 15 bp, Homo sapiens
ctcacccctgggcag

SEQ ID NO: 4012123 - DNA, 16 bp, Homo sapiens
ctcacccctgggcagg

SEQ ID NO: 4012124 - DNA, 17 bp, Homo sapiens
ctcacccctgggcaggc

SEQ ID NO: 4012125 - DNA, 13 bp, Homo sapiens
ctcaccctgcctt

SEQ ID NO: 4012126 - DNA, 14 bp, Homo sapiens
ctcaccctgcctta

SEQ ID NO: 4012127 - DNA, 21 bp, Homo sapiens
ctcaccctgccttatcttgca

SEQ ID NO: 4012128 - DNA, 13 bp, Homo sapiens
ctcaccctgggag

SEQ ID NO: 4012129 - DNA, 14 bp, Homo sapiens
ctcacctcatgccc

SEQ ID NO: 4012130 - DNA, 15 bp, Homo sapiens
ctcacctcatgccca

SEQ ID NO: 4012131 - DNA, 15 bp, Homo sapiens
ctcacctctggactg

SEQ ID NO: 4012132 - DNA, 18 bp, Homo sapiens
ctcaccttgggctggggg

SEQ ID NO: 4012133 - DNA, 23 bp, Homo sapiens
ctcacgcttacctcaaccatcct

SEQ ID NO: 4012134 - DNA, 15 bp, Homo sapiens
ctcacggggcctcca

SEQ ID NO: 4012135 - DNA, 14 bp, Homo sapiens
ctcactagtgccaa

SEQ ID NO: 4012136 - DNA, 22 bp, Homo sapiens
ctcactagtgtcaggcccccag

SEQ ID NO: 4012137 - DNA, 11 bp, Homo sapiens
ctcactatgac

SEQ ID NO: 4012138 - DNA, 22 bp, Homo sapiens
ctcactatggtatgctggccag

SEQ ID NO: 4012139 - DNA, 19 bp, Homo sapiens
ctcactattcttggaccat

SEQ ID NO: 4012140 - DNA, 21 bp, Homo sapiens
ctcactcagaagtccagagtc

SEQ ID NO: 4012141 - DNA, 18 bp, Homo sapiens
ctcactccacagagtgag

SEQ ID NO: 4012142 - DNA, 15 bp, Homo sapiens
ctcactcccagtcca

SEQ ID NO: 4012143 - DNA, 13 bp, Homo sapiens
ctcactccccagg

SEQ ID NO: 4012144 - DNA, 19 bp, Homo sapiens
ctcactcctaggagagcca

SEQ ID NO: 4012145 - DNA, 12 bp, Homo sapiens
ctcactcctgtt

SEQ ID NO: 4012146 - DNA, 20 bp, Homo sapiens
ctcactcctgttacttacct

SEQ ID NO: 4012147 - DNA, 11 bp, Homo sapiens
ctcactctggg

SEQ ID NO: 4012148 - DNA, 13 bp, Homo sapiens
ctcactctgggct

SEQ ID NO: 4012149 - DNA, 14 bp, Homo sapiens
ctcactctgggctg

SEQ ID NO: 4012150 - DNA, 12 bp, Homo sapiens
ctcactctgtca

SEQ ID NO: 4012151 - DNA, 18 bp, Homo sapiens
ctcactctgtcagccagc

SEQ ID NO: 4012152 - DNA, 19 bp, Homo sapiens
ctcactctgtcagccagcc

SEQ ID NO: 4012153 - DNA, 12 bp, Homo sapiens
ctcactgaagcc

SEQ ID NO: 4012154 - DNA, 15 bp, Homo sapiens
ctcactgaagcctgc

SEQ ID NO: 4012155 - DNA, 22 bp, Homo sapiens
ctcactgaaggacctgagctgg

SEQ ID NO: 4012156 - DNA, 22 bp, Homo sapiens
ctcactgagaagattgtgaata

SEQ ID NO: 4012157 - DNA, 14 bp, Homo sapiens
ctcactgcagcctc

SEQ ID NO: 4012158 - DNA, 20 bp, Homo sapiens
ctcactgccaggccagcctc

SEQ ID NO: 4012159 - DNA, 21 bp, Homo sapiens
ctcactgctcaagaagacatg

SEQ ID NO: 4012160 - DNA, 13 bp, Homo sapiens
ctcactggggcct

SEQ ID NO: 4012161 - DNA, 13 bp, Homo sapiens
ctcactgggtggg

SEQ ID NO: 4012162 - DNA, 22 bp, Homo sapiens
ctcactgtgatcaatattttta

SEQ ID NO: 4012163 - DNA, 18 bp, Homo sapiens
ctcactgttccctctgct

SEQ ID NO: 4012164 - DNA, 21 bp, Homo sapiens
ctcactgttccctctgctcct

SEQ ID NO: 4012165 - DNA, 15 bp, Homo sapiens
ctcactgttctgcaa

SEQ ID NO: 4012166 - DNA, 14 bp, Homo sapiens
ctcacttagtcctt

SEQ ID NO: 4012167 - DNA, 20 bp, Homo sapiens
ctcacttccatacagctcta

SEQ ID NO: 4012168 - DNA, 12 bp, Homo sapiens
ctcacttggggg

SEQ ID NO: 4012169 - DNA, 14 bp, Homo sapiens
ctcacttgggggaa

SEQ ID NO: 4012170 - DNA, 16 bp, Homo sapiens
ctcactttattatccc

SEQ ID NO: 4012171 - DNA, 18 bp, Homo sapiens
ctcagaaagtcaccagga

SEQ ID NO: 4012172 - DNA, 20 bp, Homo sapiens
ctcagaaagtcaccaggact

SEQ ID NO: 4012173 - DNA, 15 bp, Homo sapiens
ctcagaaagtgcctg

SEQ ID NO: 4012174 - DNA, 22 bp, Homo sapiens
ctcagaaagtgcctgacacact

SEQ ID NO: 4012175 - DNA, 13 bp, Homo sapiens
ctcagaagcacag

SEQ ID NO: 4012176 - DNA, 13 bp, Homo sapiens
ctcagaaggtatt

SEQ ID NO: 4012177 - DNA, 17 bp, Homo sapiens
ctcagaatgtaaaagaa

SEQ ID NO: 4012178 - DNA, 15 bp, Homo sapiens
ctcagacggcggcca

SEQ ID NO: 4012179 - DNA, 16 bp, Homo sapiens
ctcagacggcggccag

SEQ ID NO: 4012180 - DNA, 21 bp, Homo sapiens
ctcagacggcggccaggcaca

SEQ ID NO: 4012181 - DNA, 23 bp, Homo sapiens
ctcagacggcggccaggcacagg

SEQ ID NO: 4012182 - DNA, 15 bp, Homo sapiens
ctcagacgttgcctg

SEQ ID NO: 4012183 - DNA, 16 bp, Homo sapiens
ctcagacgttgcctga

SEQ ID NO: 4012184 - DNA, 14 bp, Homo sapiens
ctcagactccgccc

SEQ ID NO: 4012185 - DNA, 20 bp, Homo sapiens
ctcagagaaaaatgctcccc

SEQ ID NO: 4012186 - DNA, 17 bp, Homo sapiens
ctcagagaaggaaaaga

SEQ ID NO: 4012187 - DNA, 14 bp, Homo sapiens
ctcccatccagggc

SEQ ID NO: 4012188 - DNA, 15 bp, Homo sapiens
ctcccatcccctgga

SEQ ID NO: 4012189 - DNA, 23 bp, Homo sapiens
ctcccatcccctggactgggagg

SEQ ID NO: 4012190 - DNA, 18 bp, Homo sapiens
ctcccatccttccctcat

SEQ ID NO: 4012191 - DNA, 16 bp, Homo sapiens
ctcccatgaccatact

SEQ ID NO: 4012192 - DNA, 14 bp, Homo sapiens
ctcccattcctgaa

SEQ ID NO: 4012193 - DNA, 17 bp, Homo sapiens
ctcccattcctgaagaa

SEQ ID NO: 4012194 - DNA, 21 bp, Homo sapiens
ctccccaaggccccctgcctg

SEQ ID NO: 4012195 - DNA, 23 bp, Homo sapiens
ctccccaaggccccctgcctgcc

SEQ ID NO: 4012196 - DNA, 16 bp, Homo sapiens
ctccccaattctcccc

SEQ ID NO: 4012197 - DNA, 21 bp, Homo sapiens
ctccccacactaacctgggtt

SEQ ID NO: 4012198 - DNA, 15 bp, Homo sapiens
ctccccacagcgtcc

SEQ ID NO: 4012199 - DNA, 20 bp, Homo sapiens
ctccccacagcgtccctggc

SEQ ID NO: 4012200 - DNA, 20 bp, Homo sapiens
ctccccacatcgcacactgg

SEQ ID NO: 4012201 - DNA, 15 bp, Homo sapiens
ctccccacgagggct

SEQ ID NO: 4012202 - DNA, 12 bp, Homo sapiens
ctccccactcta

SEQ ID NO: 4012203 - DNA, 13 bp, Homo sapiens
ctccccagcccag

SEQ ID NO: 4012204 - DNA, 16 bp, Homo sapiens
ctccccagcccagaga

SEQ ID NO: 4012205 - DNA, 15 bp, Homo sapiens
ctccccagccctggc

SEQ ID NO: 4012206 - DNA, 21 bp, Homo sapiens
ctccccaggccaggccaccag

SEQ ID NO: 4012207 - DNA, 20 bp, Homo sapiens
ctccccagggagctctgggg

SEQ ID NO: 4012208 - DNA, 22 bp, Homo sapiens
ctccccagggagctctggggac

SEQ ID NO: 4012209 - DNA, 22 bp, Homo sapiens
ctccccagtctctcttaaagtt

SEQ ID NO: 4012210 - DNA, 11 bp, Homo sapiens
ctccccagtgt

SEQ ID NO: 4012211 - DNA, 11 bp, Homo sapiens
ctccccagttc

SEQ ID NO: 4012212 - DNA, 21 bp, Homo sapiens
ctccccatgtgtcctggttcc

SEQ ID NO: 4012213 - DNA, 21 bp, Homo sapiens
ctcccccaacccccaccccac

SEQ ID NO: 4012214 - DNA, 12 bp, Homo sapiens
ctcccccatcct

SEQ ID NO: 4012215 - DNA, 13 bp, Homo sapiens
ctcccccccatgc

SEQ ID NO: 4012216 - DNA, 15 bp, Homo sapiens
ctcccccccatgcac

SEQ ID NO: 4012217 - DNA, 17 bp, Homo sapiens
ctcccccgtttctcctt

SEQ ID NO: 4012218 - DNA, 12 bp, Homo sapiens
ctccccctcaga

SEQ ID NO: 4012219 - DNA, 13 bp, Homo sapiens
ctccccctcccca

SEQ ID NO: 4012220 - DNA, 14 bp, Homo sapiens
ctccccctccccag

SEQ ID NO: 4012221 - DNA, 15 bp, Homo sapiens
ctccccctcctccag

SEQ ID NO: 4012222 - DNA, 12 bp, Homo sapiens
ctccccctgcaa

SEQ ID NO: 4012223 - DNA, 23 bp, Homo sapiens
ctcccccttccccttctgtgtca

SEQ ID NO: 4012224 - DNA, 14 bp, Homo sapiens
ctcccccttttccc

SEQ ID NO: 4012225 - DNA, 20 bp, Homo sapiens
ctccccgcccctgtggccct

SEQ ID NO: 4012226 - DNA, 22 bp, Homo sapiens
ctccccgcccctgtggccctgg

SEQ ID NO: 4012227 - DNA, 23 bp, Homo sapiens
ctccccgcccctgtggccctggc

SEQ ID NO: 4012228 - DNA, 18 bp, Homo sapiens
ctccccgccttagagcct

SEQ ID NO: 4012229 - DNA, 14 bp, Homo sapiens
ctccccgcttctgc

SEQ ID NO: 4012230 - DNA, 15 bp, Homo sapiens
ctccccggacatact

SEQ ID NO: 4012231 - DNA, 16 bp, Homo sapiens
ctccccggacatactc

SEQ ID NO: 4012232 - DNA, 12 bp, Homo sapiens
ctcccctcccag

SEQ ID NO: 4012233 - DNA, 15 bp, Homo sapiens
ctcccctcccagtcc

SEQ ID NO: 4012234 - DNA, 22 bp, Homo sapiens
ctcccctcccagtcctccagac

SEQ ID NO: 4012235 - DNA, 22 bp, Homo sapiens
ctcccctgacctgtgagcccag

SEQ ID NO: 4012236 - DNA, 13 bp, Homo sapiens
ctcccctgggggt

SEQ ID NO: 4012237 - DNA, 16 bp, Homo sapiens
ctcccctgtgccagcc

SEQ ID NO: 4012238 - DNA, 14 bp, Homo sapiens
ctccccttccattt

SEQ ID NO: 4012239 - DNA, 16 bp, Homo sapiens
ctccccttccatttct

SEQ ID NO: 4012240 - DNA, 22 bp, Homo sapiens
ctccccttgatttaaacacaca

SEQ ID NO: 4012241 - DNA, 23 bp, Homo sapiens
ctccccttgatttaaacacacag

SEQ ID NO: 4012242 - DNA, 18 bp, Homo sapiens
ctcccgcaccaggccggg

SEQ ID NO: 4012243 - DNA, 23 bp, Homo sapiens
ctcccgcccaaacctttccccca

SEQ ID NO: 4012244 - DNA, 21 bp, Homo sapiens
ctcccgcccttccatgtgcct

SEQ ID NO: 4012245 - DNA, 22 bp, Homo sapiens
ctcccgcctcagggccaggccc

SEQ ID NO: 4012246 - DNA, 15 bp, Homo sapiens
ctcccgctccgggct

SEQ ID NO: 4012247 - DNA, 14 bp, Homo sapiens
ctcccggagcctgt

SEQ ID NO: 4012248 - DNA, 20 bp, Homo sapiens
ctcccggaggttgggtgggc

SEQ ID NO: 4012249 - DNA, 17 bp, Homo sapiens
ctcccggcatgggaaag

SEQ ID NO: 4012250 - DNA, 16 bp, Homo sapiens
ctcccggccctgcctg

SEQ ID NO: 4012251 - DNA, 17 bp, Homo sapiens
ctcccggccctgcctgc

SEQ ID NO: 4012252 - DNA, 18 bp, Homo sapiens
ctcccggccctgcctgct

SEQ ID NO: 4012253 - DNA, 21 bp, Homo sapiens
ctcccgggccacgccccagcc

SEQ ID NO: 4012254 - DNA, 15 bp, Homo sapiens
ctcccggtgcccaag

SEQ ID NO: 4012255 - DNA, 21 bp, Homo sapiens
ctcccggtgcccaagaataga

SEQ ID NO: 4012256 - DNA, 20 bp, Homo sapiens
ctccctcactgaaggacctg

SEQ ID NO: 4012257 - DNA, 19 bp, Homo sapiens
ctccctcagcctcagagga

SEQ ID NO: 4012258 - DNA, 18 bp, Homo sapiens
ctccctcagctctctggg

SEQ ID NO: 4012259 - DNA, 17 bp, Homo sapiens
ctccctcaggctctgtg

SEQ ID NO: 4012260 - DNA, 20 bp, Homo sapiens
ctccctcaggctctgtggag

SEQ ID NO: 4012261 - DNA, 16 bp, Homo sapiens
ctccctccacctcaag

SEQ ID NO: 4012262 - DNA, 16 bp, Homo sapiens
ctccctcccctgccct

SEQ ID NO: 4012263 - DNA, 18 bp, Homo sapiens
ctccctcccctgccctgg

SEQ ID NO: 4012264 - DNA, 23 bp, Homo sapiens
ctccctcccctgccctggtccag

SEQ ID NO: 4012265 - DNA, 14 bp, Homo sapiens
ctccctcctcacct

SEQ ID NO: 4012266 - DNA, 14 bp, Homo sapiens
ctccctcctccagg

SEQ ID NO: 4012267 - DNA, 13 bp, Homo sapiens
ctccctccttggg

SEQ ID NO: 4012268 - DNA, 23 bp, Homo sapiens
ctccctcgacagcgcccctgctg

SEQ ID NO: 4012269 - DNA, 15 bp, Homo sapiens
ctccctctctcttct

SEQ ID NO: 4012270 - DNA, 18 bp, Homo sapiens
ctccctctgatttttcat

SEQ ID NO: 4012271 - DNA, 21 bp, Homo sapiens
ctccctgaaaatgtttttctg

SEQ ID NO: 4012272 - DNA, 15 bp, Homo sapiens
ctccctgactggcct

SEQ ID NO: 4012273 - DNA, 17 bp, Homo sapiens
ctccctgatgacaccca

SEQ ID NO: 4012274 - DNA, 20 bp, Homo sapiens
ctccctgcccctcccttcaa

SEQ ID NO: 4012275 - DNA, 14 bp, Homo sapiens
ctccctgcctgagg

SEQ ID NO: 4012276 - DNA, 13 bp, Homo sapiens
ctccctgcctggc

SEQ ID NO: 4012277 - DNA, 16 bp, Homo sapiens
ctccctgcctggcccc

SEQ ID NO: 4012278 - DNA, 17 bp, Homo sapiens
ctccctgctccacgaag

SEQ ID NO: 4012279 - DNA, 19 bp, Homo sapiens
ctccctgcttgcaggaggc

SEQ ID NO: 4012280 - DNA, 22 bp, Homo sapiens
ctccctgctttggctgaggggc

SEQ ID NO: 4012281 - DNA, 22 bp, Homo sapiens
ctccctggagtgcagtttccaa

SEQ ID NO: 4012282 - DNA, 23 bp, Homo sapiens
ctccctggagtgtggctgaggag

SEQ ID NO: 4012283 - DNA, 14 bp, Homo sapiens
ctccctggctccca

SEQ ID NO: 4012284 - DNA, 15 bp, Homo sapiens
ctccctggctccctc

SEQ ID NO: 4012285 - DNA, 16 bp, Homo sapiens
ctccctggctccctcc

SEQ ID NO: 4012286 - DNA, 16 bp, Homo sapiens
ctccctggctctcaga

SEQ ID NO: 4012287 - DNA, 20 bp, Homo sapiens
ctccctggctctcagaaggt

SEQ ID NO: 4012288 - DNA, 19 bp, Homo sapiens
ctccctgggacacagaccc

SEQ ID NO: 4012289 - DNA, 17 bp, Homo sapiens
ctctctgggctgactgg

SEQ ID NO: 4012290 - DNA, 17 bp, Homo sapiens
ctctctggggccctggg

SEQ ID NO: 4012291 - DNA, 19 bp, Homo sapiens
ctctctggggccctgggcc

SEQ ID NO: 4012292 - DNA, 13 bp, Homo sapiens
ctctcttcccctt

SEQ ID NO: 4012293 - DNA, 20 bp, Homo sapiens
ctctcttccctttccccagc

SEQ ID NO: 4012294 - DNA, 12 bp, Homo sapiens
ctctcttctgct

SEQ ID NO: 4012295 - DNA, 15 bp, Homo sapiens
ctctcttctgctcca

SEQ ID NO: 4012296 - DNA, 18 bp, Homo sapiens
ctctcttgtcctcttctg

SEQ ID NO: 4012297 - DNA, 18 bp, Homo sapiens
ctctctttatacagctgt

SEQ ID NO: 4012298 - DNA, 19 bp, Homo sapiens
ctctctttatacagctgta

SEQ ID NO: 4012299 - DNA, 19 bp, Homo sapiens
ctctctttcctccacccat

SEQ ID NO: 4012300 - DNA, 19 bp, Homo sapiens
ctctgaacacaggcagctt

SEQ ID NO: 4012301 - DNA, 22 bp, Homo sapiens
ctctgaacacaggcagctttct

SEQ ID NO: 4012302 - DNA, 18 bp, Homo sapiens
ctctgaagatgatcattt

SEQ ID NO: 4012303 - DNA, 19 bp, Homo sapiens
ctctgaaggagttacaggg

SEQ ID NO: 4012304 - DNA, 22 bp, Homo sapiens
ctctgaaggagttacagggaag

SEQ ID NO: 4012305 - DNA, 17 bp, Homo sapiens
ctctgaatggtccaggg

SEQ ID NO: 4012306 - DNA, 18 bp, Homo sapiens
ctctgaatggtccagggt

SEQ ID NO: 4012307 - DNA, 13 bp, Homo sapiens
ctctgacaaagct

SEQ ID NO: 4012308 - DNA, 22 bp, Homo sapiens
ctctgaccctctggaaatatgt

SEQ ID NO: 4012309 - DNA, 16 bp, Homo sapiens
ctctgactctgagtcc

SEQ ID NO: 4012310 - DNA, 19 bp, Homo sapiens
ctctgacttaagcaaaaga

SEQ ID NO: 4012311 - DNA, 18 bp, Homo sapiens
ctctgagaattccaagga

SEQ ID NO: 4012312 - DNA, 19 bp, Homo sapiens
ctctgagaattccaaggag

SEQ ID NO: 4012313 - DNA, 20 bp, Homo sapiens
ctctgagatgtggagactga

SEQ ID NO: 4012314 - DNA, 13 bp, Homo sapiens
ctctgagcccagc

SEQ ID NO: 4012315 - DNA, 19 bp, Homo sapiens
ctctgagcccatacttttg

SEQ ID NO: 4012316 - DNA, 15 bp, Homo sapiens
ctctgagctgctcac

SEQ ID NO: 4012317 - DNA, 19 bp, Homo sapiens
ctctgaggtgcctgtccca

SEQ ID NO: 4012318 - DNA, 12 bp, Homo sapiens
ctctgagtctgg

SEQ ID NO: 4012319 - DNA, 16 bp, Homo sapiens
ctctgagtctggactt

SEQ ID NO: 4012320 - DNA, 16 bp, Homo sapiens
ctctgagtttaccatt

SEQ ID NO: 4012321 - DNA, 18 bp, Homo sapiens
ctctgagtttaccatttg

SEQ ID NO: 4012322 - DNA, 22 bp, Homo sapiens
ctctgagtttaccatttgtaat

SEQ ID NO: 4012323 - DNA, 23 bp, Homo sapiens
ctctgataaaagggcaaatctgc

SEQ ID NO: 4012324 - DNA, 19 bp, Homo sapiens
ctctgatattccatgaatg

SEQ ID NO: 4012325 - DNA, 23 bp, Homo sapiens
ctctgatattccatgaatgtatc

SEQ ID NO: 4012326 - DNA, 16 bp, Homo sapiens
ctctgatcttgtgctc

SEQ ID NO: 4012327 - DNA, 17 bp, Homo sapiens
ctctgatcttgtgctca

SEQ ID NO: 4012328 - DNA, 14 bp, Homo sapiens
ctctgatgtcccag

SEQ ID NO: 4012329 - DNA, 16 bp, Homo sapiens
ctctgatgtcccagtg

SEQ ID NO: 4012330 - DNA, 20 bp, Homo sapiens
ctctgcaagcttcttgctga

SEQ ID NO: 4012331 - DNA, 23 bp, Homo sapiens
ctctgcaatgggcactgggatga

SEQ ID NO: 4012332 - DNA, 17 bp, Homo sapiens
ctctgcaattcccctct

SEQ ID NO: 4012333 - DNA, 23 bp, Homo sapiens
ctctgcaattcccctctgctgct

SEQ ID NO: 4012334 - DNA, 14 bp, Homo sapiens
ctctgcacagatgg

SEQ ID NO: 4012335 - DNA, 10 bp, Homo sapiens
ctctgcaccc

SEQ ID NO: 4012336 - DNA, 15 bp, Homo sapiens
ctctgcacccacgtg

SEQ ID NO: 4012337 - DNA, 17 bp, Homo sapiens
ctctgcacccacgtgca

SEQ ID NO: 4012338 - DNA, 14 bp, Homo sapiens
ctctgcactaagag

SEQ ID NO: 4012339 - DNA, 12 bp, Homo sapiens
ctctgcagctgc

SEQ ID NO: 4012340 - DNA, 17 bp, Homo sapiens
ctctgcagtctcatttc

SEQ ID NO: 4012341 - DNA, 14 bp, Homo sapiens
ctctgcatcccagc

SEQ ID NO: 4012342 - DNA, 15 bp, Homo sapiens
ctctgcatcccagca

SEQ ID NO: 4012343 - DNA, 18 bp, Homo sapiens
ctctgcatcccagcacct

SEQ ID NO: 4012344 - DNA, 22 bp, Homo sapiens
ctctgcatcccagcacctgcct

SEQ ID NO: 4012345 - DNA, 16 bp, Homo sapiens
ctctgccacccactca

SEQ ID NO: 4012346 - DNA, 17 bp, Homo sapiens
ctctgccacccactcag

SEQ ID NO: 4012347 - DNA, 18 bp, Homo sapiens
ctctgccacccactcagg

SEQ ID NO: 4012348 - DNA, 20 bp, Homo sapiens
ctctgccacccactcaggat

SEQ ID NO: 4012349 - DNA, 20 bp, Homo sapiens
ctctgcccctcccaacccag

SEQ ID NO: 4012350 - DNA, 14 bp, Homo sapiens
ctctgccctggatt

SEQ ID NO: 4012351 - DNA, 15 bp, Homo sapiens
ctctgccctggattg

SEQ ID NO: 4012352 - DNA, 21 bp, Homo sapiens
ctctgccgctacctccctccc

SEQ ID NO: 4012353 - DNA, 24 bp, Homo sapiens
ctctgccggtcgggcagccagcag

SEQ ID NO: 4012354 - DNA, 14 bp, Homo sapiens
ctctgcctacagcc

SEQ ID NO: 4012355 - DNA, 22 bp, Homo sapiens
ctctgcctcagacgttgcctga

SEQ ID NO: 4012356 - DNA, 15 bp, Homo sapiens
ctctgcctccaccct

SEQ ID NO: 4012357 - DNA, 15 bp, Homo sapiens
ctctgcctcccaggt

SEQ ID NO: 4012358 - DNA, 11 bp, Homo sapiens
ctctgcctgcc

SEQ ID NO: 4012359 - DNA, 23 bp, Homo sapiens
ctctgcctggtggtcagatgcag

SEQ ID NO: 4012360 - DNA, 15 bp, Homo sapiens
ctctgcctttgacat

SEQ ID NO: 4012361 - DNA, 19 bp, Homo sapiens
ctctgctacgttcctattg

SEQ ID NO: 4012362 - DNA, 13 bp, Homo sapiens
ctctgctcagcca

SEQ ID NO: 4012363 - DNA, 13 bp, Homo sapiens
ctctgctccacca

SEQ ID NO: 4012364 - DNA, 15 bp, Homo sapiens
ctctgctccaccaca

SEQ ID NO: 4012365 - DNA, 19 bp, Homo sapiens
ctctgctccaccacatcct

SEQ ID NO: 4012366 - DNA, 13 bp, Homo sapiens
ctctgctccccag

SEQ ID NO: 4012367 - DNA, 16 bp, Homo sapiens
ctctgctccccctttt

SEQ ID NO: 4012368 - DNA, 11 bp, Homo sapiens
ctctgctctga

SEQ ID NO: 4012369 - DNA, 14 bp, Homo sapiens
ctctgctctgtcct

SEQ ID NO: 4012370 - DNA, 15 bp, Homo sapiens
ctctgctgaatgcag

SEQ ID NO: 4012371 - DNA, 21 bp, Homo sapiens
ctctgctgctgtccctccccc

SEQ ID NO: 4012372 - DNA, 22 bp, Homo sapiens
ctctgctgctgtccctccccct

SEQ ID NO: 4012373 - DNA, 11 bp, Homo sapiens
ctctgctgtgg

SEQ ID NO: 4012374 - DNA, 22 bp, Homo sapiens
ctctggaaagaggctctggaca

SEQ ID NO: 4012375 - DNA, 21 bp, Homo sapiens
ctctggaagagaggaatgcct

SEQ ID NO: 4012376 - DNA, 18 bp, Homo sapiens
ctctggaagccctggaga

SEQ ID NO: 4012377 - DNA, 15 bp, Homo sapiens
ctctggaataaagtt

SEQ ID NO: 4012378 - DNA, 22 bp, Homo sapiens
ctctggaataaagttgcagatg

SEQ ID NO: 4012379 - DNA, 15 bp, Homo sapiens
ctctggaatgcactg

SEQ ID NO: 4012380 - DNA, 16 bp, Homo sapiens
ctctggaatgcactga

SEQ ID NO: 4012381 - DNA, 18 bp, Homo sapiens
ctctggacagcagaagcc

SEQ ID NO: 4012382 - DNA, 16 bp, Homo sapiens
ctctggacggcaggct

SEQ ID NO: 4012383 - DNA, 23 bp, Homo sapiens
ctctggacggcaggctcactgcc

SEQ ID NO: 4012384 - DNA, 13 bp, Homo sapiens
ctctggactggct

SEQ ID NO: 4012385 - DNA, 14 bp, Homo sapiens
ctctggactggcta

SEQ ID NO: 4012386 - DNA, 19 bp, Homo sapiens
ctctggaggggtgtggctc

SEQ ID NO: 4012387 - DNA, 21 bp, Homo sapiens
ctctggaggggtgtggctcct

SEQ ID NO: 4012388 - DNA, 19 bp, Homo sapiens
ctctggcagttctggaatg

SEQ ID NO: 4012389 - DNA, 19 bp, Homo sapiens
ctctggcattagaattatt

SEQ ID NO: 4012390 - DNA, 16 bp, Homo sapiens
ctctggccctggccct

SEQ ID NO: 4012391 - DNA, 19 bp, Homo sapiens
ctctggctagaggccagcc

SEQ ID NO: 4012392 - DNA, 23 bp, Homo sapiens
ctcttgatgtgaagataatttgc

SEQ ID NO: 4012393 - DNA, 15 bp, Homo sapiens
ctcttgattcctggt

SEQ ID NO: 4012394 - DNA, 19 bp, Homo sapiens
ctcttgctcaaaaatctgt

SEQ ID NO: 4012395 - DNA, 15 bp, Homo sapiens
ctcttgctgtctctg

SEQ ID NO: 4012396 - DNA, 17 bp, Homo sapiens
ctcttgctgtctctgct

SEQ ID NO: 4012397 - DNA, 14 bp, Homo sapiens
ctcttgctttctat

SEQ ID NO: 4012398 - DNA, 15 bp, Homo sapiens
ctcttggagctgtga

SEQ ID NO: 4012399 - DNA, 16 bp, Homo sapiens
ctcttggcctttgcat

SEQ ID NO: 4012400 - DNA, 20 bp, Homo sapiens
ctcttggcctttgcatttat

SEQ ID NO: 4012401 - DNA, 13 bp, Homo sapiens
ctcttggctgacc

SEQ ID NO: 4012402 - DNA, 15 bp, Homo sapiens
ctcttggctgacccc

SEQ ID NO: 4012403 - DNA, 16 bp, Homo sapiens
ctcttggctgacccct

SEQ ID NO: 4012404 - DNA, 17 bp, Homo sapiens
ctcttggtcagcttttg

SEQ ID NO: 4012405 - DNA, 22 bp, Homo sapiens
ctcttggttcgatacctggagc

SEQ ID NO: 4012406 - DNA, 16 bp, Homo sapiens
ctcttgtcccacgtgt

SEQ ID NO: 4012407 - DNA, 18 bp, Homo sapiens
ctcttgtcccacgtgtct

SEQ ID NO: 4012408 - DNA, 21 bp, Homo sapiens
ctcttgtcctcagtccattta

SEQ ID NO: 4012409 - DNA, 19 bp, Homo sapiens
ctcttgtgcaaggtggcct

SEQ ID NO: 4012410 - DNA, 20 bp, Homo sapiens
ctcttgtgcaaggtggcctt

SEQ ID NO: 4012411 - DNA, 21 bp, Homo sapiens
ctcttgtgcaaggtggccttt

SEQ ID NO: 4012412 - DNA, 20 bp, Homo sapiens
ctcttgtttttattaattta

SEQ ID NO: 4012413 - DNA, 21 bp, Homo sapiens
ctcttgtttttattaatttat

SEQ ID NO: 4012414 - DNA, 23 bp, Homo sapiens
ctcttgtttttattaatttatat

SEQ ID NO: 4012415 - DNA, 20 bp, Homo sapiens
ctctttaaaaggaaagaaaa

SEQ ID NO: 4012416 - DNA, 21 bp, Homo sapiens
ctctttaagagttagtttctt

SEQ ID NO: 4012417 - DNA, 19 bp, Homo sapiens
ctctttaagggcatgcctt

SEQ ID NO: 4012418 - DNA, 20 bp, Homo sapiens
ctctttaagggcatgccttg

SEQ ID NO: 4012419 - DNA, 16 bp, Homo sapiens
ctctttaatcttcagt

SEQ ID NO: 4012420 - DNA, 18 bp, Homo sapiens
ctctttatcaagcaacat

SEQ ID NO: 4012421 - DNA, 13 bp, Homo sapiens
ctctttattttcc

SEQ ID NO: 4012422 - DNA, 22 bp, Homo sapiens
ctctttattttcccctatcatt

SEQ ID NO: 4012423 - DNA, 14 bp, Homo sapiens
ctctttcacattgt

SEQ ID NO: 4012424 - DNA, 22 bp, Homo sapiens
ctctttccagtggatcataaga

SEQ ID NO: 4012425 - DNA, 15 bp, Homo sapiens
ctctttcccacccag

SEQ ID NO: 4012426 - DNA, 12 bp, Homo sapiens
ctctttccctgc

SEQ ID NO: 4012427 - DNA, 17 bp, Homo sapiens
ctctttcccttccagtt

SEQ ID NO: 4012428 - DNA, 23 bp, Homo sapiens
ctctttcccttccagtttattcc

SEQ ID NO: 4012429 - DNA, 13 bp, Homo sapiens
ctctttcctccac

SEQ ID NO: 4012430 - DNA, 16 bp, Homo sapiens
ctctttcgtcaccctt

SEQ ID NO: 4012431 - DNA, 18 bp, Homo sapiens
ctctttcgtcacccttgg

SEQ ID NO: 4012432 - DNA, 19 bp, Homo sapiens
ctctttcgtcacccttgga

SEQ ID NO: 4012433 - DNA, 16 bp, Homo sapiens
ctctttctaatgctga

SEQ ID NO: 4012434 - DNA, 18 bp, Homo sapiens
ctctttctccttagtctt

SEQ ID NO: 4012435 - DNA, 15 bp, Homo sapiens
ctctttctctgccag

SEQ ID NO: 4012436 - DNA, 16 bp, Homo sapiens
ctctttctctgccagt

SEQ ID NO: 4012437 - DNA, 18 bp, Homo sapiens
ctctttggctcccctgta

SEQ ID NO: 4012438 - DNA, 17 bp, Homo sapiens
ctctttggggtcagcca

SEQ ID NO: 4012439 - DNA, 16 bp, Homo sapiens
ctcttttatatttgta

SEQ ID NO: 4012440 - DNA, 22 bp, Homo sapiens
ctcttttatatttgtaggagaa

SEQ ID NO: 4012441 - DNA, 23 bp, Homo sapiens
ctcttttatatttgtaggagaaa

SEQ ID NO: 4012442 - DNA, 22 bp, Homo sapiens
ctcttttcctttggtccttcaa

SEQ ID NO: 4012443 - DNA, 13 bp, Homo sapiens
ctcttttctcttt

SEQ ID NO: 4012444 - DNA, 15 bp, Homo sapiens
ctcttttctttctgt

SEQ ID NO: 4012445 - DNA, 12 bp, Homo sapiens
ctcttttgctta

SEQ ID NO: 4012446 - DNA, 14 bp, Homo sapiens
ctcttttgtaaatt

SEQ ID NO: 4012447 - DNA, 11 bp, Homo sapiens
ctctttttaag

SEQ ID NO: 4012448 - DNA, 22 bp, Homo sapiens
ctctttttagggccaggcaggt

SEQ ID NO: 4012449 - DNA, 17 bp, Homo sapiens
ctcttttttcgtttgtt

SEQ ID NO: 4012450 - DNA, 20 bp, Homo sapiens
ctcttttttgtttgtttctt

SEQ ID NO: 4012451 - DNA, 21 bp, Homo sapiens
ctcttttttgtttgtttcttt

SEQ ID NO: 4012452 - DNA, 21 bp, Homo sapiens
ctgaaaaaacacctagcttta

SEQ ID NO: 4012453 - DNA, 19 bp, Homo sapiens
ctgaaaaagtagattgagt

SEQ ID NO: 4012454 - DNA, 13 bp, Homo sapiens
ctgaaaactggaa

SEQ ID NO: 4012455 - DNA, 15 bp, Homo sapiens
ctgaaaactggaata

SEQ ID NO: 4012456 - DNA, 19 bp, Homo sapiens
ctgaaaactggaataagaa

SEQ ID NO: 4012457 - DNA, 21 bp, Homo sapiens
ctgaaaactggaataagaagc

SEQ ID NO: 4012458 - DNA, 22 bp, Homo sapiens
ctgaaaactggaataagaagca

SEQ ID NO: 4012459 - DNA, 17 bp, Homo sapiens
ctgaaaacttagccaga

SEQ ID NO: 4012460 - DNA, 15 bp, Homo sapiens
ctgaaaatataacca

SEQ ID NO: 4012461 - DNA, 13 bp, Homo sapiens
ctgaaaatgtaaa

SEQ ID NO: 4012462 - DNA, 14 bp, Homo sapiens
ctgaaaatgtatgt

SEQ ID NO: 4012463 - DNA, 20 bp, Homo sapiens
ctgaaacaacttggaaagat

SEQ ID NO: 4012464 - DNA, 13 bp, Homo sapiens
ctgaaacagattt

SEQ ID NO: 4012465 - DNA, 17 bp, Homo sapiens
ctgaaacagatttcata

SEQ ID NO: 4012466 - DNA, 20 bp, Homo sapiens
ctgaaacctagtactgcccc

SEQ ID NO: 4012467 - DNA, 19 bp, Homo sapiens
ctgaaacgctcctttgtgt

SEQ ID NO: 4012468 - DNA, 20 bp, Homo sapiens
ctgaaacgctcctttgtgtg

SEQ ID NO: 4012469 - DNA, 14 bp, Homo sapiens
ctgaaactggcttc

SEQ ID NO: 4012470 - DNA, 20 bp, Homo sapiens
ctgaaactggcttccccact

SEQ ID NO: 4012471 - DNA, 13 bp, Homo sapiens
ctgaaacttccct

SEQ ID NO: 4012472 - DNA, 21 bp, Homo sapiens
ctgaaacttgctgagctgttt

SEQ ID NO: 4012473 - DNA, 14 bp, Homo sapiens
ctgaaagaaacagt

SEQ ID NO: 4012474 - DNA, 23 bp, Homo sapiens
ctgaaagaattatttgccttctg

SEQ ID NO: 4012475 - DNA, 14 bp, Homo sapiens
ctgaaagaggctga

SEQ ID NO: 4012476 - DNA, 23 bp, Homo sapiens
ctgaaagccatttgttggggcag

SEQ ID NO: 4012477 - DNA, 19 bp, Homo sapiens
ctgaaaggatgtggaagag

SEQ ID NO: 4012478 - DNA, 15 bp, Homo sapiens
ctgaaagttttgtaa

SEQ ID NO: 4012479 - DNA, 14 bp, Homo sapiens
ctgaaataaatgtt

SEQ ID NO: 4012480 - DNA, 19 bp, Homo sapiens
ctgaaatctcagaattcct

SEQ ID NO: 4012481 - DNA, 14 bp, Homo sapiens
ctgaaatctccttt

SEQ ID NO: 4012482 - DNA, 18 bp, Homo sapiens
ctgaaatttattcacata

SEQ ID NO: 4012483 - DNA, 14 bp, Homo sapiens
ctgaaatttcacca

SEQ ID NO: 4012484 - DNA, 21 bp, Homo sapiens
ctgaacaaactaaaggtgcac

SEQ ID NO: 4012485 - DNA, 15 bp, Homo sapiens
ctgaacacaggcagc

SEQ ID NO: 4012486 - DNA, 17 bp, Homo sapiens
ctgaacacaggcagctt

SEQ ID NO: 4012487 - DNA, 22 bp, Homo sapiens
ctgaacacaggcagctttctag

SEQ ID NO: 4012488 - DNA, 13 bp, Homo sapiens
ctgaacagaagct

SEQ ID NO: 4012489 - DNA, 22 bp, Homo sapiens
ctgaacagatgacccctgccca

SEQ ID NO: 4012490 - DNA, 24 bp, Homo sapiens
ctgaacagatgacccctgcccaga

SEQ ID NO: 4012491 - DNA, 21 bp, Homo sapiens
ctgaaccccgtcgaggggctc

SEQ ID NO: 4012492 - DNA, 16 bp, Homo sapiens
ctgaaccgcaaggagc

SEQ ID NO: 4012493 - DNA, 14 bp, Homo sapiens
ctgaactcaagctg

SEQ ID NO: 4012494 - DNA, 14 bp, Homo sapiens
ctgcagcaggcagc

SEQ ID NO: 4012495 - DNA, 11 bp, Homo sapiens
ctgcagcatga

SEQ ID NO: 4012496 - DNA, 17 bp, Homo sapiens
ctgcagcatgacctgtg

SEQ ID NO: 4012497 - DNA, 19 bp, Homo sapiens
ctgcagcatgacctgtgac

SEQ ID NO: 4012498 - DNA, 16 bp, Homo sapiens
ctgcagcccaccagac

SEQ ID NO: 4012499 - DNA, 21 bp, Homo sapiens
ctgcagcccaccagacgtcag

SEQ ID NO: 4012500 - DNA, 18 bp, Homo sapiens
ctgcagccccagaagaaa

SEQ ID NO: 4012501 - DNA, 20 bp, Homo sapiens
ctgcagccccttgctctcag

SEQ ID NO: 4012502 - DNA, 19 bp, Homo sapiens
ctgcagcccttgggcagtt

SEQ ID NO: 4012503 - DNA, 16 bp, Homo sapiens
ctgcagccgtggtcca

SEQ ID NO: 4012504 - DNA, 23 bp, Homo sapiens
ctgcagcctcatactcctgggct

SEQ ID NO: 4012505 - DNA, 12 bp, Homo sapiens
ctgcagcctggc

SEQ ID NO: 4012506 - DNA, 13 bp, Homo sapiens
ctgcagcctggct

SEQ ID NO: 4012507 - DNA, 16 bp, Homo sapiens
ctgcagcctggctggt

SEQ ID NO: 4012508 - DNA, 19 bp, Homo sapiens
ctgcagcctggctggtcct

SEQ ID NO: 4012509 - DNA, 18 bp, Homo sapiens
ctgcagcctttgcctccc

SEQ ID NO: 4012510 - DNA, 20 bp, Homo sapiens
ctgcagctatgcgcaatgtg

SEQ ID NO: 4012511 - DNA, 13 bp, Homo sapiens
ctgcagctccctc

SEQ ID NO: 4012512 - DNA, 19 bp, Homo sapiens
ctgcagctccctcaaagag

SEQ ID NO: 4012513 - DNA, 16 bp, Homo sapiens
ctgcagctgagcctga

SEQ ID NO: 4012514 - DNA, 13 bp, Homo sapiens
ctgcagctgccgg

SEQ ID NO: 4012515 - DNA, 22 bp, Homo sapiens
ctgcagctgccgggcctgattt

SEQ ID NO: 4012516 - DNA, 16 bp, Homo sapiens
ctgcaggagttaaaaa

SEQ ID NO: 4012517 - DNA, 19 bp, Homo sapiens
ctgcaggattctcaccagc

SEQ ID NO: 4012518 - DNA, 20 bp, Homo sapiens
ctgcaggattctcaccagct

SEQ ID NO: 4012519 - DNA, 16 bp, Homo sapiens
ctgcaggcagagctgg

SEQ ID NO: 4012520 - DNA, 21 bp, Homo sapiens
ctgcaggcagagctggagccc

SEQ ID NO: 4012521 - DNA, 14 bp, Homo sapiens
ctgcaggtgccagg

SEQ ID NO: 4012522 - DNA, 12 bp, Homo sapiens
ctgcagtctcat

SEQ ID NO: 4012523 - DNA, 16 bp, Homo sapiens
ctgcagtctcatttct

SEQ ID NO: 4012524 - DNA, 17 bp, Homo sapiens
ctgcagtctcatttctc

SEQ ID NO: 4012525 - DNA, 19 bp, Homo sapiens
ctgcagtctcatttctcat

SEQ ID NO: 4012526 - DNA, 17 bp, Homo sapiens
ctgcagtcttatttcca

SEQ ID NO: 4012527 - DNA, 18 bp, Homo sapiens
ctgcagttggcagaaagg

SEQ ID NO: 4012528 - DNA, 15 bp, Homo sapiens
ctgcagtttcctgga

SEQ ID NO: 4012529 - DNA, 18 bp, Homo sapiens
ctgcatagcgaaataaaa

SEQ ID NO: 4012530 - DNA, 18 bp, Homo sapiens
ctgcatagctctatttta

SEQ ID NO: 4012531 - DNA, 18 bp, Homo sapiens
ctgcatcatctgtagata

SEQ ID NO: 4012532 - DNA, 15 bp, Homo sapiens
ctgcatcccagcacc

SEQ ID NO: 4012533 - DNA, 16 bp, Homo sapiens
ctgcatccccttggct

SEQ ID NO: 4012534 - DNA, 18 bp, Homo sapiens
ctgcatctggggcccata

SEQ ID NO: 4012535 - DNA, 16 bp, Homo sapiens
ctgcatgaatatcata

SEQ ID NO: 4012536 - DNA, 13 bp, Homo sapiens
ctgcatggaccta

SEQ ID NO: 4012537 - DNA, 21 bp, Homo sapiens
ctgcatgtggcttttttaaaa

SEQ ID NO: 4012538 - DNA, 12 bp, Homo sapiens
ctgcattagaaa

SEQ ID NO: 4012539 - DNA, 14 bp, Homo sapiens
ctgcattagaaaaa

SEQ ID NO: 4012540 - DNA, 15 bp, Homo sapiens
ctgcattagaaatta

SEQ ID NO: 4012541 - DNA, 13 bp, Homo sapiens
ctgcattatctat

SEQ ID NO: 4012542 - DNA, 21 bp, Homo sapiens
ctgcattatctatgcagcatg

SEQ ID NO: 4012543 - DNA, 20 bp, Homo sapiens
ctgcattttattctggatgg

SEQ ID NO: 4012544 - DNA, 19 bp, Homo sapiens
ctgccaaaggatgtgatat

SEQ ID NO: 4012545 - DNA, 20 bp, Homo sapiens
ctgccaaattttggccaaag

SEQ ID NO: 4012546 - DNA, 15 bp, Homo sapiens
ctgccaaggccagag

SEQ ID NO: 4012547 - DNA, 22 bp, Homo sapiens
ctgccaaggccagagtggcctg

SEQ ID NO: 4012548 - DNA, 11 bp, Homo sapiens
ctgccaagggt

SEQ ID NO: 4012549 - DNA, 21 bp, Homo sapiens
ctgccacaccagtcacatgac

SEQ ID NO: 4012550 - DNA, 12 bp, Homo sapiens
ctgccacagcca

SEQ ID NO: 4012551 - DNA, 17 bp, Homo sapiens
ctgccacagccagagga

SEQ ID NO: 4012552 - DNA, 18 bp, Homo sapiens
ctgccacatacaggtgct

SEQ ID NO: 4012553 - DNA, 19 bp, Homo sapiens
ctgccacatacaggtgctc

SEQ ID NO: 4012554 - DNA, 15 bp, Homo sapiens
ctgccaccagccccc

SEQ ID NO: 4012555 - DNA, 14 bp, Homo sapiens
ctgccaccatcctg

SEQ ID NO: 4012556 - DNA, 17 bp, Homo sapiens
ctgccaccatcctgctg

SEQ ID NO: 4012557 - DNA, 14 bp, Homo sapiens
ctgccacccactca

SEQ ID NO: 4012558 - DNA, 18 bp, Homo sapiens
ctgccacccactcaggat

SEQ ID NO: 4012559 - DNA, 12 bp, Homo sapiens
ctgccacctccc

SEQ ID NO: 4012560 - DNA, 15 bp, Homo sapiens
ctgccacctccctga

SEQ ID NO: 4012561 - DNA, 17 bp, Homo sapiens
ctgccacctccctgacc

SEQ ID NO: 4012562 - DNA, 18 bp, Homo sapiens
ctgccacctccctgaccc

SEQ ID NO: 4012563 - DNA, 15 bp, Homo sapiens
ctgccaccttcaagt

SEQ ID NO: 4012564 - DNA, 14 bp, Homo sapiens
ctgccagcacagag

SEQ ID NO: 4012565 - DNA, 15 bp, Homo sapiens
ctgccagcacagagc

SEQ ID NO: 4012566 - DNA, 15 bp, Homo sapiens
ctgccagcagccccg

SEQ ID NO: 4012567 - DNA, 13 bp, Homo sapiens
ctgccagcccaga

SEQ ID NO: 4012568 - DNA, 15 bp, Homo sapiens
ctgccagcccagaac

SEQ ID NO: 4012569 - DNA, 16 bp, Homo sapiens
ctgccagcccagaaca

SEQ ID NO: 4012570 - DNA, 18 bp, Homo sapiens
ctgccagcccagaacacc

SEQ ID NO: 4012571 - DNA, 21 bp, Homo sapiens
ctgccagcccagaacacccct

SEQ ID NO: 4012572 - DNA, 19 bp, Homo sapiens
ctgccagccccacacagct

SEQ ID NO: 4012573 - DNA, 12 bp, Homo sapiens
ctgccagctgca

SEQ ID NO: 4012574 - DNA, 13 bp, Homo sapiens
ctgccagctgcac

SEQ ID NO: 4012575 - DNA, 17 bp, Homo sapiens
ctgccagctgcactgat

SEQ ID NO: 4012576 - DNA, 19 bp, Homo sapiens
ctgccaggcaacttttaaa

SEQ ID NO: 4012577 - DNA, 20 bp, Homo sapiens
ctgccaggcacacacagccc

SEQ ID NO: 4012578 - DNA, 15 bp, Homo sapiens
ctgccaggcaggggt

SEQ ID NO: 4012579 - DNA, 19 bp, Homo sapiens
ctgccaggccagcctccga

SEQ ID NO: 4012580 - DNA, 14 bp, Homo sapiens
ctgccaggctgcct

SEQ ID NO: 4012581 - DNA, 18 bp, Homo sapiens
ctgccaggtgagaaactg

SEQ ID NO: 4012582 - DNA, 16 bp, Homo sapiens
ctgccagtgcagccac

SEQ ID NO: 4012583 - DNA, 19 bp, Homo sapiens
ctgccagtgcagccactgg

SEQ ID NO: 4012584 - DNA, 14 bp, Homo sapiens
ctgccagtggatcc

SEQ ID NO: 4012585 - DNA, 21 bp, Homo sapiens
ctgccagtggatcccctgcgg

SEQ ID NO: 4012586 - DNA, 20 bp, Homo sapiens
ctgccagtggggcctgaggc

SEQ ID NO: 4012587 - DNA, 17 bp, Homo sapiens
ctgccatctagccagcc

SEQ ID NO: 4012588 - DNA, 20 bp, Homo sapiens
ctgccatctagccagcccct

SEQ ID NO: 4012589 - DNA, 15 bp, Homo sapiens
ctgccatgacagagg

SEQ ID NO: 4012590 - DNA, 16 bp, Homo sapiens
ctgccatgacagaggc

SEQ ID NO: 4012591 - DNA, 16 bp, Homo sapiens
ctgccatgccaggaac

SEQ ID NO: 4012592 - DNA, 21 bp, Homo sapiens
ctgccatttgatttttctaac

SEQ ID NO: 4012593 - DNA, 14 bp, Homo sapiens
ctgcccaagcccag

SEQ ID NO: 4012594 - DNA, 16 bp, Homo sapiens
ctgcccaagcccaggc

SEQ ID NO: 4012595 - DNA, 17 bp, Homo sapiens
ctgcccaagggcctccc

SEQ ID NO: 4012596 - DNA, 19 bp, Homo sapiens
ctgcccaagggcctcccac

SEQ ID NO: 4012597 - DNA, 22 bp, Homo sapiens
ctgcttgcaggaggccaaactg

SEQ ID NO: 4012598 - DNA, 21 bp, Homo sapiens
ctgcttgcccaagtcacacag

SEQ ID NO: 4012599 - DNA, 22 bp, Homo sapiens
ctgcttgcccaagtcacacagc

SEQ ID NO: 4012600 - DNA, 22 bp, Homo sapiens
ctgcttgtcctgggcctgcccc

SEQ ID NO: 4012601 - DNA, 11 bp, Homo sapiens
ctgctttctgt

SEQ ID NO: 4012602 - DNA, 13 bp, Homo sapiens
ctgctttctgttc

SEQ ID NO: 4012603 - DNA, 15 bp, Homo sapiens
ctgctttctgttcca

SEQ ID NO: 4012604 - DNA, 14 bp, Homo sapiens
ctgctttgcatctt

SEQ ID NO: 4012605 - DNA, 17 bp, Homo sapiens
ctgctttgcatctttgt

SEQ ID NO: 4012606 - DNA, 19 bp, Homo sapiens
ctgctttgcatctttgtta

SEQ ID NO: 4012607 - DNA, 17 bp, Homo sapiens
ctgctttgcctctacca

SEQ ID NO: 4012608 - DNA, 14 bp, Homo sapiens
ctgctttggcagtg

SEQ ID NO: 4012609 - DNA, 15 bp, Homo sapiens
ctgctttggcagtgc

SEQ ID NO: 4012610 - DNA, 22 bp, Homo sapiens
ctgctttgggatttaatttcca

SEQ ID NO: 4012611 - DNA, 22 bp, Homo sapiens
ctgctttgggctgccctggtgc

SEQ ID NO: 4012612 - DNA, 17 bp, Homo sapiens
ctgcttttctgccctgg

SEQ ID NO: 4012613 - DNA, 22 bp, Homo sapiens
ctgcttttctgccctggctgct

SEQ ID NO: 4012614 - DNA, 12 bp, Homo sapiens
ctgcttttctgt

SEQ ID NO: 4012615 - DNA, 18 bp, Homo sapiens
ctgcttttctgtcctggg

SEQ ID NO: 4012616 - DNA, 14 bp, Homo sapiens
ctggaaaacctcct

SEQ ID NO: 4012617 - DNA, 16 bp, Homo sapiens
ctggaaacctgtctga

SEQ ID NO: 4012618 - DNA, 15 bp, Homo sapiens
ctggaaaggggagag

SEQ ID NO: 4012619 - DNA, 17 bp, Homo sapiens
ctggaacatcctttgca

SEQ ID NO: 4012620 - DNA, 23 bp, Homo sapiens
ctggaacatcctttgcagggcag

SEQ ID NO: 4012621 - DNA, 13 bp, Homo sapiens
ctggaacccagac

SEQ ID NO: 4012622 - DNA, 19 bp, Homo sapiens
ctggaacccagactcagac

SEQ ID NO: 4012623 - DNA, 23 bp, Homo sapiens
ctggaacctcagcctggccagac

SEQ ID NO: 4012624 - DNA, 18 bp, Homo sapiens
ctggaaccttgctgtcct

SEQ ID NO: 4012625 - DNA, 17 bp, Homo sapiens
ctggaactcctggcctt

SEQ ID NO: 4012626 - DNA, 13 bp, Homo sapiens
ctggaagagagga

SEQ ID NO: 4012627 - DNA, 22 bp, Homo sapiens
ctggaagagggtgaaaggcagg

SEQ ID NO: 4012628 - DNA, 22 bp, Homo sapiens
ctggaagatataacattcagtt

SEQ ID NO: 4012629 - DNA, 22 bp, Homo sapiens
ctggaagcccagcccctactgc

SEQ ID NO: 4012630 - DNA, 17 bp, Homo sapiens
ctggaagccctggagac

SEQ ID NO: 4012631 - DNA, 18 bp, Homo sapiens
ctggaagctaatttgcat

SEQ ID NO: 4012632 - DNA, 19 bp, Homo sapiens
ctggaaggaacatggagct

SEQ ID NO: 4012633 - DNA, 20 bp, Homo sapiens
ctggaaggaacatggagctg

SEQ ID NO: 4012634 - DNA, 23 bp, Homo sapiens
ctggaagtcatctcattccactg

SEQ ID NO: 4012635 - DNA, 20 bp, Homo sapiens
ctggaagttttgcatttatg

SEQ ID NO: 4012636 - DNA, 18 bp, Homo sapiens
ctggaataaagttgcaga

SEQ ID NO: 4012637 - DNA, 19 bp, Homo sapiens
ctggaataagaagcaaata

SEQ ID NO: 4012638 - DNA, 16 bp, Homo sapiens
ctggaataatttgtaa

SEQ ID NO: 4012639 - DNA, 17 bp, Homo sapiens
ctggaataatttgtaaa

SEQ ID NO: 4012640 - DNA, 21 bp, Homo sapiens
ctggaataatttgtaaatgat

SEQ ID NO: 4012641 - DNA, 17 bp, Homo sapiens
ctggaatctacaagcca

SEQ ID NO: 4012642 - DNA, 18 bp, Homo sapiens
ctggaatctggagaccag

SEQ ID NO: 4012643 - DNA, 24 bp, Homo sapiens
ctggaatctggagaccagggagcc

SEQ ID NO: 4012644 - DNA, 14 bp, Homo sapiens
ctggaatgcactga

SEQ ID NO: 4012645 - DNA, 20 bp, Homo sapiens
ctggaatggaagggttctgg

SEQ ID NO: 4012646 - DNA, 22 bp, Homo sapiens
ctggaatgtttttccctcccca

SEQ ID NO: 4012647 - DNA, 23 bp, Homo sapiens
ctggaatgtttttccctccccag

SEQ ID NO: 4012648 - DNA, 23 bp, Homo sapiens
ctggaattcctaacttttcaatg

SEQ ID NO: 4012649 - DNA, 15 bp, Homo sapiens
ctggacaagccaact

SEQ ID NO: 4012650 - DNA, 21 bp, Homo sapiens
ctggacaagccaacttgtaaa

SEQ ID NO: 4012651 - DNA, 15 bp, Homo sapiens
ctggacactcagacc

SEQ ID NO: 4012652 - DNA, 16 bp, Homo sapiens
ctggacactcagacct

SEQ ID NO: 4012653 - DNA, 22 bp, Homo sapiens
ctggacacttcacgcccttggc

SEQ ID NO: 4012654 - DNA, 17 bp, Homo sapiens
ctggacagcagaagcct

SEQ ID NO: 4012655 - DNA, 18 bp, Homo sapiens
ctggacagcagaagcctc

SEQ ID NO: 4012656 - DNA, 22 bp, Homo sapiens
ctggacagcagaagcctccaag

SEQ ID NO: 4012657 - DNA, 12 bp, Homo sapiens
ctggacagccag

SEQ ID NO: 4012658 - DNA, 15 bp, Homo sapiens
ctggacagccagtga

SEQ ID NO: 4012659 - DNA, 14 bp, Homo sapiens
ctggacagccccac

SEQ ID NO: 4012660 - DNA, 16 bp, Homo sapiens
ctggacagccccaccc

SEQ ID NO: 4012661 - DNA, 18 bp, Homo sapiens
ctggacagccccaccctg

SEQ ID NO: 4012662 - DNA, 19 bp, Homo sapiens
ctggacagccccaccctgg

SEQ ID NO: 4012663 - DNA, 14 bp, Homo sapiens
ctggacaggccagg

SEQ ID NO: 4012664 - DNA, 19 bp, Homo sapiens
ctggacaggctctgcttct

SEQ ID NO: 4012665 - DNA, 20 bp, Homo sapiens
ctggacctatgtcctaagga

SEQ ID NO: 4012666 - DNA, 13 bp, Homo sapiens
ctggacctgggaa

SEQ ID NO: 4012667 - DNA, 13 bp, Homo sapiens
ctggacctgggga

SEQ ID NO: 4012668 - DNA, 17 bp, Homo sapiens
ctggacggaagtggtgg

SEQ ID NO: 4012669 - DNA, 13 bp, Homo sapiens
ctggacggcaggc

SEQ ID NO: 4012670 - DNA, 16 bp, Homo sapiens
ctggactattgtgcca

SEQ ID NO: 4012671 - DNA, 21 bp, Homo sapiens
ctggactattgtgccaactgc

SEQ ID NO: 4012672 - DNA, 16 bp, Homo sapiens
ctggactgaagcctgc

SEQ ID NO: 4012673 - DNA, 19 bp, Homo sapiens
ctggactgaagcctgcagg

SEQ ID NO: 4012674 - DNA, 19 bp, Homo sapiens
ctggactggaggcccctgg

SEQ ID NO: 4012675 - DNA, 16 bp, Homo sapiens
ctggactggaggtggg

SEQ ID NO: 4012676 - DNA, 18 bp, Homo sapiens
ctggactggaggtgggca

SEQ ID NO: 4012677 - DNA, 21 bp, Homo sapiens
ctggactggctagagtcctca

SEQ ID NO: 4012678 - DNA, 13 bp, Homo sapiens
ctggactgggagg

SEQ ID NO: 4012679 - DNA, 19 bp, Homo sapiens
ctggacttctacctgccct

SEQ ID NO: 4012680 - DNA, 18 bp, Homo sapiens
ctggactttcctgcaact

SEQ ID NO: 4012681 - DNA, 20 bp, Homo sapiens
ctggactttgcttcccctcc

SEQ ID NO: 4012682 - DNA, 19 bp, Homo sapiens
ctggagaagctcacccaat

SEQ ID NO: 4012683 - DNA, 18 bp, Homo sapiens
ctggagaccagggagcct

SEQ ID NO: 4012684 - DNA, 19 bp, Homo sapiens
ctggagaccagggagcctt

SEQ ID NO: 4012685 - DNA, 22 bp, Homo sapiens
ctggagacccccccccaactcc

SEQ ID NO: 4012686 - DNA, 23 bp, Homo sapiens
ctggagagggtctcgctgtcact

SEQ ID NO: 4012687 - DNA, 23 bp, Homo sapiens
ctggagatattataagggagagc

SEQ ID NO: 4012688 - DNA, 13 bp, Homo sapiens
ctggagcagacca

SEQ ID NO: 4012689 - DNA, 14 bp, Homo sapiens
ctggagcaggagcc

SEQ ID NO: 4012690 - DNA, 19 bp, Homo sapiens
ctggagcccccagcagagg

SEQ ID NO: 4012691 - DNA, 21 bp, Homo sapiens
ctggagcccccagcagaggca

SEQ ID NO: 4012692 - DNA, 12 bp, Homo sapiens
ctggagcccctt

SEQ ID NO: 4012693 - DNA, 16 bp, Homo sapiens
ctggagcggagaggaa

SEQ ID NO: 4012694 - DNA, 21 bp, Homo sapiens
ctggagcggagaggaagccag

SEQ ID NO: 4012695 - DNA, 21 bp, Homo sapiens
ctggagctcatctgcaaaagg

SEQ ID NO: 4012696 - DNA, 20 bp, Homo sapiens
ctggaggaaagggaggagtg

SEQ ID NO: 4012697 - DNA, 22 bp, Homo sapiens
ctggaggaattcagctcagctt

SEQ ID NO: 4012698 - DNA, 17 bp, Homo sapiens
ctggaggagctgggccc

SEQ ID NO: 4012699 - DNA, 22 bp, Homo sapiens
ctggggaggaatcctggaccaa

SEQ ID NO: 4012700 - DNA, 13 bp, Homo sapiens
ctggggcagatcc

SEQ ID NO: 4012701 - DNA, 19 bp, Homo sapiens
ctggggccagaggctggga

SEQ ID NO: 4012702 - DNA, 16 bp, Homo sapiens
ctggggcccagcccct

SEQ ID NO: 4012703 - DNA, 16 bp, Homo sapiens
ctggggccctgggcct

SEQ ID NO: 4012704 - DNA, 19 bp, Homo sapiens
ctggggccctgggcctcag

SEQ ID NO: 4012705 - DNA, 22 bp, Homo sapiens
ctggggcctagcgatctctcct

SEQ ID NO: 4012706 - DNA, 15 bp, Homo sapiens
ctggggcctccagaa

SEQ ID NO: 4012707 - DNA, 15 bp, Homo sapiens
ctggggcctgactgc

SEQ ID NO: 4012708 - DNA, 19 bp, Homo sapiens
ctggggcctgactgctcag

SEQ ID NO: 4012709 - DNA, 13 bp, Homo sapiens
ctggggcctgaga

SEQ ID NO: 4012710 - DNA, 16 bp, Homo sapiens
ctggggcctggacctg

SEQ ID NO: 4012711 - DNA, 16 bp, Homo sapiens
ctggggcggggcccag

SEQ ID NO: 4012712 - DNA, 22 bp, Homo sapiens
ctggggctcacggggcctccaa

SEQ ID NO: 4012713 - DNA, 19 bp, Homo sapiens
ctggggctcctttctccag

SEQ ID NO: 4012714 - DNA, 18 bp, Homo sapiens
ctggggctctctgagact

SEQ ID NO: 4012715 - DNA, 23 bp, Homo sapiens
ctggggctggggtgagagaggaa

SEQ ID NO: 4012716 - DNA, 14 bp, Homo sapiens
ctgggggaaaaagc

SEQ ID NO: 4012717 - DNA, 20 bp, Homo sapiens
ctgggggacccaatgtagga

SEQ ID NO: 4012718 - DNA, 12 bp, Homo sapiens
ctgggggagaga

SEQ ID NO: 4012719 - DNA, 19 bp, Homo sapiens
ctgggggaggtccaagcag

SEQ ID NO: 4012720 - DNA, 12 bp, Homo sapiens
ctgggggcagga

SEQ ID NO: 4012721 - DNA, 14 bp, Homo sapiens
ctgggggtgctgga

SEQ ID NO: 4012722 - DNA, 14 bp, Homo sapiens
ctgggggtggcagg

SEQ ID NO: 4012723 - DNA, 17 bp, Homo sapiens
ctgggggtggcaggcac

SEQ ID NO: 4012724 - DNA, 21 bp, Homo sapiens
ctggggtcaggccgggcagag

SEQ ID NO: 4012725 - DNA, 24 bp, Homo sapiens
ctggggtcaggccgggcagagcac

SEQ ID NO: 4012726 - DNA, 15 bp, Homo sapiens
ctggggtggccacca

SEQ ID NO: 4012727 - DNA, 16 bp, Homo sapiens
ctggggtggccaccag

SEQ ID NO: 4012728 - DNA, 17 bp, Homo sapiens
ctgggtactgaaagcct

SEQ ID NO: 4012729 - DNA, 17 bp, Homo sapiens
ctgggtacttcttgaag

SEQ ID NO: 4012730 - DNA, 17 bp, Homo sapiens
ctgggtaggaaagagga

SEQ ID NO: 4012731 - DNA, 13 bp, Homo sapiens
ctgggtcagtctg

SEQ ID NO: 4012732 - DNA, 17 bp, Homo sapiens
ctgggtctgattttctc

SEQ ID NO: 4012733 - DNA, 22 bp, Homo sapiens
ctgggtctgattttctcactga

SEQ ID NO: 4012734 - DNA, 17 bp, Homo sapiens
ctgggtctgtgtctctt

SEQ ID NO: 4012735 - DNA, 22 bp, Homo sapiens
ctgggtgcctcccacacttgct

SEQ ID NO: 4012736 - DNA, 23 bp, Homo sapiens
ctgggtggcctcgggacacctgc

SEQ ID NO: 4012737 - DNA, 12 bp, Homo sapiens
ctgggtggcctg

SEQ ID NO: 4012738 - DNA, 13 bp, Homo sapiens
ctgggtgggctct

SEQ ID NO: 4012739 - DNA, 14 bp, Homo sapiens
ctgggtgggctctg

SEQ ID NO: 4012740 - DNA, 17 bp, Homo sapiens
ctgggtggtggcctggt

SEQ ID NO: 4012741 - DNA, 13 bp, Homo sapiens
ctgggtgtcattt

SEQ ID NO: 4012742 - DNA, 16 bp, Homo sapiens
ctgggttccctttcct

SEQ ID NO: 4012743 - DNA, 20 bp, Homo sapiens
ctgggttccctttccttcca

SEQ ID NO: 4012744 - DNA, 18 bp, Homo sapiens
ctgggtttccagggcaca

SEQ ID NO: 4012745 - DNA, 16 bp, Homo sapiens
ctgggtttcttttttc

SEQ ID NO: 4012746 - DNA, 22 bp, Homo sapiens
ctgggtttgtacttccacctcc

SEQ ID NO: 4012747 - DNA, 18 bp, Homo sapiens
ctggtaacagttcatgtt

SEQ ID NO: 4012748 - DNA, 17 bp, Homo sapiens
ctggtaagaaaaagcaa

SEQ ID NO: 4012749 - DNA, 18 bp, Homo sapiens
ctggtaagaaaaagcaaa

SEQ ID NO: 4012750 - DNA, 15 bp, Homo sapiens
ctggtaatattgact

SEQ ID NO: 4012751 - DNA, 19 bp, Homo sapiens
ctggtaatattgacttgta

SEQ ID NO: 4012752 - DNA, 15 bp, Homo sapiens
ctggtaccctcctgg

SEQ ID NO: 4012753 - DNA, 20 bp, Homo sapiens
ctggtagcataaataaaact

SEQ ID NO: 4012754 - DNA, 16 bp, Homo sapiens
ctggtaggttgggaca

SEQ ID NO: 4012755 - DNA, 22 bp, Homo sapiens
ctggtaggttgggacaccaggg

SEQ ID NO: 4012756 - DNA, 21 bp, Homo sapiens
ctggtagttagtagcatgttg

SEQ ID NO: 4012757 - DNA, 23 bp, Homo sapiens
ctggtatctcagaaagtgcctga

SEQ ID NO: 4012758 - DNA, 15 bp, Homo sapiens
ctggtattctgttct

SEQ ID NO: 4012759 - DNA, 19 bp, Homo sapiens
ctggtattctgttctggag

SEQ ID NO: 4012760 - DNA, 15 bp, Homo sapiens
ctggtattgtttacg

SEQ ID NO: 4012761 - DNA, 20 bp, Homo sapiens
ctggtcaagttgagattttt

SEQ ID NO: 4012762 - DNA, 19 bp, Homo sapiens
ctggtcacagcctcctctg

SEQ ID NO: 4012763 - DNA, 15 bp, Homo sapiens
ctggtcacttcttct

SEQ ID NO: 4012764 - DNA, 16 bp, Homo sapiens
ctggtcatttccccca

SEQ ID NO: 4012765 - DNA, 22 bp, Homo sapiens
ctggtccagggaagctggccga

SEQ ID NO: 4012766 - DNA, 21 bp, Homo sapiens
ctggtcccctccctctgtctt

SEQ ID NO: 4012767 - DNA, 20 bp, Homo sapiens
ctggtcccggggccagcact

SEQ ID NO: 4012768 - DNA, 23 bp, Homo sapiens
ctggtccctgttttcccacgagg

SEQ ID NO: 4012769 - DNA, 14 bp, Homo sapiens
ctggtcgccttcca

SEQ ID NO: 4012770 - DNA, 23 bp, Homo sapiens
ctggtctcaaacttgtggcctca

SEQ ID NO: 4012771 - DNA, 17 bp, Homo sapiens
ctggtctgcgccttggg

SEQ ID NO: 4012772 - DNA, 21 bp, Homo sapiens
ctggtctgcgccttgggatgg

SEQ ID NO: 4012773 - DNA, 14 bp, Homo sapiens
ctggtcttgagatg

SEQ ID NO: 4012774 - DNA, 15 bp, Homo sapiens
ctggtcttgttagaa

SEQ ID NO: 4012775 - DNA, 16 bp, Homo sapiens
ctggtgaatcacctgg

SEQ ID NO: 4012776 - DNA, 17 bp, Homo sapiens
ctggtgaatcacctggc

SEQ ID NO: 4012777 - DNA, 19 bp, Homo sapiens
ctggtgcattacagagagg

SEQ ID NO: 4012778 - DNA, 20 bp, Homo sapiens
ctggtgccaaaaccaggcct

SEQ ID NO: 4012779 - DNA, 22 bp, Homo sapiens
ctggtgccaaaaccaggcctct

SEQ ID NO: 4012780 - DNA, 19 bp, Homo sapiens
ctggtgccccacagctacc

SEQ ID NO: 4012781 - DNA, 20 bp, Homo sapiens
ctggtgccccacagctacct

SEQ ID NO: 4012782 - DNA, 21 bp, Homo sapiens
ctggtgccccccacccctgga

SEQ ID NO: 4012783 - DNA, 19 bp, Homo sapiens
ctggtgcggatggacacta

SEQ ID NO: 4012784 - DNA, 19 bp, Homo sapiens
ctggtgctataggctggag

SEQ ID NO: 4012785 - DNA, 14 bp, Homo sapiens
ctggtgctcctgca

SEQ ID NO: 4012786 - DNA, 14 bp, Homo sapiens
ctggtgctgctgct

SEQ ID NO: 4012787 - DNA, 20 bp, Homo sapiens
ctggtgctggatattttcaa

SEQ ID NO: 4012788 - DNA, 19 bp, Homo sapiens
ctggtgctgtggccagggt

SEQ ID NO: 4012789 - DNA, 20 bp, Homo sapiens
ctggtgctgtggccagggtg

SEQ ID NO: 4012790 - DNA, 17 bp, Homo sapiens
ctggtgcttccaaatat

SEQ ID NO: 4012791 - DNA, 20 bp, Homo sapiens
ctggtggaaagcgattcact

SEQ ID NO: 4012792 - DNA, 21 bp, Homo sapiens
ctggtggaaagcgattcactg

SEQ ID NO: 4012793 - DNA, 14 bp, Homo sapiens
ctggtggcaccaga

SEQ ID NO: 4012794 - DNA, 18 bp, Homo sapiens
ctggtggcaccagatgca

SEQ ID NO: 4012795 - DNA, 17 bp, Homo sapiens
ctggtgggacagtggtg

SEQ ID NO: 4012796 - DNA, 18 bp, Homo sapiens
ctggtgggacagtggtga

SEQ ID NO: 4012797 - DNA, 18 bp, Homo sapiens
ctggtgggcagctgagga

SEQ ID NO: 4012798 - DNA, 17 bp, Homo sapiens
ctggtgtgaactcaccc

SEQ ID NO: 4012799 - DNA, 17 bp, Homo sapiens
ctggtgtgacctgaggg

SEQ ID NO: 4012800 - DNA, 23 bp, Homo sapiens
ctggtgtgtggtgaggggctttc

SEQ ID NO: 4012801 - DNA, 22 bp, Homo sapiens
ctgttaaacagtagttgtattc

SEQ ID NO: 4012802 - DNA, 13 bp, Homo sapiens
ctgttaactgtta

SEQ ID NO: 4012803 - DNA, 22 bp, Homo sapiens
ctgttaaggttgaactttgcca

SEQ ID NO: 4012804 - DNA, 23 bp, Homo sapiens
ctgttaaggttgaactttgccaa

SEQ ID NO: 4012805 - DNA, 17 bp, Homo sapiens
ctgttaccgcctgtctc

SEQ ID NO: 4012806 - DNA, 14 bp, Homo sapiens
ctgttactccacag

SEQ ID NO: 4012807 - DNA, 18 bp, Homo sapiens
ctgttactgttaaccatt

SEQ ID NO: 4012808 - DNA, 19 bp, Homo sapiens
ctgttacttacctaaacag

SEQ ID NO: 4012809 - DNA, 13 bp, Homo sapiens
ctgttagcagaca

SEQ ID NO: 4012810 - DNA, 15 bp, Homo sapiens
ctgttagcagacagg

SEQ ID NO: 4012811 - DNA, 19 bp, Homo sapiens
ctgttaggaacagcagtgt

SEQ ID NO: 4012812 - DNA, 20 bp, Homo sapiens
ctgttaggaacagcagtgtt

SEQ ID NO: 4012813 - DNA, 14 bp, Homo sapiens
ctgttagggccttg

SEQ ID NO: 4012814 - DNA, 15 bp, Homo sapiens
ctgttagggccttgg

SEQ ID NO: 4012815 - DNA, 13 bp, Homo sapiens
ctgttagtcattt

SEQ ID NO: 4012816 - DNA, 18 bp, Homo sapiens
ctgttatcaaactgctgt

SEQ ID NO: 4012817 - DNA, 12 bp, Homo sapiens
ctgttatgtctg

SEQ ID NO: 4012818 - DNA, 16 bp, Homo sapiens
ctgttatgtctgttta

SEQ ID NO: 4012819 - DNA, 17 bp, Homo sapiens
ctgttatgtctgtttaa

SEQ ID NO: 4012820 - DNA, 20 bp, Homo sapiens
ctgttatgtctgtttaagaa

SEQ ID NO: 4012821 - DNA, 13 bp, Homo sapiens
ctgttatttcttc

SEQ ID NO: 4012822 - DNA, 15 bp, Homo sapiens
ctgttcaagtgtccc

SEQ ID NO: 4012823 - DNA, 15 bp, Homo sapiens
ctgttcacgctcacc

SEQ ID NO: 4012824 - DNA, 17 bp, Homo sapiens
ctgttcacgctcaccca

SEQ ID NO: 4012825 - DNA, 13 bp, Homo sapiens
ctgttcactctac

SEQ ID NO: 4012826 - DNA, 18 bp, Homo sapiens
ctgttcatgtgcctctgc

SEQ ID NO: 4012827 - DNA, 17 bp, Homo sapiens
ctgttccaaagccagtg

SEQ ID NO: 4012828 - DNA, 14 bp, Homo sapiens
ctgttccaaattca

SEQ ID NO: 4012829 - DNA, 22 bp, Homo sapiens
ctgttccaaattcagtttcata

SEQ ID NO: 4012830 - DNA, 16 bp, Homo sapiens
ctgttccatgcaactg

SEQ ID NO: 4012831 - DNA, 20 bp, Homo sapiens
ctgttcccatgtagccccct

SEQ ID NO: 4012832 - DNA, 16 bp, Homo sapiens
ctgttccccagagaaa

SEQ ID NO: 4012833 - DNA, 15 bp, Homo sapiens
ctgttcccccaccct

SEQ ID NO: 4012834 - DNA, 12 bp, Homo sapiens
ctgttcccctca

SEQ ID NO: 4012835 - DNA, 14 bp, Homo sapiens
ctgttcccctcact

SEQ ID NO: 4012836 - DNA, 17 bp, Homo sapiens
ctgttcccctcactgga

SEQ ID NO: 4012837 - DNA, 22 bp, Homo sapiens
ctgttcccctcactggatgaaa

SEQ ID NO: 4012838 - DNA, 19 bp, Homo sapiens
ctgttccctctgctcctgg

SEQ ID NO: 4012839 - DNA, 20 bp, Homo sapiens
ctgttccctctgctcctgga

SEQ ID NO: 4012840 - DNA, 13 bp, Homo sapiens
ctgttcccttgca

SEQ ID NO: 4012841 - DNA, 13 bp, Homo sapiens
ctgttcggaaggg

SEQ ID NO: 4012842 - DNA, 22 bp, Homo sapiens
ctgttcggaaggggttcctcaa

SEQ ID NO: 4012843 - DNA, 12 bp, Homo sapiens
ctgttctagttt

SEQ ID NO: 4012844 - DNA, 16 bp, Homo sapiens
ctgttctccaggcttc

SEQ ID NO: 4012845 - DNA, 20 bp, Homo sapiens
ctgttctccaggcttcacag

SEQ ID NO: 4012846 - DNA, 23 bp, Homo sapiens
ctgttctccaggcttcacagtct

SEQ ID NO: 4012847 - DNA, 22 bp, Homo sapiens
ctgttctgaggattcaggggct

SEQ ID NO: 4012848 - DNA, 13 bp, Homo sapiens
ctgttctgcaaag

SEQ ID NO: 4012849 - DNA, 22 bp, Homo sapiens
ctgttctggaggaaagggagga

SEQ ID NO: 4012850 - DNA, 23 bp, Homo sapiens
ctgttctggaggaaagggaggag

SEQ ID NO: 4012851 - DNA, 16 bp, Homo sapiens
ctgttctggcctcaga

SEQ ID NO: 4012852 - DNA, 19 bp, Homo sapiens
ctgttctggcctcagacca

SEQ ID NO: 4012853 - DNA, 14 bp, Homo sapiens
ctgttctgggggac

SEQ ID NO: 4012854 - DNA, 14 bp, Homo sapiens
ctgttctgtgtctt

SEQ ID NO: 4012855 - DNA, 13 bp, Homo sapiens
ctgttcttcctcc

SEQ ID NO: 4012856 - DNA, 20 bp, Homo sapiens
ctgttcttcctccagctgca

SEQ ID NO: 4012857 - DNA, 23 bp, Homo sapiens
ctgttcttcctccagctgcacca

SEQ ID NO: 4012858 - DNA, 17 bp, Homo sapiens
ctgttgaatttcccaca

SEQ ID NO: 4012859 - DNA, 14 bp, Homo sapiens
ctgttgaccaggca

SEQ ID NO: 4012860 - DNA, 15 bp, Homo sapiens
ctgttgagctgtttt

SEQ ID NO: 4012861 - DNA, 19 bp, Homo sapiens
ctgttgatgaagtatactt

SEQ ID NO: 4012862 - DNA, 22 bp, Homo sapiens
ctgttgcaattaggattttgat

SEQ ID NO: 4012863 - DNA, 12 bp, Homo sapiens
ctgttgccacca

SEQ ID NO: 4012864 - DNA, 21 bp, Homo sapiens
ctgttgctcaaatctattcag

SEQ ID NO: 4012865 - DNA, 11 bp, Homo sapiens
ctgttgcttgt

SEQ ID NO: 4012866 - DNA, 22 bp, Homo sapiens
ctgttgtaactaggctcagaga

SEQ ID NO: 4012867 - DNA, 17 bp, Homo sapiens
ctgttgtccctctgcta

SEQ ID NO: 4012868 - DNA, 17 bp, Homo sapiens
ctgttgtctcttctcct

SEQ ID NO: 4012869 - DNA, 18 bp, Homo sapiens
ctgttgtctcttctcctt

SEQ ID NO: 4012870 - DNA, 17 bp, Homo sapiens
ctgttgtgatcttgcat

SEQ ID NO: 4012871 - DNA, 17 bp, Homo sapiens
ctgttgttgttaatgaa

SEQ ID NO: 4012872 - DNA, 22 bp, Homo sapiens
ctgttgttgttaatgaaaatgt

SEQ ID NO: 4012873 - DNA, 13 bp, Homo sapiens
ctgtttaagaaaa

SEQ ID NO: 4012874 - DNA, 15 bp, Homo sapiens
ctgtttactggttct

SEQ ID NO: 4012875 - DNA, 13 bp, Homo sapiens
ctgtttatggcct

SEQ ID NO: 4012876 - DNA, 16 bp, Homo sapiens
ctgtttatttctgttt

SEQ ID NO: 4012877 - DNA, 11 bp, Homo sapiens
ctgtttcacaa

SEQ ID NO: 4012878 - DNA, 13 bp, Homo sapiens
ctgtttcagaccc

SEQ ID NO: 4012879 - DNA, 19 bp, Homo sapiens
ctgtttcagacccccccat

SEQ ID NO: 4012880 - DNA, 14 bp, Homo sapiens
ctgtttctctgctg

SEQ ID NO: 4012881 - DNA, 16 bp, Homo sapiens
ctgtttctgcagccct

SEQ ID NO: 4012882 - DNA, 23 bp, Homo sapiens
ctgtttgacacctcttttttcgt

SEQ ID NO: 4012883 - DNA, 15 bp, Homo sapiens
ctgtttggcttataa

SEQ ID NO: 4012884 - DNA, 12 bp, Homo sapiens
ctgtttgtaaat

SEQ ID NO: 4012885 - DNA, 21 bp, Homo sapiens
ctgtttgtaaattatttgcta

SEQ ID NO: 4012886 - DNA, 16 bp, Homo sapiens
ctgtttgtcctgagat

SEQ ID NO: 4012887 - DNA, 15 bp, Homo sapiens
ctgtttgtttcaaga

SEQ ID NO: 4012888 - DNA, 14 bp, Homo sapiens
ctgtttgtttcata

SEQ ID NO: 4012889 - DNA, 22 bp, Homo sapiens
ctgttttaaatttatttcaaaa

SEQ ID NO: 4012890 - DNA, 16 bp, Homo sapiens
ctgttttgcacagtta

SEQ ID NO: 4012891 - DNA, 20 bp, Homo sapiens
ctgttttgtggtcagctgta

SEQ ID NO: 4012892 - DNA, 17 bp, Homo sapiens
ctgttttgtttggcaag

SEQ ID NO: 4012893 - DNA, 22 bp, Homo sapiens
ctgttttgtttggcaaggaaag

SEQ ID NO: 4012894 - DNA, 16 bp, Homo sapiens
ctgtttttttttcatt

SEQ ID NO: 4012895 - DNA, 12 bp, Homo sapiens
cttaaaaaggaa

SEQ ID NO: 4012896 - DNA, 13 bp, Homo sapiens
cttaaaaatcaca

SEQ ID NO: 4012897 - DNA, 21 bp, Homo sapiens
cttaaaaatcacactgtaaat

SEQ ID NO: 4012898 - DNA, 20 bp, Homo sapiens
cttaaaaatcattgattgtc

SEQ ID NO: 4012899 - DNA, 18 bp, Homo sapiens
cttaaaaatgtaaatatt

SEQ ID NO: 4012900 - DNA, 13 bp, Homo sapiens
cttaaaaccaaag

SEQ ID NO: 4012901 - DNA, 13 bp, Homo sapiens
cttaaaataagca

SEQ ID NO: 4012902 - DNA, 14 bp, Homo sapiens
cttaaaatatttta

SEQ ID NO: 4012903 - DNA, 14 bp, Homo sapiens
cttaaaatggaatt

SEQ ID NO: 4012904 - DNA, 17 bp, Homo sapiens
cttccatccatctttcc

SEQ ID NO: 4012905 - DNA, 16 bp, Homo sapiens
cttccatccctacccc

SEQ ID NO: 4012906 - DNA, 14 bp, Homo sapiens
cttccatgattcta

SEQ ID NO: 4012907 - DNA, 14 bp, Homo sapiens
cttccatgatttta

SEQ ID NO: 4012908 - DNA, 14 bp, Homo sapiens
cttccatgtgcctt

SEQ ID NO: 4012909 - DNA, 18 bp, Homo sapiens
cttccatgtgcctttctt

SEQ ID NO: 4012910 - DNA, 22 bp, Homo sapiens
cttccatgtgcctttctttgcc

SEQ ID NO: 4012911 - DNA, 23 bp, Homo sapiens
cttccatgtgcctttctttgcct

SEQ ID NO: 4012912 - DNA, 15 bp, Homo sapiens
cttccatttctgcct

SEQ ID NO: 4012913 - DNA, 14 bp, Homo sapiens
cttccattttcccc

SEQ ID NO: 4012914 - DNA, 18 bp, Homo sapiens
cttcccaacagccttagc

SEQ ID NO: 4012915 - DNA, 22 bp, Homo sapiens
cttcccaacagccttagctgcc

SEQ ID NO: 4012916 - DNA, 18 bp, Homo sapiens
cttcccacccctacacac

SEQ ID NO: 4012917 - DNA, 19 bp, Homo sapiens
cttcccacccctacacaca

SEQ ID NO: 4012918 - DNA, 20 bp, Homo sapiens
cttcccacccctacacacac

SEQ ID NO: 4012919 - DNA, 15 bp, Homo sapiens
cttcccactcacccc

SEQ ID NO: 4012920 - DNA, 15 bp, Homo sapiens
cttcccactcttctc

SEQ ID NO: 4012921 - DNA, 16 bp, Homo sapiens
cttcccagctaggaag

SEQ ID NO: 4012922 - DNA, 13 bp, Homo sapiens
cttcccagctctg

SEQ ID NO: 4012923 - DNA, 15 bp, Homo sapiens
cttcccagctctgac

SEQ ID NO: 4012924 - DNA, 14 bp, Homo sapiens
cttcccataataaa

SEQ ID NO: 4012925 - DNA, 16 bp, Homo sapiens
cttcccatgactgcac

SEQ ID NO: 4012926 - DNA, 17 bp, Homo sapiens
cttcccatgactgcacc

SEQ ID NO: 4012927 - DNA, 23 bp, Homo sapiens
cttcccatgactgcacccagctc

SEQ ID NO: 4012928 - DNA, 17 bp, Homo sapiens
cttcccatgtctttctc

SEQ ID NO: 4012929 - DNA, 15 bp, Homo sapiens
cttcccatttctcta

SEQ ID NO: 4012930 - DNA, 18 bp, Homo sapiens
cttcccatttctctacac

SEQ ID NO: 4012931 - DNA, 19 bp, Homo sapiens
cttcccatttcttcccact

SEQ ID NO: 4012932 - DNA, 20 bp, Homo sapiens
cttcccatttcttcccactt

SEQ ID NO: 4012933 - DNA, 19 bp, Homo sapiens
cttccccagaaaggagact

SEQ ID NO: 4012934 - DNA, 12 bp, Homo sapiens
cttccccagaga

SEQ ID NO: 4012935 - DNA, 23 bp, Homo sapiens
cttccccagagaggcactcagtg

SEQ ID NO: 4012936 - DNA, 12 bp, Homo sapiens
cttccccctcca

SEQ ID NO: 4012937 - DNA, 13 bp, Homo sapiens
cttcccctccagg

SEQ ID NO: 4012938 - DNA, 14 bp, Homo sapiens
cttcccctccagga

SEQ ID NO: 4012939 - DNA, 18 bp, Homo sapiens
cttcccctccctggctcc

SEQ ID NO: 4012940 - DNA, 13 bp, Homo sapiens
cttccccttcctg

SEQ ID NO: 4012941 - DNA, 19 bp, Homo sapiens
cttcccgcctccctctcag

SEQ ID NO: 4012942 - DNA, 16 bp, Homo sapiens
cttcccgctcagccct

SEQ ID NO: 4012943 - DNA, 13 bp, Homo sapiens
cttccctacctca

SEQ ID NO: 4012944 - DNA, 15 bp, Homo sapiens
cttccctacctcagg

SEQ ID NO: 4012945 - DNA, 23 bp, Homo sapiens
cttccctagctttagaccctggg

SEQ ID NO: 4012946 - DNA, 15 bp, Homo sapiens
cttccctcaccccca

SEQ ID NO: 4012947 - DNA, 16 bp, Homo sapiens
cttccctcacccccag

SEQ ID NO: 4012948 - DNA, 17 bp, Homo sapiens
cttccctcaccttggca

SEQ ID NO: 4012949 - DNA, 13 bp, Homo sapiens
cttccctccctgc

SEQ ID NO: 4012950 - DNA, 13 bp, Homo sapiens
cttccctctctga

SEQ ID NO: 4012951 - DNA, 15 bp, Homo sapiens
cttccctctctgatg

SEQ ID NO: 4012952 - DNA, 20 bp, Homo sapiens
cttccctctctgatgtccca

SEQ ID NO: 4012953 - DNA, 19 bp, Homo sapiens
cttccctctgggcacgcct

SEQ ID NO: 4012954 - DNA, 22 bp, Homo sapiens
cttccctgattgacctgctccg

SEQ ID NO: 4012955 - DNA, 21 bp, Homo sapiens
cttccctgctttgcatctttg

SEQ ID NO: 4012956 - DNA, 16 bp, Homo sapiens
cttccctttccccagc

SEQ ID NO: 4012957 - DNA, 13 bp, Homo sapiens
cttccctttctgc

SEQ ID NO: 4012958 - DNA, 14 bp, Homo sapiens
cttcccttttctgt

SEQ ID NO: 4012959 - DNA, 16 bp, Homo sapiens
cttccgctgaggggtc

SEQ ID NO: 4012960 - DNA, 22 bp, Homo sapiens
cttccgctgaggggtctcggat

SEQ ID NO: 4012961 - DNA, 14 bp, Homo sapiens
cttccggagatgta

SEQ ID NO: 4012962 - DNA, 21 bp, Homo sapiens
cttccggtagggaggcagcct

SEQ ID NO: 4012963 - DNA, 23 bp, Homo sapiens
cttccggtagggaggcagcctcc

SEQ ID NO: 4012964 - DNA, 17 bp, Homo sapiens
cttcctaaacccaatga

SEQ ID NO: 4012965 - DNA, 21 bp, Homo sapiens
cttcctacaagagcagcctgt

SEQ ID NO: 4012966 - DNA, 21 bp, Homo sapiens
cttcctacatcttcttcccag

SEQ ID NO: 4012967 - DNA, 19 bp, Homo sapiens
cttcctaccaagtcaaact

SEQ ID NO: 4012968 - DNA, 23 bp, Homo sapiens
cttcctacccacacctctgccag

SEQ ID NO: 4012969 - DNA, 21 bp, Homo sapiens
cttcctactcttctctctgct

SEQ ID NO: 4012970 - DNA, 22 bp, Homo sapiens
cttcctactcttctctctgctc

SEQ ID NO: 4012971 - DNA, 17 bp, Homo sapiens
cttcctagttcatccct

SEQ ID NO: 4012972 - DNA, 24 bp, Homo sapiens
cttcctagttcatcccttctcttc

SEQ ID NO: 4012973 - DNA, 22 bp, Homo sapiens
cttcctcaaaataaagaagtat

SEQ ID NO: 4012974 - DNA, 13 bp, Homo sapiens
cttcctcacttcc

SEQ ID NO: 4012975 - DNA, 14 bp, Homo sapiens
cttcctccaaggac

SEQ ID NO: 4012976 - DNA, 19 bp, Homo sapiens
cttcctctccactgccttc

SEQ ID NO: 4012977 - DNA, 15 bp, Homo sapiens
cttcctctctcctta

SEQ ID NO: 4012978 - DNA, 15 bp, Homo sapiens
cttcctctgtaagat

SEQ ID NO: 4012979 - DNA, 23 bp, Homo sapiens
cttcctgaagggggacactccat

SEQ ID NO: 4012980 - DNA, 10 bp, Homo sapiens
cttcctgccc

SEQ ID NO: 4012981 - DNA, 15 bp, Homo sapiens
cttcctgcccttccc

SEQ ID NO: 4012982 - DNA, 15 bp, Homo sapiens
cttcctgcgtcctcc

SEQ ID NO: 4012983 - DNA, 20 bp, Homo sapiens
cttcctgcgtcctcctcacc

SEQ ID NO: 4012984 - DNA, 14 bp, Homo sapiens
cttcctgctacagg

SEQ ID NO: 4012985 - DNA, 15 bp, Homo sapiens
cttcctgctgcaccc

SEQ ID NO: 4012986 - DNA, 17 bp, Homo sapiens
cttcctgctgcaccctg

SEQ ID NO: 4012987 - DNA, 14 bp, Homo sapiens
cttcctggcctgag

SEQ ID NO: 4012988 - DNA, 19 bp, Homo sapiens
cttcctggcctgagagtca

SEQ ID NO: 4012989 - DNA, 19 bp, Homo sapiens
cttcctggttttgtacact

SEQ ID NO: 4012990 - DNA, 20 bp, Homo sapiens
cttcctggttttgtacactg

SEQ ID NO: 4012991 - DNA, 23 bp, Homo sapiens
cttcctggttttgtacactgctg

SEQ ID NO: 4012992 - DNA, 16 bp, Homo sapiens
cttcctgtccagctcc

SEQ ID NO: 4012993 - DNA, 22 bp, Homo sapiens
cttcctgtccccaaaatgtgat

SEQ ID NO: 4012994 - DNA, 16 bp, Homo sapiens
cttcctgtccctgagg

SEQ ID NO: 4012995 - DNA, 16 bp, Homo sapiens
cttcctgtggctttgt

SEQ ID NO: 4012996 - DNA, 20 bp, Homo sapiens
cttcctgtttcagacccccc

SEQ ID NO: 4012997 - DNA, 23 bp, Homo sapiens
cttccttatgtatcagtgtcctt

SEQ ID NO: 4012998 - DNA, 13 bp, Homo sapiens
cttccttcagggt

SEQ ID NO: 4012999 - DNA, 14 bp, Homo sapiens
cttccttcagggtt

SEQ ID NO: 4013000 - DNA, 18 bp, Homo sapiens
cttccttcagggtttaat

SEQ ID NO: 4013001 - DNA, 23 bp, Homo sapiens
cttccttcagggtttaatagact

SEQ ID NO: 4013002 - DNA, 11 bp, Homo sapiens
cttccttggcc

SEQ ID NO: 4013003 - DNA, 14 bp, Homo sapiens
cttccttgtgagga

SEQ ID NO: 4013004 - DNA, 15 bp, Homo sapiens
cttcctttctccagg

SEQ ID NO: 4013005 - DNA, 19 bp, Homo sapiens
cttcctttctccaggacca

SEQ ID NO: 4013006 - DNA, 15 bp, Homo sapiens
cttccttttccctgc

SEQ ID NO: 4013007 - DNA, 18 bp, Homo sapiens
cttggggtgtggggtggg

SEQ ID NO: 4013008 - DNA, 14 bp, Homo sapiens
cttgggtcattgac

SEQ ID NO: 4013009 - DNA, 14 bp, Homo sapiens
cttgggtgggtgaa

SEQ ID NO: 4013010 - DNA, 14 bp, Homo sapiens
cttgggttctgata

SEQ ID NO: 4013011 - DNA, 23 bp, Homo sapiens
cttggtatttttcagagatttat

SEQ ID NO: 4013012 - DNA, 20 bp, Homo sapiens
cttggtctgatttcaggata

SEQ ID NO: 4013013 - DNA, 20 bp, Homo sapiens
cttggtgccaccaaaagtgc

SEQ ID NO: 4013014 - DNA, 15 bp, Homo sapiens
cttggtgctctgtgt

SEQ ID NO: 4013015 - DNA, 14 bp, Homo sapiens
cttggtgctggttt

SEQ ID NO: 4013016 - DNA, 15 bp, Homo sapiens
cttggtgctggttta

SEQ ID NO: 4013017 - DNA, 16 bp, Homo sapiens
cttggtggcttatggg

SEQ ID NO: 4013018 - DNA, 18 bp, Homo sapiens
cttggtgtaatttgaaga

SEQ ID NO: 4013019 - DNA, 19 bp, Homo sapiens
cttggtgtgattgcacaga

SEQ ID NO: 4013020 - DNA, 22 bp, Homo sapiens
cttggttcaataaagcactgag

SEQ ID NO: 4013021 - DNA, 19 bp, Homo sapiens
cttggtttctctctacagt

SEQ ID NO: 4013022 - DNA, 20 bp, Homo sapiens
cttggtttctctctacagtg

SEQ ID NO: 4013023 - DNA, 23 bp, Homo sapiens
cttggtttctctctacagtgcca

SEQ ID NO: 4013024 - DNA, 14 bp, Homo sapiens
cttggtttctgtga

SEQ ID NO: 4013025 - DNA, 23 bp, Homo sapiens
cttggtttttttttttcttaaat

SEQ ID NO: 4013026 - DNA, 13 bp, Homo sapiens
cttgtaaagactg

SEQ ID NO: 4013027 - DNA, 21 bp, Homo sapiens
cttgtaaataaccacaaggtc

SEQ ID NO: 4013028 - DNA, 13 bp, Homo sapiens
cttgtaaatacac

SEQ ID NO: 4013029 - DNA, 13 bp, Homo sapiens
cttgtaataaata

SEQ ID NO: 4013030 - DNA, 16 bp, Homo sapiens
cttgtaattctaaatg

SEQ ID NO: 4013031 - DNA, 23 bp, Homo sapiens
cttgtaatttaaacatttgttcc

SEQ ID NO: 4013032 - DNA, 16 bp, Homo sapiens
cttgtaatttttattt

SEQ ID NO: 4013033 - DNA, 23 bp, Homo sapiens
cttgtatatagagattgtacatt

SEQ ID NO: 4013034 - DNA, 16 bp, Homo sapiens
cttgtatatttgtaca

SEQ ID NO: 4013035 - DNA, 17 bp, Homo sapiens
cttgtatatttgtacaa

SEQ ID NO: 4013036 - DNA, 17 bp, Homo sapiens
cttgtatattttaagaa

SEQ ID NO: 4013037 - DNA, 23 bp, Homo sapiens
cttgtatattttaagaaataaca

SEQ ID NO: 4013038 - DNA, 14 bp, Homo sapiens
cttgtcacaataaa

SEQ ID NO: 4013039 - DNA, 16 bp, Homo sapiens
cttgtcacaataaatg

SEQ ID NO: 4013040 - DNA, 18 bp, Homo sapiens
cttgtcattccagagtgc

SEQ ID NO: 4013041 - DNA, 21 bp, Homo sapiens
cttgtcccacgtgtcttccac

SEQ ID NO: 4013042 - DNA, 16 bp, Homo sapiens
cttgtcctcagtccat

SEQ ID NO: 4013043 - DNA, 13 bp, Homo sapiens
cttgtcctcttct

SEQ ID NO: 4013044 - DNA, 22 bp, Homo sapiens
cttgtcctcttctgctcttttc

SEQ ID NO: 4013045 - DNA, 14 bp, Homo sapiens
cttgtcctttccct

SEQ ID NO: 4013046 - DNA, 15 bp, Homo sapiens
cttgtcctttccctt

SEQ ID NO: 4013047 - DNA, 14 bp, Homo sapiens
cttgtcgctttctc

SEQ ID NO: 4013048 - DNA, 18 bp, Homo sapiens
cttgtcgctttctcagtg

SEQ ID NO: 4013049 - DNA, 22 bp, Homo sapiens
cttgtcgctttctcagtgtgtg

SEQ ID NO: 4013050 - DNA, 17 bp, Homo sapiens
cttgtctatttttgtct

SEQ ID NO: 4013051 - DNA, 19 bp, Homo sapiens
cttgtctcctactcctgac

SEQ ID NO: 4013052 - DNA, 20 bp, Homo sapiens
cttgtctcctactcctgact

SEQ ID NO: 4013053 - DNA, 15 bp, Homo sapiens
cttgtctttctgggg

SEQ ID NO: 4013054 - DNA, 16 bp, Homo sapiens
cttgtgaaacacagct

SEQ ID NO: 4013055 - DNA, 12 bp, Homo sapiens
cttgtgaacaga

SEQ ID NO: 4013056 - DNA, 18 bp, Homo sapiens
cttgtgaagttgtttttt

SEQ ID NO: 4013057 - DNA, 23 bp, Homo sapiens
cttgtgatccactcgcctcagcc

SEQ ID NO: 4013058 - DNA, 15 bp, Homo sapiens
cttgtgattatttat

SEQ ID NO: 4013059 - DNA, 19 bp, Homo sapiens
cttgtgcaaggtggccttt

SEQ ID NO: 4013060 - DNA, 15 bp, Homo sapiens
cttgtgcacaggcag

SEQ ID NO: 4013061 - DNA, 18 bp, Homo sapiens
cttgtgcacaggcagagc

SEQ ID NO: 4013062 - DNA, 15 bp, Homo sapiens
cttgtgcagtgttga

SEQ ID NO: 4013063 - DNA, 17 bp, Homo sapiens
cttgtgctttgctcttg

SEQ ID NO: 4013064 - DNA, 21 bp, Homo sapiens
cttgtggccccttttactttt

SEQ ID NO: 4013065 - DNA, 15 bp, Homo sapiens
cttgtgggctggtgc

SEQ ID NO: 4013066 - DNA, 16 bp, Homo sapiens
cttgtgggtccatgct

SEQ ID NO: 4013067 - DNA, 14 bp, Homo sapiens
cttgtggtgtaaag

SEQ ID NO: 4013068 - DNA, 19 bp, Homo sapiens
cttgtggtgtaaagctggc

SEQ ID NO: 4013069 - DNA, 22 bp, Homo sapiens
cttgtggtgtaaagctggccct

SEQ ID NO: 4013070 - DNA, 19 bp, Homo sapiens
cttgtgtgtgggctgtgag

SEQ ID NO: 4013071 - DNA, 16 bp, Homo sapiens
cttgttagaaaacaaa

SEQ ID NO: 4013072 - DNA, 14 bp, Homo sapiens
cttgttccctctcc

SEQ ID NO: 4013073 - DNA, 12 bp, Homo sapiens
cttgttcttcca

SEQ ID NO: 4013074 - DNA, 13 bp, Homo sapiens
cttgttcttccaa

SEQ ID NO: 4013075 - DNA, 15 bp, Homo sapiens
cttgttgcatttcca

SEQ ID NO: 4013076 - DNA, 24 bp, Homo sapiens
cttgttgcatttccagctgtgcag

SEQ ID NO: 4013077 - DNA, 12 bp, Homo sapiens
cttgtttcaatt

SEQ ID NO: 4013078 - DNA, 18 bp, Homo sapiens
cttgtttcatctggtttt

SEQ ID NO: 4013079 - DNA, 13 bp, Homo sapiens
cttgtttccttgt

SEQ ID NO: 4013080 - DNA, 18 bp, Homo sapiens
cttgtttgagtttttcct

SEQ ID NO: 4013081 - DNA, 19 bp, Homo sapiens
cttgtttggtagttagcca

SEQ ID NO: 4013082 - DNA, 21 bp, Homo sapiens
cttgttttaagcaaatgcatt

SEQ ID NO: 4013083 - DNA, 17 bp, Homo sapiens
cttgttttcttgccaat

SEQ ID NO: 4013084 - DNA, 22 bp, Homo sapiens
cttgttttctttctttaaatgt

SEQ ID NO: 4013085 - DNA, 23 bp, Homo sapiens
cttgttttctttctttaaatgtt

SEQ ID NO: 4013086 - DNA, 20 bp, Homo sapiens
cttgtttttattaatttata

SEQ ID NO: 4013087 - DNA, 23 bp, Homo sapiens
cttgttttttgtttgtttgttgc

SEQ ID NO: 4013088 - DNA, 20 bp, Homo sapiens
cttgttttttttttccactt

SEQ ID NO: 4013089 - DNA, 19 bp, Homo sapiens
ctttaaaaaaatttaagtg

SEQ ID NO: 4013090 - DNA, 18 bp, Homo sapiens
ctttaaaaaatatttatt

SEQ ID NO: 4013091 - DNA, 15 bp, Homo sapiens
ctttaaaaagaaaaa

SEQ ID NO: 4013092 - DNA, 21 bp, Homo sapiens
ctttaaaaagaaaaaaaaaga

SEQ ID NO: 4013093 - DNA, 20 bp, Homo sapiens
ctttaaaaagggaagaaact

SEQ ID NO: 4013094 - DNA, 11 bp, Homo sapiens
ctttaaaagaa

SEQ ID NO: 4013095 - DNA, 12 bp, Homo sapiens
ctttaaaagaat

SEQ ID NO: 4013096 - DNA, 16 bp, Homo sapiens
ctttaaaagaatgact

SEQ ID NO: 4013097 - DNA, 15 bp, Homo sapiens
ctttaaaagagagag

SEQ ID NO: 4013098 - DNA, 17 bp, Homo sapiens
ctttaaaaggaaagaaa

SEQ ID NO: 4013099 - DNA, 20 bp, Homo sapiens
ctttaaaattacaactaagt

SEQ ID NO: 4013100 - DNA, 13 bp, Homo sapiens
ctttaaaattgtc

SEQ ID NO: 4013101 - DNA, 18 bp, Homo sapiens
ctttaaacagtatttcat

SEQ ID NO: 4013102 - DNA, 20 bp, Homo sapiens
ctttaaagatgaactctgaa

SEQ ID NO: 4013103 - DNA, 13 bp, Homo sapiens
ctttaaatagata

SEQ ID NO: 4013104 - DNA, 19 bp, Homo sapiens
ctttaaatagatacaaatg

SEQ ID NO: 4013105 - DNA, 15 bp, Homo sapiens
ctttaaatgttttat

SEQ ID NO: 4013106 - DNA, 19 bp, Homo sapiens
ctttaacttttttttctct

SEQ ID NO: 4013107 - DNA, 14 bp, Homo sapiens
ctttaagacatact

SEQ ID NO: 4013108 - DNA, 23 bp, Homo sapiens
ctttaagacatactccttccatc

SEQ ID NO: 4013109 - DNA, 19 bp, Homo sapiens
gacaagaggtacagggttt

SEQ ID NO: 4013110 - DNA, 22 bp, Homo sapiens
gacaagcacaccacaattctcc

SEQ ID NO: 4013111 - DNA, 23 bp, Homo sapiens
gacaagccaacttgtaaatacac

SEQ ID NO: 4013112 - DNA, 21 bp, Homo sapiens
gacaagctgttgaccaggcac

SEQ ID NO: 4013113 - DNA, 22 bp, Homo sapiens
gacaagggaaaataaaaaaaga

SEQ ID NO: 4013114 - DNA, 16 bp, Homo sapiens
gacaaggtgcaggcag

SEQ ID NO: 4013115 - DNA, 18 bp, Homo sapiens
gacaaggtgcaggcaggc

SEQ ID NO: 4013116 - DNA, 16 bp, Homo sapiens
gacaagtgaagaacac

SEQ ID NO: 4013117 - DNA, 14 bp, Homo sapiens
gacaagtgctgttg

SEQ ID NO: 4013118 - DNA, 20 bp, Homo sapiens
gacaagtggactcagggcag

SEQ ID NO: 4013119 - DNA, 23 bp, Homo sapiens
gacaatgatattgacactgtccc

SEQ ID NO: 4013120 - DNA, 17 bp, Homo sapiens
gacaatgttttcttcaa

SEQ ID NO: 4013121 - DNA, 22 bp, Homo sapiens
gacaattgaggtaagttttttg

SEQ ID NO: 4013122 - DNA, 19 bp, Homo sapiens
gacaatttgatacataata

SEQ ID NO: 4013123 - DNA, 16 bp, Homo sapiens
gacacaatatgtatgc

SEQ ID NO: 4013124 - DNA, 16 bp, Homo sapiens
gacacaatccctgggg

SEQ ID NO: 4013125 - DNA, 13 bp, Homo sapiens
gacacacaaagca

SEQ ID NO: 4013126 - DNA, 14 bp, Homo sapiens
gacacacaaagcag

SEQ ID NO: 4013127 - DNA, 14 bp, Homo sapiens
gacacacagcactc

SEQ ID NO: 4013128 - DNA, 22 bp, Homo sapiens
gacacaccccacaccccagccc

SEQ ID NO: 4013129 - DNA, 23 bp, Homo sapiens
gacacaccccacaccccagccca

SEQ ID NO: 4013130 - DNA, 17 bp, Homo sapiens
gacacacctcacgcagg

SEQ ID NO: 4013131 - DNA, 15 bp, Homo sapiens
gacacactaaccaag

SEQ ID NO: 4013132 - DNA, 19 bp, Homo sapiens
gacacactaaccaagctga

SEQ ID NO: 4013133 - DNA, 11 bp, Homo sapiens
gacacagaaaa

SEQ ID NO: 4013134 - DNA, 19 bp, Homo sapiens
gacacagaaaatgttgaga

SEQ ID NO: 4013135 - DNA, 12 bp, Homo sapiens
gacacagataat

SEQ ID NO: 4013136 - DNA, 15 bp, Homo sapiens
gacacagcagcttca

SEQ ID NO: 4013137 - DNA, 14 bp, Homo sapiens
gacacagcagtgag

SEQ ID NO: 4013138 - DNA, 13 bp, Homo sapiens
gacacaggccctc

SEQ ID NO: 4013139 - DNA, 17 bp, Homo sapiens
gacacaggccctccctg

SEQ ID NO: 4013140 - DNA, 17 bp, Homo sapiens
gacacagtcagcatgct

SEQ ID NO: 4013141 - DNA, 16 bp, Homo sapiens
gacacccaccctgtgc

SEQ ID NO: 4013142 - DNA, 22 bp, Homo sapiens
gacacccaccctgtgccatcac

SEQ ID NO: 4013143 - DNA, 16 bp, Homo sapiens
gacacccctacacaca

SEQ ID NO: 4013144 - DNA, 17 bp, Homo sapiens
gacacccctacacacac

SEQ ID NO: 4013145 - DNA, 19 bp, Homo sapiens
gacacccctgctctaccca

SEQ ID NO: 4013146 - DNA, 17 bp, Homo sapiens
gacaccccttatccagg

SEQ ID NO: 4013147 - DNA, 17 bp, Homo sapiens
gacacctactgagtggc

SEQ ID NO: 4013148 - DNA, 19 bp, Homo sapiens
gacacgctcgcgggcagcg

SEQ ID NO: 4013149 - DNA, 15 bp, Homo sapiens
gacactaacgacttc

SEQ ID NO: 4013150 - DNA, 20 bp, Homo sapiens
gacactaagttatagtatat

SEQ ID NO: 4013151 - DNA, 23 bp, Homo sapiens
gacactaatgcagccacgattgg

SEQ ID NO: 4013152 - DNA, 18 bp, Homo sapiens
gacactaccccatataca

SEQ ID NO: 4013153 - DNA, 15 bp, Homo sapiens
gacactcagacctga

SEQ ID NO: 4013154 - DNA, 16 bp, Homo sapiens
gacactccccgaagtc

SEQ ID NO: 4013155 - DNA, 12 bp, Homo sapiens
gacactgagccc

SEQ ID NO: 4013156 - DNA, 14 bp, Homo sapiens
gacactggcccctc

SEQ ID NO: 4013157 - DNA, 15 bp, Homo sapiens
gacactgtccctctt

SEQ ID NO: 4013158 - DNA, 20 bp, Homo sapiens
gacacttaatactaccttga

SEQ ID NO: 4013159 - DNA, 15 bp, Homo sapiens
gacacttcagagagc

SEQ ID NO: 4013160 - DNA, 17 bp, Homo sapiens
gacacttcagagagctg

SEQ ID NO: 4013161 - DNA, 22 bp, Homo sapiens
gacacttgccttcttcacccag

SEQ ID NO: 4013162 - DNA, 13 bp, Homo sapiens
gacagacacacac

SEQ ID NO: 4013163 - DNA, 15 bp, Homo sapiens
gacagacaggctctt

SEQ ID NO: 4013164 - DNA, 21 bp, Homo sapiens
gacagacaggctcttagcagc

SEQ ID NO: 4013165 - DNA, 18 bp, Homo sapiens
gacagacatctctgcacc

SEQ ID NO: 4013166 - DNA, 22 bp, Homo sapiens
gacagaccacatctttatctgt

SEQ ID NO: 4013167 - DNA, 16 bp, Homo sapiens
gacagaccacttgcca

SEQ ID NO: 4013168 - DNA, 18 bp, Homo sapiens
gacagacttgagaacttg

SEQ ID NO: 4013169 - DNA, 13 bp, Homo sapiens
gacagagccatgc

SEQ ID NO: 4013170 - DNA, 13 bp, Homo sapiens
gacagagctctgg

SEQ ID NO: 4013171 - DNA, 18 bp, Homo sapiens
gacagaggaaagggctgg

SEQ ID NO: 4013172 - DNA, 18 bp, Homo sapiens
gacagaggagcttttctg

SEQ ID NO: 4013173 - DNA, 19 bp, Homo sapiens
gacagaggccccagcctcc

SEQ ID NO: 4013174 - DNA, 15 bp, Homo sapiens
gacagaggcctgccc

SEQ ID NO: 4013175 - DNA, 14 bp, Homo sapiens
gacagagttcacag

SEQ ID NO: 4013176 - DNA, 16 bp, Homo sapiens
gacagagttcacagga

SEQ ID NO: 4013177 - DNA, 13 bp, Homo sapiens
gacagataactct

SEQ ID NO: 4013178 - DNA, 23 bp, Homo sapiens
gacagatacgtagttgtgctttt

SEQ ID NO: 4013179 - DNA, 15 bp, Homo sapiens
gacagatatatttaa

SEQ ID NO: 4013180 - DNA, 15 bp, Homo sapiens
gacagatccccgttc

SEQ ID NO: 4013181 - DNA, 20 bp, Homo sapiens
gacagatgaatgccgtggat

SEQ ID NO: 4013182 - DNA, 18 bp, Homo sapiens
gacagatgccccagagct

SEQ ID NO: 4013183 - DNA, 18 bp, Homo sapiens
gacagatgtcagccgagc

SEQ ID NO: 4013184 - DNA, 16 bp, Homo sapiens
gacagcagaagcctcc

SEQ ID NO: 4013185 - DNA, 14 bp, Homo sapiens
gacagcaggcagcg

SEQ ID NO: 4013186 - DNA, 12 bp, Homo sapiens
gacagcaggtgg

SEQ ID NO: 4013187 - DNA, 22 bp, Homo sapiens
gacagcagtcttatgcttccag

SEQ ID NO: 4013188 - DNA, 20 bp, Homo sapiens
gacagcatcccttcccacat

SEQ ID NO: 4013189 - DNA, 23 bp, Homo sapiens
gacagcatcccttcccacatgcc

SEQ ID NO: 4013190 - DNA, 13 bp, Homo sapiens
gacagcatgcccc

SEQ ID NO: 4013191 - DNA, 19 bp, Homo sapiens
gacagcatgccccttggct

SEQ ID NO: 4013192 - DNA, 14 bp, Homo sapiens
gacagccagagctg

SEQ ID NO: 4013193 - DNA, 11 bp, Homo sapiens
gacagcccaga

SEQ ID NO: 4013194 - DNA, 14 bp, Homo sapiens
gacagccccaccct

SEQ ID NO: 4013195 - DNA, 15 bp, Homo sapiens
gacagcccctccctc

SEQ ID NO: 4013196 - DNA, 11 bp, Homo sapiens
gacagcctccc

SEQ ID NO: 4013197 - DNA, 11 bp, Homo sapiens
gacagcctggc

SEQ ID NO: 4013198 - DNA, 16 bp, Homo sapiens
gacagcgcccctgctg

SEQ ID NO: 4013199 - DNA, 11 bp, Homo sapiens
gacagctgcaa

SEQ ID NO: 4013200 - DNA, 16 bp, Homo sapiens
gacagctgcaagccag

SEQ ID NO: 4013201 - DNA, 17 bp, Homo sapiens
gacagcttagaattatt

SEQ ID NO: 4013202 - DNA, 12 bp, Homo sapiens
gacagcttcctc

SEQ ID NO: 4013203 - DNA, 22 bp, Homo sapiens
gacagcttcctcacacccctgt

SEQ ID NO: 4013204 - DNA, 19 bp, Homo sapiens
gacaggaaagccctccccc

SEQ ID NO: 4013205 - DNA, 21 bp, Homo sapiens
gacaggagacctggcactgga

SEQ ID NO: 4013206 - DNA, 16 bp, Homo sapiens
gacaggagtcagtgtc

SEQ ID NO: 4013207 - DNA, 23 bp, Homo sapiens
gacaggatgggggctggcctctg

SEQ ID NO: 4013208 - DNA, 17 bp, Homo sapiens
gacaggcagcccagcag

SEQ ID NO: 4013209 - DNA, 18 bp, Homo sapiens
gacaggcagcccagcagt

SEQ ID NO: 4013210 - DNA, 18 bp, Homo sapiens
gacaggccatgtgagcca

SEQ ID NO: 4013211 - DNA, 20 bp, Homo sapiens
gacaggcccagcgcggccag

SEQ ID NO: 4013212 - DNA, 16 bp, Homo sapiens
gacctggacactaggg

SEQ ID NO: 4013213 - DNA, 15 bp, Homo sapiens
gacctggataactta

SEQ ID NO: 4013214 - DNA, 18 bp, Homo sapiens
gacctggcactggatgca

SEQ ID NO: 4013215 - DNA, 17 bp, Homo sapiens
gacctggcactgggagg

SEQ ID NO: 4013216 - DNA, 16 bp, Homo sapiens
gacctggcagctctgg

SEQ ID NO: 4013217 - DNA, 15 bp, Homo sapiens
gacctggcctgtctg

SEQ ID NO: 4013218 - DNA, 11 bp, Homo sapiens
gacctggctgc

SEQ ID NO: 4013219 - DNA, 15 bp, Homo sapiens
gacctggctgcccct

SEQ ID NO: 4013220 - DNA, 17 bp, Homo sapiens
gacctgtgaccagcact

SEQ ID NO: 4013221 - DNA, 19 bp, Homo sapiens
gacctgtgagcccagctgg

SEQ ID NO: 4013222 - DNA, 23 bp, Homo sapiens
gacctgtgagcccagctgggtca

SEQ ID NO: 4013223 - DNA, 13 bp, Homo sapiens
gacctgtgctagt

SEQ ID NO: 4013224 - DNA, 19 bp, Homo sapiens
gacctgtgctagttttaca

SEQ ID NO: 4013225 - DNA, 12 bp, Homo sapiens
gaccttatctgt

SEQ ID NO: 4013226 - DNA, 14 bp, Homo sapiens
gaccttatctgtgc

SEQ ID NO: 4013227 - DNA, 22 bp, Homo sapiens
gaccttcctcatccaccccatc

SEQ ID NO: 4013228 - DNA, 23 bp, Homo sapiens
gaccttcctcatccaccccatcc

SEQ ID NO: 4013229 - DNA, 18 bp, Homo sapiens
gaccttctccaaatgaga

SEQ ID NO: 4013230 - DNA, 16 bp, Homo sapiens
gaccttgcaacttcat

SEQ ID NO: 4013231 - DNA, 13 bp, Homo sapiens
gacctttgacctc

SEQ ID NO: 4013232 - DNA, 22 bp, Homo sapiens
gaccttttcaacttggcttcct

SEQ ID NO: 4013233 - DNA, 15 bp, Homo sapiens
gaccttttcttcatt

SEQ ID NO: 4013234 - DNA, 16 bp, Homo sapiens
gacgaaaaagaggcat

SEQ ID NO: 4013235 - DNA, 21 bp, Homo sapiens
gacgaacatccaaccttccca

SEQ ID NO: 4013236 - DNA, 21 bp, Homo sapiens
gacgacaagtgctgaacagtg

SEQ ID NO: 4013237 - DNA, 15 bp, Homo sapiens
gacgccactccctgg

SEQ ID NO: 4013238 - DNA, 20 bp, Homo sapiens
gacgccactccctgggacac

SEQ ID NO: 4013239 - DNA, 20 bp, Homo sapiens
gacgcccagccccatccctg

SEQ ID NO: 4013240 - DNA, 21 bp, Homo sapiens
gacgccggggacagaggcctg

SEQ ID NO: 4013241 - DNA, 15 bp, Homo sapiens
gacgccgtcccacca

SEQ ID NO: 4013242 - DNA, 13 bp, Homo sapiens
gacgctctgctgt

SEQ ID NO: 4013243 - DNA, 22 bp, Homo sapiens
gacgctctgctgtgggcacagg

SEQ ID NO: 4013244 - DNA, 14 bp, Homo sapiens
gacgctgcatgaga

SEQ ID NO: 4013245 - DNA, 16 bp, Homo sapiens
gacgctgtcctgagat

SEQ ID NO: 4013246 - DNA, 19 bp, Homo sapiens
gacgcttaacctttccgct

SEQ ID NO: 4013247 - DNA, 18 bp, Homo sapiens
gacgcttcacaggacagg

SEQ ID NO: 4013248 - DNA, 12 bp, Homo sapiens
gacggaggggag

SEQ ID NO: 4013249 - DNA, 20 bp, Homo sapiens
gacggcaggctcactgccag

SEQ ID NO: 4013250 - DNA, 15 bp, Homo sapiens
gacggcctgatgctc

SEQ ID NO: 4013251 - DNA, 20 bp, Homo sapiens
gacggcctgatgctccctcc

SEQ ID NO: 4013252 - DNA, 15 bp, Homo sapiens
gacggcggccaggca

SEQ ID NO: 4013253 - DNA, 16 bp, Homo sapiens
gacggcggccaggcac

SEQ ID NO: 4013254 - DNA, 22 bp, Homo sapiens
gacggctcctcagagcgccagg

SEQ ID NO: 4013255 - DNA, 14 bp, Homo sapiens
gacggctgtggacc

SEQ ID NO: 4013256 - DNA, 23 bp, Homo sapiens
gacggctgtggaccgtggacagg

SEQ ID NO: 4013257 - DNA, 19 bp, Homo sapiens
gacgggaggggaaaggctg

SEQ ID NO: 4013258 - DNA, 15 bp, Homo sapiens
gacgggcacagacac

SEQ ID NO: 4013259 - DNA, 16 bp, Homo sapiens
gacggtcccacactgg

SEQ ID NO: 4013260 - DNA, 21 bp, Homo sapiens
gacggtgggcatttgtgaggc

SEQ ID NO: 4013261 - DNA, 18 bp, Homo sapiens
gacgtcaagtctccttcc

SEQ ID NO: 4013262 - DNA, 13 bp, Homo sapiens
gacgtcaggccct

SEQ ID NO: 4013263 - DNA, 14 bp, Homo sapiens
gacgtcaggccctg

SEQ ID NO: 4013264 - DNA, 19 bp, Homo sapiens
gacgtcaggccctgactcc

SEQ ID NO: 4013265 - DNA, 20 bp, Homo sapiens
gacgtggaacctctgtctca

SEQ ID NO: 4013266 - DNA, 14 bp, Homo sapiens
gacgttgcctgaga

SEQ ID NO: 4013267 - DNA, 20 bp, Homo sapiens
gacgtttttgtgctgtgggc

SEQ ID NO: 4013268 - DNA, 20 bp, Homo sapiens
gactaaaggatccagagagc

SEQ ID NO: 4013269 - DNA, 23 bp, Homo sapiens
gactaaaggatccagagagcagc

SEQ ID NO: 4013270 - DNA, 12 bp, Homo sapiens
gactaatttcaa

SEQ ID NO: 4013271 - DNA, 13 bp, Homo sapiens
gactaatttcaaa

SEQ ID NO: 4013272 - DNA, 15 bp, Homo sapiens
gactacaaaaatgaa

SEQ ID NO: 4013273 - DNA, 21 bp, Homo sapiens
gactacaaaatacaatcctgt

SEQ ID NO: 4013274 - DNA, 14 bp, Homo sapiens
gactacttagcatc

SEQ ID NO: 4013275 - DNA, 21 bp, Homo sapiens
gactacttagcatcctaagaa

SEQ ID NO: 4013276 - DNA, 18 bp, Homo sapiens
gactacttgggagcaccg

SEQ ID NO: 4013277 - DNA, 15 bp, Homo sapiens
gactagaagggccag

SEQ ID NO: 4013278 - DNA, 14 bp, Homo sapiens
gactagacacacaa

SEQ ID NO: 4013279 - DNA, 14 bp, Homo sapiens
gactagatgatgga

SEQ ID NO: 4013280 - DNA, 21 bp, Homo sapiens
gactagatgatggatgccaat

SEQ ID NO: 4013281 - DNA, 17 bp, Homo sapiens
gactagtacaaattata

SEQ ID NO: 4013282 - DNA, 19 bp, Homo sapiens
gactagtgccgtagggagt

SEQ ID NO: 4013283 - DNA, 17 bp, Homo sapiens
gactatagcccaggtcc

SEQ ID NO: 4013284 - DNA, 23 bp, Homo sapiens
gactatggtgctgccttgcttct

SEQ ID NO: 4013285 - DNA, 17 bp, Homo sapiens
gactattccttttctgt

SEQ ID NO: 4013286 - DNA, 23 bp, Homo sapiens
gactatttaaacttataaatcat

SEQ ID NO: 4013287 - DNA, 14 bp, Homo sapiens
gactcaagagaatt

SEQ ID NO: 4013288 - DNA, 19 bp, Homo sapiens
gactcaagtacccattctg

SEQ ID NO: 4013289 - DNA, 23 bp, Homo sapiens
gactcacttacatcttctgtgaa

SEQ ID NO: 4013290 - DNA, 12 bp, Homo sapiens
gactcagcagtg

SEQ ID NO: 4013291 - DNA, 14 bp, Homo sapiens
gactcagcagtgac

SEQ ID NO: 4013292 - DNA, 13 bp, Homo sapiens
gactcagccctga

SEQ ID NO: 4013293 - DNA, 20 bp, Homo sapiens
gactcagggaccggtgctgc

SEQ ID NO: 4013294 - DNA, 24 bp, Homo sapiens
gactcagggaccggtgctgcagga

SEQ ID NO: 4013295 - DNA, 16 bp, Homo sapiens
gactcagggcagcgcc

SEQ ID NO: 4013296 - DNA, 17 bp, Homo sapiens
gactcagggcagcgcca

SEQ ID NO: 4013297 - DNA, 19 bp, Homo sapiens
gactcagggccatgcctgc

SEQ ID NO: 4013298 - DNA, 15 bp, Homo sapiens
gactcaggttgtctg

SEQ ID NO: 4013299 - DNA, 15 bp, Homo sapiens
gactcagtttgtcag

SEQ ID NO: 4013300 - DNA, 12 bp, Homo sapiens
gactcatggcag

SEQ ID NO: 4013301 - DNA, 16 bp, Homo sapiens
gactcatggcagctgt

SEQ ID NO: 4013302 - DNA, 14 bp, Homo sapiens
gactccaggcccaa

SEQ ID NO: 4013303 - DNA, 12 bp, Homo sapiens
gactccatctct

SEQ ID NO: 4013304 - DNA, 17 bp, Homo sapiens
gactccatctctcatcc

SEQ ID NO: 4013305 - DNA, 21 bp, Homo sapiens
gactccatctctcatcctcca

SEQ ID NO: 4013306 - DNA, 18 bp, Homo sapiens
gactccatctcttctgca

SEQ ID NO: 4013307 - DNA, 22 bp, Homo sapiens
gactcccaagtttccatagcaa

SEQ ID NO: 4013308 - DNA, 22 bp, Homo sapiens
gactcccattcctgaagaacca

SEQ ID NO: 4013309 - DNA, 16 bp, Homo sapiens
gactccccaggccagg

SEQ ID NO: 4013310 - DNA, 18 bp, Homo sapiens
gactccccaggccaggcc

SEQ ID NO: 4013311 - DNA, 17 bp, Homo sapiens
gactcccgggccacgcc

SEQ ID NO: 4013312 - DNA, 13 bp, Homo sapiens
gactccctgtggg

SEQ ID NO: 4013313 - DNA, 19 bp, Homo sapiens
gactccgccctcctcgggc

SEQ ID NO: 4013314 - DNA, 17 bp, Homo sapiens
gactcctcctttttcca

SEQ ID NO: 4013315 - DNA, 14 bp, Homo sapiens
gagcacaggcagct

SEQ ID NO: 4013316 - DNA, 22 bp, Homo sapiens
gagcacatgttactgcttcatt

SEQ ID NO: 4013317 - DNA, 16 bp, Homo sapiens
gagcacccattccaaa

SEQ ID NO: 4013318 - DNA, 19 bp, Homo sapiens
gagcacccattccaaagct

SEQ ID NO: 4013319 - DNA, 15 bp, Homo sapiens
gagcaccccctgctc

SEQ ID NO: 4013320 - DNA, 20 bp, Homo sapiens
gagcaccccctgctccacca

SEQ ID NO: 4013321 - DNA, 14 bp, Homo sapiens
gagcaccctctgga

SEQ ID NO: 4013322 - DNA, 22 bp, Homo sapiens
gagcaccgcctgtgaaatacca

SEQ ID NO: 4013323 - DNA, 19 bp, Homo sapiens
gagcaccttcctcacttcc

SEQ ID NO: 4013324 - DNA, 21 bp, Homo sapiens
gagcagacaggaggaatcatg

SEQ ID NO: 4013325 - DNA, 22 bp, Homo sapiens
gagcagaccaccccgcctgccc

SEQ ID NO: 4013326 - DNA, 16 bp, Homo sapiens
gagcagagaattctct

SEQ ID NO: 4013327 - DNA, 24 bp, Homo sapiens
gagcagagacatgactcagcctgt

SEQ ID NO: 4013328 - DNA, 13 bp, Homo sapiens
gagcagaggaggg

SEQ ID NO: 4013329 - DNA, 14 bp, Homo sapiens
gagcagaggtctcc

SEQ ID NO: 4013330 - DNA, 14 bp, Homo sapiens
gagcagagtctggg

SEQ ID NO: 4013331 - DNA, 17 bp, Homo sapiens
gagcagagtctgggcct

SEQ ID NO: 4013332 - DNA, 21 bp, Homo sapiens
gagcagcagcaccaaccacag

SEQ ID NO: 4013333 - DNA, 22 bp, Homo sapiens
gagcagcagcaccaaccacagc

SEQ ID NO: 4013334 - DNA, 16 bp, Homo sapiens
gagcagcagcttgggg

SEQ ID NO: 4013335 - DNA, 21 bp, Homo sapiens
gagcagcctctggacagccag

SEQ ID NO: 4013336 - DNA, 18 bp, Homo sapiens
gagcagcctgtggcatct

SEQ ID NO: 4013337 - DNA, 18 bp, Homo sapiens
gagcagcggtttggggag

SEQ ID NO: 4013338 - DNA, 18 bp, Homo sapiens
gagcagctccccaggagc

SEQ ID NO: 4013339 - DNA, 22 bp, Homo sapiens
gagcagctttaaactcagggac

SEQ ID NO: 4013340 - DNA, 14 bp, Homo sapiens
gagcagctttggga

SEQ ID NO: 4013341 - DNA, 22 bp, Homo sapiens
gagcaggaagcattcagagagc

SEQ ID NO: 4013342 - DNA, 23 bp, Homo sapiens
gagcaggaagcattcagagagca

SEQ ID NO: 4013343 - DNA, 14 bp, Homo sapiens
gagcaggaggccaa

SEQ ID NO: 4013344 - DNA, 21 bp, Homo sapiens
gagcaggcaaaaaagggacag

SEQ ID NO: 4013345 - DNA, 22 bp, Homo sapiens
gagcaggccggaaccacagggc

SEQ ID NO: 4013346 - DNA, 14 bp, Homo sapiens
gagcagggaaggcc

SEQ ID NO: 4013347 - DNA, 16 bp, Homo sapiens
gagcagtcacactgtt

SEQ ID NO: 4013348 - DNA, 16 bp, Homo sapiens
gagcagtcctgcctca

SEQ ID NO: 4013349 - DNA, 15 bp, Homo sapiens
gagcagtgagcagaa

SEQ ID NO: 4013350 - DNA, 14 bp, Homo sapiens
gagcagtggctggt

SEQ ID NO: 4013351 - DNA, 18 bp, Homo sapiens
gagcagtgtcttccataa

SEQ ID NO: 4013352 - DNA, 19 bp, Homo sapiens
gagcagtttcatctggttg

SEQ ID NO: 4013353 - DNA, 16 bp, Homo sapiens
gagcagtttgccaccc

SEQ ID NO: 4013354 - DNA, 16 bp, Homo sapiens
gagcatctggctgttt

SEQ ID NO: 4013355 - DNA, 22 bp, Homo sapiens
gagcatctggctgtttagcaga

SEQ ID NO: 4013356 - DNA, 17 bp, Homo sapiens
gagcatgggcctggcca

SEQ ID NO: 4013357 - DNA, 20 bp, Homo sapiens
gagcattacgtgagccaggt

SEQ ID NO: 4013358 - DNA, 14 bp, Homo sapiens
gagcattagctggc

SEQ ID NO: 4013359 - DNA, 21 bp, Homo sapiens
gagcattataatcaccagggc

SEQ ID NO: 4013360 - DNA, 23 bp, Homo sapiens
gagcatttccaacaccacagaca

SEQ ID NO: 4013361 - DNA, 19 bp, Homo sapiens
gagcatttttttattcagc

SEQ ID NO: 4013362 - DNA, 21 bp, Homo sapiens
gagcatttttttattcagcag

SEQ ID NO: 4013363 - DNA, 14 bp, Homo sapiens
gagccaacctcggc

SEQ ID NO: 4013364 - DNA, 22 bp, Homo sapiens
gagccaacctcggcttgtgggc

SEQ ID NO: 4013365 - DNA, 21 bp, Homo sapiens
gagccaagatcgcgccactgc

SEQ ID NO: 4013366 - DNA, 22 bp, Homo sapiens
gagccaagccttaaactgtaca

SEQ ID NO: 4013367 - DNA, 16 bp, Homo sapiens
gagccacagaccacct

SEQ ID NO: 4013368 - DNA, 14 bp, Homo sapiens
gagccacagtggga

SEQ ID NO: 4013369 - DNA, 14 bp, Homo sapiens
gagccaccgtgcct

SEQ ID NO: 4013370 - DNA, 20 bp, Homo sapiens
gagccaccgtgcctggccag

SEQ ID NO: 4013371 - DNA, 23 bp, Homo sapiens
gagccacctggatctatccctgc

SEQ ID NO: 4013372 - DNA, 18 bp, Homo sapiens
gagccactctcttccctt

SEQ ID NO: 4013373 - DNA, 16 bp, Homo sapiens
gagccacttctcccca

SEQ ID NO: 4013374 - DNA, 15 bp, Homo sapiens
gagccagatgcagga

SEQ ID NO: 4013375 - DNA, 20 bp, Homo sapiens
gagccagatgcaggacagga

SEQ ID NO: 4013376 - DNA, 12 bp, Homo sapiens
gagccagcaggg

SEQ ID NO: 4013377 - DNA, 14 bp, Homo sapiens
gagccagcagggca

SEQ ID NO: 4013378 - DNA, 18 bp, Homo sapiens
gagccagctccctctatt

SEQ ID NO: 4013379 - DNA, 15 bp, Homo sapiens
gagccagctgctttt

SEQ ID NO: 4013380 - DNA, 23 bp, Homo sapiens
gagccagtgagggcagtcctgca

SEQ ID NO: 4013381 - DNA, 20 bp, Homo sapiens
gagccatcactagaagaaaa

SEQ ID NO: 4013382 - DNA, 22 bp, Homo sapiens
gagccatcggtgaaactaacag

SEQ ID NO: 4013383 - DNA, 22 bp, Homo sapiens
gagccatggaccacgcaggaag

SEQ ID NO: 4013384 - DNA, 21 bp, Homo sapiens
gagccattttgtgaatggatt

SEQ ID NO: 4013385 - DNA, 24 bp, Homo sapiens
gagcccactgtcctgggcctgcag

SEQ ID NO: 4013386 - DNA, 14 bp, Homo sapiens
gagcccagagaaca

SEQ ID NO: 4013387 - DNA, 18 bp, Homo sapiens
gagcccagccctccccat

SEQ ID NO: 4013388 - DNA, 12 bp, Homo sapiens
gagcccagctcc

SEQ ID NO: 4013389 - DNA, 14 bp, Homo sapiens
gagcccagctccaa

SEQ ID NO: 4013390 - DNA, 17 bp, Homo sapiens
gagcccagctgcctgga

SEQ ID NO: 4013391 - DNA, 13 bp, Homo sapiens
gagcccagctggg

SEQ ID NO: 4013392 - DNA, 12 bp, Homo sapiens
gagcccaggagt

SEQ ID NO: 4013393 - DNA, 22 bp, Homo sapiens
gagcccagggcatcttgctggc

SEQ ID NO: 4013394 - DNA, 16 bp, Homo sapiens
gagcccagtctgttga

SEQ ID NO: 4013395 - DNA, 19 bp, Homo sapiens
gagcccagtgaagcctctg

SEQ ID NO: 4013396 - DNA, 22 bp, Homo sapiens
gagcccatactcagcctgctgc

SEQ ID NO: 4013397 - DNA, 22 bp, Homo sapiens
gagcccatgctcaaccactgtg

SEQ ID NO: 4013398 - DNA, 16 bp, Homo sapiens
gagccccagctaccct

SEQ ID NO: 4013399 - DNA, 13 bp, Homo sapiens
gagccccaggcct

SEQ ID NO: 4013400 - DNA, 18 bp, Homo sapiens
gagccccaggcctctgtg

SEQ ID NO: 4013401 - DNA, 19 bp, Homo sapiens
gagccccagggtcttccct

SEQ ID NO: 4013402 - DNA, 14 bp, Homo sapiens
gagcccccaccttg

SEQ ID NO: 4013403 - DNA, 20 bp, Homo sapiens
gagcccccaccttgatccca

SEQ ID NO: 4013404 - DNA, 14 bp, Homo sapiens
gagccccctctgcc

SEQ ID NO: 4013405 - DNA, 17 bp, Homo sapiens
gagcccctcctccagcc

SEQ ID NO: 4013406 - DNA, 21 bp, Homo sapiens
gagcccctcctccagcccctg

SEQ ID NO: 4013407 - DNA, 12 bp, Homo sapiens
gagcccctggtc

SEQ ID NO: 4013408 - DNA, 20 bp, Homo sapiens
gagcccctggtcctgagggt

SEQ ID NO: 4013409 - DNA, 18 bp, Homo sapiens
gagccccttcgggagcag

SEQ ID NO: 4013410 - DNA, 20 bp, Homo sapiens
gagccccttctgctcagctc

SEQ ID NO: 4013411 - DNA, 17 bp, Homo sapiens
gagcccggcgcccctgc

SEQ ID NO: 4013412 - DNA, 17 bp, Homo sapiens
gagccctgaccttggct

SEQ ID NO: 4013413 - DNA, 19 bp, Homo sapiens
gagccctggacacccctgc

SEQ ID NO: 4013414 - DNA, 14 bp, Homo sapiens
gagccctggctggg

SEQ ID NO: 4013415 - DNA, 17 bp, Homo sapiens
gagccctggctgggttc

SEQ ID NO: 4013416 - DNA, 12 bp, Homo sapiens
gagccctgggga

SEQ ID NO: 4013417 - DNA, 15 bp, Homo sapiens
gagtaacaatacaaa

SEQ ID NO: 4013418 - DNA, 13 bp, Homo sapiens
gagtaacatttgc

SEQ ID NO: 4013419 - DNA, 15 bp, Homo sapiens
gagtaacatttgctg

SEQ ID NO: 4013420 - DNA, 12 bp, Homo sapiens
gagtaagagctg

SEQ ID NO: 4013421 - DNA, 22 bp, Homo sapiens
gagtaatggtgtagaacactaa

SEQ ID NO: 4013422 - DNA, 20 bp, Homo sapiens
gagtaatgtgactaaaggaa

SEQ ID NO: 4013423 - DNA, 23 bp, Homo sapiens
gagtacaaatgccttaaaatgga

SEQ ID NO: 4013424 - DNA, 20 bp, Homo sapiens
gagtactatatttgtgaata

SEQ ID NO: 4013425 - DNA, 14 bp, Homo sapiens
gagtagaattgcat

SEQ ID NO: 4013426 - DNA, 12 bp, Homo sapiens
gagtagagaagt

SEQ ID NO: 4013427 - DNA, 21 bp, Homo sapiens
gagtaggcggcgatttttgta

SEQ ID NO: 4013428 - DNA, 21 bp, Homo sapiens
gagtagtgaagactccagaaa

SEQ ID NO: 4013429 - DNA, 14 bp, Homo sapiens
gagtagtgtggaat

SEQ ID NO: 4013430 - DNA, 19 bp, Homo sapiens
gagtcaaaactacaaatca

SEQ ID NO: 4013431 - DNA, 15 bp, Homo sapiens
gagtcaatgtgcagt

SEQ ID NO: 4013432 - DNA, 11 bp, Homo sapiens
gagtcacctgc

SEQ ID NO: 4013433 - DNA, 14 bp, Homo sapiens
gagtcacctgctcc

SEQ ID NO: 4013434 - DNA, 18 bp, Homo sapiens
gagtcacctgctccagaa

SEQ ID NO: 4013435 - DNA, 21 bp, Homo sapiens
gagtcaccttttctgtggctg

SEQ ID NO: 4013436 - DNA, 20 bp, Homo sapiens
gagtcacgctggggctctct

SEQ ID NO: 4013437 - DNA, 21 bp, Homo sapiens
gagtcacgctggggctctctg

SEQ ID NO: 4013438 - DNA, 14 bp, Homo sapiens
gagtcagagccctg

SEQ ID NO: 4013439 - DNA, 15 bp, Homo sapiens
gagtcagagccctgg

SEQ ID NO: 4013440 - DNA, 17 bp, Homo sapiens
gagtcagagccctggct

SEQ ID NO: 4013441 - DNA, 20 bp, Homo sapiens
gagtcagagccctggctggg

SEQ ID NO: 4013442 - DNA, 21 bp, Homo sapiens
gagtcagatgagcaaggacat

SEQ ID NO: 4013443 - DNA, 18 bp, Homo sapiens
gagtcagctctctgccct

SEQ ID NO: 4013444 - DNA, 16 bp, Homo sapiens
gagtcagctgtttcta

SEQ ID NO: 4013445 - DNA, 14 bp, Homo sapiens
gagtcagtgtctgg

SEQ ID NO: 4013446 - DNA, 17 bp, Homo sapiens
gagtcagtgtctggctt

SEQ ID NO: 4013447 - DNA, 22 bp, Homo sapiens
gagtcatctgttagggccttgg

SEQ ID NO: 4013448 - DNA, 13 bp, Homo sapiens
gagtcatttaaat

SEQ ID NO: 4013449 - DNA, 12 bp, Homo sapiens
gagtccaagctg

SEQ ID NO: 4013450 - DNA, 12 bp, Homo sapiens
gagtccaaggcc

SEQ ID NO: 4013451 - DNA, 12 bp, Homo sapiens
gagtccagggaa

SEQ ID NO: 4013452 - DNA, 18 bp, Homo sapiens
gagtccagggtttctctg

SEQ ID NO: 4013453 - DNA, 23 bp, Homo sapiens
gagtccagggtttctctgcagat

SEQ ID NO: 4013454 - DNA, 16 bp, Homo sapiens
gagtccattctcccag

SEQ ID NO: 4013455 - DNA, 15 bp, Homo sapiens
gagtcccaaggaaag

SEQ ID NO: 4013456 - DNA, 17 bp, Homo sapiens
gagtccctacctgcttc

SEQ ID NO: 4013457 - DNA, 17 bp, Homo sapiens
gagtcctcactcccagt

SEQ ID NO: 4013458 - DNA, 14 bp, Homo sapiens
gagtcctccagaac

SEQ ID NO: 4013459 - DNA, 19 bp, Homo sapiens
gagtcctctagcaggccta

SEQ ID NO: 4013460 - DNA, 14 bp, Homo sapiens
gagtctccctctga

SEQ ID NO: 4013461 - DNA, 16 bp, Homo sapiens
gagtctccctctgatt

SEQ ID NO: 4013462 - DNA, 19 bp, Homo sapiens
gagtctcctctctgagact

SEQ ID NO: 4013463 - DNA, 16 bp, Homo sapiens
gagtctctgccaccca

SEQ ID NO: 4013464 - DNA, 18 bp, Homo sapiens
gagtctctgccacccact

SEQ ID NO: 4013465 - DNA, 18 bp, Homo sapiens
gagtctcttctccactgg

SEQ ID NO: 4013466 - DNA, 14 bp, Homo sapiens
gagtctgggcctct

SEQ ID NO: 4013467 - DNA, 15 bp, Homo sapiens
gagtgaaccatcatt

SEQ ID NO: 4013468 - DNA, 16 bp, Homo sapiens
gagtgaacctaccttc

SEQ ID NO: 4013469 - DNA, 15 bp, Homo sapiens
gagtgaataaatgtc

SEQ ID NO: 4013470 - DNA, 15 bp, Homo sapiens
gagtgacggtcccac

SEQ ID NO: 4013471 - DNA, 20 bp, Homo sapiens
gagtgacggtcccacactgg

SEQ ID NO: 4013472 - DNA, 15 bp, Homo sapiens
gagtgactcgagggt

SEQ ID NO: 4013473 - DNA, 15 bp, Homo sapiens
gagtgagctacagag

SEQ ID NO: 4013474 - DNA, 14 bp, Homo sapiens
gagtgagtcacctg

SEQ ID NO: 4013475 - DNA, 15 bp, Homo sapiens
gagtgagtcacctgc

SEQ ID NO: 4013476 - DNA, 16 bp, Homo sapiens
gagtgagtcacctgct

SEQ ID NO: 4013477 - DNA, 18 bp, Homo sapiens
gagtgagtcacctgctcc

SEQ ID NO: 4013478 - DNA, 20 bp, Homo sapiens
gagtgattgcagctttatgt

SEQ ID NO: 4013479 - DNA, 23 bp, Homo sapiens
gagtgcaaaaggcttgcagaact

SEQ ID NO: 4013480 - DNA, 13 bp, Homo sapiens
gagtgcacagctg

SEQ ID NO: 4013481 - DNA, 15 bp, Homo sapiens
gagtgcacagctgtc

SEQ ID NO: 4013482 - DNA, 20 bp, Homo sapiens
gagtgccaggactccccagg

SEQ ID NO: 4013483 - DNA, 17 bp, Homo sapiens
gagtgccctgctttgca

SEQ ID NO: 4013484 - DNA, 14 bp, Homo sapiens
gagtgccttttgca

SEQ ID NO: 4013485 - DNA, 14 bp, Homo sapiens
gagtgcgggctgag

SEQ ID NO: 4013486 - DNA, 18 bp, Homo sapiens
gagtgctgaggccagggc

SEQ ID NO: 4013487 - DNA, 12 bp, Homo sapiens
gagtgctggcac

SEQ ID NO: 4013488 - DNA, 14 bp, Homo sapiens
gagtgctggctcac

SEQ ID NO: 4013489 - DNA, 22 bp, Homo sapiens
gagtggatctccaaggaccagg

SEQ ID NO: 4013490 - DNA, 12 bp, Homo sapiens
gagtggcctggc

SEQ ID NO: 4013491 - DNA, 14 bp, Homo sapiens
gagtggcctggcca

SEQ ID NO: 4013492 - DNA, 19 bp, Homo sapiens
gagtgggagaaggcagtga

SEQ ID NO: 4013493 - DNA, 21 bp, Homo sapiens
gagtggtctttctggagaggt

SEQ ID NO: 4013494 - DNA, 16 bp, Homo sapiens
gagtgtagaagcattc

SEQ ID NO: 4013495 - DNA, 20 bp, Homo sapiens
gagtgtagaagcattccttc

SEQ ID NO: 4013496 - DNA, 19 bp, Homo sapiens
gagtgtcctgcccatgccc

SEQ ID NO: 4013497 - DNA, 19 bp, Homo sapiens
gagtgtccttagtgtataa

SEQ ID NO: 4013498 - DNA, 17 bp, Homo sapiens
gagtgtctctgataaaa

SEQ ID NO: 4013499 - DNA, 16 bp, Homo sapiens
gagtgtgacagggcca

SEQ ID NO: 4013500 - DNA, 13 bp, Homo sapiens
gagtgtgcatgga

SEQ ID NO: 4013501 - DNA, 15 bp, Homo sapiens
gagtgtgcatggagg

SEQ ID NO: 4013502 - DNA, 20 bp, Homo sapiens
gagtgtgcatggaggccctc

SEQ ID NO: 4013503 - DNA, 16 bp, Homo sapiens
gagtgtgtattgttcc

SEQ ID NO: 4013504 - DNA, 13 bp, Homo sapiens
gagttaagaagct

SEQ ID NO: 4013505 - DNA, 12 bp, Homo sapiens
gagttaagacct

SEQ ID NO: 4013506 - DNA, 13 bp, Homo sapiens
gagttaagacctg

SEQ ID NO: 4013507 - DNA, 18 bp, Homo sapiens
gagttacagcgagaggca

SEQ ID NO: 4013508 - DNA, 18 bp, Homo sapiens
gagttatctaaaagaaat

SEQ ID NO: 4013509 - DNA, 22 bp, Homo sapiens
gagttatgataacaccagtggg

SEQ ID NO: 4013510 - DNA, 17 bp, Homo sapiens
gagttatgatgtaatct

SEQ ID NO: 4013511 - DNA, 12 bp, Homo sapiens
gagttcacagga

SEQ ID NO: 4013512 - DNA, 14 bp, Homo sapiens
gagttcacaggagg

SEQ ID NO: 4013513 - DNA, 17 bp, Homo sapiens
gagttccttatccctct

SEQ ID NO: 4013514 - DNA, 11 bp, Homo sapiens
gagttctacat

SEQ ID NO: 4013515 - DNA, 22 bp, Homo sapiens
gagttctccctgtacagtgtta

SEQ ID NO: 4013516 - DNA, 17 bp, Homo sapiens
gagttctgggtttctag

SEQ ID NO: 4013517 - DNA, 21 bp, Homo sapiens
gagttcttaaggattgtgata

SEQ ID NO: 4013518 - DNA, 14 bp, Homo sapiens
gagttgatctggaa

SEQ ID NO: 4013519 - DNA, 17 bp, Homo sapiens
gagttgatctggaaccc

SEQ ID NO: 4013520 - DNA, 20 bp, Homo sapiens
gagttgatgactttctgttt

SEQ ID NO: 4013521 - DNA, 21 bp, Homo sapiens
gattgtgaatatttccatatg

SEQ ID NO: 4013522 - DNA, 23 bp, Homo sapiens
gattgttaggagtggttctcatt

SEQ ID NO: 4013523 - DNA, 13 bp, Homo sapiens
gatttaaaaagtg

SEQ ID NO: 4013524 - DNA, 19 bp, Homo sapiens
gatttaacagtcatttaaa

SEQ ID NO: 4013525 - DNA, 15 bp, Homo sapiens
gatttaataaaataa

SEQ ID NO: 4013526 - DNA, 23 bp, Homo sapiens
gatttaataaaataattctaaag

SEQ ID NO: 4013527 - DNA, 20 bp, Homo sapiens
gatttaggagaagccaggaa

SEQ ID NO: 4013528 - DNA, 15 bp, Homo sapiens
gatttagtttcagta

SEQ ID NO: 4013529 - DNA, 13 bp, Homo sapiens
gatttataaatgc

SEQ ID NO: 4013530 - DNA, 20 bp, Homo sapiens
gatttcaggatactctgtca

SEQ ID NO: 4013531 - DNA, 22 bp, Homo sapiens
gatttcaggatactctgtcaga

SEQ ID NO: 4013532 - DNA, 21 bp, Homo sapiens
gatttcagtcatagcaagctt

SEQ ID NO: 4013533 - DNA, 17 bp, Homo sapiens
gatttcatagttcagaa

SEQ ID NO: 4013534 - DNA, 12 bp, Homo sapiens
gatttcccctct

SEQ ID NO: 4013535 - DNA, 15 bp, Homo sapiens
gatttccttcaatgt

SEQ ID NO: 4013536 - DNA, 13 bp, Homo sapiens
gatttccttgaat

SEQ ID NO: 4013537 - DNA, 17 bp, Homo sapiens
gatttccttgaatgtgg

SEQ ID NO: 4013538 - DNA, 23 bp, Homo sapiens
gatttctagaaagcctgttcccc

SEQ ID NO: 4013539 - DNA, 13 bp, Homo sapiens
gatttgaactcag

SEQ ID NO: 4013540 - DNA, 16 bp, Homo sapiens
gatttgaactcagatc

SEQ ID NO: 4013541 - DNA, 22 bp, Homo sapiens
gatttgaactcagatctgtctg

SEQ ID NO: 4013542 - DNA, 14 bp, Homo sapiens
gatttgatgtgact

SEQ ID NO: 4013543 - DNA, 22 bp, Homo sapiens
gatttgatgtgactttttttgg

SEQ ID NO: 4013544 - DNA, 21 bp, Homo sapiens
gatttgattcattttcctgtt

SEQ ID NO: 4013545 - DNA, 14 bp, Homo sapiens
gatttgcaaaaaaa

SEQ ID NO: 4013546 - DNA, 13 bp, Homo sapiens
gatttgcatggat

SEQ ID NO: 4013547 - DNA, 15 bp, Homo sapiens
gatttgcattgaaca

SEQ ID NO: 4013548 - DNA, 20 bp, Homo sapiens
gatttggcttgacaaaggca

SEQ ID NO: 4013549 - DNA, 17 bp, Homo sapiens
gatttgtagcactgagg

SEQ ID NO: 4013550 - DNA, 17 bp, Homo sapiens
gatttgtcactgcttca

SEQ ID NO: 4013551 - DNA, 23 bp, Homo sapiens
gattttaacaataactactgtgt

SEQ ID NO: 4013552 - DNA, 20 bp, Homo sapiens
gattttatctgtgaattcag

SEQ ID NO: 4013553 - DNA, 15 bp, Homo sapiens
gattttattttacta

SEQ ID NO: 4013554 - DNA, 12 bp, Homo sapiens
gattttcagtta

SEQ ID NO: 4013555 - DNA, 15 bp, Homo sapiens
gattttcatgttctt

SEQ ID NO: 4013556 - DNA, 17 bp, Homo sapiens
gattttctactgtaaga

SEQ ID NO: 4013557 - DNA, 12 bp, Homo sapiens
gattttctattg

SEQ ID NO: 4013558 - DNA, 18 bp, Homo sapiens
gattttctattgttactc

SEQ ID NO: 4013559 - DNA, 15 bp, Homo sapiens
gattttgctgtatat

SEQ ID NO: 4013560 - DNA, 22 bp, Homo sapiens
gattttgggagtgactcaagaa

SEQ ID NO: 4013561 - DNA, 16 bp, Homo sapiens
gattttgtaacccaga

SEQ ID NO: 4013562 - DNA, 13 bp, Homo sapiens
gatttttaagaac

SEQ ID NO: 4013563 - DNA, 16 bp, Homo sapiens
gatttttaagaacttc

SEQ ID NO: 4013564 - DNA, 16 bp, Homo sapiens
gatttttacaagatcc

SEQ ID NO: 4013565 - DNA, 19 bp, Homo sapiens
gatttttttaatagtgctt

SEQ ID NO: 4013566 - DNA, 16 bp, Homo sapiens
gatttttttcctcccc

SEQ ID NO: 4013567 - DNA, 20 bp, Homo sapiens
gatttttttgtgtatgtttt

SEQ ID NO: 4013568 - DNA, 21 bp, Homo sapiens
gatttttttttttttttcctt

SEQ ID NO: 4013569 - DNA, 18 bp, Homo sapiens
gcaaaaaaaaaaaaaagc

SEQ ID NO: 4013570 - DNA, 21 bp, Homo sapiens
gcaaaaacaaaaagaaaagaa

SEQ ID NO: 4013571 - DNA, 21 bp, Homo sapiens
gcaaaaccactagaactctcc

SEQ ID NO: 4013572 - DNA, 21 bp, Homo sapiens
gcaaaaccaggttttgttccg

SEQ ID NO: 4013573 - DNA, 12 bp, Homo sapiens
gcaaaaggcagc

SEQ ID NO: 4013574 - DNA, 16 bp, Homo sapiens
gcaaaaggcagctcac

SEQ ID NO: 4013575 - DNA, 17 bp, Homo sapiens
gcaaaaggcctcttgta

SEQ ID NO: 4013576 - DNA, 23 bp, Homo sapiens
gcaaaaggcctcttgtaaagact

SEQ ID NO: 4013577 - DNA, 22 bp, Homo sapiens
gcaaaatggaacgctaatgaaa

SEQ ID NO: 4013578 - DNA, 15 bp, Homo sapiens
gcaaacactccaccc

SEQ ID NO: 4013579 - DNA, 15 bp, Homo sapiens
gcaaacagaacaggg

SEQ ID NO: 4013580 - DNA, 18 bp, Homo sapiens
gcaaagataatttatttc

SEQ ID NO: 4013581 - DNA, 15 bp, Homo sapiens
gcaaagatcaaaata

SEQ ID NO: 4013582 - DNA, 21 bp, Homo sapiens
gcaaagatctgtcctcagcct

SEQ ID NO: 4013583 - DNA, 22 bp, Homo sapiens
gcaaagatctgtcctcagcctt

SEQ ID NO: 4013584 - DNA, 21 bp, Homo sapiens
gcaaagccacaaggctggcca

SEQ ID NO: 4013585 - DNA, 23 bp, Homo sapiens
gcaaagccacaaggctggccagc

SEQ ID NO: 4013586 - DNA, 21 bp, Homo sapiens
gcaaagctgatgacaacttcc

SEQ ID NO: 4013587 - DNA, 19 bp, Homo sapiens
gcaaaggacccttgagtaa

SEQ ID NO: 4013588 - DNA, 22 bp, Homo sapiens
gcaaagggctgaaagccatttg

SEQ ID NO: 4013589 - DNA, 19 bp, Homo sapiens
gcaaaggggacagctgtgt

SEQ ID NO: 4013590 - DNA, 23 bp, Homo sapiens
gcaaagggggaggagaagaaaat

SEQ ID NO: 4013591 - DNA, 21 bp, Homo sapiens
gcaaaggtggcaatgcttaaa

SEQ ID NO: 4013592 - DNA, 15 bp, Homo sapiens
gcaaagtttaaatgt

SEQ ID NO: 4013593 - DNA, 17 bp, Homo sapiens
gcaaagtttaaatgtat

SEQ ID NO: 4013594 - DNA, 20 bp, Homo sapiens
gcaaagtttaaatgtatttt

SEQ ID NO: 4013595 - DNA, 12 bp, Homo sapiens
gcaaataaaagt

SEQ ID NO: 4013596 - DNA, 12 bp, Homo sapiens
gcaaatcaatgc

SEQ ID NO: 4013597 - DNA, 22 bp, Homo sapiens
gcaaatcagaaacttgtgaagt

SEQ ID NO: 4013598 - DNA, 15 bp, Homo sapiens
gcaaatgcattctat

SEQ ID NO: 4013599 - DNA, 22 bp, Homo sapiens
gcaaatgcattctatcgttatt

SEQ ID NO: 4013600 - DNA, 12 bp, Homo sapiens
gcaaatgggagc

SEQ ID NO: 4013601 - DNA, 20 bp, Homo sapiens
gcaaatgttgggaaagtatt

SEQ ID NO: 4013602 - DNA, 22 bp, Homo sapiens
gcaacaagaccaccacttcgaa

SEQ ID NO: 4013603 - DNA, 19 bp, Homo sapiens
gcaacacaagctggaagca

SEQ ID NO: 4013604 - DNA, 15 bp, Homo sapiens
gcaacacagaggaat

SEQ ID NO: 4013605 - DNA, 16 bp, Homo sapiens
gcaacacagaggaatt

SEQ ID NO: 4013606 - DNA, 16 bp, Homo sapiens
gcaacagatctggaac

SEQ ID NO: 4013607 - DNA, 22 bp, Homo sapiens
gcaacagatctggaacctcagc

SEQ ID NO: 4013608 - DNA, 14 bp, Homo sapiens
gcaacagcaagaaa

SEQ ID NO: 4013609 - DNA, 18 bp, Homo sapiens
gcaacaggaatcaagagc

SEQ ID NO: 4013610 - DNA, 19 bp, Homo sapiens
gcaacaggacagagttcac

SEQ ID NO: 4013611 - DNA, 23 bp, Homo sapiens
gcaacatttacagtccttcaaaa

SEQ ID NO: 4013612 - DNA, 15 bp, Homo sapiens
gcaacatttgacaaa

SEQ ID NO: 4013613 - DNA, 22 bp, Homo sapiens
gcaacccagtcacactgtggcc

SEQ ID NO: 4013614 - DNA, 21 bp, Homo sapiens
gcaacccttaccccttagcct

SEQ ID NO: 4013615 - DNA, 15 bp, Homo sapiens
gcaacctcactatgg

SEQ ID NO: 4013616 - DNA, 13 bp, Homo sapiens
gcaacctctgcct

SEQ ID NO: 4013617 - DNA, 13 bp, Homo sapiens
gcaacgcccctcc

SEQ ID NO: 4013618 - DNA, 17 bp, Homo sapiens
gcaacgcccctccaaac

SEQ ID NO: 4013619 - DNA, 15 bp, Homo sapiens
gcaactgaagacaat

SEQ ID NO: 4013620 - DNA, 15 bp, Homo sapiens
gcaacttccgctgag

SEQ ID NO: 4013621 - DNA, 15 bp, Homo sapiens
gcaacttgaaattat

SEQ ID NO: 4013622 - DNA, 20 bp, Homo sapiens
gcaagacagaaaagtgcctg

SEQ ID NO: 4013623 - DNA, 14 bp, Homo sapiens
gcagatcacttgag

SEQ ID NO: 4013624 - DNA, 18 bp, Homo sapiens
gcagatccccactgtcct

SEQ ID NO: 4013625 - DNA, 19 bp, Homo sapiens
gcagatgcagctcttcctg

SEQ ID NO: 4013626 - DNA, 22 bp, Homo sapiens
gcagatggaatgctgtgttaaa

SEQ ID NO: 4013627 - DNA, 15 bp, Homo sapiens
gcagatgggcggacg

SEQ ID NO: 4013628 - DNA, 18 bp, Homo sapiens
gcagatgtattgactgta

SEQ ID NO: 4013629 - DNA, 20 bp, Homo sapiens
gcagatgtcttccctgggct

SEQ ID NO: 4013630 - DNA, 21 bp, Homo sapiens
gcagatgtcttccctgggctg

SEQ ID NO: 4013631 - DNA, 22 bp, Homo sapiens
gcagatgtgagccaccgtgcct

SEQ ID NO: 4013632 - DNA, 23 bp, Homo sapiens
gcagatgtgagccaccgtgcctg

SEQ ID NO: 4013633 - DNA, 14 bp, Homo sapiens
gcagattctatttc

SEQ ID NO: 4013634 - DNA, 20 bp, Homo sapiens
gcagattttacaaaagatgt

SEQ ID NO: 4013635 - DNA, 17 bp, Homo sapiens
gcagcaactgaagacaa

SEQ ID NO: 4013636 - DNA, 17 bp, Homo sapiens
gcagcaaggccctgctg

SEQ ID NO: 4013637 - DNA, 16 bp, Homo sapiens
gcagcaatttaaatgt

SEQ ID NO: 4013638 - DNA, 17 bp, Homo sapiens
gcagcaatttaaatgtt

SEQ ID NO: 4013639 - DNA, 14 bp, Homo sapiens
gcagcaccaaccac

SEQ ID NO: 4013640 - DNA, 21 bp, Homo sapiens
gcagcaccaaccacagcatcg

SEQ ID NO: 4013641 - DNA, 19 bp, Homo sapiens
gcagcaccctcccccgcag

SEQ ID NO: 4013642 - DNA, 20 bp, Homo sapiens
gcagcaccctcccccgcagc

SEQ ID NO: 4013643 - DNA, 18 bp, Homo sapiens
gcagcacctccaggcctg

SEQ ID NO: 4013644 - DNA, 19 bp, Homo sapiens
gcagcacctccaggcctgt

SEQ ID NO: 4013645 - DNA, 21 bp, Homo sapiens
gcagcagagagagaggacaga

SEQ ID NO: 4013646 - DNA, 13 bp, Homo sapiens
gcagcagcaccaa

SEQ ID NO: 4013647 - DNA, 13 bp, Homo sapiens
gcagcagcccaag

SEQ ID NO: 4013648 - DNA, 14 bp, Homo sapiens
gcagcagcccaagc

SEQ ID NO: 4013649 - DNA, 21 bp, Homo sapiens
gcagcagcccaagcttccctc

SEQ ID NO: 4013650 - DNA, 13 bp, Homo sapiens
gcagcaggcagct

SEQ ID NO: 4013651 - DNA, 12 bp, Homo sapiens
gcagcagggcag

SEQ ID NO: 4013652 - DNA, 15 bp, Homo sapiens
gcagcatctgctaat

SEQ ID NO: 4013653 - DNA, 12 bp, Homo sapiens
gcagcatggaaa

SEQ ID NO: 4013654 - DNA, 14 bp, Homo sapiens
gcagcatggaaaaa

SEQ ID NO: 4013655 - DNA, 15 bp, Homo sapiens
gcagcatggaaaaat

SEQ ID NO: 4013656 - DNA, 15 bp, Homo sapiens
gcagcattgactggt

SEQ ID NO: 4013657 - DNA, 21 bp, Homo sapiens
gcagccaaacccatgaggcaa

SEQ ID NO: 4013658 - DNA, 14 bp, Homo sapiens
gcagccaacctaag

SEQ ID NO: 4013659 - DNA, 12 bp, Homo sapiens
gcagccaggctg

SEQ ID NO: 4013660 - DNA, 14 bp, Homo sapiens
gcagccaggctgcc

SEQ ID NO: 4013661 - DNA, 21 bp, Homo sapiens
gcagcccaaaacccagggcaa

SEQ ID NO: 4013662 - DNA, 14 bp, Homo sapiens
gcagcccactgcac

SEQ ID NO: 4013663 - DNA, 13 bp, Homo sapiens
gcagcccatgccc

SEQ ID NO: 4013664 - DNA, 15 bp, Homo sapiens
gcagcccatgcccac

SEQ ID NO: 4013665 - DNA, 18 bp, Homo sapiens
gcagcccatgcccacctg

SEQ ID NO: 4013666 - DNA, 22 bp, Homo sapiens
gcagccccaaattgtcacctgc

SEQ ID NO: 4013667 - DNA, 16 bp, Homo sapiens
gcagcccccatgggct

SEQ ID NO: 4013668 - DNA, 16 bp, Homo sapiens
gcagccccccagcact

SEQ ID NO: 4013669 - DNA, 19 bp, Homo sapiens
gcagccccctccacaccag

SEQ ID NO: 4013670 - DNA, 13 bp, Homo sapiens
gcagccctagagc

SEQ ID NO: 4013671 - DNA, 17 bp, Homo sapiens
gcagccctagagcctgc

SEQ ID NO: 4013672 - DNA, 22 bp, Homo sapiens
gcagccctagagcctgcctgga

SEQ ID NO: 4013673 - DNA, 15 bp, Homo sapiens
gcagccctcaacagg

SEQ ID NO: 4013674 - DNA, 20 bp, Homo sapiens
gcagccctcaacaggcccag

SEQ ID NO: 4013675 - DNA, 13 bp, Homo sapiens
gcagccctgcttt

SEQ ID NO: 4013676 - DNA, 15 bp, Homo sapiens
gcagccgccagctgg

SEQ ID NO: 4013677 - DNA, 17 bp, Homo sapiens
gcagccgccagctggga

SEQ ID NO: 4013678 - DNA, 18 bp, Homo sapiens
gcagccggcacagggtct

SEQ ID NO: 4013679 - DNA, 14 bp, Homo sapiens
gcagccgtgccttc

SEQ ID NO: 4013680 - DNA, 15 bp, Homo sapiens
gcagccgtgccttca

SEQ ID NO: 4013681 - DNA, 20 bp, Homo sapiens
gcagcctatgggggctctcg

SEQ ID NO: 4013682 - DNA, 21 bp, Homo sapiens
gcagcctcatactcctgggct

SEQ ID NO: 4013683 - DNA, 17 bp, Homo sapiens
gcagcctccaacacaag

SEQ ID NO: 4013684 - DNA, 15 bp, Homo sapiens
gcagcctctggacag

SEQ ID NO: 4013685 - DNA, 21 bp, Homo sapiens
gcagcctctggacagccagtg

SEQ ID NO: 4013686 - DNA, 13 bp, Homo sapiens
gcagcctctgggc

SEQ ID NO: 4013687 - DNA, 24 bp, Homo sapiens
gcagcctgccttgcccactcctgc

SEQ ID NO: 4013688 - DNA, 14 bp, Homo sapiens
gcagcctggctggt

SEQ ID NO: 4013689 - DNA, 21 bp, Homo sapiens
gcagcctggctggtcctccca

SEQ ID NO: 4013690 - DNA, 13 bp, Homo sapiens
gcagccttgggga

SEQ ID NO: 4013691 - DNA, 14 bp, Homo sapiens
gcagcgaccgcccc

SEQ ID NO: 4013692 - DNA, 22 bp, Homo sapiens
gcagcgaccgccccctcctcta

SEQ ID NO: 4013693 - DNA, 14 bp, Homo sapiens
gcagcgggccaggc

SEQ ID NO: 4013694 - DNA, 13 bp, Homo sapiens
gcagctagtgcct

SEQ ID NO: 4013695 - DNA, 14 bp, Homo sapiens
gcagctagtgcctt

SEQ ID NO: 4013696 - DNA, 23 bp, Homo sapiens
gcagctcaagcagcgaccgcccc

SEQ ID NO: 4013697 - DNA, 21 bp, Homo sapiens
gcagctcacccctgggcaggc

SEQ ID NO: 4013698 - DNA, 14 bp, Homo sapiens
gcagctccccagga

SEQ ID NO: 4013699 - DNA, 19 bp, Homo sapiens
gcagctccctttctcagga

SEQ ID NO: 4013700 - DNA, 20 bp, Homo sapiens
gcagctctggacagccccac

SEQ ID NO: 4013701 - DNA, 13 bp, Homo sapiens
gcagctcttcctg

SEQ ID NO: 4013702 - DNA, 21 bp, Homo sapiens
gcagctgaggacacaccccac

SEQ ID NO: 4013703 - DNA, 21 bp, Homo sapiens
gcagctgatgttggaagagaa

SEQ ID NO: 4013704 - DNA, 17 bp, Homo sapiens
gcagctgattttaacaa

SEQ ID NO: 4013705 - DNA, 18 bp, Homo sapiens
gcagctgattttaacaat

SEQ ID NO: 4013706 - DNA, 22 bp, Homo sapiens
gcagctggactctgcatcccag

SEQ ID NO: 4013707 - DNA, 10 bp, Homo sapiens
gcagctgttg

SEQ ID NO: 4013708 - DNA, 19 bp, Homo sapiens
gcagctgttgtctcttctc

SEQ ID NO: 4013709 - DNA, 15 bp, Homo sapiens
gcagctgtttctcat

SEQ ID NO: 4013710 - DNA, 16 bp, Homo sapiens
gcagctgtttctcatg

SEQ ID NO: 4013711 - DNA, 12 bp, Homo sapiens
gcagcttccaga

SEQ ID NO: 4013712 - DNA, 15 bp, Homo sapiens
gcagctttctagaag

SEQ ID NO: 4013713 - DNA, 12 bp, Homo sapiens
gcagctttggga

SEQ ID NO: 4013714 - DNA, 14 bp, Homo sapiens
gcaggaactcccag

SEQ ID NO: 4013715 - DNA, 21 bp, Homo sapiens
gcaggaagcattcagagagca

SEQ ID NO: 4013716 - DNA, 13 bp, Homo sapiens
gcaggaagccagg

SEQ ID NO: 4013717 - DNA, 16 bp, Homo sapiens
gcaggaagccaggctg

SEQ ID NO: 4013718 - DNA, 13 bp, Homo sapiens
gcaggaaggagag

SEQ ID NO: 4013719 - DNA, 21 bp, Homo sapiens
gcaggaatatatgtgtgccta

SEQ ID NO: 4013720 - DNA, 23 bp, Homo sapiens
gcaggaccagtttgattgaggag

SEQ ID NO: 4013721 - DNA, 22 bp, Homo sapiens
gcaggacctggcatcatggtgg

SEQ ID NO: 4013722 - DNA, 20 bp, Homo sapiens
gcaggagagactgagcagcc

SEQ ID NO: 4013723 - DNA, 13 bp, Homo sapiens
gcaggagcagttt

SEQ ID NO: 4013724 - DNA, 18 bp, Homo sapiens
gcaggagccccgccacag

SEQ ID NO: 4013725 - DNA, 19 bp, Homo sapiens
gcaggagccccgccacagc

SEQ ID NO: 4013726 - DNA, 12 bp, Homo sapiens
gccagcacacag

SEQ ID NO: 4013727 - DNA, 15 bp, Homo sapiens
gccagcacacagggc

SEQ ID NO: 4013728 - DNA, 17 bp, Homo sapiens
gccagcaccctctcctg

SEQ ID NO: 4013729 - DNA, 19 bp, Homo sapiens
gccagcaccctctcctggg

SEQ ID NO: 4013730 - DNA, 19 bp, Homo sapiens
gccagcacttgtccagctg

SEQ ID NO: 4013731 - DNA, 22 bp, Homo sapiens
gccagcagaagcagggtaccct

SEQ ID NO: 4013732 - DNA, 13 bp, Homo sapiens
gccagcagccccg

SEQ ID NO: 4013733 - DNA, 18 bp, Homo sapiens
gccagccaactctgggaa

SEQ ID NO: 4013734 - DNA, 14 bp, Homo sapiens
gccagccagtgcca

SEQ ID NO: 4013735 - DNA, 12 bp, Homo sapiens
gccagcccagcc

SEQ ID NO: 4013736 - DNA, 14 bp, Homo sapiens
gccagcccagccag

SEQ ID NO: 4013737 - DNA, 17 bp, Homo sapiens
gccagccccggccctgg

SEQ ID NO: 4013738 - DNA, 15 bp, Homo sapiens
gccagcccctcttcc

SEQ ID NO: 4013739 - DNA, 14 bp, Homo sapiens
gccagcccctggcc

SEQ ID NO: 4013740 - DNA, 21 bp, Homo sapiens
gccagcccctggggcccagcc

SEQ ID NO: 4013741 - DNA, 19 bp, Homo sapiens
gccagcccttcatatctgt

SEQ ID NO: 4013742 - DNA, 17 bp, Homo sapiens
gccagccgccctgggct

SEQ ID NO: 4013743 - DNA, 18 bp, Homo sapiens
gccagccgccctgggctg

SEQ ID NO: 4013744 - DNA, 19 bp, Homo sapiens
gccagccgccctgggctgt

SEQ ID NO: 4013745 - DNA, 20 bp, Homo sapiens
gccagccgccctgggctgtc

SEQ ID NO: 4013746 - DNA, 21 bp, Homo sapiens
gccagccgtgatgctcaggct

SEQ ID NO: 4013747 - DNA, 12 bp, Homo sapiens
gccagcctcctc

SEQ ID NO: 4013748 - DNA, 13 bp, Homo sapiens
gccagcctcctct

SEQ ID NO: 4013749 - DNA, 17 bp, Homo sapiens
gccagcctcctctggac

SEQ ID NO: 4013750 - DNA, 13 bp, Homo sapiens
gccagcctgacct

SEQ ID NO: 4013751 - DNA, 22 bp, Homo sapiens
gccagcctgaccttccttcctg

SEQ ID NO: 4013752 - DNA, 20 bp, Homo sapiens
gccagcctgtcccatggaca

SEQ ID NO: 4013753 - DNA, 17 bp, Homo sapiens
gccagccttgagccctg

SEQ ID NO: 4013754 - DNA, 15 bp, Homo sapiens
gccagcgggcacagg

SEQ ID NO: 4013755 - DNA, 20 bp, Homo sapiens
gccagcgggcacagggcacc

SEQ ID NO: 4013756 - DNA, 14 bp, Homo sapiens
gccagcggggctgc

SEQ ID NO: 4013757 - DNA, 15 bp, Homo sapiens
gccagcggggctgct

SEQ ID NO: 4013758 - DNA, 16 bp, Homo sapiens
gccagcgtcccagggt

SEQ ID NO: 4013759 - DNA, 23 bp, Homo sapiens
gccagctacttcctcctccccac

SEQ ID NO: 4013760 - DNA, 16 bp, Homo sapiens
gccagctcagtcccat

SEQ ID NO: 4013761 - DNA, 20 bp, Homo sapiens
gccagctgccctatgggcct

SEQ ID NO: 4013762 - DNA, 17 bp, Homo sapiens
gccagctgtgcactttc

SEQ ID NO: 4013763 - DNA, 19 bp, Homo sapiens
gccagctgtgtccttcggg

SEQ ID NO: 4013764 - DNA, 14 bp, Homo sapiens
gccagcttctctct

SEQ ID NO: 4013765 - DNA, 22 bp, Homo sapiens
gccagcttctctctccagggtg

SEQ ID NO: 4013766 - DNA, 14 bp, Homo sapiens
gccaggaagccaga

SEQ ID NO: 4013767 - DNA, 18 bp, Homo sapiens
gccaggaagccagagccc

SEQ ID NO: 4013768 - DNA, 20 bp, Homo sapiens
gccaggaagccagagcccca

SEQ ID NO: 4013769 - DNA, 22 bp, Homo sapiens
gccaggacgtctggggtgtggg

SEQ ID NO: 4013770 - DNA, 10 bp, Homo sapiens
gccaggagca

SEQ ID NO: 4013771 - DNA, 15 bp, Homo sapiens
gccaggagcaatggg

SEQ ID NO: 4013772 - DNA, 19 bp, Homo sapiens
gccaggagcaatgggactg

SEQ ID NO: 4013773 - DNA, 20 bp, Homo sapiens
gccaggagctcttcaggcct

SEQ ID NO: 4013774 - DNA, 19 bp, Homo sapiens
gccaggagtttgagaccag

SEQ ID NO: 4013775 - DNA, 19 bp, Homo sapiens
gccaggatcatggtgtaat

SEQ ID NO: 4013776 - DNA, 14 bp, Homo sapiens
gccaggcacagggc

SEQ ID NO: 4013777 - DNA, 17 bp, Homo sapiens
gccaggcacagggcccg

SEQ ID NO: 4013778 - DNA, 22 bp, Homo sapiens
gccaggcactgcccttttcagg

SEQ ID NO: 4013779 - DNA, 23 bp, Homo sapiens
gccaggcactgcccttttcagga

SEQ ID NO: 4013780 - DNA, 19 bp, Homo sapiens
gccaggccaccaggatggc

SEQ ID NO: 4013781 - DNA, 13 bp, Homo sapiens
gccaggccagcct

SEQ ID NO: 4013782 - DNA, 15 bp, Homo sapiens
gccaggccagcctcc

SEQ ID NO: 4013783 - DNA, 20 bp, Homo sapiens
gccaggcccaggcctcacca

SEQ ID NO: 4013784 - DNA, 11 bp, Homo sapiens
gccaggcctgg

SEQ ID NO: 4013785 - DNA, 15 bp, Homo sapiens
gccaggcctggctgg

SEQ ID NO: 4013786 - DNA, 15 bp, Homo sapiens
gccaggctgaccaca

SEQ ID NO: 4013787 - DNA, 19 bp, Homo sapiens
gccaggctgaccacagcac

SEQ ID NO: 4013788 - DNA, 19 bp, Homo sapiens
gccaggctgcctcctgccc

SEQ ID NO: 4013789 - DNA, 16 bp, Homo sapiens
gccagggaccccagaa

SEQ ID NO: 4013790 - DNA, 20 bp, Homo sapiens
gccagggagaagctcctctc

SEQ ID NO: 4013791 - DNA, 11 bp, Homo sapiens
gccagggagct

SEQ ID NO: 4013792 - DNA, 20 bp, Homo sapiens
gccagggcaatgatgaatga

SEQ ID NO: 4013793 - DNA, 15 bp, Homo sapiens
gccagggcccacccc

SEQ ID NO: 4013794 - DNA, 18 bp, Homo sapiens
gccagggcccaccccagc

SEQ ID NO: 4013795 - DNA, 15 bp, Homo sapiens
gccagggctgcccct

SEQ ID NO: 4013796 - DNA, 16 bp, Homo sapiens
gccagggctgccccta

SEQ ID NO: 4013797 - DNA, 13 bp, Homo sapiens
gccagggctgggg

SEQ ID NO: 4013798 - DNA, 19 bp, Homo sapiens
gccagggctggggacagag

SEQ ID NO: 4013799 - DNA, 22 bp, Homo sapiens
gccaggggaggttacaggtacc

SEQ ID NO: 4013800 - DNA, 20 bp, Homo sapiens
gccaggggggtgaggagctg

SEQ ID NO: 4013801 - DNA, 19 bp, Homo sapiens
gccagggtctctccctcag

SEQ ID NO: 4013802 - DNA, 18 bp, Homo sapiens
gccagggtctgtgtgaat

SEQ ID NO: 4013803 - DNA, 17 bp, Homo sapiens
gccagggtgagagctgc

SEQ ID NO: 4013804 - DNA, 15 bp, Homo sapiens
gccaggtaatgtgaa

SEQ ID NO: 4013805 - DNA, 22 bp, Homo sapiens
gccaggtcaccctttgctgtga

SEQ ID NO: 4013806 - DNA, 18 bp, Homo sapiens
gccaggttgggggcagtg

SEQ ID NO: 4013807 - DNA, 19 bp, Homo sapiens
gccagtaacgcgtcttcct

SEQ ID NO: 4013808 - DNA, 16 bp, Homo sapiens
gccagtaggagaaatc

SEQ ID NO: 4013809 - DNA, 19 bp, Homo sapiens
gccagtcctgcctggccag

SEQ ID NO: 4013810 - DNA, 14 bp, Homo sapiens
gccagtctcccagg

SEQ ID NO: 4013811 - DNA, 13 bp, Homo sapiens
gccagtgaaatgt

SEQ ID NO: 4013812 - DNA, 21 bp, Homo sapiens
gccagtgaaatgtgaaggaaa

SEQ ID NO: 4013813 - DNA, 13 bp, Homo sapiens
gccagtgacagac

SEQ ID NO: 4013814 - DNA, 15 bp, Homo sapiens
gccagtgacctttga

SEQ ID NO: 4013815 - DNA, 17 bp, Homo sapiens
gccagtgcacagggaag

SEQ ID NO: 4013816 - DNA, 13 bp, Homo sapiens
gccagtgcagcca

SEQ ID NO: 4013817 - DNA, 16 bp, Homo sapiens
gccagtgcagccactg

SEQ ID NO: 4013818 - DNA, 17 bp, Homo sapiens
gccagtgcagccactgg

SEQ ID NO: 4013819 - DNA, 12 bp, Homo sapiens
gccagtggatcc

SEQ ID NO: 4013820 - DNA, 17 bp, Homo sapiens
gccagtggatcccctgc

SEQ ID NO: 4013821 - DNA, 20 bp, Homo sapiens
gccagtggatcccctgcggt

SEQ ID NO: 4013822 - DNA, 21 bp, Homo sapiens
gccagtgggcgggccatgagg

SEQ ID NO: 4013823 - DNA, 14 bp, Homo sapiens
gccagtggggcctg

SEQ ID NO: 4013824 - DNA, 16 bp, Homo sapiens
gccagtttgaagcctg

SEQ ID NO: 4013825 - DNA, 21 bp, Homo sapiens
gccagtttgaagcctgtgcct

SEQ ID NO: 4013826 - DNA, 15 bp, Homo sapiens
gccagttttccctgg

SEQ ID NO: 4013827 - DNA, 17 bp, Homo sapiens
gccataatgttgcttct

SEQ ID NO: 4013828 - DNA, 19 bp, Homo sapiens
gccataggagaggagggtt

SEQ ID NO: 4013829 - DNA, 16 bp, Homo sapiens
ttatccaaaatgtgta

SEQ ID NO: 4013830 - DNA, 17 bp, Homo sapiens
ttatccaaaatgtgtat

SEQ ID NO: 4013831 - DNA, 17 bp, Homo sapiens
ttatccatattgagtca

SEQ ID NO: 4013832 - DNA, 19 bp, Homo sapiens
ttatccatattgagtcaaa

SEQ ID NO: 4013833 - DNA, 15 bp, Homo sapiens
ttatccctctcttcc

SEQ ID NO: 4013834 - DNA, 23 bp, Homo sapiens
ttatcccttccttttagcctagt

SEQ ID NO: 4013835 - DNA, 19 bp, Homo sapiens
ttatcctaaaacaaatagt

SEQ ID NO: 4013836 - DNA, 13 bp, Homo sapiens
ttatcgaaataac

SEQ ID NO: 4013837 - DNA, 14 bp, Homo sapiens
ttatcgaaataaca

SEQ ID NO: 4013838 - DNA, 15 bp, Homo sapiens
ttatcgaaataacaa

SEQ ID NO: 4013839 - DNA, 22 bp, Homo sapiens
ttatcgaaataacaatgttaag

SEQ ID NO: 4013840 - DNA, 16 bp, Homo sapiens
ttatcggaagcagtgc

SEQ ID NO: 4013841 - DNA, 16 bp, Homo sapiens
ttatcgggaacagtgt

SEQ ID NO: 4013842 - DNA, 14 bp, Homo sapiens
ttatctagctgcat

SEQ ID NO: 4013843 - DNA, 17 bp, Homo sapiens
ttatctatacatatctt

SEQ ID NO: 4013844 - DNA, 17 bp, Homo sapiens
ttatctcagtcatgcat

SEQ ID NO: 4013845 - DNA, 19 bp, Homo sapiens
ttatctcagtcatgcataa

SEQ ID NO: 4013846 - DNA, 14 bp, Homo sapiens
ttatctctctgtgc

SEQ ID NO: 4013847 - DNA, 12 bp, Homo sapiens
ttatctctgtgt

SEQ ID NO: 4013848 - DNA, 20 bp, Homo sapiens
ttatctcttttatatttgta

SEQ ID NO: 4013849 - DNA, 19 bp, Homo sapiens
ttatctggaatattgtgat

SEQ ID NO: 4013850 - DNA, 12 bp, Homo sapiens
ttatctgtgaat

SEQ ID NO: 4013851 - DNA, 19 bp, Homo sapiens
ttatctgtgcgtgaaacac

SEQ ID NO: 4013852 - DNA, 16 bp, Homo sapiens
ttatcttggactgaca

SEQ ID NO: 4013853 - DNA, 17 bp, Homo sapiens
ttatcttggactgacat

SEQ ID NO: 4013854 - DNA, 19 bp, Homo sapiens
ttatgaaattcaccccctt

SEQ ID NO: 4013855 - DNA, 17 bp, Homo sapiens
ttatgaaatttcacttc

SEQ ID NO: 4013856 - DNA, 19 bp, Homo sapiens
ttatgaaatttcacttcag

SEQ ID NO: 4013857 - DNA, 20 bp, Homo sapiens
ttatgaagtgcgtgaatgta

SEQ ID NO: 4013858 - DNA, 19 bp, Homo sapiens
ttatgaataagcacttgaa

SEQ ID NO: 4013859 - DNA, 17 bp, Homo sapiens
ttatgaatatttataac

SEQ ID NO: 4013860 - DNA, 18 bp, Homo sapiens
ttatgacctcttccttta

SEQ ID NO: 4013861 - DNA, 15 bp, Homo sapiens
ttatgactatgtaaa

SEQ ID NO: 4013862 - DNA, 20 bp, Homo sapiens
ttatgagtaactattattat

SEQ ID NO: 4013863 - DNA, 21 bp, Homo sapiens
ttatgagtttttgatagcttt

SEQ ID NO: 4013864 - DNA, 14 bp, Homo sapiens
ttatgctcagggtc

SEQ ID NO: 4013865 - DNA, 18 bp, Homo sapiens
ttatgctgtaaaagcaag

SEQ ID NO: 4013866 - DNA, 15 bp, Homo sapiens
ttatgcttccagaaa

SEQ ID NO: 4013867 - DNA, 16 bp, Homo sapiens
ttatgcttccagaaac

SEQ ID NO: 4013868 - DNA, 19 bp, Homo sapiens
ttatggaagattttaaatt

SEQ ID NO: 4013869 - DNA, 12 bp, Homo sapiens
ttatggaattaa

SEQ ID NO: 4013870 - DNA, 17 bp, Homo sapiens
ttatggaattaaccatt

SEQ ID NO: 4013871 - DNA, 21 bp, Homo sapiens
ttatggaattgatttgcattg

SEQ ID NO: 4013872 - DNA, 23 bp, Homo sapiens
ttatgggaaccccttcatcctct

SEQ ID NO: 4013873 - DNA, 15 bp, Homo sapiens
ttatgggtcctgcaa

SEQ ID NO: 4013874 - DNA, 13 bp, Homo sapiens
ttatggtccagaa

SEQ ID NO: 4013875 - DNA, 17 bp, Homo sapiens
ttatggtccagaaactc

SEQ ID NO: 4013876 - DNA, 14 bp, Homo sapiens
ttatggttacttct

SEQ ID NO: 4013877 - DNA, 11 bp, Homo sapiens
ttatggttttg

SEQ ID NO: 4013878 - DNA, 20 bp, Homo sapiens
ttatgtaaatgtttgttaaa

SEQ ID NO: 4013879 - DNA, 15 bp, Homo sapiens
ttatgtagatgtgca

SEQ ID NO: 4013880 - DNA, 16 bp, Homo sapiens
ttatgtagatgtgcat

SEQ ID NO: 4013881 - DNA, 19 bp, Homo sapiens
ttatgtagtaattgacatg

SEQ ID NO: 4013882 - DNA, 19 bp, Homo sapiens
ttatgtatcagtgtccttt

SEQ ID NO: 4013883 - DNA, 14 bp, Homo sapiens
ttatgtatctctat

SEQ ID NO: 4013884 - DNA, 13 bp, Homo sapiens
ttatgtatcttag

SEQ ID NO: 4013885 - DNA, 16 bp, Homo sapiens
ttatgtctgtttaaga

SEQ ID NO: 4013886 - DNA, 21 bp, Homo sapiens
ttatgtcttttatatttgtat

SEQ ID NO: 4013887 - DNA, 11 bp, Homo sapiens
ttatgtgaatt

SEQ ID NO: 4013888 - DNA, 15 bp, Homo sapiens
ttatgtgacattaac

SEQ ID NO: 4013889 - DNA, 20 bp, Homo sapiens
ttatgtgacattttacatta

SEQ ID NO: 4013890 - DNA, 14 bp, Homo sapiens
ttatgtgatcaatt

SEQ ID NO: 4013891 - DNA, 12 bp, Homo sapiens
ttatgtgatttt

SEQ ID NO: 4013892 - DNA, 15 bp, Homo sapiens
ttatgttcttataga

SEQ ID NO: 4013893 - DNA, 14 bp, Homo sapiens
ttatgtttgaatat

SEQ ID NO: 4013894 - DNA, 13 bp, Homo sapiens
ttattaaagtcta

SEQ ID NO: 4013895 - DNA, 16 bp, Homo sapiens
ttattaaagtctaaac

SEQ ID NO: 4013896 - DNA, 20 bp, Homo sapiens
ttattaaataaaatcaattt

SEQ ID NO: 4013897 - DNA, 20 bp, Homo sapiens
ttattaaatacaaaacttcc

SEQ ID NO: 4013898 - DNA, 15 bp, Homo sapiens
ttattaactacattt

SEQ ID NO: 4013899 - DNA, 17 bp, Homo sapiens
ttattaagatggattct

SEQ ID NO: 4013900 - DNA, 19 bp, Homo sapiens
ttattaagatggattctca

SEQ ID NO: 4013901 - DNA, 19 bp, Homo sapiens
ttattaatatgagttactg

SEQ ID NO: 4013902 - DNA, 22 bp, Homo sapiens
ttattaattgttttgcactttt

SEQ ID NO: 4013903 - DNA, 22 bp, Homo sapiens
ttattaccccctccttcagaca

SEQ ID NO: 4013904 - DNA, 22 bp, Homo sapiens
ttattagccaggtaatgtgaat

SEQ ID NO: 4013905 - DNA, 19 bp, Homo sapiens
ttattagggagaaaattca

SEQ ID NO: 4013906 - DNA, 20 bp, Homo sapiens
ttattagggagaaaattcaa

SEQ ID NO: 4013907 - DNA, 23 bp, Homo sapiens
ttattagggagaaaattcaattg

SEQ ID NO: 4013908 - DNA, 20 bp, Homo sapiens
ttattagtaaatgcttatca

SEQ ID NO: 4013909 - DNA, 21 bp, Homo sapiens
ttattataatcctcaagagaa

SEQ ID NO: 4013910 - DNA, 16 bp, Homo sapiens
ttattatctaaagtgt

SEQ ID NO: 4013911 - DNA, 13 bp, Homo sapiens
ttattatttaatt

SEQ ID NO: 4013912 - DNA, 19 bp, Homo sapiens
ttattcaattcctctggga

SEQ ID NO: 4013913 - DNA, 13 bp, Homo sapiens
ttattcatccagc

SEQ ID NO: 4013914 - DNA, 17 bp, Homo sapiens
ttattcattagctgtga

SEQ ID NO: 4013915 - DNA, 18 bp, Homo sapiens
ttattccatcaataaatg

SEQ ID NO: 4013916 - DNA, 14 bp, Homo sapiens
ttattcttccagaa

SEQ ID NO: 4013917 - DNA, 18 bp, Homo sapiens
ttattcttccagaatgct

SEQ ID NO: 4013918 - DNA, 14 bp, Homo sapiens
ttattgacacagaa

SEQ ID NO: 4013919 - DNA, 23 bp, Homo sapiens
ttattgacacagaaaatgttgag

SEQ ID NO: 4013920 - DNA, 12 bp, Homo sapiens
ttattgacactg

SEQ ID NO: 4013921 - DNA, 14 bp, Homo sapiens
ttattgacactgaa

SEQ ID NO: 4013922 - DNA, 16 bp, Homo sapiens
ttattgctagtatttg

SEQ ID NO: 4013923 - DNA, 19 bp, Homo sapiens
ttattgctagtatttgaat

SEQ ID NO: 4013924 - DNA, 13 bp, Homo sapiens
ttattgcttttat

SEQ ID NO: 4013925 - DNA, 16 bp, Homo sapiens
ttattggaattaacct

SEQ ID NO: 4013926 - DNA, 14 bp, Homo sapiens
ttattgtatttatg

SEQ ID NO: 4013927 - DNA, 20 bp, Homo sapiens
ttattgtgtttttaatttat

SEQ ID NO: 4013928 - DNA, 13 bp, Homo sapiens
ttattgttccaag

SEQ ID NO: 4013929 - DNA, 16 bp, Homo sapiens
ttattgttccaagaca

SEQ ID NO: 4013930 - DNA, 18 bp, Homo sapiens
ttattgttccaagacatt

SEQ ID NO: 4013931 - DNA, 19 bp, Homo sapiens
ttattgttccaagacattg

SEQ ID NO: 4013932 - DNA, 13 bp, Homo sapiens
ttccatgcctgag

SEQ ID NO: 4013933 - DNA, 14 bp, Homo sapiens
ttccatgcctgagg

SEQ ID NO: 4013934 - DNA, 23 bp, Homo sapiens
ttccatgggagccagctgctttt

SEQ ID NO: 4013935 - DNA, 13 bp, Homo sapiens
ttccattatctta

SEQ ID NO: 4013936 - DNA, 16 bp, Homo sapiens
ttccattccattgttt

SEQ ID NO: 4013937 - DNA, 12 bp, Homo sapiens
ttccatttacta

SEQ ID NO: 4013938 - DNA, 12 bp, Homo sapiens
ttccatttccaa

SEQ ID NO: 4013939 - DNA, 18 bp, Homo sapiens
ttccatttcttcctcact

SEQ ID NO: 4013940 - DNA, 16 bp, Homo sapiens
ttccattttcccccac

SEQ ID NO: 4013941 - DNA, 23 bp, Homo sapiens
ttcccaaaggcattataaaaaga

SEQ ID NO: 4013942 - DNA, 23 bp, Homo sapiens
ttcccaacttcatactggcagga

SEQ ID NO: 4013943 - DNA, 11 bp, Homo sapiens
ttcccaagctc

SEQ ID NO: 4013944 - DNA, 14 bp, Homo sapiens
ttcccaataaaagt

SEQ ID NO: 4013945 - DNA, 14 bp, Homo sapiens
ttcccaattaggaa

SEQ ID NO: 4013946 - DNA, 13 bp, Homo sapiens
ttcccacatcttt

SEQ ID NO: 4013947 - DNA, 16 bp, Homo sapiens
ttcccacccagcctgg

SEQ ID NO: 4013948 - DNA, 15 bp, Homo sapiens
ttcccactcaccccg

SEQ ID NO: 4013949 - DNA, 14 bp, Homo sapiens
ttcccactcttctc

SEQ ID NO: 4013950 - DNA, 22 bp, Homo sapiens
ttcccagaagtggctactgact

SEQ ID NO: 4013951 - DNA, 21 bp, Homo sapiens
ttcccagagtgtgaaacttcc

SEQ ID NO: 4013952 - DNA, 14 bp, Homo sapiens
ttcccagatacttc

SEQ ID NO: 4013953 - DNA, 13 bp, Homo sapiens
ttcccaggaccct

SEQ ID NO: 4013954 - DNA, 22 bp, Homo sapiens
ttcccagtaagtttcccctctg

SEQ ID NO: 4013955 - DNA, 11 bp, Homo sapiens
ttcccataatt

SEQ ID NO: 4013956 - DNA, 14 bp, Homo sapiens
ttcccatcgctgtc

SEQ ID NO: 4013957 - DNA, 15 bp, Homo sapiens
ttcccatcgctgtca

SEQ ID NO: 4013958 - DNA, 12 bp, Homo sapiens
ttcccatctgca

SEQ ID NO: 4013959 - DNA, 14 bp, Homo sapiens
ttcccatctgcacc

SEQ ID NO: 4013960 - DNA, 16 bp, Homo sapiens
ttcccatctttactcc

SEQ ID NO: 4013961 - DNA, 22 bp, Homo sapiens
ttcccatgactgcacccagctc

SEQ ID NO: 4013962 - DNA, 17 bp, Homo sapiens
ttcccatgtagccccct

SEQ ID NO: 4013963 - DNA, 14 bp, Homo sapiens
ttcccattttgcaa

SEQ ID NO: 4013964 - DNA, 22 bp, Homo sapiens
ttccccaccctccccttcccag

SEQ ID NO: 4013965 - DNA, 14 bp, Homo sapiens
ttccccactccccc

SEQ ID NO: 4013966 - DNA, 21 bp, Homo sapiens
ttccccactgacagcctccca

SEQ ID NO: 4013967 - DNA, 11 bp, Homo sapiens
ttccccaggat

SEQ ID NO: 4013968 - DNA, 17 bp, Homo sapiens
ttccccatcttctaaac

SEQ ID NO: 4013969 - DNA, 17 bp, Homo sapiens
ttcccccaacctcagac

SEQ ID NO: 4013970 - DNA, 20 bp, Homo sapiens
ttcccccaccagctgcagcc

SEQ ID NO: 4013971 - DNA, 14 bp, Homo sapiens
ttcccccactaccg

SEQ ID NO: 4013972 - DNA, 17 bp, Homo sapiens
ttcccccactactgcag

SEQ ID NO: 4013973 - DNA, 20 bp, Homo sapiens
ttcccccagcaacgcccctc

SEQ ID NO: 4013974 - DNA, 12 bp, Homo sapiens
ttccccccactc

SEQ ID NO: 4013975 - DNA, 19 bp, Homo sapiens
ttccccccactctccccac

SEQ ID NO: 4013976 - DNA, 20 bp, Homo sapiens
ttcccccgagctcttggcct

SEQ ID NO: 4013977 - DNA, 13 bp, Homo sapiens
ttcccccttccca

SEQ ID NO: 4013978 - DNA, 17 bp, Homo sapiens
ttcccccttcccatttc

SEQ ID NO: 4013979 - DNA, 16 bp, Homo sapiens
ttccccctttcttcct

SEQ ID NO: 4013980 - DNA, 19 bp, Homo sapiens
ttcccctaacctcattccc

SEQ ID NO: 4013981 - DNA, 15 bp, Homo sapiens
ttcccctatcattta

SEQ ID NO: 4013982 - DNA, 14 bp, Homo sapiens
ttcccctcccacct

SEQ ID NO: 4013983 - DNA, 15 bp, Homo sapiens
ttcccctcccacctc

SEQ ID NO: 4013984 - DNA, 13 bp, Homo sapiens
ttcccctccctgg

SEQ ID NO: 4013985 - DNA, 14 bp, Homo sapiens
ttcccctctgctgc

SEQ ID NO: 4013986 - DNA, 13 bp, Homo sapiens
ttcccctctggct

SEQ ID NO: 4013987 - DNA, 14 bp, Homo sapiens
ttcccctctggctt

SEQ ID NO: 4013988 - DNA, 22 bp, Homo sapiens
ttcccctctggcttgacagcat

SEQ ID NO: 4013989 - DNA, 11 bp, Homo sapiens
ttcccctgtgt

SEQ ID NO: 4013990 - DNA, 13 bp, Homo sapiens
ttcccctgtgtca

SEQ ID NO: 4013991 - DNA, 14 bp, Homo sapiens
ttcccctgttcact

SEQ ID NO: 4013992 - DNA, 17 bp, Homo sapiens
ttcccctgttcactcta

SEQ ID NO: 4013993 - DNA, 13 bp, Homo sapiens
ttccccttccctt

SEQ ID NO: 4013994 - DNA, 15 bp, Homo sapiens
ttccccttcccttat

SEQ ID NO: 4013995 - DNA, 12 bp, Homo sapiens
ttccccttcctg

SEQ ID NO: 4013996 - DNA, 15 bp, Homo sapiens
ttccccttccttctt

SEQ ID NO: 4013997 - DNA, 13 bp, Homo sapiens
ttcccgcacatgg

SEQ ID NO: 4013998 - DNA, 12 bp, Homo sapiens
ttcccgctcagc

SEQ ID NO: 4013999 - DNA, 14 bp, Homo sapiens
ttcccgctcagccc

SEQ ID NO: 4014000 - DNA, 16 bp, Homo sapiens
ttcccgctcagccctc

SEQ ID NO: 4014001 - DNA, 18 bp, Homo sapiens
ttcccgctcagccctccc

SEQ ID NO: 4014002 - DNA, 22 bp, Homo sapiens
ttcccgctcagccctccctgcc

SEQ ID NO: 4014003 - DNA, 13 bp, Homo sapiens
ttccctatctttt

SEQ ID NO: 4014004 - DNA, 12 bp, Homo sapiens
ttccctcacccc

SEQ ID NO: 4014005 - DNA, 18 bp, Homo sapiens
ttccctcacccccagcac

SEQ ID NO: 4014006 - DNA, 23 bp, Homo sapiens
ttccctccatccccctttaccct

SEQ ID NO: 4014007 - DNA, 15 bp, Homo sapiens
ttccctccctgctgt

SEQ ID NO: 4014008 - DNA, 23 bp, Homo sapiens
ttccctccctgctgtcattgctt

SEQ ID NO: 4014009 - DNA, 17 bp, Homo sapiens
ttccctcctagctctcc

SEQ ID NO: 4014010 - DNA, 18 bp, Homo sapiens
ttccctcggagttcttct

SEQ ID NO: 4014011 - DNA, 21 bp, Homo sapiens
ttccctctctcagcacagcct

SEQ ID NO: 4014012 - DNA, 22 bp, Homo sapiens
ttccctctctgatgtcccagtg

SEQ ID NO: 4014013 - DNA, 11 bp, Homo sapiens
ttccctctgag

SEQ ID NO: 4014014 - DNA, 13 bp, Homo sapiens
ttccctctgctca

SEQ ID NO: 4014015 - DNA, 14 bp, Homo sapiens
ttccctctgctcag

SEQ ID NO: 4014016 - DNA, 17 bp, Homo sapiens
ttccctctgctcagcca

SEQ ID NO: 4014017 - DNA, 22 bp, Homo sapiens
ttccctctgggcacgcctgctg

SEQ ID NO: 4014018 - DNA, 19 bp, Homo sapiens
ttccctcttctaacccaac

SEQ ID NO: 4014019 - DNA, 21 bp, Homo sapiens
ttccctcttgtccctttccct

SEQ ID NO: 4014020 - DNA, 11 bp, Homo sapiens
ttccctgcaga

SEQ ID NO: 4014021 - DNA, 15 bp, Homo sapiens
ttccctgctcttgca

SEQ ID NO: 4014022 - DNA, 14 bp, Homo sapiens
ttccctgcttccag

SEQ ID NO: 4014023 - DNA, 15 bp, Homo sapiens
ttccctgcttccagg

SEQ ID NO: 4014024 - DNA, 21 bp, Homo sapiens
ttccctgctttgcatctttgt

SEQ ID NO: 4014025 - DNA, 19 bp, Homo sapiens
ttccctggaactcctggcc

SEQ ID NO: 4014026 - DNA, 16 bp, Homo sapiens
ttccctggtaagaaaa

SEQ ID NO: 4014027 - DNA, 18 bp, Homo sapiens
ttccctggtaagaaaaag

SEQ ID NO: 4014028 - DNA, 22 bp, Homo sapiens
ttccctggtaagaaaaagcaaa

SEQ ID NO: 4014029 - DNA, 20 bp, Homo sapiens
ttccctgtctcttgaaaaat

SEQ ID NO: 4014030 - DNA, 15 bp, Homo sapiens
ttccctgttcttcct

SEQ ID NO: 4014031 - DNA, 19 bp, Homo sapiens
ttcccttcagtaccctctc

SEQ ID NO: 4014032 - DNA, 13 bp, Homo sapiens
ttcccttcctcca

SEQ ID NO: 4014033 - DNA, 22 bp, Homo sapiens
ttcccttgcaggggtcccccct

SEQ ID NO: 4014034 - DNA, 11 bp, Homo sapiens
ttcccttggcc

SEQ ID NO: 4014035 - DNA, 12 bp, Homo sapiens
ttcccttggcct

SEQ ID NO: 4014036 - DNA, 20 bp, Homo sapiens
ttctgagtgtttttactaca

SEQ ID NO: 4014037 - DNA, 20 bp, Homo sapiens
ttctgagtttcattctcctg

SEQ ID NO: 4014038 - DNA, 21 bp, Homo sapiens
ttctgatcagaggtgtacact

SEQ ID NO: 4014039 - DNA, 22 bp, Homo sapiens
ttctgcaaaggtggcaatgctt

SEQ ID NO: 4014040 - DNA, 22 bp, Homo sapiens
ttctgcaagcacatctgcattt

SEQ ID NO: 4014041 - DNA, 18 bp, Homo sapiens
ttctgcaagcctcatgcc

SEQ ID NO: 4014042 - DNA, 20 bp, Homo sapiens
ttctgcagacacgccttccc

SEQ ID NO: 4014043 - DNA, 20 bp, Homo sapiens
ttctgcagcatgacctgtga

SEQ ID NO: 4014044 - DNA, 21 bp, Homo sapiens
ttctgcatatgttgaatactt

SEQ ID NO: 4014045 - DNA, 21 bp, Homo sapiens
ttctgcattcatttttatagc

SEQ ID NO: 4014046 - DNA, 22 bp, Homo sapiens
ttctgcattgctagataaaagc

SEQ ID NO: 4014047 - DNA, 18 bp, Homo sapiens
ttctgcattttgctattg

SEQ ID NO: 4014048 - DNA, 19 bp, Homo sapiens
ttctgcccaattggaggaa

SEQ ID NO: 4014049 - DNA, 20 bp, Homo sapiens
ttctgccctggctgctgccc

SEQ ID NO: 4014050 - DNA, 14 bp, Homo sapiens
ttctgcctctctgg

SEQ ID NO: 4014051 - DNA, 19 bp, Homo sapiens
ttctgcctgccagctgcac

SEQ ID NO: 4014052 - DNA, 16 bp, Homo sapiens
ttctgccttttcactg

SEQ ID NO: 4014053 - DNA, 17 bp, Homo sapiens
ttctgctccacccttgg

SEQ ID NO: 4014054 - DNA, 20 bp, Homo sapiens
ttctgctccataccttttct

SEQ ID NO: 4014055 - DNA, 12 bp, Homo sapiens
ttctgctcctgc

SEQ ID NO: 4014056 - DNA, 20 bp, Homo sapiens
ttctgctcctgcttttctgt

SEQ ID NO: 4014057 - DNA, 14 bp, Homo sapiens
ttctgctctggaat

SEQ ID NO: 4014058 - DNA, 17 bp, Homo sapiens
ttctgctctggaataaa

SEQ ID NO: 4014059 - DNA, 22 bp, Homo sapiens
ttctgctctggttgtttctgtt

SEQ ID NO: 4014060 - DNA, 17 bp, Homo sapiens
ttctgctcttttcctgg

SEQ ID NO: 4014061 - DNA, 13 bp, Homo sapiens
ttctgctgcccct

SEQ ID NO: 4014062 - DNA, 17 bp, Homo sapiens
ttctgctgcccctgcag

SEQ ID NO: 4014063 - DNA, 13 bp, Homo sapiens
ttctgctggataa

SEQ ID NO: 4014064 - DNA, 17 bp, Homo sapiens
ttctgctggcatcaaga

SEQ ID NO: 4014065 - DNA, 13 bp, Homo sapiens
ttctgctggcctg

SEQ ID NO: 4014066 - DNA, 15 bp, Homo sapiens
ttctgctggcctgga

SEQ ID NO: 4014067 - DNA, 18 bp, Homo sapiens
ttctgctggcctggatct

SEQ ID NO: 4014068 - DNA, 14 bp, Homo sapiens
ttctgcttaggaga

SEQ ID NO: 4014069 - DNA, 18 bp, Homo sapiens
ttctgcttgtgttaagta

SEQ ID NO: 4014070 - DNA, 17 bp, Homo sapiens
ttctgcttttctgccct

SEQ ID NO: 4014071 - DNA, 19 bp, Homo sapiens
ttctgcttttctgccctgg

SEQ ID NO: 4014072 - DNA, 22 bp, Homo sapiens
ttctggaatgtaatcaatgttt

SEQ ID NO: 4014073 - DNA, 18 bp, Homo sapiens
ttctggaatttgttcaag

SEQ ID NO: 4014074 - DNA, 21 bp, Homo sapiens
ttctggaatttgttcaagttt

SEQ ID NO: 4014075 - DNA, 19 bp, Homo sapiens
ttctggaggggagagcttt

SEQ ID NO: 4014076 - DNA, 20 bp, Homo sapiens
ttctggctgtagataaataa

SEQ ID NO: 4014077 - DNA, 22 bp, Homo sapiens
ttctgggagacacccaaagggt

SEQ ID NO: 4014078 - DNA, 12 bp, Homo sapiens
ttctgggctctt

SEQ ID NO: 4014079 - DNA, 18 bp, Homo sapiens
ttctggggcaggctgggc

SEQ ID NO: 4014080 - DNA, 23 bp, Homo sapiens
ttctgggggaaaaagccatatca

SEQ ID NO: 4014081 - DNA, 19 bp, Homo sapiens
ttctggtagatagaaataa

SEQ ID NO: 4014082 - DNA, 17 bp, Homo sapiens
ttctgtaaaatgtctgt

SEQ ID NO: 4014083 - DNA, 20 bp, Homo sapiens
ttctgtagagccttctgatg

SEQ ID NO: 4014084 - DNA, 17 bp, Homo sapiens
ttctgtatatacttttt

SEQ ID NO: 4014085 - DNA, 13 bp, Homo sapiens
ttctgtatttcct

SEQ ID NO: 4014086 - DNA, 15 bp, Homo sapiens
ttctgtatttctagg

SEQ ID NO: 4014087 - DNA, 14 bp, Homo sapiens
ttctgtcctgggca

SEQ ID NO: 4014088 - DNA, 23 bp, Homo sapiens
ttctgtccttttggcactgagat

SEQ ID NO: 4014089 - DNA, 11 bp, Homo sapiens
ttctgtgaaga

SEQ ID NO: 4014090 - DNA, 17 bp, Homo sapiens
ttctgtggttcctctgc

SEQ ID NO: 4014091 - DNA, 20 bp, Homo sapiens
ttctgtggttcctctgctca

SEQ ID NO: 4014092 - DNA, 14 bp, Homo sapiens
ttctgtgtatctct

SEQ ID NO: 4014093 - DNA, 21 bp, Homo sapiens
ttctgtgtatctctttcacat

SEQ ID NO: 4014094 - DNA, 23 bp, Homo sapiens
ttctgtgtctttcacagctcctc

SEQ ID NO: 4014095 - DNA, 17 bp, Homo sapiens
ttctgtgtttacagaga

SEQ ID NO: 4014096 - DNA, 14 bp, Homo sapiens
ttctgttaaaatct

SEQ ID NO: 4014097 - DNA, 13 bp, Homo sapiens
ttctgttccaaat

SEQ ID NO: 4014098 - DNA, 23 bp, Homo sapiens
ttctgttcctctcttttcctgtt

SEQ ID NO: 4014099 - DNA, 14 bp, Homo sapiens
ttctgttctagttt

SEQ ID NO: 4014100 - DNA, 18 bp, Homo sapiens
ttctgtttatggccacat

SEQ ID NO: 4014101 - DNA, 19 bp, Homo sapiens
ttctgtttattcttccaga

SEQ ID NO: 4014102 - DNA, 14 bp, Homo sapiens
ttctgtttgattct

SEQ ID NO: 4014103 - DNA, 15 bp, Homo sapiens
ttctgtttgattctt

SEQ ID NO: 4014104 - DNA, 22 bp, Homo sapiens
ttctgtttgtaaattatttgct

SEQ ID NO: 4014105 - DNA, 23 bp, Homo sapiens
ttctgtttgtaaattatttgcta

SEQ ID NO: 4014106 - DNA, 14 bp, Homo sapiens
ttcttaaaccaacc

SEQ ID NO: 4014107 - DNA, 21 bp, Homo sapiens
ttcttaaagtttaaagttgca

SEQ ID NO: 4014108 - DNA, 14 bp, Homo sapiens
ttcttaaatatctt

SEQ ID NO: 4014109 - DNA, 16 bp, Homo sapiens
ttcttaaatatctttt

SEQ ID NO: 4014110 - DNA, 17 bp, Homo sapiens
ttcttaaatatctttta

SEQ ID NO: 4014111 - DNA, 19 bp, Homo sapiens
ttcttaaatatcttttatg

SEQ ID NO: 4014112 - DNA, 21 bp, Homo sapiens
ttcttaaatatcttttatgtt

SEQ ID NO: 4014113 - DNA, 20 bp, Homo sapiens
ttcttaaggattgtgatatt

SEQ ID NO: 4014114 - DNA, 22 bp, Homo sapiens
ttcttaaggattgtgatatttt

SEQ ID NO: 4014115 - DNA, 13 bp, Homo sapiens
ttcttaaggtttt

SEQ ID NO: 4014116 - DNA, 13 bp, Homo sapiens
ttcttaattaatt

SEQ ID NO: 4014117 - DNA, 16 bp, Homo sapiens
ttcttaattaatttga

SEQ ID NO: 4014118 - DNA, 22 bp, Homo sapiens
ttcttaattaatttgattaaca

SEQ ID NO: 4014119 - DNA, 19 bp, Homo sapiens
ttcttaattcatgaggagg

SEQ ID NO: 4014120 - DNA, 16 bp, Homo sapiens
ttcttactgataattt

SEQ ID NO: 4014121 - DNA, 15 bp, Homo sapiens
ttcttagctttttaa

SEQ ID NO: 4014122 - DNA, 20 bp, Homo sapiens
ttcttagctttttaattgtt

SEQ ID NO: 4014123 - DNA, 13 bp, Homo sapiens
ttcttagtgactt

SEQ ID NO: 4014124 - DNA, 17 bp, Homo sapiens
ttcttatacgcttttct

SEQ ID NO: 4014125 - DNA, 14 bp, Homo sapiens
ttcttatagaataa

SEQ ID NO: 4014126 - DNA, 18 bp, Homo sapiens
ttcttatgaggaggggag

SEQ ID NO: 4014127 - DNA, 16 bp, Homo sapiens
ttcttatgtgacatta

SEQ ID NO: 4014128 - DNA, 23 bp, Homo sapiens
ttcttatttaatgaaagactgta

SEQ ID NO: 4014129 - DNA, 14 bp, Homo sapiens
ttcttattttgcat

SEQ ID NO: 4014130 - DNA, 22 bp, Homo sapiens
ttcttatttttcctaacaaaag

SEQ ID NO: 4014131 - DNA, 15 bp, Homo sapiens
ttcttcaaatacaaa

SEQ ID NO: 4014132 - DNA, 16 bp, Homo sapiens
ttcttcaaatacaaag

SEQ ID NO: 4014133 - DNA, 17 bp, Homo sapiens
ttcttcaaatacaaagt

SEQ ID NO: 4014134 - DNA, 19 bp, Homo sapiens
ttcttcaaatccttccaaa

SEQ ID NO: 4014135 - DNA, 21 bp, Homo sapiens
ttcttcaacatcaatgttcat

SEQ ID NO: 4014136 - DNA, 22 bp, Homo sapiens
ttcttcaacatcaatgttcatt

SEQ ID NO: 4014137 - DNA, 17 bp, Homo sapiens
ttcttcacctgttatgt

SEQ ID NO: 4014138 - DNA, 21 bp, Homo sapiens
ttgcattgaccgcgactaatt

SEQ ID NO: 4014139 - DNA, 15 bp, Homo sapiens
ttgcattgaggaaat

SEQ ID NO: 4014140 - DNA, 20 bp, Homo sapiens
ttgcatttacttttaataaa

SEQ ID NO: 4014141 - DNA, 15 bp, Homo sapiens
ttgcatttagaaatc

SEQ ID NO: 4014142 - DNA, 15 bp, Homo sapiens
ttgcatttagaactt

SEQ ID NO: 4014143 - DNA, 17 bp, Homo sapiens
ttgcatttttattaaag

SEQ ID NO: 4014144 - DNA, 17 bp, Homo sapiens
ttgccaaaaaaaaaaga

SEQ ID NO: 4014145 - DNA, 11 bp, Homo sapiens
ttgccaaagct

SEQ ID NO: 4014146 - DNA, 16 bp, Homo sapiens
ttgccaaatatgtcct

SEQ ID NO: 4014147 - DNA, 21 bp, Homo sapiens
ttgccaagaaaatgaagggat

SEQ ID NO: 4014148 - DNA, 18 bp, Homo sapiens
ttgccaaggcagcgggat

SEQ ID NO: 4014149 - DNA, 12 bp, Homo sapiens
ttgccacagctt

SEQ ID NO: 4014150 - DNA, 13 bp, Homo sapiens
ttgccacagcttt

SEQ ID NO: 4014151 - DNA, 18 bp, Homo sapiens
ttgccacagtagaactgt

SEQ ID NO: 4014152 - DNA, 20 bp, Homo sapiens
ttgccacagtagaactgtct

SEQ ID NO: 4014153 - DNA, 17 bp, Homo sapiens
ttgccaccacctctgtg

SEQ ID NO: 4014154 - DNA, 16 bp, Homo sapiens
ttgccaccaggagaac

SEQ ID NO: 4014155 - DNA, 19 bp, Homo sapiens
ttgccaccccaccctccct

SEQ ID NO: 4014156 - DNA, 21 bp, Homo sapiens
ttgccaccccaccctccctgg

SEQ ID NO: 4014157 - DNA, 21 bp, Homo sapiens
ttgccactaattttagtattc

SEQ ID NO: 4014158 - DNA, 12 bp, Homo sapiens
ttgccagctttt

SEQ ID NO: 4014159 - DNA, 19 bp, Homo sapiens
ttgccagcttttcctccct

SEQ ID NO: 4014160 - DNA, 20 bp, Homo sapiens
ttgccagcttttcctccctt

SEQ ID NO: 4014161 - DNA, 19 bp, Homo sapiens
ttgccagtaacacaggcca

SEQ ID NO: 4014162 - DNA, 16 bp, Homo sapiens
ttgccagttttccctg

SEQ ID NO: 4014163 - DNA, 17 bp, Homo sapiens
ttgccagttttccctgg

SEQ ID NO: 4014164 - DNA, 23 bp, Homo sapiens
ttgccatctgcgtgacaataaaa

SEQ ID NO: 4014165 - DNA, 16 bp, Homo sapiens
ttgcccactcctgctc

SEQ ID NO: 4014166 - DNA, 21 bp, Homo sapiens
ttgcccactcctgctctgctc

SEQ ID NO: 4014167 - DNA, 22 bp, Homo sapiens
ttgcccactcctgctctgctcg

SEQ ID NO: 4014168 - DNA, 12 bp, Homo sapiens
ttgcccagcctc

SEQ ID NO: 4014169 - DNA, 19 bp, Homo sapiens
ttgcccagcctctttccct

SEQ ID NO: 4014170 - DNA, 13 bp, Homo sapiens
ttgcccatcctga

SEQ ID NO: 4014171 - DNA, 14 bp, Homo sapiens
ttgcccatcctgac

SEQ ID NO: 4014172 - DNA, 12 bp, Homo sapiens
ttgccccaagat

SEQ ID NO: 4014173 - DNA, 16 bp, Homo sapiens
ttgccccctctcactt

SEQ ID NO: 4014174 - DNA, 13 bp, Homo sapiens
ttgcccctggctt

SEQ ID NO: 4014175 - DNA, 20 bp, Homo sapiens
ttgcccgaaactaagccagg

SEQ ID NO: 4014176 - DNA, 14 bp, Homo sapiens
ttgcccttcacagt

SEQ ID NO: 4014177 - DNA, 22 bp, Homo sapiens
ttgccctttacttgtctttctg

SEQ ID NO: 4014178 - DNA, 23 bp, Homo sapiens
ttgcctaaaatataatttttaat

SEQ ID NO: 4014179 - DNA, 18 bp, Homo sapiens
ttgcctaactaactggca

SEQ ID NO: 4014180 - DNA, 17 bp, Homo sapiens
ttgcctccccatttccc

SEQ ID NO: 4014181 - DNA, 20 bp, Homo sapiens
ttgcctccccatttcccatc

SEQ ID NO: 4014182 - DNA, 22 bp, Homo sapiens
ttgcctccccatttcccatctg

SEQ ID NO: 4014183 - DNA, 16 bp, Homo sapiens
ttgcctctgccctgga

SEQ ID NO: 4014184 - DNA, 22 bp, Homo sapiens
ttgcctgagaagaagtggctgc

SEQ ID NO: 4014185 - DNA, 13 bp, Homo sapiens
ttgcctgctgggc

SEQ ID NO: 4014186 - DNA, 22 bp, Homo sapiens
ttgccttcctttctccaggacc

SEQ ID NO: 4014187 - DNA, 17 bp, Homo sapiens
ttgccttctacttttaa

SEQ ID NO: 4014188 - DNA, 21 bp, Homo sapiens
ttgccttctctgttcccttgc

SEQ ID NO: 4014189 - DNA, 16 bp, Homo sapiens
ttgccttgctgtttgt

SEQ ID NO: 4014190 - DNA, 20 bp, Homo sapiens
ttgccttgggctgctcctca

SEQ ID NO: 4014191 - DNA, 17 bp, Homo sapiens
ttgcctttcgaggcctg

SEQ ID NO: 4014192 - DNA, 14 bp, Homo sapiens
ttgcctttcttctg

SEQ ID NO: 4014193 - DNA, 17 bp, Homo sapiens
ttgcctttgttttgatg

SEQ ID NO: 4014194 - DNA, 14 bp, Homo sapiens
ttgcgagtccaagg

SEQ ID NO: 4014195 - DNA, 16 bp, Homo sapiens
ttgcgctggtggacca

SEQ ID NO: 4014196 - DNA, 23 bp, Homo sapiens
ttgcgctggtggaccacaggcat

SEQ ID NO: 4014197 - DNA, 14 bp, Homo sapiens
ttgcggccccagga

SEQ ID NO: 4014198 - DNA, 18 bp, Homo sapiens
ttgcgtatgtctgttacc

SEQ ID NO: 4014199 - DNA, 20 bp, Homo sapiens
ttgcgtgtcaatttccctca

SEQ ID NO: 4014200 - DNA, 13 bp, Homo sapiens
ttgctaaactgat

SEQ ID NO: 4014201 - DNA, 16 bp, Homo sapiens
ttgctaattaaaaagt

SEQ ID NO: 4014202 - DNA, 23 bp, Homo sapiens
ttgctagataaaagctgaagtta

SEQ ID NO: 4014203 - DNA, 23 bp, Homo sapiens
ttgctagcagtaaaagatgaagt

SEQ ID NO: 4014204 - DNA, 15 bp, Homo sapiens
ttgctagtatttgaa

SEQ ID NO: 4014205 - DNA, 17 bp, Homo sapiens
ttgctataatcattagt

SEQ ID NO: 4014206 - DNA, 18 bp, Homo sapiens
ttgctataatcattagtt

SEQ ID NO: 4014207 - DNA, 18 bp, Homo sapiens
ttgctatgttactatttt

SEQ ID NO: 4014208 - DNA, 19 bp, Homo sapiens
ttgctattgtaaatatgtt

SEQ ID NO: 4014209 - DNA, 13 bp, Homo sapiens
ttgctcagtctcc

SEQ ID NO: 4014210 - DNA, 20 bp, Homo sapiens
ttgctcattcttgaggagca

SEQ ID NO: 4014211 - DNA, 14 bp, Homo sapiens
ttgctcccaaccca

SEQ ID NO: 4014212 - DNA, 20 bp, Homo sapiens
ttgctccccttccccttcct

SEQ ID NO: 4014213 - DNA, 17 bp, Homo sapiens
ttgctctctgtgaccct

SEQ ID NO: 4014214 - DNA, 21 bp, Homo sapiens
ttgctctgtcccccaggctgg

SEQ ID NO: 4014215 - DNA, 22 bp, Homo sapiens
ttgctctgtcccccaggctgga

SEQ ID NO: 4014216 - DNA, 17 bp, Homo sapiens
ttgctcttagtcccaag

SEQ ID NO: 4014217 - DNA, 19 bp, Homo sapiens
ttgctcttgtcccacgtgt

SEQ ID NO: 4014218 - DNA, 14 bp, Homo sapiens
ttgctgaaagatct

SEQ ID NO: 4014219 - DNA, 14 bp, Homo sapiens
ttgctgagcctctg

SEQ ID NO: 4014220 - DNA, 15 bp, Homo sapiens
ttgctgagcctctgc

SEQ ID NO: 4014221 - DNA, 21 bp, Homo sapiens
ttgctgatcagagttcctcct

SEQ ID NO: 4014222 - DNA, 21 bp, Homo sapiens
ttgctggacggggactgggga

SEQ ID NO: 4014223 - DNA, 11 bp, Homo sapiens
ttgctgtctct

SEQ ID NO: 4014224 - DNA, 20 bp, Homo sapiens
ttgctgtgaggaatgctctg

SEQ ID NO: 4014225 - DNA, 20 bp, Homo sapiens
ttgctgtgaggctgtcctgt

SEQ ID NO: 4014226 - DNA, 12 bp, Homo sapiens
ttgcttaaacaa

SEQ ID NO: 4014227 - DNA, 18 bp, Homo sapiens
ttgcttattgttccaaga

SEQ ID NO: 4014228 - DNA, 20 bp, Homo sapiens
ttgcttattgttccaagaca

SEQ ID NO: 4014229 - DNA, 22 bp, Homo sapiens
ttgcttcaccatggccttatga

SEQ ID NO: 4014230 - DNA, 14 bp, Homo sapiens
ttgcttcataaatg

SEQ ID NO: 4014231 - DNA, 15 bp, Homo sapiens
ttgcttcataaatga

SEQ ID NO: 4014232 - DNA, 20 bp, Homo sapiens
ttgcttcataaatgaagcag

SEQ ID NO: 4014233 - DNA, 20 bp, Homo sapiens
ttgcttccccttttgccaat

SEQ ID NO: 4014234 - DNA, 11 bp, Homo sapiens
ttgcttcctga

SEQ ID NO: 4014235 - DNA, 21 bp, Homo sapiens
ttgcttctgtagtactcctta

SEQ ID NO: 4014236 - DNA, 18 bp, Homo sapiens
ttgcttctgtatttcctt

SEQ ID NO: 4014237 - DNA, 13 bp, Homo sapiens
ttgcttcttctga

SEQ ID NO: 4014238 - DNA, 16 bp, Homo sapiens
ttgcttgagcccagga

SEQ ID NO: 4014239 - DNA, 13 bp, Homo sapiens
ttgcttgtcattg

SEQ ID NO: 4014240 - DNA, 17 bp, Homo sapiens
ttgttcaaacaatatca

SEQ ID NO: 4014241 - DNA, 19 bp, Homo sapiens
ttgttcaataataaatatt

SEQ ID NO: 4014242 - DNA, 13 bp, Homo sapiens
ttgttcaattaga

SEQ ID NO: 4014243 - DNA, 15 bp, Homo sapiens
ttgttcaattagaat

SEQ ID NO: 4014244 - DNA, 21 bp, Homo sapiens
ttgttcactgaaggtgattca

SEQ ID NO: 4014245 - DNA, 13 bp, Homo sapiens
ttgttcagctccc

SEQ ID NO: 4014246 - DNA, 16 bp, Homo sapiens
ttgttccaagacattg

SEQ ID NO: 4014247 - DNA, 17 bp, Homo sapiens
ttgttccaagacattgt

SEQ ID NO: 4014248 - DNA, 22 bp, Homo sapiens
ttgttccaagacattgtcaata

SEQ ID NO: 4014249 - DNA, 11 bp, Homo sapiens
ttgttcccagt

SEQ ID NO: 4014250 - DNA, 14 bp, Homo sapiens
ttgttccctctccc

SEQ ID NO: 4014251 - DNA, 12 bp, Homo sapiens
ttgttctgagca

SEQ ID NO: 4014252 - DNA, 12 bp, Homo sapiens
ttgttctgcttt

SEQ ID NO: 4014253 - DNA, 13 bp, Homo sapiens
ttgttctgggctc

SEQ ID NO: 4014254 - DNA, 14 bp, Homo sapiens
ttgttcttccaaag

SEQ ID NO: 4014255 - DNA, 18 bp, Homo sapiens
ttgttcttccaaagcaga

SEQ ID NO: 4014256 - DNA, 12 bp, Homo sapiens
ttgttgaaattt

SEQ ID NO: 4014257 - DNA, 16 bp, Homo sapiens
ttgttgacaaaatttt

SEQ ID NO: 4014258 - DNA, 14 bp, Homo sapiens
ttgttgacttattt

SEQ ID NO: 4014259 - DNA, 18 bp, Homo sapiens
ttgttgagctattgctgt

SEQ ID NO: 4014260 - DNA, 15 bp, Homo sapiens
ttgttgattctctcc

SEQ ID NO: 4014261 - DNA, 17 bp, Homo sapiens
ttgttgcaagatgtgaa

SEQ ID NO: 4014262 - DNA, 19 bp, Homo sapiens
ttgttgcaagatgtgaatt

SEQ ID NO: 4014263 - DNA, 21 bp, Homo sapiens
ttgttggaaaagaatacagaa

SEQ ID NO: 4014264 - DNA, 15 bp, Homo sapiens
ttgttgtgtgtgcag

SEQ ID NO: 4014265 - DNA, 15 bp, Homo sapiens
ttgttgttgccaaag

SEQ ID NO: 4014266 - DNA, 15 bp, Homo sapiens
ttgttgtttgctttg

SEQ ID NO: 4014267 - DNA, 12 bp, Homo sapiens
ttgttgttttct

SEQ ID NO: 4014268 - DNA, 16 bp, Homo sapiens
ttgtttaaaattcagt

SEQ ID NO: 4014269 - DNA, 22 bp, Homo sapiens
ttgtttaatttttatttcttcc

SEQ ID NO: 4014270 - DNA, 21 bp, Homo sapiens
ttgtttatcagatacatcact

SEQ ID NO: 4014271 - DNA, 18 bp, Homo sapiens
ttgtttatgatatttctt

SEQ ID NO: 4014272 - DNA, 20 bp, Homo sapiens
ttgtttatgtaaatgtttgt

SEQ ID NO: 4014273 - DNA, 18 bp, Homo sapiens
ttgtttcaagaacctgga

SEQ ID NO: 4014274 - DNA, 21 bp, Homo sapiens
ttgtttcaatgaggtgtccaa

SEQ ID NO: 4014275 - DNA, 16 bp, Homo sapiens
ttgtttcctcttccaa

SEQ ID NO: 4014276 - DNA, 23 bp, Homo sapiens
ttgtttctcaaatcttggcaata

SEQ ID NO: 4014277 - DNA, 21 bp, Homo sapiens
ttgtttctgacccactgatct

SEQ ID NO: 4014278 - DNA, 19 bp, Homo sapiens
ttgtttcttccaaagcaca

SEQ ID NO: 4014279 - DNA, 15 bp, Homo sapiens
ttgtttctttctagt

SEQ ID NO: 4014280 - DNA, 13 bp, Homo sapiens
ttgtttctttgtg

SEQ ID NO: 4014281 - DNA, 12 bp, Homo sapiens
ttgtttgctttg

SEQ ID NO: 4014282 - DNA, 13 bp, Homo sapiens
ttgtttgtaaata

SEQ ID NO: 4014283 - DNA, 15 bp, Homo sapiens
ttgtttgtctgtttg

SEQ ID NO: 4014284 - DNA, 13 bp, Homo sapiens
ttgtttgtttttg

SEQ ID NO: 4014285 - DNA, 12 bp, Homo sapiens
ttgttttacaat

SEQ ID NO: 4014286 - DNA, 13 bp, Homo sapiens
ttgttttcagtgt

SEQ ID NO: 4014287 - DNA, 16 bp, Homo sapiens
ttgttttctgactaat

SEQ ID NO: 4014288 - DNA, 18 bp, Homo sapiens
ttgttttctgactaatta

SEQ ID NO: 4014289 - DNA, 14 bp, Homo sapiens
ttgttttgcttttt

SEQ ID NO: 4014290 - DNA, 18 bp, Homo sapiens
ttgtttttattttcaaga

SEQ ID NO: 4014291 - DNA, 13 bp, Homo sapiens
ttgtttttgcttt

SEQ ID NO: 4014292 - DNA, 22 bp, Homo sapiens
tttaaaaaagcctggtttttct

SEQ ID NO: 4014293 - DNA, 19 bp, Homo sapiens
tttaaaaacatagaaaaat

SEQ ID NO: 4014294 - DNA, 16 bp, Homo sapiens
tttaaaaagaaaaaaa

SEQ ID NO: 4014295 - DNA, 17 bp, Homo sapiens
tttaaaaagggaagaaa

SEQ ID NO: 4014296 - DNA, 22 bp, Homo sapiens
tttaaaaagtaagttaataatg

SEQ ID NO: 4014297 - DNA, 15 bp, Homo sapiens
tttaaaaagtcttca

SEQ ID NO: 4014298 - DNA, 17 bp, Homo sapiens
tttaaaaatatttcaga

SEQ ID NO: 4014299 - DNA, 11 bp, Homo sapiens
tttaaaacttg

SEQ ID NO: 4014300 - DNA, 15 bp, Homo sapiens
tttaaaataaaatga

SEQ ID NO: 4014301 - DNA, 21 bp, Homo sapiens
tttaaaatatttgaatgaaaa

SEQ ID NO: 4014302 - DNA, 20 bp, Homo sapiens
tttaaaatggtttgtcctga

SEQ ID NO: 4014303 - DNA, 10 bp, Homo sapiens
tttaaaatta

SEQ ID NO: 4014304 - DNA, 17 bp, Homo sapiens
tttaaaattaagtagaa

SEQ ID NO: 4014305 - DNA, 22 bp, Homo sapiens
tttaaaattaagtagaacaaaa

SEQ ID NO: 4014306 - DNA, 23 bp, Homo sapiens
tttaaacaaattcatattctgtc

SEQ ID NO: 4014307 - DNA, 16 bp, Homo sapiens
tttaaacatagaaagt

SEQ ID NO: 4014308 - DNA, 20 bp, Homo sapiens
tttaaacatggttacaatca

SEQ ID NO: 4014309 - DNA, 19 bp, Homo sapiens
tttaaacattaatagcagc

SEQ ID NO: 4014310 - DNA, 16 bp, Homo sapiens
tttaaacctttttctt

SEQ ID NO: 4014311 - DNA, 15 bp, Homo sapiens
tttaaactgattcat

SEQ ID NO: 4014312 - DNA, 14 bp, Homo sapiens
tttaaacttataaa

SEQ ID NO: 4014313 - DNA, 12 bp, Homo sapiens
tttaaagaataa

SEQ ID NO: 4014314 - DNA, 13 bp, Homo sapiens
tttaaagaatgct

SEQ ID NO: 4014315 - DNA, 14 bp, Homo sapiens
tttaaagagaggtt

SEQ ID NO: 4014316 - DNA, 16 bp, Homo sapiens
tttaaagcttactctg

SEQ ID NO: 4014317 - DNA, 13 bp, Homo sapiens
tttaaaggcagag

SEQ ID NO: 4014318 - DNA, 16 bp, Homo sapiens
tttaaaggggcagaaa

SEQ ID NO: 4014319 - DNA, 22 bp, Homo sapiens
tttaaaggtttttaaattgttt

SEQ ID NO: 4014320 - DNA, 18 bp, Homo sapiens
tttaaagtggcaatctca

SEQ ID NO: 4014321 - DNA, 14 bp, Homo sapiens
tttaaagtgtttca

SEQ ID NO: 4014322 - DNA, 19 bp, Homo sapiens
tttaaataaaagtgatcaa

SEQ ID NO: 4014323 - DNA, 12 bp, Homo sapiens
tttaaataaaat

SEQ ID NO: 4014324 - DNA, 14 bp, Homo sapiens
tttaaataaaatca

SEQ ID NO: 4014325 - DNA, 16 bp, Homo sapiens
tttaaatataattctg

SEQ ID NO: 4014326 - DNA, 19 bp, Homo sapiens
tttaaatcaagtattttgt

SEQ ID NO: 4014327 - DNA, 16 bp, Homo sapiens
tttaaatcatgtatgt

SEQ ID NO: 4014328 - DNA, 12 bp, Homo sapiens
tttaaatgtata

SEQ ID NO: 4014329 - DNA, 16 bp, Homo sapiens
tttaaatgtattttac

SEQ ID NO: 4014330 - DNA, 11 bp, Homo sapiens
tttaaatgtga

SEQ ID NO: 4014331 - DNA, 17 bp, Homo sapiens
tttaaatgtgaattttt

SEQ ID NO: 4014332 - DNA, 17 bp, Homo sapiens
tttaaatgtgtacaatg

SEQ ID NO: 4014333 - DNA, 17 bp, Homo sapiens
tttaaattatgtataaa

SEQ ID NO: 4014334 - DNA, 16 bp, Homo sapiens
tttaacaaaagcaaga

SEQ ID NO: 4014335 - DNA, 16 bp, Homo sapiens
tttaacaaactaaaaa

SEQ ID NO: 4014336 - DNA, 15 bp, Homo sapiens
tttaacagtcattta

SEQ ID NO: 4014337 - DNA, 22 bp, Homo sapiens
tttaacgaatgaagatgtctaa

SEQ ID NO: 4014338 - DNA, 15 bp, Homo sapiens
tttaactgaaaatgt

SEQ ID NO: 4014339 - DNA, 18 bp, Homo sapiens
tttaactgaaaatgtaaa

SEQ ID NO: 4014340 - DNA, 21 bp, Homo sapiens
tttaactgattcttatgatta

SEQ ID NO: 4014341 - DNA, 17 bp, Homo sapiens
tttaacttttttttctc

SEQ ID NO: 4014342 - DNA, 22 bp, Homo sapiens
tttaagaaaaaataacacacat

SEQ ID NO: 4014343 - DNA, 23 bp, Homo sapiens
tttaagaaaagcacttttgttat

SEQ ID NO: 4014344 - DNA, 12 bp, Homo sapiens
tttcccttccag

SEQ ID NO: 4014345 - DNA, 24 bp, Homo sapiens
tttccgctgtcgccccaggccctc

SEQ ID NO: 4014346 - DNA, 16 bp, Homo sapiens
tttcctaacaaaagat

SEQ ID NO: 4014347 - DNA, 22 bp, Homo sapiens
tttcctaatcagaaatttttat

SEQ ID NO: 4014348 - DNA, 22 bp, Homo sapiens
tttcctaggatgtcatgtctgc

SEQ ID NO: 4014349 - DNA, 14 bp, Homo sapiens
tttcctatccttat

SEQ ID NO: 4014350 - DNA, 17 bp, Homo sapiens
tttcctatgggaacaat

SEQ ID NO: 4014351 - DNA, 16 bp, Homo sapiens
tttcctatttcagtgt

SEQ ID NO: 4014352 - DNA, 22 bp, Homo sapiens
tttcctcaagtatcttctattt

SEQ ID NO: 4014353 - DNA, 12 bp, Homo sapiens
tttcctccaccc

SEQ ID NO: 4014354 - DNA, 13 bp, Homo sapiens
tttcctcctctgc

SEQ ID NO: 4014355 - DNA, 21 bp, Homo sapiens
tttcctcctgaggctttggat

SEQ ID NO: 4014356 - DNA, 11 bp, Homo sapiens
tttcctcctgg

SEQ ID NO: 4014357 - DNA, 15 bp, Homo sapiens
tttcctcctttatca

SEQ ID NO: 4014358 - DNA, 16 bp, Homo sapiens
tttcctcctttatcac

SEQ ID NO: 4014359 - DNA, 17 bp, Homo sapiens
tttcctcctttatcaca

SEQ ID NO: 4014360 - DNA, 18 bp, Homo sapiens
tttcctctatacatctct

SEQ ID NO: 4014361 - DNA, 12 bp, Homo sapiens
tttcctcttgtg

SEQ ID NO: 4014362 - DNA, 21 bp, Homo sapiens
tttcctgaaacaacttggaaa

SEQ ID NO: 4014363 - DNA, 13 bp, Homo sapiens
tttcctgaaagtg

SEQ ID NO: 4014364 - DNA, 18 bp, Homo sapiens
tttcctgaaccatgtgga

SEQ ID NO: 4014365 - DNA, 21 bp, Homo sapiens
tttcctgcccagcctggggca

SEQ ID NO: 4014366 - DNA, 12 bp, Homo sapiens
tttcctgccctg

SEQ ID NO: 4014367 - DNA, 20 bp, Homo sapiens
tttcctggacatcctcttct

SEQ ID NO: 4014368 - DNA, 16 bp, Homo sapiens
tttccttaaactgtgt

SEQ ID NO: 4014369 - DNA, 23 bp, Homo sapiens
tttccttaaactgtgtggactgt

SEQ ID NO: 4014370 - DNA, 16 bp, Homo sapiens
tttccttaatccagct

SEQ ID NO: 4014371 - DNA, 17 bp, Homo sapiens
tttccttatttgccttc

SEQ ID NO: 4014372 - DNA, 16 bp, Homo sapiens
tttccttccagcccat

SEQ ID NO: 4014373 - DNA, 11 bp, Homo sapiens
tttccttccct

SEQ ID NO: 4014374 - DNA, 19 bp, Homo sapiens
tttccttcccttttctgtt

SEQ ID NO: 4014375 - DNA, 16 bp, Homo sapiens
tttccttcctctgtaa

SEQ ID NO: 4014376 - DNA, 14 bp, Homo sapiens
tttccttgtcccgt

SEQ ID NO: 4014377 - DNA, 18 bp, Homo sapiens
tttccttgttggtcagag

SEQ ID NO: 4014378 - DNA, 19 bp, Homo sapiens
tttccttgtttatcagata

SEQ ID NO: 4014379 - DNA, 21 bp, Homo sapiens
tttcctttaaaaaaatttaag

SEQ ID NO: 4014380 - DNA, 23 bp, Homo sapiens
tttcctttaaaaaaatttaagtg

SEQ ID NO: 4014381 - DNA, 13 bp, Homo sapiens
tttcctttatgtg

SEQ ID NO: 4014382 - DNA, 17 bp, Homo sapiens
tttcctttatgtgaatt

SEQ ID NO: 4014383 - DNA, 21 bp, Homo sapiens
tttcctttatgtgaattttta

SEQ ID NO: 4014384 - DNA, 22 bp, Homo sapiens
tttcctttttaatatgcttaaa

SEQ ID NO: 4014385 - DNA, 18 bp, Homo sapiens
tttcctttttgacactga

SEQ ID NO: 4014386 - DNA, 16 bp, Homo sapiens
tttcgaaactgccaag

SEQ ID NO: 4014387 - DNA, 13 bp, Homo sapiens
tttcgaggcctga

SEQ ID NO: 4014388 - DNA, 15 bp, Homo sapiens
tttcgatgtttttga

SEQ ID NO: 4014389 - DNA, 12 bp, Homo sapiens
tttcgtttgttt

SEQ ID NO: 4014390 - DNA, 14 bp, Homo sapiens
tttcgtttgtttgt

SEQ ID NO: 4014391 - DNA, 19 bp, Homo sapiens
tttcgtttttcttggggta

SEQ ID NO: 4014392 - DNA, 14 bp, Homo sapiens
tttctaaaaaacag

SEQ ID NO: 4014393 - DNA, 14 bp, Homo sapiens
tttctaatgtttct

SEQ ID NO: 4014394 - DNA, 17 bp, Homo sapiens
tttctacaatgtgaact

SEQ ID NO: 4014395 - DNA, 18 bp, Homo sapiens
tttctacaatgtgaactt

SEQ ID NO: 4014396 - DNA, 22 bp, Homo sapiens
tttctacaatgtgaactttatt

SEQ ID NO: 4014397 - DNA, 19 bp, Homo sapiens
tttctagaagtttcccttc

SEQ ID NO: 4014398 - DNA, 22 bp, Homo sapiens
tttctagctagaaatatgattt

SEQ ID NO: 4014399 - DNA, 19 bp, Homo sapiens
tttctagctgttgagctgt

SEQ ID NO: 4014400 - DNA, 21 bp, Homo sapiens
tttctagctgttgagctgttt

SEQ ID NO: 4014401 - DNA, 16 bp, Homo sapiens
tttctagttctttcct

SEQ ID NO: 4014402 - DNA, 15 bp, Homo sapiens
tttctataacagata

SEQ ID NO: 4014403 - DNA, 16 bp, Homo sapiens
tttctatctaaatgat

SEQ ID NO: 4014404 - DNA, 20 bp, Homo sapiens
tttctattaaatagttatat

SEQ ID NO: 4014405 - DNA, 22 bp, Homo sapiens
tttctcaaaagcatttatcatt

SEQ ID NO: 4014406 - DNA, 18 bp, Homo sapiens
tttctcaaagttttgaaa

SEQ ID NO: 4014407 - DNA, 15 bp, Homo sapiens
tttctcactgaactc

SEQ ID NO: 4014408 - DNA, 15 bp, Homo sapiens
tttctcatgtatctt

SEQ ID NO: 4014409 - DNA, 14 bp, Homo sapiens
tttctcattcttgt

SEQ ID NO: 4014410 - DNA, 11 bp, Homo sapiens
tttctccagct

SEQ ID NO: 4014411 - DNA, 16 bp, Homo sapiens
tttctcctcccttcct

SEQ ID NO: 4014412 - DNA, 20 bp, Homo sapiens
tttctccttagtcttctcat

SEQ ID NO: 4014413 - DNA, 16 bp, Homo sapiens
tttctccttttgtgtt

SEQ ID NO: 4014414 - DNA, 15 bp, Homo sapiens
tttctctaatgcttg

SEQ ID NO: 4014415 - DNA, 14 bp, Homo sapiens
tttctctacactaa

SEQ ID NO: 4014416 - DNA, 21 bp, Homo sapiens
tttctctcagccttacatttg

SEQ ID NO: 4014417 - DNA, 13 bp, Homo sapiens
tttctctccctcc

SEQ ID NO: 4014418 - DNA, 18 bp, Homo sapiens
tttctctctacagtgcca

SEQ ID NO: 4014419 - DNA, 19 bp, Homo sapiens
tttctctctatttccccct

SEQ ID NO: 4014420 - DNA, 13 bp, Homo sapiens
tttctctcttccc

SEQ ID NO: 4014421 - DNA, 14 bp, Homo sapiens
tttctctcttccct

SEQ ID NO: 4014422 - DNA, 14 bp, Homo sapiens
tttctctcttttgt

SEQ ID NO: 4014423 - DNA, 20 bp, Homo sapiens
tttctctgatttgcaaaaaa

SEQ ID NO: 4014424 - DNA, 20 bp, Homo sapiens
tttctcttccccttagaaac

SEQ ID NO: 4014425 - DNA, 16 bp, Homo sapiens
tttctcttctcccctt

SEQ ID NO: 4014426 - DNA, 21 bp, Homo sapiens
tttctcttttcccctttcctg

SEQ ID NO: 4014427 - DNA, 22 bp, Homo sapiens
tttctcttttcccctttcctgt

SEQ ID NO: 4014428 - DNA, 13 bp, Homo sapiens
tttctcttttctt

SEQ ID NO: 4014429 - DNA, 21 bp, Homo sapiens
tttctgaaaatgtttaagtat

SEQ ID NO: 4014430 - DNA, 21 bp, Homo sapiens
tttctgaaaattccagaaagg

SEQ ID NO: 4014431 - DNA, 15 bp, Homo sapiens
tttctgacatgcatt

SEQ ID NO: 4014432 - DNA, 19 bp, Homo sapiens
tttctgacccactgatctc

SEQ ID NO: 4014433 - DNA, 16 bp, Homo sapiens
tttctgaggtccttat

SEQ ID NO: 4014434 - DNA, 16 bp, Homo sapiens
tttctgatcagaggtg

SEQ ID NO: 4014435 - DNA, 17 bp, Homo sapiens
tttctgattagctttgt

SEQ ID NO: 4014436 - DNA, 15 bp, Homo sapiens
tttctgattggtgat

SEQ ID NO: 4014437 - DNA, 14 bp, Homo sapiens
tttctgcagccctt

SEQ ID NO: 4014438 - DNA, 22 bp, Homo sapiens
tttctgcatgaatatcatacaa

SEQ ID NO: 4014439 - DNA, 13 bp, Homo sapiens
tttctgccctggc

SEQ ID NO: 4014440 - DNA, 22 bp, Homo sapiens
tttctgctctggaataaagttg

SEQ ID NO: 4014441 - DNA, 17 bp, Homo sapiens
tttctggccaaaagcag

SEQ ID NO: 4014442 - DNA, 16 bp, Homo sapiens
tttctggcctgccttc

SEQ ID NO: 4014443 - DNA, 16 bp, Homo sapiens
tttctgggataagtaa

SEQ ID NO: 4014444 - DNA, 15 bp, Homo sapiens
tttctggtagataga

SEQ ID NO: 4014445 - DNA, 13 bp, Homo sapiens
tttctgtaaataa

SEQ ID NO: 4014446 - DNA, 19 bp, Homo sapiens
tttctgtagtcatttacta

SEQ ID NO: 4014447 - DNA, 22 bp, Homo sapiens
ttttaatattcttttgtttcca

SEQ ID NO: 4014448 - DNA, 11 bp, Homo sapiens
ttttaatgtga

SEQ ID NO: 4014449 - DNA, 20 bp, Homo sapiens
ttttaattattatttatata

SEQ ID NO: 4014450 - DNA, 12 bp, Homo sapiens
ttttaattcatt

SEQ ID NO: 4014451 - DNA, 16 bp, Homo sapiens
ttttaatttaaagctt

SEQ ID NO: 4014452 - DNA, 17 bp, Homo sapiens
ttttaatttaaagctta

SEQ ID NO: 4014453 - DNA, 18 bp, Homo sapiens
ttttaatttaacaaacta

SEQ ID NO: 4014454 - DNA, 23 bp, Homo sapiens
ttttaatttatgagtttttgata

SEQ ID NO: 4014455 - DNA, 21 bp, Homo sapiens
ttttaatttatttcatccagt

SEQ ID NO: 4014456 - DNA, 15 bp, Homo sapiens
ttttaatttgatgaa

SEQ ID NO: 4014457 - DNA, 20 bp, Homo sapiens
ttttaatttgatgaaagctg

SEQ ID NO: 4014458 - DNA, 21 bp, Homo sapiens
ttttaatttgatgaaagctga

SEQ ID NO: 4014459 - DNA, 21 bp, Homo sapiens
ttttaattttcacaaaatgtc

SEQ ID NO: 4014460 - DNA, 10 bp, Homo sapiens
ttttacaaaa

SEQ ID NO: 4014461 - DNA, 23 bp, Homo sapiens
ttttacagttagggttttgcaat

SEQ ID NO: 4014462 - DNA, 22 bp, Homo sapiens
ttttaccactatttaagttatc

SEQ ID NO: 4014463 - DNA, 22 bp, Homo sapiens
ttttaccgttggggcccttaac

SEQ ID NO: 4014464 - DNA, 18 bp, Homo sapiens
ttttacctaccacagtgt

SEQ ID NO: 4014465 - DNA, 21 bp, Homo sapiens
ttttacctaccacagtgtctg

SEQ ID NO: 4014466 - DNA, 19 bp, Homo sapiens
ttttacttttataataaaa

SEQ ID NO: 4014467 - DNA, 14 bp, Homo sapiens
ttttagaaaacagc

SEQ ID NO: 4014468 - DNA, 21 bp, Homo sapiens
ttttaggcaaagataatttat

SEQ ID NO: 4014469 - DNA, 15 bp, Homo sapiens
ttttaggtagaaaaa

SEQ ID NO: 4014470 - DNA, 16 bp, Homo sapiens
ttttaggtgttgattt

SEQ ID NO: 4014471 - DNA, 13 bp, Homo sapiens
ttttagtccaaat

SEQ ID NO: 4014472 - DNA, 20 bp, Homo sapiens
ttttataaggacttcctgat

SEQ ID NO: 4014473 - DNA, 23 bp, Homo sapiens
ttttataataaaaggaaaagcaa

SEQ ID NO: 4014474 - DNA, 19 bp, Homo sapiens
ttttataatcaatgaattt

SEQ ID NO: 4014475 - DNA, 19 bp, Homo sapiens
ttttatattcagtgaaaag

SEQ ID NO: 4014476 - DNA, 21 bp, Homo sapiens
ttttatatttcctttatgtga

SEQ ID NO: 4014477 - DNA, 14 bp, Homo sapiens
ttttatatttgtag

SEQ ID NO: 4014478 - DNA, 13 bp, Homo sapiens
ttttatcattaat

SEQ ID NO: 4014479 - DNA, 13 bp, Homo sapiens
ttttatctgcaga

SEQ ID NO: 4014480 - DNA, 14 bp, Homo sapiens
ttttatctgtttaa

SEQ ID NO: 4014481 - DNA, 13 bp, Homo sapiens
ttttatgatcagt

SEQ ID NO: 4014482 - DNA, 13 bp, Homo sapiens
ttttatgccccat

SEQ ID NO: 4014483 - DNA, 14 bp, Homo sapiens
ttttatgtttgaat

SEQ ID NO: 4014484 - DNA, 17 bp, Homo sapiens
ttttattatttctatta

SEQ ID NO: 4014485 - DNA, 18 bp, Homo sapiens
ttttattatttttatact

SEQ ID NO: 4014486 - DNA, 12 bp, Homo sapiens
ttttattcagca

SEQ ID NO: 4014487 - DNA, 19 bp, Homo sapiens
ttttattcagcagactttc

SEQ ID NO: 4014488 - DNA, 20 bp, Homo sapiens
ttttattgctagtatttgaa

SEQ ID NO: 4014489 - DNA, 21 bp, Homo sapiens
ttttattgctagtatttgaat

SEQ ID NO: 4014490 - DNA, 14 bp, Homo sapiens
ttttatttctcctt

SEQ ID NO: 4014491 - DNA, 18 bp, Homo sapiens
ttttatttctccttttgt

SEQ ID NO: 4014492 - DNA, 13 bp, Homo sapiens
ttttatttctcgg

SEQ ID NO: 4014493 - DNA, 16 bp, Homo sapiens
ttttattttactttta

SEQ ID NO: 4014494 - DNA, 12 bp, Homo sapiens
ttttattttcaa

SEQ ID NO: 4014495 - DNA, 16 bp, Homo sapiens
ttttattttcaaatct

SEQ ID NO: 4014496 - DNA, 12 bp, Homo sapiens
ttttatttttgc

SEQ ID NO: 4014497 - DNA, 18 bp, Homo sapiens
ttttattttttcttttgt

SEQ ID NO: 4014498 - DNA, 14 bp, Homo sapiens
ttttcaaaagaaag

SEQ ID NO: 4014499 - DNA, 13 bp, Homo sapiens
ttttcaaatctgg

SEQ ID NO: 4014500 - DNA, 14 bp, Homo sapiens
ttttcaaatctggt

SEQ ID NO: 4014501 - DNA, 14 bp, Homo sapiens
ttttcaaattgtat

SEQ ID NO: 4014502 - DNA, 17 bp, Homo sapiens
ttttcaacgcagccctg

SEQ ID NO: 4014503 - DNA, 13 bp, Homo sapiens
ttttcaaggaagg

SEQ ID NO: 4014504 - DNA, 20 bp, Homo sapiens
ttttcaataccaattacatg

SEQ ID NO: 4014505 - DNA, 15 bp, Homo sapiens
ttttcaatatattga

SEQ ID NO: 4014506 - DNA, 18 bp, Homo sapiens
ttttcaatatattgaact

SEQ ID NO: 4014507 - DNA, 17 bp, Homo sapiens
ttttcacaatgtcagta

SEQ ID NO: 4014508 - DNA, 18 bp, Homo sapiens
ttttcagaaaaagaaatg

SEQ ID NO: 4014509 - DNA, 16 bp, Homo sapiens
ttttcagaaaatatta

SEQ ID NO: 4014510 - DNA, 23 bp, Homo sapiens
ttttcagaaaatattatgtgttt

SEQ ID NO: 4014511 - DNA, 17 bp, Homo sapiens
ttttcagaacctcttcc

SEQ ID NO: 4014512 - DNA, 18 bp, Homo sapiens
ttttcagaacctcttccc

SEQ ID NO: 4014513 - DNA, 22 bp, Homo sapiens
ttttcagaagcaagccagacct

SEQ ID NO: 4014514 - DNA, 21 bp, Homo sapiens
ttttcagaaggttattttctt

SEQ ID NO: 4014515 - DNA, 22 bp, Homo sapiens
ttttcagagatttatataaatg

SEQ ID NO: 4014516 - DNA, 13 bp, Homo sapiens
ttttcaggaagct

SEQ ID NO: 4014517 - DNA, 14 bp, Homo sapiens
ttttcagtgtacat

SEQ ID NO: 4014518 - DNA, 22 bp, Homo sapiens
ttttcagtttatttgaaccaat

SEQ ID NO: 4014519 - DNA, 14 bp, Homo sapiens
ttttcattaaactt

SEQ ID NO: 4014520 - DNA, 14 bp, Homo sapiens
ttttcattctcatt

SEQ ID NO: 4014521 - DNA, 18 bp, Homo sapiens
ttttcatttcatgaaaat

SEQ ID NO: 4014522 - DNA, 19 bp, Homo sapiens
ttttcatttcttcctcagc

SEQ ID NO: 4014523 - DNA, 11 bp, Homo sapiens
ttttcattttg

SEQ ID NO: 4014524 - DNA, 17 bp, Homo sapiens
ttttcccatcatccttt

SEQ ID NO: 4014525 - DNA, 20 bp, Homo sapiens
ttttcccatcatcctttgtt

SEQ ID NO: 4014526 - DNA, 17 bp, Homo sapiens
ttttcccctacagaatt

SEQ ID NO: 4014527 - DNA, 15 bp, Homo sapiens
ttttcccctttctgt

SEQ ID NO: 4014528 - DNA, 12 bp, Homo sapiens
ttttcctcccag

SEQ ID NO: 4014529 - DNA, 14 bp, Homo sapiens
ttttcctcctctgc

SEQ ID NO: 4014530 - DNA, 17 bp, Homo sapiens
ttttcctcgcttctttc

SEQ ID NO: 4014531 - DNA, 21 bp, Homo sapiens
ttttcctctgagcccagctgc

SEQ ID NO: 4014532 - DNA, 14 bp, Homo sapiens
ttttcctcttgtga

SEQ ID NO: 4014533 - DNA, 16 bp, Homo sapiens
ttttcctcttgtgatt

SEQ ID NO: 4014534 - DNA, 14 bp, Homo sapiens
ttttcctgttcagt

SEQ ID NO: 4014535 - DNA, 20 bp, Homo sapiens
ttttccttatttgccttcta

SEQ ID NO: 4014536 - DNA, 16 bp, Homo sapiens
ttttccttcattcata

SEQ ID NO: 4014537 - DNA, 24 bp, Homo sapiens
ttttccttcctctgtaagatatcc

SEQ ID NO: 4014538 - DNA, 17 bp, Homo sapiens
ttttcgtgtggatcttg

SEQ ID NO: 4014539 - DNA, 15 bp, Homo sapiens
ttttctaagagaagt

SEQ ID NO: 4014540 - DNA, 21 bp, Homo sapiens
ttttctaagcaatttcttgct

SEQ ID NO: 4014541 - DNA, 14 bp, Homo sapiens
ttttctacagtggt

SEQ ID NO: 4014542 - DNA, 23 bp, Homo sapiens
ttttctcaaagttttgaaaagct

SEQ ID NO: 4014543 - DNA, 21 bp, Homo sapiens
ttttctccctttatgtatctc

SEQ ID NO: 4014544 - DNA, 20 bp, Homo sapiens
ttttctctaatgcttgattt

SEQ ID NO: 4014545 - DNA, 14 bp, Homo sapiens
ttttctctggtaat

SEQ ID NO: 4014546 - DNA, 16 bp, Homo sapiens
ttttctctggtaatat

SEQ ID NO: 4014547 - DNA, 21 bp, Homo sapiens
ttttctctggtaatattgact

SEQ ID NO: 4014548 - DNA, 22 bp, Homo sapiens
ttttctctttctccttagtctt

SEQ ID NO: 4014549 - DNA, 18 bp, Homo sapiens
ttttctgattagctttgt

SEQ ID NO: 4014550 - DNA, 20 bp, Homo sapiens
aaaatatgggttgcatttgg

SEQ ID NO: 4014551 - DNA, 21 bp, Homo sapiens
aaaatattatgtgtttccata

SEQ ID NO: 4014552 - DNA, 14 bp, Homo sapiens
aaaatattgtttct

SEQ ID NO: 4014553 - DNA, 22 bp, Homo sapiens
aaaatattgtttctgcattcat

SEQ ID NO: 4014554 - DNA, 11 bp, Homo sapiens
aaaatatttaa

SEQ ID NO: 4014555 - DNA, 21 bp, Homo sapiens
aaaatatttataaaacttctc

SEQ ID NO: 4014556 - DNA, 23 bp, Homo sapiens
aaaatatttattaaataaaatca

SEQ ID NO: 4014557 - DNA, 14 bp, Homo sapiens
aaaatatttcagat

SEQ ID NO: 4014558 - DNA, 19 bp, Homo sapiens
aaaatatttcagatatcaa

SEQ ID NO: 4014559 - DNA, 15 bp, Homo sapiens
aaaatatttcctgac

SEQ ID NO: 4014560 - DNA, 13 bp, Homo sapiens
aaaatattttttg

SEQ ID NO: 4014561 - DNA, 15 bp, Homo sapiens
aaaatattttttgca

SEQ ID NO: 4014562 - DNA, 15 bp, Homo sapiens
aaaatcactatcttt

SEQ ID NO: 4014563 - DNA, 21 bp, Homo sapiens
aaaatccagaaacttgttctt

SEQ ID NO: 4014564 - DNA, 21 bp, Homo sapiens
aaaatccttccaaagaattct

SEQ ID NO: 4014565 - DNA, 14 bp, Homo sapiens
aaaatctaaaacaa

SEQ ID NO: 4014566 - DNA, 19 bp, Homo sapiens
aaaatctcccattttggaa

SEQ ID NO: 4014567 - DNA, 18 bp, Homo sapiens
aaaatctgaactctcaaa

SEQ ID NO: 4014568 - DNA, 19 bp, Homo sapiens
aaaatgaaagcatgtctca

SEQ ID NO: 4014569 - DNA, 22 bp, Homo sapiens
aaaatgaaagcatgtctcaata

SEQ ID NO: 4014570 - DNA, 16 bp, Homo sapiens
aaaatgaaagtgactt

SEQ ID NO: 4014571 - DNA, 23 bp, Homo sapiens
aaaatgaaagtgactttaaaaga

SEQ ID NO: 4014572 - DNA, 18 bp, Homo sapiens
aaaatgaatatctattaa

SEQ ID NO: 4014573 - DNA, 15 bp, Homo sapiens
aaaatgacagatgtt

SEQ ID NO: 4014574 - DNA, 18 bp, Homo sapiens
aaaatgacagatgttgaa

SEQ ID NO: 4014575 - DNA, 16 bp, Homo sapiens
aaaatgcaacaaatga

SEQ ID NO: 4014576 - DNA, 14 bp, Homo sapiens
aaaatgcacatagc

SEQ ID NO: 4014577 - DNA, 15 bp, Homo sapiens
aaaatgcccatttgc

SEQ ID NO: 4014578 - DNA, 17 bp, Homo sapiens
aaaatgcccttaaatca

SEQ ID NO: 4014579 - DNA, 22 bp, Homo sapiens
aaaatgcctttgagacagtttc

SEQ ID NO: 4014580 - DNA, 13 bp, Homo sapiens
aaaatgcttttta

SEQ ID NO: 4014581 - DNA, 15 bp, Homo sapiens
aaaatggaaaaaaac

SEQ ID NO: 4014582 - DNA, 23 bp, Homo sapiens
aaaatggacatggtggctttgtt

SEQ ID NO: 4014583 - DNA, 20 bp, Homo sapiens
aaaatggatattattagaaa

SEQ ID NO: 4014584 - DNA, 15 bp, Homo sapiens
aaaatggcaaatgca

SEQ ID NO: 4014585 - DNA, 21 bp, Homo sapiens
aaaatgggcgggggtggtgtg

SEQ ID NO: 4014586 - DNA, 23 bp, Homo sapiens
aaaatggggtttgggcccctcag

SEQ ID NO: 4014587 - DNA, 20 bp, Homo sapiens
aaaatgtaaatattctatat

SEQ ID NO: 4014588 - DNA, 19 bp, Homo sapiens
aaaatgtaatttagaaact

SEQ ID NO: 4014589 - DNA, 12 bp, Homo sapiens
aaaatgtctgta

SEQ ID NO: 4014590 - DNA, 19 bp, Homo sapiens
aaaatgtgacccagatcct

SEQ ID NO: 4014591 - DNA, 13 bp, Homo sapiens
aaaatgtgatttt

SEQ ID NO: 4014592 - DNA, 18 bp, Homo sapiens
aaaatgtgatttttctga

SEQ ID NO: 4014593 - DNA, 15 bp, Homo sapiens
aaaatgttctgtttg

SEQ ID NO: 4014594 - DNA, 15 bp, Homo sapiens
aaaatgttctttgga

SEQ ID NO: 4014595 - DNA, 20 bp, Homo sapiens
aaaatgttggatttataaat

SEQ ID NO: 4014596 - DNA, 17 bp, Homo sapiens
aaaattactaattttac

SEQ ID NO: 4014597 - DNA, 14 bp, Homo sapiens
aaaattagaaattg

SEQ ID NO: 4014598 - DNA, 20 bp, Homo sapiens
aaaattagaaattggctgga

SEQ ID NO: 4014599 - DNA, 16 bp, Homo sapiens
aaaattcagcaaacca

SEQ ID NO: 4014600 - DNA, 16 bp, Homo sapiens
aaaattcagtttttgt

SEQ ID NO: 4014601 - DNA, 18 bp, Homo sapiens
aaaattcagtttttgtat

SEQ ID NO: 4014602 - DNA, 21 bp, Homo sapiens
aaaattcagtttttgtatctt

SEQ ID NO: 4014603 - DNA, 12 bp, Homo sapiens
aaaattccagaa

SEQ ID NO: 4014604 - DNA, 21 bp, Homo sapiens
aaaattccatcccatcatctt

SEQ ID NO: 4014605 - DNA, 18 bp, Homo sapiens
aaaattccattatcttat

SEQ ID NO: 4014606 - DNA, 16 bp, Homo sapiens
aaaattcgctttctaa

SEQ ID NO: 4014607 - DNA, 19 bp, Homo sapiens
aaaattctagctgtatgat

SEQ ID NO: 4014608 - DNA, 22 bp, Homo sapiens
aaaattgaagagagatatatct

SEQ ID NO: 4014609 - DNA, 12 bp, Homo sapiens
aaaattgatgtg

SEQ ID NO: 4014610 - DNA, 15 bp, Homo sapiens
aaaattgcactaaat

SEQ ID NO: 4014611 - DNA, 13 bp, Homo sapiens
aaaattgctatgt

SEQ ID NO: 4014612 - DNA, 17 bp, Homo sapiens
aaaattggttggagaat

SEQ ID NO: 4014613 - DNA, 20 bp, Homo sapiens
aaaattgttaatttttccta

SEQ ID NO: 4014614 - DNA, 16 bp, Homo sapiens
aaaatttaaaattacg

SEQ ID NO: 4014615 - DNA, 23 bp, Homo sapiens
aaaatttaagcattgtttgctta

SEQ ID NO: 4014616 - DNA, 18 bp, Homo sapiens
aaaatttaagtgcgtgtg

SEQ ID NO: 4014617 - DNA, 19 bp, Homo sapiens
aaaatttagaaatataatt

SEQ ID NO: 4014618 - DNA, 13 bp, Homo sapiens
aaaatttagaaca

SEQ ID NO: 4014619 - DNA, 13 bp, Homo sapiens
aaaatttatctta

SEQ ID NO: 4014620 - DNA, 22 bp, Homo sapiens
aaaatttgttttgacggatgat

SEQ ID NO: 4014621 - DNA, 21 bp, Homo sapiens
gcccctggggtggccaccagt

SEQ ID NO: 4014622 - DNA, 11 bp, Homo sapiens
gcccctgtggc

SEQ ID NO: 4014623 - DNA, 20 bp, Homo sapiens
gcccctgtggccctggccac

SEQ ID NO: 4014624 - DNA, 24 bp, Homo sapiens
gcccctgtgtgagttgagtctcct

SEQ ID NO: 4014625 - DNA, 15 bp, Homo sapiens
gccccttcccatctc

SEQ ID NO: 4014626 - DNA, 15 bp, Homo sapiens
gccccttctgctcag

SEQ ID NO: 4014627 - DNA, 20 bp, Homo sapiens
gccccttctgctcagctctg

SEQ ID NO: 4014628 - DNA, 23 bp, Homo sapiens
gccccttctgctcagctctgggc

SEQ ID NO: 4014629 - DNA, 20 bp, Homo sapiens
gccccttcttgggccccaga

SEQ ID NO: 4014630 - DNA, 22 bp, Homo sapiens
gccccttggctggatcagggaa

SEQ ID NO: 4014631 - DNA, 24 bp, Homo sapiens
gcccgaagcatgaacagtgcacct

SEQ ID NO: 4014632 - DNA, 12 bp, Homo sapiens
gcccgacagcct

SEQ ID NO: 4014633 - DNA, 15 bp, Homo sapiens
gcccgacagcctggc

SEQ ID NO: 4014634 - DNA, 16 bp, Homo sapiens
gcccgacagcctggca

SEQ ID NO: 4014635 - DNA, 17 bp, Homo sapiens
gcccgacagcctggcac

SEQ ID NO: 4014636 - DNA, 17 bp, Homo sapiens
gcccgactgactggagg

SEQ ID NO: 4014637 - DNA, 14 bp, Homo sapiens
gcccgagctggtgc

SEQ ID NO: 4014638 - DNA, 22 bp, Homo sapiens
gcccgagctggtgcattacaga

SEQ ID NO: 4014639 - DNA, 15 bp, Homo sapiens
gcccgcaccccggcc

SEQ ID NO: 4014640 - DNA, 19 bp, Homo sapiens
gcccgcaccccggcctcag

SEQ ID NO: 4014641 - DNA, 20 bp, Homo sapiens
gcccgcaccccggcctcagg

SEQ ID NO: 4014642 - DNA, 14 bp, Homo sapiens
gcccgcagtgctgg

SEQ ID NO: 4014643 - DNA, 18 bp, Homo sapiens
gcccgcagtgctgggacc

SEQ ID NO: 4014644 - DNA, 20 bp, Homo sapiens
gcccgcagtgctgggaccag

SEQ ID NO: 4014645 - DNA, 16 bp, Homo sapiens
gcccgctcctgccgca

SEQ ID NO: 4014646 - DNA, 21 bp, Homo sapiens
gcccggagattggacggcctg

SEQ ID NO: 4014647 - DNA, 15 bp, Homo sapiens
gcccggcagggcggg

SEQ ID NO: 4014648 - DNA, 22 bp, Homo sapiens
gcccggccagcgggcacagggc

SEQ ID NO: 4014649 - DNA, 13 bp, Homo sapiens
gcccgtctcagtg

SEQ ID NO: 4014650 - DNA, 14 bp, Homo sapiens
gcccgtctcagtgt

SEQ ID NO: 4014651 - DNA, 23 bp, Homo sapiens
gcccgtgtagtccccaaccgtgt

SEQ ID NO: 4014652 - DNA, 20 bp, Homo sapiens
gccctaagtggctgccttct

SEQ ID NO: 4014653 - DNA, 16 bp, Homo sapiens
gccctacagagctgtg

SEQ ID NO: 4014654 - DNA, 18 bp, Homo sapiens
gccctagagcctgcctgg

SEQ ID NO: 4014655 - DNA, 14 bp, Homo sapiens
gccctagcccagac

SEQ ID NO: 4014656 - DNA, 16 bp, Homo sapiens
gccctagcccagactc

SEQ ID NO: 4014657 - DNA, 17 bp, Homo sapiens
gccctagcccagactct

SEQ ID NO: 4014658 - DNA, 14 bp, Homo sapiens
gccctagctgaccc

SEQ ID NO: 4014659 - DNA, 19 bp, Homo sapiens
gccctatgggcctgccggg

SEQ ID NO: 4014660 - DNA, 15 bp, Homo sapiens
gccctcaacaggccc

SEQ ID NO: 4014661 - DNA, 16 bp, Homo sapiens
gccctcaacaggccca

SEQ ID NO: 4014662 - DNA, 17 bp, Homo sapiens
gccctcaacaggcccag

SEQ ID NO: 4014663 - DNA, 19 bp, Homo sapiens
gccctcaacaggcccaggg

SEQ ID NO: 4014664 - DNA, 23 bp, Homo sapiens
gccctcaacaggcccagggaggg

SEQ ID NO: 4014665 - DNA, 17 bp, Homo sapiens
gccctcaatccaccttc

SEQ ID NO: 4014666 - DNA, 17 bp, Homo sapiens
gccctcagttccttcat

SEQ ID NO: 4014667 - DNA, 19 bp, Homo sapiens
gccctcattactgggcctt

SEQ ID NO: 4014668 - DNA, 21 bp, Homo sapiens
gccctcattactgggccttag

SEQ ID NO: 4014669 - DNA, 12 bp, Homo sapiens
gccctcccagaa

SEQ ID NO: 4014670 - DNA, 12 bp, Homo sapiens
gccctccccctc

SEQ ID NO: 4014671 - DNA, 16 bp, Homo sapiens
gccctccccctcaacc

SEQ ID NO: 4014672 - DNA, 17 bp, Homo sapiens
gccctccccctcaacct

SEQ ID NO: 4014673 - DNA, 15 bp, Homo sapiens
gccctcccccttccc

SEQ ID NO: 4014674 - DNA, 21 bp, Homo sapiens
gccctccctgttccccagaga

SEQ ID NO: 4014675 - DNA, 18 bp, Homo sapiens
gccctcctcgggccgagg

SEQ ID NO: 4014676 - DNA, 22 bp, Homo sapiens
gccctcctcgggccgaggccca

SEQ ID NO: 4014677 - DNA, 15 bp, Homo sapiens
gccctccttgtccac

SEQ ID NO: 4014678 - DNA, 17 bp, Homo sapiens
gccctccttgtccaccc

SEQ ID NO: 4014679 - DNA, 19 bp, Homo sapiens
gccctccttgtccacccac

SEQ ID NO: 4014680 - DNA, 18 bp, Homo sapiens
gccctcctttctgtgccc

SEQ ID NO: 4014681 - DNA, 21 bp, Homo sapiens
gccctcgtgcctgggggagag

SEQ ID NO: 4014682 - DNA, 22 bp, Homo sapiens
gccctcgtgcctgggggagaga

SEQ ID NO: 4014683 - DNA, 15 bp, Homo sapiens
gccctctctctgggc

SEQ ID NO: 4014684 - DNA, 12 bp, Homo sapiens
gccctcttctcg

SEQ ID NO: 4014685 - DNA, 13 bp, Homo sapiens
gccctcttggggg

SEQ ID NO: 4014686 - DNA, 15 bp, Homo sapiens
gccctctttccctgc

SEQ ID NO: 4014687 - DNA, 16 bp, Homo sapiens
gccctgaccttggctg

SEQ ID NO: 4014688 - DNA, 16 bp, Homo sapiens
gcctggactttcctgc

SEQ ID NO: 4014689 - DNA, 17 bp, Homo sapiens
gcctggactttcctgca

SEQ ID NO: 4014690 - DNA, 13 bp, Homo sapiens
gcctggagaagct

SEQ ID NO: 4014691 - DNA, 16 bp, Homo sapiens
gcctggagacagatac

SEQ ID NO: 4014692 - DNA, 15 bp, Homo sapiens
gcctggagagggtct

SEQ ID NO: 4014693 - DNA, 19 bp, Homo sapiens
gcctggagagggtctcgct

SEQ ID NO: 4014694 - DNA, 12 bp, Homo sapiens
gcctggagcccc

SEQ ID NO: 4014695 - DNA, 17 bp, Homo sapiens
gcctggagtgctgtgct

SEQ ID NO: 4014696 - DNA, 17 bp, Homo sapiens
gcctggatgccagctgt

SEQ ID NO: 4014697 - DNA, 18 bp, Homo sapiens
gcctggatgccagctgtg

SEQ ID NO: 4014698 - DNA, 14 bp, Homo sapiens
gcctggcacagggc

SEQ ID NO: 4014699 - DNA, 19 bp, Homo sapiens
gcctggcacagggcagtgg

SEQ ID NO: 4014700 - DNA, 20 bp, Homo sapiens
gcctggcagccgtgccttca

SEQ ID NO: 4014701 - DNA, 14 bp, Homo sapiens
gcctggccaccagc

SEQ ID NO: 4014702 - DNA, 17 bp, Homo sapiens
gcctggccaccagccat

SEQ ID NO: 4014703 - DNA, 16 bp, Homo sapiens
gcctggccacctctct

SEQ ID NO: 4014704 - DNA, 17 bp, Homo sapiens
gcctggccacctctctc

SEQ ID NO: 4014705 - DNA, 13 bp, Homo sapiens
gcctggccagaca

SEQ ID NO: 4014706 - DNA, 14 bp, Homo sapiens
gcctggccagacac

SEQ ID NO: 4014707 - DNA, 14 bp, Homo sapiens
gcctggccaggagc

SEQ ID NO: 4014708 - DNA, 15 bp, Homo sapiens
gcctggccaggagct

SEQ ID NO: 4014709 - DNA, 12 bp, Homo sapiens
gcctggccaggc

SEQ ID NO: 4014710 - DNA, 15 bp, Homo sapiens
gcctggccaggcacc

SEQ ID NO: 4014711 - DNA, 14 bp, Homo sapiens
gcctggccatttcc

SEQ ID NO: 4014712 - DNA, 10 bp, Homo sapiens
gcctggcccc

SEQ ID NO: 4014713 - DNA, 13 bp, Homo sapiens
gcctggccccagc

SEQ ID NO: 4014714 - DNA, 17 bp, Homo sapiens
gcctggccccaggcccc

SEQ ID NO: 4014715 - DNA, 18 bp, Homo sapiens
gcctggccccaggcccca

SEQ ID NO: 4014716 - DNA, 20 bp, Homo sapiens
gcctggccccaggccccaga

SEQ ID NO: 4014717 - DNA, 13 bp, Homo sapiens
gcctggcctctgc

SEQ ID NO: 4014718 - DNA, 14 bp, Homo sapiens
gcctggcctctgcc

SEQ ID NO: 4014719 - DNA, 19 bp, Homo sapiens
gcctggcctctgcctccac

SEQ ID NO: 4014720 - DNA, 17 bp, Homo sapiens
gcctggctgcagctggg

SEQ ID NO: 4014721 - DNA, 12 bp, Homo sapiens
gcctggctggaa

SEQ ID NO: 4014722 - DNA, 18 bp, Homo sapiens
gcctggctggaagagggt

SEQ ID NO: 4014723 - DNA, 14 bp, Homo sapiens
gcctggctggtcct

SEQ ID NO: 4014724 - DNA, 15 bp, Homo sapiens
gcctgggaatgtatt

SEQ ID NO: 4014725 - DNA, 23 bp, Homo sapiens
gcctgggaatgtattattctgca

SEQ ID NO: 4014726 - DNA, 21 bp, Homo sapiens
gcctgggacttccatgcctta

SEQ ID NO: 4014727 - DNA, 17 bp, Homo sapiens
gcctgggcagccaggct

SEQ ID NO: 4014728 - DNA, 16 bp, Homo sapiens
gcctggggcctgagag

SEQ ID NO: 4014729 - DNA, 14 bp, Homo sapiens
gcctggggctggcc

SEQ ID NO: 4014730 - DNA, 14 bp, Homo sapiens
gcctgggggagaga

SEQ ID NO: 4014731 - DNA, 19 bp, Homo sapiens
gcctgggggagttttcctc

SEQ ID NO: 4014732 - DNA, 14 bp, Homo sapiens
gcctggggtctgga

SEQ ID NO: 4014733 - DNA, 20 bp, Homo sapiens
gcctgggtgacagagcaaga

SEQ ID NO: 4014734 - DNA, 14 bp, Homo sapiens
gcctgggtgctggc

SEQ ID NO: 4014735 - DNA, 13 bp, Homo sapiens
gcctggtttttct

SEQ ID NO: 4014736 - DNA, 16 bp, Homo sapiens
gcctgtaatcccagct

SEQ ID NO: 4014737 - DNA, 19 bp, Homo sapiens
gcctgtagagttgctgaga

SEQ ID NO: 4014738 - DNA, 19 bp, Homo sapiens
gcctgtagtcccagccact

SEQ ID NO: 4014739 - DNA, 12 bp, Homo sapiens
gcctgtcacccc

SEQ ID NO: 4014740 - DNA, 17 bp, Homo sapiens
gcctgtcccaattctgc

SEQ ID NO: 4014741 - DNA, 14 bp, Homo sapiens
gcctgtcccttgcc

SEQ ID NO: 4014742 - DNA, 18 bp, Homo sapiens
gcctgtcgtgccagtcct

SEQ ID NO: 4014743 - DNA, 22 bp, Homo sapiens
gcctgtctcatccccaggggtc

SEQ ID NO: 4014744 - DNA, 20 bp, Homo sapiens
gcctgtctcggaacctgtga

SEQ ID NO: 4014745 - DNA, 23 bp, Homo sapiens
gcctgtctgagactcacaggaag

SEQ ID NO: 4014746 - DNA, 11 bp, Homo sapiens
gcctgtgaatc

SEQ ID NO: 4014747 - DNA, 15 bp, Homo sapiens
gcctgtgcctcccag

SEQ ID NO: 4014748 - DNA, 18 bp, Homo sapiens
gcctgtgcctctgggact

SEQ ID NO: 4014749 - DNA, 17 bp, Homo sapiens
gcctgtggaatgagtgt

SEQ ID NO: 4014750 - DNA, 18 bp, Homo sapiens
gcctgtggagctcagccc

SEQ ID NO: 4014751 - DNA, 19 bp, Homo sapiens
gcctgtggagctcagcccc

SEQ ID NO: 4014752 - DNA, 22 bp, Homo sapiens
gcctgtggcatctttgccttgg

SEQ ID NO: 4014753 - DNA, 15 bp, Homo sapiens
gcctgttctgaggat

SEQ ID NO: 4014754 - DNA, 21 bp, Homo sapiens
gcctgtttctgcagcccttgg

SEQ ID NO: 4014755 - DNA, 22 bp, Homo sapiens
gcctgtttctgcagcccttggg

SEQ ID NO: 4014756 - DNA, 14 bp, Homo sapiens
gccttaaaatggaa

SEQ ID NO: 4014757 - DNA, 20 bp, Homo sapiens
gccttaaactgtacagaatt

SEQ ID NO: 4014758 - DNA, 14 bp, Homo sapiens
gccttaagctgatc

SEQ ID NO: 4014759 - DNA, 20 bp, Homo sapiens
gccttaatgacattcccctc

SEQ ID NO: 4014760 - DNA, 23 bp, Homo sapiens
gccttaatttcctttttgacact

SEQ ID NO: 4014761 - DNA, 17 bp, Homo sapiens
gccttaattttcagtat

SEQ ID NO: 4014762 - DNA, 12 bp, Homo sapiens
gccttagctgcc

SEQ ID NO: 4014763 - DNA, 15 bp, Homo sapiens
gccttagctgccagt

SEQ ID NO: 4014764 - DNA, 20 bp, Homo sapiens
gccttagctgccagtgctgg

SEQ ID NO: 4014765 - DNA, 17 bp, Homo sapiens
gccttagggcactgggc

SEQ ID NO: 4014766 - DNA, 22 bp, Homo sapiens
gccttagtctcagtttgtgtgt

SEQ ID NO: 4014767 - DNA, 22 bp, Homo sapiens
gccttatcttgcaccccaaagc

SEQ ID NO: 4014768 - DNA, 13 bp, Homo sapiens
gccttcagctcta

SEQ ID NO: 4014769 - DNA, 16 bp, Homo sapiens
gccttcagctctacag

SEQ ID NO: 4014770 - DNA, 14 bp, Homo sapiens
gccttcaggcttct

SEQ ID NO: 4014771 - DNA, 23 bp, Homo sapiens
gccttccaactagctgggactac

SEQ ID NO: 4014772 - DNA, 13 bp, Homo sapiens
gccttccacctct

SEQ ID NO: 4014773 - DNA, 14 bp, Homo sapiens
gccttccagctgct

SEQ ID NO: 4014774 - DNA, 15 bp, Homo sapiens
gccttccataattat

SEQ ID NO: 4014775 - DNA, 16 bp, Homo sapiens
gccttccataattatg

SEQ ID NO: 4014776 - DNA, 13 bp, Homo sapiens
gccttcctcagct

SEQ ID NO: 4014777 - DNA, 16 bp, Homo sapiens
gccttcctctctccag

SEQ ID NO: 4014778 - DNA, 17 bp, Homo sapiens
gccttcctctctccaga

SEQ ID NO: 4014779 - DNA, 18 bp, Homo sapiens
gccttcctctctccagat

SEQ ID NO: 4014780 - DNA, 11 bp, Homo sapiens
gccttccttcc

SEQ ID NO: 4014781 - DNA, 19 bp, Homo sapiens
gccttcctttctccaggac

SEQ ID NO: 4014782 - DNA, 21 bp, Homo sapiens
gccttcctttctccaggacca

SEQ ID NO: 4014783 - DNA, 20 bp, Homo sapiens
gccttctcctctctgggcct

SEQ ID NO: 4014784 - DNA, 17 bp, Homo sapiens
gccttctccttccccag

SEQ ID NO: 4014785 - DNA, 18 bp, Homo sapiens
gccttctccttccccagg

SEQ ID NO: 4014786 - DNA, 20 bp, Homo sapiens
gccttctccttccccaggat

SEQ ID NO: 4014787 - DNA, 21 bp, Homo sapiens
gccttctccttccccaggatg

SEQ ID NO: 4014788 - DNA, 23 bp, Homo sapiens
gccttctgatgtctctaaagcac

SEQ ID NO: 4014789 - DNA, 12 bp, Homo sapiens
gccttctttcca

SEQ ID NO: 4014790 - DNA, 21 bp, Homo sapiens
gccttctttccatcaactccc

SEQ ID NO: 4014791 - DNA, 15 bp, Homo sapiens
gcggatggatggaag

SEQ ID NO: 4014792 - DNA, 18 bp, Homo sapiens
gcggccagcgtcccaggg

SEQ ID NO: 4014793 - DNA, 16 bp, Homo sapiens
gcggccaggcacaggg

SEQ ID NO: 4014794 - DNA, 23 bp, Homo sapiens
gcggccaggcacagggcccgcag

SEQ ID NO: 4014795 - DNA, 12 bp, Homo sapiens
gcggccccagga

SEQ ID NO: 4014796 - DNA, 13 bp, Homo sapiens
gcggccccaggag

SEQ ID NO: 4014797 - DNA, 15 bp, Homo sapiens
gcggccccaggaggg

SEQ ID NO: 4014798 - DNA, 16 bp, Homo sapiens
gcggcccctcccgccc

SEQ ID NO: 4014799 - DNA, 14 bp, Homo sapiens
gcggcccggccagc

SEQ ID NO: 4014800 - DNA, 23 bp, Homo sapiens
gcggcccggccagcgggcacagg

SEQ ID NO: 4014801 - DNA, 22 bp, Homo sapiens
gcggcctcgtgccatgatctgt

SEQ ID NO: 4014802 - DNA, 19 bp, Homo sapiens
gcggctcaaaaggaaacca

SEQ ID NO: 4014803 - DNA, 18 bp, Homo sapiens
gcggctcaagcccaggag

SEQ ID NO: 4014804 - DNA, 14 bp, Homo sapiens
gcggctgttccccc

SEQ ID NO: 4014805 - DNA, 12 bp, Homo sapiens
gcgggcacaggg

SEQ ID NO: 4014806 - DNA, 21 bp, Homo sapiens
gcgggcacagggcaccagagg

SEQ ID NO: 4014807 - DNA, 23 bp, Homo sapiens
gcgggcacagggcaccagaggcc

SEQ ID NO: 4014808 - DNA, 17 bp, Homo sapiens
gcgggcagagggctgga

SEQ ID NO: 4014809 - DNA, 18 bp, Homo sapiens
gcgggcagagggctggag

SEQ ID NO: 4014810 - DNA, 15 bp, Homo sapiens
gcgggccaggcccgc

SEQ ID NO: 4014811 - DNA, 18 bp, Homo sapiens
gcgggccaggcccgcacc

SEQ ID NO: 4014812 - DNA, 22 bp, Homo sapiens
gcgggccatgagggacagggtc

SEQ ID NO: 4014813 - DNA, 20 bp, Homo sapiens
gcgggctaacgggaggctgg

SEQ ID NO: 4014814 - DNA, 19 bp, Homo sapiens
gcgggcttatttattaaca

SEQ ID NO: 4014815 - DNA, 21 bp, Homo sapiens
gcgggtgaacaaagcagccac

SEQ ID NO: 4014816 - DNA, 15 bp, Homo sapiens
gcgggtgatggccag

SEQ ID NO: 4014817 - DNA, 22 bp, Homo sapiens
gcggtagccagcacacagggca

SEQ ID NO: 4014818 - DNA, 19 bp, Homo sapiens
gcggtcaggctgggcagcc

SEQ ID NO: 4014819 - DNA, 21 bp, Homo sapiens
gcggtcaggctgggcagcccc

SEQ ID NO: 4014820 - DNA, 22 bp, Homo sapiens
gcggtcaggctgggcagcccca

SEQ ID NO: 4014821 - DNA, 12 bp, Homo sapiens
gcggtccccatc

SEQ ID NO: 4014822 - DNA, 22 bp, Homo sapiens
gcggtccccatccccaccagct

SEQ ID NO: 4014823 - DNA, 17 bp, Homo sapiens
gcggtggctgccccggc

SEQ ID NO: 4014824 - DNA, 14 bp, Homo sapiens
gcggtgggggagga

SEQ ID NO: 4014825 - DNA, 18 bp, Homo sapiens
gcggttataaaaaatggt

SEQ ID NO: 4014826 - DNA, 22 bp, Homo sapiens
gcggttataaaaaatggttcag

SEQ ID NO: 4014827 - DNA, 14 bp, Homo sapiens
gcggtttggggagc

SEQ ID NO: 4014828 - DNA, 19 bp, Homo sapiens
gcgtagtgcagcagggcag

SEQ ID NO: 4014829 - DNA, 13 bp, Homo sapiens
gcgtatgtctgtt

SEQ ID NO: 4014830 - DNA, 21 bp, Homo sapiens
gcgtatgtctgttaccatgtc

SEQ ID NO: 4014831 - DNA, 17 bp, Homo sapiens
gcgtcagctgctccctg

SEQ ID NO: 4014832 - DNA, 22 bp, Homo sapiens
gcgtcagctgctccctggcatt

SEQ ID NO: 4014833 - DNA, 17 bp, Homo sapiens
gcgtcctgacggcgccc

SEQ ID NO: 4014834 - DNA, 17 bp, Homo sapiens
gcgtccttccccctgta

SEQ ID NO: 4014835 - DNA, 21 bp, Homo sapiens
gcgtccttccccctgtagact

SEQ ID NO: 4014836 - DNA, 21 bp, Homo sapiens
gcgtctggaagtccaatgtgg

SEQ ID NO: 4014837 - DNA, 13 bp, Homo sapiens
gcgtcttcctgag

SEQ ID NO: 4014838 - DNA, 14 bp, Homo sapiens
gcgtcttcctgagt

SEQ ID NO: 4014839 - DNA, 21 bp, Homo sapiens
gcgtcttcctgagtggtgcca

SEQ ID NO: 4014840 - DNA, 19 bp, Homo sapiens
gcgtgaaacacaccaggct

SEQ ID NO: 4014841 - DNA, 16 bp, Homo sapiens
gcgtgaggtcccagga

SEQ ID NO: 4014842 - DNA, 14 bp, Homo sapiens
gcgtgccgtgtgag

SEQ ID NO: 4014843 - DNA, 20 bp, Homo sapiens
gcgtgccgtgtgagtgtgac

SEQ ID NO: 4014844 - DNA, 17 bp, Homo sapiens
gcgtgcgtgtaactgta

SEQ ID NO: 4014845 - DNA, 13 bp, Homo sapiens
gcgtggaaaaaga

SEQ ID NO: 4014846 - DNA, 17 bp, Homo sapiens
gcgtggcccaccaggcc

SEQ ID NO: 4014847 - DNA, 12 bp, Homo sapiens
gcgtgtgtagag

SEQ ID NO: 4014848 - DNA, 21 bp, Homo sapiens
gcgtgtgtagagttaagaagc

SEQ ID NO: 4014849 - DNA, 15 bp, Homo sapiens
gcgttcctttctttt

SEQ ID NO: 4014850 - DNA, 16 bp, Homo sapiens
gcgttcctttcttttc

SEQ ID NO: 4014851 - DNA, 17 bp, Homo sapiens
gcgttctgctgcccctg

SEQ ID NO: 4014852 - DNA, 14 bp, Homo sapiens
gcgttgggagccta

SEQ ID NO: 4014853 - DNA, 22 bp, Homo sapiens
gcgtttattaatgcctctcccg

SEQ ID NO: 4014854 - DNA, 14 bp, Homo sapiens
gcgtttttttacaa

SEQ ID NO: 4014855 - DNA, 21 bp, Homo sapiens
gctaaagataattgctattta

SEQ ID NO: 4014856 - DNA, 19 bp, Homo sapiens
gctaaatcctttactgtta

SEQ ID NO: 4014857 - DNA, 18 bp, Homo sapiens
gctaaatgcctaataaac

SEQ ID NO: 4014858 - DNA, 23 bp, Homo sapiens
gctaaatggtcgcccaggagaca

SEQ ID NO: 4014859 - DNA, 23 bp, Homo sapiens
gctaaattctatgttaaatactg

SEQ ID NO: 4014860 - DNA, 22 bp, Homo sapiens
gctaacccccttctactgagcc

SEQ ID NO: 4014861 - DNA, 16 bp, Homo sapiens
gctaacgggaggctgg

SEQ ID NO: 4014862 - DNA, 17 bp, Homo sapiens
gctaacgggaggctggg

SEQ ID NO: 4014863 - DNA, 21 bp, Homo sapiens
gctaacgggaggctgggcaca

SEQ ID NO: 4014864 - DNA, 16 bp, Homo sapiens
gctaagggaagacatt

SEQ ID NO: 4014865 - DNA, 20 bp, Homo sapiens
gctaagggaagacatttctt

SEQ ID NO: 4014866 - DNA, 20 bp, Homo sapiens
gctaagtacacaataagcaa

SEQ ID NO: 4014867 - DNA, 20 bp, Homo sapiens
gctaataaaattcgctttct

SEQ ID NO: 4014868 - DNA, 18 bp, Homo sapiens
gctaatctgtagggctgg

SEQ ID NO: 4014869 - DNA, 19 bp, Homo sapiens
gctaatctgtagggctgga

SEQ ID NO: 4014870 - DNA, 21 bp, Homo sapiens
gctaatgaagggaaaggatat

SEQ ID NO: 4014871 - DNA, 13 bp, Homo sapiens
gctaatgtaaact

SEQ ID NO: 4014872 - DNA, 14 bp, Homo sapiens
gctaattaaaaagt

SEQ ID NO: 4014873 - DNA, 18 bp, Homo sapiens
gctaattttttgtacttt

SEQ ID NO: 4014874 - DNA, 22 bp, Homo sapiens
gctacaggaagcaccccatgcc

SEQ ID NO: 4014875 - DNA, 23 bp, Homo sapiens
gctacaggaagcaccccatgcca

SEQ ID NO: 4014876 - DNA, 12 bp, Homo sapiens
gctacaggaggg

SEQ ID NO: 4014877 - DNA, 11 bp, Homo sapiens
gctacattata

SEQ ID NO: 4014878 - DNA, 15 bp, Homo sapiens
gctacattataaacg

SEQ ID NO: 4014879 - DNA, 21 bp, Homo sapiens
gctaccactggtacttccttt

SEQ ID NO: 4014880 - DNA, 16 bp, Homo sapiens
gctacccgtgagccct

SEQ ID NO: 4014881 - DNA, 18 bp, Homo sapiens
gctaccctttttctccag

SEQ ID NO: 4014882 - DNA, 15 bp, Homo sapiens
gctaccgccctgggc

SEQ ID NO: 4014883 - DNA, 18 bp, Homo sapiens
gctaccgccctgggctgg

SEQ ID NO: 4014884 - DNA, 22 bp, Homo sapiens
gctaccgccctgggctggactg

SEQ ID NO: 4014885 - DNA, 23 bp, Homo sapiens
gctaccgccctgggctggactgg

SEQ ID NO: 4014886 - DNA, 14 bp, Homo sapiens
gctaccgttgactt

SEQ ID NO: 4014887 - DNA, 21 bp, Homo sapiens
gctacctctctgtcccttgct

SEQ ID NO: 4014888 - DNA, 15 bp, Homo sapiens
gctactataaagaga

SEQ ID NO: 4014889 - DNA, 17 bp, Homo sapiens
gctactgatttcctttg

SEQ ID NO: 4014890 - DNA, 20 bp, Homo sapiens
gctactgatttcctttggag

SEQ ID NO: 4014891 - DNA, 18 bp, Homo sapiens
gctactgcactccagcct

SEQ ID NO: 4014892 - DNA, 22 bp, Homo sapiens
gctactgtaattttatatgaag

SEQ ID NO: 4014893 - DNA, 12 bp, Homo sapiens
gctctcagttct

SEQ ID NO: 4014894 - DNA, 22 bp, Homo sapiens
gctctcccagtgaactcctgcc

SEQ ID NO: 4014895 - DNA, 20 bp, Homo sapiens
gctctcctaggtagccccct

SEQ ID NO: 4014896 - DNA, 14 bp, Homo sapiens
gctctcctgacttt

SEQ ID NO: 4014897 - DNA, 16 bp, Homo sapiens
gctctcctgactttta

SEQ ID NO: 4014898 - DNA, 19 bp, Homo sapiens
gctctctaggcctctccag

SEQ ID NO: 4014899 - DNA, 24 bp, Homo sapiens
gctctctccactaccccacaccag

SEQ ID NO: 4014900 - DNA, 13 bp, Homo sapiens
gctctctgctgta

SEQ ID NO: 4014901 - DNA, 22 bp, Homo sapiens
gctctgaagtcacatcacagga

SEQ ID NO: 4014902 - DNA, 19 bp, Homo sapiens
gctctgacaaagcttcccg

SEQ ID NO: 4014903 - DNA, 14 bp, Homo sapiens
gctctgacaagatg

SEQ ID NO: 4014904 - DNA, 15 bp, Homo sapiens
gctctgacaagatgg

SEQ ID NO: 4014905 - DNA, 15 bp, Homo sapiens
gctctgacgtagaaa

SEQ ID NO: 4014906 - DNA, 16 bp, Homo sapiens
gctctgacgtagaaag

SEQ ID NO: 4014907 - DNA, 21 bp, Homo sapiens
gctctgagacccttttctcag

SEQ ID NO: 4014908 - DNA, 18 bp, Homo sapiens
gctctgcaattcccctct

SEQ ID NO: 4014909 - DNA, 15 bp, Homo sapiens
gctctgcacagatgg

SEQ ID NO: 4014910 - DNA, 18 bp, Homo sapiens
gctctgcacagatggatt

SEQ ID NO: 4014911 - DNA, 17 bp, Homo sapiens
gctctgcacccctctgc

SEQ ID NO: 4014912 - DNA, 18 bp, Homo sapiens
gctctgccagtggatccc

SEQ ID NO: 4014913 - DNA, 23 bp, Homo sapiens
gctctgcctcagacgttgcctga

SEQ ID NO: 4014914 - DNA, 13 bp, Homo sapiens
gctctgcctcccg

SEQ ID NO: 4014915 - DNA, 13 bp, Homo sapiens
gctctgctcgcct

SEQ ID NO: 4014916 - DNA, 14 bp, Homo sapiens
gctctggaagagag

SEQ ID NO: 4014917 - DNA, 15 bp, Homo sapiens
gctctggaagagagg

SEQ ID NO: 4014918 - DNA, 20 bp, Homo sapiens
gctctggacagcagaagcct

SEQ ID NO: 4014919 - DNA, 21 bp, Homo sapiens
gctctggacagcagaagcctc

SEQ ID NO: 4014920 - DNA, 16 bp, Homo sapiens
gctctggacagcccca

SEQ ID NO: 4014921 - DNA, 20 bp, Homo sapiens
gctctggacagccccaccct

SEQ ID NO: 4014922 - DNA, 15 bp, Homo sapiens
gctctgtcccccagg

SEQ ID NO: 4014923 - DNA, 17 bp, Homo sapiens
gctctgtcccccaggct

SEQ ID NO: 4014924 - DNA, 18 bp, Homo sapiens
gctctgtcccccaggctg

SEQ ID NO: 4014925 - DNA, 20 bp, Homo sapiens
gctctgtcccccaggctgga

SEQ ID NO: 4014926 - DNA, 19 bp, Homo sapiens
gctctgtgcagtcactgga

SEQ ID NO: 4014927 - DNA, 19 bp, Homo sapiens
gctctgtgttcccagaggc

SEQ ID NO: 4014928 - DNA, 23 bp, Homo sapiens
gctctgtttgatgctatttatgc

SEQ ID NO: 4014929 - DNA, 17 bp, Homo sapiens
gctcttaagcagcatgg

SEQ ID NO: 4014930 - DNA, 19 bp, Homo sapiens
gctcttaagcagcatggaa

SEQ ID NO: 4014931 - DNA, 17 bp, Homo sapiens
gctcttagcagcttcca

SEQ ID NO: 4014932 - DNA, 15 bp, Homo sapiens
gctcttagtcccaag

SEQ ID NO: 4014933 - DNA, 15 bp, Homo sapiens
gctcttcaggcctcc

SEQ ID NO: 4014934 - DNA, 17 bp, Homo sapiens
gctcttctcctttcaca

SEQ ID NO: 4014935 - DNA, 17 bp, Homo sapiens
gctcttggagctgtgag

SEQ ID NO: 4014936 - DNA, 12 bp, Homo sapiens
gctcttggcctt

SEQ ID NO: 4014937 - DNA, 22 bp, Homo sapiens
gctcttggctgacccctctggt

SEQ ID NO: 4014938 - DNA, 14 bp, Homo sapiens
gctcttgtcccacg

SEQ ID NO: 4014939 - DNA, 20 bp, Homo sapiens
gctctttctacatgactggg

SEQ ID NO: 4014940 - DNA, 23 bp, Homo sapiens
gctctttctacatgactgggcct

SEQ ID NO: 4014941 - DNA, 14 bp, Homo sapiens
gctctttctctgcc

SEQ ID NO: 4014942 - DNA, 18 bp, Homo sapiens
gctctttggggtcagcca

SEQ ID NO: 4014943 - DNA, 21 bp, Homo sapiens
gctctttggggtcagccaggg

SEQ ID NO: 4014944 - DNA, 23 bp, Homo sapiens
gctctttggggtcagccagggcc

SEQ ID NO: 4014945 - DNA, 23 bp, Homo sapiens
gctgaaagaacatggacttgtat

SEQ ID NO: 4014946 - DNA, 13 bp, Homo sapiens
gctgaaagccatt

SEQ ID NO: 4014947 - DNA, 23 bp, Homo sapiens
gctgaacagatgacccctgccca

SEQ ID NO: 4014948 - DNA, 22 bp, Homo sapiens
gctgaacagtggaggaagaggg

SEQ ID NO: 4014949 - DNA, 22 bp, Homo sapiens
gctgaacccattttgagtgact

SEQ ID NO: 4014950 - DNA, 20 bp, Homo sapiens
gctgaagggaccttgaaggg

SEQ ID NO: 4014951 - DNA, 19 bp, Homo sapiens
gctgacacgctcagttgaa

SEQ ID NO: 4014952 - DNA, 17 bp, Homo sapiens
gctgacattcacctgcc

SEQ ID NO: 4014953 - DNA, 20 bp, Homo sapiens
gctgaccaattgtgctgcca

SEQ ID NO: 4014954 - DNA, 21 bp, Homo sapiens
gctgaccaattgtgctgccat

SEQ ID NO: 4014955 - DNA, 14 bp, Homo sapiens
gctgaccacagcac

SEQ ID NO: 4014956 - DNA, 16 bp, Homo sapiens
gctgaccacagcacag

SEQ ID NO: 4014957 - DNA, 17 bp, Homo sapiens
gctgaccacagcacagc

SEQ ID NO: 4014958 - DNA, 19 bp, Homo sapiens
gctgaccccgagaagtgct

SEQ ID NO: 4014959 - DNA, 18 bp, Homo sapiens
gctgacccctctggtgtg

SEQ ID NO: 4014960 - DNA, 18 bp, Homo sapiens
gctgacccggcctctctg

SEQ ID NO: 4014961 - DNA, 16 bp, Homo sapiens
gctgactggggctggg

SEQ ID NO: 4014962 - DNA, 18 bp, Homo sapiens
gctgactgtactcctccc

SEQ ID NO: 4014963 - DNA, 19 bp, Homo sapiens
gctgactgtactcctccca

SEQ ID NO: 4014964 - DNA, 16 bp, Homo sapiens
gctgacttcatctggg

SEQ ID NO: 4014965 - DNA, 17 bp, Homo sapiens
gctgagagcccccacct

SEQ ID NO: 4014966 - DNA, 12 bp, Homo sapiens
gctgagcagcct

SEQ ID NO: 4014967 - DNA, 17 bp, Homo sapiens
gctgagcagcctctgga

SEQ ID NO: 4014968 - DNA, 13 bp, Homo sapiens
gctgagccctggg

SEQ ID NO: 4014969 - DNA, 19 bp, Homo sapiens
gctgagcctctgctcccca

SEQ ID NO: 4014970 - DNA, 14 bp, Homo sapiens
gctgagcgccagga

SEQ ID NO: 4014971 - DNA, 14 bp, Homo sapiens
gctgagctgagctt

SEQ ID NO: 4014972 - DNA, 22 bp, Homo sapiens
gctgagcttcggttctccagaa

SEQ ID NO: 4014973 - DNA, 14 bp, Homo sapiens
gctgaggaggcctc

SEQ ID NO: 4014974 - DNA, 13 bp, Homo sapiens
gctgaggcagaag

SEQ ID NO: 4014975 - DNA, 14 bp, Homo sapiens
gctgaggccagagt

SEQ ID NO: 4014976 - DNA, 15 bp, Homo sapiens
gctgaggccagagtc

SEQ ID NO: 4014977 - DNA, 19 bp, Homo sapiens
gctgaggccagagtcacct

SEQ ID NO: 4014978 - DNA, 14 bp, Homo sapiens
gctgaggcctggac

SEQ ID NO: 4014979 - DNA, 15 bp, Homo sapiens
gctgaggcgggagaa

SEQ ID NO: 4014980 - DNA, 15 bp, Homo sapiens
gctgaggctggggga

SEQ ID NO: 4014981 - DNA, 22 bp, Homo sapiens
gctgaggctgggggagagccgt

SEQ ID NO: 4014982 - DNA, 23 bp, Homo sapiens
gctgaggctgggggagagccgtg

SEQ ID NO: 4014983 - DNA, 13 bp, Homo sapiens
gctgagggcagct

SEQ ID NO: 4014984 - DNA, 13 bp, Homo sapiens
gctgagggcctgc

SEQ ID NO: 4014985 - DNA, 14 bp, Homo sapiens
gctgagggcctgct

SEQ ID NO: 4014986 - DNA, 17 bp, Homo sapiens
gctgagggcctgctgga

SEQ ID NO: 4014987 - DNA, 18 bp, Homo sapiens
gctgagggcctgctggag

SEQ ID NO: 4014988 - DNA, 22 bp, Homo sapiens
gctgagggcctgctggaggcct

SEQ ID NO: 4014989 - DNA, 19 bp, Homo sapiens
gctgagggctgccagcagc

SEQ ID NO: 4014990 - DNA, 23 bp, Homo sapiens
gctgagggctgccagcagccccg

SEQ ID NO: 4014991 - DNA, 23 bp, Homo sapiens
gctgaggggcaacgaagaaaaaa

SEQ ID NO: 4014992 - DNA, 22 bp, Homo sapiens
gctgaggggcttgggaaaaaaa

SEQ ID NO: 4014993 - DNA, 21 bp, Homo sapiens
gctgaggggtctcggatgaca

SEQ ID NO: 4014994 - DNA, 18 bp, Homo sapiens
gctgaggtgtctggcctg

SEQ ID NO: 4014995 - DNA, 15 bp, Homo sapiens
gctggtgccccacag

SEQ ID NO: 4014996 - DNA, 15 bp, Homo sapiens
gctggtgctgtggcc

SEQ ID NO: 4014997 - DNA, 20 bp, Homo sapiens
gctggtggaaagcgattcac

SEQ ID NO: 4014998 - DNA, 14 bp, Homo sapiens
gctggttactcagg

SEQ ID NO: 4014999 - DNA, 12 bp, Homo sapiens
gctggttctgta

SEQ ID NO: 4015000 - DNA, 22 bp, Homo sapiens
gctggtttcctgcccagcctgg

SEQ ID NO: 4015001 - DNA, 16 bp, Homo sapiens
gctgtaacgtggcact

SEQ ID NO: 4015002 - DNA, 22 bp, Homo sapiens
gctgtaatctatgaattctaag

SEQ ID NO: 4015003 - DNA, 17 bp, Homo sapiens
gctgtacccagatgcct

SEQ ID NO: 4015004 - DNA, 14 bp, Homo sapiens
gctgtagataaata

SEQ ID NO: 4015005 - DNA, 20 bp, Homo sapiens
gctgtagtcctcataaaaag

SEQ ID NO: 4015006 - DNA, 14 bp, Homo sapiens
gctgtataagttat

SEQ ID NO: 4015007 - DNA, 12 bp, Homo sapiens
gctgtatgattt

SEQ ID NO: 4015008 - DNA, 14 bp, Homo sapiens
gctgtatgatttgt

SEQ ID NO: 4015009 - DNA, 15 bp, Homo sapiens
gctgtatgatttgtt

SEQ ID NO: 4015010 - DNA, 13 bp, Homo sapiens
gctgtcacaggcg

SEQ ID NO: 4015011 - DNA, 16 bp, Homo sapiens
gctgtcactggctggc

SEQ ID NO: 4015012 - DNA, 18 bp, Homo sapiens
gctgtcactggctggctc

SEQ ID NO: 4015013 - DNA, 19 bp, Homo sapiens
gctgtcactggctggctcc

SEQ ID NO: 4015014 - DNA, 23 bp, Homo sapiens
gctgtcactggctggctcctagg

SEQ ID NO: 4015015 - DNA, 22 bp, Homo sapiens
gctgtcatcactcaacaaaaaa

SEQ ID NO: 4015016 - DNA, 14 bp, Homo sapiens
gctgtcatctgtgc

SEQ ID NO: 4015017 - DNA, 13 bp, Homo sapiens
gctgtccctcact

SEQ ID NO: 4015018 - DNA, 15 bp, Homo sapiens
gctgtccctccccct

SEQ ID NO: 4015019 - DNA, 19 bp, Homo sapiens
gctgtcctctcgagcccag

SEQ ID NO: 4015020 - DNA, 20 bp, Homo sapiens
gctgtccttaacccacctct

SEQ ID NO: 4015021 - DNA, 22 bp, Homo sapiens
gctgtccttaacccacctctcc

SEQ ID NO: 4015022 - DNA, 15 bp, Homo sapiens
gctgtcgccccaggc

SEQ ID NO: 4015023 - DNA, 16 bp, Homo sapiens
gctgtcgccccaggcc

SEQ ID NO: 4015024 - DNA, 19 bp, Homo sapiens
gctgtcgccccaggccctc

SEQ ID NO: 4015025 - DNA, 20 bp, Homo sapiens
gctgtcgccccaggccctcc

SEQ ID NO: 4015026 - DNA, 21 bp, Homo sapiens
gctgtctaacccccagctggg

SEQ ID NO: 4015027 - DNA, 22 bp, Homo sapiens
gctgtctaacccccagctgggt

SEQ ID NO: 4015028 - DNA, 14 bp, Homo sapiens
gctgtctagaatgt

SEQ ID NO: 4015029 - DNA, 12 bp, Homo sapiens
gctgtctgtcac

SEQ ID NO: 4015030 - DNA, 23 bp, Homo sapiens
gctgtcttctggacaggctctgc

SEQ ID NO: 4015031 - DNA, 24 bp, Homo sapiens
gctgtcttctggacaggctctgct

SEQ ID NO: 4015032 - DNA, 13 bp, Homo sapiens
gctgtgaacaggc

SEQ ID NO: 4015033 - DNA, 21 bp, Homo sapiens
gctgtgaaccctggggcctga

SEQ ID NO: 4015034 - DNA, 23 bp, Homo sapiens
gctgtgaaccctggggcctgact

SEQ ID NO: 4015035 - DNA, 18 bp, Homo sapiens
gctgtgacaataagtttg

SEQ ID NO: 4015036 - DNA, 15 bp, Homo sapiens
gctgtgagcccctgg

SEQ ID NO: 4015037 - DNA, 20 bp, Homo sapiens
gctgtgagcccctggtcctg

SEQ ID NO: 4015038 - DNA, 11 bp, Homo sapiens
gctgtgaggaa

SEQ ID NO: 4015039 - DNA, 21 bp, Homo sapiens
gctgtgaggaatgctctgtgc

SEQ ID NO: 4015040 - DNA, 18 bp, Homo sapiens
gctgtgaggcccctggac

SEQ ID NO: 4015041 - DNA, 14 bp, Homo sapiens
gctgtgagggaggg

SEQ ID NO: 4015042 - DNA, 20 bp, Homo sapiens
gctgtgatacgatgcttcaa

SEQ ID NO: 4015043 - DNA, 22 bp, Homo sapiens
gctgtgcagcacgtctcagaga

SEQ ID NO: 4015044 - DNA, 18 bp, Homo sapiens
gctgtgcagcgcagctgg

SEQ ID NO: 4015045 - DNA, 18 bp, Homo sapiens
gctgtgcgtggaaaaaga

SEQ ID NO: 4015046 - DNA, 18 bp, Homo sapiens
gctgtgcttgaaggccct

SEQ ID NO: 4015047 - DNA, 20 bp, Homo sapiens
gctgtgcttgaaggccctgc

SEQ ID NO: 4015048 - DNA, 21 bp, Homo sapiens
gctgtggaccgtggacaggcc

SEQ ID NO: 4015049 - DNA, 24 bp, Homo sapiens
gctgtggaccgtggacaggcccag

SEQ ID NO: 4015050 - DNA, 14 bp, Homo sapiens
gctgtggccagggt

SEQ ID NO: 4015051 - DNA, 15 bp, Homo sapiens
gctgtggccgtctcc

SEQ ID NO: 4015052 - DNA, 20 bp, Homo sapiens
gctgtggccgtctcctccct

SEQ ID NO: 4015053 - DNA, 22 bp, Homo sapiens
gctgtggccgtctcctccctca

SEQ ID NO: 4015054 - DNA, 13 bp, Homo sapiens
gctgtgggcagca

SEQ ID NO: 4015055 - DNA, 16 bp, Homo sapiens
gctgtgggcagcaccc

SEQ ID NO: 4015056 - DNA, 18 bp, Homo sapiens
gctgtgggcagcaccctc

SEQ ID NO: 4015057 - DNA, 20 bp, Homo sapiens
gctgtggtggggagaggcat

SEQ ID NO: 4015058 - DNA, 14 bp, Homo sapiens
gctgtgtgattaga

SEQ ID NO: 4015059 - DNA, 15 bp, Homo sapiens
gctgtgtgcctgggg

SEQ ID NO: 4015060 - DNA, 19 bp, Homo sapiens
gctgtgttgggtagaatag

SEQ ID NO: 4015061 - DNA, 20 bp, Homo sapiens
gctgttatgtctgtttaaga

SEQ ID NO: 4015062 - DNA, 22 bp, Homo sapiens
gctgttcccatgtagccccctg

SEQ ID NO: 4015063 - DNA, 12 bp, Homo sapiens
gctgttcttcct

SEQ ID NO: 4015064 - DNA, 14 bp, Homo sapiens
gctgttcttcctgg

SEQ ID NO: 4015065 - DNA, 20 bp, Homo sapiens
gctgttcttctgttctgcag

SEQ ID NO: 4015066 - DNA, 13 bp, Homo sapiens
gctgttgaccagg

SEQ ID NO: 4015067 - DNA, 15 bp, Homo sapiens
gctgttgaccaggca

SEQ ID NO: 4015068 - DNA, 23 bp, Homo sapiens
gctgttgaccaggcacctcccct

SEQ ID NO: 4015069 - DNA, 13 bp, Homo sapiens
gctgttgggatat

SEQ ID NO: 4015070 - DNA, 16 bp, Homo sapiens
gctgttgtccctctgc

SEQ ID NO: 4015071 - DNA, 16 bp, Homo sapiens
gctgttgtctcttctc

SEQ ID NO: 4015072 - DNA, 16 bp, Homo sapiens
gctgtttatggcctca

SEQ ID NO: 4015073 - DNA, 19 bp, Homo sapiens
gctgtttctcatgaagcta

SEQ ID NO: 4015074 - DNA, 17 bp, Homo sapiens
gctgtttgtcctgagat

SEQ ID NO: 4015075 - DNA, 16 bp, Homo sapiens
gctgttttaaacatta

SEQ ID NO: 4015076 - DNA, 17 bp, Homo sapiens
gctgttttccctgacct

SEQ ID NO: 4015077 - DNA, 15 bp, Homo sapiens
gcttaaaaatcattg

SEQ ID NO: 4015078 - DNA, 11 bp, Homo sapiens
gcttaaacaaa

SEQ ID NO: 4015079 - DNA, 12 bp, Homo sapiens
gcttaaacaaag

SEQ ID NO: 4015080 - DNA, 13 bp, Homo sapiens
gcttaaacaaagt

SEQ ID NO: 4015081 - DNA, 13 bp, Homo sapiens
gcttaagaaaaaa

SEQ ID NO: 4015082 - DNA, 15 bp, Homo sapiens
gcttaattcaaataa

SEQ ID NO: 4015083 - DNA, 18 bp, Homo sapiens
gcttacacatctcagacc

SEQ ID NO: 4015084 - DNA, 15 bp, Homo sapiens
gcttacatagtttta

SEQ ID NO: 4015085 - DNA, 11 bp, Homo sapiens
gcttacatttt

SEQ ID NO: 4015086 - DNA, 18 bp, Homo sapiens
gcttacatttttacaata

SEQ ID NO: 4015087 - DNA, 19 bp, Homo sapiens
gcttacatttttacaataa

SEQ ID NO: 4015088 - DNA, 13 bp, Homo sapiens
gcttacctgacct

SEQ ID NO: 4015089 - DNA, 21 bp, Homo sapiens
gcttacctgacctcttgctgt

SEQ ID NO: 4015090 - DNA, 23 bp, Homo sapiens
gcttacctgacctcttgctgtct

SEQ ID NO: 4015091 - DNA, 17 bp, Homo sapiens
gcttactaagctttgcc

SEQ ID NO: 4015092 - DNA, 16 bp, Homo sapiens
gcttagagaggacaat

SEQ ID NO: 4015093 - DNA, 12 bp, Homo sapiens
gcttagaggcat

SEQ ID NO: 4015094 - DNA, 19 bp, Homo sapiens
gcttagtatttctcaggaa

SEQ ID NO: 4015095 - DNA, 20 bp, Homo sapiens
gcttatacacttacacttta

SEQ ID NO: 4015096 - DNA, 18 bp, Homo sapiens
gcttatatgtacttttat

SEQ ID NO: 4015097 - DNA, 15 bp, Homo sapiens
gcttatatttgtgta

SEQ ID NO: 4015098 - DNA, 23 bp, Homo sapiens
gcttgtagaactcactctgggct

SEQ ID NO: 4015099 - DNA, 17 bp, Homo sapiens
gcttgtcatagccagtg

SEQ ID NO: 4015100 - DNA, 20 bp, Homo sapiens
gcttgtcgctttctcagtgt

SEQ ID NO: 4015101 - DNA, 22 bp, Homo sapiens
gcttgtcgctttctcagtgtgt

SEQ ID NO: 4015102 - DNA, 21 bp, Homo sapiens
gcttgtggagttgatgacttt

SEQ ID NO: 4015103 - DNA, 21 bp, Homo sapiens
gcttgtggccccttttacttt

SEQ ID NO: 4015104 - DNA, 16 bp, Homo sapiens
gcttgtgttctgctcc

SEQ ID NO: 4015105 - DNA, 17 bp, Homo sapiens
gcttgttatattaagca

SEQ ID NO: 4015106 - DNA, 20 bp, Homo sapiens
gcttgttgcatttccagctg

SEQ ID NO: 4015107 - DNA, 21 bp, Homo sapiens
gctttaaactcagggacagag

SEQ ID NO: 4015108 - DNA, 14 bp, Homo sapiens
gctttagaccctgg

SEQ ID NO: 4015109 - DNA, 16 bp, Homo sapiens
gctttagaccctgggt

SEQ ID NO: 4015110 - DNA, 18 bp, Homo sapiens
gctttattaaagaaataa

SEQ ID NO: 4015111 - DNA, 13 bp, Homo sapiens
gctttatttttta

SEQ ID NO: 4015112 - DNA, 12 bp, Homo sapiens
gctttcatgatt

SEQ ID NO: 4015113 - DNA, 14 bp, Homo sapiens
gctttcctgcccca

SEQ ID NO: 4015114 - DNA, 17 bp, Homo sapiens
gctttcctgccccaggc

SEQ ID NO: 4015115 - DNA, 12 bp, Homo sapiens
gctttctagaag

SEQ ID NO: 4015116 - DNA, 14 bp, Homo sapiens
gctttctggggcct

SEQ ID NO: 4015117 - DNA, 15 bp, Homo sapiens
gctttctgttgtcat

SEQ ID NO: 4015118 - DNA, 14 bp, Homo sapiens
gctttgatccctga

SEQ ID NO: 4015119 - DNA, 15 bp, Homo sapiens
gctttgatccctgac

SEQ ID NO: 4015120 - DNA, 20 bp, Homo sapiens
gctttgcattcctacaaaga

SEQ ID NO: 4015121 - DNA, 14 bp, Homo sapiens
gctttgccagctgc

SEQ ID NO: 4015122 - DNA, 19 bp, Homo sapiens
gctttgccagctgctgctg

SEQ ID NO: 4015123 - DNA, 14 bp, Homo sapiens
gctttgcccacccc

SEQ ID NO: 4015124 - DNA, 15 bp, Homo sapiens
gctttgcccacccct

SEQ ID NO: 4015125 - DNA, 19 bp, Homo sapiens
gctttgcgctggtggacca

SEQ ID NO: 4015126 - DNA, 17 bp, Homo sapiens
gctttggatttgacatt

SEQ ID NO: 4015127 - DNA, 18 bp, Homo sapiens
gctttggcagtgttttgg

SEQ ID NO: 4015128 - DNA, 13 bp, Homo sapiens
gctttggctgagg

SEQ ID NO: 4015129 - DNA, 19 bp, Homo sapiens
gctttgggctgccctggtg

SEQ ID NO: 4015130 - DNA, 20 bp, Homo sapiens
gctttggttccttctctggg

SEQ ID NO: 4015131 - DNA, 22 bp, Homo sapiens
gctttggttccttctctgggtc

SEQ ID NO: 4015132 - DNA, 15 bp, Homo sapiens
gctttgtatgcactt

SEQ ID NO: 4015133 - DNA, 13 bp, Homo sapiens
gctttgtgttgta

SEQ ID NO: 4015134 - DNA, 22 bp, Homo sapiens
gctttgtgttgtaattcttcag

SEQ ID NO: 4015135 - DNA, 19 bp, Homo sapiens
gctttgtgtttggtttaca

SEQ ID NO: 4015136 - DNA, 22 bp, Homo sapiens
gctttgtgtttggtttacattt

SEQ ID NO: 4015137 - DNA, 16 bp, Homo sapiens
gcttttaattctcatt

SEQ ID NO: 4015138 - DNA, 19 bp, Homo sapiens
gcttttagtttttctgtcc

SEQ ID NO: 4015139 - DNA, 22 bp, Homo sapiens
gcttttatagaggctagcttct

SEQ ID NO: 4015140 - DNA, 23 bp, Homo sapiens
gcttttattcgtcctttgacaaa

SEQ ID NO: 4015141 - DNA, 15 bp, Homo sapiens
gcttttattttttct

SEQ ID NO: 4015142 - DNA, 12 bp, Homo sapiens
gcttttcactgc

SEQ ID NO: 4015143 - DNA, 18 bp, Homo sapiens
gcttttcactgctggctg

SEQ ID NO: 4015144 - DNA, 16 bp, Homo sapiens
gcttttctgccctggc

SEQ ID NO: 4015145 - DNA, 17 bp, Homo sapiens
gcttttctgccctggct

SEQ ID NO: 4015146 - DNA, 18 bp, Homo sapiens
gcttttctgccctggctg

SEQ ID NO: 4015147 - DNA, 13 bp, Homo sapiens
cagatccaggact

SEQ ID NO: 4015148 - DNA, 14 bp, Homo sapiens
cagatccagggaca

SEQ ID NO: 4015149 - DNA, 23 bp, Homo sapiens
cagatccagggacagaggcccca

SEQ ID NO: 4015150 - DNA, 22 bp, Homo sapiens
cagatcccatccatcagctccc

SEQ ID NO: 4015151 - DNA, 23 bp, Homo sapiens
cagatcccatccatcagctccct

SEQ ID NO: 4015152 - DNA, 13 bp, Homo sapiens
cagatcctcttgg

SEQ ID NO: 4015153 - DNA, 23 bp, Homo sapiens
cagatcctgggtactgaaagcct

SEQ ID NO: 4015154 - DNA, 20 bp, Homo sapiens
cagatcctttttccatcatt

SEQ ID NO: 4015155 - DNA, 23 bp, Homo sapiens
cagatcctttttccatcatttta

SEQ ID NO: 4015156 - DNA, 15 bp, Homo sapiens
cagatctcccactgc

SEQ ID NO: 4015157 - DNA, 19 bp, Homo sapiens
cagatctggaacctcagcc

SEQ ID NO: 4015158 - DNA, 20 bp, Homo sapiens
cagatctggaacctcagcct

SEQ ID NO: 4015159 - DNA, 23 bp, Homo sapiens
cagatctggaacctcagcctggc

SEQ ID NO: 4015160 - DNA, 20 bp, Homo sapiens
cagatctggtctagttaacc

SEQ ID NO: 4015161 - DNA, 18 bp, Homo sapiens
cagatctgtctgatagga

SEQ ID NO: 4015162 - DNA, 18 bp, Homo sapiens
cagatctgtgccccatgc

SEQ ID NO: 4015163 - DNA, 20 bp, Homo sapiens
cagatctgtgccccatgcct

SEQ ID NO: 4015164 - DNA, 23 bp, Homo sapiens
cagatctgtgccccatgcctgtc

SEQ ID NO: 4015165 - DNA, 16 bp, Homo sapiens
cagatgaaatgttctg

SEQ ID NO: 4015166 - DNA, 23 bp, Homo sapiens
cagatgagcaaggacattgcccc

SEQ ID NO: 4015167 - DNA, 19 bp, Homo sapiens
cagatgagcagtcacactg

SEQ ID NO: 4015168 - DNA, 18 bp, Homo sapiens
cagatgcagagagccatt

SEQ ID NO: 4015169 - DNA, 18 bp, Homo sapiens
cagatgcagctcttcctg

SEQ ID NO: 4015170 - DNA, 15 bp, Homo sapiens
cagatgcaggacagg

SEQ ID NO: 4015171 - DNA, 18 bp, Homo sapiens
cagatgcaggacaggagg

SEQ ID NO: 4015172 - DNA, 20 bp, Homo sapiens
cagatgcaggacaggaggcg

SEQ ID NO: 4015173 - DNA, 18 bp, Homo sapiens
cagatgccccagagctgt

SEQ ID NO: 4015174 - DNA, 17 bp, Homo sapiens
cagatgctaataaactg

SEQ ID NO: 4015175 - DNA, 14 bp, Homo sapiens
cagatgctctgaga

SEQ ID NO: 4015176 - DNA, 12 bp, Homo sapiens
cagatgcttctg

SEQ ID NO: 4015177 - DNA, 17 bp, Homo sapiens
cagatgcttctgggaga

SEQ ID NO: 4015178 - DNA, 18 bp, Homo sapiens
cagatggaaaaactgagg

SEQ ID NO: 4015179 - DNA, 21 bp, Homo sapiens
cagatggaaagacgtttttgt

SEQ ID NO: 4015180 - DNA, 17 bp, Homo sapiens
cagatggaatgctgtgt

SEQ ID NO: 4015181 - DNA, 21 bp, Homo sapiens
cagatggatttgcctgtgcca

SEQ ID NO: 4015182 - DNA, 21 bp, Homo sapiens
cagatggcccggatgctgctt

SEQ ID NO: 4015183 - DNA, 21 bp, Homo sapiens
cagatgggccacggctgagcc

SEQ ID NO: 4015184 - DNA, 20 bp, Homo sapiens
cagatgggtctgatattaat

SEQ ID NO: 4015185 - DNA, 22 bp, Homo sapiens
cagatggtttccacatttagat

SEQ ID NO: 4015186 - DNA, 12 bp, Homo sapiens
cagatgtattga

SEQ ID NO: 4015187 - DNA, 19 bp, Homo sapiens
cagatgtattgactgtacc

SEQ ID NO: 4015188 - DNA, 15 bp, Homo sapiens
cagatgtctctgggg

SEQ ID NO: 4015189 - DNA, 15 bp, Homo sapiens
cagatgtcttccctg

SEQ ID NO: 4015190 - DNA, 17 bp, Homo sapiens
cagatgtcttccctggg

SEQ ID NO: 4015191 - DNA, 19 bp, Homo sapiens
cagatgtcttccctgggct

SEQ ID NO: 4015192 - DNA, 23 bp, Homo sapiens
cagatgtcttccctgggctgcca

SEQ ID NO: 4015193 - DNA, 23 bp, Homo sapiens
cagatgtgagccaccgtgcctgg

SEQ ID NO: 4015194 - DNA, 20 bp, Homo sapiens
cagatgtgtcccccccaggc

SEQ ID NO: 4015195 - DNA, 15 bp, Homo sapiens
cagatgtttccagac

SEQ ID NO: 4015196 - DNA, 16 bp, Homo sapiens
cagatgtttccagact

SEQ ID NO: 4015197 - DNA, 15 bp, Homo sapiens
cagatgtttgcctca

SEQ ID NO: 4015198 - DNA, 18 bp, Homo sapiens
cagattattggctgcttt

SEQ ID NO: 4015199 - DNA, 18 bp, Homo sapiens
cagattcaggccagccca

SEQ ID NO: 4015200 - DNA, 22 bp, Homo sapiens
cagattcaggccagcccagcca

SEQ ID NO: 4015201 - DNA, 20 bp, Homo sapiens
cagattctaggacctgtgtc

SEQ ID NO: 4015202 - DNA, 17 bp, Homo sapiens
cagattctgcctctctg

SEQ ID NO: 4015203 - DNA, 18 bp, Homo sapiens
cagattgtcttgcaactt

SEQ ID NO: 4015204 - DNA, 14 bp, Homo sapiens
cagattgttatcta

SEQ ID NO: 4015205 - DNA, 19 bp, Homo sapiens
cagatttgaactcttcaat

SEQ ID NO: 4015206 - DNA, 21 bp, Homo sapiens
cagatttgatatttgcattga

SEQ ID NO: 4015207 - DNA, 18 bp, Homo sapiens
cagatttggcttgacaaa

SEQ ID NO: 4015208 - DNA, 19 bp, Homo sapiens
cagattttacaaaagatgt

SEQ ID NO: 4015209 - DNA, 16 bp, Homo sapiens
cattgtactacctgtg

SEQ ID NO: 4015210 - DNA, 16 bp, Homo sapiens
cattgtccagagctgc

SEQ ID NO: 4015211 - DNA, 18 bp, Homo sapiens
cattgtccagagctgctt

SEQ ID NO: 4015212 - DNA, 20 bp, Homo sapiens
cattgtccctcttcactccc

SEQ ID NO: 4015213 - DNA, 16 bp, Homo sapiens
cattgtgaagcaccta

SEQ ID NO: 4015214 - DNA, 18 bp, Homo sapiens
cattgtgattggcctgta

SEQ ID NO: 4015215 - DNA, 22 bp, Homo sapiens
cattgtgggatgttcagcactg

SEQ ID NO: 4015216 - DNA, 18 bp, Homo sapiens
cattgttcaattagaata

SEQ ID NO: 4015217 - DNA, 20 bp, Homo sapiens
cattgttgagctattgctgt

SEQ ID NO: 4015218 - DNA, 18 bp, Homo sapiens
cattgttgaggtggtctg

SEQ ID NO: 4015219 - DNA, 15 bp, Homo sapiens
cattgttggctattt

SEQ ID NO: 4015220 - DNA, 14 bp, Homo sapiens
cattgtttgctgct

SEQ ID NO: 4015221 - DNA, 16 bp, Homo sapiens
cattgtttgctgctat

SEQ ID NO: 4015222 - DNA, 18 bp, Homo sapiens
cattgtttgcttattgtt

SEQ ID NO: 4015223 - DNA, 19 bp, Homo sapiens
cattgtttgcttattgttc

SEQ ID NO: 4015224 - DNA, 21 bp, Homo sapiens
cattgtttgcttattgttcca

SEQ ID NO: 4015225 - DNA, 22 bp, Homo sapiens
cattgtttgcttattgttccaa

SEQ ID NO: 4015226 - DNA, 13 bp, Homo sapiens
catttaaaatgat

SEQ ID NO: 4015227 - DNA, 14 bp, Homo sapiens
catttaaaatgatt

SEQ ID NO: 4015228 - DNA, 15 bp, Homo sapiens
catttaaaattgcta

SEQ ID NO: 4015229 - DNA, 14 bp, Homo sapiens
catttaaagcattg

SEQ ID NO: 4015230 - DNA, 15 bp, Homo sapiens
catttaaagcattgc

SEQ ID NO: 4015231 - DNA, 20 bp, Homo sapiens
catttaaatgtgtacaatgt

SEQ ID NO: 4015232 - DNA, 21 bp, Homo sapiens
catttaaatgtgtacaatgta

SEQ ID NO: 4015233 - DNA, 20 bp, Homo sapiens
catttaagggaaagaaaatg

SEQ ID NO: 4015234 - DNA, 22 bp, Homo sapiens
catttaatggcagctagtgcct

SEQ ID NO: 4015235 - DNA, 19 bp, Homo sapiens
catttaatttagtgatctt

SEQ ID NO: 4015236 - DNA, 16 bp, Homo sapiens
catttacatgttttaa

SEQ ID NO: 4015237 - DNA, 17 bp, Homo sapiens
catttacctctaaattt

SEQ ID NO: 4015238 - DNA, 13 bp, Homo sapiens
catttactaaaca

SEQ ID NO: 4015239 - DNA, 17 bp, Homo sapiens
catttagaaatcaagca

SEQ ID NO: 4015240 - DNA, 16 bp, Homo sapiens
catttagcatgttgtt

SEQ ID NO: 4015241 - DNA, 14 bp, Homo sapiens
catttataacccca

SEQ ID NO: 4015242 - DNA, 16 bp, Homo sapiens
catttataaccccagc

SEQ ID NO: 4015243 - DNA, 19 bp, Homo sapiens
catttataaccccagcctg

SEQ ID NO: 4015244 - DNA, 22 bp, Homo sapiens
catttataaccccagcctgacc

SEQ ID NO: 4015245 - DNA, 13 bp, Homo sapiens
catttatatattg

SEQ ID NO: 4015246 - DNA, 22 bp, Homo sapiens
catttatatattgaattaatat

SEQ ID NO: 4015247 - DNA, 15 bp, Homo sapiens
catttatgatttaat

SEQ ID NO: 4015248 - DNA, 17 bp, Homo sapiens
catttatgatttaataa

SEQ ID NO: 4015249 - DNA, 20 bp, Homo sapiens
catttatgatttaataaaat

SEQ ID NO: 4015250 - DNA, 21 bp, Homo sapiens
catttatgatttaataaaata

SEQ ID NO: 4015251 - DNA, 14 bp, Homo sapiens
catttatgtttatt

SEQ ID NO: 4015252 - DNA, 20 bp, Homo sapiens
catttatttattactgtccc

SEQ ID NO: 4015253 - DNA, 15 bp, Homo sapiens
catttattttaagca

SEQ ID NO: 4015254 - DNA, 17 bp, Homo sapiens
catttcaggaatttaaa

SEQ ID NO: 4015255 - DNA, 21 bp, Homo sapiens
catttcagtaaacctgtctga

SEQ ID NO: 4015256 - DNA, 14 bp, Homo sapiens
catttcagtatcat

SEQ ID NO: 4015257 - DNA, 15 bp, Homo sapiens
catttcagtggcttc

SEQ ID NO: 4015258 - DNA, 18 bp, Homo sapiens
catttcatcattgtttct

SEQ ID NO: 4015259 - DNA, 19 bp, Homo sapiens
catttcatcattgtttctg

SEQ ID NO: 4015260 - DNA, 21 bp, Homo sapiens
catttcatcattgtttctgca

SEQ ID NO: 4015261 - DNA, 17 bp, Homo sapiens
catttcatcctttcact

SEQ ID NO: 4015262 - DNA, 15 bp, Homo sapiens
catttcattccattg

SEQ ID NO: 4015263 - DNA, 18 bp, Homo sapiens
catttcattccattgcct

SEQ ID NO: 4015264 - DNA, 21 bp, Homo sapiens
catttcattccattgcctagc

SEQ ID NO: 4015265 - DNA, 20 bp, Homo sapiens
catttccaacaccacagaca

SEQ ID NO: 4015266 - DNA, 21 bp, Homo sapiens
catttccaacaccacagacac

SEQ ID NO: 4015267 - DNA, 17 bp, Homo sapiens
catttcccatctgcacc

SEQ ID NO: 4015268 - DNA, 20 bp, Homo sapiens
catttcccatctgcacccct

SEQ ID NO: 4015269 - DNA, 17 bp, Homo sapiens
catttcccccaaaggca

SEQ ID NO: 4015270 - DNA, 18 bp, Homo sapiens
catttcctcacactaaga

SEQ ID NO: 4015271 - DNA, 22 bp, Homo sapiens
catttcctcacactaagagggc

SEQ ID NO: 4015272 - DNA, 14 bp, Homo sapiens
catttccttccagc

SEQ ID NO: 4015273 - DNA, 20 bp, Homo sapiens
catttccttccagcccatcc

SEQ ID NO: 4015274 - DNA, 13 bp, Homo sapiens
catttccttggag

SEQ ID NO: 4015275 - DNA, 14 bp, Homo sapiens
catttccttggagg

SEQ ID NO: 4015276 - DNA, 17 bp, Homo sapiens
catttccttggaggcca

SEQ ID NO: 4015277 - DNA, 23 bp, Homo sapiens
catttccttggaggccaccggga

SEQ ID NO: 4015278 - DNA, 20 bp, Homo sapiens
catttctagcgcatggcctg

SEQ ID NO: 4015279 - DNA, 23 bp, Homo sapiens
catttctcactagtgtcaggccc

SEQ ID NO: 4015280 - DNA, 12 bp, Homo sapiens
catttctcactg

SEQ ID NO: 4015281 - DNA, 16 bp, Homo sapiens
catttctgatcagagg

SEQ ID NO: 4015282 - DNA, 13 bp, Homo sapiens
catttctgcctcg

SEQ ID NO: 4015283 - DNA, 14 bp, Homo sapiens
catttcttcctcag

SEQ ID NO: 4015284 - DNA, 15 bp, Homo sapiens
catttcttttctttt

SEQ ID NO: 4015285 - DNA, 22 bp, Homo sapiens
catttgaacctggatccagcac

SEQ ID NO: 4015286 - DNA, 16 bp, Homo sapiens
catttgacaaaactaa

SEQ ID NO: 4015287 - DNA, 14 bp, Homo sapiens
catttgatgctaaa

SEQ ID NO: 4015288 - DNA, 15 bp, Homo sapiens
catttgatgctaaat

SEQ ID NO: 4015289 - DNA, 16 bp, Homo sapiens
catttgatttttctaa

SEQ ID NO: 4015290 - DNA, 20 bp, Homo sapiens
catttgcagggtcctcttct

SEQ ID NO: 4015291 - DNA, 22 bp, Homo sapiens
catttgcagggtcctcttctgg

SEQ ID NO: 4015292 - DNA, 20 bp, Homo sapiens
catttgcctttctgggagca

SEQ ID NO: 4015293 - DNA, 21 bp, Homo sapiens
catttgcctttctgggagcag

SEQ ID NO: 4015294 - DNA, 15 bp, Homo sapiens
catttggaatacttt

SEQ ID NO: 4015295 - DNA, 17 bp, Homo sapiens
catttggaatacttttt

SEQ ID NO: 4015296 - DNA, 20 bp, Homo sapiens
catttggaattagtggattt

SEQ ID NO: 4015297 - DNA, 18 bp, Homo sapiens
catttgggagacatgtga

SEQ ID NO: 4015298 - DNA, 20 bp, Homo sapiens
catttgggagacatgtgaca

SEQ ID NO: 4015299 - DNA, 18 bp, Homo sapiens
catttggtctgccagaat

SEQ ID NO: 4015300 - DNA, 16 bp, Homo sapiens
catttggttcattaat

SEQ ID NO: 4015301 - DNA, 14 bp, Homo sapiens
catttgtaataaag

SEQ ID NO: 4015302 - DNA, 17 bp, Homo sapiens
catttgtaataaagtat

SEQ ID NO: 4015303 - DNA, 22 bp, Homo sapiens
catttgtacagaattttggaag

SEQ ID NO: 4015304 - DNA, 21 bp, Homo sapiens
catttgtcccagactaaagga

SEQ ID NO: 4015305 - DNA, 15 bp, Homo sapiens
catttgtgaggccca

SEQ ID NO: 4015306 - DNA, 14 bp, Homo sapiens
catttgttcagctc

SEQ ID NO: 4015307 - DNA, 16 bp, Homo sapiens
catttgttcagctccc

SEQ ID NO: 4015308 - DNA, 17 bp, Homo sapiens
catttgttcctgcttcc

SEQ ID NO: 4015309 - DNA, 20 bp, Homo sapiens
catttgttcctggagttttg

SEQ ID NO: 4015310 - DNA, 16 bp, Homo sapiens
cattttaactttatca

SEQ ID NO: 4015311 - DNA, 22 bp, Homo sapiens
ccacaaggtccactccctgctc

SEQ ID NO: 4015312 - DNA, 15 bp, Homo sapiens
ccacaagtcttccag

SEQ ID NO: 4015313 - DNA, 22 bp, Homo sapiens
ccacaagtcttccagaggatgc

SEQ ID NO: 4015314 - DNA, 20 bp, Homo sapiens
ccacaagttaaataaatcat

SEQ ID NO: 4015315 - DNA, 23 bp, Homo sapiens
ccacaatgatgattaaacacctg

SEQ ID NO: 4015316 - DNA, 19 bp, Homo sapiens
ccacacagctacagctttc

SEQ ID NO: 4015317 - DNA, 13 bp, Homo sapiens
ccacacagctgcc

SEQ ID NO: 4015318 - DNA, 14 bp, Homo sapiens
ccacacagctgccc

SEQ ID NO: 4015319 - DNA, 16 bp, Homo sapiens
ccacacagctgcccta

SEQ ID NO: 4015320 - DNA, 21 bp, Homo sapiens
ccacacagctgccctagctga

SEQ ID NO: 4015321 - DNA, 14 bp, Homo sapiens
ccacacaggctggc

SEQ ID NO: 4015322 - DNA, 19 bp, Homo sapiens
ccacacatttcactgtctg

SEQ ID NO: 4015323 - DNA, 14 bp, Homo sapiens
ccacaccaacactg

SEQ ID NO: 4015324 - DNA, 14 bp, Homo sapiens
ccacacccagggga

SEQ ID NO: 4015325 - DNA, 22 bp, Homo sapiens
ccacacccaggggaaggccctg

SEQ ID NO: 4015326 - DNA, 13 bp, Homo sapiens
ccacaccccagcc

SEQ ID NO: 4015327 - DNA, 15 bp, Homo sapiens
ccacaccccagccca

SEQ ID NO: 4015328 - DNA, 11 bp, Homo sapiens
ccacaccctcc

SEQ ID NO: 4015329 - DNA, 16 bp, Homo sapiens
ccacaccctgtactgt

SEQ ID NO: 4015330 - DNA, 14 bp, Homo sapiens
ccacaccgcagaag

SEQ ID NO: 4015331 - DNA, 18 bp, Homo sapiens
ccacaccgtgtaaaccaa

SEQ ID NO: 4015332 - DNA, 16 bp, Homo sapiens
ccacacctctgccaga

SEQ ID NO: 4015333 - DNA, 18 bp, Homo sapiens
ccacacctgaacttgcct

SEQ ID NO: 4015334 - DNA, 18 bp, Homo sapiens
ccacaccttccagggccc

SEQ ID NO: 4015335 - DNA, 17 bp, Homo sapiens
ccacacggactcccggg

SEQ ID NO: 4015336 - DNA, 22 bp, Homo sapiens
ccacactaacctgggttccctt

SEQ ID NO: 4015337 - DNA, 23 bp, Homo sapiens
ccacactcccaaggttggagccc

SEQ ID NO: 4015338 - DNA, 23 bp, Homo sapiens
ccacactccccgccttagagcct

SEQ ID NO: 4015339 - DNA, 13 bp, Homo sapiens
ccacactggtgac

SEQ ID NO: 4015340 - DNA, 14 bp, Homo sapiens
ccacactggtgact

SEQ ID NO: 4015341 - DNA, 17 bp, Homo sapiens
ccacacttgagaggatg

SEQ ID NO: 4015342 - DNA, 20 bp, Homo sapiens
ccacacttgttccagctctt

SEQ ID NO: 4015343 - DNA, 20 bp, Homo sapiens
ccacagaaccttcaacccag

SEQ ID NO: 4015344 - DNA, 11 bp, Homo sapiens
ccacagacaca

SEQ ID NO: 4015345 - DNA, 21 bp, Homo sapiens
ccacagacacacacacgcacg

SEQ ID NO: 4015346 - DNA, 15 bp, Homo sapiens
ccacagacagatccc

SEQ ID NO: 4015347 - DNA, 20 bp, Homo sapiens
ccacagacagatcccatcca

SEQ ID NO: 4015348 - DNA, 15 bp, Homo sapiens
ccacagaccacctgc

SEQ ID NO: 4015349 - DNA, 20 bp, Homo sapiens
ccacagaccacctgcttctg

SEQ ID NO: 4015350 - DNA, 16 bp, Homo sapiens
ccacagactggttttg

SEQ ID NO: 4015351 - DNA, 21 bp, Homo sapiens
ccacagagagggagagcagag

SEQ ID NO: 4015352 - DNA, 17 bp, Homo sapiens
ccacagagtgagccagt

SEQ ID NO: 4015353 - DNA, 19 bp, Homo sapiens
ccacagagtgagccagtga

SEQ ID NO: 4015354 - DNA, 20 bp, Homo sapiens
ccacagcatcattttgcatt

SEQ ID NO: 4015355 - DNA, 22 bp, Homo sapiens
ccacagcatcgggagcacccag

SEQ ID NO: 4015356 - DNA, 13 bp, Homo sapiens
ccacagccagagg

SEQ ID NO: 4015357 - DNA, 19 bp, Homo sapiens
ccacagcctccccacccag

SEQ ID NO: 4015358 - DNA, 15 bp, Homo sapiens
ccacagcggaggaga

SEQ ID NO: 4015359 - DNA, 19 bp, Homo sapiens
ccacagcggaggagaccag

SEQ ID NO: 4015360 - DNA, 15 bp, Homo sapiens
ccacagcgtccctgg

SEQ ID NO: 4015361 - DNA, 16 bp, Homo sapiens
ccacagcgtccctggc

SEQ ID NO: 4015362 - DNA, 11 bp, Homo sapiens
ccacagctacc

SEQ ID NO: 4015363 - DNA, 18 bp, Homo sapiens
ccacagctacctgagacg

SEQ ID NO: 4015364 - DNA, 15 bp, Homo sapiens
ccacagctccttttc

SEQ ID NO: 4015365 - DNA, 16 bp, Homo sapiens
ccacagctccttttcc

SEQ ID NO: 4015366 - DNA, 17 bp, Homo sapiens
ccacagctgctgttctc

SEQ ID NO: 4015367 - DNA, 20 bp, Homo sapiens
ccacagctgctgttctcagg

SEQ ID NO: 4015368 - DNA, 15 bp, Homo sapiens
ccacagcttttgcaa

SEQ ID NO: 4015369 - DNA, 19 bp, Homo sapiens
ccacaggaagcctgcagtc

SEQ ID NO: 4015370 - DNA, 19 bp, Homo sapiens
ccacaggcccttcctctcc

SEQ ID NO: 4015371 - DNA, 22 bp, Homo sapiens
ccacaggcccttcctctccact

SEQ ID NO: 4015372 - DNA, 16 bp, Homo sapiens
ccacagggaaccctgc

SEQ ID NO: 4015373 - DNA, 14 bp, Homo sapiens
ccacagggccagag

SEQ ID NO: 4015374 - DNA, 15 bp, Homo sapiens
ccacagggccagagg

SEQ ID NO: 4015375 - DNA, 16 bp, Homo sapiens
ccacagggccagaggg

SEQ ID NO: 4015376 - DNA, 20 bp, Homo sapiens
ccacagggccagagggagct

SEQ ID NO: 4015377 - DNA, 17 bp, Homo sapiens
ccacagtagtcttgatg

SEQ ID NO: 4015378 - DNA, 19 bp, Homo sapiens
ccacagtctcccccaccct

SEQ ID NO: 4015379 - DNA, 23 bp, Homo sapiens
ccacagttgccaccacctctgtg

SEQ ID NO: 4015380 - DNA, 14 bp, Homo sapiens
ccacatacaggtgc

SEQ ID NO: 4015381 - DNA, 19 bp, Homo sapiens
ccacatacaggtgctcaat

SEQ ID NO: 4015382 - DNA, 22 bp, Homo sapiens
ccacatccacacacgcaggaac

SEQ ID NO: 4015383 - DNA, 18 bp, Homo sapiens
ccacatcccagcagccca

SEQ ID NO: 4015384 - DNA, 19 bp, Homo sapiens
ccacatcctccgtccagcc

SEQ ID NO: 4015385 - DNA, 13 bp, Homo sapiens
ccacatcgcacac

SEQ ID NO: 4015386 - DNA, 15 bp, Homo sapiens
ccacatcgcacactg

SEQ ID NO: 4015387 - DNA, 15 bp, Homo sapiens
ccacatctgccagac

SEQ ID NO: 4015388 - DNA, 16 bp, Homo sapiens
ccacatctgccagacc

SEQ ID NO: 4015389 - DNA, 14 bp, Homo sapiens
ccacatctgcctta

SEQ ID NO: 4015390 - DNA, 23 bp, Homo sapiens
ccacatctgccttaaaaccaaag

SEQ ID NO: 4015391 - DNA, 14 bp, Homo sapiens
ccacatgccactgc

SEQ ID NO: 4015392 - DNA, 20 bp, Homo sapiens
ccacatgccactgcctgcac

SEQ ID NO: 4015393 - DNA, 21 bp, Homo sapiens
ccacatgccactgcctgcacc

SEQ ID NO: 4015394 - DNA, 19 bp, Homo sapiens
ccacatgcctgcgcctgct

SEQ ID NO: 4015395 - DNA, 15 bp, Homo sapiens
ccacatggagccccc

SEQ ID NO: 4015396 - DNA, 16 bp, Homo sapiens
ccacatggagccccct

SEQ ID NO: 4015397 - DNA, 20 bp, Homo sapiens
ccacatgtacagacatacat

SEQ ID NO: 4015398 - DNA, 19 bp, Homo sapiens
ccacatttagtcctgtact

SEQ ID NO: 4015399 - DNA, 10 bp, Homo sapiens
ccacatttct

SEQ ID NO: 4015400 - DNA, 22 bp, Homo sapiens
ccacatttggaatactttttgt

SEQ ID NO: 4015401 - DNA, 16 bp, Homo sapiens
ccacattttatattta

SEQ ID NO: 4015402 - DNA, 17 bp, Homo sapiens
ccaccacaccgcagaag

SEQ ID NO: 4015403 - DNA, 20 bp, Homo sapiens
ccaccacccgaaatgccacg

SEQ ID NO: 4015404 - DNA, 21 bp, Homo sapiens
ccaccagacatcaccctttgc

SEQ ID NO: 4015405 - DNA, 18 bp, Homo sapiens
ccaccagatagcagaggg

SEQ ID NO: 4015406 - DNA, 12 bp, Homo sapiens
ccaccagccatc

SEQ ID NO: 4015407 - DNA, 18 bp, Homo sapiens
ccaccaggatcccagggg

SEQ ID NO: 4015408 - DNA, 14 bp, Homo sapiens
ccaccaggtgtcag

SEQ ID NO: 4015409 - DNA, 19 bp, Homo sapiens
ccaccatatgaattgtaca

SEQ ID NO: 4015410 - DNA, 13 bp, Homo sapiens
ccaccatccctga

SEQ ID NO: 4015411 - DNA, 16 bp, Homo sapiens
ccaccatggccagcca

SEQ ID NO: 4015412 - DNA, 17 bp, Homo sapiens
ccacccaagcaggaggc

SEQ ID NO: 4015413 - DNA, 19 bp, Homo sapiens
ccacccacacagctgccct

SEQ ID NO: 4015414 - DNA, 23 bp, Homo sapiens
aaactgcataagtgaaaatctta

SEQ ID NO: 4015415 - DNA, 23 bp, Homo sapiens
aaactgctaaattctatgttaaa

SEQ ID NO: 4015416 - DNA, 15 bp, Homo sapiens
aaactggactcacat

SEQ ID NO: 4015417 - DNA, 21 bp, Homo sapiens
aaactggattaaaacaatttt

SEQ ID NO: 4015418 - DNA, 15 bp, Homo sapiens
aaactggcctgactt

SEQ ID NO: 4015419 - DNA, 19 bp, Homo sapiens
aaactggcttccccactcc

SEQ ID NO: 4015420 - DNA, 18 bp, Homo sapiens
aaactggggcctccagaa

SEQ ID NO: 4015421 - DNA, 14 bp, Homo sapiens
aaactgtacagaat

SEQ ID NO: 4015422 - DNA, 19 bp, Homo sapiens
aaactgtacagaatttcca

SEQ ID NO: 4015423 - DNA, 15 bp, Homo sapiens
aaactgtacatttaa

SEQ ID NO: 4015424 - DNA, 17 bp, Homo sapiens
aaactgtacatttaaaa

SEQ ID NO: 4015425 - DNA, 22 bp, Homo sapiens
aaactgtacatttaaaattgct

SEQ ID NO: 4015426 - DNA, 16 bp, Homo sapiens
aaactgtagaaatgat

SEQ ID NO: 4015427 - DNA, 14 bp, Homo sapiens
aaactgtgttgcca

SEQ ID NO: 4015428 - DNA, 15 bp, Homo sapiens
aaactgtgttgccac

SEQ ID NO: 4015429 - DNA, 14 bp, Homo sapiens
aaactgttctctat

SEQ ID NO: 4015430 - DNA, 23 bp, Homo sapiens
aaactgttctctattagacttta

SEQ ID NO: 4015431 - DNA, 14 bp, Homo sapiens
aaactgtttgaaaa

SEQ ID NO: 4015432 - DNA, 20 bp, Homo sapiens
aaacttacctaagtgacatt

SEQ ID NO: 4015433 - DNA, 14 bp, Homo sapiens
aaacttagaggaaa

SEQ ID NO: 4015434 - DNA, 15 bp, Homo sapiens
aaacttataaatcat

SEQ ID NO: 4015435 - DNA, 21 bp, Homo sapiens
aaacttataaatcatattgat

SEQ ID NO: 4015436 - DNA, 20 bp, Homo sapiens
aaacttcagaagcaaacaat

SEQ ID NO: 4015437 - DNA, 17 bp, Homo sapiens
aaacttccccatcttct

SEQ ID NO: 4015438 - DNA, 16 bp, Homo sapiens
aaacttcttaaatatc

SEQ ID NO: 4015439 - DNA, 19 bp, Homo sapiens
aaacttgactccatttcat

SEQ ID NO: 4015440 - DNA, 21 bp, Homo sapiens
aaacttgagttggagtactat

SEQ ID NO: 4015441 - DNA, 18 bp, Homo sapiens
aaacttgctttatgcctt

SEQ ID NO: 4015442 - DNA, 18 bp, Homo sapiens
aaacttggatacttggat

SEQ ID NO: 4015443 - DNA, 18 bp, Homo sapiens
aaacttggattctctaac

SEQ ID NO: 4015444 - DNA, 23 bp, Homo sapiens
aaacttggtgacttgatccacta

SEQ ID NO: 4015445 - DNA, 16 bp, Homo sapiens
aaactttaaaaaatat

SEQ ID NO: 4015446 - DNA, 21 bp, Homo sapiens
aaactttagagtagcatgaga

SEQ ID NO: 4015447 - DNA, 19 bp, Homo sapiens
aaactttagggtaaaaatt

SEQ ID NO: 4015448 - DNA, 13 bp, Homo sapiens
aaactttcacttt

SEQ ID NO: 4015449 - DNA, 20 bp, Homo sapiens
aaacttttttatatcttttg

SEQ ID NO: 4015450 - DNA, 14 bp, Homo sapiens
aaagaaaagataaa

SEQ ID NO: 4015451 - DNA, 15 bp, Homo sapiens
aaagaaaagccaagc

SEQ ID NO: 4015452 - DNA, 19 bp, Homo sapiens
aaagaaaatttttgtagta

SEQ ID NO: 4015453 - DNA, 20 bp, Homo sapiens
aaagaaatccggagaagctg

SEQ ID NO: 4015454 - DNA, 19 bp, Homo sapiens
aaagaaatgtctattaagg

SEQ ID NO: 4015455 - DNA, 17 bp, Homo sapiens
aaagaaatgtcttaatt

SEQ ID NO: 4015456 - DNA, 18 bp, Homo sapiens
aaagaacatggacttgta

SEQ ID NO: 4015457 - DNA, 21 bp, Homo sapiens
aaagaacatggacttgtatat

SEQ ID NO: 4015458 - DNA, 12 bp, Homo sapiens
aaagaagatgtt

SEQ ID NO: 4015459 - DNA, 21 bp, Homo sapiens
aaagaagggctggtattgttc

SEQ ID NO: 4015460 - DNA, 17 bp, Homo sapiens
aaagaagttactttgta

SEQ ID NO: 4015461 - DNA, 17 bp, Homo sapiens
aaagaatacagaaagat

SEQ ID NO: 4015462 - DNA, 18 bp, Homo sapiens
aaagaatgccatttctca

SEQ ID NO: 4015463 - DNA, 16 bp, Homo sapiens
aaagaattatttgcct

SEQ ID NO: 4015464 - DNA, 16 bp, Homo sapiens
aaagacactggcagag

SEQ ID NO: 4015465 - DNA, 14 bp, Homo sapiens
aaagacagaatggt

SEQ ID NO: 4015466 - DNA, 15 bp, Homo sapiens
aaagacccaggggga

SEQ ID NO: 4015467 - DNA, 16 bp, Homo sapiens
aaagacccagggggag

SEQ ID NO: 4015468 - DNA, 22 bp, Homo sapiens
aaagacgatgtttatgttctta

SEQ ID NO: 4015469 - DNA, 17 bp, Homo sapiens
aaagactcaagagaatt

SEQ ID NO: 4015470 - DNA, 17 bp, Homo sapiens
aaagactctattctcaa

SEQ ID NO: 4015471 - DNA, 21 bp, Homo sapiens
aaagagaattgggggcttagg

SEQ ID NO: 4015472 - DNA, 18 bp, Homo sapiens
aaagagagaatgtagata

SEQ ID NO: 4015473 - DNA, 15 bp, Homo sapiens
aaagagataataaga

SEQ ID NO: 4015474 - DNA, 16 bp, Homo sapiens
aaagagataataagat

SEQ ID NO: 4015475 - DNA, 13 bp, Homo sapiens
aaagagatatttt

SEQ ID NO: 4015476 - DNA, 15 bp, Homo sapiens
aaagagcccttgcct

SEQ ID NO: 4015477 - DNA, 18 bp, Homo sapiens
aaagagcccttgcctccc

SEQ ID NO: 4015478 - DNA, 20 bp, Homo sapiens
aaagaggctgaaagaggcca

SEQ ID NO: 4015479 - DNA, 19 bp, Homo sapiens
aaagaggctgaggcctgga

SEQ ID NO: 4015480 - DNA, 21 bp, Homo sapiens
aaagaggctgaggcctggact

SEQ ID NO: 4015481 - DNA, 12 bp, Homo sapiens
aaataagtattt

SEQ ID NO: 4015482 - DNA, 22 bp, Homo sapiens
aaataagtatttataatagcaa

SEQ ID NO: 4015483 - DNA, 13 bp, Homo sapiens
aaataatgaataa

SEQ ID NO: 4015484 - DNA, 19 bp, Homo sapiens
aaataatgaatacatttcc

SEQ ID NO: 4015485 - DNA, 12 bp, Homo sapiens
aaatacaaatct

SEQ ID NO: 4015486 - DNA, 13 bp, Homo sapiens
aaatacaaatctg

SEQ ID NO: 4015487 - DNA, 15 bp, Homo sapiens
aaatacaaatctgta

SEQ ID NO: 4015488 - DNA, 19 bp, Homo sapiens
aaatacaagactgttgtga

SEQ ID NO: 4015489 - DNA, 13 bp, Homo sapiens
aaatacaataaac

SEQ ID NO: 4015490 - DNA, 21 bp, Homo sapiens
aaatacaccacctcactcctg

SEQ ID NO: 4015491 - DNA, 17 bp, Homo sapiens
aaatacagatagatata

SEQ ID NO: 4015492 - DNA, 14 bp, Homo sapiens
aaatacatgcatct

SEQ ID NO: 4015493 - DNA, 18 bp, Homo sapiens
aaatacattgtatatatg

SEQ ID NO: 4015494 - DNA, 18 bp, Homo sapiens
aaatacatttaaaactta

SEQ ID NO: 4015495 - DNA, 16 bp, Homo sapiens
aaatactgtgcagaat

SEQ ID NO: 4015496 - DNA, 23 bp, Homo sapiens
aaatactgtgcagaataatggaa

SEQ ID NO: 4015497 - DNA, 13 bp, Homo sapiens
aaatacttcatga

SEQ ID NO: 4015498 - DNA, 11 bp, Homo sapiens
aaatacttgtc

SEQ ID NO: 4015499 - DNA, 21 bp, Homo sapiens
aaatacttgtcaatatttaaa

SEQ ID NO: 4015500 - DNA, 19 bp, Homo sapiens
aaatacttttactctgcct

SEQ ID NO: 4015501 - DNA, 15 bp, Homo sapiens
aaatagacaaataga

SEQ ID NO: 4015502 - DNA, 12 bp, Homo sapiens
aaatagctatat

SEQ ID NO: 4015503 - DNA, 14 bp, Homo sapiens
aaataggagaggat

SEQ ID NO: 4015504 - DNA, 16 bp, Homo sapiens
aaataggagaggatga

SEQ ID NO: 4015505 - DNA, 17 bp, Homo sapiens
aaataggggatatttaa

SEQ ID NO: 4015506 - DNA, 20 bp, Homo sapiens
aaataggggatggtccagga

SEQ ID NO: 4015507 - DNA, 22 bp, Homo sapiens
aaatagttaagacatgatttcc

SEQ ID NO: 4015508 - DNA, 13 bp, Homo sapiens
aaatataaaatat

SEQ ID NO: 4015509 - DNA, 12 bp, Homo sapiens
aaatataaacat

SEQ ID NO: 4015510 - DNA, 21 bp, Homo sapiens
aaatataagacatttgtttgc

SEQ ID NO: 4015511 - DNA, 14 bp, Homo sapiens
aaatataagatttt

SEQ ID NO: 4015512 - DNA, 22 bp, Homo sapiens
aaatataagccttttatactga

SEQ ID NO: 4015513 - DNA, 21 bp, Homo sapiens
aaatatataaaaagaaaagat

SEQ ID NO: 4015514 - DNA, 15 bp, Homo sapiens
aaatatatattttgt

SEQ ID NO: 4015515 - DNA, 15 bp, Homo sapiens
aaatatatttaatga

SEQ ID NO: 4015516 - DNA, 15 bp, Homo sapiens
aaatatcagactagt

SEQ ID NO: 4015517 - DNA, 14 bp, Homo sapiens
aaatatctgaaaat

SEQ ID NO: 4015518 - DNA, 21 bp, Homo sapiens
aaatatctgaaaatgtatgtg

SEQ ID NO: 4015519 - DNA, 21 bp, Homo sapiens
aaatatcttttatgtttgaat

SEQ ID NO: 4015520 - DNA, 22 bp, Homo sapiens
aaatatcttttatgtttgaata

SEQ ID NO: 4015521 - DNA, 14 bp, Homo sapiens
aaatatgaaattcc

SEQ ID NO: 4015522 - DNA, 18 bp, Homo sapiens
aaatatgaaattccagca

SEQ ID NO: 4015523 - DNA, 20 bp, Homo sapiens
aaatatgaagacataaaccc

SEQ ID NO: 4015524 - DNA, 14 bp, Homo sapiens
aaatatgcagtgat

SEQ ID NO: 4015525 - DNA, 23 bp, Homo sapiens
aaatatgcagtgatatggcagaa

SEQ ID NO: 4015526 - DNA, 13 bp, Homo sapiens
aaatatggaactt

SEQ ID NO: 4015527 - DNA, 16 bp, Homo sapiens
aaatatggaacttaca

SEQ ID NO: 4015528 - DNA, 20 bp, Homo sapiens
aaatatggacacttaatact

SEQ ID NO: 4015529 - DNA, 19 bp, Homo sapiens
aaatatggtttggtttttc

SEQ ID NO: 4015530 - DNA, 14 bp, Homo sapiens
aaatatgtaatgct

SEQ ID NO: 4015531 - DNA, 16 bp, Homo sapiens
aaatatgtaatgcttc

SEQ ID NO: 4015532 - DNA, 24 bp, Homo sapiens
aaatatgtgagattttttattgct

SEQ ID NO: 4015533 - DNA, 23 bp, Homo sapiens
aaatatgttttttagatcaaata

SEQ ID NO: 4015534 - DNA, 20 bp, Homo sapiens
aaatattataacttaaaaaa

SEQ ID NO: 4015535 - DNA, 17 bp, Homo sapiens
aaatattcactggcccc

SEQ ID NO: 4015536 - DNA, 16 bp, Homo sapiens
aaatattcctccaaat

SEQ ID NO: 4015537 - DNA, 19 bp, Homo sapiens
aaatattcctccaaatctc

SEQ ID NO: 4015538 - DNA, 19 bp, Homo sapiens
aaatattgaggctttgtgt

SEQ ID NO: 4015539 - DNA, 23 bp, Homo sapiens
aaatattgaggctttgtgttgta

SEQ ID NO: 4015540 - DNA, 14 bp, Homo sapiens
aaatatttacctaa

SEQ ID NO: 4015541 - DNA, 19 bp, Homo sapiens
aaatatttataaaacttct

SEQ ID NO: 4015542 - DNA, 18 bp, Homo sapiens
aaatatttattaaataaa

SEQ ID NO: 4015543 - DNA, 12 bp, Homo sapiens
aaatatttctga

SEQ ID NO: 4015544 - DNA, 17 bp, Homo sapiens
aaatatttgaatgaaaa

SEQ ID NO: 4015545 - DNA, 20 bp, Homo sapiens
aaatatttgaatgaaaacat

SEQ ID NO: 4015546 - DNA, 18 bp, Homo sapiens
aaatatttgacttgcatg

SEQ ID NO: 4015547 - DNA, 20 bp, Homo sapiens
aaatattttgataataaatt

SEQ ID NO: 4015548 - DNA, 15 bp, Homo sapiens
aaatattttttacag

SEQ ID NO: 4015549 - DNA, 23 bp, Homo sapiens
aaatcaagtatttgggaagtgaa

SEQ ID NO: 4015550 - DNA, 16 bp, Homo sapiens
aaatcaagtattttgt

SEQ ID NO: 4015551 - DNA, 15 bp, Homo sapiens
aaatcaatacactag

SEQ ID NO: 4015552 - DNA, 22 bp, Homo sapiens
aaatcaatacactagttgtttc

SEQ ID NO: 4015553 - DNA, 13 bp, Homo sapiens
aaatcaatgtcac

SEQ ID NO: 4015554 - DNA, 14 bp, Homo sapiens
aaatcaatttttag

SEQ ID NO: 4015555 - DNA, 12 bp, Homo sapiens
aaatcagaataa

SEQ ID NO: 4015556 - DNA, 14 bp, Homo sapiens
aaatcagaataaat

SEQ ID NO: 4015557 - DNA, 16 bp, Homo sapiens
aaatcagctgctacta

SEQ ID NO: 4015558 - DNA, 13 bp, Homo sapiens
aaatcaggtgttt

SEQ ID NO: 4015559 - DNA, 11 bp, Homo sapiens
aaatcagtaag

SEQ ID NO: 4015560 - DNA, 13 bp, Homo sapiens
aaatcagtaagag

SEQ ID NO: 4015561 - DNA, 13 bp, Homo sapiens
aaatcatattgat

SEQ ID NO: 4015562 - DNA, 18 bp, Homo sapiens
aaatccaaaacttctctt

SEQ ID NO: 4015563 - DNA, 13 bp, Homo sapiens
aaatccaataaaa

SEQ ID NO: 4015564 - DNA, 16 bp, Homo sapiens
aaatcccaccttccca

SEQ ID NO: 4015565 - DNA, 22 bp, Homo sapiens
aaatcctattctgatgaatctc

SEQ ID NO: 4015566 - DNA, 22 bp, Homo sapiens
aaatcctgcaatgaaaggtact

SEQ ID NO: 4015567 - DNA, 16 bp, Homo sapiens
aaatcctgccatttaa

SEQ ID NO: 4015568 - DNA, 18 bp, Homo sapiens
aaatcctgccatttaaaa

SEQ ID NO: 4015569 - DNA, 22 bp, Homo sapiens
aaatcggatctggggctctggg

SEQ ID NO: 4015570 - DNA, 21 bp, Homo sapiens
aaatctaaaacaaaatctgaa

SEQ ID NO: 4015571 - DNA, 23 bp, Homo sapiens
aaatctaaaacaaaatctgaact

SEQ ID NO: 4015572 - DNA, 15 bp, Homo sapiens
aaatctacagatcct

SEQ ID NO: 4015573 - DNA, 16 bp, Homo sapiens
aaatctatttattaat

SEQ ID NO: 4015574 - DNA, 22 bp, Homo sapiens
aaatctatttattaatatttaa

SEQ ID NO: 4015575 - DNA, 18 bp, Homo sapiens
aaatctcccattttggaa

SEQ ID NO: 4015576 - DNA, 21 bp, Homo sapiens
aaatctcccattttggaattt

SEQ ID NO: 4015577 - DNA, 15 bp, Homo sapiens
aaatctgaactctca

SEQ ID NO: 4015578 - DNA, 19 bp, Homo sapiens
aaatctgctagaaagttag

SEQ ID NO: 4015579 - DNA, 11 bp, Homo sapiens
aaatctggtcc

SEQ ID NO: 4015580 - DNA, 20 bp, Homo sapiens
aaatctggtccatatttaca

SEQ ID NO: 4015581 - DNA, 17 bp, Homo sapiens
aaatctgtataaatgtc

SEQ ID NO: 4015582 - DNA, 21 bp, Homo sapiens
aaatctgtccaaaggaggctg

SEQ ID NO: 4015583 - DNA, 22 bp, Homo sapiens
aaatctgtccaaaggaggctgg

SEQ ID NO: 4015584 - DNA, 19 bp, Homo sapiens
aacacgcatggtcaaccct

SEQ ID NO: 4015585 - DNA, 20 bp, Homo sapiens
aacactaaagatccaagaag

SEQ ID NO: 4015586 - DNA, 17 bp, Homo sapiens
aacactaattcataatc

SEQ ID NO: 4015587 - DNA, 21 bp, Homo sapiens
aacactccccattaacagatg

SEQ ID NO: 4015588 - DNA, 19 bp, Homo sapiens
aacactggcaacaacaaag

SEQ ID NO: 4015589 - DNA, 20 bp, Homo sapiens
aacactggcacactgctctt

SEQ ID NO: 4015590 - DNA, 17 bp, Homo sapiens
aacactggtgtgacctg

SEQ ID NO: 4015591 - DNA, 20 bp, Homo sapiens
aacactggtgtgacctgagg

SEQ ID NO: 4015592 - DNA, 14 bp, Homo sapiens
aacagaacagggtc

SEQ ID NO: 4015593 - DNA, 14 bp, Homo sapiens
aacagaactaaatg

SEQ ID NO: 4015594 - DNA, 15 bp, Homo sapiens
aacagaactaaatgt

SEQ ID NO: 4015595 - DNA, 18 bp, Homo sapiens
aacagaactaaatgttct

SEQ ID NO: 4015596 - DNA, 22 bp, Homo sapiens
aacagaagctcttactctttcc

SEQ ID NO: 4015597 - DNA, 18 bp, Homo sapiens
aacagacaaaacaatccc

SEQ ID NO: 4015598 - DNA, 16 bp, Homo sapiens
aacagacaacagaagt

SEQ ID NO: 4015599 - DNA, 21 bp, Homo sapiens
aacagacaatatgtgagtgcc

SEQ ID NO: 4015600 - DNA, 18 bp, Homo sapiens
aacagaccccctctagaa

SEQ ID NO: 4015601 - DNA, 17 bp, Homo sapiens
aacagactgttgagtta

SEQ ID NO: 4015602 - DNA, 17 bp, Homo sapiens
aacagaggccatggcag

SEQ ID NO: 4015603 - DNA, 21 bp, Homo sapiens
aacagagtggcctccctgctg

SEQ ID NO: 4015604 - DNA, 15 bp, Homo sapiens
aacagagttatagaa

SEQ ID NO: 4015605 - DNA, 18 bp, Homo sapiens
aacagataagcaagagag

SEQ ID NO: 4015606 - DNA, 23 bp, Homo sapiens
aacagatactggaagttttgcat

SEQ ID NO: 4015607 - DNA, 18 bp, Homo sapiens
aacagatgacccctgccc

SEQ ID NO: 4015608 - DNA, 17 bp, Homo sapiens
aacagatgctctgagag

SEQ ID NO: 4015609 - DNA, 17 bp, Homo sapiens
aacagattcaggccagc

SEQ ID NO: 4015610 - DNA, 18 bp, Homo sapiens
aacagattcaggccagcc

SEQ ID NO: 4015611 - DNA, 14 bp, Homo sapiens
aacagcaagaaata

SEQ ID NO: 4015612 - DNA, 21 bp, Homo sapiens
aacagcagaggttcttttaaa

SEQ ID NO: 4015613 - DNA, 19 bp, Homo sapiens
aacagcagtgatctcaggg

SEQ ID NO: 4015614 - DNA, 23 bp, Homo sapiens
aacagcagtgatctcagggcaga

SEQ ID NO: 4015615 - DNA, 16 bp, Homo sapiens
aacagcagtgttctca

SEQ ID NO: 4015616 - DNA, 23 bp, Homo sapiens
aacagcattcttgtcacaataaa

SEQ ID NO: 4015617 - DNA, 18 bp, Homo sapiens
aacagccaagattttcct

SEQ ID NO: 4015618 - DNA, 19 bp, Homo sapiens
aacagccattgcggcccca

SEQ ID NO: 4015619 - DNA, 24 bp, Homo sapiens
aacagccattgcggccccaggagg

SEQ ID NO: 4015620 - DNA, 22 bp, Homo sapiens
aacagccgtcagccaaatgtaa

SEQ ID NO: 4015621 - DNA, 16 bp, Homo sapiens
aaaaatgttggattta

SEQ ID NO: 4015622 - DNA, 20 bp, Homo sapiens
aaaaatgttggatttataaa

SEQ ID NO: 4015623 - DNA, 19 bp, Homo sapiens
aaaaattatctatagctaa

SEQ ID NO: 4015624 - DNA, 11 bp, Homo sapiens
aaaaattatta

SEQ ID NO: 4015625 - DNA, 19 bp, Homo sapiens
aaaaattattgattgcttt

SEQ ID NO: 4015626 - DNA, 21 bp, Homo sapiens
aaaaattcagagtccttgcaa

SEQ ID NO: 4015627 - DNA, 22 bp, Homo sapiens
aaaaattcagcaaaccattttt

SEQ ID NO: 4015628 - DNA, 16 bp, Homo sapiens
aaaaatttaagcattg

SEQ ID NO: 4015629 - DNA, 13 bp, Homo sapiens
aaaacaaaaggca

SEQ ID NO: 4015630 - DNA, 15 bp, Homo sapiens
aaaacacaagcaaaa

SEQ ID NO: 4015631 - DNA, 22 bp, Homo sapiens
aaaacaccgcttctgccttttc

SEQ ID NO: 4015632 - DNA, 10 bp, Homo sapiens
aaaacactaa

SEQ ID NO: 4015633 - DNA, 20 bp, Homo sapiens
aaaacagcattgctttctga

SEQ ID NO: 4015634 - DNA, 19 bp, Homo sapiens
aaaacagctgcattagaaa

SEQ ID NO: 4015635 - DNA, 19 bp, Homo sapiens
aaaacaggtatatactttg

SEQ ID NO: 4015636 - DNA, 16 bp, Homo sapiens
aaaacagtatttattt

SEQ ID NO: 4015637 - DNA, 17 bp, Homo sapiens
aaaacagtatttatttt

SEQ ID NO: 4015638 - DNA, 18 bp, Homo sapiens
aaaacagtatttattttg

SEQ ID NO: 4015639 - DNA, 21 bp, Homo sapiens
aaaacagtatttattttgtaa

SEQ ID NO: 4015640 - DNA, 15 bp, Homo sapiens
aaaacatgtttattt

SEQ ID NO: 4015641 - DNA, 19 bp, Homo sapiens
aaaacatgtttatttttct

SEQ ID NO: 4015642 - DNA, 18 bp, Homo sapiens
aaaacatttggcagaaaa

SEQ ID NO: 4015643 - DNA, 23 bp, Homo sapiens
aaaacatttttaatttaacaaac

SEQ ID NO: 4015644 - DNA, 21 bp, Homo sapiens
aaaacattttttaatagaata

SEQ ID NO: 4015645 - DNA, 13 bp, Homo sapiens
aaaaccaaagagg

SEQ ID NO: 4015646 - DNA, 22 bp, Homo sapiens
aaaaccaaagagggcttcctct

SEQ ID NO: 4015647 - DNA, 16 bp, Homo sapiens
aaaaccactagaactc

SEQ ID NO: 4015648 - DNA, 17 bp, Homo sapiens
aaaaccactagaactct

SEQ ID NO: 4015649 - DNA, 12 bp, Homo sapiens
aaaaccaggcct

SEQ ID NO: 4015650 - DNA, 19 bp, Homo sapiens
aaaaccgtgtttgtctctt

SEQ ID NO: 4015651 - DNA, 23 bp, Homo sapiens
aaaaccgtgtttgtctcttctgg

SEQ ID NO: 4015652 - DNA, 14 bp, Homo sapiens
aaaacgcatggagt

SEQ ID NO: 4015653 - DNA, 19 bp, Homo sapiens
aaaacgttttattgtgttt

SEQ ID NO: 4015654 - DNA, 20 bp, Homo sapiens
aaaactaagctctttgagaa

SEQ ID NO: 4015655 - DNA, 21 bp, Homo sapiens
aaaactacaaatcaagtattt

SEQ ID NO: 4015656 - DNA, 22 bp, Homo sapiens
aaaactaggtaatgttttgtat

SEQ ID NO: 4015657 - DNA, 21 bp, Homo sapiens
aaaactataaatacaaatctg

SEQ ID NO: 4015658 - DNA, 15 bp, Homo sapiens
aaaactcactgtgat

SEQ ID NO: 4015659 - DNA, 22 bp, Homo sapiens
aaaactgggattaagaaacctt

SEQ ID NO: 4015660 - DNA, 20 bp, Homo sapiens
aaaactgtacatttaaaatt

SEQ ID NO: 4015661 - DNA, 21 bp, Homo sapiens
aaaacttcacatttatgtggc

SEQ ID NO: 4015662 - DNA, 20 bp, Homo sapiens
aaaacttgaaaatatatgat

SEQ ID NO: 4015663 - DNA, 21 bp, Homo sapiens
aaaacttgactccatttcatc

SEQ ID NO: 4015664 - DNA, 13 bp, Homo sapiens
aaaacttggcact

SEQ ID NO: 4015665 - DNA, 17 bp, Homo sapiens
aaaacttgtaaatgctg

SEQ ID NO: 4015666 - DNA, 14 bp, Homo sapiens
aaaactttcctcgc

SEQ ID NO: 4015667 - DNA, 16 bp, Homo sapiens
aaaactttcctcgcct

SEQ ID NO: 4015668 - DNA, 17 bp, Homo sapiens
aaaactttgactttgcc

SEQ ID NO: 4015669 - DNA, 11 bp, Homo sapiens
aaaactttgga

SEQ ID NO: 4015670 - DNA, 17 bp, Homo sapiens
aaaagaaaaaaaaaaga

SEQ ID NO: 4015671 - DNA, 10 bp, Homo sapiens
aaaagaaaca

SEQ ID NO: 4015672 - DNA, 16 bp, Homo sapiens
aaaagaatacagaaag

SEQ ID NO: 4015673 - DNA, 12 bp, Homo sapiens
aaaagaattacc

SEQ ID NO: 4015674 - DNA, 19 bp, Homo sapiens
aaaagagataataagatta

SEQ ID NO: 4015675 - DNA, 13 bp, Homo sapiens
aaaagataaagat

SEQ ID NO: 4015676 - DNA, 17 bp, Homo sapiens
aaaagataaagatgatc

SEQ ID NO: 4015677 - DNA, 20 bp, Homo sapiens
aaaagatacgactttatttt

SEQ ID NO: 4015678 - DNA, 12 bp, Homo sapiens
aaaagattaatg

SEQ ID NO: 4015679 - DNA, 13 bp, Homo sapiens
aaaagattagcaa

SEQ ID NO: 4015680 - DNA, 13 bp, Homo sapiens
aaaagatttgttt

SEQ ID NO: 4015681 - DNA, 14 bp, Homo sapiens
aaaagcaaatgaga

SEQ ID NO: 4015682 - DNA, 20 bp, Homo sapiens
aaaagcaagtactctggagc

SEQ ID NO: 4015683 - DNA, 17 bp, Homo sapiens
aaaagcacatacattaa

SEQ ID NO: 4015684 - DNA, 22 bp, Homo sapiens
aaaagcacatacattaaaacta

SEQ ID NO: 4015685 - DNA, 19 bp, Homo sapiens
aaaagcacttttgttattc

SEQ ID NO: 4015686 - DNA, 20 bp, Homo sapiens
aaaagcagaattttaatgtg

SEQ ID NO: 4015687 - DNA, 15 bp, Homo sapiens
aaaagcataaatgca

SEQ ID NO: 4015688 - DNA, 17 bp, Homo sapiens
aaaagcatgatgggaaa

SEQ ID NO: 4015689 - DNA, 19 bp, Homo sapiens
aaaagcatgatgggaaaat

SEQ ID NO: 4015690 - DNA, 20 bp, Homo sapiens
aaaagcatgatgggaaaata

SEQ ID NO: 4015691 - DNA, 17 bp, Homo sapiens
aaaagcatttttcaata

SEQ ID NO: 4015692 - DNA, 11 bp, Homo sapiens
aaaagccaagc

SEQ ID NO: 4015693 - DNA, 17 bp, Homo sapiens
aaaagccactagactct

SEQ ID NO: 4015694 - DNA, 15 bp, Homo sapiens
aaaagccatatcatg

SEQ ID NO: 4015695 - DNA, 21 bp, Homo sapiens
aaaagcctcaactagtcattt

SEQ ID NO: 4015696 - DNA, 15 bp, Homo sapiens
aaaagcctggttttt

SEQ ID NO: 4015697 - DNA, 11 bp, Homo sapiens
aaaagccttgt

SEQ ID NO: 4015698 - DNA, 14 bp, Homo sapiens
aaaagccttgtgta

SEQ ID NO: 4015699 - DNA, 23 bp, Homo sapiens
aaaagccttgtgtatatttgtat

SEQ ID NO: 4015700 - DNA, 17 bp, Homo sapiens
aaaagctattagccagg

SEQ ID NO: 4015701 - DNA, 21 bp, Homo sapiens
aaaagctattagccaggatca

SEQ ID NO: 4015702 - DNA, 15 bp, Homo sapiens
aaaagctcttttaat

SEQ ID NO: 4015703 - DNA, 18 bp, Homo sapiens
aaaagctgtggaatgaag

SEQ ID NO: 4015704 - DNA, 17 bp, Homo sapiens
aaaagcttccctccctg

SEQ ID NO: 4015705 - DNA, 18 bp, Homo sapiens
aaaaggaaaaataatcaa

SEQ ID NO: 4015706 - DNA, 14 bp, Homo sapiens
aaaaggaaaagcaa

SEQ ID NO: 4015707 - DNA, 21 bp, Homo sapiens
aaaaggaaacttcagttgatc

SEQ ID NO: 4015708 - DNA, 14 bp, Homo sapiens
aaaaggaaagaaaa

SEQ ID NO: 4015709 - DNA, 23 bp, Homo sapiens
aaaaggaacagttgcatttagct

SEQ ID NO: 4015710 - DNA, 14 bp, Homo sapiens
aaaaggaagactag

SEQ ID NO: 4015711 - DNA, 15 bp, Homo sapiens
aaaaggaagactaga

SEQ ID NO: 4015712 - DNA, 18 bp, Homo sapiens
aaaaggaagccaaagagt

SEQ ID NO: 4015713 - DNA, 19 bp, Homo sapiens
aaaaggagccttttgctct

SEQ ID NO: 4015714 - DNA, 15 bp, Homo sapiens
aaaaggcgcatctaa

SEQ ID NO: 4015715 - DNA, 15 bp, Homo sapiens
aaaagggaagaaact

SEQ ID NO: 4015716 - DNA, 16 bp, Homo sapiens
aaaagggaagaaactg

SEQ ID NO: 4015717 - DNA, 13 bp, Homo sapiens
aaaagggacagca

SEQ ID NO: 4015718 - DNA, 18 bp, Homo sapiens
aaaagggtcaaacctgta

SEQ ID NO: 4015719 - DNA, 19 bp, Homo sapiens
aaaaggtggagtttctctg

SEQ ID NO: 4015720 - DNA, 19 bp, Homo sapiens
aaaaggttaatttttcctt

SEQ ID NO: 4015721 - DNA, 11 bp, Homo sapiens
aaaagtaaaca

SEQ ID NO: 4015722 - DNA, 21 bp, Homo sapiens
aaaagtacatttaatacagca

SEQ ID NO: 4015723 - DNA, 14 bp, Homo sapiens
aaaagtatatgtta

SEQ ID NO: 4015724 - DNA, 19 bp, Homo sapiens
acctcttccggagatgtag

SEQ ID NO: 4015725 - DNA, 14 bp, Homo sapiens
acctcttgctgtct

SEQ ID NO: 4015726 - DNA, 16 bp, Homo sapiens
acctcttgctgtctct

SEQ ID NO: 4015727 - DNA, 17 bp, Homo sapiens
acctcttgctgtctctg

SEQ ID NO: 4015728 - DNA, 24 bp, Homo sapiens
acctcttgctgtctctgctcgccc

SEQ ID NO: 4015729 - DNA, 15 bp, Homo sapiens
acctcttgtgcaagg

SEQ ID NO: 4015730 - DNA, 20 bp, Homo sapiens
acctcttgtgcaaggtggcc

SEQ ID NO: 4015731 - DNA, 18 bp, Homo sapiens
acctcttttctgcatcat

SEQ ID NO: 4015732 - DNA, 16 bp, Homo sapiens
acctgaagactgagga

SEQ ID NO: 4015733 - DNA, 15 bp, Homo sapiens
acctgacacatcttg

SEQ ID NO: 4015734 - DNA, 22 bp, Homo sapiens
acctgacagatgtcagccgagc

SEQ ID NO: 4015735 - DNA, 17 bp, Homo sapiens
acctgacagcccctccc

SEQ ID NO: 4015736 - DNA, 16 bp, Homo sapiens
acctgactaagaaatt

SEQ ID NO: 4015737 - DNA, 20 bp, Homo sapiens
acctgactggttaacagcag

SEQ ID NO: 4015738 - DNA, 23 bp, Homo sapiens
acctgagaccagttgggagcact

SEQ ID NO: 4015739 - DNA, 21 bp, Homo sapiens
acctgagactgtcggagaggc

SEQ ID NO: 4015740 - DNA, 21 bp, Homo sapiens
acctgagcccggatgcttctc

SEQ ID NO: 4015741 - DNA, 20 bp, Homo sapiens
acctgagctggccaggccct

SEQ ID NO: 4015742 - DNA, 20 bp, Homo sapiens
acctgaggacatggcttctg

SEQ ID NO: 4015743 - DNA, 23 bp, Homo sapiens
acctgagggcagaaaggttctgc

SEQ ID NO: 4015744 - DNA, 18 bp, Homo sapiens
acctgatcactagcctgt

SEQ ID NO: 4015745 - DNA, 19 bp, Homo sapiens
acctgatcactagcctgtc

SEQ ID NO: 4015746 - DNA, 22 bp, Homo sapiens
acctgatcctggaggcccagtt

SEQ ID NO: 4015747 - DNA, 11 bp, Homo sapiens
acctgcacact

SEQ ID NO: 4015748 - DNA, 17 bp, Homo sapiens
acctgcacactccatct

SEQ ID NO: 4015749 - DNA, 18 bp, Homo sapiens
acctgcacactccatctc

SEQ ID NO: 4015750 - DNA, 20 bp, Homo sapiens
acctgcacactccatctcct

SEQ ID NO: 4015751 - DNA, 20 bp, Homo sapiens
acctgcacgttcataaccaa

SEQ ID NO: 4015752 - DNA, 15 bp, Homo sapiens
agcttgctccctgtg

SEQ ID NO: 4015753 - DNA, 19 bp, Homo sapiens
agcttggaggtcacagctg

SEQ ID NO: 4015754 - DNA, 18 bp, Homo sapiens
agcttgggaggcttcccc

SEQ ID NO: 4015755 - DNA, 12 bp, Homo sapiens
agcttgggcagt

SEQ ID NO: 4015756 - DNA, 19 bp, Homo sapiens
agcttgggcagtgccccag

SEQ ID NO: 4015757 - DNA, 20 bp, Homo sapiens
agcttgggcagtgccccagg

SEQ ID NO: 4015758 - DNA, 17 bp, Homo sapiens
agcttgtatgcaatgga

SEQ ID NO: 4015759 - DNA, 18 bp, Homo sapiens
agcttgtatgcaatggat

SEQ ID NO: 4015760 - DNA, 18 bp, Homo sapiens
agcttgtggcccctttta

SEQ ID NO: 4015761 - DNA, 23 bp, Homo sapiens
agcttgtggccccttttactttt

SEQ ID NO: 4015762 - DNA, 16 bp, Homo sapiens
agcttgttatttataa

SEQ ID NO: 4015763 - DNA, 15 bp, Homo sapiens
agcttgttctgggct

SEQ ID NO: 4015764 - DNA, 19 bp, Homo sapiens
agcttgttctgggctcagg

SEQ ID NO: 4015765 - DNA, 17 bp, Homo sapiens
agctttaccctcaggca

SEQ ID NO: 4015766 - DNA, 22 bp, Homo sapiens
agctttagaccctgggtgggct

SEQ ID NO: 4015767 - DNA, 23 bp, Homo sapiens
agctttatgttcatttgtttgtt

SEQ ID NO: 4015768 - DNA, 19 bp, Homo sapiens
agctttattttttaagtat

SEQ ID NO: 4015769 - DNA, 22 bp, Homo sapiens
agctttattttttaagtattta

SEQ ID NO: 4015770 - DNA, 22 bp, Homo sapiens
agctttcctgccccaggcctga

SEQ ID NO: 4015771 - DNA, 21 bp, Homo sapiens
agctttctaagagaagcaatt

SEQ ID NO: 4015772 - DNA, 22 bp, Homo sapiens
agctttctgtccttttggcact

SEQ ID NO: 4015773 - DNA, 11 bp, Homo sapiens
agctttcttct

SEQ ID NO: 4015774 - DNA, 17 bp, Homo sapiens
agctttgccagctgctg

SEQ ID NO: 4015775 - DNA, 12 bp, Homo sapiens
agctttgtgttt

SEQ ID NO: 4015776 - DNA, 12 bp, Homo sapiens
agcttttaaaaa

SEQ ID NO: 4015777 - DNA, 14 bp, Homo sapiens
agcttttactgttt

SEQ ID NO: 4015778 - DNA, 14 bp, Homo sapiens
agcttttcattgct

SEQ ID NO: 4015779 - DNA, 14 bp, Homo sapiens
agctttttaattgt

SEQ ID NO: 4015780 - DNA, 21 bp, Homo sapiens
agctttttaattgttgtttct

SEQ ID NO: 4015781 - DNA, 22 bp, Homo sapiens
agctttttaattgttgtttctt

SEQ ID NO: 4015782 - DNA, 21 bp, Homo sapiens
agcttttttccttaatccagc

SEQ ID NO: 4015783 - DNA, 15 bp, Homo sapiens
aggaaaaaaatgact

SEQ ID NO: 4015784 - DNA, 23 bp, Homo sapiens
aggaaaaaatgttggatttataa

SEQ ID NO: 4015785 - DNA, 21 bp, Homo sapiens
aggaaaaccaagccgtggctt

SEQ ID NO: 4015786 - DNA, 23 bp, Homo sapiens
aggaaaaccaagccgtggcttcc

SEQ ID NO: 4015787 - DNA, 16 bp, Homo sapiens
aggaaaacctgaagac

SEQ ID NO: 4015788 - DNA, 16 bp, Homo sapiens
aggaaaagcaaattga

SEQ ID NO: 4015789 - DNA, 15 bp, Homo sapiens
aggaaaaggaaaaaa

SEQ ID NO: 4015790 - DNA, 16 bp, Homo sapiens
aggaaaatagtaatgt

SEQ ID NO: 4015791 - DNA, 16 bp, Homo sapiens
aggaaaatagtttagg

SEQ ID NO: 4015792 - DNA, 19 bp, Homo sapiens
aggaaaatagtttaggaga

SEQ ID NO: 4015793 - DNA, 21 bp, Homo sapiens
aggaaaccgcctagtttactg

SEQ ID NO: 4015794 - DNA, 19 bp, Homo sapiens
aggaaactccacatctgcc

SEQ ID NO: 4015795 - DNA, 22 bp, Homo sapiens
aggaaactccacatctgcctta

SEQ ID NO: 4015796 - DNA, 17 bp, Homo sapiens
aggaaactcttatctca

SEQ ID NO: 4015797 - DNA, 18 bp, Homo sapiens
aggaaactcttatctcag

SEQ ID NO: 4015798 - DNA, 15 bp, Homo sapiens
aggaaactgaagcat

SEQ ID NO: 4015799 - DNA, 17 bp, Homo sapiens
aggaaagaggaagcaaa

SEQ ID NO: 4015800 - DNA, 16 bp, Homo sapiens
aggaaagcaataaatg

SEQ ID NO: 4015801 - DNA, 13 bp, Homo sapiens
aggaaagccctcc

SEQ ID NO: 4015802 - DNA, 23 bp, Homo sapiens
aggaaagccctcccccttcccct

SEQ ID NO: 4015803 - DNA, 18 bp, Homo sapiens
aggaaagtcaagaagaat

SEQ ID NO: 4015804 - DNA, 18 bp, Homo sapiens
aggaaatccattgtttaa

SEQ ID NO: 4015805 - DNA, 20 bp, Homo sapiens
aggaaatccattgtttaaag

SEQ ID NO: 4015806 - DNA, 23 bp, Homo sapiens
aggaaatgtcacagaagcagcta

SEQ ID NO: 4015807 - DNA, 14 bp, Homo sapiens
aggaacagtggctg

SEQ ID NO: 4015808 - DNA, 22 bp, Homo sapiens
aggaaccgtggtatgtctgcca

SEQ ID NO: 4015809 - DNA, 14 bp, Homo sapiens
aggaaccttccttc

SEQ ID NO: 4015810 - DNA, 19 bp, Homo sapiens
aggaaccttccttcctgct

SEQ ID NO: 4015811 - DNA, 20 bp, Homo sapiens
aggaaccttccttcctgctt

SEQ ID NO: 4015812 - DNA, 21 bp, Homo sapiens
aggaactcgcacctgtgctgg

SEQ ID NO: 4015813 - DNA, 16 bp, Homo sapiens
aggaactctggcttcc

SEQ ID NO: 4015814 - DNA, 21 bp, Homo sapiens
aggaactctggcttccaggta

SEQ ID NO: 4015815 - DNA, 17 bp, Homo sapiens
aggaactgtccagagag

SEQ ID NO: 4015816 - DNA, 14 bp, Homo sapiens
aggaacttccaggt

SEQ ID NO: 4015817 - DNA, 14 bp, Homo sapiens
aggaagagaaacca

SEQ ID NO: 4015818 - DNA, 17 bp, Homo sapiens
aggaagagggctgagct

SEQ ID NO: 4015819 - DNA, 21 bp, Homo sapiens
aggaagagggctgagctgagc

SEQ ID NO: 4015820 - DNA, 19 bp, Homo sapiens
aggaagcaaatagaagaga

SEQ ID NO: 4015821 - DNA, 15 bp, Homo sapiens
aggaagccaaagagt

SEQ ID NO: 4015822 - DNA, 12 bp, Homo sapiens
aggaagccagag

SEQ ID NO: 4015823 - DNA, 19 bp, Homo sapiens
aggaagccagagccccaag

SEQ ID NO: 4015824 - DNA, 15 bp, Homo sapiens
aggaagccaggctga

SEQ ID NO: 4015825 - DNA, 12 bp, Homo sapiens
aggaaggaaaga

SEQ ID NO: 4015826 - DNA, 15 bp, Homo sapiens
aggaaggacaggaag

SEQ ID NO: 4015827 - DNA, 17 bp, Homo sapiens
aggaaggagagcctgct

SEQ ID NO: 4015828 - DNA, 14 bp, Homo sapiens
aggaaggaggggag

SEQ ID NO: 4015829 - DNA, 14 bp, Homo sapiens
aggaaggattgtaa

SEQ ID NO: 4015830 - DNA, 12 bp, Homo sapiens
aggaaggtagcc

SEQ ID NO: 4015831 - DNA, 16 bp, Homo sapiens
aggaaggtagcccagc

SEQ ID NO: 4015832 - DNA, 22 bp, Homo sapiens
aggaagtgagcagtcgcctgcc

SEQ ID NO: 4015833 - DNA, 18 bp, Homo sapiens
aggaagtgtaacagctga

SEQ ID NO: 4015834 - DNA, 18 bp, Homo sapiens
aggaagttgacttatagt

SEQ ID NO: 4015835 - DNA, 22 bp, Homo sapiens
aggaagttgacttatagtacat

SEQ ID NO: 4015836 - DNA, 15 bp, Homo sapiens
aggaagttttctgta

SEQ ID NO: 4015837 - DNA, 13 bp, Homo sapiens
aggaataaataaa

SEQ ID NO: 4015838 - DNA, 21 bp, Homo sapiens
aggaataaatgagagggaatc

SEQ ID NO: 4015839 - DNA, 16 bp, Homo sapiens
aggaatcaagagctgc

SEQ ID NO: 4015840 - DNA, 19 bp, Homo sapiens
aggaatcaagagctgccct

SEQ ID NO: 4015841 - DNA, 21 bp, Homo sapiens
aggaatcaagagctgccctcc

SEQ ID NO: 4015842 - DNA, 22 bp, Homo sapiens
aggaatctgtgggtctgggagt

SEQ ID NO: 4015843 - DNA, 15 bp, Homo sapiens
aggaatgctctgtgc

SEQ ID NO: 4015844 - DNA, 18 bp, Homo sapiens
aggaatgtagctggtttc

SEQ ID NO: 4015845 - DNA, 12 bp, Homo sapiens
aggaattatgtc

SEQ ID NO: 4015846 - DNA, 13 bp, Homo sapiens
aggaattcctctt

SEQ ID NO: 4015847 - DNA, 15 bp, Homo sapiens
aggaatttcccagga

SEQ ID NO: 4015848 - DNA, 20 bp, Homo sapiens
aggaatttgatgattttcat

SEQ ID NO: 4015849 - DNA, 13 bp, Homo sapiens
aggacacactaat

SEQ ID NO: 4015850 - DNA, 12 bp, Homo sapiens
aggacactcccg

SEQ ID NO: 4015851 - DNA, 14 bp, Homo sapiens
aggacacttccgta

SEQ ID NO: 4015852 - DNA, 22 bp, Homo sapiens
aggacagaaggctcctgccccc

SEQ ID NO: 4015853 - DNA, 14 bp, Homo sapiens
aggacagagttcac

SEQ ID NO: 4015854 - DNA, 21 bp, Homo sapiens
aggcagagaaagaagagacag

SEQ ID NO: 4015855 - DNA, 22 bp, Homo sapiens
aggcagagaaagaagagacagg

SEQ ID NO: 4015856 - DNA, 14 bp, Homo sapiens
aggcagagcccaga

SEQ ID NO: 4015857 - DNA, 13 bp, Homo sapiens
aggcagagctgga

SEQ ID NO: 4015858 - DNA, 20 bp, Homo sapiens
aggcagagctggagccccca

SEQ ID NO: 4015859 - DNA, 23 bp, Homo sapiens
aggcagagctggagcccccagca

SEQ ID NO: 4015860 - DNA, 19 bp, Homo sapiens
aggcagagttctgtgaaga

SEQ ID NO: 4015861 - DNA, 15 bp, Homo sapiens
aggcagattgaaaag

SEQ ID NO: 4015862 - DNA, 20 bp, Homo sapiens
aggcagcaagtcttaacaaa

SEQ ID NO: 4015863 - DNA, 22 bp, Homo sapiens
aggcagcagagagagaggacag

SEQ ID NO: 4015864 - DNA, 13 bp, Homo sapiens
aggcagcccagca

SEQ ID NO: 4015865 - DNA, 20 bp, Homo sapiens
aggcagcccagcagtgtgga

SEQ ID NO: 4015866 - DNA, 15 bp, Homo sapiens
aggcagcccagccct

SEQ ID NO: 4015867 - DNA, 13 bp, Homo sapiens
aggcagccccctc

SEQ ID NO: 4015868 - DNA, 14 bp, Homo sapiens
aggcagccccctcc

SEQ ID NO: 4015869 - DNA, 16 bp, Homo sapiens
aggcagccccctccac

SEQ ID NO: 4015870 - DNA, 17 bp, Homo sapiens
aggcagccccctccaca

SEQ ID NO: 4015871 - DNA, 13 bp, Homo sapiens
aggcagccgccct

SEQ ID NO: 4015872 - DNA, 16 bp, Homo sapiens
aggcagcctccagcct

SEQ ID NO: 4015873 - DNA, 19 bp, Homo sapiens
aggcagcgccaagtgcgtg

SEQ ID NO: 4015874 - DNA, 12 bp, Homo sapiens
aggcagctcacc

SEQ ID NO: 4015875 - DNA, 20 bp, Homo sapiens
aggcagctcacccctgggca

SEQ ID NO: 4015876 - DNA, 21 bp, Homo sapiens
aggcagctcacccctgggcag

SEQ ID NO: 4015877 - DNA, 17 bp, Homo sapiens
aggcaggaagggcagga

SEQ ID NO: 4015878 - DNA, 14 bp, Homo sapiens
aggcaggccgactg

SEQ ID NO: 4015879 - DNA, 13 bp, Homo sapiens
aggcaggctggga

SEQ ID NO: 4015880 - DNA, 23 bp, Homo sapiens
aggcaggctgggacggaccagca

SEQ ID NO: 4015881 - DNA, 16 bp, Homo sapiens
aggcagggctctcccg

SEQ ID NO: 4015882 - DNA, 17 bp, Homo sapiens
aggcaggggccctgcag

SEQ ID NO: 4015883 - DNA, 19 bp, Homo sapiens
aggcaggggccctgcagct

SEQ ID NO: 4015884 - DNA, 23 bp, Homo sapiens
aggcagggggaaggtggggtcct

SEQ ID NO: 4015885 - DNA, 15 bp, Homo sapiens
aggcaggggtggggg

SEQ ID NO: 4015886 - DNA, 16 bp, Homo sapiens
aggcaggggtgggggt

SEQ ID NO: 4015887 - DNA, 19 bp, Homo sapiens
aggcaggggtgggggtgga

SEQ ID NO: 4015888 - DNA, 21 bp, Homo sapiens
aggcagggtcccatttctcac

SEQ ID NO: 4015889 - DNA, 23 bp, Homo sapiens
aggcagtaggacaaggtgcaggc

SEQ ID NO: 4015890 - DNA, 19 bp, Homo sapiens
aggcagtattttgtgtcct

SEQ ID NO: 4015891 - DNA, 21 bp, Homo sapiens
aggcagtattttgtgtcctcc

SEQ ID NO: 4015892 - DNA, 19 bp, Homo sapiens
aggcagttgcccagcctct

SEQ ID NO: 4015893 - DNA, 20 bp, Homo sapiens
aggcagttgcccagcctctt

SEQ ID NO: 4015894 - DNA, 20 bp, Homo sapiens
aggcatacgagagcagaggt

SEQ ID NO: 4015895 - DNA, 21 bp, Homo sapiens
aggcatacgagagcagaggtc

SEQ ID NO: 4015896 - DNA, 15 bp, Homo sapiens
aggcatagaggcttc

SEQ ID NO: 4015897 - DNA, 20 bp, Homo sapiens
aggcatatcttctatatctg

SEQ ID NO: 4015898 - DNA, 22 bp, Homo sapiens
aggcatatcttctatatctgaa

SEQ ID NO: 4015899 - DNA, 20 bp, Homo sapiens
aggcatattgctttttctaa

SEQ ID NO: 4015900 - DNA, 21 bp, Homo sapiens
aggcatcagtccccctgtgca

SEQ ID NO: 4015901 - DNA, 14 bp, Homo sapiens
aggcatcccagcct

SEQ ID NO: 4015902 - DNA, 15 bp, Homo sapiens
aggcatcccagcctg

SEQ ID NO: 4015903 - DNA, 23 bp, Homo sapiens
aggcatcccagcctgggggccag

SEQ ID NO: 4015904 - DNA, 17 bp, Homo sapiens
aggcatctacacagcct

SEQ ID NO: 4015905 - DNA, 20 bp, Homo sapiens
aggcatctacacagcctgga

SEQ ID NO: 4015906 - DNA, 15 bp, Homo sapiens
aggcatgcacatctg

SEQ ID NO: 4015907 - DNA, 18 bp, Homo sapiens
aggcatgcacatctggaa

SEQ ID NO: 4015908 - DNA, 13 bp, Homo sapiens
aggcatggccctg

SEQ ID NO: 4015909 - DNA, 21 bp, Homo sapiens
aggcatggccctggggtccca

SEQ ID NO: 4015910 - DNA, 23 bp, Homo sapiens
aggcatggctcagagcttgaaga

SEQ ID NO: 4015911 - DNA, 22 bp, Homo sapiens
aggcatgtcccatgtgagctgc

SEQ ID NO: 4015912 - DNA, 23 bp, Homo sapiens
aggcatgtgtcaccatgcccagc

SEQ ID NO: 4015913 - DNA, 18 bp, Homo sapiens
aggcatttcccaccctga

SEQ ID NO: 4015914 - DNA, 12 bp, Homo sapiens
aggcatttccta

SEQ ID NO: 4015915 - DNA, 18 bp, Homo sapiens
aggcatttgcagggtcct

SEQ ID NO: 4015916 - DNA, 11 bp, Homo sapiens
aggcatttgtt

SEQ ID NO: 4015917 - DNA, 17 bp, Homo sapiens
aggccaaactgtccctc

SEQ ID NO: 4015918 - DNA, 19 bp, Homo sapiens
aggccaaactgtccctccc

SEQ ID NO: 4015919 - DNA, 17 bp, Homo sapiens
aggccaaaggctggtgg

SEQ ID NO: 4015920 - DNA, 15 bp, Homo sapiens
aggccaataaaaagt

SEQ ID NO: 4015921 - DNA, 17 bp, Homo sapiens
aggccaataaaaagttc

SEQ ID NO: 4015922 - DNA, 20 bp, Homo sapiens
aggccacacgcactggtgcc

SEQ ID NO: 4015923 - DNA, 21 bp, Homo sapiens
aggccacacgcactggtgcca

SEQ ID NO: 4015924 - DNA, 20 bp, Homo sapiens
aggccacatccacagtctcc

SEQ ID NO: 4015925 - DNA, 12 bp, Homo sapiens
aggccaccagga

SEQ ID NO: 4015926 - DNA, 23 bp, Homo sapiens
aggccaccccctatcctctgagt

SEQ ID NO: 4015927 - DNA, 22 bp, Homo sapiens
aggccaccctgtgcagaaggga

SEQ ID NO: 4015928 - DNA, 21 bp, Homo sapiens
aggccaccgggacagacctgg

SEQ ID NO: 4015929 - DNA, 22 bp, Homo sapiens
aggccaccgggacagacctgga

SEQ ID NO: 4015930 - DNA, 22 bp, Homo sapiens
aggccagagtggcctggccagg

SEQ ID NO: 4015931 - DNA, 12 bp, Homo sapiens
aggccagcaacg

SEQ ID NO: 4015932 - DNA, 14 bp, Homo sapiens
aggccagcccagcc

SEQ ID NO: 4015933 - DNA, 19 bp, Homo sapiens
aggccagcccagccaggcc

SEQ ID NO: 4015934 - DNA, 13 bp, Homo sapiens
aggccagccccac

SEQ ID NO: 4015935 - DNA, 15 bp, Homo sapiens
aggccagccccaccc

SEQ ID NO: 4015936 - DNA, 16 bp, Homo sapiens
aggccagccccaccca

SEQ ID NO: 4015937 - DNA, 17 bp, Homo sapiens
aggccagccccacccag

SEQ ID NO: 4015938 - DNA, 11 bp, Homo sapiens
aggccagcctc

SEQ ID NO: 4015939 - DNA, 13 bp, Homo sapiens
aggccagcctccg

SEQ ID NO: 4015940 - DNA, 17 bp, Homo sapiens
aggccagcctccgagag

SEQ ID NO: 4015941 - DNA, 18 bp, Homo sapiens
aggccagcctccgagagg

SEQ ID NO: 4015942 - DNA, 14 bp, Homo sapiens
aggccaggccacca

SEQ ID NO: 4015943 - DNA, 16 bp, Homo sapiens
aggccaggccaccagg

SEQ ID NO: 4015944 - DNA, 17 bp, Homo sapiens
aggccaggccaccagga

SEQ ID NO: 4015945 - DNA, 22 bp, Homo sapiens
aggccagtccccatttctgcct

SEQ ID NO: 4015946 - DNA, 13 bp, Homo sapiens
aggccagtgtctg

SEQ ID NO: 4015947 - DNA, 17 bp, Homo sapiens
aggccatctcaggagat

SEQ ID NO: 4015948 - DNA, 19 bp, Homo sapiens
aggccatctcaggagatgg

SEQ ID NO: 4015949 - DNA, 16 bp, Homo sapiens
aggccatgatggcctt

SEQ ID NO: 4015950 - DNA, 16 bp, Homo sapiens
aggccatggaggcagt

SEQ ID NO: 4015951 - DNA, 15 bp, Homo sapiens
aggccatgtgagcca

SEQ ID NO: 4015952 - DNA, 16 bp, Homo sapiens
aggccatgtgagccac

SEQ ID NO: 4015953 - DNA, 22 bp, Homo sapiens
aggccatgtgagccaccgctgc

SEQ ID NO: 4015954 - DNA, 20 bp, Homo sapiens
aggcccaagagcagagtctg

SEQ ID NO: 4015955 - DNA, 15 bp, Homo sapiens
aggcccaaggctccc

SEQ ID NO: 4015956 - DNA, 20 bp, Homo sapiens
agggaggtcactggaaaggg

SEQ ID NO: 4015957 - DNA, 21 bp, Homo sapiens
agggaggtcactggaaagggg

SEQ ID NO: 4015958 - DNA, 19 bp, Homo sapiens
agggagtacctgctgcccc

SEQ ID NO: 4015959 - DNA, 14 bp, Homo sapiens
agggagtcagctgt

SEQ ID NO: 4015960 - DNA, 12 bp, Homo sapiens
agggagtccagg

SEQ ID NO: 4015961 - DNA, 18 bp, Homo sapiens
agggagtgctggctcaca

SEQ ID NO: 4015962 - DNA, 24 bp, Homo sapiens
agggagtgctggctcacagtacag

SEQ ID NO: 4015963 - DNA, 22 bp, Homo sapiens
agggatacgagcggagtcccct

SEQ ID NO: 4015964 - DNA, 21 bp, Homo sapiens
agggatcaaccagctaagaaa

SEQ ID NO: 4015965 - DNA, 20 bp, Homo sapiens
agggatctcagaggctcaga

SEQ ID NO: 4015966 - DNA, 20 bp, Homo sapiens
agggatcttgcattcccagt

SEQ ID NO: 4015967 - DNA, 16 bp, Homo sapiens
agggatgaagaaagac

SEQ ID NO: 4015968 - DNA, 17 bp, Homo sapiens
agggatgaagggcgagt

SEQ ID NO: 4015969 - DNA, 15 bp, Homo sapiens
agggatgctgctccg

SEQ ID NO: 4015970 - DNA, 18 bp, Homo sapiens
agggatgctgctccgccc

SEQ ID NO: 4015971 - DNA, 17 bp, Homo sapiens
agggatgctgggctggg

SEQ ID NO: 4015972 - DNA, 17 bp, Homo sapiens
agggatggagaggcggc

SEQ ID NO: 4015973 - DNA, 18 bp, Homo sapiens
agggatggagaggcggcc

SEQ ID NO: 4015974 - DNA, 16 bp, Homo sapiens
agggatgggggatggg

SEQ ID NO: 4015975 - DNA, 20 bp, Homo sapiens
agggatgggggatgggccag

SEQ ID NO: 4015976 - DNA, 22 bp, Homo sapiens
agggatgtgaattgcctgcaga

SEQ ID NO: 4015977 - DNA, 23 bp, Homo sapiens
agggatgtgaattgcctgcagag

SEQ ID NO: 4015978 - DNA, 16 bp, Homo sapiens
agggattcaggctgct

SEQ ID NO: 4015979 - DNA, 19 bp, Homo sapiens
agggattcaggctgcttgg

SEQ ID NO: 4015980 - DNA, 23 bp, Homo sapiens
agggattctgggcttggggtgtg

SEQ ID NO: 4015981 - DNA, 13 bp, Homo sapiens
agggatttccctg

SEQ ID NO: 4015982 - DNA, 14 bp, Homo sapiens
agggatttccctgc

SEQ ID NO: 4015983 - DNA, 21 bp, Homo sapiens
agggcaagggttaaggcctga

SEQ ID NO: 4015984 - DNA, 15 bp, Homo sapiens
agggcaatctttgcc

SEQ ID NO: 4015985 - DNA, 14 bp, Homo sapiens
agggcacagccctc

SEQ ID NO: 4015986 - DNA, 16 bp, Homo sapiens
agggcactggtggccc

SEQ ID NO: 4015987 - DNA, 17 bp, Homo sapiens
agggcactggtggcccg

SEQ ID NO: 4015988 - DNA, 19 bp, Homo sapiens
agggcagaaaggttctgcc

SEQ ID NO: 4015989 - DNA, 19 bp, Homo sapiens
agggcagagggagaatcca

SEQ ID NO: 4015990 - DNA, 14 bp, Homo sapiens
agggcagcgccagg

SEQ ID NO: 4015991 - DNA, 17 bp, Homo sapiens
agggcagcgccaggctg

SEQ ID NO: 4015992 - DNA, 18 bp, Homo sapiens
agggcaggaaggagagcc

SEQ ID NO: 4015993 - DNA, 23 bp, Homo sapiens
agggcaggaaggagagcctgctg

SEQ ID NO: 4015994 - DNA, 22 bp, Homo sapiens
agggcaggatggcctttccttc

SEQ ID NO: 4015995 - DNA, 21 bp, Homo sapiens
agggcagggtgggcagcctat

SEQ ID NO: 4015996 - DNA, 15 bp, Homo sapiens
agggcagtaccctcc

SEQ ID NO: 4015997 - DNA, 13 bp, Homo sapiens
agggcatctcctg

SEQ ID NO: 4015998 - DNA, 14 bp, Homo sapiens
agggcatctcctgt

SEQ ID NO: 4015999 - DNA, 17 bp, Homo sapiens
agggcatcttagcttct

SEQ ID NO: 4016000 - DNA, 13 bp, Homo sapiens
agggcatcttgct

SEQ ID NO: 4016001 - DNA, 18 bp, Homo sapiens
agggcatgcattttgcag

SEQ ID NO: 4016002 - DNA, 15 bp, Homo sapiens
agggcatgccttgtg

SEQ ID NO: 4016003 - DNA, 16 bp, Homo sapiens
agggcatgccttgtgc

SEQ ID NO: 4016004 - DNA, 15 bp, Homo sapiens
agggcatgtgtatgt

SEQ ID NO: 4016005 - DNA, 21 bp, Homo sapiens
agggcattcgggccacagggc

SEQ ID NO: 4016006 - DNA, 15 bp, Homo sapiens
agggccacgctccag

SEQ ID NO: 4016007 - DNA, 16 bp, Homo sapiens
agggccacgctccagc

SEQ ID NO: 4016008 - DNA, 17 bp, Homo sapiens
agggccacgctccagct

SEQ ID NO: 4016009 - DNA, 12 bp, Homo sapiens
agggccagaggg

SEQ ID NO: 4016010 - DNA, 16 bp, Homo sapiens
agggccagagggagct

SEQ ID NO: 4016011 - DNA, 10 bp, Homo sapiens
agggccaggc

SEQ ID NO: 4016012 - DNA, 13 bp, Homo sapiens
agggccaggcagg

SEQ ID NO: 4016013 - DNA, 14 bp, Homo sapiens
agggccaggcaggt

SEQ ID NO: 4016014 - DNA, 21 bp, Homo sapiens
agggccaggcaggtgcctgga

SEQ ID NO: 4016015 - DNA, 13 bp, Homo sapiens
agggccagtcctg

SEQ ID NO: 4016016 - DNA, 17 bp, Homo sapiens
agggccagtcctgcctg

SEQ ID NO: 4016017 - DNA, 18 bp, Homo sapiens
agggccagtcctgcctgg

SEQ ID NO: 4016018 - DNA, 15 bp, Homo sapiens
agggccagtctgggc

SEQ ID NO: 4016019 - DNA, 17 bp, Homo sapiens
agggccagtggggcctg

SEQ ID NO: 4016020 - DNA, 17 bp, Homo sapiens
agggccatgcctgcccc

SEQ ID NO: 4016021 - DNA, 18 bp, Homo sapiens
agggccatgctgaaggga

SEQ ID NO: 4016022 - DNA, 17 bp, Homo sapiens
agggcccaccccagcct

SEQ ID NO: 4016023 - DNA, 20 bp, Homo sapiens
agggcccaccccagcctcgc

SEQ ID NO: 4016024 - DNA, 17 bp, Homo sapiens
agggcccagagcaggaa

SEQ ID NO: 4016025 - DNA, 18 bp, Homo sapiens
agggcccagagcaggaag

SEQ ID NO: 4016026 - DNA, 14 bp, Homo sapiens
agggcccagagccc

SEQ ID NO: 4016027 - DNA, 17 bp, Homo sapiens
agggcccagagcccagc

SEQ ID NO: 4016028 - DNA, 18 bp, Homo sapiens
agggcccagagcccagct

SEQ ID NO: 4016029 - DNA, 12 bp, Homo sapiens
agggcccagccc

SEQ ID NO: 4016030 - DNA, 22 bp, Homo sapiens
agggcccagcccagagccacct

SEQ ID NO: 4016031 - DNA, 19 bp, Homo sapiens
agggcccctcaccctgcct

SEQ ID NO: 4016032 - DNA, 20 bp, Homo sapiens
agggcccctgggcccctctt

SEQ ID NO: 4016033 - DNA, 19 bp, Homo sapiens
agggcccgcagtgctggga

SEQ ID NO: 4016034 - DNA, 13 bp, Homo sapiens
agggccctaggcc

SEQ ID NO: 4016035 - DNA, 14 bp, Homo sapiens
agggccctggccag

SEQ ID NO: 4016036 - DNA, 14 bp, Homo sapiens
agggcctccagggc

SEQ ID NO: 4016037 - DNA, 19 bp, Homo sapiens
agggcctcccaccagagac

SEQ ID NO: 4016038 - DNA, 17 bp, Homo sapiens
agggcctgacaccccct

SEQ ID NO: 4016039 - DNA, 18 bp, Homo sapiens
agggcctgacaccccctc

SEQ ID NO: 4016040 - DNA, 20 bp, Homo sapiens
agggcctgacaccccctccc

SEQ ID NO: 4016041 - DNA, 12 bp, Homo sapiens
agggcctgctgg

SEQ ID NO: 4016042 - DNA, 16 bp, Homo sapiens
agggcctgctggaggc

SEQ ID NO: 4016043 - DNA, 23 bp, Homo sapiens
agggcctgctggaggcctcaggt

SEQ ID NO: 4016044 - DNA, 14 bp, Homo sapiens
agggcctggagccc

SEQ ID NO: 4016045 - DNA, 21 bp, Homo sapiens
agggcctggagccccatcggc

SEQ ID NO: 4016046 - DNA, 23 bp, Homo sapiens
agggcctggcaggccagtgtctg

SEQ ID NO: 4016047 - DNA, 15 bp, Homo sapiens
agggcctggggcctg

SEQ ID NO: 4016048 - DNA, 19 bp, Homo sapiens
agggcctggggcctgagag

SEQ ID NO: 4016049 - DNA, 21 bp, Homo sapiens
agggcctggggcctgagagaa

SEQ ID NO: 4016050 - DNA, 13 bp, Homo sapiens
agggcgagactcc

SEQ ID NO: 4016051 - DNA, 13 bp, Homo sapiens
agggcgctcagac

SEQ ID NO: 4016052 - DNA, 14 bp, Homo sapiens
agggcgctcagacg

SEQ ID NO: 4016053 - DNA, 18 bp, Homo sapiens
agggcgggcagagggctg

SEQ ID NO: 4016054 - DNA, 16 bp, Homo sapiens
agggctagcatccctg

SEQ ID NO: 4016055 - DNA, 18 bp, Homo sapiens
agggctcgaggggtgggc

SEQ ID NO: 4016056 - DNA, 23 bp, Homo sapiens
agggctctaaaaaaagccccaaa

SEQ ID NO: 4016057 - DNA, 21 bp, Homo sapiens
agggctctgatattccatgaa

SEQ ID NO: 4016058 - DNA, 22 bp, Homo sapiens
agggctctgatattccatgaat

SEQ ID NO: 4016059 - DNA, 17 bp, Homo sapiens
agggctgagctgagctt

SEQ ID NO: 4016060 - DNA, 17 bp, Homo sapiens
agggctgatggaggaaa

SEQ ID NO: 4016061 - DNA, 19 bp, Homo sapiens
agggctgatggaggaaaaa

SEQ ID NO: 4016062 - DNA, 14 bp, Homo sapiens
agggctgccagcag

SEQ ID NO: 4016063 - DNA, 16 bp, Homo sapiens
agggctgccctgagaa

SEQ ID NO: 4016064 - DNA, 15 bp, Homo sapiens
agggctggaggccca

SEQ ID NO: 4016065 - DNA, 16 bp, Homo sapiens
agggctggaggcccag

SEQ ID NO: 4016066 - DNA, 17 bp, Homo sapiens
agggctggaggcccagg

SEQ ID NO: 4016067 - DNA, 19 bp, Homo sapiens
agggctggccccagggcac

SEQ ID NO: 4016068 - DNA, 14 bp, Homo sapiens
agggctggctcccc

SEQ ID NO: 4016069 - DNA, 12 bp, Homo sapiens
agggctggctct

SEQ ID NO: 4016070 - DNA, 12 bp, Homo sapiens
agggctgtccca

SEQ ID NO: 4016071 - DNA, 14 bp, Homo sapiens
agggctgtcccagc

SEQ ID NO: 4016072 - DNA, 18 bp, Homo sapiens
agggctgtcccagccccg

SEQ ID NO: 4016073 - DNA, 17 bp, Homo sapiens
agggctgtgtgaaacat

SEQ ID NO: 4016074 - DNA, 22 bp, Homo sapiens
agggcttcctctagaagccaag

SEQ ID NO: 4016075 - DNA, 15 bp, Homo sapiens
agggctttggttcct

SEQ ID NO: 4016076 - DNA, 19 bp, Homo sapiens
agggctttggttccttctc

SEQ ID NO: 4016077 - DNA, 21 bp, Homo sapiens
agggctttggttccttctctg

SEQ ID NO: 4016078 - DNA, 13 bp, Homo sapiens
aggggaaaatgaa

SEQ ID NO: 4016079 - DNA, 16 bp, Homo sapiens
aggggaaggccctgag

SEQ ID NO: 4016080 - DNA, 14 bp, Homo sapiens
aggggaagggccag

SEQ ID NO: 4016081 - DNA, 21 bp, Homo sapiens
aggggaagggctttgagggtg

SEQ ID NO: 4016082 - DNA, 15 bp, Homo sapiens
aggggaatcagaact

SEQ ID NO: 4016083 - DNA, 22 bp, Homo sapiens
aggggacaagggatttgaggtg

SEQ ID NO: 4016084 - DNA, 17 bp, Homo sapiens
aggggactcagccctga

SEQ ID NO: 4016085 - DNA, 12 bp, Homo sapiens
aggggactgggg

SEQ ID NO: 4016086 - DNA, 20 bp, Homo sapiens
aggggactgggggactggga

SEQ ID NO: 4016087 - DNA, 16 bp, Homo sapiens
aggggagacaggagcc

SEQ ID NO: 4016088 - DNA, 14 bp, Homo sapiens
aggggagagacagg

SEQ ID NO: 4016089 - DNA, 22 bp, Homo sapiens
aggggagagcctgctggcaccc

SEQ ID NO: 4016090 - DNA, 23 bp, Homo sapiens
aggggagcaaaatcgatgcagtg

SEQ ID NO: 4016091 - DNA, 15 bp, Homo sapiens
aggggagccaggagg

SEQ ID NO: 4016092 - DNA, 16 bp, Homo sapiens
aggggagccaggaggg

SEQ ID NO: 4016093 - DNA, 10 bp, Homo sapiens
aggggaggag

SEQ ID NO: 4016094 - DNA, 13 bp, Homo sapiens
aggggaggagatg

SEQ ID NO: 4016095 - DNA, 21 bp, Homo sapiens
aggggaggcagccggcaccca

SEQ ID NO: 4016096 - DNA, 16 bp, Homo sapiens
aggggagttgtgtctg

SEQ ID NO: 4016097 - DNA, 20 bp, Homo sapiens
aggggcaacgaagaaaaaaa

SEQ ID NO: 4016098 - DNA, 22 bp, Homo sapiens
aggggcacactacagagcagct

SEQ ID NO: 4016099 - DNA, 15 bp, Homo sapiens
aggggcagaggaggc

SEQ ID NO: 4016100 - DNA, 14 bp, Homo sapiens
aggggcagcctgcc

SEQ ID NO: 4016101 - DNA, 18 bp, Homo sapiens
aggggcagcctgccttgc

SEQ ID NO: 4016102 - DNA, 15 bp, Homo sapiens
aggggcaggactgag

SEQ ID NO: 4016103 - DNA, 20 bp, Homo sapiens
aggggcaggactgagtcccc

SEQ ID NO: 4016104 - DNA, 15 bp, Homo sapiens
aggggcatctgcccc

SEQ ID NO: 4016105 - DNA, 16 bp, Homo sapiens
aggggcatctgcccct

SEQ ID NO: 4016106 - DNA, 20 bp, Homo sapiens
aggggcatctgcccctcccc

SEQ ID NO: 4016107 - DNA, 22 bp, Homo sapiens
aggggccagaggaactgtccag

SEQ ID NO: 4016108 - DNA, 23 bp, Homo sapiens
aggggccggggaagctgccagcc

SEQ ID NO: 4016109 - DNA, 15 bp, Homo sapiens
aggggcctggcagcc

SEQ ID NO: 4016110 - DNA, 20 bp, Homo sapiens
aggggccttagggcactggg

SEQ ID NO: 4016111 - DNA, 22 bp, Homo sapiens
aggggccttagggcactgggct

SEQ ID NO: 4016112 - DNA, 17 bp, Homo sapiens
aggggcggcaggaggga

SEQ ID NO: 4016113 - DNA, 20 bp, Homo sapiens
aggggcggcaggagggaggt

SEQ ID NO: 4016114 - DNA, 18 bp, Homo sapiens
aggggcggtgcccacacc

SEQ ID NO: 4016115 - DNA, 19 bp, Homo sapiens
aggggctgtggccgtctcc

SEQ ID NO: 4016116 - DNA, 21 bp, Homo sapiens
aggggctgtggccgtctcctc

SEQ ID NO: 4016117 - DNA, 21 bp, Homo sapiens
aggggcttataataaaggact

SEQ ID NO: 4016118 - DNA, 15 bp, Homo sapiens
aggggctttctcttc

SEQ ID NO: 4016119 - DNA, 21 bp, Homo sapiens
agggggagccccttctgctca

SEQ ID NO: 4016120 - DNA, 23 bp, Homo sapiens
agggggagccggtaactgtcctg

SEQ ID NO: 4016121 - DNA, 16 bp, Homo sapiens
agggggatgccactcc

SEQ ID NO: 4016122 - DNA, 23 bp, Homo sapiens
agggggatgccactcctccctcc

SEQ ID NO: 4016123 - DNA, 22 bp, Homo sapiens
agggggccccgccagggctggg

SEQ ID NO: 4016124 - DNA, 23 bp, Homo sapiens
agggggccccgccagggctgggg

SEQ ID NO: 4016125 - DNA, 13 bp, Homo sapiens
agggggctggcca

SEQ ID NO: 4016126 - DNA, 14 bp, Homo sapiens
agggggctggccat

SEQ ID NO: 4016127 - DNA, 19 bp, Homo sapiens
agggggcttgaagccaaag

SEQ ID NO: 4016128 - DNA, 17 bp, Homo sapiens
aggggggagggggaggg

SEQ ID NO: 4016129 - DNA, 20 bp, Homo sapiens
aggggggttgcagtggagag

SEQ ID NO: 4016130 - DNA, 16 bp, Homo sapiens
agggggtcattgttct

SEQ ID NO: 4016131 - DNA, 15 bp, Homo sapiens
agggggtccgtggaa

SEQ ID NO: 4016132 - DNA, 15 bp, Homo sapiens
agggggtggaggggt

SEQ ID NO: 4016133 - DNA, 12 bp, Homo sapiens
agggggttacaa

SEQ ID NO: 4016134 - DNA, 15 bp, Homo sapiens
aggggtagggagcct

SEQ ID NO: 4016135 - DNA, 19 bp, Homo sapiens
aggggtcccagccaccccg

SEQ ID NO: 4016136 - DNA, 16 bp, Homo sapiens
aggggtcccctctgga

SEQ ID NO: 4016137 - DNA, 16 bp, Homo sapiens
aggggtccttggtgtg

SEQ ID NO: 4016138 - DNA, 19 bp, Homo sapiens
aggggtctccctggagtgc

SEQ ID NO: 4016139 - DNA, 13 bp, Homo sapiens
aggggtctgtctg

SEQ ID NO: 4016140 - DNA, 13 bp, Homo sapiens
aggggtgatttca

SEQ ID NO: 4016141 - DNA, 13 bp, Homo sapiens
aggggtgggctgg

SEQ ID NO: 4016142 - DNA, 18 bp, Homo sapiens
aggggtggggagatgctt

SEQ ID NO: 4016143 - DNA, 18 bp, Homo sapiens
aggggtggggggtgcagg

SEQ ID NO: 4016144 - DNA, 13 bp, Homo sapiens
aggggtggtcctg

SEQ ID NO: 4016145 - DNA, 16 bp, Homo sapiens
aggggtgtggcagtgg

SEQ ID NO: 4016146 - DNA, 20 bp, Homo sapiens
aggggttcctcaaatttttt

SEQ ID NO: 4016147 - DNA, 15 bp, Homo sapiens
aggggttgagggaag

SEQ ID NO: 4016148 - DNA, 18 bp, Homo sapiens
aggggttgcagtgagcgg

SEQ ID NO: 4016149 - DNA, 18 bp, Homo sapiens
aggggttggtgggagggt

SEQ ID NO: 4016150 - DNA, 22 bp, Homo sapiens
agggtaaataaaccactgtgcg

SEQ ID NO: 4016151 - DNA, 17 bp, Homo sapiens
agggtacccgcctgagc

SEQ ID NO: 4016152 - DNA, 21 bp, Homo sapiens
agggtaccctttggggagcag

SEQ ID NO: 4016153 - DNA, 15 bp, Homo sapiens
agggtactaaattta

SEQ ID NO: 4016154 - DNA, 17 bp, Homo sapiens
agggtactaaatttaaa

SEQ ID NO: 4016155 - DNA, 13 bp, Homo sapiens
agggtaggaaagg

SEQ ID NO: 4016156 - DNA, 19 bp, Homo sapiens
agggtcaaagacagaatgg

SEQ ID NO: 4016157 - DNA, 18 bp, Homo sapiens
agggtccccacctgggac

SEQ ID NO: 4016158 - DNA, 14 bp, Homo sapiens
agggtcctggctcc

SEQ ID NO: 4016159 - DNA, 17 bp, Homo sapiens
agggtcctggctcctga

SEQ ID NO: 4016160 - DNA, 21 bp, Homo sapiens
agggtcctggctcctgagggg

SEQ ID NO: 4016161 - DNA, 22 bp, Homo sapiens
agggtcggaacccaagcttaga

SEQ ID NO: 4016162 - DNA, 23 bp, Homo sapiens
acttacaaactttgtttgtcaca

SEQ ID NO: 4016163 - DNA, 16 bp, Homo sapiens
acttacactttatgca

SEQ ID NO: 4016164 - DNA, 12 bp, Homo sapiens
acttactatttt

SEQ ID NO: 4016165 - DNA, 16 bp, Homo sapiens
acttagaaattgcatt

SEQ ID NO: 4016166 - DNA, 14 bp, Homo sapiens
acttagaggaaaat

SEQ ID NO: 4016167 - DNA, 15 bp, Homo sapiens
acttagaggaaaatg

SEQ ID NO: 4016168 - DNA, 16 bp, Homo sapiens
acttagaggaaaatga

SEQ ID NO: 4016169 - DNA, 17 bp, Homo sapiens
acttagagtttctgttt

SEQ ID NO: 4016170 - DNA, 20 bp, Homo sapiens
acttagagtttctgtttgat

SEQ ID NO: 4016171 - DNA, 23 bp, Homo sapiens
acttagcagcaactgaagacaat

SEQ ID NO: 4016172 - DNA, 14 bp, Homo sapiens
acttagcatcctaa

SEQ ID NO: 4016173 - DNA, 21 bp, Homo sapiens
acttagcatcctaagaaatat

SEQ ID NO: 4016174 - DNA, 23 bp, Homo sapiens
acttagggccaagtcttgggtct

SEQ ID NO: 4016175 - DNA, 19 bp, Homo sapiens
acttataaatcatattgat

SEQ ID NO: 4016176 - DNA, 13 bp, Homo sapiens
acttatattgaag

SEQ ID NO: 4016177 - DNA, 22 bp, Homo sapiens
acttatctctctgtgctgtgga

SEQ ID NO: 4016178 - DNA, 14 bp, Homo sapiens
acttatgtttttaa

SEQ ID NO: 4016179 - DNA, 14 bp, Homo sapiens
acttattagaaacc

SEQ ID NO: 4016180 - DNA, 18 bp, Homo sapiens
acttatttaaaaatattt

SEQ ID NO: 4016181 - DNA, 21 bp, Homo sapiens
acttatttaaaaatatttcag

SEQ ID NO: 4016182 - DNA, 11 bp, Homo sapiens
acttatttcac

SEQ ID NO: 4016183 - DNA, 23 bp, Homo sapiens
acttatttcactatcttcttcaa

SEQ ID NO: 4016184 - DNA, 11 bp, Homo sapiens
acttatttctg

SEQ ID NO: 4016185 - DNA, 12 bp, Homo sapiens
acttatttctgc

SEQ ID NO: 4016186 - DNA, 13 bp, Homo sapiens
acttatttctgct

SEQ ID NO: 4016187 - DNA, 16 bp, Homo sapiens
acttatttcttcaaat

SEQ ID NO: 4016188 - DNA, 17 bp, Homo sapiens
acttattttatttccat

SEQ ID NO: 4016189 - DNA, 12 bp, Homo sapiens
acttatttttct

SEQ ID NO: 4016190 - DNA, 13 bp, Homo sapiens
acttatttttctg

SEQ ID NO: 4016191 - DNA, 18 bp, Homo sapiens
acttcaagggagaatata

SEQ ID NO: 4016192 - DNA, 16 bp, Homo sapiens
acttcaagttaaagtg

SEQ ID NO: 4016193 - DNA, 19 bp, Homo sapiens
acttcaatgggctcttcca

SEQ ID NO: 4016194 - DNA, 14 bp, Homo sapiens
acttcaattaatgc

SEQ ID NO: 4016195 - DNA, 17 bp, Homo sapiens
acttcagaagcaaacaa

SEQ ID NO: 4016196 - DNA, 15 bp, Homo sapiens
acttcagagagctgg

SEQ ID NO: 4016197 - DNA, 16 bp, Homo sapiens
acttcagagagctggt

SEQ ID NO: 4016198 - DNA, 20 bp, Homo sapiens
acttcagagagctggtagtt

SEQ ID NO: 4016199 - DNA, 15 bp, Homo sapiens
acttcagctgcctga

SEQ ID NO: 4016200 - DNA, 21 bp, Homo sapiens
acttcagctgcctgaaacagc

SEQ ID NO: 4016201 - DNA, 14 bp, Homo sapiens
acttcaggctcttc

SEQ ID NO: 4016202 - DNA, 17 bp, Homo sapiens
acttcaggctcttctcc

SEQ ID NO: 4016203 - DNA, 14 bp, Homo sapiens
acttcatattgctg

SEQ ID NO: 4016204 - DNA, 22 bp, Homo sapiens
acttcatattgctgagagaaat

SEQ ID NO: 4016205 - DNA, 19 bp, Homo sapiens
acttcatgacaagcatttt

SEQ ID NO: 4016206 - DNA, 14 bp, Homo sapiens
acttcatgtcaact

SEQ ID NO: 4016207 - DNA, 14 bp, Homo sapiens
acttcattcttgaa

SEQ ID NO: 4016208 - DNA, 20 bp, Homo sapiens
acttcatttaaaaaaatcac

SEQ ID NO: 4016209 - DNA, 14 bp, Homo sapiens
acttccaaaattct

SEQ ID NO: 4016210 - DNA, 16 bp, Homo sapiens
acttccaaaattctta

SEQ ID NO: 4016211 - DNA, 20 bp, Homo sapiens
acttccaaacctgacagatg

SEQ ID NO: 4016212 - DNA, 16 bp, Homo sapiens
acttccaggggaacct

SEQ ID NO: 4016213 - DNA, 17 bp, Homo sapiens
acttccatgaggccaaa

SEQ ID NO: 4016214 - DNA, 17 bp, Homo sapiens
acttcccaacagcctta

SEQ ID NO: 4016215 - DNA, 22 bp, Homo sapiens
acttcccagttcaggagtccca

SEQ ID NO: 4016216 - DNA, 22 bp, Homo sapiens
acttccctgattgacctgctcc

SEQ ID NO: 4016217 - DNA, 22 bp, Homo sapiens
acttccctgctccaacccccgc

SEQ ID NO: 4016218 - DNA, 22 bp, Homo sapiens
acttccctttctgcttgtgtta

SEQ ID NO: 4016219 - DNA, 13 bp, Homo sapiens
acttccgctgagg

SEQ ID NO: 4016220 - DNA, 22 bp, Homo sapiens
acttccgctgaggggtctcgga

SEQ ID NO: 4016221 - DNA, 17 bp, Homo sapiens
acttcctcctccccact

SEQ ID NO: 4016222 - DNA, 21 bp, Homo sapiens
acttcctgattggtttctctt

SEQ ID NO: 4016223 - DNA, 23 bp, Homo sapiens
acttcctgattggtttctcttct

SEQ ID NO: 4016224 - DNA, 16 bp, Homo sapiens
acttcctgctacagga

SEQ ID NO: 4016225 - DNA, 18 bp, Homo sapiens
acttcctgctacaggagg

SEQ ID NO: 4016226 - DNA, 18 bp, Homo sapiens
acttcctgctgcaccctg

SEQ ID NO: 4016227 - DNA, 12 bp, Homo sapiens
acttcctgtact

SEQ ID NO: 4016228 - DNA, 22 bp, Homo sapiens
acttccttgagacacggagccc

SEQ ID NO: 4016229 - DNA, 14 bp, Homo sapiens
acttccttgccagt

SEQ ID NO: 4016230 - DNA, 16 bp, Homo sapiens
acttcgggctgtgtaa

SEQ ID NO: 4016231 - DNA, 18 bp, Homo sapiens
acttcgtcttctaatttc

SEQ ID NO: 4016232 - DNA, 20 bp, Homo sapiens
acttcgtcttctaatttcaa

SEQ ID NO: 4016233 - DNA, 20 bp, Homo sapiens
acttgagtgttcctttttaa

SEQ ID NO: 4016234 - DNA, 22 bp, Homo sapiens
acttgagtgttcctttttaaat

SEQ ID NO: 4016235 - DNA, 20 bp, Homo sapiens
acttgatagcaaacactggg

SEQ ID NO: 4016236 - DNA, 20 bp, Homo sapiens
acttgatgtgccattttaaa

SEQ ID NO: 4016237 - DNA, 17 bp, Homo sapiens
acttgattaagatttta

SEQ ID NO: 4016238 - DNA, 23 bp, Homo sapiens
acttgattaagattttacaaaag

SEQ ID NO: 4016239 - DNA, 12 bp, Homo sapiens
acttgatttgat

SEQ ID NO: 4016240 - DNA, 15 bp, Homo sapiens
acttgatttgatgtg

SEQ ID NO: 4016241 - DNA, 14 bp, Homo sapiens
acttgattttttca

SEQ ID NO: 4016242 - DNA, 15 bp, Homo sapiens
acttgattttttcaa

SEQ ID NO: 4016243 - DNA, 23 bp, Homo sapiens
acttgcactgggggaacagatgc

SEQ ID NO: 4016244 - DNA, 22 bp, Homo sapiens
acttgccgtcccctaaggaaat

SEQ ID NO: 4016245 - DNA, 22 bp, Homo sapiens
acttgcctaactaactggcagg

SEQ ID NO: 4016246 - DNA, 21 bp, Homo sapiens
acttgcgagtccaaggccagt

SEQ ID NO: 4016247 - DNA, 14 bp, Homo sapiens
acttgctcccaacc

SEQ ID NO: 4016248 - DNA, 13 bp, Homo sapiens
acttgctgctgtc

SEQ ID NO: 4016249 - DNA, 15 bp, Homo sapiens
acttgctgctgtctt

SEQ ID NO: 4016250 - DNA, 19 bp, Homo sapiens
acttgcttaaatttcttat

SEQ ID NO: 4016251 - DNA, 16 bp, Homo sapiens
acttgcttctctagct

SEQ ID NO: 4016252 - DNA, 18 bp, Homo sapiens
acttggaatttgtaacct

SEQ ID NO: 4016253 - DNA, 21 bp, Homo sapiens
acttggaatttgtaacctcag

SEQ ID NO: 4016254 - DNA, 13 bp, Homo sapiens
acttggattctct

SEQ ID NO: 4016255 - DNA, 22 bp, Homo sapiens
acttgggaggctgaggcaggag

SEQ ID NO: 4016256 - DNA, 20 bp, Homo sapiens
acttgggggttcaggcccgg

SEQ ID NO: 4016257 - DNA, 16 bp, Homo sapiens
acttgggtgacggcag

SEQ ID NO: 4016258 - DNA, 20 bp, Homo sapiens
acttggttggtagggtggga

SEQ ID NO: 4016259 - DNA, 12 bp, Homo sapiens
acttggtttgtg

SEQ ID NO: 4016260 - DNA, 15 bp, Homo sapiens
acttgtaaatacacc

SEQ ID NO: 4016261 - DNA, 17 bp, Homo sapiens
acttgtaatatttttat

SEQ ID NO: 4016262 - DNA, 16 bp, Homo sapiens
acttgtagagcagatg

SEQ ID NO: 4016263 - DNA, 14 bp, Homo sapiens
acttgtatatttta

SEQ ID NO: 4016264 - DNA, 16 bp, Homo sapiens
acttgtctttttctgg

SEQ ID NO: 4016265 - DNA, 19 bp, Homo sapiens
acttgtgaaacacagctgt

SEQ ID NO: 4016266 - DNA, 20 bp, Homo sapiens
acttgtgattatttattatt

SEQ ID NO: 4016267 - DNA, 15 bp, Homo sapiens
acttgtgctttgctc

SEQ ID NO: 4016268 - DNA, 14 bp, Homo sapiens
acttgtgtttgctt

SEQ ID NO: 4016269 - DNA, 19 bp, Homo sapiens
acttgtgtttgcttaaaca

SEQ ID NO: 4016270 - DNA, 17 bp, Homo sapiens
acttgttttatgctcag

SEQ ID NO: 4016271 - DNA, 21 bp, Homo sapiens
actttaaaaaatatttattaa

SEQ ID NO: 4016272 - DNA, 20 bp, Homo sapiens
actttaaaggaaaaaatgtt

SEQ ID NO: 4016273 - DNA, 21 bp, Homo sapiens
actttaaaggaaaaaatgttg

SEQ ID NO: 4016274 - DNA, 22 bp, Homo sapiens
actttaagctccttgagtaaaa

SEQ ID NO: 4016275 - DNA, 15 bp, Homo sapiens
actttaagtttcagg

SEQ ID NO: 4016276 - DNA, 18 bp, Homo sapiens
actttaagtttcaggata

SEQ ID NO: 4016277 - DNA, 18 bp, Homo sapiens
actttacagaaatggact

SEQ ID NO: 4016278 - DNA, 15 bp, Homo sapiens
actttacgcccatct

SEQ ID NO: 4016279 - DNA, 19 bp, Homo sapiens
actttagaagtgcatttct

SEQ ID NO: 4016280 - DNA, 19 bp, Homo sapiens
actttagggtaaaaattgc

SEQ ID NO: 4016281 - DNA, 12 bp, Homo sapiens
actttatacatt

SEQ ID NO: 4016282 - DNA, 19 bp, Homo sapiens
actttatacattagtaaat

SEQ ID NO: 4016283 - DNA, 14 bp, Homo sapiens
actttatcaattaa

SEQ ID NO: 4016284 - DNA, 15 bp, Homo sapiens
actttattaaataca

SEQ ID NO: 4016285 - DNA, 16 bp, Homo sapiens
actttatttatttcta

SEQ ID NO: 4016286 - DNA, 17 bp, Homo sapiens
actttatttatttctag

SEQ ID NO: 4016287 - DNA, 18 bp, Homo sapiens
actttcaaaattaaatct

SEQ ID NO: 4016288 - DNA, 14 bp, Homo sapiens
actttcactttgaa

SEQ ID NO: 4016289 - DNA, 16 bp, Homo sapiens
actttcactttgaaaa

SEQ ID NO: 4016290 - DNA, 21 bp, Homo sapiens
actttcatcctgactctgccc

SEQ ID NO: 4016291 - DNA, 18 bp, Homo sapiens
actttccaattctccttt

SEQ ID NO: 4016292 - DNA, 16 bp, Homo sapiens
actttcccaggttctg

SEQ ID NO: 4016293 - DNA, 15 bp, Homo sapiens
actttcgtacattgg

SEQ ID NO: 4016294 - DNA, 16 bp, Homo sapiens
actttcgtacattggc

SEQ ID NO: 4016295 - DNA, 15 bp, Homo sapiens
actttctaatgtttc

SEQ ID NO: 4016296 - DNA, 17 bp, Homo sapiens
actttctacaatgtgaa

SEQ ID NO: 4016297 - DNA, 21 bp, Homo sapiens
actttctacaatgtgaacttt

SEQ ID NO: 4016298 - DNA, 15 bp, Homo sapiens
actttctatgtgaca

SEQ ID NO: 4016299 - DNA, 16 bp, Homo sapiens
actttctatgtgacat

SEQ ID NO: 4016300 - DNA, 12 bp, Homo sapiens
actttctgattg

SEQ ID NO: 4016301 - DNA, 20 bp, Homo sapiens
actttgaaaggagatgtctt

SEQ ID NO: 4016302 - DNA, 15 bp, Homo sapiens
agaaagtaaaaaagg

SEQ ID NO: 4016303 - DNA, 16 bp, Homo sapiens
agaaagtgtgagcaaa

SEQ ID NO: 4016304 - DNA, 20 bp, Homo sapiens
agaaagtgttttattttcaa

SEQ ID NO: 4016305 - DNA, 24 bp, Homo sapiens
agaaagtgttttattttcaaatct

SEQ ID NO: 4016306 - DNA, 21 bp, Homo sapiens
agaaataaagtttgcttagaa

SEQ ID NO: 4016307 - DNA, 15 bp, Homo sapiens
agaaataaatagcta

SEQ ID NO: 4016308 - DNA, 17 bp, Homo sapiens
agaaataaattcctaaa

SEQ ID NO: 4016309 - DNA, 23 bp, Homo sapiens
agaaataaattcctaaactccct

SEQ ID NO: 4016310 - DNA, 17 bp, Homo sapiens
agaaataaatttatttc

SEQ ID NO: 4016311 - DNA, 15 bp, Homo sapiens
agaaatatgaaattc

SEQ ID NO: 4016312 - DNA, 13 bp, Homo sapiens
agaaatatgattt

SEQ ID NO: 4016313 - DNA, 15 bp, Homo sapiens
agaaatatgatttta

SEQ ID NO: 4016314 - DNA, 16 bp, Homo sapiens
agaaatatgattttat

SEQ ID NO: 4016315 - DNA, 13 bp, Homo sapiens
agaaatatgtgag

SEQ ID NO: 4016316 - DNA, 14 bp, Homo sapiens
agaaatatgtgaga

SEQ ID NO: 4016317 - DNA, 15 bp, Homo sapiens
agaaatatgtgagat

SEQ ID NO: 4016318 - DNA, 15 bp, Homo sapiens
agaaatatgtggttt

SEQ ID NO: 4016319 - DNA, 15 bp, Homo sapiens
agaaatatttaccta

SEQ ID NO: 4016320 - DNA, 17 bp, Homo sapiens
agaaatcaaagagagaa

SEQ ID NO: 4016321 - DNA, 19 bp, Homo sapiens
agaaatccctgtttaatat

SEQ ID NO: 4016322 - DNA, 14 bp, Homo sapiens
agaaatctagaaga

SEQ ID NO: 4016323 - DNA, 13 bp, Homo sapiens
agaaatgaacaaa

SEQ ID NO: 4016324 - DNA, 12 bp, Homo sapiens
agaaatgaataa

SEQ ID NO: 4016325 - DNA, 14 bp, Homo sapiens
agaaatgctgctgg

SEQ ID NO: 4016326 - DNA, 19 bp, Homo sapiens
agaaatgtccctttcttct

SEQ ID NO: 4016327 - DNA, 19 bp, Homo sapiens
agaaattctgttaaaatct

SEQ ID NO: 4016328 - DNA, 20 bp, Homo sapiens
agaaattctgttaaaatcta

SEQ ID NO: 4016329 - DNA, 21 bp, Homo sapiens
agaaattctgttaaaatctat

SEQ ID NO: 4016330 - DNA, 20 bp, Homo sapiens
agaaattgcatttcctgaca

SEQ ID NO: 4016331 - DNA, 19 bp, Homo sapiens
agaaattggaacagaatgt

SEQ ID NO: 4016332 - DNA, 22 bp, Homo sapiens
agaaattttgtaagaaggcaat

SEQ ID NO: 4016333 - DNA, 23 bp, Homo sapiens
agaaatttttcagatgcttctgg

SEQ ID NO: 4016334 - DNA, 17 bp, Homo sapiens
agaacaaggtagttttt

SEQ ID NO: 4016335 - DNA, 19 bp, Homo sapiens
agaacaaggtagtttttac

SEQ ID NO: 4016336 - DNA, 22 bp, Homo sapiens
agaacacaaagcggggggaggg

SEQ ID NO: 4016337 - DNA, 16 bp, Homo sapiens
agaacactaattcata

SEQ ID NO: 4016338 - DNA, 18 bp, Homo sapiens
agaatgtgttttctgaat

SEQ ID NO: 4016339 - DNA, 22 bp, Homo sapiens
agaatgttcctactcacacttc

SEQ ID NO: 4016340 - DNA, 15 bp, Homo sapiens
agaatgttgtattca

SEQ ID NO: 4016341 - DNA, 18 bp, Homo sapiens
agaatgttttactgtgaa

SEQ ID NO: 4016342 - DNA, 14 bp, Homo sapiens
agaattaaactttt

SEQ ID NO: 4016343 - DNA, 20 bp, Homo sapiens
agaattaaacttttaattca

SEQ ID NO: 4016344 - DNA, 14 bp, Homo sapiens
agaattagattata

SEQ ID NO: 4016345 - DNA, 16 bp, Homo sapiens
agaattatatatttct

SEQ ID NO: 4016346 - DNA, 21 bp, Homo sapiens
agaattatttgccttctgaaa

SEQ ID NO: 4016347 - DNA, 14 bp, Homo sapiens
agaattatttttgt

SEQ ID NO: 4016348 - DNA, 20 bp, Homo sapiens
agaattcaaactggggcctc

SEQ ID NO: 4016349 - DNA, 20 bp, Homo sapiens
agaattccaaggagttccat

SEQ ID NO: 4016350 - DNA, 14 bp, Homo sapiens
agaattcgaaggct

SEQ ID NO: 4016351 - DNA, 14 bp, Homo sapiens
agaattgccaatct

SEQ ID NO: 4016352 - DNA, 13 bp, Homo sapiens
agaattggctcaa

SEQ ID NO: 4016353 - DNA, 16 bp, Homo sapiens
agaattggctcaataa

SEQ ID NO: 4016354 - DNA, 14 bp, Homo sapiens
agaatttagggaga

SEQ ID NO: 4016355 - DNA, 21 bp, Homo sapiens
agaatttatcacacttctgtg

SEQ ID NO: 4016356 - DNA, 13 bp, Homo sapiens
agaatttattcaa

SEQ ID NO: 4016357 - DNA, 17 bp, Homo sapiens
agaatttccactgtaat

SEQ ID NO: 4016358 - DNA, 21 bp, Homo sapiens
agaatttcttggtaagaagcc

SEQ ID NO: 4016359 - DNA, 22 bp, Homo sapiens
agaatttcttggtaagaagccg

SEQ ID NO: 4016360 - DNA, 13 bp, Homo sapiens
agaattttaaatt

SEQ ID NO: 4016361 - DNA, 19 bp, Homo sapiens
agaattttaatgtgaagac

SEQ ID NO: 4016362 - DNA, 18 bp, Homo sapiens
agaattttacttccatta

SEQ ID NO: 4016363 - DNA, 14 bp, Homo sapiens
agaattttaggaac

SEQ ID NO: 4016364 - DNA, 15 bp, Homo sapiens
agacaaaaggaaagg

SEQ ID NO: 4016365 - DNA, 19 bp, Homo sapiens
agacaaatagaaaatggtc

SEQ ID NO: 4016366 - DNA, 18 bp, Homo sapiens
agacaaatggaggaatat

SEQ ID NO: 4016367 - DNA, 14 bp, Homo sapiens
agacaacagaagtc

SEQ ID NO: 4016368 - DNA, 18 bp, Homo sapiens
agacaacgatgaatttct

SEQ ID NO: 4016369 - DNA, 19 bp, Homo sapiens
agacaacgatgaatttctt

SEQ ID NO: 4016370 - DNA, 15 bp, Homo sapiens
agacaagagatggga

SEQ ID NO: 4016371 - DNA, 15 bp, Homo sapiens
agacaagatattgta

SEQ ID NO: 4016372 - DNA, 17 bp, Homo sapiens
agacaagatattgtaca

SEQ ID NO: 4016373 - DNA, 18 bp, Homo sapiens
agacaagatattgtacat

SEQ ID NO: 4016374 - DNA, 19 bp, Homo sapiens
agacaagatattgtacata

SEQ ID NO: 4016375 - DNA, 22 bp, Homo sapiens
agacaagctgttgaccaggcac

SEQ ID NO: 4016376 - DNA, 18 bp, Homo sapiens
agacaagttggaaaaaca

SEQ ID NO: 4016377 - DNA, 15 bp, Homo sapiens
agacaatatacaagc

SEQ ID NO: 4016378 - DNA, 20 bp, Homo sapiens
agacaatatgtgagtgcctt

SEQ ID NO: 4016379 - DNA, 24 bp, Homo sapiens
agcatccatgtgtggactcaagtc

SEQ ID NO: 4016380 - DNA, 13 bp, Homo sapiens
agcatccctggag

SEQ ID NO: 4016381 - DNA, 19 bp, Homo sapiens
agcatccctggagcaggag

SEQ ID NO: 4016382 - DNA, 13 bp, Homo sapiens
agcatcccttccc

SEQ ID NO: 4016383 - DNA, 16 bp, Homo sapiens
agcatcctaagaaata

SEQ ID NO: 4016384 - DNA, 19 bp, Homo sapiens
agcatcctaagaaatatgt

SEQ ID NO: 4016385 - DNA, 22 bp, Homo sapiens
agcatcctaagaaatatgtgag

SEQ ID NO: 4016386 - DNA, 14 bp, Homo sapiens
agcatctggctgtc

SEQ ID NO: 4016387 - DNA, 18 bp, Homo sapiens
agcatcttcacttctaaa

SEQ ID NO: 4016388 - DNA, 20 bp, Homo sapiens
agcatcttcacttctaaatg

SEQ ID NO: 4016389 - DNA, 15 bp, Homo sapiens
agcatgagactttct

SEQ ID NO: 4016390 - DNA, 20 bp, Homo sapiens
agcatgaggtgttgtgcatt

SEQ ID NO: 4016391 - DNA, 22 bp, Homo sapiens
agcatgaggtgttgtgcatttg

SEQ ID NO: 4016392 - DNA, 13 bp, Homo sapiens
agcatgatgggaa

SEQ ID NO: 4016393 - DNA, 19 bp, Homo sapiens
agcatgatgggaaaatatt

SEQ ID NO: 4016394 - DNA, 20 bp, Homo sapiens
agcatgcagaggaggtgaga

SEQ ID NO: 4016395 - DNA, 17 bp, Homo sapiens
agcatgcttcccagagg

SEQ ID NO: 4016396 - DNA, 19 bp, Homo sapiens
agcatgctttctttgagtt

SEQ ID NO: 4016397 - DNA, 13 bp, Homo sapiens
agcatggaaaaat

SEQ ID NO: 4016398 - DNA, 15 bp, Homo sapiens
agcatggaaaaatgg

SEQ ID NO: 4016399 - DNA, 21 bp, Homo sapiens
agcatgtactgagccttgtaa

SEQ ID NO: 4016400 - DNA, 19 bp, Homo sapiens
agcatgtagactgtgccag

SEQ ID NO: 4016401 - DNA, 19 bp, Homo sapiens
agcatgtggatgacacaat

SEQ ID NO: 4016402 - DNA, 16 bp, Homo sapiens
agcatgtgttgaaaaa

SEQ ID NO: 4016403 - DNA, 16 bp, Homo sapiens
agcatgttgagccagg

SEQ ID NO: 4016404 - DNA, 17 bp, Homo sapiens
agcattaaggtatttcg

SEQ ID NO: 4016405 - DNA, 17 bp, Homo sapiens
agcattacgtgagccag

SEQ ID NO: 4016406 - DNA, 20 bp, Homo sapiens
agcattacgtgagccaggta

SEQ ID NO: 4016407 - DNA, 15 bp, Homo sapiens
agcattatgcaatta

SEQ ID NO: 4016408 - DNA, 18 bp, Homo sapiens
agcattccttctttgata

SEQ ID NO: 4016409 - DNA, 21 bp, Homo sapiens
agcattccttctttgataatg

SEQ ID NO: 4016410 - DNA, 24 bp, Homo sapiens
agcattccttctttgataatgtta

SEQ ID NO: 4016411 - DNA, 18 bp, Homo sapiens
agcattctggaggggaga

SEQ ID NO: 4016412 - DNA, 19 bp, Homo sapiens
agcattcttgtcacaataa

SEQ ID NO: 4016413 - DNA, 15 bp, Homo sapiens
agcattgctgttatg

SEQ ID NO: 4016414 - DNA, 13 bp, Homo sapiens
agcattgctttct

SEQ ID NO: 4016415 - DNA, 20 bp, Homo sapiens
agcattggggatgtttttct

SEQ ID NO: 4016416 - DNA, 15 bp, Homo sapiens
agcattgtttgctta

SEQ ID NO: 4016417 - DNA, 17 bp, Homo sapiens
agcattgtttgcttatt

SEQ ID NO: 4016418 - DNA, 12 bp, Homo sapiens
agcatttatcat

SEQ ID NO: 4016419 - DNA, 22 bp, Homo sapiens
agcatttccaacaccacagaca

SEQ ID NO: 4016420 - DNA, 22 bp, Homo sapiens
agcatttttcaatatattgaac

SEQ ID NO: 4016421 - DNA, 14 bp, Homo sapiens
agccaaaagtccct

SEQ ID NO: 4016422 - DNA, 19 bp, Homo sapiens
agccaaaagtccctccctg

SEQ ID NO: 4016423 - DNA, 11 bp, Homo sapiens
agccaaagagt

SEQ ID NO: 4016424 - DNA, 19 bp, Homo sapiens
agccaacacgcacctgcct

SEQ ID NO: 4016425 - DNA, 22 bp, Homo sapiens
agccaacacgcacctgcctcag

SEQ ID NO: 4016426 - DNA, 18 bp, Homo sapiens
agccaacagaagcttcca

SEQ ID NO: 4016427 - DNA, 23 bp, Homo sapiens
agccaacaggtggcaggaccagg

SEQ ID NO: 4016428 - DNA, 16 bp, Homo sapiens
agccaacctaagcaag

SEQ ID NO: 4016429 - DNA, 15 bp, Homo sapiens
agccaacttgtaaat

SEQ ID NO: 4016430 - DNA, 17 bp, Homo sapiens
agccaagccttaaactg

SEQ ID NO: 4016431 - DNA, 21 bp, Homo sapiens
agccaagccttaaactgtaca

SEQ ID NO: 4016432 - DNA, 21 bp, Homo sapiens
agccaagcttgttatcagctt

SEQ ID NO: 4016433 - DNA, 16 bp, Homo sapiens
agccaagggaaagggg

SEQ ID NO: 4016434 - DNA, 19 bp, Homo sapiens
agccaagtgccaaatgctc

SEQ ID NO: 4016435 - DNA, 12 bp, Homo sapiens
agccaagtgtga

SEQ ID NO: 4016436 - DNA, 13 bp, Homo sapiens
agccacagaccac

SEQ ID NO: 4016437 - DNA, 21 bp, Homo sapiens
agccacagctgctgttctcag

SEQ ID NO: 4016438 - DNA, 22 bp, Homo sapiens
agccacagctgctgttctcagg

SEQ ID NO: 4016439 - DNA, 15 bp, Homo sapiens
agccacaggaaggag

SEQ ID NO: 4016440 - DNA, 23 bp, Homo sapiens
agccacaggaaggaggggagaga

SEQ ID NO: 4016441 - DNA, 14 bp, Homo sapiens
agccacatccccaa

SEQ ID NO: 4016442 - DNA, 17 bp, Homo sapiens
agccacatccccaagcc

SEQ ID NO: 4016443 - DNA, 12 bp, Homo sapiens
agccacatggcc

SEQ ID NO: 4016444 - DNA, 15 bp, Homo sapiens
agccacatggcccca

SEQ ID NO: 4016445 - DNA, 22 bp, Homo sapiens
agccacatggccccatcccagt

SEQ ID NO: 4016446 - DNA, 20 bp, Homo sapiens
agccacatttggaatacttt

SEQ ID NO: 4016447 - DNA, 14 bp, Homo sapiens
agccacccaaagca

SEQ ID NO: 4016448 - DNA, 15 bp, Homo sapiens
agccacccaaagcag

SEQ ID NO: 4016449 - DNA, 18 bp, Homo sapiens
agccacccaaagcagtgg

SEQ ID NO: 4016450 - DNA, 14 bp, Homo sapiens
agccaccccgggct

SEQ ID NO: 4016451 - DNA, 21 bp, Homo sapiens
agccaccccgggctctctgct

SEQ ID NO: 4016452 - DNA, 23 bp, Homo sapiens
agccaccccgggctctctgctgt

SEQ ID NO: 4016453 - DNA, 16 bp, Homo sapiens
agccaccgtgcctggc

SEQ ID NO: 4016454 - DNA, 15 bp, Homo sapiens
agccacctctccctc

SEQ ID NO: 4016455 - DNA, 23 bp, Homo sapiens
agccacctctgtcatttgttgtg

SEQ ID NO: 4016456 - DNA, 18 bp, Homo sapiens
agccacgctgtcctctcg

SEQ ID NO: 4016457 - DNA, 23 bp, Homo sapiens
agccacgctgtcctctcgagccc

SEQ ID NO: 4016458 - DNA, 14 bp, Homo sapiens
agccactagactct

SEQ ID NO: 4016459 - DNA, 15 bp, Homo sapiens
agccactcaggaggc

SEQ ID NO: 4016460 - DNA, 19 bp, Homo sapiens
agccactcgggaggctgag

SEQ ID NO: 4016461 - DNA, 13 bp, Homo sapiens
agccacttctccc

SEQ ID NO: 4016462 - DNA, 15 bp, Homo sapiens
agccacttctcccca

SEQ ID NO: 4016463 - DNA, 17 bp, Homo sapiens
agccacttctccccaga

SEQ ID NO: 4016464 - DNA, 18 bp, Homo sapiens
agccacttctccccagaa

SEQ ID NO: 4016465 - DNA, 15 bp, Homo sapiens
agccagacagaccct

SEQ ID NO: 4016466 - DNA, 20 bp, Homo sapiens
agccagagccccaagcagga

SEQ ID NO: 4016467 - DNA, 12 bp, Homo sapiens
agccagagctgg

SEQ ID NO: 4016468 - DNA, 20 bp, Homo sapiens
agccagagctgggtggggac

SEQ ID NO: 4016469 - DNA, 16 bp, Homo sapiens
agccagaggagggcag

SEQ ID NO: 4016470 - DNA, 18 bp, Homo sapiens
agccagaggagggcagag

SEQ ID NO: 4016471 - DNA, 14 bp, Homo sapiens
agccagagttaggt

SEQ ID NO: 4016472 - DNA, 16 bp, Homo sapiens
agccagatcctcttgg

SEQ ID NO: 4016473 - DNA, 15 bp, Homo sapiens
agccagatgcaggac

SEQ ID NO: 4016474 - DNA, 17 bp, Homo sapiens
agccagatgcaggacag

SEQ ID NO: 4016475 - DNA, 18 bp, Homo sapiens
agccagatgcaggacagg

SEQ ID NO: 4016476 - DNA, 20 bp, Homo sapiens
agccagcacttgtccagctg

SEQ ID NO: 4016477 - DNA, 11 bp, Homo sapiens
agccagcaggg

SEQ ID NO: 4016478 - DNA, 17 bp, Homo sapiens
agccagcccctcttccc

SEQ ID NO: 4016479 - DNA, 14 bp, Homo sapiens
agccagcctgacct

SEQ ID NO: 4016480 - DNA, 18 bp, Homo sapiens
agccagcctgaccttcct

SEQ ID NO: 4016481 - DNA, 17 bp, Homo sapiens
agccagctccctctatt

SEQ ID NO: 4016482 - DNA, 12 bp, Homo sapiens
agcccctcttcc

SEQ ID NO: 4016483 - DNA, 18 bp, Homo sapiens
agcccctggggcccagcc

SEQ ID NO: 4016484 - DNA, 21 bp, Homo sapiens
agcccctggggtggccaccag

SEQ ID NO: 4016485 - DNA, 22 bp, Homo sapiens
agcccctggggtggccaccagt

SEQ ID NO: 4016486 - DNA, 14 bp, Homo sapiens
agcccctggtcctg

SEQ ID NO: 4016487 - DNA, 18 bp, Homo sapiens
agccccttcgggagcagg

SEQ ID NO: 4016488 - DNA, 15 bp, Homo sapiens
agccccttctgctca

SEQ ID NO: 4016489 - DNA, 17 bp, Homo sapiens
agccccttgagaaacct

SEQ ID NO: 4016490 - DNA, 15 bp, Homo sapiens
agcccgcacacctgc

SEQ ID NO: 4016491 - DNA, 20 bp, Homo sapiens
agcccggaccttggcagccc

SEQ ID NO: 4016492 - DNA, 22 bp, Homo sapiens
agcccggcctgctcccagcagc

SEQ ID NO: 4016493 - DNA, 14 bp, Homo sapiens
agcccgtctcagtg

SEQ ID NO: 4016494 - DNA, 19 bp, Homo sapiens
agccctaaaaatccagact

SEQ ID NO: 4016495 - DNA, 20 bp, Homo sapiens
agccctaagtggctgccttc

SEQ ID NO: 4016496 - DNA, 14 bp, Homo sapiens
agccctagagcctg

SEQ ID NO: 4016497 - DNA, 17 bp, Homo sapiens
agccctagagcctgcct

SEQ ID NO: 4016498 - DNA, 21 bp, Homo sapiens
agccctcaacaggcccaggga

SEQ ID NO: 4016499 - DNA, 16 bp, Homo sapiens
agccctcagttccttc

SEQ ID NO: 4016500 - DNA, 23 bp, Homo sapiens
agccctcagttccttcatttcca

SEQ ID NO: 4016501 - DNA, 16 bp, Homo sapiens
agccctccccctcaac

SEQ ID NO: 4016502 - DNA, 19 bp, Homo sapiens
agccctccccctcaacctc

SEQ ID NO: 4016503 - DNA, 12 bp, Homo sapiens
agccctccctgc

SEQ ID NO: 4016504 - DNA, 22 bp, Homo sapiens
agccctcttgggggcactgctc

SEQ ID NO: 4016505 - DNA, 13 bp, Homo sapiens
agccctgcagccc

SEQ ID NO: 4016506 - DNA, 15 bp, Homo sapiens
agccctgccctgcac

SEQ ID NO: 4016507 - DNA, 23 bp, Homo sapiens
agccctgctttgggctgccctgg

SEQ ID NO: 4016508 - DNA, 19 bp, Homo sapiens
agccctggacacccctgct

SEQ ID NO: 4016509 - DNA, 12 bp, Homo sapiens
agccctggggac

SEQ ID NO: 4016510 - DNA, 21 bp, Homo sapiens
agccctggggactgttccaaa

SEQ ID NO: 4016511 - DNA, 17 bp, Homo sapiens
agccctgtcgagacact

SEQ ID NO: 4016512 - DNA, 13 bp, Homo sapiens
agcccttcagatt

SEQ ID NO: 4016513 - DNA, 14 bp, Homo sapiens
agcccttccctgag

SEQ ID NO: 4016514 - DNA, 12 bp, Homo sapiens
agcccttcctct

SEQ ID NO: 4016515 - DNA, 15 bp, Homo sapiens
agcccttcctctgct

SEQ ID NO: 4016516 - DNA, 22 bp, Homo sapiens
agcccttcggaggaccagggct

SEQ ID NO: 4016517 - DNA, 12 bp, Homo sapiens
agcccttgggca

SEQ ID NO: 4016518 - DNA, 14 bp, Homo sapiens
agcccttgggcagt

SEQ ID NO: 4016519 - DNA, 21 bp, Homo sapiens
agccctttacttgacctccta

SEQ ID NO: 4016520 - DNA, 15 bp, Homo sapiens
agccctttggagaac

SEQ ID NO: 4016521 - DNA, 23 bp, Homo sapiens
agccctttggagaacgccagtct

SEQ ID NO: 4016522 - DNA, 19 bp, Homo sapiens
agccgacctgaggacatgg

SEQ ID NO: 4016523 - DNA, 15 bp, Homo sapiens
agccgactctggccc

SEQ ID NO: 4016524 - DNA, 16 bp, Homo sapiens
agccgagccgggcctg

SEQ ID NO: 4016525 - DNA, 23 bp, Homo sapiens
agccgccagctgggagcactggt

SEQ ID NO: 4016526 - DNA, 17 bp, Homo sapiens
agccgccattgccacca

SEQ ID NO: 4016527 - DNA, 21 bp, Homo sapiens
agccgccattgccaccaggag

SEQ ID NO: 4016528 - DNA, 19 bp, Homo sapiens
agccgcggggaagctggct

SEQ ID NO: 4016529 - DNA, 16 bp, Homo sapiens
agccgctgtgagcccc

SEQ ID NO: 4016530 - DNA, 15 bp, Homo sapiens
agccggcacagggtc

SEQ ID NO: 4016531 - DNA, 23 bp, Homo sapiens
agccgggaacagacaacagaagt

SEQ ID NO: 4016532 - DNA, 18 bp, Homo sapiens
agccgggcccctgggctt

SEQ ID NO: 4016533 - DNA, 23 bp, Homo sapiens
agccggggccttatcgggctcca

SEQ ID NO: 4016534 - DNA, 19 bp, Homo sapiens
agccggggtgtaacttcct

SEQ ID NO: 4016535 - DNA, 23 bp, Homo sapiens
agccggggtgtaacttcctgctg

SEQ ID NO: 4016536 - DNA, 20 bp, Homo sapiens
agccgtcagccaaatgtaat

SEQ ID NO: 4016537 - DNA, 16 bp, Homo sapiens
agccgtgccttcagct

SEQ ID NO: 4016538 - DNA, 14 bp, Homo sapiens
agccgtggcttccc

SEQ ID NO: 4016539 - DNA, 15 bp, Homo sapiens
agcctaatccctggg

SEQ ID NO: 4016540 - DNA, 22 bp, Homo sapiens
agcctaatccctgggcattgct

SEQ ID NO: 4016541 - DNA, 19 bp, Homo sapiens
agcctagaagagcttctga

SEQ ID NO: 4016542 - DNA, 17 bp, Homo sapiens
agcctagcggagcccag

SEQ ID NO: 4016543 - DNA, 22 bp, Homo sapiens
agatctaaggatgtcacagggc

SEQ ID NO: 4016544 - DNA, 23 bp, Homo sapiens
agatctcccactgcggggagaca

SEQ ID NO: 4016545 - DNA, 14 bp, Homo sapiens
agatctggaacctc

SEQ ID NO: 4016546 - DNA, 20 bp, Homo sapiens
agatctggaacctcagcctg

SEQ ID NO: 4016547 - DNA, 15 bp, Homo sapiens
agatctgtcctcagc

SEQ ID NO: 4016548 - DNA, 23 bp, Homo sapiens
agatcttaggtatagaggaccct

SEQ ID NO: 4016549 - DNA, 21 bp, Homo sapiens
agatcttcccataataaagca

SEQ ID NO: 4016550 - DNA, 13 bp, Homo sapiens
agatctttcagga

SEQ ID NO: 4016551 - DNA, 17 bp, Homo sapiens
agatgaaagaggaggtt

SEQ ID NO: 4016552 - DNA, 19 bp, Homo sapiens
agatgaactctgaactttg

SEQ ID NO: 4016553 - DNA, 22 bp, Homo sapiens
agatgaactctgaactttggag

SEQ ID NO: 4016554 - DNA, 21 bp, Homo sapiens
agatgaactctttctggcctg

SEQ ID NO: 4016555 - DNA, 16 bp, Homo sapiens
agatgaaggagaggca

SEQ ID NO: 4016556 - DNA, 22 bp, Homo sapiens
agatgaagtttgtagttgtttt

SEQ ID NO: 4016557 - DNA, 14 bp, Homo sapiens
agatgaagttttat

SEQ ID NO: 4016558 - DNA, 17 bp, Homo sapiens
agatgacaacctccatt

SEQ ID NO: 4016559 - DNA, 19 bp, Homo sapiens
agatgaccagggatgctgg

SEQ ID NO: 4016560 - DNA, 20 bp, Homo sapiens
agatgacccctgcccagatc

SEQ ID NO: 4016561 - DNA, 13 bp, Homo sapiens
agatgagcaagga

SEQ ID NO: 4016562 - DNA, 19 bp, Homo sapiens
agatgagcaaggacattgc

SEQ ID NO: 4016563 - DNA, 15 bp, Homo sapiens
agatgaggaggggag

SEQ ID NO: 4016564 - DNA, 16 bp, Homo sapiens
agatgatctactcaga

SEQ ID NO: 4016565 - DNA, 15 bp, Homo sapiens
agatgatctctccac

SEQ ID NO: 4016566 - DNA, 13 bp, Homo sapiens
agatgatggattt

SEQ ID NO: 4016567 - DNA, 14 bp, Homo sapiens
agatgcaacctcac

SEQ ID NO: 4016568 - DNA, 20 bp, Homo sapiens
agatgcagagagccattttg

SEQ ID NO: 4016569 - DNA, 13 bp, Homo sapiens
agatgcagctctt

SEQ ID NO: 4016570 - DNA, 18 bp, Homo sapiens
agatgcagctcttcctgg

SEQ ID NO: 4016571 - DNA, 15 bp, Homo sapiens
agatgcaggacagga

SEQ ID NO: 4016572 - DNA, 17 bp, Homo sapiens
agatgcaggacaggagg

SEQ ID NO: 4016573 - DNA, 18 bp, Homo sapiens
agatgcaggacaggaggc

SEQ ID NO: 4016574 - DNA, 16 bp, Homo sapiens
agatgcagggcagtca

SEQ ID NO: 4016575 - DNA, 15 bp, Homo sapiens
agatgcagtttggag

SEQ ID NO: 4016576 - DNA, 17 bp, Homo sapiens
agatgcatgacttgtgt

SEQ ID NO: 4016577 - DNA, 17 bp, Homo sapiens
agatgccccagagctgt

SEQ ID NO: 4016578 - DNA, 15 bp, Homo sapiens
agatgcttctgggag

SEQ ID NO: 4016579 - DNA, 17 bp, Homo sapiens
agatggaaacaatgtgg

SEQ ID NO: 4016580 - DNA, 18 bp, Homo sapiens
agatggaaacaatgtgga

SEQ ID NO: 4016581 - DNA, 13 bp, Homo sapiens
agatggaatgctg

SEQ ID NO: 4016582 - DNA, 13 bp, Homo sapiens
agatggagcccat

SEQ ID NO: 4016583 - DNA, 19 bp, Homo sapiens
agatggataaactgagcct

SEQ ID NO: 4016584 - DNA, 15 bp, Homo sapiens
agatggattctcaga

SEQ ID NO: 4016585 - DNA, 20 bp, Homo sapiens
agatggattctcagatattt

SEQ ID NO: 4016586 - DNA, 20 bp, Homo sapiens
agatggatttgcctgtgcca

SEQ ID NO: 4016587 - DNA, 16 bp, Homo sapiens
agatggcaaatgacca

SEQ ID NO: 4016588 - DNA, 23 bp, Homo sapiens
agatggcatatatgtgatctggg

SEQ ID NO: 4016589 - DNA, 21 bp, Homo sapiens
agatggcccggatgctgcttc

SEQ ID NO: 4016590 - DNA, 22 bp, Homo sapiens
agatggcctcttactaatgtaa

SEQ ID NO: 4016591 - DNA, 14 bp, Homo sapiens
agatggcctttgct

SEQ ID NO: 4016592 - DNA, 15 bp, Homo sapiens
agatggcctttgctt

SEQ ID NO: 4016593 - DNA, 21 bp, Homo sapiens
agatggctgaggcaggagaac

SEQ ID NO: 4016594 - DNA, 21 bp, Homo sapiens
agatggctggaaggggtccag

SEQ ID NO: 4016595 - DNA, 14 bp, Homo sapiens
agatggcttatttt

SEQ ID NO: 4016596 - DNA, 15 bp, Homo sapiens
agcaaccccaggctg

SEQ ID NO: 4016597 - DNA, 20 bp, Homo sapiens
agcaaccgcctcaaaatgtg

SEQ ID NO: 4016598 - DNA, 15 bp, Homo sapiens
agcaacgcccctcca

SEQ ID NO: 4016599 - DNA, 16 bp, Homo sapiens
agcaacgcccctccaa

SEQ ID NO: 4016600 - DNA, 17 bp, Homo sapiens
agcaacgcttgtagaac

SEQ ID NO: 4016601 - DNA, 23 bp, Homo sapiens
agcaacgcttgtagaactcactc

SEQ ID NO: 4016602 - DNA, 16 bp, Homo sapiens
agcaactgaagacaat

SEQ ID NO: 4016603 - DNA, 17 bp, Homo sapiens
agcaactgaagacaatt

SEQ ID NO: 4016604 - DNA, 20 bp, Homo sapiens
agcaacttgtctttttctgg

SEQ ID NO: 4016605 - DNA, 15 bp, Homo sapiens
agcaacttttgtgta

SEQ ID NO: 4016606 - DNA, 12 bp, Homo sapiens
agcaagagagat

SEQ ID NO: 4016607 - DNA, 23 bp, Homo sapiens
agcaagagagcagcaaggtcttg

SEQ ID NO: 4016608 - DNA, 12 bp, Homo sapiens
agcaagccagac

SEQ ID NO: 4016609 - DNA, 14 bp, Homo sapiens
agcaagccagacct

SEQ ID NO: 4016610 - DNA, 15 bp, Homo sapiens
agcaagcgggagccc

SEQ ID NO: 4016611 - DNA, 12 bp, Homo sapiens
agcaagctggcc

SEQ ID NO: 4016612 - DNA, 15 bp, Homo sapiens
agcaagctggcctct

SEQ ID NO: 4016613 - DNA, 11 bp, Homo sapiens
agcaaggacat

SEQ ID NO: 4016614 - DNA, 13 bp, Homo sapiens
agcaaggacattg

SEQ ID NO: 4016615 - DNA, 21 bp, Homo sapiens
agcaaggacattgccccaaga

SEQ ID NO: 4016616 - DNA, 22 bp, Homo sapiens
agcaaggacattgccccaagat

SEQ ID NO: 4016617 - DNA, 20 bp, Homo sapiens
agcaaggtcatttcttcagt

SEQ ID NO: 4016618 - DNA, 20 bp, Homo sapiens
agcaaggtcttgctctccta

SEQ ID NO: 4016619 - DNA, 21 bp, Homo sapiens
agcaagttctagagaagaggc

SEQ ID NO: 4016620 - DNA, 16 bp, Homo sapiens
agcaatatttatggat

SEQ ID NO: 4016621 - DNA, 16 bp, Homo sapiens
agcaatcctcctgcct

SEQ ID NO: 4016622 - DNA, 15 bp, Homo sapiens
agcaatctcttcatt

SEQ ID NO: 4016623 - DNA, 18 bp, Homo sapiens
agcaatctcttcattatt

SEQ ID NO: 4016624 - DNA, 18 bp, Homo sapiens
agcaatgacatctcaggg

SEQ ID NO: 4016625 - DNA, 13 bp, Homo sapiens
agcaatgggactg

SEQ ID NO: 4016626 - DNA, 15 bp, Homo sapiens
agcaatgggactgga

SEQ ID NO: 4016627 - DNA, 22 bp, Homo sapiens
agcaattctcctgcctcagcct

SEQ ID NO: 4016628 - DNA, 22 bp, Homo sapiens
agcaatttcgccgttgaagagg

SEQ ID NO: 4016629 - DNA, 13 bp, Homo sapiens
agcaatttctaat

SEQ ID NO: 4016630 - DNA, 21 bp, Homo sapiens
agcaatttcttgctctatctc

SEQ ID NO: 4016631 - DNA, 18 bp, Homo sapiens
agcacaacccccagctcc

SEQ ID NO: 4016632 - DNA, 19 bp, Homo sapiens
agcacaacccccagctccc

SEQ ID NO: 4016633 - DNA, 17 bp, Homo sapiens
agcacaccacaattctc

SEQ ID NO: 4016634 - DNA, 12 bp, Homo sapiens
agcacagagcct

SEQ ID NO: 4016635 - DNA, 14 bp, Homo sapiens
agcacagagcctgg

SEQ ID NO: 4016636 - DNA, 22 bp, Homo sapiens
agcacagagcctggccccaggc

SEQ ID NO: 4016637 - DNA, 16 bp, Homo sapiens
agcacagagcgtcctt

SEQ ID NO: 4016638 - DNA, 10 bp, Homo sapiens
agcacagcag

SEQ ID NO: 4016639 - DNA, 15 bp, Homo sapiens
agcacagcagcctgg

SEQ ID NO: 4016640 - DNA, 12 bp, Homo sapiens
agcacagcctag

SEQ ID NO: 4016641 - DNA, 14 bp, Homo sapiens
agcacagctccctt

SEQ ID NO: 4016642 - DNA, 15 bp, Homo sapiens
agcacagctcccttc

SEQ ID NO: 4016643 - DNA, 20 bp, Homo sapiens
agcacagcttagatttcata

SEQ ID NO: 4016644 - DNA, 23 bp, Homo sapiens
agcacatctgcattttcacccca

SEQ ID NO: 4016645 - DNA, 18 bp, Homo sapiens
agcacatgtgtatttata

SEQ ID NO: 4016646 - DNA, 15 bp, Homo sapiens
agcaccaaccacagc

SEQ ID NO: 4016647 - DNA, 16 bp, Homo sapiens
agcaccaccctccttc

SEQ ID NO: 4016648 - DNA, 17 bp, Homo sapiens
agcaccagcttctccag

SEQ ID NO: 4016649 - DNA, 14 bp, Homo sapiens
agcaccccctgctc

SEQ ID NO: 4016650 - DNA, 18 bp, Homo sapiens
ccaggcaccctcagggag

SEQ ID NO: 4016651 - DNA, 19 bp, Homo sapiens
ccaggcaccctcagggagc

SEQ ID NO: 4016652 - DNA, 16 bp, Homo sapiens
ccaggcacctcttcct

SEQ ID NO: 4016653 - DNA, 12 bp, Homo sapiens
ccaggcactgcc

SEQ ID NO: 4016654 - DNA, 18 bp, Homo sapiens
ccaggcactgccttctcc

SEQ ID NO: 4016655 - DNA, 13 bp, Homo sapiens
ccaggcagatcca

SEQ ID NO: 4016656 - DNA, 17 bp, Homo sapiens
ccaggcagatctgtgcc

SEQ ID NO: 4016657 - DNA, 23 bp, Homo sapiens
ccaggcagatctgtgccccatgc

SEQ ID NO: 4016658 - DNA, 15 bp, Homo sapiens
ccaggcagcacccag

SEQ ID NO: 4016659 - DNA, 21 bp, Homo sapiens
ccaggcaggggtgggggtgga

SEQ ID NO: 4016660 - DNA, 12 bp, Homo sapiens
ccaggccaccag

SEQ ID NO: 4016661 - DNA, 19 bp, Homo sapiens
ccaggccagagggcagtgg

SEQ ID NO: 4016662 - DNA, 11 bp, Homo sapiens
ccaggccagcc

SEQ ID NO: 4016663 - DNA, 19 bp, Homo sapiens
ccaggccagcctccgagag

SEQ ID NO: 4016664 - DNA, 20 bp, Homo sapiens
ccaggccagcctccgagagg

SEQ ID NO: 4016665 - DNA, 18 bp, Homo sapiens
ccaggccaggccaccagg

SEQ ID NO: 4016666 - DNA, 15 bp, Homo sapiens
ccaggcccaaggctc

SEQ ID NO: 4016667 - DNA, 18 bp, Homo sapiens
ccaggcccaaggctcccg

SEQ ID NO: 4016668 - DNA, 14 bp, Homo sapiens
ccaggcccaggcct

SEQ ID NO: 4016669 - DNA, 14 bp, Homo sapiens
ccaggcccatgcca

SEQ ID NO: 4016670 - DNA, 14 bp, Homo sapiens
ccaggccctccctg

SEQ ID NO: 4016671 - DNA, 18 bp, Homo sapiens
ccaggcccttcaggaact

SEQ ID NO: 4016672 - DNA, 15 bp, Homo sapiens
ccaggccggcccaga

SEQ ID NO: 4016673 - DNA, 16 bp, Homo sapiens
ccaggccggcccagat

SEQ ID NO: 4016674 - DNA, 23 bp, Homo sapiens
ccaggccgggcttgggccctgca

SEQ ID NO: 4016675 - DNA, 15 bp, Homo sapiens
ccaggcctcaccacc

SEQ ID NO: 4016676 - DNA, 17 bp, Homo sapiens
ccaggcctcaccacctg

SEQ ID NO: 4016677 - DNA, 21 bp, Homo sapiens
ccaggcctcaccacctgacgc

SEQ ID NO: 4016678 - DNA, 15 bp, Homo sapiens
ccaggcctctgtgtc

SEQ ID NO: 4016679 - DNA, 18 bp, Homo sapiens
ccaggcctctgtgtcctt

SEQ ID NO: 4016680 - DNA, 19 bp, Homo sapiens
ccaggcctgaaagaggctg

SEQ ID NO: 4016681 - DNA, 19 bp, Homo sapiens
ccaggcctgatcttgcctg

SEQ ID NO: 4016682 - DNA, 16 bp, Homo sapiens
ccaggcctgggtctgt

SEQ ID NO: 4016683 - DNA, 11 bp, Homo sapiens
ccaggcctgtg

SEQ ID NO: 4016684 - DNA, 12 bp, Homo sapiens
ccaggccttgtc

SEQ ID NO: 4016685 - DNA, 19 bp, Homo sapiens
ccaggcgccccttccccct

SEQ ID NO: 4016686 - DNA, 21 bp, Homo sapiens
ccaggctgaccacagcacagc

SEQ ID NO: 4016687 - DNA, 17 bp, Homo sapiens
ccaggctgagtgagcca

SEQ ID NO: 4016688 - DNA, 21 bp, Homo sapiens
ccaggctggtttcgaactcct

SEQ ID NO: 4016689 - DNA, 20 bp, Homo sapiens
ccaggctgtgcagcgcagct

SEQ ID NO: 4016690 - DNA, 14 bp, Homo sapiens
agacaatcttctgt

SEQ ID NO: 4016691 - DNA, 18 bp, Homo sapiens
agacaatggacccttttt

SEQ ID NO: 4016692 - DNA, 23 bp, Homo sapiens
agacaattgaggtaagttttttg

SEQ ID NO: 4016693 - DNA, 14 bp, Homo sapiens
agacacaactattt

SEQ ID NO: 4016694 - DNA, 19 bp, Homo sapiens
agacacaactatttttcca

SEQ ID NO: 4016695 - DNA, 14 bp, Homo sapiens
agacacacaaagca

SEQ ID NO: 4016696 - DNA, 15 bp, Homo sapiens
agacacacaaagcag

SEQ ID NO: 4016697 - DNA, 12 bp, Homo sapiens
agacacacacac

SEQ ID NO: 4016698 - DNA, 22 bp, Homo sapiens
agacacacacacgcacgcacac

SEQ ID NO: 4016699 - DNA, 20 bp, Homo sapiens
agacacacatgggcagccca

SEQ ID NO: 4016700 - DNA, 12 bp, Homo sapiens
agacacccagga

SEQ ID NO: 4016701 - DNA, 15 bp, Homo sapiens
agacacccaggactt

SEQ ID NO: 4016702 - DNA, 19 bp, Homo sapiens
agacaccctcaacctcttc

SEQ ID NO: 4016703 - DNA, 19 bp, Homo sapiens
agacaccgttcattcaggc

SEQ ID NO: 4016704 - DNA, 18 bp, Homo sapiens
agacacgccttcccctca

SEQ ID NO: 4016705 - DNA, 21 bp, Homo sapiens
agacacgctcgcgggcagcgg

SEQ ID NO: 4016706 - DNA, 20 bp, Homo sapiens
agacactccccgaagtcttt

SEQ ID NO: 4016707 - DNA, 13 bp, Homo sapiens
agacacttgcctt

SEQ ID NO: 4016708 - DNA, 17 bp, Homo sapiens
agacacttgctcccaac

SEQ ID NO: 4016709 - DNA, 12 bp, Homo sapiens
agacagaaaagt

SEQ ID NO: 4016710 - DNA, 16 bp, Homo sapiens
agacagaagtctcctc

SEQ ID NO: 4016711 - DNA, 19 bp, Homo sapiens
agacagaatggtggagtgt

SEQ ID NO: 4016712 - DNA, 17 bp, Homo sapiens
agacagaccctgaaaag

SEQ ID NO: 4016713 - DNA, 15 bp, Homo sapiens
agacagacttgagaa

SEQ ID NO: 4016714 - DNA, 18 bp, Homo sapiens
agacagaggaaagggctg

SEQ ID NO: 4016715 - DNA, 23 bp, Homo sapiens
agacagaggaaagggctggctcc

SEQ ID NO: 4016716 - DNA, 14 bp, Homo sapiens
agacagatgcccca

SEQ ID NO: 4016717 - DNA, 14 bp, Homo sapiens
agacagcaggcagc

SEQ ID NO: 4016718 - DNA, 21 bp, Homo sapiens
agacagctccaccctggccga

SEQ ID NO: 4016719 - DNA, 20 bp, Homo sapiens
agacagctgatacttcattt

SEQ ID NO: 4016720 - DNA, 14 bp, Homo sapiens
agacaggagcctag

SEQ ID NO: 4016721 - DNA, 15 bp, Homo sapiens
agacaggagcctagc

SEQ ID NO: 4016722 - DNA, 14 bp, Homo sapiens
agacaggagggcaa

SEQ ID NO: 4016723 - DNA, 15 bp, Homo sapiens
agacaggctcttagc

SEQ ID NO: 4016724 - DNA, 16 bp, Homo sapiens
agacagggtcttgctc

SEQ ID NO: 4016725 - DNA, 18 bp, Homo sapiens
agacagggtgggcttcct

SEQ ID NO: 4016726 - DNA, 20 bp, Homo sapiens
agacagggtgggcttcctgc

SEQ ID NO: 4016727 - DNA, 23 bp, Homo sapiens
agacagggtttcaccatgttgcc

SEQ ID NO: 4016728 - DNA, 18 bp, Homo sapiens
agacagtatatttatagt

SEQ ID NO: 4016729 - DNA, 13 bp, Homo sapiens
agacagtccagtg

SEQ ID NO: 4016730 - DNA, 19 bp, Homo sapiens
agacagtgatattggaact

SEQ ID NO: 4016731 - DNA, 15 bp, Homo sapiens
agacagtgatctcca

SEQ ID NO: 4016732 - DNA, 14 bp, Homo sapiens
agacagtttcttag

SEQ ID NO: 4016733 - DNA, 15 bp, Homo sapiens
agacagtttcttagc

SEQ ID NO: 4016734 - DNA, 21 bp, Homo sapiens
agacagtttcttagcttttta

SEQ ID NO: 4016735 - DNA, 14 bp, Homo sapiens
agacataacgtttt

SEQ ID NO: 4016736 - DNA, 20 bp, Homo sapiens
agacataacgtttttccttt

SEQ ID NO: 4016737 - DNA, 20 bp, Homo sapiens
agacatacttgaagggccag

SEQ ID NO: 4016738 - DNA, 21 bp, Homo sapiens
agacatacttgaagggccaga

SEQ ID NO: 4016739 - DNA, 15 bp, Homo sapiens
agacatgatttcctt

SEQ ID NO: 4016740 - DNA, 17 bp, Homo sapiens
agacatgtgaggaggaa

SEQ ID NO: 4016741 - DNA, 15 bp, Homo sapiens
agacattggcaccta

SEQ ID NO: 4016742 - DNA, 19 bp, Homo sapiens
agacatttcttttcttttt

SEQ ID NO: 4016743 - DNA, 20 bp, Homo sapiens
agacatttcttttcttttta

SEQ ID NO: 4016744 - DNA, 22 bp, Homo sapiens
agacatttcttttctttttaca

SEQ ID NO: 4016745 - DNA, 23 bp, Homo sapiens
agacatttcttttctttttacat

SEQ ID NO: 4016746 - DNA, 20 bp, Homo sapiens
agacatttgttattttggaa

SEQ ID NO: 4016747 - DNA, 15 bp, Homo sapiens
agacatttgtttgct

SEQ ID NO: 4016748 - DNA, 17 bp, Homo sapiens
agacattttttgctata

SEQ ID NO: 4016749 - DNA, 11 bp, Homo sapiens
agaccaaagca

SEQ ID NO: 4016750 - DNA, 22 bp, Homo sapiens
agggctcccaggggtctccctg

SEQ ID NO: 4016751 - DNA, 20 bp, Homo sapiens
agggctcgaggggtgggctg

SEQ ID NO: 4016752 - DNA, 14 bp, Homo sapiens
agtatgagccctaa

SEQ ID NO: 4016753 - DNA, 13 bp, Homo sapiens
agtattaatgtaa

SEQ ID NO: 4016754 - DNA, 15 bp, Homo sapiens
agtattatctgtgtt

SEQ ID NO: 4016755 - DNA, 13 bp, Homo sapiens
agtattctcagag

SEQ ID NO: 4016756 - DNA, 15 bp, Homo sapiens
agtccttacctcttc

SEQ ID NO: 4016757 - DNA, 17 bp, Homo sapiens
agtccttacctcttccg

SEQ ID NO: 4016758 - DNA, 21 bp, Homo sapiens
agtccttacctcttccggaga

SEQ ID NO: 4016759 - DNA, 23 bp, Homo sapiens
agtccttacctcttccggagatg

SEQ ID NO: 4016760 - DNA, 16 bp, Homo sapiens
agtccttatctagctg

SEQ ID NO: 4016761 - DNA, 15 bp, Homo sapiens
agtcctttgtgaata

SEQ ID NO: 4016762 - DNA, 19 bp, Homo sapiens
agtcgcatctcagtgcagg

SEQ ID NO: 4016763 - DNA, 19 bp, Homo sapiens
agtcgggatgtcagcagac

SEQ ID NO: 4016764 - DNA, 18 bp, Homo sapiens
agtctaaacaaaattgca

SEQ ID NO: 4016765 - DNA, 16 bp, Homo sapiens
agtctaaatatttcct

SEQ ID NO: 4016766 - DNA, 16 bp, Homo sapiens
agtctaagatgattca

SEQ ID NO: 4016767 - DNA, 18 bp, Homo sapiens
agtctatatgaaaaacaa

SEQ ID NO: 4016768 - DNA, 20 bp, Homo sapiens
agtctatttttttaactgaa

SEQ ID NO: 4016769 - DNA, 20 bp, Homo sapiens
agtctcaaaaatacaaaata

SEQ ID NO: 4016770 - DNA, 21 bp, Homo sapiens
agtctcaaaaatacaaaataa

SEQ ID NO: 4016771 - DNA, 20 bp, Homo sapiens
agtctcactgcagtcttatt

SEQ ID NO: 4016772 - DNA, 10 bp, Homo sapiens
agtctcagtt

SEQ ID NO: 4016773 - DNA, 23 bp, Homo sapiens
agtctcccaggccccctgcatct

SEQ ID NO: 4016774 - DNA, 11 bp, Homo sapiens
agtctcctcaa

SEQ ID NO: 4016775 - DNA, 21 bp, Homo sapiens
agtctcctttgcactgagggc

SEQ ID NO: 4016776 - DNA, 16 bp, Homo sapiens
agtctctaggttctga

SEQ ID NO: 4016777 - DNA, 12 bp, Homo sapiens
agtctctctgtg

SEQ ID NO: 4016778 - DNA, 13 bp, Homo sapiens
agtctctctgtga

SEQ ID NO: 4016779 - DNA, 16 bp, Homo sapiens
agtctctctgtgaata

SEQ ID NO: 4016780 - DNA, 15 bp, Homo sapiens
agtctctgccaccca

SEQ ID NO: 4016781 - DNA, 19 bp, Homo sapiens
agtctctgccacccactca

SEQ ID NO: 4016782 - DNA, 21 bp, Homo sapiens
agtctctgccacccactcagg

SEQ ID NO: 4016783 - DNA, 22 bp, Homo sapiens
agtctctgccacccactcagga

SEQ ID NO: 4016784 - DNA, 12 bp, Homo sapiens
agtctcttcaga

SEQ ID NO: 4016785 - DNA, 13 bp, Homo sapiens
agtctcttctcca

SEQ ID NO: 4016786 - DNA, 16 bp, Homo sapiens
agtctcttctccactg

SEQ ID NO: 4016787 - DNA, 19 bp, Homo sapiens
agtctcttctccactggat

SEQ ID NO: 4016788 - DNA, 17 bp, Homo sapiens
agtctcttgtattaaac

SEQ ID NO: 4016789 - DNA, 17 bp, Homo sapiens
agtctctttaatcttca

SEQ ID NO: 4016790 - DNA, 21 bp, Homo sapiens
agtctctttaatcttcagttt

SEQ ID NO: 4016791 - DNA, 21 bp, Homo sapiens
agtctgaaactggcttcccca

SEQ ID NO: 4016792 - DNA, 20 bp, Homo sapiens
agtctgataaactgacgatt

SEQ ID NO: 4016793 - DNA, 18 bp, Homo sapiens
agtctggagtgggcagag

SEQ ID NO: 4016794 - DNA, 22 bp, Homo sapiens
agtctggcagactttcttctct

SEQ ID NO: 4016795 - DNA, 15 bp, Homo sapiens
agtctggccaacatc

SEQ ID NO: 4016796 - DNA, 17 bp, Homo sapiens
agtctgggcctctgact

SEQ ID NO: 4016797 - DNA, 14 bp, Homo sapiens
agtctgggctgccg

SEQ ID NO: 4016798 - DNA, 15 bp, Homo sapiens
agtctgtcctgtgac

SEQ ID NO: 4016799 - DNA, 16 bp, Homo sapiens
agtctgtctttcctga

SEQ ID NO: 4016800 - DNA, 11 bp, Homo sapiens
agtctgtgtga

SEQ ID NO: 4016801 - DNA, 15 bp, Homo sapiens
agtcttaacaaacca

SEQ ID NO: 4016802 - DNA, 23 bp, Homo sapiens
agtcttaacaaaccaacatcttt

SEQ ID NO: 4016803 - DNA, 16 bp, Homo sapiens
agtcttcactctctga

SEQ ID NO: 4016804 - DNA, 13 bp, Homo sapiens
agtcttctcatag

SEQ ID NO: 4016805 - DNA, 23 bp, Homo sapiens
agtcttgctctgttacccaggct

SEQ ID NO: 4016806 - DNA, 19 bp, Homo sapiens
agtcttgggtctgaattta

SEQ ID NO: 4016807 - DNA, 16 bp, Homo sapiens
agtcttggtggttcta

SEQ ID NO: 4016808 - DNA, 23 bp, Homo sapiens
agtcttggtttctctctacagtg

SEQ ID NO: 4016809 - DNA, 15 bp, Homo sapiens
agtctttgccttctc

SEQ ID NO: 4016810 - DNA, 12 bp, Homo sapiens
agtcttttctgt

SEQ ID NO: 4016811 - DNA, 19 bp, Homo sapiens
agtgaaaagattttattta

SEQ ID NO: 4016812 - DNA, 14 bp, Homo sapiens
agtgaaataacaaa

SEQ ID NO: 4016813 - DNA, 14 bp, Homo sapiens
agtgaaataataga

SEQ ID NO: 4016814 - DNA, 15 bp, Homo sapiens
agtgaaatggatact

SEQ ID NO: 4016815 - DNA, 21 bp, Homo sapiens
agtgaaccatcattataaacg

SEQ ID NO: 4016816 - DNA, 15 bp, Homo sapiens
agtgaacctgtataa

SEQ ID NO: 4016817 - DNA, 15 bp, Homo sapiens
agtgaactcctgcca

SEQ ID NO: 4016818 - DNA, 17 bp, Homo sapiens
agtgaactcctgccagg

SEQ ID NO: 4016819 - DNA, 15 bp, Homo sapiens
agtgaagaccagagc

SEQ ID NO: 4016820 - DNA, 18 bp, Homo sapiens
agtgaagaccagagcagt

SEQ ID NO: 4016821 - DNA, 16 bp, Homo sapiens
agtgaagactggaagc

SEQ ID NO: 4016822 - DNA, 20 bp, Homo sapiens
agtgaagatgcaatcagaca

SEQ ID NO: 4016823 - DNA, 14 bp, Homo sapiens
agtgaataaatgtc

SEQ ID NO: 4016824 - DNA, 22 bp, Homo sapiens
agtgaatacttactataatttg

SEQ ID NO: 4016825 - DNA, 14 bp, Homo sapiens
agtgaatgaaagat

SEQ ID NO: 4016826 - DNA, 20 bp, Homo sapiens
agtgaatgtgtctggacctc

SEQ ID NO: 4016827 - DNA, 14 bp, Homo sapiens
agtgaatttgaatg

SEQ ID NO: 4016828 - DNA, 15 bp, Homo sapiens
agtgaatttgaatga

SEQ ID NO: 4016829 - DNA, 14 bp, Homo sapiens
agtgacaaaataga

SEQ ID NO: 4016830 - DNA, 15 bp, Homo sapiens
agtgacaagtgaaga

SEQ ID NO: 4016831 - DNA, 18 bp, Homo sapiens
agtgacaagtgaagaaca

SEQ ID NO: 4016832 - DNA, 13 bp, Homo sapiens
agtgacacagcag

SEQ ID NO: 4016833 - DNA, 17 bp, Homo sapiens
agtgacacagcagcttc

SEQ ID NO: 4016834 - DNA, 21 bp, Homo sapiens
agtgacacttcagagagctgg

SEQ ID NO: 4016835 - DNA, 19 bp, Homo sapiens
agtgacagagttcactata

SEQ ID NO: 4016836 - DNA, 14 bp, Homo sapiens
agtgacctgtttat

SEQ ID NO: 4016837 - DNA, 14 bp, Homo sapiens
agtgaccttttctt

SEQ ID NO: 4016838 - DNA, 17 bp, Homo sapiens
agtgaccttttcttcat

SEQ ID NO: 4016839 - DNA, 17 bp, Homo sapiens
agtgactagtacaaatt

SEQ ID NO: 4016840 - DNA, 23 bp, Homo sapiens
agtgactgtttggcttataaaca

SEQ ID NO: 4016841 - DNA, 16 bp, Homo sapiens
agtgacttgtgtccca

SEQ ID NO: 4016842 - DNA, 13 bp, Homo sapiens
agtgactttgtat

SEQ ID NO: 4016843 - DNA, 14 bp, Homo sapiens
agtgagaaaaagct

SEQ ID NO: 4016844 - DNA, 19 bp, Homo sapiens
agtgagaaaaagctcctgt

SEQ ID NO: 4016845 - DNA, 15 bp, Homo sapiens
agtgagactgcccca

SEQ ID NO: 4016846 - DNA, 22 bp, Homo sapiens
agtgagagagatgggagctcct

SEQ ID NO: 4016847 - DNA, 22 bp, Homo sapiens
agttacagcctgttagtaacat

SEQ ID NO: 4016848 - DNA, 22 bp, Homo sapiens
agttacagcgagaggcagagaa

SEQ ID NO: 4016849 - DNA, 14 bp, Homo sapiens
agttacatgcataa

SEQ ID NO: 4016850 - DNA, 18 bp, Homo sapiens
agttacatgctgtatatg

SEQ ID NO: 4016851 - DNA, 16 bp, Homo sapiens
agttacattaatgtta

SEQ ID NO: 4016852 - DNA, 16 bp, Homo sapiens
agttactacctcctct

SEQ ID NO: 4016853 - DNA, 14 bp, Homo sapiens
agttactttgtaat

SEQ ID NO: 4016854 - DNA, 15 bp, Homo sapiens
agttactttgtaatt

SEQ ID NO: 4016855 - DNA, 16 bp, Homo sapiens
agttagggttttgcaa

SEQ ID NO: 4016856 - DNA, 17 bp, Homo sapiens
agttagtagcatgttga

SEQ ID NO: 4016857 - DNA, 21 bp, Homo sapiens
agttagttgtgaaagaaagct

SEQ ID NO: 4016858 - DNA, 19 bp, Homo sapiens
agttataaatagccttcaa

SEQ ID NO: 4016859 - DNA, 15 bp, Homo sapiens
agttatagtgaatac

SEQ ID NO: 4016860 - DNA, 12 bp, Homo sapiens
agttatgatgta

SEQ ID NO: 4016861 - DNA, 14 bp, Homo sapiens
agttatgtgaatga

SEQ ID NO: 4016862 - DNA, 15 bp, Homo sapiens
agttatgtgaatgat

SEQ ID NO: 4016863 - DNA, 22 bp, Homo sapiens
agttattaatttttaaggatgt

SEQ ID NO: 4016864 - DNA, 22 bp, Homo sapiens
agttattcattctgtgatcatt

SEQ ID NO: 4016865 - DNA, 23 bp, Homo sapiens
agttattgtccctggcttcctta

SEQ ID NO: 4016866 - DNA, 14 bp, Homo sapiens
agttatttactttt

SEQ ID NO: 4016867 - DNA, 14 bp, Homo sapiens
agttattttctaca

SEQ ID NO: 4016868 - DNA, 14 bp, Homo sapiens
agttattttggata

SEQ ID NO: 4016869 - DNA, 16 bp, Homo sapiens
agttatttttgtacat

SEQ ID NO: 4016870 - DNA, 20 bp, Homo sapiens
agttcaacctggtggcacca

SEQ ID NO: 4016871 - DNA, 15 bp, Homo sapiens
agttcaatctcccgc

SEQ ID NO: 4016872 - DNA, 22 bp, Homo sapiens
agttcaatctcccgctgctgct

SEQ ID NO: 4016873 - DNA, 17 bp, Homo sapiens
agttcacaggaggccag

SEQ ID NO: 4016874 - DNA, 16 bp, Homo sapiens
agttcactataaatgg

SEQ ID NO: 4016875 - DNA, 21 bp, Homo sapiens
agttcactataaatggtgttt

SEQ ID NO: 4016876 - DNA, 18 bp, Homo sapiens
agttcagagccaagcctt

SEQ ID NO: 4016877 - DNA, 15 bp, Homo sapiens
agttcagcaccaccc

SEQ ID NO: 4016878 - DNA, 21 bp, Homo sapiens
agttcagcatccgcaggtgct

SEQ ID NO: 4016879 - DNA, 12 bp, Homo sapiens
agttcagggacc

SEQ ID NO: 4016880 - DNA, 18 bp, Homo sapiens
agttcatatgtaccatgt

SEQ ID NO: 4016881 - DNA, 22 bp, Homo sapiens
agttcatatgtaccatgtacat

SEQ ID NO: 4016882 - DNA, 22 bp, Homo sapiens
agttcatccaatcctcactggg

SEQ ID NO: 4016883 - DNA, 13 bp, Homo sapiens
agttcatcccttc

SEQ ID NO: 4016884 - DNA, 17 bp, Homo sapiens
agttcccaaaagattgc

SEQ ID NO: 4016885 - DNA, 18 bp, Homo sapiens
agttcccaccatctgatt

SEQ ID NO: 4016886 - DNA, 19 bp, Homo sapiens
agttcccccagtacctcca

SEQ ID NO: 4016887 - DNA, 17 bp, Homo sapiens
agttccctctgctcagc

SEQ ID NO: 4016888 - DNA, 21 bp, Homo sapiens
agttccctgtctcttgaaaaa

SEQ ID NO: 4016889 - DNA, 13 bp, Homo sapiens
agttcccttggcc

SEQ ID NO: 4016890 - DNA, 14 bp, Homo sapiens
agttcctcctactt

SEQ ID NO: 4016891 - DNA, 20 bp, Homo sapiens
agttcctgtcccttctctta

SEQ ID NO: 4016892 - DNA, 18 bp, Homo sapiens
agttccttatccctctct

SEQ ID NO: 4016893 - DNA, 19 bp, Homo sapiens
agttcctttccttttcttt

SEQ ID NO: 4016894 - DNA, 15 bp, Homo sapiens
agttctacataagta

SEQ ID NO: 4016895 - DNA, 20 bp, Homo sapiens
agttctacctcaggcagctc

SEQ ID NO: 4016896 - DNA, 22 bp, Homo sapiens
agttctactatggctgagttct

SEQ ID NO: 4016897 - DNA, 20 bp, Homo sapiens
agttctagaaccacttcctg

SEQ ID NO: 4016898 - DNA, 13 bp, Homo sapiens
agttctagagaag

SEQ ID NO: 4016899 - DNA, 15 bp, Homo sapiens
agttctagagaagag

SEQ ID NO: 4016900 - DNA, 17 bp, Homo sapiens
agttctcactcctagga

SEQ ID NO: 4016901 - DNA, 15 bp, Homo sapiens
agttctgagtgtttt

SEQ ID NO: 4016902 - DNA, 15 bp, Homo sapiens
agttctgccaggcaa

SEQ ID NO: 4016903 - DNA, 16 bp, Homo sapiens
agttctggtcaaagaa

SEQ ID NO: 4016904 - DNA, 14 bp, Homo sapiens
agttctgtgaagag

SEQ ID NO: 4016905 - DNA, 23 bp, Homo sapiens
agttcttaaagtttaaagttgca

SEQ ID NO: 4016906 - DNA, 17 bp, Homo sapiens
agttcttatgaggaggg

SEQ ID NO: 4016907 - DNA, 14 bp, Homo sapiens
agttcttcacctct

SEQ ID NO: 4016908 - DNA, 18 bp, Homo sapiens
agttcttcacctctatcc

SEQ ID NO: 4016909 - DNA, 20 bp, Homo sapiens
agttcttggtgactgtccca

SEQ ID NO: 4016910 - DNA, 16 bp, Homo sapiens
agttcttggtgctctg

SEQ ID NO: 4016911 - DNA, 22 bp, Homo sapiens
agttcttgtctgattggctcac

SEQ ID NO: 4016912 - DNA, 19 bp, Homo sapiens
agttctttccataataaaa

SEQ ID NO: 4016913 - DNA, 18 bp, Homo sapiens
agttctttcctccccctg

SEQ ID NO: 4016914 - DNA, 21 bp, Homo sapiens
agttctttcctccccctgcaa

SEQ ID NO: 4016915 - DNA, 15 bp, Homo sapiens
agttctttgggccag

SEQ ID NO: 4016916 - DNA, 16 bp, Homo sapiens
agttctttgggccaga

SEQ ID NO: 4016917 - DNA, 23 bp, Homo sapiens
agttctttttgccagttttccct

SEQ ID NO: 4016918 - DNA, 18 bp, Homo sapiens
agttgaaaggcctcaaga

SEQ ID NO: 4016919 - DNA, 17 bp, Homo sapiens
agttgaagtcatgctcc

SEQ ID NO: 4016920 - DNA, 15 bp, Homo sapiens
agttgaagtttagga

SEQ ID NO: 4016921 - DNA, 23 bp, Homo sapiens
agttgaattgaggggattaatat

SEQ ID NO: 4016922 - DNA, 16 bp, Homo sapiens
agttgactcacaggcc

SEQ ID NO: 4016923 - DNA, 18 bp, Homo sapiens
agttgatctggaacccag

SEQ ID NO: 4016924 - DNA, 19 bp, Homo sapiens
agttgatctggaacccaga

SEQ ID NO: 4016925 - DNA, 16 bp, Homo sapiens
agttgatgttgcattt

SEQ ID NO: 4016926 - DNA, 18 bp, Homo sapiens
agttgcaattgaattaaa

SEQ ID NO: 4016927 - DNA, 16 bp, Homo sapiens
agttgcagactcagtt

SEQ ID NO: 4016928 - DNA, 18 bp, Homo sapiens
agttgcagactcagtttg

SEQ ID NO: 4016929 - DNA, 22 bp, Homo sapiens
agttgcagactcagtttgtcag

SEQ ID NO: 4016930 - DNA, 17 bp, Homo sapiens
agttgcatttagaaatc

SEQ ID NO: 4016931 - DNA, 18 bp, Homo sapiens
agttgcatttagcttctt

SEQ ID NO: 4016932 - DNA, 19 bp, Homo sapiens
agttgccaccacctctgtg

SEQ ID NO: 4016933 - DNA, 19 bp, Homo sapiens
agttgtcaagtctctgctg

SEQ ID NO: 4016934 - DNA, 16 bp, Homo sapiens
agttgtcacatcagat

SEQ ID NO: 4016935 - DNA, 20 bp, Homo sapiens
agttgtcctatggacaactt

SEQ ID NO: 4016936 - DNA, 12 bp, Homo sapiens
agttgtcttaaa

SEQ ID NO: 4016937 - DNA, 13 bp, Homo sapiens
agttgtcttgtcc

SEQ ID NO: 4016938 - DNA, 20 bp, Homo sapiens
agttgttcaataataaatat

SEQ ID NO: 4016939 - DNA, 12 bp, Homo sapiens
agttgttgtaac

SEQ ID NO: 4016940 - DNA, 20 bp, Homo sapiens
agttgtttctgacccactga

SEQ ID NO: 4016941 - DNA, 16 bp, Homo sapiens
agttgtttgtttttgc

SEQ ID NO: 4016942 - DNA, 19 bp, Homo sapiens
agtttaaaaaacagaaaaa

SEQ ID NO: 4016943 - DNA, 17 bp, Homo sapiens
agtttaaaacagtattt

SEQ ID NO: 4016944 - DNA, 20 bp, Homo sapiens
agtttaaaacagtatttatt

SEQ ID NO: 4016945 - DNA, 22 bp, Homo sapiens
agtttacaacttgattttttca

SEQ ID NO: 4016946 - DNA, 13 bp, Homo sapiens
agtttacaatatt

SEQ ID NO: 4016947 - DNA, 15 bp, Homo sapiens
agtttacattgtaaa

SEQ ID NO: 4016948 - DNA, 17 bp, Homo sapiens
agtttacattgtaaata

SEQ ID NO: 4016949 - DNA, 12 bp, Homo sapiens
agtttacatttt

SEQ ID NO: 4016950 - DNA, 13 bp, Homo sapiens
agtttacattttt

SEQ ID NO: 4016951 - DNA, 19 bp, Homo sapiens
agtttaccatttgtaataa

SEQ ID NO: 4016952 - DNA, 17 bp, Homo sapiens
agtttacccatgaagat

SEQ ID NO: 4016953 - DNA, 13 bp, Homo sapiens
agtttaggagaaa

SEQ ID NO: 4016954 - DNA, 15 bp, Homo sapiens
agtttattctcattt

SEQ ID NO: 4016955 - DNA, 16 bp, Homo sapiens
agtttatttttaaaga

SEQ ID NO: 4016956 - DNA, 16 bp, Homo sapiens
agtttatttttcacac

SEQ ID NO: 4016957 - DNA, 13 bp, Homo sapiens
agtttcagacagg

SEQ ID NO: 4016958 - DNA, 12 bp, Homo sapiens
agtttcagagaa

SEQ ID NO: 4016959 - DNA, 18 bp, Homo sapiens
agtttcagagaagttctg

SEQ ID NO: 4016960 - DNA, 17 bp, Homo sapiens
agtttcagcttaaaata

SEQ ID NO: 4016961 - DNA, 21 bp, Homo sapiens
agtttcagcttaaaataaaca

SEQ ID NO: 4016962 - DNA, 20 bp, Homo sapiens
agtttcaggatacatgtgcc

SEQ ID NO: 4016963 - DNA, 14 bp, Homo sapiens
agtttcaggtgaca

SEQ ID NO: 4016964 - DNA, 17 bp, Homo sapiens
agtttcaggtgacatgt

SEQ ID NO: 4016965 - DNA, 20 bp, Homo sapiens
agtttcagtattagatgcac

SEQ ID NO: 4016966 - DNA, 15 bp, Homo sapiens
agtttcatctggttg

SEQ ID NO: 4016967 - DNA, 16 bp, Homo sapiens
agtttcccttcctcca

SEQ ID NO: 4016968 - DNA, 20 bp, Homo sapiens
agtttcccttcctccatcct

SEQ ID NO: 4016969 - DNA, 16 bp, Homo sapiens
agtttcctaatcagaa

SEQ ID NO: 4016970 - DNA, 21 bp, Homo sapiens
agtttctccaagtacttttgt

SEQ ID NO: 4016971 - DNA, 19 bp, Homo sapiens
agtttctgtttgattcttt

SEQ ID NO: 4016972 - DNA, 22 bp, Homo sapiens
agtttcttactgttttgtatca

SEQ ID NO: 4016973 - DNA, 14 bp, Homo sapiens
agtttcttagcttt

SEQ ID NO: 4016974 - DNA, 15 bp, Homo sapiens
agtttcttagctttt

SEQ ID NO: 4016975 - DNA, 16 bp, Homo sapiens
agtttgaagcctgtgc

SEQ ID NO: 4016976 - DNA, 16 bp, Homo sapiens
agtttgagctgccttc

SEQ ID NO: 4016977 - DNA, 17 bp, Homo sapiens
agtttgatattaaagga

SEQ ID NO: 4016978 - DNA, 21 bp, Homo sapiens
agtttgattgaggagctgcac

SEQ ID NO: 4016979 - DNA, 22 bp, Homo sapiens
agtttgattgaggagctgcact

SEQ ID NO: 4016980 - DNA, 16 bp, Homo sapiens
agtttgcacctgtccc

SEQ ID NO: 4016981 - DNA, 19 bp, Homo sapiens
agtttgccacccctgtcca

SEQ ID NO: 4016982 - DNA, 16 bp, Homo sapiens
agtttggatatttttg

SEQ ID NO: 4016983 - DNA, 22 bp, Homo sapiens
agtttggatatttttgtacttg

SEQ ID NO: 4016984 - DNA, 18 bp, Homo sapiens
agtttgggtaaaatactt

SEQ ID NO: 4016985 - DNA, 17 bp, Homo sapiens
agtttgtagttgtttta

SEQ ID NO: 4016986 - DNA, 22 bp, Homo sapiens
agtttgtatgccaagtgagaag

SEQ ID NO: 4016987 - DNA, 20 bp, Homo sapiens
agtttgtgtctgttgcttgt

SEQ ID NO: 4016988 - DNA, 15 bp, Homo sapiens
agtttgtgtgtctta

SEQ ID NO: 4016989 - DNA, 21 bp, Homo sapiens
agtttgttctccgggtgtggc

SEQ ID NO: 4016990 - DNA, 15 bp, Homo sapiens
agttttaaactcatt

SEQ ID NO: 4016991 - DNA, 20 bp, Homo sapiens
agttttacagattgcctcct

SEQ ID NO: 4016992 - DNA, 21 bp, Homo sapiens
agttttacagattgcctcctt

SEQ ID NO: 4016993 - DNA, 21 bp, Homo sapiens
agttttagttgcagaaacatt

SEQ ID NO: 4016994 - DNA, 15 bp, Homo sapiens
agttttagttttctc

SEQ ID NO: 4016995 - DNA, 12 bp, Homo sapiens
agttttcagaaa

SEQ ID NO: 4016996 - DNA, 21 bp, Homo sapiens
agttttcatttagaaaataga

SEQ ID NO: 4016997 - DNA, 12 bp, Homo sapiens
agttttccatga

SEQ ID NO: 4016998 - DNA, 22 bp, Homo sapiens
agttttcctctatacatctctc

SEQ ID NO: 4016999 - DNA, 12 bp, Homo sapiens
agttttgaaaag

SEQ ID NO: 4017000 - DNA, 14 bp, Homo sapiens
agttttgaaaagct

SEQ ID NO: 4017001 - DNA, 16 bp, Homo sapiens
agttttgaaaagctat

SEQ ID NO: 4017002 - DNA, 16 bp, Homo sapiens
agttttgcatttatgg

SEQ ID NO: 4017003 - DNA, 21 bp, Homo sapiens
agttttgcttttagtttttct

SEQ ID NO: 4017004 - DNA, 13 bp, Homo sapiens
agtttttctgtcc

SEQ ID NO: 4017005 - DNA, 23 bp, Homo sapiens
agtttttctgttttgtttggcaa

SEQ ID NO: 4017006 - DNA, 21 bp, Homo sapiens
agtttttggataaagaatact

SEQ ID NO: 4017007 - DNA, 13 bp, Homo sapiens
agtttttgtatct

SEQ ID NO: 4017008 - DNA, 14 bp, Homo sapiens
agtttttgtatctt

SEQ ID NO: 4017009 - DNA, 19 bp, Homo sapiens
agttttttttttgtttgtt

SEQ ID NO: 4017010 - DNA, 15 bp, Homo sapiens
ataaaaaattatgac

SEQ ID NO: 4017011 - DNA, 19 bp, Homo sapiens
ataaaaacattttgaagtg

SEQ ID NO: 4017012 - DNA, 13 bp, Homo sapiens
ataaaaagcagaa

SEQ ID NO: 4017013 - DNA, 20 bp, Homo sapiens
ataaaaagcctgcaatttca

SEQ ID NO: 4017014 - DNA, 17 bp, Homo sapiens
ataaaaagtgacacagc

SEQ ID NO: 4017015 - DNA, 19 bp, Homo sapiens
ataaaaagtgacacagcag

SEQ ID NO: 4017016 - DNA, 21 bp, Homo sapiens
ataaaaagtttcacaggtcaa

SEQ ID NO: 4017017 - DNA, 14 bp, Homo sapiens
ataaaaatattgtg

SEQ ID NO: 4017018 - DNA, 22 bp, Homo sapiens
ataaaaatattgtgttgtgaat

SEQ ID NO: 4017019 - DNA, 12 bp, Homo sapiens
ataaaactgaat

SEQ ID NO: 4017020 - DNA, 20 bp, Homo sapiens
ataaaagcataaatgcaaac

SEQ ID NO: 4017021 - DNA, 19 bp, Homo sapiens
ataaaagggtcaaacctgt

SEQ ID NO: 4017022 - DNA, 20 bp, Homo sapiens
ataaaagggtcaaacctgta

SEQ ID NO: 4017023 - DNA, 20 bp, Homo sapiens
ataaaaggtggagtttctct

SEQ ID NO: 4017024 - DNA, 19 bp, Homo sapiens
ataaaagtgaatgaaagat

SEQ ID NO: 4017025 - DNA, 21 bp, Homo sapiens
ataaaagtgaatgaaagatta

SEQ ID NO: 4017026 - DNA, 13 bp, Homo sapiens
ataaaataaagta

SEQ ID NO: 4017027 - DNA, 20 bp, Homo sapiens
ataaaataaataattttaat

SEQ ID NO: 4017028 - DNA, 23 bp, Homo sapiens
ataaaataatgggattttctttt

SEQ ID NO: 4017029 - DNA, 16 bp, Homo sapiens
ataaaatcaaaacaag

SEQ ID NO: 4017030 - DNA, 16 bp, Homo sapiens
ataaaatgaaaattgt

SEQ ID NO: 4017031 - DNA, 17 bp, Homo sapiens
ataaaatgaaaattgta

SEQ ID NO: 4017032 - DNA, 18 bp, Homo sapiens
ataaaatgaaaattgtat

SEQ ID NO: 4017033 - DNA, 19 bp, Homo sapiens
ataaaatgaaaattgtatt

SEQ ID NO: 4017034 - DNA, 12 bp, Homo sapiens
ataaaatgacta

SEQ ID NO: 4017035 - DNA, 16 bp, Homo sapiens
ataaaatgactactta

SEQ ID NO: 4017036 - DNA, 21 bp, Homo sapiens
agggagactgggtaggaaaga

SEQ ID NO: 4017037 - DNA, 16 bp, Homo sapiens
agggagagacctcatc

SEQ ID NO: 4017038 - DNA, 14 bp, Homo sapiens
agggagagggaggt

SEQ ID NO: 4017039 - DNA, 21 bp, Homo sapiens
agggagcggccggccagcccc

SEQ ID NO: 4017040 - DNA, 15 bp, Homo sapiens
agggagctggctcca

SEQ ID NO: 4017041 - DNA, 16 bp, Homo sapiens
agggagctggctccag

SEQ ID NO: 4017042 - DNA, 21 bp, Homo sapiens
agggagctggctccagcctgg

SEQ ID NO: 4017043 - DNA, 22 bp, Homo sapiens
agggagctggctccagcctgga

SEQ ID NO: 4017044 - DNA, 12 bp, Homo sapiens
agggaggcagcc

SEQ ID NO: 4017045 - DNA, 15 bp, Homo sapiens
agggaggcagcctcc

SEQ ID NO: 4017046 - DNA, 12 bp, Homo sapiens
agggaggccaca

SEQ ID NO: 4017047 - DNA, 15 bp, Homo sapiens
agggaggccacacgc

SEQ ID NO: 4017048 - DNA, 17 bp, Homo sapiens
agggagggcagttttct

SEQ ID NO: 4017049 - DNA, 15 bp, Homo sapiens
agggagggctgtcat

SEQ ID NO: 4017050 - DNA, 21 bp, Homo sapiens
agggaggggaaaagcattttt

SEQ ID NO: 4017051 - DNA, 16 bp, Homo sapiens
agggaggggaaatgta

SEQ ID NO: 4017052 - DNA, 23 bp, Homo sapiens
agggaggggaaatgtaatactgg

SEQ ID NO: 4017053 - DNA, 19 bp, Homo sapiens
agggaggtaacgggtgcct

SEQ ID NO: 4017054 - DNA, 20 bp, Homo sapiens
agggaggtgtttaaagagag

SEQ ID NO: 4017055 - DNA, 17 bp, Homo sapiens
agggaggtttgtgagag

SEQ ID NO: 4017056 - DNA, 13 bp, Homo sapiens
agggagtccaggg

SEQ ID NO: 4017057 - DNA, 21 bp, Homo sapiens
agggagtccagggtttctctg

SEQ ID NO: 4017058 - DNA, 15 bp, Homo sapiens
agggagtgctggctc

SEQ ID NO: 4017059 - DNA, 17 bp, Homo sapiens
agggagtgctggctcac

SEQ ID NO: 4017060 - DNA, 21 bp, Homo sapiens
agggagttatctaaaagaaat

SEQ ID NO: 4017061 - DNA, 14 bp, Homo sapiens
agggagttcatctg

SEQ ID NO: 4017062 - DNA, 20 bp, Homo sapiens
agggagttcatctggagggt

SEQ ID NO: 4017063 - DNA, 22 bp, Homo sapiens
agggatcttgcattcccagtgg

SEQ ID NO: 4017064 - DNA, 16 bp, Homo sapiens
agggatgctgggctgg

SEQ ID NO: 4017065 - DNA, 15 bp, Homo sapiens
agggatggaaaagga

SEQ ID NO: 4017066 - DNA, 17 bp, Homo sapiens
agggattaacctctgca

SEQ ID NO: 4017067 - DNA, 18 bp, Homo sapiens
agggattaacctctgcac

SEQ ID NO: 4017068 - DNA, 22 bp, Homo sapiens
agggattctgggcttggggtgt

SEQ ID NO: 4017069 - DNA, 19 bp, Homo sapiens
agggattgaggggccctgg

SEQ ID NO: 4017070 - DNA, 13 bp, Homo sapiens
agggcaagggcca

SEQ ID NO: 4017071 - DNA, 22 bp, Homo sapiens
agggcaagggccatgctgaagg

SEQ ID NO: 4017072 - DNA, 19 bp, Homo sapiens
agggcacagccctccgacc

SEQ ID NO: 4017073 - DNA, 14 bp, Homo sapiens
agggcaccagaggc

SEQ ID NO: 4017074 - DNA, 15 bp, Homo sapiens
agggcaccagaggcc

SEQ ID NO: 4017075 - DNA, 17 bp, Homo sapiens
agggcaccagaggccga

SEQ ID NO: 4017076 - DNA, 17 bp, Homo sapiens
agggcacgcaggaccag

SEQ ID NO: 4017077 - DNA, 21 bp, Homo sapiens
agggcacgcaggaccagtttg

SEQ ID NO: 4017078 - DNA, 13 bp, Homo sapiens
agggcactgggct

SEQ ID NO: 4017079 - DNA, 15 bp, Homo sapiens
agggcactgggctgt

SEQ ID NO: 4017080 - DNA, 20 bp, Homo sapiens
agggcagaaaggttctgccc

SEQ ID NO: 4017081 - DNA, 15 bp, Homo sapiens
agggcagactggggc

SEQ ID NO: 4017082 - DNA, 17 bp, Homo sapiens
agggcagcctggatccc

SEQ ID NO: 4017083 - DNA, 19 bp, Homo sapiens
agggcagcctggatccctg

SEQ ID NO: 4017084 - DNA, 16 bp, Homo sapiens
agggcagcgccaggct

SEQ ID NO: 4017085 - DNA, 19 bp, Homo sapiens
agggcaggaaggagagcct

SEQ ID NO: 4017086 - DNA, 21 bp, Homo sapiens
agggcaggaaggagagcctgc

SEQ ID NO: 4017087 - DNA, 16 bp, Homo sapiens
agggcagggctctgat

SEQ ID NO: 4017088 - DNA, 13 bp, Homo sapiens
agggcagttttct

SEQ ID NO: 4017089 - DNA, 22 bp, Homo sapiens
agggcatgccacgtgggctcat

SEQ ID NO: 4017090 - DNA, 13 bp, Homo sapiens
agggcatgccttg

SEQ ID NO: 4017091 - DNA, 21 bp, Homo sapiens
agggccaaaagcttccctccc

SEQ ID NO: 4017092 - DNA, 23 bp, Homo sapiens
agggccaacttgagggcccagag

SEQ ID NO: 4017093 - DNA, 24 bp, Homo sapiens
agggccacactattaccatgagaa

SEQ ID NO: 4017094 - DNA, 15 bp, Homo sapiens
agggccagagggagc

SEQ ID NO: 4017095 - DNA, 12 bp, Homo sapiens
agggccaggcag

SEQ ID NO: 4017096 - DNA, 14 bp, Homo sapiens
agggccaggcccag

SEQ ID NO: 4017097 - DNA, 23 bp, Homo sapiens
agggccaggcccaggcctcacca

SEQ ID NO: 4017098 - DNA, 20 bp, Homo sapiens
agggccaggggtctccctgg

SEQ ID NO: 4017099 - DNA, 19 bp, Homo sapiens
agggccagtcctgcctggc

SEQ ID NO: 4017100 - DNA, 23 bp, Homo sapiens
agggccagtggggcctgtggaat

SEQ ID NO: 4017101 - DNA, 18 bp, Homo sapiens
agggcccacccatgtcac

SEQ ID NO: 4017102 - DNA, 19 bp, Homo sapiens
agggcccacccatgtcacc

SEQ ID NO: 4017103 - DNA, 13 bp, Homo sapiens
agggcccacccca

SEQ ID NO: 4017104 - DNA, 15 bp, Homo sapiens
agggcccagagccca

SEQ ID NO: 4017105 - DNA, 11 bp, Homo sapiens
agggcccagcc

SEQ ID NO: 4017106 - DNA, 18 bp, Homo sapiens
agggcccagccaggagca

SEQ ID NO: 4017107 - DNA, 18 bp, Homo sapiens
agggcccagcccagagcc

SEQ ID NO: 4017108 - DNA, 17 bp, Homo sapiens
agggcccgcagtgctgg

SEQ ID NO: 4017109 - DNA, 13 bp, Homo sapiens
agggccctacctg

SEQ ID NO: 4017110 - DNA, 15 bp, Homo sapiens
agggccctggccagc

SEQ ID NO: 4017111 - DNA, 17 bp, Homo sapiens
agggccctggccagccg

SEQ ID NO: 4017112 - DNA, 18 bp, Homo sapiens
agggccctggccagccgg

SEQ ID NO: 4017113 - DNA, 18 bp, Homo sapiens
agggcccttggggctggg

SEQ ID NO: 4017114 - DNA, 21 bp, Homo sapiens
agggccgaggaggtgcctgga

SEQ ID NO: 4017115 - DNA, 19 bp, Homo sapiens
agggcctgacaccccctcc

SEQ ID NO: 4017116 - DNA, 17 bp, Homo sapiens
agggcctgctggaggcc

SEQ ID NO: 4017117 - DNA, 17 bp, Homo sapiens
agggcctggagccccat

SEQ ID NO: 4017118 - DNA, 15 bp, Homo sapiens
agggcctggcaggcc

SEQ ID NO: 4017119 - DNA, 19 bp, Homo sapiens
agggcctggcaggccagtg

SEQ ID NO: 4017120 - DNA, 22 bp, Homo sapiens
agggcctggggcctgagagaat

SEQ ID NO: 4017121 - DNA, 12 bp, Homo sapiens
agggcctgtggg

SEQ ID NO: 4017122 - DNA, 18 bp, Homo sapiens
agggcctgtgggagcctg

SEQ ID NO: 4017123 - DNA, 19 bp, Homo sapiens
agggcctgtgggagcctgc

SEQ ID NO: 4017124 - DNA, 20 bp, Homo sapiens
agggcgaacgacaatagctt

SEQ ID NO: 4017125 - DNA, 21 bp, Homo sapiens
agggcgaggattataaatgaa

SEQ ID NO: 4017126 - DNA, 20 bp, Homo sapiens
agggcgaggggttggtggga

SEQ ID NO: 4017127 - DNA, 13 bp, Homo sapiens
agggcgagtgaat

SEQ ID NO: 4017128 - DNA, 17 bp, Homo sapiens
agggcgccgccggccct

SEQ ID NO: 4017129 - DNA, 19 bp, Homo sapiens
agggcgctcagacggcggc

SEQ ID NO: 4017130 - DNA, 20 bp, Homo sapiens
agggcgctcagacggcggcc

SEQ ID NO: 4017131 - DNA, 22 bp, Homo sapiens
agggcgctcagacggcggccag

SEQ ID NO: 4017132 - DNA, 17 bp, Homo sapiens
agggcgggcagagggct

SEQ ID NO: 4017133 - DNA, 20 bp, Homo sapiens
agggcgggcagagggctgga

SEQ ID NO: 4017134 - DNA, 15 bp, Homo sapiens
agggcggtgctagct

SEQ ID NO: 4017135 - DNA, 22 bp, Homo sapiens
agggctagtgacttgtgtccca

SEQ ID NO: 4017136 - DNA, 14 bp, Homo sapiens
agggctcaacactg

SEQ ID NO: 4017137 - DNA, 13 bp, Homo sapiens
agggctcccaggg

SEQ ID NO: 4017138 - DNA, 14 bp, Homo sapiens
agggctcccagggg

SEQ ID NO: 4017139 - DNA, 19 bp, Homo sapiens
aggccccactgatgctgtt

SEQ ID NO: 4017140 - DNA, 11 bp, Homo sapiens
aggccccagac

SEQ ID NO: 4017141 - DNA, 17 bp, Homo sapiens
aggccccagacagggtg

SEQ ID NO: 4017142 - DNA, 21 bp, Homo sapiens
aggcccccaaacatagcccct

SEQ ID NO: 4017143 - DNA, 14 bp, Homo sapiens
aggcccccacttct

SEQ ID NO: 4017144 - DNA, 13 bp, Homo sapiens
aggccccctgcat

SEQ ID NO: 4017145 - DNA, 16 bp, Homo sapiens
aggccccctgcatcta

SEQ ID NO: 4017146 - DNA, 20 bp, Homo sapiens
aggccccgccccatgggccc

SEQ ID NO: 4017147 - DNA, 16 bp, Homo sapiens
aggcccctggagccag

SEQ ID NO: 4017148 - DNA, 12 bp, Homo sapiens
aggcccctgggg

SEQ ID NO: 4017149 - DNA, 13 bp, Homo sapiens
aggcccctggggc

SEQ ID NO: 4017150 - DNA, 15 bp, Homo sapiens
aggcccctgggtttc

SEQ ID NO: 4017151 - DNA, 18 bp, Homo sapiens
aggccccttctctccctg

SEQ ID NO: 4017152 - DNA, 22 bp, Homo sapiens
aggcccgcaccccggcctcagg

SEQ ID NO: 4017153 - DNA, 19 bp, Homo sapiens
aggccctcaatccaccttc

SEQ ID NO: 4017154 - DNA, 17 bp, Homo sapiens
aggccctccctgactcc

SEQ ID NO: 4017155 - DNA, 18 bp, Homo sapiens
aggccctgactcctctgg

SEQ ID NO: 4017156 - DNA, 20 bp, Homo sapiens
aggccctgactcctctggct

SEQ ID NO: 4017157 - DNA, 22 bp, Homo sapiens
aggccctgactcctctggcttt

SEQ ID NO: 4017158 - DNA, 22 bp, Homo sapiens
aggccctgctcctgcagcatgg

SEQ ID NO: 4017159 - DNA, 16 bp, Homo sapiens
aggccctgctgagtca

SEQ ID NO: 4017160 - DNA, 14 bp, Homo sapiens
aggccctgctgccc

SEQ ID NO: 4017161 - DNA, 10 bp, Homo sapiens
aggccctggc

SEQ ID NO: 4017162 - DNA, 13 bp, Homo sapiens
aggcccttcctct

SEQ ID NO: 4017163 - DNA, 18 bp, Homo sapiens
aggcccttcctctccact

SEQ ID NO: 4017164 - DNA, 24 bp, Homo sapiens
aggccctttgaagcctcagctacc

SEQ ID NO: 4017165 - DNA, 17 bp, Homo sapiens
aggccgaaggtgcctca

SEQ ID NO: 4017166 - DNA, 17 bp, Homo sapiens
aggccgagcgttcccag

SEQ ID NO: 4017167 - DNA, 18 bp, Homo sapiens
aggccgagcgttcccagc

SEQ ID NO: 4017168 - DNA, 16 bp, Homo sapiens
aggccgaggcgggtgg

SEQ ID NO: 4017169 - DNA, 15 bp, Homo sapiens
aggccggaaccacag

SEQ ID NO: 4017170 - DNA, 22 bp, Homo sapiens
aggccggaaccacagggccaga

SEQ ID NO: 4017171 - DNA, 14 bp, Homo sapiens
aggccgggcagagc

SEQ ID NO: 4017172 - DNA, 14 bp, Homo sapiens
aggccgtgccttgt

SEQ ID NO: 4017173 - DNA, 16 bp, Homo sapiens
aggccgtgtctctgag

SEQ ID NO: 4017174 - DNA, 16 bp, Homo sapiens
aggcctaaaagtaaac

SEQ ID NO: 4017175 - DNA, 17 bp, Homo sapiens
aggcctacagccacatc

SEQ ID NO: 4017176 - DNA, 18 bp, Homo sapiens
aggcctacagccacatcc

SEQ ID NO: 4017177 - DNA, 13 bp, Homo sapiens
aggcctcaagaac

SEQ ID NO: 4017178 - DNA, 18 bp, Homo sapiens
aggcctccctcaggctct

SEQ ID NO: 4017179 - DNA, 14 bp, Homo sapiens
aggcctccctgcca

SEQ ID NO: 4017180 - DNA, 15 bp, Homo sapiens
aggcctccctgccag

SEQ ID NO: 4017181 - DNA, 21 bp, Homo sapiens
aggcctctccagtttgcacct

SEQ ID NO: 4017182 - DNA, 20 bp, Homo sapiens
aggcctctgctgccgccctt

SEQ ID NO: 4017183 - DNA, 22 bp, Homo sapiens
aggcctctgtgtccttccctgc

SEQ ID NO: 4017184 - DNA, 19 bp, Homo sapiens
aggcctcttgtaaagactg

SEQ ID NO: 4017185 - DNA, 21 bp, Homo sapiens
aggcctgaaagaggctgaggc

SEQ ID NO: 4017186 - DNA, 13 bp, Homo sapiens
aggcctgaagcca

SEQ ID NO: 4017187 - DNA, 23 bp, Homo sapiens
aggcctgaatcatgagcctgctg

SEQ ID NO: 4017188 - DNA, 20 bp, Homo sapiens
aggcctgaatccaaaagaaa

SEQ ID NO: 4017189 - DNA, 23 bp, Homo sapiens
aggcctgaatccaaaagaaaaac

SEQ ID NO: 4017190 - DNA, 17 bp, Homo sapiens
aggcctgacttctgctg

SEQ ID NO: 4017191 - DNA, 21 bp, Homo sapiens
aggcctgacttctgctggcat

SEQ ID NO: 4017192 - DNA, 16 bp, Homo sapiens
aggcctgccctcaggg

SEQ ID NO: 4017193 - DNA, 22 bp, Homo sapiens
aggcctgccctcagggatcttg

SEQ ID NO: 4017194 - DNA, 18 bp, Homo sapiens
aggcctgcctcccacttc

SEQ ID NO: 4017195 - DNA, 22 bp, Homo sapiens
aggcctgcctcccacttcactg

SEQ ID NO: 4017196 - DNA, 18 bp, Homo sapiens
aggcctgctgccagtgca

SEQ ID NO: 4017197 - DNA, 11 bp, Homo sapiens
aggcctggcca

SEQ ID NO: 4017198 - DNA, 12 bp, Homo sapiens
aggcctggctgg

SEQ ID NO: 4017199 - DNA, 23 bp, Homo sapiens
aggcctgggtgctggctgcccag

SEQ ID NO: 4017200 - DNA, 22 bp, Homo sapiens
aggcctgtcccaattctgcccg

SEQ ID NO: 4017201 - DNA, 17 bp, Homo sapiens
aggcctgtcccttgcct

SEQ ID NO: 4017202 - DNA, 18 bp, Homo sapiens
aggcctgtcccttgcctc

SEQ ID NO: 4017203 - DNA, 20 bp, Homo sapiens
aggcctgtcccttgcctctg

SEQ ID NO: 4017204 - DNA, 23 bp, Homo sapiens
aggcctgtggccccaccgagctg

SEQ ID NO: 4017205 - DNA, 23 bp, Homo sapiens
aggcctgtgtgtgaaaggaagct

SEQ ID NO: 4017206 - DNA, 16 bp, Homo sapiens
aggccttccagctgct

SEQ ID NO: 4017207 - DNA, 17 bp, Homo sapiens
aggccttccagctgctg

SEQ ID NO: 4017208 - DNA, 15 bp, Homo sapiens
aggccttcctctctc

SEQ ID NO: 4017209 - DNA, 19 bp, Homo sapiens
aggccttcctctctccaga

SEQ ID NO: 4017210 - DNA, 23 bp, Homo sapiens
aggcgacgcggttttttcacttc

SEQ ID NO: 4017211 - DNA, 14 bp, Homo sapiens
aggcgagtgccagg

SEQ ID NO: 4017212 - DNA, 20 bp, Homo sapiens
aggcgatggggcaagacaga

SEQ ID NO: 4017213 - DNA, 21 bp, Homo sapiens
aggcgcagtgcttctctacag

SEQ ID NO: 4017214 - DNA, 15 bp, Homo sapiens
aggcgctagcacagc

SEQ ID NO: 4017215 - DNA, 24 bp, Homo sapiens
aggcggagagtacagtgagccaag

SEQ ID NO: 4017216 - DNA, 22 bp, Homo sapiens
aggcggaggctgtgctccgcca

SEQ ID NO: 4017217 - DNA, 12 bp, Homo sapiens
aggcggcccctc

SEQ ID NO: 4017218 - DNA, 16 bp, Homo sapiens
aggcggcccctcccgc

SEQ ID NO: 4017219 - DNA, 14 bp, Homo sapiens
aggcgggaggaggt

SEQ ID NO: 4017220 - DNA, 23 bp, Homo sapiens
aggcggtccccatccccaccagc

SEQ ID NO: 4017221 - DNA, 12 bp, Homo sapiens
aggcgtgatcca

SEQ ID NO: 4017222 - DNA, 13 bp, Homo sapiens
aggctaaacatcc

SEQ ID NO: 4017223 - DNA, 14 bp, Homo sapiens
aggctaagctgccg

SEQ ID NO: 4017224 - DNA, 19 bp, Homo sapiens
aggctaatgttggcagatg

SEQ ID NO: 4017225 - DNA, 22 bp, Homo sapiens
aggctaatgttggcagatgcag

SEQ ID NO: 4017226 - DNA, 17 bp, Homo sapiens
aggctagcttctgcttt

SEQ ID NO: 4017227 - DNA, 11 bp, Homo sapiens
aggctatttgt

SEQ ID NO: 4017228 - DNA, 13 bp, Homo sapiens
aggctcactgcca

SEQ ID NO: 4017229 - DNA, 16 bp, Homo sapiens
aggctcactgccaggc

SEQ ID NO: 4017230 - DNA, 20 bp, Homo sapiens
aggctcactgccaggccagc

SEQ ID NO: 4017231 - DNA, 21 bp, Homo sapiens
aggctcactgccaggccagcc

SEQ ID NO: 4017232 - DNA, 17 bp, Homo sapiens
agcctagctcctgccac

SEQ ID NO: 4017233 - DNA, 21 bp, Homo sapiens
agcctagctcctgccacatgg

SEQ ID NO: 4017234 - DNA, 19 bp, Homo sapiens
agcctaggaggactggggt

SEQ ID NO: 4017235 - DNA, 17 bp, Homo sapiens
agcctagttcatccaat

SEQ ID NO: 4017236 - DNA, 17 bp, Homo sapiens
agcctcactgatatatt

SEQ ID NO: 4017237 - DNA, 19 bp, Homo sapiens
agcctcatactcctgggct

SEQ ID NO: 4017238 - DNA, 15 bp, Homo sapiens
agcctcatatttaaa

SEQ ID NO: 4017239 - DNA, 16 bp, Homo sapiens
agcctcatatttaaag

SEQ ID NO: 4017240 - DNA, 22 bp, Homo sapiens
agcctccaagcacagagcctgg

SEQ ID NO: 4017241 - DNA, 20 bp, Homo sapiens
agcctccactgcctctggaa

SEQ ID NO: 4017242 - DNA, 17 bp, Homo sapiens
agcctccagggcccccc

SEQ ID NO: 4017243 - DNA, 22 bp, Homo sapiens
agcctccagtccaaagccggct

SEQ ID NO: 4017244 - DNA, 23 bp, Homo sapiens
agcctccagtccaaagccggctt

SEQ ID NO: 4017245 - DNA, 20 bp, Homo sapiens
agcctccatttagttctttg

SEQ ID NO: 4017246 - DNA, 19 bp, Homo sapiens
agcctccccatctgtccag

SEQ ID NO: 4017247 - DNA, 23 bp, Homo sapiens
agcctccccctcagatgatctct

SEQ ID NO: 4017248 - DNA, 14 bp, Homo sapiens
agcctccctgaagc

SEQ ID NO: 4017249 - DNA, 16 bp, Homo sapiens
agcctccctgtctcca

SEQ ID NO: 4017250 - DNA, 22 bp, Homo sapiens
agcctccctgtctccagctgcc

SEQ ID NO: 4017251 - DNA, 23 bp, Homo sapiens
agcctccctgtctccagctgcct

SEQ ID NO: 4017252 - DNA, 11 bp, Homo sapiens
agcctcctctg

SEQ ID NO: 4017253 - DNA, 14 bp, Homo sapiens
agcctcctctggac

SEQ ID NO: 4017254 - DNA, 18 bp, Homo sapiens
agcctcctctggacggca

SEQ ID NO: 4017255 - DNA, 18 bp, Homo sapiens
agcctcctctgtctgccc

SEQ ID NO: 4017256 - DNA, 20 bp, Homo sapiens
agcctcctctgtctgccctt

SEQ ID NO: 4017257 - DNA, 21 bp, Homo sapiens
agcctcctctgtctgcccttc

SEQ ID NO: 4017258 - DNA, 18 bp, Homo sapiens
agcctcctgtgcctggcc

SEQ ID NO: 4017259 - DNA, 22 bp, Homo sapiens
agcctcgcaggcctccctgcca

SEQ ID NO: 4017260 - DNA, 14 bp, Homo sapiens
agcctcgcctgtca

SEQ ID NO: 4017261 - DNA, 15 bp, Homo sapiens
agcctcgcctgtcac

SEQ ID NO: 4017262 - DNA, 19 bp, Homo sapiens
agcctcgcctgtcaccccc

SEQ ID NO: 4017263 - DNA, 21 bp, Homo sapiens
agcctcgcctgtcacccccac

SEQ ID NO: 4017264 - DNA, 21 bp, Homo sapiens
agcctcgttggaagaggaaca

SEQ ID NO: 4017265 - DNA, 17 bp, Homo sapiens
agcctcgttttgatgcc

SEQ ID NO: 4017266 - DNA, 23 bp, Homo sapiens
agcctctccaggaatgcctcctc

SEQ ID NO: 4017267 - DNA, 14 bp, Homo sapiens
agcctctggacagc

SEQ ID NO: 4017268 - DNA, 17 bp, Homo sapiens
agcctctggacagccag

SEQ ID NO: 4017269 - DNA, 22 bp, Homo sapiens
agcctctggcattagaattatt

SEQ ID NO: 4017270 - DNA, 12 bp, Homo sapiens
agcctctttccc

SEQ ID NO: 4017271 - DNA, 21 bp, Homo sapiens
agcctctttcccttccagttt

SEQ ID NO: 4017272 - DNA, 22 bp, Homo sapiens
agctgctatccccatctccctg

SEQ ID NO: 4017273 - DNA, 16 bp, Homo sapiens
agctgctccaggcctg

SEQ ID NO: 4017274 - DNA, 18 bp, Homo sapiens
agctgctccaggcctgca

SEQ ID NO: 4017275 - DNA, 18 bp, Homo sapiens
agctgctctgagccacag

SEQ ID NO: 4017276 - DNA, 14 bp, Homo sapiens
agctgctctggaaa

SEQ ID NO: 4017277 - DNA, 15 bp, Homo sapiens
agctgctctggaaaa

SEQ ID NO: 4017278 - DNA, 17 bp, Homo sapiens
agctgctgaccaattgt

SEQ ID NO: 4017279 - DNA, 23 bp, Homo sapiens
agctgctgaccaattgtgctgcc

SEQ ID NO: 4017280 - DNA, 17 bp, Homo sapiens
agctgctggcttgcagt

SEQ ID NO: 4017281 - DNA, 18 bp, Homo sapiens
agctgctgtcttctggac

SEQ ID NO: 4017282 - DNA, 16 bp, Homo sapiens
agctgctgttctcagg

SEQ ID NO: 4017283 - DNA, 21 bp, Homo sapiens
agctgctgttctcaggacagc

SEQ ID NO: 4017284 - DNA, 15 bp, Homo sapiens
agctgcttgcccaag

SEQ ID NO: 4017285 - DNA, 20 bp, Homo sapiens
agctgcttgcccaagtcaca

SEQ ID NO: 4017286 - DNA, 19 bp, Homo sapiens
agctgctttctgttgtcat

SEQ ID NO: 4017287 - DNA, 14 bp, Homo sapiens
agctggacttctgt

SEQ ID NO: 4017288 - DNA, 20 bp, Homo sapiens
agctggacttctgtgggccc

SEQ ID NO: 4017289 - DNA, 23 bp, Homo sapiens
agctggagcggagaggaagccag

SEQ ID NO: 4017290 - DNA, 12 bp, Homo sapiens
agctggccctgc

SEQ ID NO: 4017291 - DNA, 18 bp, Homo sapiens
agctggccctgcctcctg

SEQ ID NO: 4017292 - DNA, 22 bp, Homo sapiens
agctggccctgcctcctgggaa

SEQ ID NO: 4017293 - DNA, 23 bp, Homo sapiens
agctggccctgcctcctgggaag

SEQ ID NO: 4017294 - DNA, 12 bp, Homo sapiens
agctggcctgag

SEQ ID NO: 4017295 - DNA, 17 bp, Homo sapiens
agctggctccagcctgg

SEQ ID NO: 4017296 - DNA, 15 bp, Homo sapiens
agctgggaccagtac

SEQ ID NO: 4017297 - DNA, 10 bp, Homo sapiens
agctgggcaa

SEQ ID NO: 4017298 - DNA, 16 bp, Homo sapiens
agctgggctggggagg

SEQ ID NO: 4017299 - DNA, 14 bp, Homo sapiens
agctggggacctgg

SEQ ID NO: 4017300 - DNA, 20 bp, Homo sapiens
agctttccacatttgtcaca

SEQ ID NO: 4017301 - DNA, 23 bp, Homo sapiens
agctttcctgccccaggcctgaa

SEQ ID NO: 4017302 - DNA, 12 bp, Homo sapiens
agctttctgtat

SEQ ID NO: 4017303 - DNA, 15 bp, Homo sapiens
agctttcttctacaa

SEQ ID NO: 4017304 - DNA, 20 bp, Homo sapiens
agctttcttctacaaccaga

SEQ ID NO: 4017305 - DNA, 21 bp, Homo sapiens
agctttcttctacaaccagag

SEQ ID NO: 4017306 - DNA, 22 bp, Homo sapiens
agctttcttctacaaccagagc

SEQ ID NO: 4017307 - DNA, 17 bp, Homo sapiens
agctttcttgctccctt

SEQ ID NO: 4017308 - DNA, 20 bp, Homo sapiens
agctttgccagctgctgctg

SEQ ID NO: 4017309 - DNA, 16 bp, Homo sapiens
agctttggaaacagga

SEQ ID NO: 4017310 - DNA, 14 bp, Homo sapiens
agctttgtgcttgt

SEQ ID NO: 4017311 - DNA, 23 bp, Homo sapiens
agctttgtgtttggtttacattt

SEQ ID NO: 4017312 - DNA, 17 bp, Homo sapiens
agcttttgccagtatta

SEQ ID NO: 4017313 - DNA, 18 bp, Homo sapiens
agcttttgccagtattat

SEQ ID NO: 4017314 - DNA, 19 bp, Homo sapiens
agcttttgccagtattatg

SEQ ID NO: 4017315 - DNA, 17 bp, Homo sapiens
agctttttaaaacatta

SEQ ID NO: 4017316 - DNA, 17 bp, Homo sapiens
agctttttaattgttgt

SEQ ID NO: 4017317 - DNA, 15 bp, Homo sapiens
agctttttcctcctg

SEQ ID NO: 4017318 - DNA, 14 bp, Homo sapiens
agcttttttcttta

SEQ ID NO: 4017319 - DNA, 14 bp, Homo sapiens
aggaaaaataatca

SEQ ID NO: 4017320 - DNA, 19 bp, Homo sapiens
aggaaaaccaagccgtggc

SEQ ID NO: 4017321 - DNA, 20 bp, Homo sapiens
aggaaaaccaagccgtggct

SEQ ID NO: 4017322 - DNA, 22 bp, Homo sapiens
aggaaaaccaagccgtggcttc

SEQ ID NO: 4017323 - DNA, 19 bp, Homo sapiens
aggaaaagtacatttaata

SEQ ID NO: 4017324 - DNA, 22 bp, Homo sapiens
aggaaaagtacatttaatacag

SEQ ID NO: 4017325 - DNA, 20 bp, Homo sapiens
aggaaaataatacttatctt

SEQ ID NO: 4017326 - DNA, 16 bp, Homo sapiens
aggaaaatgagtattt

SEQ ID NO: 4017327 - DNA, 16 bp, Homo sapiens
aggaaacgctacctct

SEQ ID NO: 4017328 - DNA, 16 bp, Homo sapiens
aggaaactccacatct

SEQ ID NO: 4017329 - DNA, 21 bp, Homo sapiens
aggaaactccacatctgcctt

SEQ ID NO: 4017330 - DNA, 12 bp, Homo sapiens
aggaaactctta

SEQ ID NO: 4017331 - DNA, 13 bp, Homo sapiens
aggaaagaaaaca

SEQ ID NO: 4017332 - DNA, 17 bp, Homo sapiens
aggaaagaaagaaggaa

SEQ ID NO: 4017333 - DNA, 18 bp, Homo sapiens
aggaaagcaataaatgaa

SEQ ID NO: 4017334 - DNA, 19 bp, Homo sapiens
aggaaagccccagcactaa

SEQ ID NO: 4017335 - DNA, 14 bp, Homo sapiens
aggaaagccctccc

SEQ ID NO: 4017336 - DNA, 17 bp, Homo sapiens
aggaaagccctccccct

SEQ ID NO: 4017337 - DNA, 20 bp, Homo sapiens
aggaaagcctcactgatata

SEQ ID NO: 4017338 - DNA, 14 bp, Homo sapiens
aggaaaggagatca

SEQ ID NO: 4017339 - DNA, 14 bp, Homo sapiens
aggaaagggaggag

SEQ ID NO: 4017340 - DNA, 20 bp, Homo sapiens
aggaaaggtctcagcttgta

SEQ ID NO: 4017341 - DNA, 16 bp, Homo sapiens
aggaaatccattgttt

SEQ ID NO: 4017342 - DNA, 11 bp, Homo sapiens
aggaaatctgt

SEQ ID NO: 4017343 - DNA, 23 bp, Homo sapiens
aggaaattgagattagagggagg

SEQ ID NO: 4017344 - DNA, 23 bp, Homo sapiens
aggaacacccgactcctcaaaag

SEQ ID NO: 4017345 - DNA, 14 bp, Homo sapiens
aggaacagcagtgt

SEQ ID NO: 4017346 - DNA, 21 bp, Homo sapiens
aggaacagctatgggagcccc

SEQ ID NO: 4017347 - DNA, 15 bp, Homo sapiens
aggaacagtggctgg

SEQ ID NO: 4017348 - DNA, 21 bp, Homo sapiens
aggaacagtgtggtttgggaa

SEQ ID NO: 4017349 - DNA, 16 bp, Homo sapiens
aggaacatatgaaaat

SEQ ID NO: 4017350 - DNA, 16 bp, Homo sapiens
aggaacccccaccaga

SEQ ID NO: 4017351 - DNA, 18 bp, Homo sapiens
aggaacccccaccagaca

SEQ ID NO: 4017352 - DNA, 22 bp, Homo sapiens
aggaaccttccttcctgcttga

SEQ ID NO: 4017353 - DNA, 14 bp, Homo sapiens
aggaactcccagca

SEQ ID NO: 4017354 - DNA, 23 bp, Homo sapiens
aggaactcccagcaacacaagct

SEQ ID NO: 4017355 - DNA, 22 bp, Homo sapiens
aggaactcgcacctgtgctgga

SEQ ID NO: 4017356 - DNA, 13 bp, Homo sapiens
aggaactctggct

SEQ ID NO: 4017357 - DNA, 15 bp, Homo sapiens
aggaactgtccagag

SEQ ID NO: 4017358 - DNA, 16 bp, Homo sapiens
aggaagagctaataaa

SEQ ID NO: 4017359 - DNA, 14 bp, Homo sapiens
aggaagagggacag

SEQ ID NO: 4017360 - DNA, 18 bp, Homo sapiens
aggaagagggctgagctg

SEQ ID NO: 4017361 - DNA, 17 bp, Homo sapiens
aggaagatgaaagagga

SEQ ID NO: 4017362 - DNA, 17 bp, Homo sapiens
aggaagcagcctcagag

SEQ ID NO: 4017363 - DNA, 13 bp, Homo sapiens
aggaagccagctg

SEQ ID NO: 4017364 - DNA, 14 bp, Homo sapiens
aggaagccagctgg

SEQ ID NO: 4017365 - DNA, 16 bp, Homo sapiens
aggaagccaggctgag

SEQ ID NO: 4017366 - DNA, 18 bp, Homo sapiens
aggaagccaggctgagtg

SEQ ID NO: 4017367 - DNA, 15 bp, Homo sapiens
aggaagccttgctca

SEQ ID NO: 4017368 - DNA, 15 bp, Homo sapiens
aggaagctccactgt

SEQ ID NO: 4017369 - DNA, 18 bp, Homo sapiens
aggaagctggcagaacgg

SEQ ID NO: 4017370 - DNA, 20 bp, Homo sapiens
aggaaggaggggagagacag

SEQ ID NO: 4017371 - DNA, 15 bp, Homo sapiens
aggaaggattgtaaa

SEQ ID NO: 4017372 - DNA, 13 bp, Homo sapiens
aggaaggcaagag

SEQ ID NO: 4017373 - DNA, 17 bp, Homo sapiens
aggaagggcaggaagga

SEQ ID NO: 4017374 - DNA, 16 bp, Homo sapiens
aggaaggtctcattct

SEQ ID NO: 4017375 - DNA, 23 bp, Homo sapiens
aggaagtccttatctagctgcat

SEQ ID NO: 4017376 - DNA, 16 bp, Homo sapiens
aggaagttttctgtag

SEQ ID NO: 4017377 - DNA, 21 bp, Homo sapiens
aggaataaataaaaatggata

SEQ ID NO: 4017378 - DNA, 21 bp, Homo sapiens
cagccccttctcccagcacac

SEQ ID NO: 4017379 - DNA, 14 bp, Homo sapiens
cagcccgcacacct

SEQ ID NO: 4017380 - DNA, 15 bp, Homo sapiens
cagcccgcacacctg

SEQ ID NO: 4017381 - DNA, 16 bp, Homo sapiens
cagcccgcacacctgc

SEQ ID NO: 4017382 - DNA, 15 bp, Homo sapiens
cagcccggaccttgg

SEQ ID NO: 4017383 - DNA, 18 bp, Homo sapiens
cagcccggaccttggcag

SEQ ID NO: 4017384 - DNA, 12 bp, Homo sapiens
cagcccggcctg

SEQ ID NO: 4017385 - DNA, 19 bp, Homo sapiens
cagccctaaggatctctca

SEQ ID NO: 4017386 - DNA, 21 bp, Homo sapiens
cagccctaaggatctctcagg

SEQ ID NO: 4017387 - DNA, 13 bp, Homo sapiens
cagccctcagttc

SEQ ID NO: 4017388 - DNA, 13 bp, Homo sapiens
cagccctccctgc

SEQ ID NO: 4017389 - DNA, 15 bp, Homo sapiens
cagccctccctgccc

SEQ ID NO: 4017390 - DNA, 18 bp, Homo sapiens
cagccctccctgcccctc

SEQ ID NO: 4017391 - DNA, 16 bp, Homo sapiens
cagccctgcagcccaa

SEQ ID NO: 4017392 - DNA, 16 bp, Homo sapiens
cagcccttcctctgct

SEQ ID NO: 4017393 - DNA, 18 bp, Homo sapiens
cagcccttcctctgctcc

SEQ ID NO: 4017394 - DNA, 14 bp, Homo sapiens
cagcccttgggcag

SEQ ID NO: 4017395 - DNA, 12 bp, Homo sapiens
cagccgagccgg

SEQ ID NO: 4017396 - DNA, 18 bp, Homo sapiens
cagccgagccgggcctgg

SEQ ID NO: 4017397 - DNA, 15 bp, Homo sapiens
cagccgccagctggg

SEQ ID NO: 4017398 - DNA, 18 bp, Homo sapiens
cagccgccattgccacca

SEQ ID NO: 4017399 - DNA, 15 bp, Homo sapiens
cagccgccccagccc

SEQ ID NO: 4017400 - DNA, 14 bp, Homo sapiens
cagccgctccagag

SEQ ID NO: 4017401 - DNA, 18 bp, Homo sapiens
cagccgctccagagtcag

SEQ ID NO: 4017402 - DNA, 14 bp, Homo sapiens
cagccggcacccac

SEQ ID NO: 4017403 - DNA, 16 bp, Homo sapiens
cagccgggagcttggc

SEQ ID NO: 4017404 - DNA, 18 bp, Homo sapiens
cagccgggagcttggctc

SEQ ID NO: 4017405 - DNA, 20 bp, Homo sapiens
cagccgggagcttggctctc

SEQ ID NO: 4017406 - DNA, 18 bp, Homo sapiens
cagccgtcagccaaatgt

SEQ ID NO: 4017407 - DNA, 19 bp, Homo sapiens
cagccgtcagccaaatgta

SEQ ID NO: 4017408 - DNA, 17 bp, Homo sapiens
cagcctatgggggctct

SEQ ID NO: 4017409 - DNA, 17 bp, Homo sapiens
cagcctcatactcctgg

SEQ ID NO: 4017410 - DNA, 22 bp, Homo sapiens
cagcctcatactcctgggctca

SEQ ID NO: 4017411 - DNA, 13 bp, Homo sapiens
cagcctccagggc

SEQ ID NO: 4017412 - DNA, 15 bp, Homo sapiens
cagcctccagggccc

SEQ ID NO: 4017413 - DNA, 16 bp, Homo sapiens
cagcctcccaccccca

SEQ ID NO: 4017414 - DNA, 14 bp, Homo sapiens
cagcctccccaccc

SEQ ID NO: 4017415 - DNA, 17 bp, Homo sapiens
cagcctccccacccagg

SEQ ID NO: 4017416 - DNA, 12 bp, Homo sapiens
cagcctccctga

SEQ ID NO: 4017417 - DNA, 17 bp, Homo sapiens
cagcctccctgaagcct

SEQ ID NO: 4017418 - DNA, 13 bp, Homo sapiens
cagcctccctgtc

SEQ ID NO: 4017419 - DNA, 14 bp, Homo sapiens
cagcctccctgtct

SEQ ID NO: 4017420 - DNA, 19 bp, Homo sapiens
cagcctccctgtctccagc

SEQ ID NO: 4017421 - DNA, 21 bp, Homo sapiens
cagcctccctgtctccagctg

SEQ ID NO: 4017422 - DNA, 23 bp, Homo sapiens
cagcctccctgtctccagctgcc

SEQ ID NO: 4017423 - DNA, 19 bp, Homo sapiens
cagcctccgagagggagag

SEQ ID NO: 4017424 - DNA, 17 bp, Homo sapiens
cagcctcctctggacgg

SEQ ID NO: 4017425 - DNA, 16 bp, Homo sapiens
cagcctcctgagcctg

SEQ ID NO: 4017426 - DNA, 17 bp, Homo sapiens
cagcctcctgagcctgt

SEQ ID NO: 4017427 - DNA, 22 bp, Homo sapiens
cagcctcgcctgtcacccccac

SEQ ID NO: 4017428 - DNA, 22 bp, Homo sapiens
cagcctcgttggaagaggaaca

SEQ ID NO: 4017429 - DNA, 13 bp, Homo sapiens
cagcctctggaca

SEQ ID NO: 4017430 - DNA, 17 bp, Homo sapiens
cagcctctggacagcca

SEQ ID NO: 4017431 - DNA, 20 bp, Homo sapiens
cagcctctggacagccagtg

SEQ ID NO: 4017432 - DNA, 21 bp, Homo sapiens
cagcctctggacagccagtga

SEQ ID NO: 4017433 - DNA, 16 bp, Homo sapiens
cagcctctttcccttc

SEQ ID NO: 4017434 - DNA, 20 bp, Homo sapiens
cagcctctttcccttccagt

SEQ ID NO: 4017435 - DNA, 17 bp, Homo sapiens
cagcctgacctgagact

SEQ ID NO: 4017436 - DNA, 16 bp, Homo sapiens
cagcctgagcaactct

SEQ ID NO: 4017437 - DNA, 16 bp, Homo sapiens
cagcctgagtctcctg

SEQ ID NO: 4017438 - DNA, 23 bp, Homo sapiens
cagcctgcccaagcccaggccac

SEQ ID NO: 4017439 - DNA, 21 bp, Homo sapiens
cagcctgccttgcccactcct

SEQ ID NO: 4017440 - DNA, 21 bp, Homo sapiens
cagcctgctctagtgggacag

SEQ ID NO: 4017441 - DNA, 10 bp, Homo sapiens
cagcctgctg

SEQ ID NO: 4017442 - DNA, 14 bp, Homo sapiens
cagcctgctgccca

SEQ ID NO: 4017443 - DNA, 20 bp, Homo sapiens
cagcctggccaacatgctga

SEQ ID NO: 4017444 - DNA, 15 bp, Homo sapiens
cagcctggccagaca

SEQ ID NO: 4017445 - DNA, 21 bp, Homo sapiens
cagcctggctggtcctcccat

SEQ ID NO: 4017446 - DNA, 13 bp, Homo sapiens
cagcctgggagcc

SEQ ID NO: 4017447 - DNA, 16 bp, Homo sapiens
cagcctgggagcccag

SEQ ID NO: 4017448 - DNA, 20 bp, Homo sapiens
cagcctgggcaacagagcaa

SEQ ID NO: 4017449 - DNA, 20 bp, Homo sapiens
cagcctgggcagcatagcaa

SEQ ID NO: 4017450 - DNA, 12 bp, Homo sapiens
cagcctgggcca

SEQ ID NO: 4017451 - DNA, 18 bp, Homo sapiens
cagcctggggctggcctc

SEQ ID NO: 4017452 - DNA, 17 bp, Homo sapiens
cagcctgggggccagtg

SEQ ID NO: 4017453 - DNA, 19 bp, Homo sapiens
cagcctggtcgccttccac

SEQ ID NO: 4017454 - DNA, 23 bp, Homo sapiens
cagcctggtcgccttccacctct

SEQ ID NO: 4017455 - DNA, 19 bp, Homo sapiens
cagcctgtcccatggacac

SEQ ID NO: 4017456 - DNA, 22 bp, Homo sapiens
cagcctgtcccatggacactcc

SEQ ID NO: 4017457 - DNA, 15 bp, Homo sapiens
cagcctgtggcatct

SEQ ID NO: 4017458 - DNA, 19 bp, Homo sapiens
cagcctgtggttacagtgc

SEQ ID NO: 4017459 - DNA, 22 bp, Homo sapiens
cagcctgtggttacagtgcaga

SEQ ID NO: 4017460 - DNA, 19 bp, Homo sapiens
cagccttcggacagacata

SEQ ID NO: 4017461 - DNA, 16 bp, Homo sapiens
cagccttctccatatc

SEQ ID NO: 4017462 - DNA, 15 bp, Homo sapiens
cagccttgccagaga

SEQ ID NO: 4017463 - DNA, 20 bp, Homo sapiens
cagcctttttgtttcaatga

SEQ ID NO: 4017464 - DNA, 16 bp, Homo sapiens
cagcgaagtagcttgc

SEQ ID NO: 4017465 - DNA, 16 bp, Homo sapiens
cagcgaccgccccctc

SEQ ID NO: 4017466 - DNA, 18 bp, Homo sapiens
cagcgagaggcagagaaa

SEQ ID NO: 4017467 - DNA, 21 bp, Homo sapiens
cagcgccaagtaaacagggta

SEQ ID NO: 4017468 - DNA, 18 bp, Homo sapiens
cagcgccaagtgcgtgcc

SEQ ID NO: 4017469 - DNA, 19 bp, Homo sapiens
cagcgccaggctgaccaca

SEQ ID NO: 4017470 - DNA, 20 bp, Homo sapiens
cagcgccaggctgaccacag

SEQ ID NO: 4017471 - DNA, 21 bp, Homo sapiens
cagcgccaggctgaccacagc

SEQ ID NO: 4017472 - DNA, 22 bp, Homo sapiens
cagcgccaggctgaccacagca

SEQ ID NO: 4017473 - DNA, 18 bp, Homo sapiens
cagcgcccctgctgtctt

SEQ ID NO: 4017474 - DNA, 13 bp, Homo sapiens
cagcgcggccagc

SEQ ID NO: 4017475 - DNA, 17 bp, Homo sapiens
cagcgcggccagcgtcc

SEQ ID NO: 4017476 - DNA, 17 bp, Homo sapiens
cagcggagtctgtcctg

SEQ ID NO: 4017477 - DNA, 14 bp, Homo sapiens
cagcggcccctgca

SEQ ID NO: 4017478 - DNA, 14 bp, Homo sapiens
cagcggctcccctc

SEQ ID NO: 4017479 - DNA, 13 bp, Homo sapiens
cagcgggagacct

SEQ ID NO: 4017480 - DNA, 20 bp, Homo sapiens
cagcgggcacagggcaccag

SEQ ID NO: 4017481 - DNA, 16 bp, Homo sapiens
cacccaagcaggaggc

SEQ ID NO: 4017482 - DNA, 19 bp, Homo sapiens
cacccaatcaagggaagaa

SEQ ID NO: 4017483 - DNA, 15 bp, Homo sapiens
cacccacacagctgc

SEQ ID NO: 4017484 - DNA, 24 bp, Homo sapiens
cacccacacagctgccctagctga

SEQ ID NO: 4017485 - DNA, 15 bp, Homo sapiens
cacccaccagggcga

SEQ ID NO: 4017486 - DNA, 13 bp, Homo sapiens
cacccacctccac

SEQ ID NO: 4017487 - DNA, 17 bp, Homo sapiens
cacccacctccacccag

SEQ ID NO: 4017488 - DNA, 18 bp, Homo sapiens
cacccacctccacccagc

SEQ ID NO: 4017489 - DNA, 22 bp, Homo sapiens
cacccacctccacccagcccct

SEQ ID NO: 4017490 - DNA, 22 bp, Homo sapiens
cacccactcccttccccataga

SEQ ID NO: 4017491 - DNA, 16 bp, Homo sapiens
cagattttacaaaaga

SEQ ID NO: 4017492 - DNA, 22 bp, Homo sapiens
cagattttcctcagattagatg

SEQ ID NO: 4017493 - DNA, 16 bp, Homo sapiens
cagattttgctgtata

SEQ ID NO: 4017494 - DNA, 18 bp, Homo sapiens
cagatttttcggaggccc

SEQ ID NO: 4017495 - DNA, 15 bp, Homo sapiens
cagcaaacactccac

SEQ ID NO: 4017496 - DNA, 14 bp, Homo sapiens
cagcaaaccggggc

SEQ ID NO: 4017497 - DNA, 17 bp, Homo sapiens
cagcaacagcaagaaat

SEQ ID NO: 4017498 - DNA, 18 bp, Homo sapiens
cagcaacagcaagaaata

SEQ ID NO: 4017499 - DNA, 17 bp, Homo sapiens
cagcaaccccaggctga

SEQ ID NO: 4017500 - DNA, 13 bp, Homo sapiens
cagcaacgcccct

SEQ ID NO: 4017501 - DNA, 15 bp, Homo sapiens
cagcaacgcccctcc

SEQ ID NO: 4017502 - DNA, 16 bp, Homo sapiens
cagcaacgcccctcca

SEQ ID NO: 4017503 - DNA, 19 bp, Homo sapiens
cagcaacgcccctccaaac

SEQ ID NO: 4017504 - DNA, 15 bp, Homo sapiens
cagcaactgaagaca

SEQ ID NO: 4017505 - DNA, 19 bp, Homo sapiens
cagcaagccctacagagct

SEQ ID NO: 4017506 - DNA, 12 bp, Homo sapiens
cagcaaggcagg

SEQ ID NO: 4017507 - DNA, 17 bp, Homo sapiens
cagcaagtacagcggct

SEQ ID NO: 4017508 - DNA, 15 bp, Homo sapiens
cagcaataagaaatg

SEQ ID NO: 4017509 - DNA, 17 bp, Homo sapiens
cagcaattcagacccct

SEQ ID NO: 4017510 - DNA, 14 bp, Homo sapiens
cagcaatttaaatg

SEQ ID NO: 4017511 - DNA, 13 bp, Homo sapiens
cagcaatttctaa

SEQ ID NO: 4017512 - DNA, 13 bp, Homo sapiens
cagcacacagggc

SEQ ID NO: 4017513 - DNA, 19 bp, Homo sapiens
cagcacacagggcagtgag

SEQ ID NO: 4017514 - DNA, 23 bp, Homo sapiens
cagcacagaaggaatctgtgcag

SEQ ID NO: 4017515 - DNA, 24 bp, Homo sapiens
cagcacatagggttcccacgaagc

SEQ ID NO: 4017516 - DNA, 16 bp, Homo sapiens
cagcaccaaccacagc

SEQ ID NO: 4017517 - DNA, 17 bp, Homo sapiens
cagcaccaaccacagca

SEQ ID NO: 4017518 - DNA, 13 bp, Homo sapiens
cagcaccacccta

SEQ ID NO: 4017519 - DNA, 12 bp, Homo sapiens
cagcacccccac

SEQ ID NO: 4017520 - DNA, 16 bp, Homo sapiens
cagcacccccacccac

SEQ ID NO: 4017521 - DNA, 20 bp, Homo sapiens
cagcacccccacccacctcc

SEQ ID NO: 4017522 - DNA, 14 bp, Homo sapiens
cagcaccctctcct

SEQ ID NO: 4017523 - DNA, 19 bp, Homo sapiens
cagcaccctctcctggggg

SEQ ID NO: 4017524 - DNA, 16 bp, Homo sapiens
cagcaccgttctgtgc

SEQ ID NO: 4017525 - DNA, 17 bp, Homo sapiens
cagcaccgttctgtgca

SEQ ID NO: 4017526 - DNA, 18 bp, Homo sapiens
cagcaccgttctgtgcac

SEQ ID NO: 4017527 - DNA, 16 bp, Homo sapiens
cagcacctccaggcct

SEQ ID NO: 4017528 - DNA, 13 bp, Homo sapiens
cagcacctgcctc

SEQ ID NO: 4017529 - DNA, 19 bp, Homo sapiens
cagcacctgcctcctcgtt

SEQ ID NO: 4017530 - DNA, 20 bp, Homo sapiens
cagcacctgtaagaaacaga

SEQ ID NO: 4017531 - DNA, 14 bp, Homo sapiens
cagcacgtctcaga

SEQ ID NO: 4017532 - DNA, 15 bp, Homo sapiens
cagcacgtctcagag

SEQ ID NO: 4017533 - DNA, 19 bp, Homo sapiens
cagcactaaggccgtgtct

SEQ ID NO: 4017534 - DNA, 16 bp, Homo sapiens
cagcactactgggtgt

SEQ ID NO: 4017535 - DNA, 19 bp, Homo sapiens
cagcactactgggtgtcat

SEQ ID NO: 4017536 - DNA, 20 bp, Homo sapiens
cagcactactgggtgtcatt

SEQ ID NO: 4017537 - DNA, 21 bp, Homo sapiens
cagcactccgcatcacctcac

SEQ ID NO: 4017538 - DNA, 13 bp, Homo sapiens
cagcactgtccct

SEQ ID NO: 4017539 - DNA, 11 bp, Homo sapiens
cagcactgtga

SEQ ID NO: 4017540 - DNA, 13 bp, Homo sapiens
cagcacttccatg

SEQ ID NO: 4017541 - DNA, 23 bp, Homo sapiens
cagcacttgggggttcaggcccg

SEQ ID NO: 4017542 - DNA, 20 bp, Homo sapiens
cagcactttagatcacttga

SEQ ID NO: 4017543 - DNA, 22 bp, Homo sapiens
cagcactttgggaggctgaggc

SEQ ID NO: 4017544 - DNA, 12 bp, Homo sapiens
cagcagaagcct

SEQ ID NO: 4017545 - DNA, 14 bp, Homo sapiens
cagcagacacacat

SEQ ID NO: 4017546 - DNA, 20 bp, Homo sapiens
cagcagagagagaggacaga

SEQ ID NO: 4017547 - DNA, 12 bp, Homo sapiens
cagcagaggcag

SEQ ID NO: 4017548 - DNA, 15 bp, Homo sapiens
cagcagaggcaggct

SEQ ID NO: 4017549 - DNA, 13 bp, Homo sapiens
cagcagaggcggt

SEQ ID NO: 4017550 - DNA, 20 bp, Homo sapiens
cagcagataacaatgcagca

SEQ ID NO: 4017551 - DNA, 16 bp, Homo sapiens
cagcagcagcccaagc

SEQ ID NO: 4017552 - DNA, 18 bp, Homo sapiens
cagcagcccaagcttccc

SEQ ID NO: 4017553 - DNA, 19 bp, Homo sapiens
cagcagcccaagcttccct

SEQ ID NO: 4017554 - DNA, 20 bp, Homo sapiens
cagcagcccaagcttccctc

SEQ ID NO: 4017555 - DNA, 12 bp, Homo sapiens
cagcagcccccc

SEQ ID NO: 4017556 - DNA, 15 bp, Homo sapiens
cagcagccccccagc

SEQ ID NO: 4017557 - DNA, 17 bp, Homo sapiens
cagcagccccccagcac

SEQ ID NO: 4017558 - DNA, 14 bp, Homo sapiens
atttgcaacattta

SEQ ID NO: 4017559 - DNA, 15 bp, Homo sapiens
atttgcaacatttac

SEQ ID NO: 4017560 - DNA, 9 bp, Homo sapiens
atttgcata

SEQ ID NO: 4017561 - DNA, 19 bp, Homo sapiens
atttgcatattctattgta

SEQ ID NO: 4017562 - DNA, 22 bp, Homo sapiens
atttgcatattttgagaaactg

SEQ ID NO: 4017563 - DNA, 22 bp, Homo sapiens
atttgcatggctccagaaatgt

SEQ ID NO: 4017564 - DNA, 19 bp, Homo sapiens
atttgcattaaattcacaa

SEQ ID NO: 4017565 - DNA, 16 bp, Homo sapiens
atttgcattgaacaca

SEQ ID NO: 4017566 - DNA, 19 bp, Homo sapiens
atttgcattgaggaaatat

SEQ ID NO: 4017567 - DNA, 15 bp, Homo sapiens
atttgcctgtgccac

SEQ ID NO: 4017568 - DNA, 15 bp, Homo sapiens
atttgccttctgaaa

SEQ ID NO: 4017569 - DNA, 14 bp, Homo sapiens
atttgcctttaaaa

SEQ ID NO: 4017570 - DNA, 18 bp, Homo sapiens
atttgctaatcaaagcca

SEQ ID NO: 4017571 - DNA, 11 bp, Homo sapiens
atttgctcttt

SEQ ID NO: 4017572 - DNA, 23 bp, Homo sapiens
atttgctctttgacaactaaaat

SEQ ID NO: 4017573 - DNA, 15 bp, Homo sapiens
atttggaatactttt

SEQ ID NO: 4017574 - DNA, 21 bp, Homo sapiens
atttgggagggaaaagggaag

SEQ ID NO: 4017575 - DNA, 17 bp, Homo sapiens
atttgggttctgcctgc

SEQ ID NO: 4017576 - DNA, 17 bp, Homo sapiens
atttggtccaaaaaaag

SEQ ID NO: 4017577 - DNA, 22 bp, Homo sapiens
atttggtccaaaaaaaggaaaa

SEQ ID NO: 4017578 - DNA, 22 bp, Homo sapiens
atttgtaaaaacagcattgctt

SEQ ID NO: 4017579 - DNA, 17 bp, Homo sapiens
atttgtaaatctgccac

SEQ ID NO: 4017580 - DNA, 11 bp, Homo sapiens
atttgtaaatg

SEQ ID NO: 4017581 - DNA, 17 bp, Homo sapiens
atttgtaaatgatttta

SEQ ID NO: 4017582 - DNA, 18 bp, Homo sapiens
atttgtaaatgattttaa

SEQ ID NO: 4017583 - DNA, 17 bp, Homo sapiens
atttgtaacctcagctc

SEQ ID NO: 4017584 - DNA, 21 bp, Homo sapiens
atttgtaacctcagctctggg

SEQ ID NO: 4017585 - DNA, 21 bp, Homo sapiens
atttgtaagggctctcaaaga

SEQ ID NO: 4017586 - DNA, 18 bp, Homo sapiens
atttgtaagtttcaggtg

SEQ ID NO: 4017587 - DNA, 19 bp, Homo sapiens
atttgtaattgcttacatt

SEQ ID NO: 4017588 - DNA, 20 bp, Homo sapiens
atttgtaattgcttacattt

SEQ ID NO: 4017589 - DNA, 21 bp, Homo sapiens
atttgtacctctaagtacata

SEQ ID NO: 4017590 - DNA, 17 bp, Homo sapiens
atttgtcaatgacagtt

SEQ ID NO: 4017591 - DNA, 21 bp, Homo sapiens
atttgtcacagaaatcagagg

SEQ ID NO: 4017592 - DNA, 12 bp, Homo sapiens
atttgtcccaga

SEQ ID NO: 4017593 - DNA, 14 bp, Homo sapiens
atttgtgagactgt

SEQ ID NO: 4017594 - DNA, 15 bp, Homo sapiens
atttgtgatagcact

SEQ ID NO: 4017595 - DNA, 22 bp, Homo sapiens
atttgttaaaatacagttctgt

SEQ ID NO: 4017596 - DNA, 23 bp, Homo sapiens
atttgttcactgaaggtgattca

SEQ ID NO: 4017597 - DNA, 14 bp, Homo sapiens
atttgttcagctcc

SEQ ID NO: 4017598 - DNA, 13 bp, Homo sapiens
atttgttcctgct

SEQ ID NO: 4017599 - DNA, 14 bp, Homo sapiens
atttgttcctgctt

SEQ ID NO: 4017600 - DNA, 12 bp, Homo sapiens
atttgttcctgg

SEQ ID NO: 4017601 - DNA, 23 bp, Homo sapiens
atttgttcctggagttttgattt

SEQ ID NO: 4017602 - DNA, 19 bp, Homo sapiens
atttgttgacaaaattttc

SEQ ID NO: 4017603 - DNA, 16 bp, Homo sapiens
atttgttgattctctc

SEQ ID NO: 4017604 - DNA, 15 bp, Homo sapiens
atttgttttgaattt

SEQ ID NO: 4017605 - DNA, 18 bp, Homo sapiens
atttgttttgacggatga

SEQ ID NO: 4017606 - DNA, 15 bp, Homo sapiens
atttgtttttcattc

SEQ ID NO: 4017607 - DNA, 16 bp, Homo sapiens
attttaaaaacataga

SEQ ID NO: 4017608 - DNA, 14 bp, Homo sapiens
attttaaaaataca

SEQ ID NO: 4017609 - DNA, 15 bp, Homo sapiens
attttaaaaatacat

SEQ ID NO: 4017610 - DNA, 17 bp, Homo sapiens
attttaaaaatacatat

SEQ ID NO: 4017611 - DNA, 13 bp, Homo sapiens
attttaaaatatt

SEQ ID NO: 4017612 - DNA, 14 bp, Homo sapiens
attttaaaatattt

SEQ ID NO: 4017613 - DNA, 14 bp, Homo sapiens
attttaaaggcaga

SEQ ID NO: 4017614 - DNA, 18 bp, Homo sapiens
attttaagaagacatact

SEQ ID NO: 4017615 - DNA, 12 bp, Homo sapiens
attttaagtgct

SEQ ID NO: 4017616 - DNA, 16 bp, Homo sapiens
attttaagtgctttgt

SEQ ID NO: 4017617 - DNA, 15 bp, Homo sapiens
attttaatcctgtac

SEQ ID NO: 4017618 - DNA, 22 bp, Homo sapiens
attttaatgcagttgcttacta

SEQ ID NO: 4017619 - DNA, 15 bp, Homo sapiens
attttaatgtgaaga

SEQ ID NO: 4017620 - DNA, 13 bp, Homo sapiens
attttaattatta

SEQ ID NO: 4017621 - DNA, 23 bp, Homo sapiens
attttaattattattcttcataa

SEQ ID NO: 4017622 - DNA, 18 bp, Homo sapiens
attttaatttatgagttt

SEQ ID NO: 4017623 - DNA, 19 bp, Homo sapiens
attttaattttatattcag

SEQ ID NO: 4017624 - DNA, 22 bp, Homo sapiens
attttacaaaagaggagcactt

SEQ ID NO: 4017625 - DNA, 15 bp, Homo sapiens
attttacaaaagatg

SEQ ID NO: 4017626 - DNA, 18 bp, Homo sapiens
attttacagctcattaaa

SEQ ID NO: 4017627 - DNA, 11 bp, Homo sapiens
attttacagtg

SEQ ID NO: 4017628 - DNA, 12 bp, Homo sapiens
attttacagtga

SEQ ID NO: 4017629 - DNA, 22 bp, Homo sapiens
attttacagtgaccttttcttc

SEQ ID NO: 4017630 - DNA, 15 bp, Homo sapiens
attttacattaaatt

SEQ ID NO: 4017631 - DNA, 19 bp, Homo sapiens
attttaggaacttcagaga

SEQ ID NO: 4017632 - DNA, 22 bp, Homo sapiens
attttaggcactcttaaatgat

SEQ ID NO: 4017633 - DNA, 23 bp, Homo sapiens
attttaggtgttgattttctgtt

SEQ ID NO: 4017634 - DNA, 13 bp, Homo sapiens
attttagtattca

SEQ ID NO: 4017635 - DNA, 19 bp, Homo sapiens
attttatagctcagtttat

SEQ ID NO: 4017636 - DNA, 20 bp, Homo sapiens
attttattctttaagttcac

SEQ ID NO: 4017637 - DNA, 19 bp, Homo sapiens
attttatttagacaagaga

SEQ ID NO: 4017638 - DNA, 11 bp, Homo sapiens
attttatttat

SEQ ID NO: 4017639 - DNA, 13 bp, Homo sapiens
attttatttatgg

SEQ ID NO: 4017640 - DNA, 14 bp, Homo sapiens
attttatttgacaa

SEQ ID NO: 4017641 - DNA, 19 bp, Homo sapiens
attttatttttaaaatatt

SEQ ID NO: 4017642 - DNA, 20 bp, Homo sapiens
attttatttttaaaatatta

SEQ ID NO: 4017643 - DNA, 14 bp, Homo sapiens
attttcaactgctt

SEQ ID NO: 4017644 - DNA, 20 bp, Homo sapiens
attttcaactgtcttcctca

SEQ ID NO: 4017645 - DNA, 14 bp, Homo sapiens
attttcacaaaatg

SEQ ID NO: 4017646 - DNA, 18 bp, Homo sapiens
caaataagtatttataat

SEQ ID NO: 4017647 - DNA, 20 bp, Homo sapiens
caaatacaaagtaaatacaa

SEQ ID NO: 4017648 - DNA, 16 bp, Homo sapiens
caaatactttaaagga

SEQ ID NO: 4017649 - DNA, 19 bp, Homo sapiens
caaatagatttttgttttt

SEQ ID NO: 4017650 - DNA, 13 bp, Homo sapiens
caaatagcaaaga

SEQ ID NO: 4017651 - DNA, 15 bp, Homo sapiens
caaatagcataagtt

SEQ ID NO: 4017652 - DNA, 20 bp, Homo sapiens
caaatagtttataaatgtga

SEQ ID NO: 4017653 - DNA, 21 bp, Homo sapiens
caaatatgagtacaaatgcct

SEQ ID NO: 4017654 - DNA, 22 bp, Homo sapiens
caaatatgagtacaaatgcctt

SEQ ID NO: 4017655 - DNA, 23 bp, Homo sapiens
caaatatgagtacaaatgcctta

SEQ ID NO: 4017656 - DNA, 17 bp, Homo sapiens
caaatcacatctcacct

SEQ ID NO: 4017657 - DNA, 14 bp, Homo sapiens
caaatcccagggaa

SEQ ID NO: 4017658 - DNA, 18 bp, Homo sapiens
caaatcccagggaaggac

SEQ ID NO: 4017659 - DNA, 22 bp, Homo sapiens
caaatctacagatcctttttcc

SEQ ID NO: 4017660 - DNA, 17 bp, Homo sapiens
caaatctcttgcttgtc

SEQ ID NO: 4017661 - DNA, 14 bp, Homo sapiens
caaatctgaagatt

SEQ ID NO: 4017662 - DNA, 16 bp, Homo sapiens
caaatctgacatatta

SEQ ID NO: 4017663 - DNA, 16 bp, Homo sapiens
caaatctgatggcctt

SEQ ID NO: 4017664 - DNA, 21 bp, Homo sapiens
caaatctgctttttaaagaat

SEQ ID NO: 4017665 - DNA, 16 bp, Homo sapiens
caaatctggtccatat

SEQ ID NO: 4017666 - DNA, 15 bp, Homo sapiens
caaatctgtataaat

SEQ ID NO: 4017667 - DNA, 18 bp, Homo sapiens
caaatctgtataaatgtc

SEQ ID NO: 4017668 - DNA, 19 bp, Homo sapiens
caaatctgtataaatgtct

SEQ ID NO: 4017669 - DNA, 13 bp, Homo sapiens
caaatctgtctgc

SEQ ID NO: 4017670 - DNA, 14 bp, Homo sapiens
caaatctgtctgct

SEQ ID NO: 4017671 - DNA, 19 bp, Homo sapiens
caaatcttgaaattaagaa

SEQ ID NO: 4017672 - DNA, 22 bp, Homo sapiens
caaatcttgggtgggtgaaggc

SEQ ID NO: 4017673 - DNA, 22 bp, Homo sapiens
caaatgaccagcagattcaaat

SEQ ID NO: 4017674 - DNA, 13 bp, Homo sapiens
caaatgagccatg

SEQ ID NO: 4017675 - DNA, 19 bp, Homo sapiens
caaatgagtaacatttgct

SEQ ID NO: 4017676 - DNA, 22 bp, Homo sapiens
caaatgcagggaggggaggcag

SEQ ID NO: 4017677 - DNA, 14 bp, Homo sapiens
caaatggggccaga

SEQ ID NO: 4017678 - DNA, 16 bp, Homo sapiens
caaatggggccagatc

SEQ ID NO: 4017679 - DNA, 19 bp, Homo sapiens
caaatggggccagatccag

SEQ ID NO: 4017680 - DNA, 22 bp, Homo sapiens
caaatgtaatgtggcttctgga

SEQ ID NO: 4017681 - DNA, 14 bp, Homo sapiens
caaatgtattttga

SEQ ID NO: 4017682 - DNA, 15 bp, Homo sapiens
caaatgtattttgaa

SEQ ID NO: 4017683 - DNA, 17 bp, Homo sapiens
caaatgtattttgaaga

SEQ ID NO: 4017684 - DNA, 19 bp, Homo sapiens
caaatgtcctccagaagcc

SEQ ID NO: 4017685 - DNA, 15 bp, Homo sapiens
caaattaatctttct

SEQ ID NO: 4017686 - DNA, 13 bp, Homo sapiens
caaattagaaaat

SEQ ID NO: 4017687 - DNA, 18 bp, Homo sapiens
caaattagaaaatgttat

SEQ ID NO: 4017688 - DNA, 19 bp, Homo sapiens
caaattagaaaatgttatt

SEQ ID NO: 4017689 - DNA, 15 bp, Homo sapiens
caaattcagtttcat

SEQ ID NO: 4017690 - DNA, 14 bp, Homo sapiens
caaattcatttttt

SEQ ID NO: 4017691 - DNA, 18 bp, Homo sapiens
caaattgtatctagtgca

SEQ ID NO: 4017692 - DNA, 19 bp, Homo sapiens
caaattgtatctagtgcag

SEQ ID NO: 4017693 - DNA, 20 bp, Homo sapiens
caaattgtcacctgcttctc

SEQ ID NO: 4017694 - DNA, 16 bp, Homo sapiens
caaatttatcaaagca

SEQ ID NO: 4017695 - DNA, 17 bp, Homo sapiens
caaatttatcaaagcat

SEQ ID NO: 4017696 - DNA, 15 bp, Homo sapiens
caaatttcacttata

SEQ ID NO: 4017697 - DNA, 20 bp, Homo sapiens
caaatttgtacctctaagta

SEQ ID NO: 4017698 - DNA, 23 bp, Homo sapiens
caaattttttgactttttttgta

SEQ ID NO: 4017699 - DNA, 14 bp, Homo sapiens
caacaaagaaatat

SEQ ID NO: 4017700 - DNA, 19 bp, Homo sapiens
caacaaagccaacagtcaa

SEQ ID NO: 4017701 - DNA, 18 bp, Homo sapiens
caacaaaggcaagttaag

SEQ ID NO: 4017702 - DNA, 16 bp, Homo sapiens
caacaacaattggtaa

SEQ ID NO: 4017703 - DNA, 16 bp, Homo sapiens
caacaagaagaaatat

SEQ ID NO: 4017704 - DNA, 19 bp, Homo sapiens
caacaagaagaaatatgaa

SEQ ID NO: 4017705 - DNA, 22 bp, Homo sapiens
caacaagcccgttagccccagg

SEQ ID NO: 4017706 - DNA, 17 bp, Homo sapiens
caacacaagctggaagc

SEQ ID NO: 4017707 - DNA, 20 bp, Homo sapiens
caacacaagctggaagcaca

SEQ ID NO: 4017708 - DNA, 16 bp, Homo sapiens
caacacaataacacta

SEQ ID NO: 4017709 - DNA, 16 bp, Homo sapiens
caacacagttgggacc

SEQ ID NO: 4017710 - DNA, 15 bp, Homo sapiens
caacaccacagacac

SEQ ID NO: 4017711 - DNA, 16 bp, Homo sapiens
caacaccacagacaca

SEQ ID NO: 4017712 - DNA, 18 bp, Homo sapiens
caacaccacagacacaca

SEQ ID NO: 4017713 - DNA, 22 bp, Homo sapiens
caacactggtgtgacctgaggg

SEQ ID NO: 4017714 - DNA, 15 bp, Homo sapiens
caacagaagaactgt

SEQ ID NO: 4017715 - DNA, 22 bp, Homo sapiens
caacagaagtcatgaagcccaa

SEQ ID NO: 4017716 - DNA, 17 bp, Homo sapiens
caacagactgttgagtt

SEQ ID NO: 4017717 - DNA, 17 bp, Homo sapiens
caacagatactggaagt

SEQ ID NO: 4017718 - DNA, 23 bp, Homo sapiens
caacagatctggaacctcagcct

SEQ ID NO: 4017719 - DNA, 20 bp, Homo sapiens
caacagcacctccccgctgg

SEQ ID NO: 4017720 - DNA, 12 bp, Homo sapiens
caacagccatgc

SEQ ID NO: 4017721 - DNA, 19 bp, Homo sapiens
caacaggaatcaagagctg

SEQ ID NO: 4017722 - DNA, 21 bp, Homo sapiens
caacaggaatcaagagctgcc

SEQ ID NO: 4017723 - DNA, 19 bp, Homo sapiens
caacaggacagagttcaca

SEQ ID NO: 4017724 - DNA, 15 bp, Homo sapiens
caacaggggaaacta

SEQ ID NO: 4017725 - DNA, 18 bp, Homo sapiens
caacaggtggcaggacca

SEQ ID NO: 4017726 - DNA, 23 bp, Homo sapiens
caacaggtggcaggaccaggact

SEQ ID NO: 4017727 - DNA, 14 bp, Homo sapiens
caacagtcaaaaca

SEQ ID NO: 4017728 - DNA, 18 bp, Homo sapiens
caacagtcaaaacagaga

SEQ ID NO: 4017729 - DNA, 22 bp, Homo sapiens
caacagttttttatgctaatca

SEQ ID NO: 4017730 - DNA, 17 bp, Homo sapiens
caacatatatttattga

SEQ ID NO: 4017731 - DNA, 20 bp, Homo sapiens
caacatatatttattgagta

SEQ ID NO: 4017732 - DNA, 17 bp, Homo sapiens
caacatcaatgttcatt

SEQ ID NO: 4017733 - DNA, 21 bp, Homo sapiens
caaccacacttgtcggctcca

SEQ ID NO: 4017734 - DNA, 21 bp, Homo sapiens
caaccacgttgggacagggag

SEQ ID NO: 4017735 - DNA, 22 bp, Homo sapiens
caaccactggtctgtagggatt

SEQ ID NO: 4017736 - DNA, 12 bp, Homo sapiens
caaccactgtgg

SEQ ID NO: 4017737 - DNA, 14 bp, Homo sapiens
caaccactgtggcg

SEQ ID NO: 4017738 - DNA, 23 bp, Homo sapiens
caaccactgtggcgttctgctgc

SEQ ID NO: 4017739 - DNA, 19 bp, Homo sapiens
caaccagagccccccacaa

SEQ ID NO: 4017740 - DNA, 15 bp, Homo sapiens
caaccagctaagaaa

SEQ ID NO: 4017741 - DNA, 17 bp, Homo sapiens
caaccatccctgccaca

SEQ ID NO: 4017742 - DNA, 22 bp, Homo sapiens
caacccagccgtcgtctccctc

SEQ ID NO: 4017743 - DNA, 21 bp, Homo sapiens
caacccagtcacactgtggcc

SEQ ID NO: 4017744 - DNA, 12 bp, Homo sapiens
caacccccaccc

SEQ ID NO: 4017745 - DNA, 14 bp, Homo sapiens
caacccccacccca

SEQ ID NO: 4017746 - DNA, 18 bp, Homo sapiens
caacccccaccccacact

SEQ ID NO: 4017747 - DNA, 23 bp, Homo sapiens
caacccccaccccacacttgttc

SEQ ID NO: 4017748 - DNA, 13 bp, Homo sapiens
caccgagaatgtt

SEQ ID NO: 4017749 - DNA, 17 bp, Homo sapiens
caccgatggagccccca

SEQ ID NO: 4017750 - DNA, 13 bp, Homo sapiens
caccgctgccagc

SEQ ID NO: 4017751 - DNA, 16 bp, Homo sapiens
caccgctggttggaaa

SEQ ID NO: 4017752 - DNA, 23 bp, Homo sapiens
caccgctggttggaaagagtgtt

SEQ ID NO: 4017753 - DNA, 15 bp, Homo sapiens
caccgggagcctccc

SEQ ID NO: 4017754 - DNA, 24 bp, Homo sapiens
caccgggcatgtctgcctggagtg

SEQ ID NO: 4017755 - DNA, 18 bp, Homo sapiens
caccgtgaaccagagggt

SEQ ID NO: 4017756 - DNA, 18 bp, Homo sapiens
caccgtgcctggccagat

SEQ ID NO: 4017757 - DNA, 17 bp, Homo sapiens
caccgtggaggaggaag

SEQ ID NO: 4017758 - DNA, 15 bp, Homo sapiens
caccgtgggcaggga

SEQ ID NO: 4017759 - DNA, 20 bp, Homo sapiens
caccgtgtcaagctgctctg

SEQ ID NO: 4017760 - DNA, 14 bp, Homo sapiens
caccgttcattcag

SEQ ID NO: 4017761 - DNA, 19 bp, Homo sapiens
cacctaatcaggctgaggt

SEQ ID NO: 4017762 - DNA, 17 bp, Homo sapiens
cacctaatccaggcaga

SEQ ID NO: 4017763 - DNA, 20 bp, Homo sapiens
cacctaatgtttatgagcca

SEQ ID NO: 4017764 - DNA, 22 bp, Homo sapiens
cacctaattcgatgaaggctgc

SEQ ID NO: 4017765 - DNA, 22 bp, Homo sapiens
cacctaccatcagggacaggat

SEQ ID NO: 4017766 - DNA, 20 bp, Homo sapiens
cacctactatgtgctgggtg

SEQ ID NO: 4017767 - DNA, 15 bp, Homo sapiens
cacctagacaaacaa

SEQ ID NO: 4017768 - DNA, 21 bp, Homo sapiens
cacctatctcgtgggagagcc

SEQ ID NO: 4017769 - DNA, 14 bp, Homo sapiens
cacctatgtgccaa

SEQ ID NO: 4017770 - DNA, 17 bp, Homo sapiens
cacctatgtgccaactg

SEQ ID NO: 4017771 - DNA, 21 bp, Homo sapiens
cacctatgtgccaactgttgt

SEQ ID NO: 4017772 - DNA, 15 bp, Homo sapiens
cacctatgttatttt

SEQ ID NO: 4017773 - DNA, 16 bp, Homo sapiens
cacctatgttattttg

SEQ ID NO: 4017774 - DNA, 17 bp, Homo sapiens
cacctatgttattttgt

SEQ ID NO: 4017775 - DNA, 10 bp, Homo sapiens
cacctcaccc

SEQ ID NO: 4017776 - DNA, 11 bp, Homo sapiens
cacctcacccg

SEQ ID NO: 4017777 - DNA, 13 bp, Homo sapiens
cacctcactcctg

SEQ ID NO: 4017778 - DNA, 15 bp, Homo sapiens
cacctcactcctgtt

SEQ ID NO: 4017779 - DNA, 18 bp, Homo sapiens
cacctcagttcccttggc

SEQ ID NO: 4017780 - DNA, 19 bp, Homo sapiens
cacctcagttcccttggcc

SEQ ID NO: 4017781 - DNA, 21 bp, Homo sapiens
cacctcagttcccttggcctc

SEQ ID NO: 4017782 - DNA, 23 bp, Homo sapiens
cacctcagttcccttggcctcag

SEQ ID NO: 4017783 - DNA, 12 bp, Homo sapiens
cacctcatgccc

SEQ ID NO: 4017784 - DNA, 14 bp, Homo sapiens
cacctcatgcccac

SEQ ID NO: 4017785 - DNA, 19 bp, Homo sapiens
cacctcatgcccaccccct

SEQ ID NO: 4017786 - DNA, 20 bp, Homo sapiens
cacctccaccacatctgcca

SEQ ID NO: 4017787 - DNA, 13 bp, Homo sapiens
cacctccacccag

SEQ ID NO: 4017788 - DNA, 16 bp, Homo sapiens
cacctccacccagccc

SEQ ID NO: 4017789 - DNA, 19 bp, Homo sapiens
cacctccacccagcccctg

SEQ ID NO: 4017790 - DNA, 14 bp, Homo sapiens
cacctccagcctga

SEQ ID NO: 4017791 - DNA, 13 bp, Homo sapiens
cacctccaggcct

SEQ ID NO: 4017792 - DNA, 23 bp, Homo sapiens
cacctccccacatcgcacactgg

SEQ ID NO: 4017793 - DNA, 17 bp, Homo sapiens
cacctcccccactccca

SEQ ID NO: 4017794 - DNA, 21 bp, Homo sapiens
cacctcccccactcccaacca

SEQ ID NO: 4017795 - DNA, 15 bp, Homo sapiens
cacctctatccaaag

SEQ ID NO: 4017796 - DNA, 15 bp, Homo sapiens
cacctctccaagtct

SEQ ID NO: 4017797 - DNA, 21 bp, Homo sapiens
cacctctccaggtgctcattg

SEQ ID NO: 4017798 - DNA, 12 bp, Homo sapiens
cacctctcctgc

SEQ ID NO: 4017799 - DNA, 16 bp, Homo sapiens
cacctctcctgccctg

SEQ ID NO: 4017800 - DNA, 12 bp, Homo sapiens
cacctctctcag

SEQ ID NO: 4017801 - DNA, 14 bp, Homo sapiens
cacctctctcagag

SEQ ID NO: 4017802 - DNA, 15 bp, Homo sapiens
cacctctctcagagc

SEQ ID NO: 4017803 - DNA, 17 bp, Homo sapiens
cacctctctcagagcat

SEQ ID NO: 4017804 - DNA, 12 bp, Homo sapiens
cacctctgccag

SEQ ID NO: 4017805 - DNA, 13 bp, Homo sapiens
cacctctgccaga

SEQ ID NO: 4017806 - DNA, 17 bp, Homo sapiens
cacctctggactggcta

SEQ ID NO: 4017807 - DNA, 18 bp, Homo sapiens
cacctctggactggctag

SEQ ID NO: 4017808 - DNA, 19 bp, Homo sapiens
cacctctggactggctaga

SEQ ID NO: 4017809 - DNA, 23 bp, Homo sapiens
cacctctgttaaggttgaacttt

SEQ ID NO: 4017810 - DNA, 20 bp, Homo sapiens
cacctcttcaccccccactc

SEQ ID NO: 4017811 - DNA, 19 bp, Homo sapiens
cacctgacagcccctccct

SEQ ID NO: 4017812 - DNA, 17 bp, Homo sapiens
cacctgatattcaggct

SEQ ID NO: 4017813 - DNA, 13 bp, Homo sapiens
cacctgcacactc

SEQ ID NO: 4017814 - DNA, 18 bp, Homo sapiens
cacctgcacactccatct

SEQ ID NO: 4017815 - DNA, 14 bp, Homo sapiens
cacctgcagctccc

SEQ ID NO: 4017816 - DNA, 17 bp, Homo sapiens
cacctgcatctggggcc

SEQ ID NO: 4017817 - DNA, 13 bp, Homo sapiens
cacctgcctcagg

SEQ ID NO: 4017818 - DNA, 17 bp, Homo sapiens
cacctgcctgccccaca

SEQ ID NO: 4017819 - DNA, 19 bp, Homo sapiens
cacctgcctgccccacacg

SEQ ID NO: 4017820 - DNA, 11 bp, Homo sapiens
cacctgctcca

SEQ ID NO: 4017821 - DNA, 23 bp, Homo sapiens
cacctgctgagaaaacatgcctc

SEQ ID NO: 4017822 - DNA, 18 bp, Homo sapiens
cacctgcttctctgccca

SEQ ID NO: 4017823 - DNA, 19 bp, Homo sapiens
cacctggctgaggttcctc

SEQ ID NO: 4017824 - DNA, 22 bp, Homo sapiens
cacctggctgaggttcctctgc

SEQ ID NO: 4017825 - DNA, 14 bp, Homo sapiens
cacctgtaagaaac

SEQ ID NO: 4017826 - DNA, 21 bp, Homo sapiens
cacctgtaatcccagctactt

SEQ ID NO: 4017827 - DNA, 17 bp, Homo sapiens
cacctgtagccatctgc

SEQ ID NO: 4017828 - DNA, 21 bp, Homo sapiens
cacctgtccccaccctccact

SEQ ID NO: 4017829 - DNA, 22 bp, Homo sapiens
cacctgtccccaccctccactc

SEQ ID NO: 4017830 - DNA, 15 bp, Homo sapiens
cacctgtctgctcca

SEQ ID NO: 4017831 - DNA, 23 bp, Homo sapiens
cacctgtctgctccagctctggc

SEQ ID NO: 4017832 - DNA, 22 bp, Homo sapiens
cacctgtgggtgtagccaggta

SEQ ID NO: 4017833 - DNA, 15 bp, Homo sapiens
cacctgttatgtatg

SEQ ID NO: 4017834 - DNA, 14 bp, Homo sapiens
caccttcagggctg

SEQ ID NO: 4017835 - DNA, 14 bp, Homo sapiens
caccttccagctcc

SEQ ID NO: 4017836 - DNA, 18 bp, Homo sapiens
caccttccagctcctgta

SEQ ID NO: 4017837 - DNA, 13 bp, Homo sapiens
caccttccagggc

SEQ ID NO: 4017838 - DNA, 14 bp, Homo sapiens
caccttccagggcc

SEQ ID NO: 4017839 - DNA, 17 bp, Homo sapiens
cactatgacactgagca

SEQ ID NO: 4017840 - DNA, 19 bp, Homo sapiens
cactatggggtggggtggg

SEQ ID NO: 4017841 - DNA, 21 bp, Homo sapiens
cactatggtatgctggccagc

SEQ ID NO: 4017842 - DNA, 14 bp, Homo sapiens
cactcaactctgag

SEQ ID NO: 4017843 - DNA, 15 bp, Homo sapiens
cactcaagcactgat

SEQ ID NO: 4017844 - DNA, 18 bp, Homo sapiens
cactcaccagtgtcccct

SEQ ID NO: 4017845 - DNA, 21 bp, Homo sapiens
cactcaccagtgtcccctcca

SEQ ID NO: 4017846 - DNA, 21 bp, Homo sapiens
cactcacccatgtgccaaggt

SEQ ID NO: 4017847 - DNA, 22 bp, Homo sapiens
cactcacccatgtgccaaggtg

SEQ ID NO: 4017848 - DNA, 17 bp, Homo sapiens
cactcagagcagtctgt

SEQ ID NO: 4017849 - DNA, 13 bp, Homo sapiens
cactcagcacaag

SEQ ID NO: 4017850 - DNA, 22 bp, Homo sapiens
cactcagcacaaggccatctgg

SEQ ID NO: 4017851 - DNA, 18 bp, Homo sapiens
cactcagctgtcctgcag

SEQ ID NO: 4017852 - DNA, 20 bp, Homo sapiens
cactcagctgtcctgcagca

SEQ ID NO: 4017853 - DNA, 19 bp, Homo sapiens
cactcagcttcctacccac

SEQ ID NO: 4017854 - DNA, 20 bp, Homo sapiens
cactcaggcctgtgcccact

SEQ ID NO: 4017855 - DNA, 17 bp, Homo sapiens
cactcaggttcttcagg

SEQ ID NO: 4017856 - DNA, 20 bp, Homo sapiens
cactcagtgagcctcctgtg

SEQ ID NO: 4017857 - DNA, 15 bp, Homo sapiens
cactccaagccagca

SEQ ID NO: 4017858 - DNA, 21 bp, Homo sapiens
cactccaatgtctgctgagga

SEQ ID NO: 4017859 - DNA, 12 bp, Homo sapiens
cactccaccctc

SEQ ID NO: 4017860 - DNA, 17 bp, Homo sapiens
cactccaccctccacct

SEQ ID NO: 4017861 - DNA, 16 bp, Homo sapiens
cactccagtgccagca

SEQ ID NO: 4017862 - DNA, 13 bp, Homo sapiens
cactccagtggca

SEQ ID NO: 4017863 - DNA, 20 bp, Homo sapiens
cactcccaaggttggagccc

SEQ ID NO: 4017864 - DNA, 15 bp, Homo sapiens
cactcccacctcacc

SEQ ID NO: 4017865 - DNA, 17 bp, Homo sapiens
cactcccacctcacccg

SEQ ID NO: 4017866 - DNA, 22 bp, Homo sapiens
cactcccacctgcatctggggc

SEQ ID NO: 4017867 - DNA, 22 bp, Homo sapiens
cactccccagggagctctgggg

SEQ ID NO: 4017868 - DNA, 23 bp, Homo sapiens
cactccccagggagctctgggga

SEQ ID NO: 4017869 - DNA, 21 bp, Homo sapiens
cactccccctaaacccctgtc

SEQ ID NO: 4017870 - DNA, 19 bp, Homo sapiens
cactccccgaagtcttttg

SEQ ID NO: 4017871 - DNA, 18 bp, Homo sapiens
cactccccgccttagagc

SEQ ID NO: 4017872 - DNA, 17 bp, Homo sapiens
cactccctctgccttca

SEQ ID NO: 4017873 - DNA, 13 bp, Homo sapiens
cactccctgctcc

SEQ ID NO: 4017874 - DNA, 22 bp, Homo sapiens
cactccctgggacacagaccca

SEQ ID NO: 4017875 - DNA, 21 bp, Homo sapiens
cactcctagagaacgcagccc

SEQ ID NO: 4017876 - DNA, 21 bp, Homo sapiens
cactcctaggagagccaacct

SEQ ID NO: 4017877 - DNA, 13 bp, Homo sapiens
cactcctccctcc

SEQ ID NO: 4017878 - DNA, 14 bp, Homo sapiens
cactcctgctctgc

SEQ ID NO: 4017879 - DNA, 11 bp, Homo sapiens
cactcctgggg

SEQ ID NO: 4017880 - DNA, 18 bp, Homo sapiens
cactcgggaggctgagac

SEQ ID NO: 4017881 - DNA, 13 bp, Homo sapiens
cactctaaaaaac

SEQ ID NO: 4017882 - DNA, 20 bp, Homo sapiens
cactctaaactgcaaacaga

SEQ ID NO: 4017883 - DNA, 17 bp, Homo sapiens
cactctaccctatacaa

SEQ ID NO: 4017884 - DNA, 15 bp, Homo sapiens
cactctaccctccca

SEQ ID NO: 4017885 - DNA, 16 bp, Homo sapiens
cactctaccctcccac

SEQ ID NO: 4017886 - DNA, 19 bp, Homo sapiens
cactctaccctcccacccc

SEQ ID NO: 4017887 - DNA, 11 bp, Homo sapiens
cactctaccta

SEQ ID NO: 4017888 - DNA, 14 bp, Homo sapiens
cactctacttagca

SEQ ID NO: 4017889 - DNA, 17 bp, Homo sapiens
cactctaggggtcaggc

SEQ ID NO: 4017890 - DNA, 19 bp, Homo sapiens
cactctaggggtcaggctc

SEQ ID NO: 4017891 - DNA, 22 bp, Homo sapiens
cactctaggggtcaggctccat

SEQ ID NO: 4017892 - DNA, 14 bp, Homo sapiens
cactctccccacac

SEQ ID NO: 4017893 - DNA, 23 bp, Homo sapiens
cactctctgaagatgatcatttg

SEQ ID NO: 4017894 - DNA, 17 bp, Homo sapiens
cactctcttccctttcc

SEQ ID NO: 4017895 - DNA, 12 bp, Homo sapiens
cactctggcctc

SEQ ID NO: 4017896 - DNA, 12 bp, Homo sapiens
cactctgtcagc

SEQ ID NO: 4017897 - DNA, 16 bp, Homo sapiens
cactctgtcagccagc

SEQ ID NO: 4017898 - DNA, 21 bp, Homo sapiens
cactctgtcagccagccgccc

SEQ ID NO: 4017899 - DNA, 14 bp, Homo sapiens
cactcttaaatgat

SEQ ID NO: 4017900 - DNA, 11 bp, Homo sapiens
cactcttccaa

SEQ ID NO: 4017901 - DNA, 22 bp, Homo sapiens
cactcttctttaagccatagac

SEQ ID NO: 4017902 - DNA, 12 bp, Homo sapiens
cactctttgtaa

SEQ ID NO: 4017903 - DNA, 23 bp, Homo sapiens
cactgaaaaatctaagtgatata

SEQ ID NO: 4017904 - DNA, 14 bp, Homo sapiens
cactgaaaaattat

SEQ ID NO: 4017905 - DNA, 16 bp, Homo sapiens
cactgaaagttttgta

SEQ ID NO: 4017906 - DNA, 19 bp, Homo sapiens
cactgaaagttttgtaaaa

SEQ ID NO: 4017907 - DNA, 20 bp, Homo sapiens
cactgaaagttttgtaaaag

SEQ ID NO: 4017908 - DNA, 15 bp, Homo sapiens
cactgaacaaactaa

SEQ ID NO: 4017909 - DNA, 22 bp, Homo sapiens
cactgaacaaactaaaggtgca

SEQ ID NO: 4017910 - DNA, 14 bp, Homo sapiens
cactgaactccacc

SEQ ID NO: 4017911 - DNA, 15 bp, Homo sapiens
cactgaactccaccg

SEQ ID NO: 4017912 - DNA, 17 bp, Homo sapiens
cactgaagcctgcgttg

SEQ ID NO: 4017913 - DNA, 15 bp, Homo sapiens
cactgaaggacctga

SEQ ID NO: 4017914 - DNA, 20 bp, Homo sapiens
cactgaataaagcacgtgca

SEQ ID NO: 4017915 - DNA, 13 bp, Homo sapiens
cactgaatattta

SEQ ID NO: 4017916 - DNA, 15 bp, Homo sapiens
cactgaattaatcat

SEQ ID NO: 4017917 - DNA, 17 bp, Homo sapiens
cactgacagcctcccac

SEQ ID NO: 4017918 - DNA, 15 bp, Homo sapiens
cactgagctccccag

SEQ ID NO: 4017919 - DNA, 19 bp, Homo sapiens
cactgaggcagccttgggg

SEQ ID NO: 4017920 - DNA, 14 bp, Homo sapiens
cactgagggccaca

SEQ ID NO: 4017921 - DNA, 18 bp, Homo sapiens
cactgagggccacactat

SEQ ID NO: 4017922 - DNA, 17 bp, Homo sapiens
cactgagtaccaggggc

SEQ ID NO: 4017923 - DNA, 23 bp, Homo sapiens
cactgagtaccaggggctgggct

SEQ ID NO: 4017924 - DNA, 13 bp, Homo sapiens
cactgatcaccca

SEQ ID NO: 4017925 - DNA, 15 bp, Homo sapiens
cactgatgcttagat

SEQ ID NO: 4017926 - DNA, 16 bp, Homo sapiens
cactgatgcttagatg

SEQ ID NO: 4017927 - DNA, 13 bp, Homo sapiens
cactgatttcaca

SEQ ID NO: 4017928 - DNA, 15 bp, Homo sapiens
cactgattttgtaaa

SEQ ID NO: 4017929 - DNA, 22 bp, Homo sapiens
cactgcaaaaccaggttttgtt

SEQ ID NO: 4017930 - DNA, 16 bp, Homo sapiens
cactgcaaattttaac

SEQ ID NO: 4017931 - DNA, 19 bp, Homo sapiens
cactgcacagtgcatctca

SEQ ID NO: 4017932 - DNA, 23 bp, Homo sapiens
cactgcacagtgcatctcagccc

SEQ ID NO: 4017933 - DNA, 14 bp, Homo sapiens
cactgcaccgcctc

SEQ ID NO: 4017934 - DNA, 12 bp, Homo sapiens
cactgcactcca

SEQ ID NO: 4017935 - DNA, 13 bp, Homo sapiens
cactgccaggcca

SEQ ID NO: 4017936 - DNA, 18 bp, Homo sapiens
cactgccaggccagcctc

SEQ ID NO: 4017937 - DNA, 17 bp, Homo sapiens
cactgcccatggacagg

SEQ ID NO: 4017938 - DNA, 21 bp, Homo sapiens
cactgcccgagctggtgcatt

SEQ ID NO: 4017939 - DNA, 20 bp, Homo sapiens
cactgccctgttcatgtgcc

SEQ ID NO: 4017940 - DNA, 16 bp, Homo sapiens
cactgcctcccatcct

SEQ ID NO: 4017941 - DNA, 23 bp, Homo sapiens
cactgcctccccaaggccccctg

SEQ ID NO: 4017942 - DNA, 23 bp, Homo sapiens
cagaatatttttatatttccttt

SEQ ID NO: 4017943 - DNA, 22 bp, Homo sapiens
cagaatcttgactttctgattg

SEQ ID NO: 4017944 - DNA, 18 bp, Homo sapiens
cagaatgaggaataataa

SEQ ID NO: 4017945 - DNA, 18 bp, Homo sapiens
cagaatgctgaactcctt

SEQ ID NO: 4017946 - DNA, 18 bp, Homo sapiens
cagaatgctgcaggactt

SEQ ID NO: 4017947 - DNA, 17 bp, Homo sapiens
cagaatgctgtacatct

SEQ ID NO: 4017948 - DNA, 18 bp, Homo sapiens
cagaatgctgtacatcta

SEQ ID NO: 4017949 - DNA, 23 bp, Homo sapiens
cagaatggaactcaagctggttt

SEQ ID NO: 4017950 - DNA, 20 bp, Homo sapiens
cagaatgtaagaaaacaaaa

SEQ ID NO: 4017951 - DNA, 16 bp, Homo sapiens
cagaatgttttactgt

SEQ ID NO: 4017952 - DNA, 20 bp, Homo sapiens
cagaatgttttactgtgaaa

SEQ ID NO: 4017953 - DNA, 23 bp, Homo sapiens
cagaattaaacttttaattcatt

SEQ ID NO: 4017954 - DNA, 15 bp, Homo sapiens
cagaattatttttaa

SEQ ID NO: 4017955 - DNA, 21 bp, Homo sapiens
cagaattatttttaaaaagaa

SEQ ID NO: 4017956 - DNA, 22 bp, Homo sapiens
cagaatttaccatcatctctga

SEQ ID NO: 4017957 - DNA, 18 bp, Homo sapiens
cagaatttagtgtatcca

SEQ ID NO: 4017958 - DNA, 17 bp, Homo sapiens
cagaatttccactgtaa

SEQ ID NO: 4017959 - DNA, 22 bp, Homo sapiens
cagaatttccactgtaattaaa

SEQ ID NO: 4017960 - DNA, 22 bp, Homo sapiens
cagacaaatgtggttacacact

SEQ ID NO: 4017961 - DNA, 16 bp, Homo sapiens
attctcaccaggaagg

SEQ ID NO: 4017962 - DNA, 14 bp, Homo sapiens
attctcagaatctc

SEQ ID NO: 4017963 - DNA, 23 bp, Homo sapiens
attctcagatatttatattttta

SEQ ID NO: 4017964 - DNA, 22 bp, Homo sapiens
attctcataattcctacagcac

SEQ ID NO: 4017965 - DNA, 13 bp, Homo sapiens
attctccacagca

SEQ ID NO: 4017966 - DNA, 14 bp, Homo sapiens
attctccacagcaa

SEQ ID NO: 4017967 - DNA, 21 bp, Homo sapiens
attctcccaggtaccagctgc

SEQ ID NO: 4017968 - DNA, 12 bp, Homo sapiens
attctcccctcc

SEQ ID NO: 4017969 - DNA, 23 bp, Homo sapiens
attctcctgcctcagcctcccaa

SEQ ID NO: 4017970 - DNA, 22 bp, Homo sapiens
attctcctgcctgtagcagtga

SEQ ID NO: 4017971 - DNA, 13 bp, Homo sapiens
attctcctgtgct

SEQ ID NO: 4017972 - DNA, 16 bp, Homo sapiens
attctctagatttatt

SEQ ID NO: 4017973 - DNA, 19 bp, Homo sapiens
attctgaagcaacatttta

SEQ ID NO: 4017974 - DNA, 19 bp, Homo sapiens
attctgagcagtgcctctt

SEQ ID NO: 4017975 - DNA, 20 bp, Homo sapiens
attctgagcagtgcctcttg

SEQ ID NO: 4017976 - DNA, 18 bp, Homo sapiens
attctgaggccctgccca

SEQ ID NO: 4017977 - DNA, 22 bp, Homo sapiens
attctgcaagcacatctgcatt

SEQ ID NO: 4017978 - DNA, 15 bp, Homo sapiens
attctgcagcatgac

SEQ ID NO: 4017979 - DNA, 18 bp, Homo sapiens
attctgcagtaaatcttt

SEQ ID NO: 4017980 - DNA, 19 bp, Homo sapiens
attctgcattgctagataa

SEQ ID NO: 4017981 - DNA, 22 bp, Homo sapiens
attctgcattgctagataaaag

SEQ ID NO: 4017982 - DNA, 15 bp, Homo sapiens
attctggagatactg

SEQ ID NO: 4017983 - DNA, 20 bp, Homo sapiens
attctggaggggagagcttt

SEQ ID NO: 4017984 - DNA, 22 bp, Homo sapiens
attctggatggatttgaagcaa

SEQ ID NO: 4017985 - DNA, 23 bp, Homo sapiens
attctgggctcctggaaccaatc

SEQ ID NO: 4017986 - DNA, 20 bp, Homo sapiens
attctgtgccttgttttttg

SEQ ID NO: 4017987 - DNA, 17 bp, Homo sapiens
attctgtgtgttttcat

SEQ ID NO: 4017988 - DNA, 22 bp, Homo sapiens
attctgttaaaatctattctgt

SEQ ID NO: 4017989 - DNA, 21 bp, Homo sapiens
attctgtttattcttccagaa

SEQ ID NO: 4017990 - DNA, 23 bp, Homo sapiens
attcttaaaatatatttcagata

SEQ ID NO: 4017991 - DNA, 18 bp, Homo sapiens
attcttatttaatgaaag

SEQ ID NO: 4017992 - DNA, 20 bp, Homo sapiens
attcttcagcgtaaaatggt

SEQ ID NO: 4017993 - DNA, 11 bp, Homo sapiens
attcttccaga

SEQ ID NO: 4017994 - DNA, 13 bp, Homo sapiens
attcttccagaat

SEQ ID NO: 4017995 - DNA, 22 bp, Homo sapiens
attcttcctaatgtcagaacag

SEQ ID NO: 4017996 - DNA, 10 bp, Homo sapiens
attcttcctt

SEQ ID NO: 4017997 - DNA, 17 bp, Homo sapiens
attcttctgtatttcta

SEQ ID NO: 4017998 - DNA, 19 bp, Homo sapiens
attcttctgtatttctagg

SEQ ID NO: 4017999 - DNA, 14 bp, Homo sapiens
attcttctttcttt

SEQ ID NO: 4018000 - DNA, 17 bp, Homo sapiens
attcttggaccatgcca

SEQ ID NO: 4018001 - DNA, 19 bp, Homo sapiens
attcttggaccatgccaga

SEQ ID NO: 4018002 - DNA, 20 bp, Homo sapiens
attcttggaccatgccagat

SEQ ID NO: 4018003 - DNA, 18 bp, Homo sapiens
attcttgtcacaataaat

SEQ ID NO: 4018004 - DNA, 16 bp, Homo sapiens
attcttgttttgcttc

SEQ ID NO: 4018005 - DNA, 15 bp, Homo sapiens
attctttagagaaga

SEQ ID NO: 4018006 - DNA, 22 bp, Homo sapiens
attctttggagttgtcacatca

SEQ ID NO: 4018007 - DNA, 15 bp, Homo sapiens
attcttttgtttcca

SEQ ID NO: 4018008 - DNA, 16 bp, Homo sapiens
attcttttgtttccat

SEQ ID NO: 4018009 - DNA, 16 bp, Homo sapiens
attgaaaaactcttta

SEQ ID NO: 4018010 - DNA, 15 bp, Homo sapiens
attgaaagagaacca

SEQ ID NO: 4018011 - DNA, 18 bp, Homo sapiens
attgaaagagaaccagtt

SEQ ID NO: 4018012 - DNA, 19 bp, Homo sapiens
attgaaattatagtttcaa

SEQ ID NO: 4018013 - DNA, 14 bp, Homo sapiens
attgaacacaaact

SEQ ID NO: 4018014 - DNA, 19 bp, Homo sapiens
attgaacacaaactgtaaa

SEQ ID NO: 4018015 - DNA, 18 bp, Homo sapiens
attgaacattttatcatt

SEQ ID NO: 4018016 - DNA, 16 bp, Homo sapiens
attgaacttttgtact

SEQ ID NO: 4018017 - DNA, 23 bp, Homo sapiens
attgaacttttgtactgaatttt

SEQ ID NO: 4018018 - DNA, 20 bp, Homo sapiens
attgaagacaatttgataca

SEQ ID NO: 4018019 - DNA, 21 bp, Homo sapiens
attgaagagagatatatctga

SEQ ID NO: 4018020 - DNA, 23 bp, Homo sapiens
attgaagagagatatatctgaaa

SEQ ID NO: 4018021 - DNA, 22 bp, Homo sapiens
attgaagtaaactttttgttct

SEQ ID NO: 4018022 - DNA, 14 bp, Homo sapiens
attgaagtaatgaa

SEQ ID NO: 4018023 - DNA, 20 bp, Homo sapiens
attgaatcagtataaacaaa

SEQ ID NO: 4018024 - DNA, 22 bp, Homo sapiens
attgaatgtggctgaagttgaa

SEQ ID NO: 4018025 - DNA, 15 bp, Homo sapiens
attgacaagtcattt

SEQ ID NO: 4018026 - DNA, 13 bp, Homo sapiens
attgacacacagc

SEQ ID NO: 4018027 - DNA, 16 bp, Homo sapiens
attgacacacagcact

SEQ ID NO: 4018028 - DNA, 17 bp, Homo sapiens
attgacacacagcactc

SEQ ID NO: 4018029 - DNA, 12 bp, Homo sapiens
attgacacagaa

SEQ ID NO: 4018030 - DNA, 14 bp, Homo sapiens
attgacacagaaaa

SEQ ID NO: 4018031 - DNA, 14 bp, Homo sapiens
attgacactgaact

SEQ ID NO: 4018032 - DNA, 16 bp, Homo sapiens
attgacactgaactta

SEQ ID NO: 4018033 - DNA, 16 bp, Homo sapiens
attgaccaagaactgc

SEQ ID NO: 4018034 - DNA, 23 bp, Homo sapiens
attgaccgcgactaatttcaaaa

SEQ ID NO: 4018035 - DNA, 13 bp, Homo sapiens
attgacctctcag

SEQ ID NO: 4018036 - DNA, 14 bp, Homo sapiens
attgacctctcagg

SEQ ID NO: 4018037 - DNA, 20 bp, Homo sapiens
attgacctctcagggcctgg

SEQ ID NO: 4018038 - DNA, 22 bp, Homo sapiens
attgaccttgaccattaataaa

SEQ ID NO: 4018039 - DNA, 22 bp, Homo sapiens
attgacgacaagtgctgaacag

SEQ ID NO: 4018040 - DNA, 19 bp, Homo sapiens
attgagataatatctgtga

SEQ ID NO: 4018041 - DNA, 12 bp, Homo sapiens
atgtattttcct

SEQ ID NO: 4018042 - DNA, 16 bp, Homo sapiens
atgtattttgacactg

SEQ ID NO: 4018043 - DNA, 15 bp, Homo sapiens
atgtcaaacagtgcc

SEQ ID NO: 4018044 - DNA, 22 bp, Homo sapiens
atgtcaaacagtgccaaatgct

SEQ ID NO: 4018045 - DNA, 19 bp, Homo sapiens
atgtcaacttctggctcct

SEQ ID NO: 4018046 - DNA, 22 bp, Homo sapiens
atgtcacaacctctctgatctt

SEQ ID NO: 4018047 - DNA, 18 bp, Homo sapiens
atgtcaccggtcagtgcc

SEQ ID NO: 4018048 - DNA, 22 bp, Homo sapiens
atgtcaccggtcagtgcctttt

SEQ ID NO: 4018049 - DNA, 16 bp, Homo sapiens
atgtcactagaatgga

SEQ ID NO: 4018050 - DNA, 14 bp, Homo sapiens
atgtcagcagacac

SEQ ID NO: 4018051 - DNA, 15 bp, Homo sapiens
atgtcagcagacaca

SEQ ID NO: 4018052 - DNA, 19 bp, Homo sapiens
atgtcagcagacacacatg

SEQ ID NO: 4018053 - DNA, 19 bp, Homo sapiens
atgtcagccgagccgggcc

SEQ ID NO: 4018054 - DNA, 17 bp, Homo sapiens
atgtcatgtctgcttgt

SEQ ID NO: 4018055 - DNA, 16 bp, Homo sapiens
atgtccaaagaggctg

SEQ ID NO: 4018056 - DNA, 22 bp, Homo sapiens
atgtccaaagaggctgcccctc

SEQ ID NO: 4018057 - DNA, 12 bp, Homo sapiens
atgtccagaaga

SEQ ID NO: 4018058 - DNA, 23 bp, Homo sapiens
atgtccagaagaatattcaggac

SEQ ID NO: 4018059 - DNA, 21 bp, Homo sapiens
atgtccatacactttgttgca

SEQ ID NO: 4018060 - DNA, 19 bp, Homo sapiens
atgtccatttatatcattt

SEQ ID NO: 4018061 - DNA, 23 bp, Homo sapiens
atgtcccagtgctcaccagccct

SEQ ID NO: 4018062 - DNA, 24 bp, Homo sapiens
atgtccctaccgagtctcttctcc

SEQ ID NO: 4018063 - DNA, 15 bp, Homo sapiens
atgtccctgggccag

SEQ ID NO: 4018064 - DNA, 20 bp, Homo sapiens
atgtccctttcttggccagt

SEQ ID NO: 4018065 - DNA, 18 bp, Homo sapiens
atgtcctccagaagcctc

SEQ ID NO: 4018066 - DNA, 20 bp, Homo sapiens
atgtcctccagaagcctctg

SEQ ID NO: 4018067 - DNA, 22 bp, Homo sapiens
atgtcctccagaagcctctggc

SEQ ID NO: 4018068 - DNA, 14 bp, Homo sapiens
atgtcgattaaaat

SEQ ID NO: 4018069 - DNA, 12 bp, Homo sapiens
atgtctaaaatt

SEQ ID NO: 4018070 - DNA, 14 bp, Homo sapiens
atgtctaaaattgt

SEQ ID NO: 4018071 - DNA, 17 bp, Homo sapiens
atgtctaaatgctgaaa

SEQ ID NO: 4018072 - DNA, 22 bp, Homo sapiens
atgtctataatcccagcacttt

SEQ ID NO: 4018073 - DNA, 15 bp, Homo sapiens
atgtctattattatg

SEQ ID NO: 4018074 - DNA, 12 bp, Homo sapiens
atgtctatttaa

SEQ ID NO: 4018075 - DNA, 14 bp, Homo sapiens
atgtctatttaagc

SEQ ID NO: 4018076 - DNA, 16 bp, Homo sapiens
atgtctcactgttctg

SEQ ID NO: 4018077 - DNA, 20 bp, Homo sapiens
atgtctcactgttctgcaaa

SEQ ID NO: 4018078 - DNA, 21 bp, Homo sapiens
atgtctcactgttctgcaaag

SEQ ID NO: 4018079 - DNA, 14 bp, Homo sapiens
atgtctctaaagca

SEQ ID NO: 4018080 - DNA, 12 bp, Homo sapiens
atgtctctgggg

SEQ ID NO: 4018081 - DNA, 13 bp, Homo sapiens
atgtctctggggc

SEQ ID NO: 4018082 - DNA, 16 bp, Homo sapiens
atgtctgagtgaacct

SEQ ID NO: 4018083 - DNA, 15 bp, Homo sapiens
atgtctgataatgat

SEQ ID NO: 4018084 - DNA, 19 bp, Homo sapiens
atgtctgcagtgtgccccc

SEQ ID NO: 4018085 - DNA, 20 bp, Homo sapiens
atgtctgcagtgtgcccccc

SEQ ID NO: 4018086 - DNA, 15 bp, Homo sapiens
atgtctgcctggagt

SEQ ID NO: 4018087 - DNA, 21 bp, Homo sapiens
atgtctgctgagttggcctgg

SEQ ID NO: 4018088 - DNA, 16 bp, Homo sapiens
atgtctgcttgtcaaa

SEQ ID NO: 4018089 - DNA, 18 bp, Homo sapiens
atgtctgcttgtcaaaag

SEQ ID NO: 4018090 - DNA, 13 bp, Homo sapiens
atgtctgttcttc

SEQ ID NO: 4018091 - DNA, 16 bp, Homo sapiens
atgtctgtttaagaaa

SEQ ID NO: 4018092 - DNA, 19 bp, Homo sapiens
atgtctgtttaagaaaagt

SEQ ID NO: 4018093 - DNA, 17 bp, Homo sapiens
atgtcttaatttttgaa

SEQ ID NO: 4018094 - DNA, 18 bp, Homo sapiens
atgtcttccatgtatctt

SEQ ID NO: 4018095 - DNA, 16 bp, Homo sapiens
atgtcttccctgggct

SEQ ID NO: 4018096 - DNA, 20 bp, Homo sapiens
atgtcttggaacattggaat

SEQ ID NO: 4018097 - DNA, 18 bp, Homo sapiens
atgtctttctccaaagtt

SEQ ID NO: 4018098 - DNA, 22 bp, Homo sapiens
atgtctttgtaagtcagtgttg

SEQ ID NO: 4018099 - DNA, 15 bp, Homo sapiens
atgtgaaaccttttt

SEQ ID NO: 4018100 - DNA, 18 bp, Homo sapiens
atgtgcctctgcggggca

SEQ ID NO: 4018101 - DNA, 10 bp, Homo sapiens
atgtgccttt

SEQ ID NO: 4018102 - DNA, 19 bp, Homo sapiens
atgtgcctttctttgcctc

SEQ ID NO: 4018103 - DNA, 21 bp, Homo sapiens
atgtgcctttctttgcctctg

SEQ ID NO: 4018104 - DNA, 19 bp, Homo sapiens
atgtgctgggtgcctccca

SEQ ID NO: 4018105 - DNA, 16 bp, Homo sapiens
atgtggaaagtgaatt

SEQ ID NO: 4018106 - DNA, 17 bp, Homo sapiens
atgtggaaagtgaattt

SEQ ID NO: 4018107 - DNA, 12 bp, Homo sapiens
atgtggaagagc

SEQ ID NO: 4018108 - DNA, 14 bp, Homo sapiens
atgtggaagagcat

SEQ ID NO: 4018109 - DNA, 15 bp, Homo sapiens
atgtggactaaatat

SEQ ID NO: 4018110 - DNA, 19 bp, Homo sapiens
atgtggagtctccctctga

SEQ ID NO: 4018111 - DNA, 16 bp, Homo sapiens
atgtggatgacacaat

SEQ ID NO: 4018112 - DNA, 10 bp, Homo sapiens
atgtgggagg

SEQ ID NO: 4018113 - DNA, 13 bp, Homo sapiens
atgtgggcactgg

SEQ ID NO: 4018114 - DNA, 16 bp, Homo sapiens
atgtgggttgcctggt

SEQ ID NO: 4018115 - DNA, 23 bp, Homo sapiens
atgtggtcgttagagacagagcg

SEQ ID NO: 4018116 - DNA, 15 bp, Homo sapiens
atgtggtctcaggat

SEQ ID NO: 4018117 - DNA, 15 bp, Homo sapiens
atgtggttacacact

SEQ ID NO: 4018118 - DNA, 21 bp, Homo sapiens
atgtggttacttcctactgta

SEQ ID NO: 4018119 - DNA, 21 bp, Homo sapiens
atgtgtaaacaattttatata

SEQ ID NO: 4018120 - DNA, 14 bp, Homo sapiens
atgtgtaagtattc

SEQ ID NO: 4018121 - DNA, 18 bp, Homo sapiens
atgtgtacaatgtacaca

SEQ ID NO: 4018122 - DNA, 11 bp, Homo sapiens
atgtgtatgtg

SEQ ID NO: 4018123 - DNA, 20 bp, Homo sapiens
atgtgtatttccagtgcaat

SEQ ID NO: 4018124 - DNA, 21 bp, Homo sapiens
atgtgtcactactcacagtct

SEQ ID NO: 4018125 - DNA, 17 bp, Homo sapiens
atgtgtcagagtgttgt

SEQ ID NO: 4018126 - DNA, 19 bp, Homo sapiens
atgtgtcccccccaggcct

SEQ ID NO: 4018127 - DNA, 23 bp, Homo sapiens
atgtgtcccccccaggccttgtc

SEQ ID NO: 4018128 - DNA, 13 bp, Homo sapiens
atgtgtcccctca

SEQ ID NO: 4018129 - DNA, 18 bp, Homo sapiens
atgtgtcctatctatctt

SEQ ID NO: 4018130 - DNA, 19 bp, Homo sapiens
atgtgtcctatctatcttc

SEQ ID NO: 4018131 - DNA, 14 bp, Homo sapiens
atgtgtggcctgca

SEQ ID NO: 4018132 - DNA, 16 bp, Homo sapiens
atgtgtggtggcctca

SEQ ID NO: 4018133 - DNA, 12 bp, Homo sapiens
atgtgtgtgtgt

SEQ ID NO: 4018134 - DNA, 23 bp, Homo sapiens
atgtgttcttctttctctgtatt

SEQ ID NO: 4018135 - DNA, 24 bp, Homo sapiens
atgtgtttattcatccagcagtgt

SEQ ID NO: 4018136 - DNA, 13 bp, Homo sapiens
atgtgtttgctgc

SEQ ID NO: 4018137 - DNA, 14 bp, Homo sapiens
atgtgtttgctgcc

SEQ ID NO: 4018138 - DNA, 16 bp, Homo sapiens
atgtgtttgctgcctt

SEQ ID NO: 4018139 - DNA, 14 bp, Homo sapiens
atgttaaatactgt

SEQ ID NO: 4018140 - DNA, 23 bp, Homo sapiens
atgttaaatactgtgcagaataa

SEQ ID NO: 4018141 - DNA, 16 bp, Homo sapiens
atgttaaatttgtaag

SEQ ID NO: 4018142 - DNA, 23 bp, Homo sapiens
atgttaaatttgtaagtttcagg

SEQ ID NO: 4018143 - DNA, 21 bp, Homo sapiens
atgttaacctcagtgtcattt

SEQ ID NO: 4018144 - DNA, 12 bp, Homo sapiens
atgttaagcaga

SEQ ID NO: 4018145 - DNA, 13 bp, Homo sapiens
atgttaagcagat

SEQ ID NO: 4018146 - DNA, 21 bp, Homo sapiens
atgttaagcagctaaattttc

SEQ ID NO: 4018147 - DNA, 19 bp, Homo sapiens
atgttacataagataaatg

SEQ ID NO: 4018148 - DNA, 20 bp, Homo sapiens
atgttacataagataaatgt

SEQ ID NO: 4018149 - DNA, 17 bp, Homo sapiens
atgttacatcacagtgt

SEQ ID NO: 4018150 - DNA, 16 bp, Homo sapiens
atgttaccatcttact

SEQ ID NO: 4018151 - DNA, 21 bp, Homo sapiens
atgttacctcctataaactta

SEQ ID NO: 4018152 - DNA, 14 bp, Homo sapiens
atgttactattttc

SEQ ID NO: 4018153 - DNA, 21 bp, Homo sapiens
atgttactattttctacaatt

SEQ ID NO: 4018154 - DNA, 23 bp, Homo sapiens
atgttactattttctacaattaa

SEQ ID NO: 4018155 - DNA, 16 bp, Homo sapiens
atgttactgcttcatt

SEQ ID NO: 4018156 - DNA, 14 bp, Homo sapiens
atgttagtatttta

SEQ ID NO: 4018157 - DNA, 18 bp, Homo sapiens
atgttatatcatatgtat

SEQ ID NO: 4018158 - DNA, 14 bp, Homo sapiens
atgttatgaacatg

SEQ ID NO: 4018159 - DNA, 24 bp, Homo sapiens
atgttatgactatgtaaactactt

SEQ ID NO: 4018160 - DNA, 17 bp, Homo sapiens
atgttatgatattgttt

SEQ ID NO: 4018161 - DNA, 22 bp, Homo sapiens
atgttatgatattgtttaaaat

SEQ ID NO: 4018162 - DNA, 23 bp, Homo sapiens
atgttatttaacagctgaattat

SEQ ID NO: 4018163 - DNA, 21 bp, Homo sapiens
atgttattttctgttgaagtt

SEQ ID NO: 4018164 - DNA, 19 bp, Homo sapiens
atgttattttttaattatt

SEQ ID NO: 4018165 - DNA, 19 bp, Homo sapiens
atgttcagcactgtccctt

SEQ ID NO: 4018166 - DNA, 10 bp, Homo sapiens
attgcactaa

SEQ ID NO: 4018167 - DNA, 20 bp, Homo sapiens
attgcagataactttgactt

SEQ ID NO: 4018168 - DNA, 14 bp, Homo sapiens
attgcagctttatg

SEQ ID NO: 4018169 - DNA, 16 bp, Homo sapiens
attgcagctttatgtt

SEQ ID NO: 4018170 - DNA, 17 bp, Homo sapiens
attgcagctttatgttc

SEQ ID NO: 4018171 - DNA, 16 bp, Homo sapiens
attgcaggtggaactc

SEQ ID NO: 4018172 - DNA, 17 bp, Homo sapiens
attgcaggtggaactca

SEQ ID NO: 4018173 - DNA, 14 bp, Homo sapiens
attgcataaagcat

SEQ ID NO: 4018174 - DNA, 15 bp, Homo sapiens
attgcataaagcata

SEQ ID NO: 4018175 - DNA, 21 bp, Homo sapiens
attgcatctaggtaattttta

SEQ ID NO: 4018176 - DNA, 13 bp, Homo sapiens
attgcattctatt

SEQ ID NO: 4018177 - DNA, 16 bp, Homo sapiens
attgcatttgcttttg

SEQ ID NO: 4018178 - DNA, 22 bp, Homo sapiens
attgccccatccagacctggct

SEQ ID NO: 4018179 - DNA, 16 bp, Homo sapiens
attgcggccccaggag

SEQ ID NO: 4018180 - DNA, 20 bp, Homo sapiens
attgcgtttgaccttttatg

SEQ ID NO: 4018181 - DNA, 17 bp, Homo sapiens
attgctagataaaagct

SEQ ID NO: 4018182 - DNA, 14 bp, Homo sapiens
attgctagtatttg

SEQ ID NO: 4018183 - DNA, 16 bp, Homo sapiens
attgctagtatttgaa

SEQ ID NO: 4018184 - DNA, 19 bp, Homo sapiens
attgctagtatttgaatta

SEQ ID NO: 4018185 - DNA, 20 bp, Homo sapiens
attgctagtatttgaattaa

SEQ ID NO: 4018186 - DNA, 23 bp, Homo sapiens
attgctatctggaggccttccag

SEQ ID NO: 4018187 - DNA, 18 bp, Homo sapiens
attgctatgttactattt

SEQ ID NO: 4018188 - DNA, 18 bp, Homo sapiens
attgctccctaagactgt

SEQ ID NO: 4018189 - DNA, 14 bp, Homo sapiens
attgctctgttccc

SEQ ID NO: 4018190 - DNA, 22 bp, Homo sapiens
attgctctgttcccagtagtta

SEQ ID NO: 4018191 - DNA, 19 bp, Homo sapiens
attgctcttagtcccaagc

SEQ ID NO: 4018192 - DNA, 22 bp, Homo sapiens
attgctgagagaaatatggaac

SEQ ID NO: 4018193 - DNA, 22 bp, Homo sapiens
attgctgagcctctgctcccca

SEQ ID NO: 4018194 - DNA, 23 bp, Homo sapiens
attgctgagcctctgctccccag

SEQ ID NO: 4018195 - DNA, 22 bp, Homo sapiens
attgctgccataattctaagtt

SEQ ID NO: 4018196 - DNA, 23 bp, Homo sapiens
attgctgtcaagttcctttgggt

SEQ ID NO: 4018197 - DNA, 19 bp, Homo sapiens
attgcttacatttttacaa

SEQ ID NO: 4018198 - DNA, 20 bp, Homo sapiens
attgcttacatttttacaat

SEQ ID NO: 4018199 - DNA, 21 bp, Homo sapiens
attgcttacatttttacaata

SEQ ID NO: 4018200 - DNA, 15 bp, Homo sapiens
attgcttctgtagta

SEQ ID NO: 4018201 - DNA, 16 bp, Homo sapiens
attgctttctgaaatt

SEQ ID NO: 4018202 - DNA, 14 bp, Homo sapiens
attgctttggtcat

SEQ ID NO: 4018203 - DNA, 20 bp, Homo sapiens
attgctttttctaatgtggt

SEQ ID NO: 4018204 - DNA, 18 bp, Homo sapiens
attgcttttttgtattgg

SEQ ID NO: 4018205 - DNA, 14 bp, Homo sapiens
attggaattaacct

SEQ ID NO: 4018206 - DNA, 20 bp, Homo sapiens
attggaattaacctggtgct

SEQ ID NO: 4018207 - DNA, 16 bp, Homo sapiens
attggacatagatatt

SEQ ID NO: 4018208 - DNA, 22 bp, Homo sapiens
attggacatagatattttcaca

SEQ ID NO: 4018209 - DNA, 21 bp, Homo sapiens
attggagaatactttgcttca

SEQ ID NO: 4018210 - DNA, 22 bp, Homo sapiens
attggagaatactttgcttcat

SEQ ID NO: 4018211 - DNA, 23 bp, Homo sapiens
attggagaatactttgcttcata

SEQ ID NO: 4018212 - DNA, 19 bp, Homo sapiens
attggaggtgagatcacag

SEQ ID NO: 4018213 - DNA, 19 bp, Homo sapiens
attggattattcatttaaa

SEQ ID NO: 4018214 - DNA, 21 bp, Homo sapiens
attggattattcatttaaaat

SEQ ID NO: 4018215 - DNA, 14 bp, Homo sapiens
attggattatttaa

SEQ ID NO: 4018216 - DNA, 17 bp, Homo sapiens
attggattatttaataa

SEQ ID NO: 4018217 - DNA, 15 bp, Homo sapiens
attggcagtgacttt

SEQ ID NO: 4018218 - DNA, 19 bp, Homo sapiens
attggcagtgactttgtat

SEQ ID NO: 4018219 - DNA, 18 bp, Homo sapiens
attggccacctgtagcca

SEQ ID NO: 4018220 - DNA, 23 bp, Homo sapiens
attggccacctgtagccatctgc

SEQ ID NO: 4018221 - DNA, 18 bp, Homo sapiens
attggctatttaaaactt

SEQ ID NO: 4018222 - DNA, 13 bp, Homo sapiens
attgggttcatta

SEQ ID NO: 4018223 - DNA, 19 bp, Homo sapiens
attggtatagccatgattt

SEQ ID NO: 4018224 - DNA, 17 bp, Homo sapiens
attggtatcaagaaagt

SEQ ID NO: 4018225 - DNA, 23 bp, Homo sapiens
attggttggaagctaccagagct

SEQ ID NO: 4018226 - DNA, 15 bp, Homo sapiens
attggtttctcttct

SEQ ID NO: 4018227 - DNA, 16 bp, Homo sapiens
attgtaaattgaatca

SEQ ID NO: 4018228 - DNA, 17 bp, Homo sapiens
attgtaaattgaatcag

SEQ ID NO: 4018229 - DNA, 17 bp, Homo sapiens
attgtaagttgtacaaa

SEQ ID NO: 4018230 - DNA, 18 bp, Homo sapiens
attgtaagttgtacaaat

SEQ ID NO: 4018231 - DNA, 15 bp, Homo sapiens
attgtaatctttcat

SEQ ID NO: 4018232 - DNA, 18 bp, Homo sapiens
attgtaccatcattttat

SEQ ID NO: 4018233 - DNA, 19 bp, Homo sapiens
attgtaccatcattttatt

SEQ ID NO: 4018234 - DNA, 12 bp, Homo sapiens
attgtacctctc

SEQ ID NO: 4018235 - DNA, 18 bp, Homo sapiens
attgtacctctcttatag

SEQ ID NO: 4018236 - DNA, 18 bp, Homo sapiens
attgtactacctgtgtat

SEQ ID NO: 4018237 - DNA, 12 bp, Homo sapiens
attgtataagca

SEQ ID NO: 4018238 - DNA, 17 bp, Homo sapiens
attgtataagcatgctt

SEQ ID NO: 4018239 - DNA, 19 bp, Homo sapiens
attgtataagcatgctttc

SEQ ID NO: 4018240 - DNA, 15 bp, Homo sapiens
attgtatctagtgca

SEQ ID NO: 4018241 - DNA, 16 bp, Homo sapiens
attgtatctagtgcag

SEQ ID NO: 4018242 - DNA, 21 bp, Homo sapiens
attgtatctagtgcagctgat

SEQ ID NO: 4018243 - DNA, 14 bp, Homo sapiens
attgtattgctgct

SEQ ID NO: 4018244 - DNA, 20 bp, Homo sapiens
attgtcatggggatcaattt

SEQ ID NO: 4018245 - DNA, 18 bp, Homo sapiens
attgtccctggcttcctt

SEQ ID NO: 4018246 - DNA, 14 bp, Homo sapiens
attgtcctaagtgt

SEQ ID NO: 4018247 - DNA, 14 bp, Homo sapiens
attgtctatttatc

SEQ ID NO: 4018248 - DNA, 21 bp, Homo sapiens
attgtctcaacgcctccccct

SEQ ID NO: 4018249 - DNA, 18 bp, Homo sapiens
attgtcttttgtcatgtg

SEQ ID NO: 4018250 - DNA, 20 bp, Homo sapiens
attgtcttttgtcatgtggc

SEQ ID NO: 4018251 - DNA, 18 bp, Homo sapiens
attgtgtaaaaaatggaa

SEQ ID NO: 4018252 - DNA, 20 bp, Homo sapiens
attgtgtaaaaaatggaaaa

SEQ ID NO: 4018253 - DNA, 22 bp, Homo sapiens
attgtgtaaaaaatggaaaaaa

SEQ ID NO: 4018254 - DNA, 15 bp, Homo sapiens
attgtgtagcctttt

SEQ ID NO: 4018255 - DNA, 22 bp, Homo sapiens
attgtgtagcctttttgtataa

SEQ ID NO: 4018256 - DNA, 14 bp, Homo sapiens
attgtgttgtgaat

SEQ ID NO: 4018257 - DNA, 17 bp, Homo sapiens
attgttaactcttgtct

SEQ ID NO: 4018258 - DNA, 21 bp, Homo sapiens
attgttaagtctaaatatttc

SEQ ID NO: 4018259 - DNA, 22 bp, Homo sapiens
attgttaagtctaaatatttcc

SEQ ID NO: 4018260 - DNA, 17 bp, Homo sapiens
attgttaatttttccta

SEQ ID NO: 4018261 - DNA, 17 bp, Homo sapiens
attgttacacattaagt

SEQ ID NO: 4018262 - DNA, 21 bp, Homo sapiens
attgttacattatgtggaaaa

SEQ ID NO: 4018263 - DNA, 14 bp, Homo sapiens
attgttcaaacaat

SEQ ID NO: 4018264 - DNA, 14 bp, Homo sapiens
attgttccaagaca

SEQ ID NO: 4018265 - DNA, 17 bp, Homo sapiens
attgttccaagacattg

SEQ ID NO: 4018266 - DNA, 16 bp, Homo sapiens
attgttccagagacaa

SEQ ID NO: 4018267 - DNA, 17 bp, Homo sapiens
attgttctcctcgtcca

SEQ ID NO: 4018268 - DNA, 20 bp, Homo sapiens
atttcagtatcatctccatc

SEQ ID NO: 4018269 - DNA, 15 bp, Homo sapiens
atttcagtggcttcc

SEQ ID NO: 4018270 - DNA, 14 bp, Homo sapiens
atttcatagttcag

SEQ ID NO: 4018271 - DNA, 19 bp, Homo sapiens
atttcatagttcagaattt

SEQ ID NO: 4018272 - DNA, 18 bp, Homo sapiens
atttcatcattgtttctg

SEQ ID NO: 4018273 - DNA, 19 bp, Homo sapiens
atttcatccagtttgttct

SEQ ID NO: 4018274 - DNA, 15 bp, Homo sapiens
atttcatgaaaatga

SEQ ID NO: 4018275 - DNA, 15 bp, Homo sapiens
atttcatgatttcat

SEQ ID NO: 4018276 - DNA, 13 bp, Homo sapiens
atttcattccatt

SEQ ID NO: 4018277 - DNA, 14 bp, Homo sapiens
atttcattcctaac

SEQ ID NO: 4018278 - DNA, 17 bp, Homo sapiens
atttcattgcctgtgta

SEQ ID NO: 4018279 - DNA, 20 bp, Homo sapiens
atttccaacaccacagacac

SEQ ID NO: 4018280 - DNA, 21 bp, Homo sapiens
atttccaacaccacagacaca

SEQ ID NO: 4018281 - DNA, 15 bp, Homo sapiens
atttccaagaggctg

SEQ ID NO: 4018282 - DNA, 18 bp, Homo sapiens
atttccaccaggccgtgc

SEQ ID NO: 4018283 - DNA, 16 bp, Homo sapiens
atttccactgtaatta

SEQ ID NO: 4018284 - DNA, 17 bp, Homo sapiens
atttccagtacctttgt

SEQ ID NO: 4018285 - DNA, 17 bp, Homo sapiens
atttccatatggatttt

SEQ ID NO: 4018286 - DNA, 17 bp, Homo sapiens
atttccattatttatat

SEQ ID NO: 4018287 - DNA, 14 bp, Homo sapiens
atttcccacatctt

SEQ ID NO: 4018288 - DNA, 15 bp, Homo sapiens
atttcccagggttaa

SEQ ID NO: 4018289 - DNA, 14 bp, Homo sapiens
atttcccatctgca

SEQ ID NO: 4018290 - DNA, 18 bp, Homo sapiens
atttccccctttcttcct

SEQ ID NO: 4018291 - DNA, 20 bp, Homo sapiens
atttccccctttcttcctca

SEQ ID NO: 4018292 - DNA, 15 bp, Homo sapiens
atttcccctccttcc

SEQ ID NO: 4018293 - DNA, 14 bp, Homo sapiens
atttcccgcacatg

SEQ ID NO: 4018294 - DNA, 21 bp, Homo sapiens
atttccctaaaatacatttaa

SEQ ID NO: 4018295 - DNA, 14 bp, Homo sapiens
atttccctcaggtt

SEQ ID NO: 4018296 - DNA, 20 bp, Homo sapiens
atttccctcaggttctattt

SEQ ID NO: 4018297 - DNA, 18 bp, Homo sapiens
atttccctgactcctcta

SEQ ID NO: 4018298 - DNA, 24 bp, Homo sapiens
atttcctcaacgttgctccccatc

SEQ ID NO: 4018299 - DNA, 19 bp, Homo sapiens
atttcctcagcttatctct

SEQ ID NO: 4018300 - DNA, 21 bp, Homo sapiens
atttcctcagcttatctcttt

SEQ ID NO: 4018301 - DNA, 16 bp, Homo sapiens
atttccttccagccca

SEQ ID NO: 4018302 - DNA, 17 bp, Homo sapiens
atttccttccagcccat

SEQ ID NO: 4018303 - DNA, 15 bp, Homo sapiens
atttccttggaggcc

SEQ ID NO: 4018304 - DNA, 15 bp, Homo sapiens
atttcctttatactg

SEQ ID NO: 4018305 - DNA, 15 bp, Homo sapiens
atttcctttatgtga

SEQ ID NO: 4018306 - DNA, 17 bp, Homo sapiens
atttcctttatgtgaat

SEQ ID NO: 4018307 - DNA, 19 bp, Homo sapiens
atttcctttatgtgaattt

SEQ ID NO: 4018308 - DNA, 18 bp, Homo sapiens
atttcctttggagctttt

SEQ ID NO: 4018309 - DNA, 18 bp, Homo sapiens
atttccttttctctgccc

SEQ ID NO: 4018310 - DNA, 14 bp, Homo sapiens
atttcgaaactgcc

SEQ ID NO: 4018311 - DNA, 19 bp, Homo sapiens
atttcggattttttccaaa

SEQ ID NO: 4018312 - DNA, 14 bp, Homo sapiens
atttctaactatat

SEQ ID NO: 4018313 - DNA, 21 bp, Homo sapiens
atttctaatccttttccttat

SEQ ID NO: 4018314 - DNA, 16 bp, Homo sapiens
atttctactgtgactg

SEQ ID NO: 4018315 - DNA, 18 bp, Homo sapiens
atttctactgtgactgat

SEQ ID NO: 4018316 - DNA, 14 bp, Homo sapiens
atttctagaaacaa

SEQ ID NO: 4018317 - DNA, 20 bp, Homo sapiens
atttctagaagcacatgtgt

SEQ ID NO: 4018318 - DNA, 13 bp, Homo sapiens
atttctatttatt

SEQ ID NO: 4018319 - DNA, 15 bp, Homo sapiens
atttctcaggaagag

SEQ ID NO: 4018320 - DNA, 18 bp, Homo sapiens
atttctcataattttgca

SEQ ID NO: 4018321 - DNA, 14 bp, Homo sapiens
atttctcatcacag

SEQ ID NO: 4018322 - DNA, 14 bp, Homo sapiens
atttctcctccctt

SEQ ID NO: 4018323 - DNA, 10 bp, Homo sapiens
atttctcctt

SEQ ID NO: 4018324 - DNA, 17 bp, Homo sapiens
atttctccttttgtgtt

SEQ ID NO: 4018325 - DNA, 23 bp, Homo sapiens
atttctgagtttcattctcctgc

SEQ ID NO: 4018326 - DNA, 13 bp, Homo sapiens
atttctgctctgg

SEQ ID NO: 4018327 - DNA, 12 bp, Homo sapiens
atttctggttga

SEQ ID NO: 4018328 - DNA, 16 bp, Homo sapiens
atttcttatgtgacat

SEQ ID NO: 4018329 - DNA, 18 bp, Homo sapiens
atttcttatgtgacatta

SEQ ID NO: 4018330 - DNA, 18 bp, Homo sapiens
atttcttcagtcagaaaa

SEQ ID NO: 4018331 - DNA, 11 bp, Homo sapiens
atttcttccca

SEQ ID NO: 4018332 - DNA, 15 bp, Homo sapiens
atttcttccctgctt

SEQ ID NO: 4018333 - DNA, 19 bp, Homo sapiens
atttcttcctaccaagtca

SEQ ID NO: 4018334 - DNA, 16 bp, Homo sapiens
atttcttcctcactat

SEQ ID NO: 4018335 - DNA, 22 bp, Homo sapiens
atttcttccttgttgtttgctt

SEQ ID NO: 4018336 - DNA, 23 bp, Homo sapiens
atttcttccttgttgtttgcttt

SEQ ID NO: 4018337 - DNA, 18 bp, Homo sapiens
atttcttgtcaattatgt

SEQ ID NO: 4018338 - DNA, 14 bp, Homo sapiens
atttcttgtttgtt

SEQ ID NO: 4018339 - DNA, 22 bp, Homo sapiens
atttctttgttatcaaacttca

SEQ ID NO: 4018340 - DNA, 13 bp, Homo sapiens
atttcttttcctt

SEQ ID NO: 4018341 - DNA, 20 bp, Homo sapiens
atttcttttctttttacata

SEQ ID NO: 4018342 - DNA, 14 bp, Homo sapiens
atttctttttaatt

SEQ ID NO: 4018343 - DNA, 18 bp, Homo sapiens
atttctttttaattattt

SEQ ID NO: 4018344 - DNA, 19 bp, Homo sapiens
atttctttttaattatttt

SEQ ID NO: 4018345 - DNA, 14 bp, Homo sapiens
atttgaaaaaaact

SEQ ID NO: 4018346 - DNA, 17 bp, Homo sapiens
atttgaaaccaggacat

SEQ ID NO: 4018347 - DNA, 18 bp, Homo sapiens
atttgaaaccaggacatt

SEQ ID NO: 4018348 - DNA, 17 bp, Homo sapiens
atttgaaatactaaaag

SEQ ID NO: 4018349 - DNA, 14 bp, Homo sapiens
atttgaaccaataa

SEQ ID NO: 4018350 - DNA, 16 bp, Homo sapiens
atttgaacctggatcc

SEQ ID NO: 4018351 - DNA, 16 bp, Homo sapiens
atttgaagaacatgtg

SEQ ID NO: 4018352 - DNA, 16 bp, Homo sapiens
atttgaagcaaagcac

SEQ ID NO: 4018353 - DNA, 13 bp, Homo sapiens
atttgaatgaaaa

SEQ ID NO: 4018354 - DNA, 19 bp, Homo sapiens
atttgaatgaaaaatttaa

SEQ ID NO: 4018355 - DNA, 18 bp, Homo sapiens
attttttcttctgaagat

SEQ ID NO: 4018356 - DNA, 23 bp, Homo sapiens
attttttgactttttttgtatgt

SEQ ID NO: 4018357 - DNA, 15 bp, Homo sapiens
atttttttaaacata

SEQ ID NO: 4018358 - DNA, 21 bp, Homo sapiens
atttttttaactgaaaatgta

SEQ ID NO: 4018359 - DNA, 18 bp, Homo sapiens
atttttttaatttacaaa

SEQ ID NO: 4018360 - DNA, 13 bp, Homo sapiens
atttttttattca

SEQ ID NO: 4018361 - DNA, 15 bp, Homo sapiens
atttttttcaatatt

SEQ ID NO: 4018362 - DNA, 14 bp, Homo sapiens
atttttttgtaata

SEQ ID NO: 4018363 - DNA, 15 bp, Homo sapiens
atttttttgtaataa

SEQ ID NO: 4018364 - DNA, 14 bp, Homo sapiens
atttttttgtaatt

SEQ ID NO: 4018365 - DNA, 22 bp, Homo sapiens
atttttttgtcattaaaattgt

SEQ ID NO: 4018366 - DNA, 23 bp, Homo sapiens
atttttttttcatagagatttgt

SEQ ID NO: 4018367 - DNA, 18 bp, Homo sapiens
atttttttttctaagaga

SEQ ID NO: 4018368 - DNA, 19 bp, Homo sapiens
atttttttttctaagagaa

SEQ ID NO: 4018369 - DNA, 17 bp, Homo sapiens
attttttttttcctctt

SEQ ID NO: 4018370 - DNA, 23 bp, Homo sapiens
atttttttttttttttttttaag

SEQ ID NO: 4018371 - DNA, 13 bp, Homo sapiens
caaaaaaaaaaga

SEQ ID NO: 4018372 - DNA, 20 bp, Homo sapiens
caaaaaaaaagttttatttt

SEQ ID NO: 4018373 - DNA, 19 bp, Homo sapiens
caaaaaaaatttagccggg

SEQ ID NO: 4018374 - DNA, 17 bp, Homo sapiens
caaaaaaaggaaaaata

SEQ ID NO: 4018375 - DNA, 22 bp, Homo sapiens
caaaaaaaggaaaaataatcaa

SEQ ID NO: 4018376 - DNA, 18 bp, Homo sapiens
caaaaaaatatatttaat

SEQ ID NO: 4018377 - DNA, 23 bp, Homo sapiens
caaaaaaatatatttaatgataa

SEQ ID NO: 4018378 - DNA, 11 bp, Homo sapiens
caaaaaactac

SEQ ID NO: 4018379 - DNA, 15 bp, Homo sapiens
caaaaaagggacagc

SEQ ID NO: 4018380 - DNA, 22 bp, Homo sapiens
caaaaactgtctttaaaagaga

SEQ ID NO: 4018381 - DNA, 23 bp, Homo sapiens
caaaaactttggagtcccctcac

SEQ ID NO: 4018382 - DNA, 20 bp, Homo sapiens
caaaaagaaaagaaaatttt

SEQ ID NO: 4018383 - DNA, 16 bp, Homo sapiens
caaaaagaaatgacta

SEQ ID NO: 4018384 - DNA, 14 bp, Homo sapiens
caaaaagcaaggga

SEQ ID NO: 4018385 - DNA, 13 bp, Homo sapiens
caaaaagcttccc

SEQ ID NO: 4018386 - DNA, 14 bp, Homo sapiens
caaaaatagctggg

SEQ ID NO: 4018387 - DNA, 12 bp, Homo sapiens
caaaaatataaa

SEQ ID NO: 4018388 - DNA, 15 bp, Homo sapiens
caaaaatataactta

SEQ ID NO: 4018389 - DNA, 20 bp, Homo sapiens
caaaaatcccaccttcccac

SEQ ID NO: 4018390 - DNA, 13 bp, Homo sapiens
caaaaatgatttt

SEQ ID NO: 4018391 - DNA, 18 bp, Homo sapiens
caaaaatgcaacaaatga

SEQ ID NO: 4018392 - DNA, 19 bp, Homo sapiens
caaaaatgcaacaaatgaa

SEQ ID NO: 4018393 - DNA, 17 bp, Homo sapiens
caaaaattagccgggca

SEQ ID NO: 4018394 - DNA, 11 bp, Homo sapiens
caaaaattagg

SEQ ID NO: 4018395 - DNA, 18 bp, Homo sapiens
caaaaattaggtattttg

SEQ ID NO: 4018396 - DNA, 15 bp, Homo sapiens
caaaacactatgtat

SEQ ID NO: 4018397 - DNA, 19 bp, Homo sapiens
caaaacagagatgtgataa

SEQ ID NO: 4018398 - DNA, 19 bp, Homo sapiens
caaaaccaggcctctgctg

SEQ ID NO: 4018399 - DNA, 15 bp, Homo sapiens
caaaacccagacctg

SEQ ID NO: 4018400 - DNA, 21 bp, Homo sapiens
caaaacctgatgttaaaattc

SEQ ID NO: 4018401 - DNA, 13 bp, Homo sapiens
caaaacggggcag

SEQ ID NO: 4018402 - DNA, 16 bp, Homo sapiens
caaaactcctgtcttt

SEQ ID NO: 4018403 - DNA, 15 bp, Homo sapiens
caaaagaaatacctt

SEQ ID NO: 4018404 - DNA, 21 bp, Homo sapiens
caaaagaaatttaagttctat

SEQ ID NO: 4018405 - DNA, 16 bp, Homo sapiens
caaaagaagcccccag

SEQ ID NO: 4018406 - DNA, 19 bp, Homo sapiens
caaaagattaatgtgtatt

SEQ ID NO: 4018407 - DNA, 16 bp, Homo sapiens
caaaagcaagactgtt

SEQ ID NO: 4018408 - DNA, 19 bp, Homo sapiens
caaaagctagacagatccc

SEQ ID NO: 4018409 - DNA, 16 bp, Homo sapiens
caaaagcttcaaatta

SEQ ID NO: 4018410 - DNA, 17 bp, Homo sapiens
caaaagcttcaaattaa

SEQ ID NO: 4018411 - DNA, 16 bp, Homo sapiens
caaaaggcagctcacc

SEQ ID NO: 4018412 - DNA, 22 bp, Homo sapiens
caaaaggcctcttgtaaagact

SEQ ID NO: 4018413 - DNA, 19 bp, Homo sapiens
caaaaggcttgcagaactt

SEQ ID NO: 4018414 - DNA, 12 bp, Homo sapiens
caaaagtaaatg

SEQ ID NO: 4018415 - DNA, 13 bp, Homo sapiens
caaaagtaaatgg

SEQ ID NO: 4018416 - DNA, 15 bp, Homo sapiens
caaaagtccctccct

SEQ ID NO: 4018417 - DNA, 21 bp, Homo sapiens
caaaagtccctccctgcctga

SEQ ID NO: 4018418 - DNA, 22 bp, Homo sapiens
caaaagtccctccctgcctgag

SEQ ID NO: 4018419 - DNA, 21 bp, Homo sapiens
caaaagtgctccccaaaagga

SEQ ID NO: 4018420 - DNA, 22 bp, Homo sapiens
caaaataaaaagtgacacagca

SEQ ID NO: 4018421 - DNA, 17 bp, Homo sapiens
caaaataaaaatgaggt

SEQ ID NO: 4018422 - DNA, 22 bp, Homo sapiens
caaaataaggaagagggctgag

SEQ ID NO: 4018423 - DNA, 14 bp, Homo sapiens
caaaataattctaa

SEQ ID NO: 4018424 - DNA, 15 bp, Homo sapiens
caaaatatgcccctt

SEQ ID NO: 4018425 - DNA, 15 bp, Homo sapiens
caaaatattttttgc

SEQ ID NO: 4018426 - DNA, 20 bp, Homo sapiens
caaaatcactttaagatctt

SEQ ID NO: 4018427 - DNA, 18 bp, Homo sapiens
caaaatccttccaaagaa

SEQ ID NO: 4018428 - DNA, 20 bp, Homo sapiens
caaaatgctttttatttctg

SEQ ID NO: 4018429 - DNA, 23 bp, Homo sapiens
caaaatgctttttatttctgcat

SEQ ID NO: 4018430 - DNA, 16 bp, Homo sapiens
caaaatggacatggtg

SEQ ID NO: 4018431 - DNA, 14 bp, Homo sapiens
caaaatgtagcttt

SEQ ID NO: 4018432 - DNA, 23 bp, Homo sapiens
caaaatgtagcttttggggaggg

SEQ ID NO: 4018433 - DNA, 15 bp, Homo sapiens
caaaatgtagggtta

SEQ ID NO: 4018434 - DNA, 13 bp, Homo sapiens
caaaatgtctgta

SEQ ID NO: 4018435 - DNA, 20 bp, Homo sapiens
caaaatgtgtatttcttata

SEQ ID NO: 4018436 - DNA, 17 bp, Homo sapiens
caaaattctagctgtat

SEQ ID NO: 4018437 - DNA, 22 bp, Homo sapiens
caaaattgatgtgtttatttat

SEQ ID NO: 4018438 - DNA, 19 bp, Homo sapiens
caaaattgcaatttcttag

SEQ ID NO: 4018439 - DNA, 14 bp, Homo sapiens
caaaatttccagta

SEQ ID NO: 4018440 - DNA, 14 bp, Homo sapiens
caaaatttgaaatt

SEQ ID NO: 4018441 - DNA, 14 bp, Homo sapiens
caaaattttatttt

SEQ ID NO: 4018442 - DNA, 20 bp, Homo sapiens
caaacaaaaaggttctcagg

SEQ ID NO: 4018443 - DNA, 15 bp, Homo sapiens
caaacaaatatgcaa

SEQ ID NO: 4018444 - DNA, 17 bp, Homo sapiens
caaacaaatatgcaaaa

SEQ ID NO: 4018445 - DNA, 15 bp, Homo sapiens
caaacacacacacta

SEQ ID NO: 4018446 - DNA, 21 bp, Homo sapiens
caaacaccttccagctcctgt

SEQ ID NO: 4018447 - DNA, 12 bp, Homo sapiens
atgattaatcaa

SEQ ID NO: 4018448 - DNA, 13 bp, Homo sapiens
atgattaatcaaa

SEQ ID NO: 4018449 - DNA, 15 bp, Homo sapiens
atgattaatcaaagg

SEQ ID NO: 4018450 - DNA, 16 bp, Homo sapiens
atgattaattcacctt

SEQ ID NO: 4018451 - DNA, 23 bp, Homo sapiens
atgattagcaagttacagtgatg

SEQ ID NO: 4018452 - DNA, 17 bp, Homo sapiens
atgattcagaaattgga

SEQ ID NO: 4018453 - DNA, 14 bp, Homo sapiens
atgattggattatt

SEQ ID NO: 4018454 - DNA, 18 bp, Homo sapiens
atgattgtataagcatgc

SEQ ID NO: 4018455 - DNA, 12 bp, Homo sapiens
atgattgtttct

SEQ ID NO: 4018456 - DNA, 13 bp, Homo sapiens
atgatttaataaa

SEQ ID NO: 4018457 - DNA, 18 bp, Homo sapiens
atgatttaataaaataat

SEQ ID NO: 4018458 - DNA, 22 bp, Homo sapiens
atgatttaataaaataattcta

SEQ ID NO: 4018459 - DNA, 14 bp, Homo sapiens
atgatttcatttca

SEQ ID NO: 4018460 - DNA, 19 bp, Homo sapiens
atgatttccttcaatgtgc

SEQ ID NO: 4018461 - DNA, 13 bp, Homo sapiens
atgatttccttga

SEQ ID NO: 4018462 - DNA, 15 bp, Homo sapiens
atgatttccttgaat

SEQ ID NO: 4018463 - DNA, 19 bp, Homo sapiens
atgatttccttgaatgtgg

SEQ ID NO: 4018464 - DNA, 20 bp, Homo sapiens
atgatttccttgaatgtggc

SEQ ID NO: 4018465 - DNA, 17 bp, Homo sapiens
atgatttgtagtggaaa

SEQ ID NO: 4018466 - DNA, 22 bp, Homo sapiens
atgattttcatttcatgaaaat

SEQ ID NO: 4018467 - DNA, 14 bp, Homo sapiens
atgattttcctttt

SEQ ID NO: 4018468 - DNA, 18 bp, Homo sapiens
atgattttgcaaaatgag

SEQ ID NO: 4018469 - DNA, 23 bp, Homo sapiens
atgcaaaaaaaaaaaaagcaatt

SEQ ID NO: 4018470 - DNA, 11 bp, Homo sapiens
atgcaaaatgg

SEQ ID NO: 4018471 - DNA, 14 bp, Homo sapiens
atgcaacaaatgaa

SEQ ID NO: 4018472 - DNA, 18 bp, Homo sapiens
atgcaagagtgattgcag

SEQ ID NO: 4018473 - DNA, 20 bp, Homo sapiens
atgcaaggaaggaaagaaag

SEQ ID NO: 4018474 - DNA, 19 bp, Homo sapiens
atgcaatgacatcttcaaa

SEQ ID NO: 4018475 - DNA, 17 bp, Homo sapiens
atgcaatgtgctactga

SEQ ID NO: 4018476 - DNA, 21 bp, Homo sapiens
atgcacacacacacgctttct

SEQ ID NO: 4018477 - DNA, 20 bp, Homo sapiens
atgcacactagcctctccag

SEQ ID NO: 4018478 - DNA, 17 bp, Homo sapiens
atgcacagtaaaaatgg

SEQ ID NO: 4018479 - DNA, 19 bp, Homo sapiens
atgcacagtatcttttctt

SEQ ID NO: 4018480 - DNA, 22 bp, Homo sapiens
atgcacccctgagccagcaggg

SEQ ID NO: 4018481 - DNA, 14 bp, Homo sapiens
atgcactatgtata

SEQ ID NO: 4018482 - DNA, 22 bp, Homo sapiens
atgcactgaaaacttagccaga

SEQ ID NO: 4018483 - DNA, 16 bp, Homo sapiens
atgcagaaaaagaaaa

SEQ ID NO: 4018484 - DNA, 17 bp, Homo sapiens
atgcagaaaaagaaaaa

SEQ ID NO: 4018485 - DNA, 13 bp, Homo sapiens
atgcagagagcca

SEQ ID NO: 4018486 - DNA, 20 bp, Homo sapiens
atgcagagagccattttgtg

SEQ ID NO: 4018487 - DNA, 21 bp, Homo sapiens
atgcagaggaggtgagagtgg

SEQ ID NO: 4018488 - DNA, 23 bp, Homo sapiens
atgcagaggtaaaagtgtgagca

SEQ ID NO: 4018489 - DNA, 20 bp, Homo sapiens
atgcagccacgattggagaa

SEQ ID NO: 4018490 - DNA, 21 bp, Homo sapiens
atgcagcccatgcccacctgc

SEQ ID NO: 4018491 - DNA, 23 bp, Homo sapiens
atgcagcctaaagtacagcctgg

SEQ ID NO: 4018492 - DNA, 17 bp, Homo sapiens
atgcaggacaggaggcg

SEQ ID NO: 4018493 - DNA, 19 bp, Homo sapiens
atgcagggaggggaggcag

SEQ ID NO: 4018494 - DNA, 15 bp, Homo sapiens
atgcagggcagtcat

SEQ ID NO: 4018495 - DNA, 17 bp, Homo sapiens
atgcaggtgtcctgagc

SEQ ID NO: 4018496 - DNA, 18 bp, Homo sapiens
atgcagtgatatggcaga

SEQ ID NO: 4018497 - DNA, 17 bp, Homo sapiens
atgcagttcattatttt

SEQ ID NO: 4018498 - DNA, 17 bp, Homo sapiens
atgcagttttaagaatt

SEQ ID NO: 4018499 - DNA, 22 bp, Homo sapiens
atgcataaaagggtcaaacctg

SEQ ID NO: 4018500 - DNA, 17 bp, Homo sapiens
ataaaatgtaattactt

SEQ ID NO: 4018501 - DNA, 16 bp, Homo sapiens
ataaaattacaaaaga

SEQ ID NO: 4018502 - DNA, 14 bp, Homo sapiens
ataaaattttgctt

SEQ ID NO: 4018503 - DNA, 15 bp, Homo sapiens
ataaacaaagttact

SEQ ID NO: 4018504 - DNA, 19 bp, Homo sapiens
ataaacagacaatatgtga

SEQ ID NO: 4018505 - DNA, 20 bp, Homo sapiens
ataaacagactgttaattat

SEQ ID NO: 4018506 - DNA, 13 bp, Homo sapiens
ataaacagtaatg

SEQ ID NO: 4018507 - DNA, 17 bp, Homo sapiens
ataaacatcacacacac

SEQ ID NO: 4018508 - DNA, 15 bp, Homo sapiens
ataaaccaataaatc

SEQ ID NO: 4018509 - DNA, 12 bp, Homo sapiens
ataaaccaatct

SEQ ID NO: 4018510 - DNA, 15 bp, Homo sapiens
ataaactagagaagg

SEQ ID NO: 4018511 - DNA, 19 bp, Homo sapiens
ataaactgaatattttgga

SEQ ID NO: 4018512 - DNA, 21 bp, Homo sapiens
ataaactgaatattttggaaa

SEQ ID NO: 4018513 - DNA, 22 bp, Homo sapiens
ataaactgactatcataaaatc

SEQ ID NO: 4018514 - DNA, 14 bp, Homo sapiens
ataaactgagcctc

SEQ ID NO: 4018515 - DNA, 17 bp, Homo sapiens
ataaacttagaggaaaa

SEQ ID NO: 4018516 - DNA, 11 bp, Homo sapiens
ataaagatgat

SEQ ID NO: 4018517 - DNA, 19 bp, Homo sapiens
ataaagatgatctactcag

SEQ ID NO: 4018518 - DNA, 14 bp, Homo sapiens
ataaagcataagta

SEQ ID NO: 4018519 - DNA, 20 bp, Homo sapiens
ataaagcctgttttgtcttt

SEQ ID NO: 4018520 - DNA, 17 bp, Homo sapiens
ataaagcttgtggcccc

SEQ ID NO: 4018521 - DNA, 22 bp, Homo sapiens
ataaaggatgtgattgtggaat

SEQ ID NO: 4018522 - DNA, 16 bp, Homo sapiens
ataaagggttgaaaat

SEQ ID NO: 4018523 - DNA, 21 bp, Homo sapiens
ataaaggttgacaataaatgt

SEQ ID NO: 4018524 - DNA, 14 bp, Homo sapiens
ataaagtaaagcta

SEQ ID NO: 4018525 - DNA, 21 bp, Homo sapiens
ataaagttctgagtgttttta

SEQ ID NO: 4018526 - DNA, 12 bp, Homo sapiens
ataaagtttgct

SEQ ID NO: 4018527 - DNA, 19 bp, Homo sapiens
ataaagtttgcttagaaaa

SEQ ID NO: 4018528 - DNA, 16 bp, Homo sapiens
ataaataaaactgaat

SEQ ID NO: 4018529 - DNA, 19 bp, Homo sapiens
ataaataaaactgaatctc

SEQ ID NO: 4018530 - DNA, 11 bp, Homo sapiens
ataaataattt

SEQ ID NO: 4018531 - DNA, 21 bp, Homo sapiens
ataaatacaaatctgtataaa

SEQ ID NO: 4018532 - DNA, 14 bp, Homo sapiens
ataaatagaactat

SEQ ID NO: 4018533 - DNA, 12 bp, Homo sapiens
ataaatagcctt

SEQ ID NO: 4018534 - DNA, 11 bp, Homo sapiens
ataaatagcta

SEQ ID NO: 4018535 - DNA, 14 bp, Homo sapiens
ataaatagctatat

SEQ ID NO: 4018536 - DNA, 16 bp, Homo sapiens
ataaataggagaggat

SEQ ID NO: 4018537 - DNA, 22 bp, Homo sapiens
ataaataggtcaatacaaatgt

SEQ ID NO: 4018538 - DNA, 23 bp, Homo sapiens
ataaatatataaaaagaaaagat

SEQ ID NO: 4018539 - DNA, 18 bp, Homo sapiens
ataaatatcacagtatta

SEQ ID NO: 4018540 - DNA, 13 bp, Homo sapiens
ataaatatgcagt

SEQ ID NO: 4018541 - DNA, 15 bp, Homo sapiens
ataaatcacacattc

SEQ ID NO: 4018542 - DNA, 18 bp, Homo sapiens
ataaatcatattgatgaa

SEQ ID NO: 4018543 - DNA, 15 bp, Homo sapiens
ataaatcatttcagt

SEQ ID NO: 4018544 - DNA, 16 bp, Homo sapiens
ataaatctgacccagt

SEQ ID NO: 4018545 - DNA, 17 bp, Homo sapiens
ataaatgaagcagcttt

SEQ ID NO: 4018546 - DNA, 11 bp, Homo sapiens
ataaatgaatg

SEQ ID NO: 4018547 - DNA, 13 bp, Homo sapiens
ataaatggctggt

SEQ ID NO: 4018548 - DNA, 15 bp, Homo sapiens
ataaatgtatcttat

SEQ ID NO: 4018549 - DNA, 14 bp, Homo sapiens
ataaattaggacca

SEQ ID NO: 4018550 - DNA, 14 bp, Homo sapiens
ataaattagttgtt

SEQ ID NO: 4018551 - DNA, 22 bp, Homo sapiens
ataaattcagatatatttttca

SEQ ID NO: 4018552 - DNA, 16 bp, Homo sapiens
ataaattctataggaa

SEQ ID NO: 4018553 - DNA, 14 bp, Homo sapiens
ataaattctgattc

SEQ ID NO: 4018554 - DNA, 23 bp, Homo sapiens
ataaattgtaccatcattttatt

SEQ ID NO: 4018555 - DNA, 16 bp, Homo sapiens
ataaatttactttaca

SEQ ID NO: 4018556 - DNA, 20 bp, Homo sapiens
ataacaaacgtgttttttaa

SEQ ID NO: 4018557 - DNA, 13 bp, Homo sapiens
ataacaatgttaa

SEQ ID NO: 4018558 - DNA, 23 bp, Homo sapiens
ataacactataaaggttgacaat

SEQ ID NO: 4018559 - DNA, 16 bp, Homo sapiens
ataacagtaaatgtgc

SEQ ID NO: 4018560 - DNA, 13 bp, Homo sapiens
ataacatgtaatt

SEQ ID NO: 4018561 - DNA, 18 bp, Homo sapiens
ataacatgtaattaagta

SEQ ID NO: 4018562 - DNA, 15 bp, Homo sapiens
ataaccaacaatata

SEQ ID NO: 4018563 - DNA, 15 bp, Homo sapiens
ataaccaagtttatt

SEQ ID NO: 4018564 - DNA, 23 bp, Homo sapiens
ataaccaagtttattcagtaaac

SEQ ID NO: 4018565 - DNA, 14 bp, Homo sapiens
ataaccatgagaat

SEQ ID NO: 4018566 - DNA, 16 bp, Homo sapiens
ataaccatgagaattt

SEQ ID NO: 4018567 - DNA, 21 bp, Homo sapiens
ataaccccaccttgccaagct

SEQ ID NO: 4018568 - DNA, 16 bp, Homo sapiens
ataaccccagcctgac

SEQ ID NO: 4018569 - DNA, 18 bp, Homo sapiens
ataacctatttttttctc

SEQ ID NO: 4018570 - DNA, 16 bp, Homo sapiens
ataactaaaaggtatg

SEQ ID NO: 4018571 - DNA, 14 bp, Homo sapiens
ataactaaataaag

SEQ ID NO: 4018572 - DNA, 15 bp, Homo sapiens
ataactactgtgttc

SEQ ID NO: 4018573 - DNA, 16 bp, Homo sapiens
ataactactgtgttcc

SEQ ID NO: 4018574 - DNA, 19 bp, Homo sapiens
ataactactgtgttcctgg

SEQ ID NO: 4018575 - DNA, 15 bp, Homo sapiens
ataactcaatggaaa

SEQ ID NO: 4018576 - DNA, 14 bp, Homo sapiens
ataactcagaatat

SEQ ID NO: 4018577 - DNA, 17 bp, Homo sapiens
ataactcatcataaaat

SEQ ID NO: 4018578 - DNA, 22 bp, Homo sapiens
ataactcctgtcccttttccct

SEQ ID NO: 4018579 - DNA, 12 bp, Homo sapiens
ataactccttct

SEQ ID NO: 4018580 - DNA, 13 bp, Homo sapiens
ataactctgtaaa

SEQ ID NO: 4018581 - DNA, 23 bp, Homo sapiens
ataactgccttgaacctgtgagt

SEQ ID NO: 4018582 - DNA, 15 bp, Homo sapiens
ataactgtgtactgt

SEQ ID NO: 4018583 - DNA, 16 bp, Homo sapiens
ataacttaaaaaaatg

SEQ ID NO: 4018584 - DNA, 18 bp, Homo sapiens
atcactccccaaggaaga

SEQ ID NO: 4018585 - DNA, 20 bp, Homo sapiens
atcactccccaaggaagagc

SEQ ID NO: 4018586 - DNA, 17 bp, Homo sapiens
atcactctaaaaaacat

SEQ ID NO: 4018587 - DNA, 19 bp, Homo sapiens
atcactggctggcctgagc

SEQ ID NO: 4018588 - DNA, 16 bp, Homo sapiens
atcactttgtctaact

SEQ ID NO: 4018589 - DNA, 14 bp, Homo sapiens
atcagaagataact

SEQ ID NO: 4018590 - DNA, 19 bp, Homo sapiens
atcagaatagccacatttg

SEQ ID NO: 4018591 - DNA, 12 bp, Homo sapiens
atcagaattctc

SEQ ID NO: 4018592 - DNA, 19 bp, Homo sapiens
atcagacaccctctcctta

SEQ ID NO: 4018593 - DNA, 20 bp, Homo sapiens
atcagaccataatgttacat

SEQ ID NO: 4018594 - DNA, 12 bp, Homo sapiens
atcagacctgtc

SEQ ID NO: 4018595 - DNA, 13 bp, Homo sapiens
atcagacctgtct

SEQ ID NO: 4018596 - DNA, 17 bp, Homo sapiens
atcagaggtgtacacta

SEQ ID NO: 4018597 - DNA, 21 bp, Homo sapiens
atcagaggtgtacactaacat

SEQ ID NO: 4018598 - DNA, 15 bp, Homo sapiens
atcagagtagaaata

SEQ ID NO: 4018599 - DNA, 20 bp, Homo sapiens
atcagagtagaaataaaagt

SEQ ID NO: 4018600 - DNA, 21 bp, Homo sapiens
atcagagtagaaataaaagtg

SEQ ID NO: 4018601 - DNA, 15 bp, Homo sapiens
atcagataagacata

SEQ ID NO: 4018602 - DNA, 14 bp, Homo sapiens
atcagatggaaata

SEQ ID NO: 4018603 - DNA, 18 bp, Homo sapiens
atcagcatctgtgatggg

SEQ ID NO: 4018604 - DNA, 20 bp, Homo sapiens
atcagcccaatccctgatcc

SEQ ID NO: 4018605 - DNA, 20 bp, Homo sapiens
atcagcctgagtctcctgtg

SEQ ID NO: 4018606 - DNA, 11 bp, Homo sapiens
atcagctccct

SEQ ID NO: 4018607 - DNA, 21 bp, Homo sapiens
atcagctccttttccgttctg

SEQ ID NO: 4018608 - DNA, 16 bp, Homo sapiens
atcagctgtttgtcat

SEQ ID NO: 4018609 - DNA, 21 bp, Homo sapiens
atcaggaaatatatatgtgtg

SEQ ID NO: 4018610 - DNA, 18 bp, Homo sapiens
atcaggatgaacccagga

SEQ ID NO: 4018611 - DNA, 19 bp, Homo sapiens
atcaggatgaacccaggac

SEQ ID NO: 4018612 - DNA, 16 bp, Homo sapiens
atcaggctactagaat

SEQ ID NO: 4018613 - DNA, 15 bp, Homo sapiens
atcaggctatgtatg

SEQ ID NO: 4018614 - DNA, 19 bp, Homo sapiens
atcagggaatccagctccc

SEQ ID NO: 4018615 - DNA, 16 bp, Homo sapiens
atcagggatctcagag

SEQ ID NO: 4018616 - DNA, 24 bp, Homo sapiens
atcagggcctggggcctgagagaa

SEQ ID NO: 4018617 - DNA, 17 bp, Homo sapiens
atcagtaagaggtgtta

SEQ ID NO: 4018618 - DNA, 17 bp, Homo sapiens
atcagtagcttaagaaa

SEQ ID NO: 4018619 - DNA, 14 bp, Homo sapiens
atcagtataaacaa

SEQ ID NO: 4018620 - DNA, 16 bp, Homo sapiens
atcagtataaacaaag

SEQ ID NO: 4018621 - DNA, 19 bp, Homo sapiens
atcagtcataactaaataa

SEQ ID NO: 4018622 - DNA, 14 bp, Homo sapiens
atcagtcctttgat

SEQ ID NO: 4018623 - DNA, 20 bp, Homo sapiens
atcagtgttttaaattctga

SEQ ID NO: 4018624 - DNA, 20 bp, Homo sapiens
atcagttacccactcggtcc

SEQ ID NO: 4018625 - DNA, 22 bp, Homo sapiens
atcagttacccactcggtccca

SEQ ID NO: 4018626 - DNA, 15 bp, Homo sapiens
atcagttgactttaa

SEQ ID NO: 4018627 - DNA, 17 bp, Homo sapiens
atcagtttttaaaatat

SEQ ID NO: 4018628 - DNA, 21 bp, Homo sapiens
atcagtttttaaaatatttag

SEQ ID NO: 4018629 - DNA, 18 bp, Homo sapiens
atcataagaatttttcag

SEQ ID NO: 4018630 - DNA, 16 bp, Homo sapiens
atcataagtgaattta

SEQ ID NO: 4018631 - DNA, 20 bp, Homo sapiens
atcatagctcactgcagcct

SEQ ID NO: 4018632 - DNA, 16 bp, Homo sapiens
atcatataataaatgt

SEQ ID NO: 4018633 - DNA, 14 bp, Homo sapiens
atcatatgcctgac

SEQ ID NO: 4018634 - DNA, 19 bp, Homo sapiens
atcatatgtgtctttatag

SEQ ID NO: 4018635 - DNA, 17 bp, Homo sapiens
atcatattgatgaaaag

SEQ ID NO: 4018636 - DNA, 18 bp, Homo sapiens
atcatattgatgaaaaga

SEQ ID NO: 4018637 - DNA, 13 bp, Homo sapiens
atcatcagggcct

SEQ ID NO: 4018638 - DNA, 15 bp, Homo sapiens
atcatcagggcctgg

SEQ ID NO: 4018639 - DNA, 15 bp, Homo sapiens
atcatccctttccct

SEQ ID NO: 4018640 - DNA, 21 bp, Homo sapiens
atcatcctttaggtaagaagt

SEQ ID NO: 4018641 - DNA, 17 bp, Homo sapiens
atcatcctttgttctga

SEQ ID NO: 4018642 - DNA, 19 bp, Homo sapiens
atcatcctttgttctgagc

SEQ ID NO: 4018643 - DNA, 20 bp, Homo sapiens
atcatcgccagaggtgcttc

SEQ ID NO: 4018644 - DNA, 22 bp, Homo sapiens
atcatcgccagaggtgcttcac

SEQ ID NO: 4018645 - DNA, 24 bp, Homo sapiens
atcatcggagtcagccaggagctg

SEQ ID NO: 4018646 - DNA, 18 bp, Homo sapiens
atcatctataaagaagaa

SEQ ID NO: 4018647 - DNA, 15 bp, Homo sapiens
atcatgaaatatgca

SEQ ID NO: 4018648 - DNA, 21 bp, Homo sapiens
atcatgaattcccttttaatc

SEQ ID NO: 4018649 - DNA, 13 bp, Homo sapiens
atcatgaatttta

SEQ ID NO: 4018650 - DNA, 17 bp, Homo sapiens
atcatgagcctgctgga

SEQ ID NO: 4018651 - DNA, 21 bp, Homo sapiens
atcatgagcctgctggaagcc

SEQ ID NO: 4018652 - DNA, 14 bp, Homo sapiens
atcatgcattgttg

SEQ ID NO: 4018653 - DNA, 16 bp, Homo sapiens
atcatgctaaaattct

SEQ ID NO: 4018654 - DNA, 21 bp, Homo sapiens
ctcaacctcttctggctcaaa

SEQ ID NO: 4018655 - DNA, 17 bp, Homo sapiens
ctcaactcacctaatgt

SEQ ID NO: 4018656 - DNA, 17 bp, Homo sapiens
ctcaactctacccctgc

SEQ ID NO: 4018657 - DNA, 18 bp, Homo sapiens
ctcaactctgagcccata

SEQ ID NO: 4018658 - DNA, 21 bp, Homo sapiens
ctcaagaagacatggagactc

SEQ ID NO: 4018659 - DNA, 22 bp, Homo sapiens
ctcaagaagacatggagactcc

SEQ ID NO: 4018660 - DNA, 16 bp, Homo sapiens
ctcaagaccagagacc

SEQ ID NO: 4018661 - DNA, 21 bp, Homo sapiens
ctcaagactttagcttttcct

SEQ ID NO: 4018662 - DNA, 19 bp, Homo sapiens
ctcaagagggcactggtgg

SEQ ID NO: 4018663 - DNA, 21 bp, Homo sapiens
ctcaagagggcactggtggcc

SEQ ID NO: 4018664 - DNA, 16 bp, Homo sapiens
ctcaagcaatcctcct

SEQ ID NO: 4018665 - DNA, 22 bp, Homo sapiens
ctcaagcaatcctcctgcctca

SEQ ID NO: 4018666 - DNA, 23 bp, Homo sapiens
ctcaagcaatcctcctgcctcag

SEQ ID NO: 4018667 - DNA, 23 bp, Homo sapiens
ctcaagcagcgaccgccccctcc

SEQ ID NO: 4018668 - DNA, 16 bp, Homo sapiens
ctcaagcccaggaggg

SEQ ID NO: 4018669 - DNA, 12 bp, Homo sapiens
ctcaagccccag

SEQ ID NO: 4018670 - DNA, 18 bp, Homo sapiens
ctcaagccccatttcctc

SEQ ID NO: 4018671 - DNA, 17 bp, Homo sapiens
ctcaagctagtgtttct

SEQ ID NO: 4018672 - DNA, 21 bp, Homo sapiens
ctcaagggctagcatccctga

SEQ ID NO: 4018673 - DNA, 19 bp, Homo sapiens
ctcaaggtgggccttgcta

SEQ ID NO: 4018674 - DNA, 22 bp, Homo sapiens
ctcaagtacccattctgttttc

SEQ ID NO: 4018675 - DNA, 16 bp, Homo sapiens
ctcaataaacacttgt

SEQ ID NO: 4018676 - DNA, 17 bp, Homo sapiens
ctcaataaacatttcat

SEQ ID NO: 4018677 - DNA, 21 bp, Homo sapiens
ctcaataaacatttcatttcc

SEQ ID NO: 4018678 - DNA, 16 bp, Homo sapiens
ctcaataaatgattct

SEQ ID NO: 4018679 - DNA, 16 bp, Homo sapiens
ctcaatattcctgaat

SEQ ID NO: 4018680 - DNA, 15 bp, Homo sapiens
ctcaatccaccttca

SEQ ID NO: 4018681 - DNA, 15 bp, Homo sapiens
ctcaatgcctggaga

SEQ ID NO: 4018682 - DNA, 17 bp, Homo sapiens
ctcaatggactggaagg

SEQ ID NO: 4018683 - DNA, 20 bp, Homo sapiens
ctcaatggactggaagggga

SEQ ID NO: 4018684 - DNA, 14 bp, Homo sapiens
ctcaatgtgaccag

SEQ ID NO: 4018685 - DNA, 14 bp, Homo sapiens
ctcaattatttgca

SEQ ID NO: 4018686 - DNA, 16 bp, Homo sapiens
ctcaattatttgcata

SEQ ID NO: 4018687 - DNA, 22 bp, Homo sapiens
ctcaattatttgcatattttga

SEQ ID NO: 4018688 - DNA, 12 bp, Homo sapiens
ctcaatttcaat

SEQ ID NO: 4018689 - DNA, 17 bp, Homo sapiens
ctcaatttttgtctcag

SEQ ID NO: 4018690 - DNA, 20 bp, Homo sapiens
ctcaatttttgtctcagaag

SEQ ID NO: 4018691 - DNA, 17 bp, Homo sapiens
ctcacaaaatcacttta

SEQ ID NO: 4018692 - DNA, 18 bp, Homo sapiens
ctcacacacacagctggg

SEQ ID NO: 4018693 - DNA, 19 bp, Homo sapiens
ctcacacacacagctgggc

SEQ ID NO: 4018694 - DNA, 20 bp, Homo sapiens
ctcacacacacagctgggca

SEQ ID NO: 4018695 - DNA, 21 bp, Homo sapiens
ctcacacacacagctgggcaa

SEQ ID NO: 4018696 - DNA, 15 bp, Homo sapiens
ctcacacaccctgag

SEQ ID NO: 4018697 - DNA, 21 bp, Homo sapiens
ctcacacattcccccaccagc

SEQ ID NO: 4018698 - DNA, 23 bp, Homo sapiens
ctcacacattcccccaccagctg

SEQ ID NO: 4018699 - DNA, 13 bp, Homo sapiens
ctcacaccaaatt

SEQ ID NO: 4018700 - DNA, 19 bp, Homo sapiens
ctcacacctgtaatgccag

SEQ ID NO: 4018701 - DNA, 19 bp, Homo sapiens
ctcacactaagagggcaga

SEQ ID NO: 4018702 - DNA, 22 bp, Homo sapiens
ctcacagtacagcatgtgcctt

SEQ ID NO: 4018703 - DNA, 19 bp, Homo sapiens
ctcacagtctctttaatct

SEQ ID NO: 4018704 - DNA, 12 bp, Homo sapiens
ctcacagtgtgg

SEQ ID NO: 4018705 - DNA, 21 bp, Homo sapiens
ctcacagtgttgcccaggctg

SEQ ID NO: 4018706 - DNA, 14 bp, Homo sapiens
ctcacatccctcta

SEQ ID NO: 4018707 - DNA, 12 bp, Homo sapiens
ctcacatgggac

SEQ ID NO: 4018708 - DNA, 14 bp, Homo sapiens
ctcacatgggactg

SEQ ID NO: 4018709 - DNA, 18 bp, Homo sapiens
ctcacattcgacataccc

SEQ ID NO: 4018710 - DNA, 13 bp, Homo sapiens
ctcaccacctgcc

SEQ ID NO: 4018711 - DNA, 16 bp, Homo sapiens
ctcaccacctgcctct

SEQ ID NO: 4018712 - DNA, 17 bp, Homo sapiens
ctcaccacctgcctcta

SEQ ID NO: 4018713 - DNA, 12 bp, Homo sapiens
ctcaccagccct

SEQ ID NO: 4018714 - DNA, 13 bp, Homo sapiens
ctcaccaggaagg

SEQ ID NO: 4018715 - DNA, 24 bp, Homo sapiens
ctcaccagtgtcccctccactgtc

SEQ ID NO: 4018716 - DNA, 13 bp, Homo sapiens
ctccagaatggaa

SEQ ID NO: 4018717 - DNA, 17 bp, Homo sapiens
ctccagacccaccacac

SEQ ID NO: 4018718 - DNA, 21 bp, Homo sapiens
ctccagacccctggcttttca

SEQ ID NO: 4018719 - DNA, 12 bp, Homo sapiens
ctccagacctga

SEQ ID NO: 4018720 - DNA, 18 bp, Homo sapiens
ctccagagaaacccaggg

SEQ ID NO: 4018721 - DNA, 19 bp, Homo sapiens
ctccagagcaacgaccagg

SEQ ID NO: 4018722 - DNA, 14 bp, Homo sapiens
ctccagaggtcctc

SEQ ID NO: 4018723 - DNA, 21 bp, Homo sapiens
ctccagatagctcatttcatt

SEQ ID NO: 4018724 - DNA, 16 bp, Homo sapiens
ctccagatgcagggca

SEQ ID NO: 4018725 - DNA, 17 bp, Homo sapiens
ctccagatgtttccaga

SEQ ID NO: 4018726 - DNA, 12 bp, Homo sapiens
ctccagccagca

SEQ ID NO: 4018727 - DNA, 16 bp, Homo sapiens
ctccagccagcaatga

SEQ ID NO: 4018728 - DNA, 23 bp, Homo sapiens
ctccagccagcaatgatgtccag

SEQ ID NO: 4018729 - DNA, 13 bp, Homo sapiens
ctccagcccctgt

SEQ ID NO: 4018730 - DNA, 14 bp, Homo sapiens
ctccagcctccctg

SEQ ID NO: 4018731 - DNA, 12 bp, Homo sapiens
ctccagcctggg

SEQ ID NO: 4018732 - DNA, 13 bp, Homo sapiens
ctccagcctgggg

SEQ ID NO: 4018733 - DNA, 17 bp, Homo sapiens
ctccagctgcaccagag

SEQ ID NO: 4018734 - DNA, 16 bp, Homo sapiens
ctccagctgcctgggc

SEQ ID NO: 4018735 - DNA, 18 bp, Homo sapiens
ctccagctgcctgggccc

SEQ ID NO: 4018736 - DNA, 19 bp, Homo sapiens
ctccagctgcctgggcccg

SEQ ID NO: 4018737 - DNA, 15 bp, Homo sapiens
ctccagctgggctct

SEQ ID NO: 4018738 - DNA, 20 bp, Homo sapiens
ctccagctgggctctgcaat

SEQ ID NO: 4018739 - DNA, 12 bp, Homo sapiens
ctccaggaaaga

SEQ ID NO: 4018740 - DNA, 20 bp, Homo sapiens
ctccaggaaagagcagtcag

SEQ ID NO: 4018741 - DNA, 21 bp, Homo sapiens
ctccaggaaggtagcccagca

SEQ ID NO: 4018742 - DNA, 17 bp, Homo sapiens
ctccaggagcttcttgt

SEQ ID NO: 4018743 - DNA, 20 bp, Homo sapiens
ctccaggagggaccaccctc

SEQ ID NO: 4018744 - DNA, 11 bp, Homo sapiens
ctccaggcagc

SEQ ID NO: 4018745 - DNA, 11 bp, Homo sapiens
ctccaggccca

SEQ ID NO: 4018746 - DNA, 19 bp, Homo sapiens
ctccaggcccaaggctccc

SEQ ID NO: 4018747 - DNA, 13 bp, Homo sapiens
ctccaggccctcc

SEQ ID NO: 4018748 - DNA, 15 bp, Homo sapiens
ctccaggcctgcagc

SEQ ID NO: 4018749 - DNA, 13 bp, Homo sapiens
ctccaggcctgcc

SEQ ID NO: 4018750 - DNA, 14 bp, Homo sapiens
ctccaggcctgcct

SEQ ID NO: 4018751 - DNA, 15 bp, Homo sapiens
ctccaggcctgcctc

SEQ ID NO: 4018752 - DNA, 20 bp, Homo sapiens
ctccaggcctgcctcccact

SEQ ID NO: 4018753 - DNA, 22 bp, Homo sapiens
ctccaggcgacgcggttttttc

SEQ ID NO: 4018754 - DNA, 18 bp, Homo sapiens
ctccaggcttcacagtct

SEQ ID NO: 4018755 - DNA, 23 bp, Homo sapiens
ctccaggcttcacagtctggtgc

SEQ ID NO: 4018756 - DNA, 24 bp, Homo sapiens
ctccaggcttcacagtctggtgct

SEQ ID NO: 4018757 - DNA, 23 bp, Homo sapiens
ctccaggggcccttgggacagcc

SEQ ID NO: 4018758 - DNA, 15 bp, Homo sapiens
ctccagggtgatttt

SEQ ID NO: 4018759 - DNA, 12 bp, Homo sapiens
ctccagggtgct

SEQ ID NO: 4018760 - DNA, 16 bp, Homo sapiens
ctccagggtgtgtgct

SEQ ID NO: 4018761 - DNA, 22 bp, Homo sapiens
ctccaggtcctctacttaatga

SEQ ID NO: 4018762 - DNA, 16 bp, Homo sapiens
ctccaggtctcacggg

SEQ ID NO: 4018763 - DNA, 17 bp, Homo sapiens
ctccaggtctcacgggc

SEQ ID NO: 4018764 - DNA, 18 bp, Homo sapiens
ctccaggtctcacgggca

SEQ ID NO: 4018765 - DNA, 14 bp, Homo sapiens
ctccaggtgctcat

SEQ ID NO: 4018766 - DNA, 17 bp, Homo sapiens
ctccaggtgctcattgt

SEQ ID NO: 4018767 - DNA, 17 bp, Homo sapiens
ctccaggtggctctgag

SEQ ID NO: 4018768 - DNA, 19 bp, Homo sapiens
ctccagtattgccccctct

SEQ ID NO: 4018769 - DNA, 14 bp, Homo sapiens
ctccagtccccaga

SEQ ID NO: 4018770 - DNA, 16 bp, Homo sapiens
ctccagtccccagaac

SEQ ID NO: 4018771 - DNA, 17 bp, Homo sapiens
ctccagtccccagaact

SEQ ID NO: 4018772 - DNA, 18 bp, Homo sapiens
ctccagtgccagcaatga

SEQ ID NO: 4018773 - DNA, 14 bp, Homo sapiens
ctccagtggtgacc

SEQ ID NO: 4018774 - DNA, 22 bp, Homo sapiens
ctccagtgtgggcttgaccagg

SEQ ID NO: 4018775 - DNA, 18 bp, Homo sapiens
ctccagttgggactcagg

SEQ ID NO: 4018776 - DNA, 16 bp, Homo sapiens
ctccagtttgcacctg

SEQ ID NO: 4018777 - DNA, 16 bp, Homo sapiens
ctccataccttttctc

SEQ ID NO: 4018778 - DNA, 14 bp, Homo sapiens
ctccatactcagga

SEQ ID NO: 4018779 - DNA, 21 bp, Homo sapiens
ctccatcatatgcctgacccc

SEQ ID NO: 4018780 - DNA, 16 bp, Homo sapiens
ctccatccatccttcc

SEQ ID NO: 4018781 - DNA, 23 bp, Homo sapiens
ctccatccccctttaccctcttt

SEQ ID NO: 4018782 - DNA, 14 bp, Homo sapiens
ctccatctcatgta

SEQ ID NO: 4018783 - DNA, 19 bp, Homo sapiens
ctccatctcctgctcacca

SEQ ID NO: 4018784 - DNA, 12 bp, Homo sapiens
ctccatcttatt

SEQ ID NO: 4018785 - DNA, 21 bp, Homo sapiens
ctccatgagacacatctcctc

SEQ ID NO: 4018786 - DNA, 13 bp, Homo sapiens
ctccatgagcacc

SEQ ID NO: 4018787 - DNA, 21 bp, Homo sapiens
ctccatgctcctcacctgtct

SEQ ID NO: 4018788 - DNA, 17 bp, Homo sapiens
ctccattctattttaga

SEQ ID NO: 4018789 - DNA, 19 bp, Homo sapiens
ctccattggctcccaagtc

SEQ ID NO: 4018790 - DNA, 21 bp, Homo sapiens
ctccattgggcacagtccaga

SEQ ID NO: 4018791 - DNA, 23 bp, Homo sapiens
ctccatttataaccccagcctga

SEQ ID NO: 4018792 - DNA, 21 bp, Homo sapiens
ctccattttggtgtctttctc

SEQ ID NO: 4018793 - DNA, 15 bp, Homo sapiens
ctcccaaagtgctga

SEQ ID NO: 4018794 - DNA, 15 bp, Homo sapiens
ctcccaaatgagcca

SEQ ID NO: 4018795 - DNA, 20 bp, Homo sapiens
ctcccaacttcttcctgtga

SEQ ID NO: 4018796 - DNA, 22 bp, Homo sapiens
ctcccaaggggcccaaattctt

SEQ ID NO: 4018797 - DNA, 17 bp, Homo sapiens
ctcccaaggtcctctca

SEQ ID NO: 4018798 - DNA, 18 bp, Homo sapiens
ctcccaaggtcctctcag

SEQ ID NO: 4018799 - DNA, 18 bp, Homo sapiens
ctcccaaggttggagccc

SEQ ID NO: 4018800 - DNA, 19 bp, Homo sapiens
ctcccaagtcacacccact

SEQ ID NO: 4018801 - DNA, 15 bp, Homo sapiens
ctcccacactcgcca

SEQ ID NO: 4018802 - DNA, 20 bp, Homo sapiens
ctcccacacttgctggggct

SEQ ID NO: 4018803 - DNA, 22 bp, Homo sapiens
ctcagctgacccggcctctctg

SEQ ID NO: 4018804 - DNA, 23 bp, Homo sapiens
ctcagctggttactcagggttca

SEQ ID NO: 4018805 - DNA, 17 bp, Homo sapiens
ctcagctgtcctgcagc

SEQ ID NO: 4018806 - DNA, 14 bp, Homo sapiens
ctcagcttatctct

SEQ ID NO: 4018807 - DNA, 14 bp, Homo sapiens
ctcagcttcctacc

SEQ ID NO: 4018808 - DNA, 20 bp, Homo sapiens
ctcagcttcttcacaggcac

SEQ ID NO: 4018809 - DNA, 16 bp, Homo sapiens
ctcaggacagatgcca

SEQ ID NO: 4018810 - DNA, 18 bp, Homo sapiens
ctcaggacagatgccaca

SEQ ID NO: 4018811 - DNA, 19 bp, Homo sapiens
ctcaggacagatgccacac

SEQ ID NO: 4018812 - DNA, 16 bp, Homo sapiens
ctcaggagatggaggg

SEQ ID NO: 4018813 - DNA, 14 bp, Homo sapiens
ctcaggagcacagg

SEQ ID NO: 4018814 - DNA, 17 bp, Homo sapiens
ctcaggagcacaggcag

SEQ ID NO: 4018815 - DNA, 22 bp, Homo sapiens
ctcaggagcacaggcagctgga

SEQ ID NO: 4018816 - DNA, 17 bp, Homo sapiens
ctcaggaggctgaggca

SEQ ID NO: 4018817 - DNA, 18 bp, Homo sapiens
ctcaggaggctgaggcag

SEQ ID NO: 4018818 - DNA, 23 bp, Homo sapiens
ctcaggaggctgaggcaggagga

SEQ ID NO: 4018819 - DNA, 22 bp, Homo sapiens
ctcaggatatccttatcagagc

SEQ ID NO: 4018820 - DNA, 14 bp, Homo sapiens
ctcaggcagctcaa

SEQ ID NO: 4018821 - DNA, 15 bp, Homo sapiens
ctcaggcagctcaag

SEQ ID NO: 4018822 - DNA, 16 bp, Homo sapiens
ctcaggcataggcctg

SEQ ID NO: 4018823 - DNA, 14 bp, Homo sapiens
ctcaggctctgctg

SEQ ID NO: 4018824 - DNA, 20 bp, Homo sapiens
ctcaggctctgctggtggaa

SEQ ID NO: 4018825 - DNA, 19 bp, Homo sapiens
ctcagggacagagccatgc

SEQ ID NO: 4018826 - DNA, 17 bp, Homo sapiens
ctcagggaccggtgctg

SEQ ID NO: 4018827 - DNA, 20 bp, Homo sapiens
ctcagggaccggtgctgcag

SEQ ID NO: 4018828 - DNA, 21 bp, Homo sapiens
ctcagggaccggtgctgcagg

SEQ ID NO: 4018829 - DNA, 22 bp, Homo sapiens
ctcagggagcagggaaggcctg

SEQ ID NO: 4018830 - DNA, 23 bp, Homo sapiens
ctcagggagcagggaaggcctga

SEQ ID NO: 4018831 - DNA, 14 bp, Homo sapiens
ctcagggagcctcc

SEQ ID NO: 4018832 - DNA, 15 bp, Homo sapiens
ctcagggagcctccc

SEQ ID NO: 4018833 - DNA, 13 bp, Homo sapiens
ctcagggagggag

SEQ ID NO: 4018834 - DNA, 14 bp, Homo sapiens
ctcagggcacgcag

SEQ ID NO: 4018835 - DNA, 10 bp, Homo sapiens
ctcagggcag

SEQ ID NO: 4018836 - DNA, 23 bp, Homo sapiens
ctcagggcctggcaggccagtgt

SEQ ID NO: 4018837 - DNA, 13 bp, Homo sapiens
ctcagggcgctca

SEQ ID NO: 4018838 - DNA, 16 bp, Homo sapiens
ctcagggcgctcagac

SEQ ID NO: 4018839 - DNA, 18 bp, Homo sapiens
ctcagggcgctcagacgg

SEQ ID NO: 4018840 - DNA, 21 bp, Homo sapiens
ctcagggctgtcccagccccg

SEQ ID NO: 4018841 - DNA, 17 bp, Homo sapiens
ctcaggggccagaggaa

SEQ ID NO: 4018842 - DNA, 18 bp, Homo sapiens
ctcaggggccagaggaac

SEQ ID NO: 4018843 - DNA, 20 bp, Homo sapiens
ctcaggggccagaggaactg

SEQ ID NO: 4018844 - DNA, 18 bp, Homo sapiens
ctcagggtcaaagacaga

SEQ ID NO: 4018845 - DNA, 16 bp, Homo sapiens
ctcagggtgcagaggt

SEQ ID NO: 4018846 - DNA, 20 bp, Homo sapiens
ctcagggttcatctgtccat

SEQ ID NO: 4018847 - DNA, 20 bp, Homo sapiens
ctcaggtccctggggctagg

SEQ ID NO: 4018848 - DNA, 14 bp, Homo sapiens
ctcaggtgggccct

SEQ ID NO: 4018849 - DNA, 13 bp, Homo sapiens
ctcaggtggggag

SEQ ID NO: 4018850 - DNA, 14 bp, Homo sapiens
ctcaggttctattt

SEQ ID NO: 4018851 - DNA, 21 bp, Homo sapiens
ctcaggttctattttcttaaa

SEQ ID NO: 4018852 - DNA, 18 bp, Homo sapiens
ctcaggttcttcagggcc

SEQ ID NO: 4018853 - DNA, 22 bp, Homo sapiens
ctcaggttgtctgaagtcactg

SEQ ID NO: 4018854 - DNA, 14 bp, Homo sapiens
ctcagtcatgcata

SEQ ID NO: 4018855 - DNA, 23 bp, Homo sapiens
ctcagtcatgcataaatatgcag

SEQ ID NO: 4018856 - DNA, 17 bp, Homo sapiens
ctcagtgagcctcctgt

SEQ ID NO: 4018857 - DNA, 21 bp, Homo sapiens
ctcagtgagcctcctgtgcct

SEQ ID NO: 4018858 - DNA, 15 bp, Homo sapiens
ctcagtgctctctcc

SEQ ID NO: 4018859 - DNA, 16 bp, Homo sapiens
ctcagtgctctctcca

SEQ ID NO: 4018860 - DNA, 18 bp, Homo sapiens
ctcagtggcttcatctgt

SEQ ID NO: 4018861 - DNA, 12 bp, Homo sapiens
ctcagtgtgtgt

SEQ ID NO: 4018862 - DNA, 22 bp, Homo sapiens
ctcagtgtgtgtgtgtggtcca

SEQ ID NO: 4018863 - DNA, 14 bp, Homo sapiens
ctcagtgttagaga

SEQ ID NO: 4018864 - DNA, 18 bp, Homo sapiens
ctcagttcaacctggtgg

SEQ ID NO: 4018865 - DNA, 22 bp, Homo sapiens
ctcagttcaacctggtggcacc

SEQ ID NO: 4018866 - DNA, 14 bp, Homo sapiens
ctcagttccaggcc

SEQ ID NO: 4018867 - DNA, 15 bp, Homo sapiens
ctcagttcccttggc

SEQ ID NO: 4018868 - DNA, 18 bp, Homo sapiens
ctcagttcccttggcctc

SEQ ID NO: 4018869 - DNA, 24 bp, Homo sapiens
ctcagttccttcatttccaccagg

SEQ ID NO: 4018870 - DNA, 17 bp, Homo sapiens
ctcagttttatcatttt

SEQ ID NO: 4018871 - DNA, 16 bp, Homo sapiens
ctcagttttatgcccc

SEQ ID NO: 4018872 - DNA, 23 bp, Homo sapiens
cctggctacatcccagcctgtgg

SEQ ID NO: 4018873 - DNA, 19 bp, Homo sapiens
cctggctccactcttgatc

SEQ ID NO: 4018874 - DNA, 21 bp, Homo sapiens
cctggctccactcttgatctc

SEQ ID NO: 4018875 - DNA, 14 bp, Homo sapiens
cctggctcccatga

SEQ ID NO: 4018876 - DNA, 21 bp, Homo sapiens
cctggctcccatgaccatact

SEQ ID NO: 4018877 - DNA, 12 bp, Homo sapiens
cctggctccctc

SEQ ID NO: 4018878 - DNA, 15 bp, Homo sapiens
cctggctccctcctc

SEQ ID NO: 4018879 - DNA, 13 bp, Homo sapiens
cctggctgagcag

SEQ ID NO: 4018880 - DNA, 16 bp, Homo sapiens
cctggctgaggttcct

SEQ ID NO: 4018881 - DNA, 23 bp, Homo sapiens
cctggctgaggttcctctgcctg

SEQ ID NO: 4018882 - DNA, 19 bp, Homo sapiens
cctggctgatgatccagaa

SEQ ID NO: 4018883 - DNA, 13 bp, Homo sapiens
cctggctgcagct

SEQ ID NO: 4018884 - DNA, 12 bp, Homo sapiens
cctggctgccca

SEQ ID NO: 4018885 - DNA, 23 bp, Homo sapiens
cctggctgcccatcatgtggccc

SEQ ID NO: 4018886 - DNA, 22 bp, Homo sapiens
cctggctgcccctcaccttggg

SEQ ID NO: 4018887 - DNA, 17 bp, Homo sapiens
cctggctgctgccccca

SEQ ID NO: 4018888 - DNA, 22 bp, Homo sapiens
cctggctgctgcccccaccccg

SEQ ID NO: 4018889 - DNA, 18 bp, Homo sapiens
cctggctggaggagcagc

SEQ ID NO: 4018890 - DNA, 21 bp, Homo sapiens
cctggctgggacgtggctcag

SEQ ID NO: 4018891 - DNA, 17 bp, Homo sapiens
cctggctgggccatcct

SEQ ID NO: 4018892 - DNA, 18 bp, Homo sapiens
cctggctgggccatcctt

SEQ ID NO: 4018893 - DNA, 15 bp, Homo sapiens
cctggctggtcctcc

SEQ ID NO: 4018894 - DNA, 13 bp, Homo sapiens
cctggcttcctta

SEQ ID NO: 4018895 - DNA, 15 bp, Homo sapiens
cctggcttccttact

SEQ ID NO: 4018896 - DNA, 14 bp, Homo sapiens
cctggctttgcctc

SEQ ID NO: 4018897 - DNA, 16 bp, Homo sapiens
cctggctttgcctctt

SEQ ID NO: 4018898 - DNA, 20 bp, Homo sapiens
cctggcttttcactgctggc

SEQ ID NO: 4018899 - DNA, 21 bp, Homo sapiens
cctggcttttcactgctggct

SEQ ID NO: 4018900 - DNA, 18 bp, Homo sapiens
cctgggacacagacccag

SEQ ID NO: 4018901 - DNA, 19 bp, Homo sapiens
cctgggacacagacccagg

SEQ ID NO: 4018902 - DNA, 23 bp, Homo sapiens
cctgggacacagacccaggaccc

SEQ ID NO: 4018903 - DNA, 11 bp, Homo sapiens
cctgggacccc

SEQ ID NO: 4018904 - DNA, 15 bp, Homo sapiens
cctgggagacagacc

SEQ ID NO: 4018905 - DNA, 20 bp, Homo sapiens
cctgggagccagtcctccac

SEQ ID NO: 4018906 - DNA, 16 bp, Homo sapiens
cctgggagcccagagg

SEQ ID NO: 4018907 - DNA, 21 bp, Homo sapiens
cctgggagcccccaccacaaa

SEQ ID NO: 4018908 - DNA, 22 bp, Homo sapiens
cctgggagcccccaccacaaac

SEQ ID NO: 4018909 - DNA, 23 bp, Homo sapiens
cctgggaggcggagagtacagtg

SEQ ID NO: 4018910 - DNA, 12 bp, Homo sapiens
cctgggcaggcg

SEQ ID NO: 4018911 - DNA, 19 bp, Homo sapiens
cctgggcatgggtccaggg
